United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 79

SEQ ID NO: 2851973 - RNA, 13 nt, Mycobacterium avium subsp. paratuberculosis
gcgucgcgaucag

SEQ ID NO: 2851974 - RNA, 23 nt, Mycobacterium avium subsp. paratuberculosis
gcgucgcgaugagauucgagcgu

SEQ ID NO: 2851975 - RNA, 15 nt, Mycobacterium avium subsp. paratuberculosis
gcgucgcgaugccca

SEQ ID NO: 2851976 - RNA, 13 nt, Mycobacterium avium subsp. paratuberculosis
gcgucgcgcagca

SEQ ID NO: 2851977 - RNA, 21 nt, Mycobacterium avium subsp. paratuberculosis
gcgucgcgcagcaacgguacg

SEQ ID NO: 2851978 - RNA, 15 nt, Mycobacterium avium subsp. paratuberculosis
gcgucgcgcagcagc

SEQ ID NO: 2851979 - RNA, 16 nt, Mycobacterium avium subsp. paratuberculosis
gcgucgcgcagcagcg

SEQ ID NO: 2851980 - RNA, 15 nt, Mycobacterium avium subsp. paratuberculosis
gcgucgcgcagcgaa

SEQ ID NO: 2851981 - RNA, 16 nt, Mycobacterium avium subsp. paratuberculosis
gcgucgcgcccggcgu

SEQ ID NO: 2851982 - RNA, 13 nt, Mycobacterium avium subsp. paratuberculosis
gcgucgcgccgcc

SEQ ID NO: 2851983 - RNA, 22 nt, Mycobacterium avium subsp. paratuberculosis
gcgucgcgccgccgcgucgugc

SEQ ID NO: 2851984 - RNA, 21 nt, Mycobacterium avium subsp. paratuberculosis
gcgucgcgcgguuccggcgug

SEQ ID NO: 2851985 - RNA, 23 nt, Mycobacterium avium subsp. paratuberculosis
gcgucgcgcgguuccggcgugca

SEQ ID NO: 2851986 - RNA, 16 nt, Mycobacterium avium subsp. paratuberculosis
gcgucgcggcgcaccc

SEQ ID NO: 2851987 - RNA, 20 nt, Mycobacterium avium subsp. paratuberculosis
gcgucgcggcgcacccgggc

SEQ ID NO: 2851988 - RNA, 22 nt, Mycobacterium avium subsp. paratuberculosis
gcgucgcggcgcacccgggcag

SEQ ID NO: 2851989 - RNA, 14 nt, Mycobacterium avium subsp. paratuberculosis
gcgucgcggcgcgg

SEQ ID NO: 2851990 - RNA, 13 nt, Mycobacterium avium subsp. paratuberculosis
gcgucgcggcggg

SEQ ID NO: 2851991 - RNA, 14 nt, Mycobacterium avium subsp. paratuberculosis
gcgucgcgggcccg

SEQ ID NO: 2851992 - RNA, 22 nt, Mycobacterium avium subsp. paratuberculosis
gcgucgcgggcccgggccaccc

SEQ ID NO: 2851993 - RNA, 22 nt, Mycobacterium avium subsp. paratuberculosis
gcgucgcgguaguuguccccga

SEQ ID NO: 2851994 - RNA, 14 nt, Mycobacterium avium subsp. paratuberculosis
gcgucgcggucggc

SEQ ID NO: 2851995 - RNA, 16 nt, Mycobacterium avium subsp. paratuberculosis
gcgucgcggucggcgu

SEQ ID NO: 2851996 - RNA, 17 nt, Mycobacterium avium subsp. paratuberculosis
gcgucgcggucggcguc

SEQ ID NO: 2851997 - RNA, 23 nt, Mycobacterium avium subsp. paratuberculosis
gcgucgcggugaaguugccgccg

SEQ ID NO: 2851998 - RNA, 17 nt, Mycobacterium avium subsp. paratuberculosis
gcgucgcgguggagcac

SEQ ID NO: 2851999 - RNA, 14 nt, Mycobacterium avium subsp. paratuberculosis
gcgucgcguggcaa

SEQ ID NO: 2852000 - RNA, 23 nt, Mycobacterium avium subsp. paratuberculosis
gcgucgcucauguugugcaggca

SEQ ID NO: 2852001 - RNA, 17 nt, Mycobacterium avium subsp. paratuberculosis
gcgucgcugggcagccg

SEQ ID NO: 2852002 - RNA, 16 nt, Mycobacterium avium subsp. paratuberculosis
gcgucgcugucggcga

SEQ ID NO: 2852003 - RNA, 17 nt, Mycobacterium avium subsp. paratuberculosis
gcgucgcugucggcgaa

SEQ ID NO: 2852004 - RNA, 18 nt, Mycobacterium avium subsp. paratuberculosis
gcgucggacaugccggcg

SEQ ID NO: 2852005 - RNA, 19 nt, Mycobacterium avium subsp. paratuberculosis
gcgucggacaugccggcgc

SEQ ID NO: 2852006 - RNA, 20 nt, Mycobacterium avium subsp. paratuberculosis
gcgucggacaugccggcgcc

SEQ ID NO: 2852007 - RNA, 22 nt, Mycobacterium avium subsp. paratuberculosis
gcgucggacaugccggcgccga

SEQ ID NO: 2852008 - RNA, 15 nt, Mycobacterium avium subsp. paratuberculosis
gcgucggaccccgau

SEQ ID NO: 2852009 - RNA, 18 nt, Mycobacterium avium subsp. paratuberculosis
gcgucggugaacucgucc

SEQ ID NO: 2852010 - RNA, 22 nt, Mycobacterium avium subsp. paratuberculosis
gcgucggugaacucguccaugc

SEQ ID NO: 2852011 - RNA, 13 nt, Mycobacterium avium subsp. paratuberculosis
gcgucggugaugc

SEQ ID NO: 2852012 - RNA, 22 nt, Mycobacterium avium subsp. paratuberculosis
gcgucgguggcggcggcgacga

SEQ ID NO: 2852013 - RNA, 18 nt, Mycobacterium avium subsp. paratuberculosis
gcgucggugucccgcgcc

SEQ ID NO: 2852014 - RNA, 23 nt, Mycobacterium avium subsp. paratuberculosis
gcgucggugucccgcgcccgcga

SEQ ID NO: 2852015 - RNA, 15 nt, Mycobacterium avium subsp. paratuberculosis
gcgucguacaccucg

SEQ ID NO: 2852016 - RNA, 18 nt, Mycobacterium avium subsp. paratuberculosis
gcgucguacaccucgguc

SEQ ID NO: 2852017 - RNA, 22 nt, Mycobacterium avium subsp. paratuberculosis
gcgucguacaccucggucgggg

SEQ ID NO: 2852018 - RNA, 20 nt, Mycobacterium avium subsp. paratuberculosis
gcgucguacagcagccccug

SEQ ID NO: 2852019 - RNA, 16 nt, Mycobacterium avium subsp. paratuberculosis
gcgucguagagcugac

SEQ ID NO: 2852020 - RNA, 16 nt, Mycobacterium avium subsp. paratuberculosis
gcgucguagccggcac

SEQ ID NO: 2852021 - RNA, 22 nt, Mycobacterium avium subsp. paratuberculosis
gcgucguaguaacgcgagauga

SEQ ID NO: 2852022 - RNA, 13 nt, Mycobacterium avium subsp. paratuberculosis
gcgucguagucgc

SEQ ID NO: 2852023 - RNA, 23 nt, Mycobacterium avium subsp. paratuberculosis
gcgucguagucgcucggcggcga

SEQ ID NO: 2852024 - RNA, 18 nt, Mycobacterium avium subsp. paratuberculosis
gcgucguaguugcggccg

SEQ ID NO: 2852025 - RNA, 20 nt, Mycobacterium avium subsp. paratuberculosis
gcgucguaguugcggccggc

SEQ ID NO: 2852026 - RNA, 22 nt, Mycobacterium avium subsp. paratuberculosis
gcgucguaguugcggccggcgg

SEQ ID NO: 2852027 - RNA, 23 nt, Mycobacterium avium subsp. paratuberculosis
gcgucguaguugcggccggcggu

SEQ ID NO: 2852028 - RNA, 12 nt, Mycobacterium avium subsp. paratuberculosis
gcgucguccaug

SEQ ID NO: 2852029 - RNA, 13 nt, Mycobacterium avium subsp. paratuberculosis
gcgucguccaugc

SEQ ID NO: 2852030 - RNA, 22 nt, Mycobacterium avium subsp. paratuberculosis
gcgucguccaugcccgcccacg

SEQ ID NO: 2852031 - RNA, 16 nt, Mycobacterium avium subsp. paratuberculosis
gcgucguccgacacca

SEQ ID NO: 2852032 - RNA, 22 nt, Mycobacterium avium subsp. paratuberculosis
gcgucguccgacaccaccugca

SEQ ID NO: 2852033 - RNA, 23 nt, Mycobacterium avium subsp. paratuberculosis
gcgucguccgacaccaccugcac

SEQ ID NO: 2852034 - RNA, 23 nt, Mycobacterium avium subsp. paratuberculosis
gcgucgucgagcaccggcagccg

SEQ ID NO: 2852035 - RNA, 14 nt, Mycobacterium avium subsp. paratuberculosis
gcgucgucgaggcg

SEQ ID NO: 2852036 - RNA, 16 nt, Mycobacterium avium subsp. paratuberculosis
gcgucgucgauggcca

SEQ ID NO: 2852037 - RNA, 23 nt, Mycobacterium avium subsp. paratuberculosis
gcgucgucgauggccaccagguc

SEQ ID NO: 2852038 - RNA, 18 nt, Mycobacterium avium subsp. paratuberculosis
gcgucgucgcccgaacuc

SEQ ID NO: 2852039 - RNA, 13 nt, Mycobacterium avium subsp. paratuberculosis
gcgucgucgccga

SEQ ID NO: 2852040 - RNA, 12 nt, Mycobacterium avium subsp. paratuberculosis
gcgucgucggcc

SEQ ID NO: 2852041 - RNA, 13 nt, Mycobacterium avium subsp. paratuberculosis
gcgucgucggccg

SEQ ID NO: 2852042 - RNA, 17 nt, Mycobacterium avium subsp. paratuberculosis
gcgucgucggccggcuc

SEQ ID NO: 2852043 - RNA, 18 nt, Mycobacterium avium subsp. paratuberculosis
gcgucgucggcggcgacg

SEQ ID NO: 2852044 - RNA, 22 nt, Mycobacterium avium subsp. paratuberculosis
gcgucgucggcggcgacgugcc

SEQ ID NO: 2852045 - RNA, 15 nt, Mycobacterium avium subsp. paratuberculosis
gcgucgucgucgacc

SEQ ID NO: 2852046 - RNA, 14 nt, Mycobacterium avium subsp. paratuberculosis
gcgucgucgucgag

SEQ ID NO: 2852047 - RNA, 22 nt, Mycobacterium avium subsp. paratuberculosis
gcgucgucgucgagccgcucgc

SEQ ID NO: 2852048 - RNA, 22 nt, Mycobacterium avium subsp. paratuberculosis
gcgucgucgucgcagugcccgc

SEQ ID NO: 2852049 - RNA, 15 nt, Mycobacterium avium subsp. paratuberculosis
gcgucgucuuggccu

SEQ ID NO: 2852050 - RNA, 12 nt, Mycobacterium avium subsp. paratuberculosis
gcgucgugaccg

SEQ ID NO: 2852051 - RNA, 21 nt, Mycobacterium avium subsp. paratuberculosis
gcgucgugcaacucccgcgcc

SEQ ID NO: 2852052 - RNA, 23 nt, Mycobacterium avium subsp. paratuberculosis
gcgucgugcaacucccgcgccgc

SEQ ID NO: 2852053 - RNA, 17 nt, Mycobacterium avium subsp. paratuberculosis
gcgucgugccgagcgug

SEQ ID NO: 2852054 - RNA, 19 nt, Mycobacterium avium subsp. paratuberculosis
gcgucgugccgagcgugaa

SEQ ID NO: 2852055 - RNA, 23 nt, Mycobacterium avium subsp. paratuberculosis
gcgucgugccgagcgugaagcua

SEQ ID NO: 2852056 - RNA, 14 nt, Mycobacterium avium subsp. paratuberculosis
gcgucgugcggccg

SEQ ID NO: 2852057 - RNA, 22 nt, Mycobacterium avium subsp. paratuberculosis
gcgucgugcggccggcgccggc

SEQ ID NO: 2852058 - RNA, 17 nt, Mycobacterium avium subsp. paratuberculosis
gcgucgugcgggcuccg

SEQ ID NO: 2852059 - RNA, 23 nt, Mycobacterium avium subsp. paratuberculosis
gcgucgugcgggcuccgcacgac

SEQ ID NO: 2852060 - RNA, 20 nt, Mycobacterium avium subsp. paratuberculosis
gcgucguggcccugcucguc

SEQ ID NO: 2852061 - RNA, 22 nt, Mycobacterium avium subsp. paratuberculosis
gcgucguggcccugcucgucgu

SEQ ID NO: 2852062 - RNA, 14 nt, Mycobacterium avium subsp. paratuberculosis
gcgucguggucgac

SEQ ID NO: 2852063 - RNA, 18 nt, Mycobacterium avium subsp. paratuberculosis
gcgucguggucgacgccg

SEQ ID NO: 2852064 - RNA, 17 nt, Mycobacterium avium subsp. paratuberculosis
gcgucguguccgggccc

SEQ ID NO: 2852065 - RNA, 19 nt, Mycobacterium avium subsp. paratuberculosis
gcgucguguccgggcccga

SEQ ID NO: 2852066 - RNA, 18 nt, Mycobacterium avium subsp. paratuberculosis
gcgucguugaacgcgcgg

SEQ ID NO: 2852067 - RNA, 21 nt, Mycobacterium avium subsp. paratuberculosis
gcgucguugaacgcgcgggug

SEQ ID NO: 2852068 - RNA, 15 nt, Mycobacterium avium subsp. paratuberculosis
gcgucguuggcgccg

SEQ ID NO: 2852069 - RNA, 18 nt, Mycobacterium avium subsp. paratuberculosis
gcgucguuggcgccgucc

SEQ ID NO: 2852070 - RNA, 17 nt, Mycobacterium avium subsp. paratuberculosis
gcgucguugucgucgcc

SEQ ID NO: 2852071 - RNA, 21 nt, Mycobacterium avium subsp. paratuberculosis
gcgucguugucgucgccggcc

SEQ ID NO: 2852072 - RNA, 13 nt, Mycobacterium avium subsp. paratuberculosis
gcgucucccgggu

SEQ ID NO: 2852073 - RNA, 22 nt, Mycobacterium avium subsp. paratuberculosis
gcgucucccgggugcgcgucgc

SEQ ID NO: 2852074 - RNA, 14 nt, Mycobacterium avium subsp. paratuberculosis
gcgucuccggcggg

SEQ ID NO: 2852075 - RNA, 18 nt, Mycobacterium avium subsp. paratuberculosis
gcgucuccggcgggcugg

SEQ ID NO: 2852076 - RNA, 20 nt, Mycobacterium avium subsp. paratuberculosis
gcgucuccggcgggcuggug

SEQ ID NO: 2852077 - RNA, 15 nt, Mycobacterium avium subsp. paratuberculosis
gcgucuccucgaccg

SEQ ID NO: 2852078 - RNA, 17 nt, Mycobacterium avium subsp. paratuberculosis
gcgucuccucgaccgcc

SEQ ID NO: 2852079 - RNA, 15 nt, Mycobacterium avium subsp. paratuberculosis
gcgucucgaaccguc

SEQ ID NO: 2852080 - RNA, 14 nt, Mycobacterium avium subsp. paratuberculosis
gcgucucgaccgcg

SEQ ID NO: 2852081 - RNA, 20 nt, Mycobacterium avium subsp. paratuberculosis
gcgucucgaccgcgguggcg

SEQ ID NO: 2852082 - RNA, 13 nt, Mycobacterium avium subsp. paratuberculosis
gcgucucgacggc

SEQ ID NO: 2852083 - RNA, 18 nt, Mycobacterium avium subsp. paratuberculosis
gcgucucgacggcgccga

SEQ ID NO: 2852084 - RNA, 19 nt, Mycobacterium avium subsp. paratuberculosis
gcgucucgacggcgccgac

SEQ ID NO: 2852085 - RNA, 13 nt, Mycobacterium avium subsp. paratuberculosis
gcgucucgaucga

SEQ ID NO: 2852086 - RNA, 21 nt, Mycobacterium avium subsp. paratuberculosis
gcgucucgaucgacgacgcca

SEQ ID NO: 2852087 - RNA, 22 nt, Mycobacterium avium subsp. paratuberculosis
gcgucucgaucgacgacgccag

SEQ ID NO: 2852088 - RNA, 23 nt, Mycobacterium avium subsp. paratuberculosis
gcgucucgaucgacgacgccagc

SEQ ID NO: 2852089 - RNA, 22 nt, Mycobacterium avium subsp. paratuberculosis
gcgucucgaugaccucgcgggu

SEQ ID NO: 2852090 - RNA, 23 nt, Mycobacterium avium subsp. paratuberculosis
gcgucucgaugaccucgcgggug

SEQ ID NO: 2852091 - RNA, 13 nt, Mycobacterium avium subsp. paratuberculosis
gcgucucgaugag

SEQ ID NO: 2852092 - RNA, 16 nt, Mycobacterium avium subsp. paratuberculosis
gcgucucgccggggaa

SEQ ID NO: 2852093 - RNA, 14 nt, Mycobacterium avium subsp. paratuberculosis
gcgugacgcucgac

SEQ ID NO: 2852094 - RNA, 20 nt, Mycobacterium avium subsp. paratuberculosis
gcgugacgcucgacggccgg

SEQ ID NO: 2852095 - RNA, 13 nt, Mycobacterium avium subsp. paratuberculosis
gcgugacgcucgc

SEQ ID NO: 2852096 - RNA, 16 nt, Mycobacterium avium subsp. paratuberculosis
gcgugacgcucgccgg

SEQ ID NO: 2852097 - RNA, 18 nt, Mycobacterium avium subsp. paratuberculosis
gcgugacgcucgccggcg

SEQ ID NO: 2852098 - RNA, 22 nt, Mycobacterium avium subsp. paratuberculosis
gcgugacgcucgccggcggccg

SEQ ID NO: 2852099 - RNA, 17 nt, Mycobacterium avium subsp. paratuberculosis
gcgugacgcucgcgugg

SEQ ID NO: 2852100 - RNA, 15 nt, Mycobacterium avium subsp. paratuberculosis
gcgugacgcucggcg

SEQ ID NO: 2852101 - RNA, 21 nt, Mycobacterium avium subsp. paratuberculosis
gcgugacgcucggcgcgucgu

SEQ ID NO: 2852102 - RNA, 14 nt, Mycobacterium avium subsp. paratuberculosis
gcgugacgcucggg

SEQ ID NO: 2852103 - RNA, 22 nt, Mycobacterium avium subsp. paratuberculosis
gcgugacgcucgggcuucggcg

SEQ ID NO: 2852104 - RNA, 15 nt, Mycobacterium avium subsp. paratuberculosis
gcgugacggccgcgg

SEQ ID NO: 2852105 - RNA, 16 nt, Mycobacterium avium subsp. paratuberculosis
gcgugacggcggggcg

SEQ ID NO: 2852106 - RNA, 17 nt, Mycobacterium avium subsp. paratuberculosis
gcgugacggcggggcgg

SEQ ID NO: 2852107 - RNA, 18 nt, Mycobacterium avium subsp. paratuberculosis
gcgugacggcggggcgga

SEQ ID NO: 2852108 - RNA, 16 nt, Mycobacterium avium subsp. paratuberculosis
gcgugacgucgacguu

SEQ ID NO: 2852109 - RNA, 18 nt, Mycobacterium avium subsp. paratuberculosis
gcgugacgucgacguucg

SEQ ID NO: 2852110 - RNA, 12 nt, Mycobacterium avium subsp. paratuberculosis
gcgugacguucg

SEQ ID NO: 2852111 - RNA, 16 nt, Mycobacterium avium subsp. paratuberculosis
gcgugacuugucgggc

SEQ ID NO: 2852112 - RNA, 16 nt, Mycobacterium avium subsp. paratuberculosis
gcgugauaggccucgu

SEQ ID NO: 2852113 - RNA, 19 nt, Mycobacterium avium subsp. paratuberculosis
gcgugaucccgauccucgc

SEQ ID NO: 2852114 - RNA, 18 nt, Mycobacterium avium subsp. paratuberculosis
gcgugauccggaaugcgg

SEQ ID NO: 2852115 - RNA, 21 nt, Mycobacterium avium subsp. paratuberculosis
gcgugauccggaaugcggugc

SEQ ID NO: 2852116 - RNA, 19 nt, Mycobacterium avium subsp. paratuberculosis
gcgugaucggugcccgcgg

SEQ ID NO: 2852117 - RNA, 17 nt, Mycobacterium avium subsp. paratuberculosis
gcgugaucuguucggcg

SEQ ID NO: 2852118 - RNA, 20 nt, Mycobacterium avium subsp. paratuberculosis
gcgugaucuguucggcggcg

SEQ ID NO: 2852119 - RNA, 21 nt, Mycobacterium avium subsp. paratuberculosis
gcgugaucuguucggcggcga

SEQ ID NO: 2852120 - RNA, 15 nt, Mycobacterium avium subsp. paratuberculosis
gcgugaugaccaggg

SEQ ID NO: 2852121 - RNA, 18 nt, Mycobacterium avium subsp. paratuberculosis
gcgugaugacggcggcgg

SEQ ID NO: 2852122 - RNA, 19 nt, Mycobacterium avium subsp. paratuberculosis
gcgugaugacggcggcggu

SEQ ID NO: 2852123 - RNA, 23 nt, Mycobacterium avium subsp. paratuberculosis
gcgugaugacggcggcggugccg

SEQ ID NO: 2852124 - RNA, 15 nt, Mycobacterium avium subsp. paratuberculosis
gcgugaugcagcagg

SEQ ID NO: 2852125 - RNA, 22 nt, Mycobacterium avium subsp. paratuberculosis
gcgugaugggugggcagcucgg

SEQ ID NO: 2852126 - RNA, 17 nt, Mycobacterium avium subsp. paratuberculosis
gcgugauguacagcgac

SEQ ID NO: 2852127 - RNA, 16 nt, Mycobacterium avium subsp. paratuberculosis
gcgugcaacugcgugg

SEQ ID NO: 2852128 - RNA, 17 nt, Mycobacterium avium subsp. paratuberculosis
gcgugcaacugcguggc

SEQ ID NO: 2852129 - RNA, 20 nt, Mycobacterium avium subsp. paratuberculosis
gcgugcacacccgcagcgac

SEQ ID NO: 2852130 - RNA, 21 nt, Mycobacterium avium subsp. paratuberculosis
gcgugcacacccgcagcgacc

SEQ ID NO: 2852131 - RNA, 15 nt, Mycobacterium avium subsp. paratuberculosis
gcgugcacaccggcc

SEQ ID NO: 2852132 - RNA, 15 nt, Mycobacterium avium subsp. paratuberculosis
gcgugcacaggccgc

SEQ ID NO: 2852133 - RNA, 13 nt, Mycobacterium avium subsp. paratuberculosis
gcgugcacccggu

SEQ ID NO: 2852134 - RNA, 15 nt, Mycobacterium avium subsp. paratuberculosis
gcgugcaccgcccgc

SEQ ID NO: 2852135 - RNA, 17 nt, Mycobacterium avium subsp. paratuberculosis
gcgugcaccgcccgcgc

SEQ ID NO: 2852136 - RNA, 16 nt, Mycobacterium avium subsp. paratuberculosis
gcgugcacgaacgcgg

SEQ ID NO: 2852137 - RNA, 22 nt, Mycobacterium avium subsp. paratuberculosis
gcgugcacgaacgcggccagcg

SEQ ID NO: 2852138 - RNA, 20 nt, Mycobacterium avium subsp. paratuberculosis
gcgugcagacaaccggugug

SEQ ID NO: 2852139 - RNA, 18 nt, Mycobacterium avium subsp. paratuberculosis
gcgugcagcacggggacg

SEQ ID NO: 2852140 - RNA, 12 nt, Mycobacterium avium subsp. paratuberculosis
gcgugcagccga

SEQ ID NO: 2852141 - RNA, 15 nt, Mycobacterium avium subsp. paratuberculosis
gcgugcagccgaaga

SEQ ID NO: 2852142 - RNA, 13 nt, Mycobacterium avium subsp. paratuberculosis
gcgugcagccgca

SEQ ID NO: 2852143 - RNA, 15 nt, Mycobacterium avium subsp. paratuberculosis
gcgugcagccgcaag

SEQ ID NO: 2852144 - RNA, 16 nt, Mycobacterium avium subsp. paratuberculosis
gcgugcagccgggcgg

SEQ ID NO: 2852145 - RNA, 17 nt, Mycobacterium avium subsp. paratuberculosis
gcgugcagccgggcggc

SEQ ID NO: 2852146 - RNA, 22 nt, Mycobacterium avium subsp. paratuberculosis
gcgugcagccgggcggcgccga

SEQ ID NO: 2852147 - RNA, 17 nt, Mycobacterium avium subsp. paratuberculosis
gcgugcagcgcggcgau

SEQ ID NO: 2852148 - RNA, 19 nt, Mycobacterium avium subsp. paratuberculosis
gcgugcaggauccgcucga

SEQ ID NO: 2852149 - RNA, 20 nt, Mycobacterium avium subsp. paratuberculosis
gcgugcaggauccgcucgac

SEQ ID NO: 2852150 - RNA, 21 nt, Mycobacterium avium subsp. paratuberculosis
gcgugcaggauccgcucgacg

SEQ ID NO: 2852151 - RNA, 15 nt, Mycobacterium avium subsp. paratuberculosis
gcgugcaggccgcgg

SEQ ID NO: 2852152 - RNA, 17 nt, Mycobacterium avium subsp. paratuberculosis
gcgugcaggccgcgggu

SEQ ID NO: 2852153 - RNA, 21 nt, Mycobacterium avium subsp. paratuberculosis
gcgugcaggccgcggguggcg

SEQ ID NO: 2852154 - RNA, 20 nt, Mycobacterium avium subsp. paratuberculosis
gcgugcauucagugcgagaa

SEQ ID NO: 2852155 - RNA, 23 nt, Mycobacterium avium subsp. paratuberculosis
gcgugccaagcguauccggccag

SEQ ID NO: 2852156 - RNA, 12 nt, Mycobacterium avium subsp. paratuberculosis
gcgugccaccgc

SEQ ID NO: 2852157 - RNA, 15 nt, Mycobacterium avium subsp. paratuberculosis
gcgugccaccgcugg

SEQ ID NO: 2852158 - RNA, 18 nt, Mycobacterium avium subsp. paratuberculosis
gcgugccaccgcugggcg

SEQ ID NO: 2852159 - RNA, 13 nt, Mycobacterium avium subsp. paratuberculosis
gcgugcccgccga

SEQ ID NO: 2852160 - RNA, 14 nt, Mycobacterium avium subsp. paratuberculosis
gcgugcccgccgaa

SEQ ID NO: 2852161 - RNA, 15 nt, Mycobacterium avium subsp. paratuberculosis
gcgugcccgccgaau

SEQ ID NO: 2852162 - RNA, 14 nt, Mycobacterium avium subsp. paratuberculosis
gcgugcccgccgac

SEQ ID NO: 2852163 - RNA, 13 nt, Mycobacterium avium subsp. paratuberculosis
gcgugcccgcgcc

SEQ ID NO: 2852164 - RNA, 16 nt, Mycobacterium avium subsp. paratuberculosis
gcgugcccgcgcccac

SEQ ID NO: 2852165 - RNA, 20 nt, Mycobacterium avium subsp. paratuberculosis
gcgugcccgcgcccaccugg

SEQ ID NO: 2852166 - RNA, 13 nt, Mycobacterium avium subsp. paratuberculosis
gcgugcccgcggu

SEQ ID NO: 2852167 - RNA, 17 nt, Mycobacterium avium subsp. paratuberculosis
gcgugcccggaucgccg

SEQ ID NO: 2852168 - RNA, 12 nt, Mycobacterium avium subsp. paratuberculosis
gcgugcccggcc

SEQ ID NO: 2852169 - RNA, 14 nt, Mycobacterium avium subsp. paratuberculosis
gcgugcccggccag

SEQ ID NO: 2852170 - RNA, 15 nt, Mycobacterium avium subsp. paratuberculosis
gcgugcccggccagc

SEQ ID NO: 2852171 - RNA, 13 nt, Mycobacterium avium subsp. paratuberculosis
gcgugcccggcgc

SEQ ID NO: 2852172 - RNA, 16 nt, Mycobacterium avium subsp. paratuberculosis
gcgugcccggcgcaca

SEQ ID NO: 2852173 - RNA, 15 nt, Mycobacterium avium subsp. paratuberculosis
gcgugcccggcgccg

SEQ ID NO: 2852174 - RNA, 16 nt, Mycobacterium avium subsp. paratuberculosis
gcgugcccggcgccga

SEQ ID NO: 2852175 - RNA, 20 nt, Mycobacterium avium subsp. paratuberculosis
gcgugcccggcgccgaccag

SEQ ID NO: 2852176 - RNA, 20 nt, Mycobacterium avium subsp. paratuberculosis
gcgugccgaucgagaccaug

SEQ ID NO: 2852177 - RNA, 21 nt, Mycobacterium avium subsp. paratuberculosis
gcgugccgaucgagaccaugu

SEQ ID NO: 2852178 - RNA, 14 nt, Mycobacterium avium subsp. paratuberculosis
gcguggcgguggcg

SEQ ID NO: 2852179 - RNA, 15 nt, Mycobacterium avium subsp. paratuberculosis
gcguggcgucgguga

SEQ ID NO: 2852180 - RNA, 14 nt, Mycobacterium avium subsp. paratuberculosis
gcguggcucggccc

SEQ ID NO: 2852181 - RNA, 15 nt, Mycobacterium avium subsp. paratuberculosis
gcguggcucggcccg

SEQ ID NO: 2852182 - RNA, 19 nt, Mycobacterium avium subsp. paratuberculosis
gcguggcucggcccgccgg

SEQ ID NO: 2852183 - RNA, 18 nt, Mycobacterium avium subsp. paratuberculosis
gcguggcugaggccgccc

SEQ ID NO: 2852184 - RNA, 22 nt, Mycobacterium avium subsp. paratuberculosis
gcguggcugaggccgccccggc

SEQ ID NO: 2852185 - RNA, 22 nt, Mycobacterium avium subsp. paratuberculosis
gcgugggagagcgggaccgagg

SEQ ID NO: 2852186 - RNA, 15 nt, Mycobacterium avium subsp. paratuberculosis
gcgugggcaccccga

SEQ ID NO: 2852187 - RNA, 20 nt, Mycobacterium avium subsp. paratuberculosis
gcgugggcaccccgaucagg

SEQ ID NO: 2852188 - RNA, 18 nt, Mycobacterium avium subsp. paratuberculosis
gcgugggcaccggcaccg

SEQ ID NO: 2852189 - RNA, 22 nt, Mycobacterium avium subsp. paratuberculosis
gcgugggcaccggcaccgcccc

SEQ ID NO: 2852190 - RNA, 13 nt, Mycobacterium avium subsp. paratuberculosis
gcgugggcccuca

SEQ ID NO: 2852191 - RNA, 21 nt, Mycobacterium avium subsp. paratuberculosis
gcgugggcccucagugcgggu

SEQ ID NO: 2852192 - RNA, 15 nt, Mycobacterium avium subsp. paratuberculosis
gcgugggccgcagcg

SEQ ID NO: 2852193 - RNA, 16 nt, Mycobacterium avium subsp. paratuberculosis
gcgugggccgcagcgc

SEQ ID NO: 2852194 - RNA, 21 nt, Mycobacterium avium subsp. paratuberculosis
gcguggggacccccucgucga

SEQ ID NO: 2852195 - RNA, 22 nt, Mycobacterium avium subsp. paratuberculosis
gcguggggacccccucgucgau

SEQ ID NO: 2852196 - RNA, 18 nt, Mycobacterium avium subsp. paratuberculosis
gcgugggguucccggccg

SEQ ID NO: 2852197 - RNA, 19 nt, Mycobacterium avium subsp. paratuberculosis
gcguggguguccuugcgca

SEQ ID NO: 2852198 - RNA, 18 nt, Mycobacterium avium subsp. paratuberculosis
gcguggucacccgcagcc

SEQ ID NO: 2852199 - RNA, 21 nt, Mycobacterium avium subsp. paratuberculosis
gcguggucacccgcagcccga

SEQ ID NO: 2852200 - RNA, 22 nt, Mycobacterium avium subsp. paratuberculosis
gcguggucacccgcagcccgac

SEQ ID NO: 2852201 - RNA, 21 nt, Mycobacterium avium subsp. paratuberculosis
gcguggucagcgucucgccgg

SEQ ID NO: 2852202 - RNA, 20 nt, Mycobacterium avium subsp. paratuberculosis
gcgugguccagcacgugccc

SEQ ID NO: 2852203 - RNA, 13 nt, Mycobacterium avium subsp. paratuberculosis
gcguggucgccgu

SEQ ID NO: 2852204 - RNA, 17 nt, Mycobacterium avium subsp. paratuberculosis
gcguggucgccguuggc

SEQ ID NO: 2852205 - RNA, 22 nt, Mycobacterium avium subsp. paratuberculosis
gcguggucgccguuggcgugga

SEQ ID NO: 2852206 - RNA, 15 nt, Mycobacterium avium subsp. paratuberculosis
gcguggucggcgaag

SEQ ID NO: 2852207 - RNA, 14 nt, Mycobacterium avium subsp. paratuberculosis
gcguggucggcgcg

SEQ ID NO: 2852208 - RNA, 23 nt, Mycobacterium avium subsp. paratuberculosis
gcguggugaagcagaacgccauc

SEQ ID NO: 2852209 - RNA, 16 nt, Mycobacterium avium subsp. paratuberculosis
gcguggugcgcccguc

SEQ ID NO: 2852210 - RNA, 18 nt, Mycobacterium avium subsp. paratuberculosis
gcguggugcgcccgucgg

SEQ ID NO: 2852211 - RNA, 15 nt, Mycobacterium avium subsp. paratuberculosis
gcguggugcucacgc

SEQ ID NO: 2852212 - RNA, 23 nt, Mycobacterium avium subsp. paratuberculosis
gcgugguggaaggugacgucgcc

SEQ ID NO: 2852213 - RNA, 19 nt, Mycobacterium avium subsp. paratuberculosis
gcguguagccugcggccug

SEQ ID NO: 2852214 - RNA, 18 nt, Mycobacterium avium subsp. paratuberculosis
gcguguaguacugcucga

SEQ ID NO: 2852215 - RNA, 20 nt, Mycobacterium avium subsp. paratuberculosis
gcguguaguacugcucgacg

SEQ ID NO: 2852216 - RNA, 17 nt, Mycobacterium avium subsp. paratuberculosis
gcgugucacuacccgcg

SEQ ID NO: 2852217 - RNA, 21 nt, Mycobacterium avium subsp. paratuberculosis
gcgugucacuacccgcgaugg

SEQ ID NO: 2852218 - RNA, 17 nt, Mycobacterium avium subsp. paratuberculosis
gcgugucgccggggcgg

SEQ ID NO: 2852219 - RNA, 14 nt, Mycobacterium avium subsp. paratuberculosis
gcgugucgcgugcu

SEQ ID NO: 2852220 - RNA, 16 nt, Mycobacterium avium subsp. paratuberculosis
gcgugucggcgccacc

SEQ ID NO: 2852221 - RNA, 20 nt, Mycobacterium avium subsp. paratuberculosis
gcgugucgugugcgugacgu

SEQ ID NO: 2852222 - RNA, 21 nt, Mycobacterium avium subsp. paratuberculosis
gcgugugcccagcacgacgcc

SEQ ID NO: 2852223 - RNA, 20 nt, Mycobacterium avium subsp. paratuberculosis
gcgugugcccgccucgcagc

SEQ ID NO: 2852224 - RNA, 20 nt, Mycobacterium avium subsp. paratuberculosis
gcgugugcgugguggggccg

SEQ ID NO: 2852225 - RNA, 15 nt, Mycobacterium avium subsp. paratuberculosis
gcguguggcccugcg

SEQ ID NO: 2852226 - RNA, 15 nt, Mycobacterium avium subsp. paratuberculosis
gcgugugggcucgcc

SEQ ID NO: 2852227 - RNA, 17 nt, Mycobacterium avium subsp. paratuberculosis
gcgugugggcucgcccg

SEQ ID NO: 2852228 - RNA, 19 nt, Mycobacterium avium subsp. paratuberculosis
gcgugugggcucgcccggg

SEQ ID NO: 2852229 - RNA, 20 nt, Mycobacterium avium subsp. paratuberculosis
gcguguuccuugcggccgcc

SEQ ID NO: 2852230 - RNA, 22 nt, Mycobacterium avium subsp. paratuberculosis
gcguguuccuugcggccgccga

SEQ ID NO: 2852231 - RNA, 15 nt, Mycobacterium avium subsp. paratuberculosis
gcguguugagcucgc

SEQ ID NO: 2852232 - RNA, 18 nt, Mycobacterium avium subsp. paratuberculosis
gcguguugagcucgcggc

SEQ ID NO: 2852233 - RNA, 19 nt, Mycobacterium avium subsp. paratuberculosis
gcguguugagcucgcggcg

SEQ ID NO: 2852234 - RNA, 14 nt, Mycobacterium avium subsp. paratuberculosis
gcguguuggacgcc

SEQ ID NO: 2852235 - RNA, 23 nt, Mycobacterium avium subsp. paratuberculosis
gcguuacacccauucacgcagcu

SEQ ID NO: 2852236 - RNA, 24 nt, Mycobacterium avium subsp. paratuberculosis
gcguuacacccauucacgcagcug

SEQ ID NO: 2852237 - RNA, 15 nt, Mycobacterium avium subsp. paratuberculosis
gcguuacacccgcgg

SEQ ID NO: 2852238 - RNA, 19 nt, Mycobacterium avium subsp. paratuberculosis
gcguuauuugugcgcuggc

SEQ ID NO: 2852239 - RNA, 17 nt, Mycobacterium avium subsp. paratuberculosis
gcguucacaguaggcgg

SEQ ID NO: 2852240 - RNA, 22 nt, Mycobacterium avium subsp. paratuberculosis
gcguucacccgcgcccgcaugu

SEQ ID NO: 2852241 - RNA, 14 nt, Mycobacterium avium subsp. paratuberculosis
gcguucacgucgau

SEQ ID NO: 2852242 - RNA, 17 nt, Mycobacterium avium subsp. paratuberculosis
gcguucagccggagccg

SEQ ID NO: 2852243 - RNA, 19 nt, Mycobacterium avium subsp. paratuberculosis
gcguucagccggagccggc

SEQ ID NO: 2852244 - RNA, 15 nt, Mycobacterium avium subsp. paratuberculosis
gcguucagcggcacc

SEQ ID NO: 2852245 - RNA, 18 nt, Mycobacterium avium subsp. paratuberculosis
gcguucagcggcaccguc

SEQ ID NO: 2852246 - RNA, 15 nt, Mycobacterium avium subsp. paratuberculosis
gcguucaucaccugg

SEQ ID NO: 2852247 - RNA, 17 nt, Mycobacterium avium subsp. paratuberculosis
gcguucaucaccugguc

SEQ ID NO: 2852248 - RNA, 17 nt, Mycobacterium avium subsp. paratuberculosis
gcguucaucguccacac

SEQ ID NO: 2852249 - RNA, 15 nt, Mycobacterium avium subsp. paratuberculosis
gcguuccagcacccg

SEQ ID NO: 2852250 - RNA, 17 nt, Mycobacterium avium subsp. paratuberculosis
gcguuccagcacccggc

SEQ ID NO: 2852251 - RNA, 18 nt, Mycobacterium avium subsp. paratuberculosis
gcguuccagcacccggcc

SEQ ID NO: 2852252 - RNA, 20 nt, Mycobacterium avium subsp. paratuberculosis
gcguuccagcacccggccca

SEQ ID NO: 2852253 - RNA, 12 nt, Mycobacterium avium subsp. paratuberculosis
gcguuccagcau

SEQ ID NO: 2852254 - RNA, 15 nt, Mycobacterium avium subsp. paratuberculosis
gcguuccaggugugc

SEQ ID NO: 2852255 - RNA, 22 nt, Mycobacterium avium subsp. paratuberculosis
gcguuccaggugugccgcuggu

SEQ ID NO: 2852256 - RNA, 23 nt, Mycobacterium avium subsp. paratuberculosis
gcguuccaggugugccgcuggua

SEQ ID NO: 2852257 - RNA, 16 nt, Mycobacterium avium subsp. paratuberculosis
gcguuccagguucagc

SEQ ID NO: 2852258 - RNA, 21 nt, Mycobacterium avium subsp. paratuberculosis
gcguuccagguucagcccggc

SEQ ID NO: 2852259 - RNA, 22 nt, Mycobacterium avium subsp. paratuberculosis
gcguuccagguucagcccggcg

SEQ ID NO: 2852260 - RNA, 17 nt, Mycobacterium avium subsp. paratuberculosis
gcguuccaucagcgccc

SEQ ID NO: 2852261 - RNA, 22 nt, Mycobacterium avium subsp. paratuberculosis
gcguuccaucagcgcccgcgcg

SEQ ID NO: 2852262 - RNA, 19 nt, Mycobacterium avium subsp. paratuberculosis
gcguugcggaucgaacggc

SEQ ID NO: 2852263 - RNA, 15 nt, Mycobacterium avium subsp. paratuberculosis
gcguugcggaucucg

SEQ ID NO: 2852264 - RNA, 17 nt, Mycobacterium avium subsp. paratuberculosis
gcguugcggcacaggcg

SEQ ID NO: 2852265 - RNA, 16 nt, Mycobacterium avium subsp. paratuberculosis
gcguugcggccgucca

SEQ ID NO: 2852266 - RNA, 16 nt, Mycobacterium avium subsp. paratuberculosis
gcguugcgggcgaacg

SEQ ID NO: 2852267 - RNA, 18 nt, Mycobacterium avium subsp. paratuberculosis
gcguuggacagcucgacg

SEQ ID NO: 2852268 - RNA, 19 nt, Mycobacterium avium subsp. paratuberculosis
gcguuggacagcucgacga

SEQ ID NO: 2852269 - RNA, 16 nt, Mycobacterium avium subsp. paratuberculosis
gcguuggacuccaccg

SEQ ID NO: 2852270 - RNA, 18 nt, Mycobacterium avium subsp. paratuberculosis
gcguuggacuccaccgcc

SEQ ID NO: 2852271 - RNA, 19 nt, Mycobacterium avium subsp. paratuberculosis
gcguuggacuccaccgcca

SEQ ID NO: 2852272 - RNA, 21 nt, Mycobacterium avium subsp. paratuberculosis
gcguuggacuccaccgccacc

SEQ ID NO: 2852273 - RNA, 17 nt, Mycobacterium avium subsp. paratuberculosis
gcguuggagccgaccag

SEQ ID NO: 2852274 - RNA, 19 nt, Mycobacterium avium subsp. paratuberculosis
gcguuggagccgaccagcg

SEQ ID NO: 2852275 - RNA, 23 nt, Mycobacterium avium subsp. paratuberculosis
gcguuggcccgugucgcggccuc

SEQ ID NO: 2852276 - RNA, 14 nt, Mycobacterium avium subsp. paratuberculosis
gcguuggccgagca

SEQ ID NO: 2852277 - RNA, 19 nt, Mycobacterium avium subsp. paratuberculosis
gcguuggccgagcagccgg

SEQ ID NO: 2852278 - RNA, 22 nt, Mycobacterium avium subsp. paratuberculosis
gcguuggccgagcagccgggcc

SEQ ID NO: 2852279 - RNA, 15 nt, Mycobacterium avium subsp. paratuberculosis
gcguuggccgccgcc

SEQ ID NO: 2852280 - RNA, 17 nt, Mycobacterium avium subsp. paratuberculosis
gcguuggccgccgccug

SEQ ID NO: 2852281 - RNA, 23 nt, Mycobacterium avium subsp. paratuberculosis
gcguuggcggcgucgaguucgcc

SEQ ID NO: 2852282 - RNA, 21 nt, Mycobacterium avium subsp. paratuberculosis
gcguugguccacacguccugg

SEQ ID NO: 2852283 - RNA, 22 nt, Mycobacterium avium subsp. paratuberculosis
gcguugguugcggccccgccag

SEQ ID NO: 2852284 - RNA, 19 nt, Mycobacterium avium subsp. paratuberculosis
gcguuguccagguagccca

SEQ ID NO: 2852285 - RNA, 19 nt, Mycobacterium avium subsp. paratuberculosis
gcguugucgaccaccaggu

SEQ ID NO: 2852286 - RNA, 13 nt, Mycobacterium avium subsp. paratuberculosis
gcguugucggcga

SEQ ID NO: 2852287 - RNA, 19 nt, Mycobacterium avium subsp. paratuberculosis
gcguugucggcgacggcgg

SEQ ID NO: 2852288 - RNA, 14 nt, Mycobacterium avium subsp. paratuberculosis
gcguugugcaccaa

SEQ ID NO: 2852289 - RNA, 19 nt, Mycobacterium avium subsp. paratuberculosis
gcguuguugaggaacgcga

SEQ ID NO: 2852290 - RNA, 18 nt, Mycobacterium avium subsp. paratuberculosis
gcguuguugcucggcggc

SEQ ID NO: 2852291 - RNA, 22 nt, Mycobacterium avium subsp. paratuberculosis
gcguuguugcucggcggcccgc

SEQ ID NO: 2852292 - RNA, 16 nt, Mycobacterium avium subsp. paratuberculosis
gcguuucagcaacccg

SEQ ID NO: 2852293 - RNA, 20 nt, Mycobacterium avium subsp. paratuberculosis
gcguuucagcaacccgaaag

SEQ ID NO: 2852294 - RNA, 19 nt, Mycobacterium avium subsp. paratuberculosis
gcguuuccuggugcaccag

SEQ ID NO: 2852295 - RNA, 20 nt, Mycobacterium avium subsp. paratuberculosis
gcguuuccuggugcaccagg

SEQ ID NO: 2852296 - RNA, 18 nt, Mycobacterium avium subsp. paratuberculosis
gcguuuggccugcggcaa

SEQ ID NO: 2852297 - RNA, 18 nt, Mycobacterium avium subsp. paratuberculosis
gcguuuugaaauccgggc

SEQ ID NO: 2852298 - RNA, 19 nt, Mycobacterium avium subsp. paratuberculosis
gcguuuugaaauccgggcg

SEQ ID NO: 2852299 - RNA, 15 nt, Mycobacterium avium subsp. paratuberculosis
gcuaaaccccacggc

SEQ ID NO: 2852300 - RNA, 16 nt, Mycobacterium avium subsp. paratuberculosis
gcuaaagccgaccgcc

SEQ ID NO: 2852301 - RNA, 13 nt, Mycobacterium avium subsp. paratuberculosis
gcuaacaaaagcc

SEQ ID NO: 2852302 - RNA, 17 nt, Mycobacterium avium subsp. paratuberculosis
gcuaaccaccggugacg

SEQ ID NO: 2852303 - RNA, 14 nt, Mycobacterium avium subsp. paratuberculosis
gcuaagcgauuacg

SEQ ID NO: 2852304 - RNA, 18 nt, Mycobacterium avium subsp. paratuberculosis
gcuaaugcaucgaugccg

SEQ ID NO: 2852305 - RNA, 17 nt, Mycobacterium avium subsp. paratuberculosis
gcuaccagccccaggag

SEQ ID NO: 2852306 - RNA, 12 nt, Mycobacterium avium subsp. paratuberculosis
gcuacccggcga

SEQ ID NO: 2852307 - RNA, 21 nt, Mycobacterium avium subsp. paratuberculosis
gcuacccggcgaaccgggaca

SEQ ID NO: 2852308 - RNA, 22 nt, Mycobacterium avium subsp. paratuberculosis
gcuacccggcgaaccgggacag

SEQ ID NO: 2852309 - RNA, 19 nt, Mycobacterium avium subsp. paratuberculosis
gcuaccgccgggcgggccg

SEQ ID NO: 2852310 - RNA, 16 nt, Mycobacterium avium subsp. paratuberculosis
gcuaccgcgcucaccg

SEQ ID NO: 2852311 - RNA, 17 nt, Mycobacterium avium subsp. paratuberculosis
gcuaccgcgcucaccgu

SEQ ID NO: 2852312 - RNA, 19 nt, Mycobacterium avium subsp. paratuberculosis
gcuaccgcgcucaccgucg

SEQ ID NO: 2852313 - RNA, 17 nt, Mycobacterium avium subsp. paratuberculosis
gcuaccuaggcgucguc

SEQ ID NO: 2852314 - RNA, 19 nt, Mycobacterium avium subsp. paratuberculosis
gcuaccuaggcgucgucgg

SEQ ID NO: 2852315 - RNA, 20 nt, Mycobacterium avium subsp. paratuberculosis
gcuaccucacaaccgaugug

SEQ ID NO: 2852316 - RNA, 22 nt, Mycobacterium avium subsp. paratuberculosis
gcuaccuuguugugacacagcc

SEQ ID NO: 2852317 - RNA, 15 nt, Mycobacterium avium subsp. paratuberculosis
gcuacgccggcucgg

SEQ ID NO: 2852318 - RNA, 13 nt, Mycobacterium avium subsp. paratuberculosis
gcuacgcgagcug

SEQ ID NO: 2852319 - RNA, 16 nt, Mycobacterium avium subsp. paratuberculosis
gcuacgcgagcugcuu

SEQ ID NO: 2852320 - RNA, 17 nt, Mycobacterium avium subsp. paratuberculosis
gcuacggacgcauccac

SEQ ID NO: 2852321 - RNA, 13 nt, Mycobacterium avium subsp. paratuberculosis
gcuacugccgacg

SEQ ID NO: 2852322 - RNA, 16 nt, Mycobacterium avium subsp. paratuberculosis
gcuacugccgacgcau

SEQ ID NO: 2852323 - RNA, 20 nt, Mycobacterium avium subsp. paratuberculosis
gcuacuucuucuccauggug

SEQ ID NO: 2852324 - RNA, 21 nt, Mycobacterium avium subsp. paratuberculosis
gcuacuucuucuccaugguga

SEQ ID NO: 2852325 - RNA, 15 nt, Mycobacterium avium subsp. paratuberculosis
gcuagaccgauggcg

SEQ ID NO: 2852326 - RNA, 21 nt, Mycobacterium avium subsp. paratuberculosis
gcuagaccgauggcggcggcc

SEQ ID NO: 2852327 - RNA, 17 nt, Mycobacterium avium subsp. paratuberculosis
gcuagacgcgcaccagg

SEQ ID NO: 2852328 - RNA, 20 nt, Mycobacterium avium subsp. paratuberculosis
gcuagacgcgcaccagggcc

SEQ ID NO: 2852329 - RNA, 14 nt, Mycobacterium avium subsp. paratuberculosis
gcuagcgagcgggc

SEQ ID NO: 2852330 - RNA, 20 nt, Mycobacterium avium subsp. paratuberculosis
gcuagcgagcgggcacgccg

SEQ ID NO: 2852331 - RNA, 16 nt, Mycobacterium avium subsp. paratuberculosis
gcuagcggcugacccg

SEQ ID NO: 2852332 - RNA, 23 nt, Mycobacterium avium subsp. paratuberculosis
gcuagcggcugacccgcccgggu

SEQ ID NO: 2852333 - RNA, 17 nt, Mycobacterium avium subsp. paratuberculosis
gcuagcgggcgcgcagc

SEQ ID NO: 2852334 - RNA, 19 nt, Mycobacterium avium subsp. paratuberculosis
gcuagcgggcgcgcagcca

SEQ ID NO: 2852335 - RNA, 12 nt, Mycobacterium avium subsp. paratuberculosis
gcuagcgugacg

SEQ ID NO: 2852336 - RNA, 19 nt, Mycobacterium avium subsp. paratuberculosis
gcuagcgugacgcucgcgu

SEQ ID NO: 2852337 - RNA, 23 nt, Mycobacterium avium subsp. paratuberculosis
gcuagcgugacgcucgcguggcc

SEQ ID NO: 2852338 - RNA, 16 nt, Mycobacterium avium subsp. paratuberculosis
gcuagcugcgccggcu

SEQ ID NO: 2852339 - RNA, 15 nt, Mycobacterium avium subsp. paratuberculosis
gcuagcuucacgcuc

SEQ ID NO: 2852340 - RNA, 19 nt, Mycobacterium avium subsp. paratuberculosis
gcuagcuucacgcucggcg

SEQ ID NO: 2852341 - RNA, 22 nt, Mycobacterium avium subsp. paratuberculosis
gcuagcuucacgcucggcgccg

SEQ ID NO: 2852342 - RNA, 20 nt, Mycobacterium avium subsp. paratuberculosis
gcuaggaagccagccguccc

SEQ ID NO: 2852343 - RNA, 20 nt, Mycobacterium avium subsp. paratuberculosis
gcuaggccagcagcgcggcg

SEQ ID NO: 2852344 - RNA, 19 nt, Mycobacterium avium subsp. paratuberculosis
gcuaggcggccgggcggcc

SEQ ID NO: 2852345 - RNA, 18 nt, Mycobacterium avium subsp. paratuberculosis
gcuaggcucggcagccgg

SEQ ID NO: 2852346 - RNA, 13 nt, Mycobacterium avium subsp. paratuberculosis
gcuaggucaccgg

SEQ ID NO: 2852347 - RNA, 17 nt, Mycobacterium avium subsp. paratuberculosis
gcuagguuuggccagca

SEQ ID NO: 2852348 - RNA, 22 nt, Mycobacterium avium subsp. paratuberculosis
gcuagguuuggccagcaccgcg

SEQ ID NO: 2852349 - RNA, 15 nt, Mycobacterium avium subsp. paratuberculosis
gcuagucgcccagca

SEQ ID NO: 2852350 - RNA, 18 nt, Mycobacterium avium subsp. paratuberculosis
gcuagucgcccagcagcc

SEQ ID NO: 2852351 - RNA, 18 nt, Mycobacterium avium subsp. paratuberculosis
gcuaguuggugcugggca

SEQ ID NO: 2852352 - RNA, 17 nt, Mycobacterium avium subsp. paratuberculosis
gcuaguuucacguucgc

SEQ ID NO: 2852353 - RNA, 15 nt, Mycobacterium avium subsp. paratuberculosis
gcuaucagcucgcgu

SEQ ID NO: 2852354 - RNA, 14 nt, Mycobacterium avium subsp. paratuberculosis
gcuaucgcccggcg

SEQ ID NO: 2852355 - RNA, 20 nt, Mycobacterium avium subsp. paratuberculosis
gcuauuggccgagccgggcg

SEQ ID NO: 2852356 - RNA, 21 nt, Mycobacterium avium subsp. paratuberculosis
gcuauuggccgagccgggcgg

SEQ ID NO: 2852357 - RNA, 15 nt, Mycobacterium avium subsp. paratuberculosis
gcucaacagcauugg

SEQ ID NO: 2852358 - RNA, 14 nt, Mycobacterium avium subsp. paratuberculosis
gcucaacccgggcc

SEQ ID NO: 2852359 - RNA, 15 nt, Mycobacterium avium subsp. paratuberculosis
gcucaacccgggccg

SEQ ID NO: 2852360 - RNA, 21 nt, Mycobacterium avium subsp. paratuberculosis
gcucaacccgggccggacacg

SEQ ID NO: 2852361 - RNA, 21 nt, Mycobacterium avium subsp. paratuberculosis
gcucaacccgucgcgggucag

SEQ ID NO: 2852362 - RNA, 15 nt, Mycobacterium avium subsp. paratuberculosis
gcucaaccgcccagc

SEQ ID NO: 2852363 - RNA, 18 nt, Mycobacterium avium subsp. paratuberculosis
gcucaaccgcccagcggc

SEQ ID NO: 2852364 - RNA, 16 nt, Mycobacterium avium subsp. paratuberculosis
gcucaacggccggcgc

SEQ ID NO: 2852365 - RNA, 21 nt, Mycobacterium avium subsp. paratuberculosis
gcucaacggccggcgccgccg

SEQ ID NO: 2852366 - RNA, 14 nt, Mycobacterium avium subsp. paratuberculosis
gcucaacggcucca

SEQ ID NO: 2852367 - RNA, 21 nt, Mycobacterium avium subsp. paratuberculosis
gcucaacgugauacgccgacg

SEQ ID NO: 2852368 - RNA, 20 nt, Mycobacterium avium subsp. paratuberculosis
gcucacacagccgcuuggcg

SEQ ID NO: 2852369 - RNA, 17 nt, Mycobacterium avium subsp. paratuberculosis
gcucacagcgcggcggu

SEQ ID NO: 2852370 - RNA, 13 nt, Mycobacterium avium subsp. paratuberculosis
gcucaccccggcc

SEQ ID NO: 2852371 - RNA, 20 nt, Mycobacterium avium subsp. paratuberculosis
gcucaccccggccagggugc

SEQ ID NO: 2852372 - RNA, 12 nt, Mycobacterium avium subsp. paratuberculosis
gcucacccggcc

SEQ ID NO: 2852373 - RNA, 14 nt, Mycobacterium avium subsp. paratuberculosis
gcucacccggccca

SEQ ID NO: 2852374 - RNA, 19 nt, Mycobacterium avium subsp. paratuberculosis
gcucacccggcccaccggc

SEQ ID NO: 2852375 - RNA, 21 nt, Mycobacterium avium subsp. paratuberculosis
gcucaccgacaagggccgggc

SEQ ID NO: 2852376 - RNA, 15 nt, Mycobacterium avium subsp. paratuberculosis
gcucaccgagcuggg

SEQ ID NO: 2852377 - RNA, 16 nt, Mycobacterium avium subsp. paratuberculosis
gcucaccgagcugggc

SEQ ID NO: 2852378 - RNA, 17 nt, Mycobacterium avium subsp. paratuberculosis
gcucaccgagcugggcc

SEQ ID NO: 2852379 - RNA, 21 nt, Mycobacterium avium subsp. paratuberculosis
gcucaccgagcugggccggcg

SEQ ID NO: 2852380 - RNA, 22 nt, Mycobacterium avium subsp. paratuberculosis
gcucaccgcaucgaaccgccgc

SEQ ID NO: 2852381 - RNA, 11 nt, Mycobacterium avium subsp. paratuberculosis
gcucaccgccg

SEQ ID NO: 2852382 - RNA, 14 nt, Mycobacterium avium subsp. paratuberculosis
gcucaccgccgagc

SEQ ID NO: 2852383 - RNA, 18 nt, Mycobacterium avium subsp. paratuberculosis
gcucaccgccgagccgcu

SEQ ID NO: 2852384 - RNA, 17 nt, Mycobacterium avium subsp. paratuberculosis
gcucaccgccgaugaug

SEQ ID NO: 2852385 - RNA, 22 nt, Mycobacterium avium subsp. paratuberculosis
gcucaccgccgaugaugguggc

SEQ ID NO: 2852386 - RNA, 24 nt, Mycobacterium avium subsp. paratuberculosis
gcucaccgccgaugaugguggcgg

SEQ ID NO: 2852387 - RNA, 19 nt, Mycobacterium avium subsp. paratuberculosis
gcucaccgcgaugauggcg

SEQ ID NO: 2852388 - RNA, 22 nt, Mycobacterium avium subsp. paratuberculosis
gcucaccgcggggugcccggcg

SEQ ID NO: 2852389 - RNA, 13 nt, Mycobacterium avium subsp. paratuberculosis
gcucaccggccag

SEQ ID NO: 2852390 - RNA, 22 nt, Mycobacterium avium subsp. paratuberculosis
gcucaccggccagggccgccgc

SEQ ID NO: 2852391 - RNA, 24 nt, Mycobacterium avium subsp. paratuberculosis
gcucaccggccagggccgccgcau

SEQ ID NO: 2852392 - RNA, 13 nt, Mycobacterium avium subsp. paratuberculosis
gcucaccggcgug

SEQ ID NO: 2852393 - RNA, 15 nt, Mycobacterium avium subsp. paratuberculosis
gcucaccgggcucgg

SEQ ID NO: 2852394 - RNA, 23 nt, Mycobacterium avium subsp. paratuberculosis
gcucaccucgcuggaaaccucuu

SEQ ID NO: 2852395 - RNA, 16 nt, Mycobacterium avium subsp. paratuberculosis
gcucaccugcggcccg

SEQ ID NO: 2852396 - RNA, 17 nt, Mycobacterium avium subsp. paratuberculosis
gcucaccugcggcccgu

SEQ ID NO: 2852397 - RNA, 18 nt, Mycobacterium avium subsp. paratuberculosis
gcucaccugcggcccguc

SEQ ID NO: 2852398 - RNA, 14 nt, Mycobacterium avium subsp. paratuberculosis
gcucacggugucgg

SEQ ID NO: 2852399 - RNA, 16 nt, Mycobacterium avium subsp. paratuberculosis
gcucacggugucggcg

SEQ ID NO: 2852400 - RNA, 17 nt, Mycobacterium avium subsp. paratuberculosis
gcucacggugucggcgg

SEQ ID NO: 2852401 - RNA, 19 nt, Mycobacterium avium subsp. paratuberculosis
gcucacggugucggcggug

SEQ ID NO: 2852402 - RNA, 20 nt, Mycobacterium avium subsp. paratuberculosis
gcucacggugucggcgguga

SEQ ID NO: 2852403 - RNA, 23 nt, Mycobacterium avium subsp. paratuberculosis
gcucacguagucgaccgggaucg

SEQ ID NO: 2852404 - RNA, 15 nt, Mycobacterium avium subsp. paratuberculosis
gcucagacugccgag

SEQ ID NO: 2852405 - RNA, 18 nt, Mycobacterium avium subsp. paratuberculosis
gcucagagcugcaccggg

SEQ ID NO: 2852406 - RNA, 16 nt, Mycobacterium avium subsp. paratuberculosis
gcucagcaacccgccg

SEQ ID NO: 2852407 - RNA, 13 nt, Mycobacterium avium subsp. paratuberculosis
gcucagcaccaca

SEQ ID NO: 2852408 - RNA, 19 nt, Mycobacterium avium subsp. paratuberculosis
gcucagcacgcggaucgcg

SEQ ID NO: 2852409 - RNA, 13 nt, Mycobacterium avium subsp. paratuberculosis
gcucagcagcacc

SEQ ID NO: 2852410 - RNA, 15 nt, Mycobacterium avium subsp. paratuberculosis
gcucagccacgccgg

SEQ ID NO: 2852411 - RNA, 17 nt, Mycobacterium avium subsp. paratuberculosis
gcucagccacgccggca

SEQ ID NO: 2852412 - RNA, 14 nt, Mycobacterium avium subsp. paratuberculosis
gcucagccccagcg

SEQ ID NO: 2852413 - RNA, 18 nt, Mycobacterium avium subsp. paratuberculosis
gcucagccccagcggagc

SEQ ID NO: 2852414 - RNA, 19 nt, Mycobacterium avium subsp. paratuberculosis
gcucagcccgauucagccg

SEQ ID NO: 2852415 - RNA, 20 nt, Mycobacterium avium subsp. paratuberculosis
gcucagcccgauucagccgg

SEQ ID NO: 2852416 - RNA, 22 nt, Mycobacterium avium subsp. paratuberculosis
gcucagcccgauucagccggcg

SEQ ID NO: 2852417 - RNA, 11 nt, Mycobacterium avium subsp. paratuberculosis
gcucagcccgg

SEQ ID NO: 2852418 - RNA, 16 nt, Mycobacterium avium subsp. paratuberculosis
gcucagcccggcgcuc

SEQ ID NO: 2852419 - RNA, 18 nt, Mycobacterium avium subsp. paratuberculosis
gcucagccgaagccggcg

SEQ ID NO: 2852420 - RNA, 19 nt, Mycobacterium avium subsp. paratuberculosis
gcucagccgaagccggcgc

SEQ ID NO: 2852421 - RNA, 23 nt, Mycobacterium avium subsp. paratuberculosis
gcucagccgaagccggcgcaggu

SEQ ID NO: 2852422 - RNA, 13 nt, Mycobacterium avium subsp. paratuberculosis
gcucagccgcacg

SEQ ID NO: 2852423 - RNA, 14 nt, Mycobacterium avium subsp. paratuberculosis
gcucagccgcacgg

SEQ ID NO: 2852424 - RNA, 15 nt, Mycobacterium avium subsp. paratuberculosis
gcucagccgcacgga

SEQ ID NO: 2852425 - RNA, 14 nt, Mycobacterium avium subsp. paratuberculosis
gcucagccgccugg

SEQ ID NO: 2852426 - RNA, 14 nt, Mycobacterium avium subsp. paratuberculosis
gcucagccguucgc

SEQ ID NO: 2852427 - RNA, 17 nt, Mycobacterium avium subsp. paratuberculosis
gcucagccuagccuugg

SEQ ID NO: 2852428 - RNA, 18 nt, Mycobacterium avium subsp. paratuberculosis
gcucagcgauugcggccg

SEQ ID NO: 2852429 - RNA, 19 nt, Mycobacterium avium subsp. paratuberculosis
gcucagcgauugcggccgc

SEQ ID NO: 2852430 - RNA, 21 nt, Mycobacterium avium subsp. paratuberculosis
gcucagcgauugcggccgccg

SEQ ID NO: 2852431 - RNA, 23 nt, Mycobacterium avium subsp. paratuberculosis
gcuccuaugucggugcggcgggc

SEQ ID NO: 2852432 - RNA, 20 nt, Mycobacterium avium subsp. paratuberculosis
gcuccuccggguccccgccg

SEQ ID NO: 2852433 - RNA, 22 nt, Mycobacterium avium subsp. paratuberculosis
gcuccuccggguccccgccgcc

SEQ ID NO: 2852434 - RNA, 13 nt, Mycobacterium avium subsp. paratuberculosis
gcuccuccucgcg

SEQ ID NO: 2852435 - RNA, 17 nt, Mycobacterium avium subsp. paratuberculosis
gcuccuccucgcgccgc

SEQ ID NO: 2852436 - RNA, 19 nt, Mycobacterium avium subsp. paratuberculosis
gcuccuccucgcgccgcca

SEQ ID NO: 2852437 - RNA, 20 nt, Mycobacterium avium subsp. paratuberculosis
gcuccuccucgcgccgccac

SEQ ID NO: 2852438 - RNA, 13 nt, Mycobacterium avium subsp. paratuberculosis
gcuccuccugcgg

SEQ ID NO: 2852439 - RNA, 17 nt, Mycobacterium avium subsp. paratuberculosis
gcuccucgaaccucgcg

SEQ ID NO: 2852440 - RNA, 14 nt, Mycobacterium avium subsp. paratuberculosis
gcuccucgaccacg

SEQ ID NO: 2852441 - RNA, 15 nt, Mycobacterium avium subsp. paratuberculosis
gcuccucgaccacgc

SEQ ID NO: 2852442 - RNA, 14 nt, Mycobacterium avium subsp. paratuberculosis
gcuccucggccagc

SEQ ID NO: 2852443 - RNA, 16 nt, Mycobacterium avium subsp. paratuberculosis
gcuccucggccagcac

SEQ ID NO: 2852444 - RNA, 16 nt, Mycobacterium avium subsp. paratuberculosis
gcuccucggccagcgg

SEQ ID NO: 2852445 - RNA, 17 nt, Mycobacterium avium subsp. paratuberculosis
gcuccucggccagcggu

SEQ ID NO: 2852446 - RNA, 20 nt, Mycobacterium avium subsp. paratuberculosis
gcuccucggucagcggcgug

SEQ ID NO: 2852447 - RNA, 23 nt, Mycobacterium avium subsp. paratuberculosis
gcuccucggucagcucgggguag

SEQ ID NO: 2852448 - RNA, 19 nt, Mycobacterium avium subsp. paratuberculosis
gcuccugcagcgcggcgau

SEQ ID NO: 2852449 - RNA, 12 nt, Mycobacterium avium subsp. paratuberculosis
gcuccugcaggc

SEQ ID NO: 2852450 - RNA, 20 nt, Mycobacterium avium subsp. paratuberculosis
gcuccugcaggccgagccgc

SEQ ID NO: 2852451 - RNA, 21 nt, Mycobacterium avium subsp. paratuberculosis
gcuccugcaggccgagccgcc

SEQ ID NO: 2852452 - RNA, 20 nt, Mycobacterium avium subsp. paratuberculosis
gcuccugccagcggcgcaac

SEQ ID NO: 2852453 - RNA, 16 nt, Mycobacterium avium subsp. paratuberculosis
gcuccugccguucggc

SEQ ID NO: 2852454 - RNA, 21 nt, Mycobacterium avium subsp. paratuberculosis
gcuccuugagccgccgcggca

SEQ ID NO: 2852455 - RNA, 14 nt, Mycobacterium avium subsp. paratuberculosis
gcuccuugcgccgc

SEQ ID NO: 2852456 - RNA, 18 nt, Mycobacterium avium subsp. paratuberculosis
gcuccuugcgccgcaaca

SEQ ID NO: 2852457 - RNA, 23 nt, Mycobacterium avium subsp. paratuberculosis
gcucgaaaugccuuggcggcgug

SEQ ID NO: 2852458 - RNA, 18 nt, Mycobacterium avium subsp. paratuberculosis
gcucgaacaacccggccg

SEQ ID NO: 2852459 - RNA, 19 nt, Mycobacterium avium subsp. paratuberculosis
gcucgaacaacccggccgc

SEQ ID NO: 2852460 - RNA, 21 nt, Mycobacterium avium subsp. paratuberculosis
gcucgaacaacccggccgcga

SEQ ID NO: 2852461 - RNA, 15 nt, Mycobacterium avium subsp. paratuberculosis
gcucgaacaccgucg

SEQ ID NO: 2852462 - RNA, 16 nt, Mycobacterium avium subsp. paratuberculosis
gcucgaacaccgucga

SEQ ID NO: 2852463 - RNA, 13 nt, Mycobacterium avium subsp. paratuberculosis
gcucgaaccgcga

SEQ ID NO: 2852464 - RNA, 21 nt, Mycobacterium avium subsp. paratuberculosis
gcucgaaccgcgagacccggu

SEQ ID NO: 2852465 - RNA, 13 nt, Mycobacterium avium subsp. paratuberculosis
gcucgaaccugga

SEQ ID NO: 2852466 - RNA, 15 nt, Mycobacterium avium subsp. paratuberculosis
gcucgaaccuggagg

SEQ ID NO: 2852467 - RNA, 17 nt, Mycobacterium avium subsp. paratuberculosis
gcucgaacucaccggug

SEQ ID NO: 2852468 - RNA, 20 nt, Mycobacterium avium subsp. paratuberculosis
gcucgaacucaccgguggcc

SEQ ID NO: 2852469 - RNA, 21 nt, Mycobacterium avium subsp. paratuberculosis
gcucgaacucaccgguggccg

SEQ ID NO: 2852470 - RNA, 23 nt, Mycobacterium avium subsp. paratuberculosis
gcucgaacucaccgguggccgcg

SEQ ID NO: 2852471 - RNA, 20 nt, Mycobacterium avium subsp. paratuberculosis
gcucgaagcuuucggugcgc

SEQ ID NO: 2852472 - RNA, 11 nt, Mycobacterium avium subsp. paratuberculosis
gcucgaaggca

SEQ ID NO: 2852473 - RNA, 16 nt, Mycobacterium avium subsp. paratuberculosis
gcucgaaggcaacucg

SEQ ID NO: 2852474 - RNA, 17 nt, Mycobacterium avium subsp. paratuberculosis
gcucgaaggugaccauc

SEQ ID NO: 2852475 - RNA, 16 nt, Mycobacterium avium subsp. paratuberculosis
gcucgaaggugcccgc

SEQ ID NO: 2852476 - RNA, 22 nt, Mycobacterium avium subsp. paratuberculosis
gcucgacaacugcccaaugauc

SEQ ID NO: 2852477 - RNA, 19 nt, Mycobacterium avium subsp. paratuberculosis
gcucgacacgauguugaug

SEQ ID NO: 2852478 - RNA, 20 nt, Mycobacterium avium subsp. paratuberculosis
gcucgacacgauguugaugu

SEQ ID NO: 2852479 - RNA, 16 nt, Mycobacterium avium subsp. paratuberculosis
gcucgacaggcagccc

SEQ ID NO: 2852480 - RNA, 17 nt, Mycobacterium avium subsp. paratuberculosis
gcucgacaucggccgcc

SEQ ID NO: 2852481 - RNA, 14 nt, Mycobacterium avium subsp. paratuberculosis
gcucgaccacgccg

SEQ ID NO: 2852482 - RNA, 15 nt, Mycobacterium avium subsp. paratuberculosis
gcucgaccacgccgu

SEQ ID NO: 2852483 - RNA, 16 nt, Mycobacterium avium subsp. paratuberculosis
gcucgaccacgccgua

SEQ ID NO: 2852484 - RNA, 16 nt, Mycobacterium avium subsp. paratuberculosis
gcucgaccagauugcg

SEQ ID NO: 2852485 - RNA, 12 nt, Mycobacterium avium subsp. paratuberculosis
gcucgaccagcc

SEQ ID NO: 2852486 - RNA, 13 nt, Mycobacterium avium subsp. paratuberculosis
gcucgaccagccc

SEQ ID NO: 2852487 - RNA, 17 nt, Mycobacterium avium subsp. paratuberculosis
gcucgaccagcccccgc

SEQ ID NO: 2852488 - RNA, 19 nt, Mycobacterium avium subsp. paratuberculosis
gcucgaccagcccccgcgg

SEQ ID NO: 2852489 - RNA, 15 nt, Mycobacterium avium subsp. paratuberculosis
gcucgaccagccggg

SEQ ID NO: 2852490 - RNA, 20 nt, Mycobacterium avium subsp. paratuberculosis
gcucgaccagccggguccgc

SEQ ID NO: 2852491 - RNA, 13 nt, Mycobacterium avium subsp. paratuberculosis
gcucgaccagcgc

SEQ ID NO: 2852492 - RNA, 14 nt, Mycobacterium avium subsp. paratuberculosis
gcucgaccagcgcc

SEQ ID NO: 2852493 - RNA, 15 nt, Mycobacterium avium subsp. paratuberculosis
gcucgaccagcgccg

SEQ ID NO: 2852494 - RNA, 17 nt, Mycobacterium avium subsp. paratuberculosis
gcucgaccagcgccgag

SEQ ID NO: 2852495 - RNA, 15 nt, Mycobacterium avium subsp. paratuberculosis
gcucgaccccucggc

SEQ ID NO: 2852496 - RNA, 17 nt, Mycobacterium avium subsp. paratuberculosis
gcucgaccccucggcau

SEQ ID NO: 2852497 - RNA, 15 nt, Mycobacterium avium subsp. paratuberculosis
gcucgaccgcggcga

SEQ ID NO: 2852498 - RNA, 17 nt, Mycobacterium avium subsp. paratuberculosis
gcucgaccucggcgacc

SEQ ID NO: 2852499 - RNA, 18 nt, Mycobacterium avium subsp. paratuberculosis
gcucgaccucggcggcca

SEQ ID NO: 2852500 - RNA, 18 nt, Mycobacterium avium subsp. paratuberculosis
gcucgacgaacuccgcgc

SEQ ID NO: 2852501 - RNA, 17 nt, Mycobacterium avium subsp. paratuberculosis
gcucgacgaccucgccg

SEQ ID NO: 2852502 - RNA, 15 nt, Mycobacterium avium subsp. paratuberculosis
gcucgacgacuucgg

SEQ ID NO: 2852503 - RNA, 16 nt, Mycobacterium avium subsp. paratuberculosis
gcucgacgacuucggc

SEQ ID NO: 2852504 - RNA, 18 nt, Mycobacterium avium subsp. paratuberculosis
gcucgacgacuucggccu

SEQ ID NO: 2852505 - RNA, 20 nt, Mycobacterium avium subsp. paratuberculosis
gcucgacgcgcacccgggac

SEQ ID NO: 2852506 - RNA, 14 nt, Mycobacterium avium subsp. paratuberculosis
gcucgacgcgucga

SEQ ID NO: 2852507 - RNA, 16 nt, Mycobacterium avium subsp. paratuberculosis
gcucgacgcgucgaca

SEQ ID NO: 2852508 - RNA, 17 nt, Mycobacterium avium subsp. paratuberculosis
gcucgacggcacccggc

SEQ ID NO: 2852509 - RNA, 20 nt, Mycobacterium avium subsp. paratuberculosis
gcucgacggcacccggcccu

SEQ ID NO: 2852510 - RNA, 14 nt, Mycobacterium avium subsp. paratuberculosis
gcucgacggccggc

SEQ ID NO: 2852511 - RNA, 14 nt, Mycobacterium avium subsp. paratuberculosis
gcucgacguagucg

SEQ ID NO: 2852512 - RNA, 20 nt, Mycobacterium avium subsp. paratuberculosis
gcucgacguagucgcgcacc

SEQ ID NO: 2852513 - RNA, 23 nt, Mycobacterium avium subsp. paratuberculosis
gcucgacguagucgcgcaccauc

SEQ ID NO: 2852514 - RNA, 15 nt, Mycobacterium avium subsp. paratuberculosis
gcucgagcaacacca

SEQ ID NO: 2852515 - RNA, 17 nt, Mycobacterium avium subsp. paratuberculosis
gcucgagcaacaccacc

SEQ ID NO: 2852516 - RNA, 21 nt, Mycobacterium avium subsp. paratuberculosis
gcucgccgcugucgucgaaga

SEQ ID NO: 2852517 - RNA, 17 nt, Mycobacterium avium subsp. paratuberculosis
gcucgccggcccgaccg

SEQ ID NO: 2852518 - RNA, 12 nt, Mycobacterium avium subsp. paratuberculosis
gcucgccggccg

SEQ ID NO: 2852519 - RNA, 14 nt, Mycobacterium avium subsp. paratuberculosis
gcucgccggccgcg

SEQ ID NO: 2852520 - RNA, 14 nt, Mycobacterium avium subsp. paratuberculosis
gcucgccggcgcgc

SEQ ID NO: 2852521 - RNA, 17 nt, Mycobacterium avium subsp. paratuberculosis
gcucgccggcgcgcagc

SEQ ID NO: 2852522 - RNA, 16 nt, Mycobacterium avium subsp. paratuberculosis
gcucgccggcggccgc

SEQ ID NO: 2852523 - RNA, 17 nt, Mycobacterium avium subsp. paratuberculosis
gcucgccggcggccgcc

SEQ ID NO: 2852524 - RNA, 13 nt, Mycobacterium avium subsp. paratuberculosis
gcucgccggcuac

SEQ ID NO: 2852525 - RNA, 23 nt, Mycobacterium avium subsp. paratuberculosis
gcucgccggcuaccggcgcugga

SEQ ID NO: 2852526 - RNA, 13 nt, Mycobacterium avium subsp. paratuberculosis
gcucgccggggac

SEQ ID NO: 2852527 - RNA, 15 nt, Mycobacterium avium subsp. paratuberculosis
gcucgccggggacga

SEQ ID NO: 2852528 - RNA, 19 nt, Mycobacterium avium subsp. paratuberculosis
gcucgccggggacgacggc

SEQ ID NO: 2852529 - RNA, 20 nt, Mycobacterium avium subsp. paratuberculosis
gcucgccggggacgacggcg

SEQ ID NO: 2852530 - RNA, 14 nt, Mycobacterium avium subsp. paratuberculosis
gcucgccgguggcg

SEQ ID NO: 2852531 - RNA, 20 nt, Mycobacterium avium subsp. paratuberculosis
gcucgccgguggcggcgaca

SEQ ID NO: 2852532 - RNA, 23 nt, Mycobacterium avium subsp. paratuberculosis
gcucgccgucacaccgcggccag

SEQ ID NO: 2852533 - RNA, 13 nt, Mycobacterium avium subsp. paratuberculosis
gcucgccguccgg

SEQ ID NO: 2852534 - RNA, 23 nt, Mycobacterium avium subsp. paratuberculosis
gcucgccgucggccagcagcgcg

SEQ ID NO: 2852535 - RNA, 20 nt, Mycobacterium avium subsp. paratuberculosis
gcucgccguugcgggucggc

SEQ ID NO: 2852536 - RNA, 15 nt, Mycobacterium avium subsp. paratuberculosis
gcucgccucaacggu

SEQ ID NO: 2852537 - RNA, 23 nt, Mycobacterium avium subsp. paratuberculosis
gcucgccugacuaagucaccagg

SEQ ID NO: 2852538 - RNA, 22 nt, Mycobacterium avium subsp. paratuberculosis
gcucgccuuugaugacgacgug

SEQ ID NO: 2852539 - RNA, 23 nt, Mycobacterium avium subsp. paratuberculosis
gcucgccuuugaugacgacguga

SEQ ID NO: 2852540 - RNA, 15 nt, Mycobacterium avium subsp. paratuberculosis
gcucgcgaagcgcga

SEQ ID NO: 2852541 - RNA, 13 nt, Mycobacterium avium subsp. paratuberculosis
gcucgcgacgcgg

SEQ ID NO: 2852542 - RNA, 17 nt, Mycobacterium avium subsp. paratuberculosis
gcucgcgacgcggcucg

SEQ ID NO: 2852543 - RNA, 17 nt, Mycobacterium avium subsp. paratuberculosis
gcucgcgagggcgggcc

SEQ ID NO: 2852544 - RNA, 22 nt, Mycobacterium avium subsp. paratuberculosis
gcucgcgagggcgggccagcuc

SEQ ID NO: 2852545 - RNA, 13 nt, Mycobacterium avium subsp. paratuberculosis
gcucgcgcaccgg

SEQ ID NO: 2852546 - RNA, 16 nt, Mycobacterium avium subsp. paratuberculosis
gcucgcgcaccgggac

SEQ ID NO: 2852547 - RNA, 20 nt, Mycobacterium avium subsp. paratuberculosis
gcucgcgcaccgggaccagc

SEQ ID NO: 2852548 - RNA, 22 nt, Mycobacterium avium subsp. paratuberculosis
gcucgcgcaccgggaccagcgc

SEQ ID NO: 2852549 - RNA, 23 nt, Mycobacterium avium subsp. paratuberculosis
gcucgcgcagcagcugcacccgc

SEQ ID NO: 2852550 - RNA, 18 nt, Mycobacterium avium subsp. paratuberculosis
gcucgcgcagccggccga

SEQ ID NO: 2852551 - RNA, 19 nt, Mycobacterium avium subsp. paratuberculosis
gcucgcgcagccggccgac

SEQ ID NO: 2852552 - RNA, 13 nt, Mycobacterium avium subsp. paratuberculosis
gcucgcgcagcug

SEQ ID NO: 2852553 - RNA, 22 nt, Mycobacterium avium subsp. paratuberculosis
gcucgcgcaggaacuccagcag

SEQ ID NO: 2852554 - RNA, 14 nt, Mycobacterium avium subsp. paratuberculosis
gcucgcgcaucagc

SEQ ID NO: 2852555 - RNA, 13 nt, Mycobacterium avium subsp. paratuberculosis
gcucgcgcccggc

SEQ ID NO: 2852556 - RNA, 14 nt, Mycobacterium avium subsp. paratuberculosis
gcucgcgcccggcc

SEQ ID NO: 2852557 - RNA, 16 nt, Mycobacterium avium subsp. paratuberculosis
gcucgcgcccggccag

SEQ ID NO: 2852558 - RNA, 16 nt, Mycobacterium avium subsp. paratuberculosis
gcucgcgccgacccgc

SEQ ID NO: 2852559 - RNA, 19 nt, Mycobacterium avium subsp. paratuberculosis
gcucgcgccgacccgcccg

SEQ ID NO: 2852560 - RNA, 20 nt, Mycobacterium avium subsp. paratuberculosis
gcucgcgccgacccgcccgc

SEQ ID NO: 2852561 - RNA, 18 nt, Mycobacterium avium subsp. paratuberculosis
gcucgcgccgggcggccu

SEQ ID NO: 2852562 - RNA, 22 nt, Mycobacterium avium subsp. paratuberculosis
gcucgcgccgggcggccucggc

SEQ ID NO: 2852563 - RNA, 13 nt, Mycobacterium avium subsp. paratuberculosis
gcucgcgcugaag

SEQ ID NO: 2852564 - RNA, 16 nt, Mycobacterium avium subsp. paratuberculosis
gcucgcgcugccgcgc

SEQ ID NO: 2852565 - RNA, 17 nt, Mycobacterium avium subsp. paratuberculosis
gcucgcgcugccgcgcg

SEQ ID NO: 2852566 - RNA, 19 nt, Mycobacterium avium subsp. paratuberculosis
gcucgcgcugccgcgcgcc

SEQ ID NO: 2852567 - RNA, 13 nt, Mycobacterium avium subsp. paratuberculosis
gcucgcgcuggcg

SEQ ID NO: 2852568 - RNA, 14 nt, Mycobacterium avium subsp. paratuberculosis
gcucgcgcuggcgg

SEQ ID NO: 2852569 - RNA, 16 nt, Mycobacterium avium subsp. paratuberculosis
gcucgcgcuggcggcc

SEQ ID NO: 2852570 - RNA, 17 nt, Mycobacterium avium subsp. paratuberculosis
gcucgcgcuggcggcca

SEQ ID NO: 2852571 - RNA, 20 nt, Mycobacterium avium subsp. paratuberculosis
gcucgcggauccgcagcuga

SEQ ID NO: 2852572 - RNA, 23 nt, Mycobacterium avium subsp. paratuberculosis
gcucgcggauccgggccggcguc

SEQ ID NO: 2852573 - RNA, 22 nt, Mycobacterium avium subsp. paratuberculosis
gcucgcggccguagccggaccg

SEQ ID NO: 2852574 - RNA, 18 nt, Mycobacterium avium subsp. paratuberculosis
gcucgcggccugcgggcg

SEQ ID NO: 2852575 - RNA, 21 nt, Mycobacterium avium subsp. paratuberculosis
gcucgcggccugcgggcgccg

SEQ ID NO: 2852576 - RNA, 16 nt, Mycobacterium avium subsp. paratuberculosis
gcucgcggcgcagcuc

SEQ ID NO: 2852577 - RNA, 18 nt, Mycobacterium avium subsp. paratuberculosis
gcucgcggcgcagcucgc

SEQ ID NO: 2852578 - RNA, 19 nt, Mycobacterium avium subsp. paratuberculosis
gcucgcggcgcagcucgcg

SEQ ID NO: 2852579 - RNA, 21 nt, Mycobacterium avium subsp. paratuberculosis
gcucgcggcgcagcucgcgca

SEQ ID NO: 2852580 - RNA, 16 nt, Mycobacterium avium subsp. paratuberculosis
gcucgcggcguaggcg

SEQ ID NO: 2852581 - RNA, 14 nt, Mycobacterium avium subsp. paratuberculosis
gcucgcgggccaca

SEQ ID NO: 2852582 - RNA, 19 nt, Mycobacterium avium subsp. paratuberculosis
gcucgcgggccacagcggc

SEQ ID NO: 2852583 - RNA, 14 nt, Mycobacterium avium subsp. paratuberculosis
gcucgcgggccacc

SEQ ID NO: 2852584 - RNA, 16 nt, Mycobacterium avium subsp. paratuberculosis
gcucgcgggccaccgc

SEQ ID NO: 2852585 - RNA, 14 nt, Mycobacterium avium subsp. paratuberculosis
gcucgcgggcccgc

SEQ ID NO: 2852586 - RNA, 17 nt, Mycobacterium avium subsp. paratuberculosis
gcucgcgggcccgcgcc

SEQ ID NO: 2852587 - RNA, 21 nt, Mycobacterium avium subsp. paratuberculosis
gcucgcgggccugcucgucgg

SEQ ID NO: 2852588 - RNA, 21 nt, Mycobacterium avium subsp. paratuberculosis
gcucgcgggcgaugcggcccg

SEQ ID NO: 2852589 - RNA, 23 nt, Mycobacterium avium subsp. paratuberculosis
gcucgcgggcgaugcggcccggc

SEQ ID NO: 2852590 - RNA, 14 nt, Mycobacterium avium subsp. paratuberculosis
gcucgcgggggccg

SEQ ID NO: 2852591 - RNA, 12 nt, Mycobacterium avium subsp. paratuberculosis
gcucgcgggugc

SEQ ID NO: 2852592 - RNA, 15 nt, Mycobacterium avium subsp. paratuberculosis
gcucgcgggugcggc

SEQ ID NO: 2852593 - RNA, 21 nt, Mycobacterium avium subsp. paratuberculosis
gcucgcgggugcggcgcugcc

SEQ ID NO: 2852594 - RNA, 15 nt, Mycobacterium avium subsp. paratuberculosis
gcucgcgggugucga

SEQ ID NO: 2852595 - RNA, 18 nt, Mycobacterium avium subsp. paratuberculosis
gcucgcgggugucgagcc

SEQ ID NO: 2852596 - RNA, 15 nt, Mycobacterium avium subsp. paratuberculosis
gcucgcggucgggga

SEQ ID NO: 2852597 - RNA, 20 nt, Mycobacterium avium subsp. paratuberculosis
gcucgcggugcgcgcgcgcu

SEQ ID NO: 2852598 - RNA, 14 nt, Mycobacterium avium subsp. paratuberculosis
gcucgcgguguggg

SEQ ID NO: 2852599 - RNA, 17 nt, Mycobacterium avium subsp. paratuberculosis
gcucgcggugugggcgg

SEQ ID NO: 2852600 - RNA, 18 nt, Mycobacterium avium subsp. paratuberculosis
gcucgcgguugggccgcc

SEQ ID NO: 2852601 - RNA, 14 nt, Mycobacterium avium subsp. paratuberculosis
gcucggcgccgacc

SEQ ID NO: 2852602 - RNA, 14 nt, Mycobacterium avium subsp. paratuberculosis
gcucggcgccgagc

SEQ ID NO: 2852603 - RNA, 15 nt, Mycobacterium avium subsp. paratuberculosis
gcucggcgccgagcg

SEQ ID NO: 2852604 - RNA, 16 nt, Mycobacterium avium subsp. paratuberculosis
gcucggcgccgagcgu

SEQ ID NO: 2852605 - RNA, 14 nt, Mycobacterium avium subsp. paratuberculosis
gcucggcgccgcgg

SEQ ID NO: 2852606 - RNA, 15 nt, Mycobacterium avium subsp. paratuberculosis
gcucggcgccgcggg

SEQ ID NO: 2852607 - RNA, 16 nt, Mycobacterium avium subsp. paratuberculosis
gcucggcgccggccgu

SEQ ID NO: 2852608 - RNA, 23 nt, Mycobacterium avium subsp. paratuberculosis
gcucggcgccggccgucacgcug

SEQ ID NO: 2852609 - RNA, 20 nt, Mycobacterium avium subsp. paratuberculosis
gcucggcgcgcggggccggc

SEQ ID NO: 2852610 - RNA, 13 nt, Mycobacterium avium subsp. paratuberculosis
gcucggcgcggcu

SEQ ID NO: 2852611 - RNA, 16 nt, Mycobacterium avium subsp. paratuberculosis
gcucggcgcgucgucc

SEQ ID NO: 2852612 - RNA, 22 nt, Mycobacterium avium subsp. paratuberculosis
gcucggcgcuccagcgggcggc

SEQ ID NO: 2852613 - RNA, 13 nt, Mycobacterium avium subsp. paratuberculosis
gcucggcggcccg

SEQ ID NO: 2852614 - RNA, 14 nt, Mycobacterium avium subsp. paratuberculosis
gcucggcggcccgc

SEQ ID NO: 2852615 - RNA, 15 nt, Mycobacterium avium subsp. paratuberculosis
gcucggcggcccgca

SEQ ID NO: 2852616 - RNA, 18 nt, Mycobacterium avium subsp. paratuberculosis
gcucggcggcccgccgga

SEQ ID NO: 2852617 - RNA, 12 nt, Mycobacterium avium subsp. paratuberculosis
gcucggcggccg

SEQ ID NO: 2852618 - RNA, 14 nt, Mycobacterium avium subsp. paratuberculosis
gcucggcggccgcc

SEQ ID NO: 2852619 - RNA, 17 nt, Mycobacterium avium subsp. paratuberculosis
gcucggcggccgccagc

SEQ ID NO: 2852620 - RNA, 13 nt, Mycobacterium avium subsp. paratuberculosis
gcucggcggccug

SEQ ID NO: 2852621 - RNA, 13 nt, Mycobacterium avium subsp. paratuberculosis
gcucggcggcgac

SEQ ID NO: 2852622 - RNA, 17 nt, Mycobacterium avium subsp. paratuberculosis
gcucggcggcgacggug

SEQ ID NO: 2852623 - RNA, 13 nt, Mycobacterium avium subsp. paratuberculosis
gcucggcggcgca

SEQ ID NO: 2852624 - RNA, 15 nt, Mycobacterium avium subsp. paratuberculosis
gcucggcggcgcagg

SEQ ID NO: 2852625 - RNA, 13 nt, Mycobacterium avium subsp. paratuberculosis
gcucggcggcgcc

SEQ ID NO: 2852626 - RNA, 14 nt, Mycobacterium avium subsp. paratuberculosis
gcucggcggcgccg

SEQ ID NO: 2852627 - RNA, 20 nt, Mycobacterium avium subsp. paratuberculosis
gcucggcggcgccgucgucg

SEQ ID NO: 2852628 - RNA, 20 nt, Mycobacterium avium subsp. paratuberculosis
gcucggcggcgucguaguug

SEQ ID NO: 2852629 - RNA, 19 nt, Mycobacterium avium subsp. paratuberculosis
gcucggcggcucagcaacc

SEQ ID NO: 2852630 - RNA, 22 nt, Mycobacterium avium subsp. paratuberculosis
gcucggcggcucagcaacccgc

SEQ ID NO: 2852631 - RNA, 14 nt, Mycobacterium avium subsp. paratuberculosis
gcucggcgggcucg

SEQ ID NO: 2852632 - RNA, 22 nt, Mycobacterium avium subsp. paratuberculosis
gcucggcgggcucgcgcuggcg

SEQ ID NO: 2852633 - RNA, 21 nt, Mycobacterium avium subsp. paratuberculosis
gcucggcggggggagaggcgc

SEQ ID NO: 2852634 - RNA, 20 nt, Mycobacterium avium subsp. paratuberculosis
gcucggcgggucacucgacc

SEQ ID NO: 2852635 - RNA, 23 nt, Mycobacterium avium subsp. paratuberculosis
gcucggcgggucguagccgucga

SEQ ID NO: 2852636 - RNA, 20 nt, Mycobacterium avium subsp. paratuberculosis
gcucggcggguugcugagcc

SEQ ID NO: 2852637 - RNA, 17 nt, Mycobacterium avium subsp. paratuberculosis
gcucggcguacaggccg

SEQ ID NO: 2852638 - RNA, 22 nt, Mycobacterium avium subsp. paratuberculosis
gcucggcguacaggccgucggg

SEQ ID NO: 2852639 - RNA, 22 nt, Mycobacterium avium subsp. paratuberculosis
gcucggcguauucgucgucggc

SEQ ID NO: 2852640 - RNA, 23 nt, Mycobacterium avium subsp. paratuberculosis
gcucggcguauucgucgucggcc

SEQ ID NO: 2852641 - RNA, 14 nt, Mycobacterium avium subsp. paratuberculosis
gcucggcguccagc

SEQ ID NO: 2852642 - RNA, 17 nt, Mycobacterium avium subsp. paratuberculosis
gcucggcgucccgcgcc

SEQ ID NO: 2852643 - RNA, 18 nt, Mycobacterium avium subsp. paratuberculosis
gcucggcgucgcacgugg

SEQ ID NO: 2852644 - RNA, 13 nt, Mycobacterium avium subsp. paratuberculosis
gcucggcgucgua

SEQ ID NO: 2852645 - RNA, 14 nt, Mycobacterium avium subsp. paratuberculosis
gcucggcguggcgc

SEQ ID NO: 2852646 - RNA, 18 nt, Mycobacterium avium subsp. paratuberculosis
gcucggcguggcgcucag

SEQ ID NO: 2852647 - RNA, 13 nt, Mycobacterium avium subsp. paratuberculosis
gcucggcgugguc

SEQ ID NO: 2852648 - RNA, 14 nt, Mycobacterium avium subsp. paratuberculosis
gcucggcguggucg

SEQ ID NO: 2852649 - RNA, 18 nt, Mycobacterium avium subsp. paratuberculosis
gcucggcguugagccggc

SEQ ID NO: 2852650 - RNA, 19 nt, Mycobacterium avium subsp. paratuberculosis
gcucggcguugagccggcg

SEQ ID NO: 2852651 - RNA, 16 nt, Mycobacterium avium subsp. paratuberculosis
gcucggcguuggcgua

SEQ ID NO: 2852652 - RNA, 16 nt, Mycobacterium avium subsp. paratuberculosis
gcucggcucggccggc

SEQ ID NO: 2852653 - RNA, 22 nt, Mycobacterium avium subsp. paratuberculosis
gcucgggaacggucagccgcgg

SEQ ID NO: 2852654 - RNA, 14 nt, Mycobacterium avium subsp. paratuberculosis
gcucgggcagcccg

SEQ ID NO: 2852655 - RNA, 17 nt, Mycobacterium avium subsp. paratuberculosis
gcucgggcagcccgccg

SEQ ID NO: 2852656 - RNA, 17 nt, Mycobacterium avium subsp. paratuberculosis
gcucgggcagcgugucc

SEQ ID NO: 2852657 - RNA, 20 nt, Mycobacterium avium subsp. paratuberculosis
gcucgggccauauuucguga

SEQ ID NO: 2852658 - RNA, 13 nt, Mycobacterium avium subsp. paratuberculosis
gcucgggccauga

SEQ ID NO: 2852659 - RNA, 15 nt, Mycobacterium avium subsp. paratuberculosis
gcucgggcccgcgca

SEQ ID NO: 2852660 - RNA, 20 nt, Mycobacterium avium subsp. paratuberculosis
gcucgggcccgcgcaccguc

SEQ ID NO: 2852661 - RNA, 13 nt, Mycobacterium avium subsp. paratuberculosis
gcucgggcgccuc

SEQ ID NO: 2852662 - RNA, 15 nt, Mycobacterium avium subsp. paratuberculosis
gcucgggcgguggcg

SEQ ID NO: 2852663 - RNA, 18 nt, Mycobacterium avium subsp. paratuberculosis
gcucgggcgguggcgccg

SEQ ID NO: 2852664 - RNA, 20 nt, Mycobacterium avium subsp. paratuberculosis
gcucgggcgguggcgccggg

SEQ ID NO: 2852665 - RNA, 23 nt, Mycobacterium avium subsp. paratuberculosis
gcucgggcgguggcgccggggcg

SEQ ID NO: 2852666 - RNA, 20 nt, Mycobacterium avium subsp. paratuberculosis
gcucggggcaguaguggucc

SEQ ID NO: 2852667 - RNA, 17 nt, Mycobacterium avium subsp. paratuberculosis
gcucggggcucgcggug

SEQ ID NO: 2852668 - RNA, 15 nt, Mycobacterium avium subsp. paratuberculosis
gcucgggggugcccg

SEQ ID NO: 2852669 - RNA, 13 nt, Mycobacterium avium subsp. paratuberculosis
gcucggggucggc

SEQ ID NO: 2852670 - RNA, 15 nt, Mycobacterium avium subsp. paratuberculosis
gcucggggucggccg

SEQ ID NO: 2852671 - RNA, 14 nt, Mycobacterium avium subsp. paratuberculosis
gcucgggugacgcc

SEQ ID NO: 2852672 - RNA, 14 nt, Mycobacterium avium subsp. paratuberculosis
gcucgggugucgcc

SEQ ID NO: 2852673 - RNA, 22 nt, Mycobacterium avium subsp. paratuberculosis
gcucgggugucgccgagccgca

SEQ ID NO: 2852674 - RNA, 16 nt, Mycobacterium avium subsp. paratuberculosis
gcucgguaugcggcga

SEQ ID NO: 2852675 - RNA, 20 nt, Mycobacterium avium subsp. paratuberculosis
gcucgguaugcggcgacgau

SEQ ID NO: 2852676 - RNA, 16 nt, Mycobacterium avium subsp. paratuberculosis
gcucggucaacccgau

SEQ ID NO: 2852677 - RNA, 18 nt, Mycobacterium avium subsp. paratuberculosis
gcucggucaagccggcca

SEQ ID NO: 2852678 - RNA, 19 nt, Mycobacterium avium subsp. paratuberculosis
gcucggucaagccggccag

SEQ ID NO: 2852679 - RNA, 20 nt, Mycobacterium avium subsp. paratuberculosis
gcucggucaagccggccagc

SEQ ID NO: 2852680 - RNA, 14 nt, Mycobacterium avium subsp. paratuberculosis
gcucggucaccagc

SEQ ID NO: 2852681 - RNA, 15 nt, Mycobacterium avium subsp. paratuberculosis
gcucggucaccagcg

SEQ ID NO: 2852682 - RNA, 13 nt, Mycobacterium avium subsp. paratuberculosis
gcucggucacccc

SEQ ID NO: 2852683 - RNA, 14 nt, Mycobacterium avium subsp. paratuberculosis
gcucggucagccgg

SEQ ID NO: 2852684 - RNA, 16 nt, Mycobacterium avium subsp. paratuberculosis
gcucggucagccgggc

SEQ ID NO: 2852685 - RNA, 14 nt, Mycobacterium avium subsp. paratuberculosis
gcucggucgccacg

SEQ ID NO: 2852686 - RNA, 17 nt, Mycobacterium avium subsp. paratuberculosis
gcucucguccucgaaca

SEQ ID NO: 2852687 - RNA, 21 nt, Mycobacterium avium subsp. paratuberculosis
gcucucguccucgaacaggcu

SEQ ID NO: 2852688 - RNA, 16 nt, Mycobacterium avium subsp. paratuberculosis
gcucucgucgucggcg

SEQ ID NO: 2852689 - RNA, 17 nt, Mycobacterium avium subsp. paratuberculosis
gcucucgucgucggcgg

SEQ ID NO: 2852690 - RNA, 23 nt, Mycobacterium avium subsp. paratuberculosis
gcucugacggcucuucggcgccg

SEQ ID NO: 2852691 - RNA, 14 nt, Mycobacterium avium subsp. paratuberculosis
gcucugcagagcgg

SEQ ID NO: 2852692 - RNA, 21 nt, Mycobacterium avium subsp. paratuberculosis
gcucugccgggccgcauccag

SEQ ID NO: 2852693 - RNA, 19 nt, Mycobacterium avium subsp. paratuberculosis
gcucugccuacuugcggcc

SEQ ID NO: 2852694 - RNA, 20 nt, Mycobacterium avium subsp. paratuberculosis
gcucugccuacuugcggccg

SEQ ID NO: 2852695 - RNA, 20 nt, Mycobacterium avium subsp. paratuberculosis
gcucuggaagauguccucgg

SEQ ID NO: 2852696 - RNA, 18 nt, Mycobacterium avium subsp. paratuberculosis
gcucuggccgaucuuguc

SEQ ID NO: 2852697 - RNA, 23 nt, Mycobacterium avium subsp. paratuberculosis
gcucugguuuuacacaccagcgg

SEQ ID NO: 2852698 - RNA, 18 nt, Mycobacterium avium subsp. paratuberculosis
gcucuucaggaacccgaa

SEQ ID NO: 2852699 - RNA, 14 nt, Mycobacterium avium subsp. paratuberculosis
gcucuucgauggcc

SEQ ID NO: 2852700 - RNA, 15 nt, Mycobacterium avium subsp. paratuberculosis
gcucuucgcgcgcgg

SEQ ID NO: 2852701 - RNA, 16 nt, Mycobacterium avium subsp. paratuberculosis
gcucuucgcgcgcggc

SEQ ID NO: 2852702 - RNA, 15 nt, Mycobacterium avium subsp. paratuberculosis
gcucuucgguggugu

SEQ ID NO: 2852703 - RNA, 16 nt, Mycobacterium avium subsp. paratuberculosis
gcucuucucguucugc

SEQ ID NO: 2852704 - RNA, 22 nt, Mycobacterium avium subsp. paratuberculosis
gcucuuggcgaccucguggucc

SEQ ID NO: 2852705 - RNA, 15 nt, Mycobacterium avium subsp. paratuberculosis
gcucuuggugguggu

SEQ ID NO: 2852706 - RNA, 21 nt, Mycobacterium avium subsp. paratuberculosis
gcucuuggugguggucgucga

SEQ ID NO: 2852707 - RNA, 22 nt, Mycobacterium avium subsp. paratuberculosis
gcugaacacgaacccggcggcc

SEQ ID NO: 2852708 - RNA, 15 nt, Mycobacterium avium subsp. paratuberculosis
gcugaacagcagcag

SEQ ID NO: 2852709 - RNA, 14 nt, Mycobacterium avium subsp. paratuberculosis
gcugaacagcgcgc

SEQ ID NO: 2852710 - RNA, 16 nt, Mycobacterium avium subsp. paratuberculosis
gcugaacagcgcgccg

SEQ ID NO: 2852711 - RNA, 15 nt, Mycobacterium avium subsp. paratuberculosis
gcugaaccaccgcgc

SEQ ID NO: 2852712 - RNA, 17 nt, Mycobacterium avium subsp. paratuberculosis
gcugaaccaccgcgccc

SEQ ID NO: 2852713 - RNA, 22 nt, Mycobacterium avium subsp. paratuberculosis
gcugaaccaccgcgcccacccg

SEQ ID NO: 2852714 - RNA, 19 nt, Mycobacterium avium subsp. paratuberculosis
gcugaaccgguagucgucg

SEQ ID NO: 2852715 - RNA, 20 nt, Mycobacterium avium subsp. paratuberculosis
gcugaaccgguagucgucga

SEQ ID NO: 2852716 - RNA, 22 nt, Mycobacterium avium subsp. paratuberculosis
gcugaaccgguagucgucgagg

SEQ ID NO: 2852717 - RNA, 15 nt, Mycobacterium avium subsp. paratuberculosis
gcugaacgccagcag

SEQ ID NO: 2852718 - RNA, 16 nt, Mycobacterium avium subsp. paratuberculosis
gcugaacgccagcagc

SEQ ID NO: 2852719 - RNA, 18 nt, Mycobacterium avium subsp. paratuberculosis
gcugaacgccagcagccg

SEQ ID NO: 2852720 - RNA, 19 nt, Mycobacterium avium subsp. paratuberculosis
gcugaacgccagcagccgc

SEQ ID NO: 2852721 - RNA, 12 nt, Mycobacterium avium subsp. paratuberculosis
gcugaacgcggu

SEQ ID NO: 2852722 - RNA, 14 nt, Mycobacterium avium subsp. paratuberculosis
gcugaacgggcagc

SEQ ID NO: 2852723 - RNA, 15 nt, Mycobacterium avium subsp. paratuberculosis
gcugaacgggcagcc

SEQ ID NO: 2852724 - RNA, 19 nt, Mycobacterium avium subsp. paratuberculosis
gcugaacgggcagccacgc

SEQ ID NO: 2852725 - RNA, 20 nt, Mycobacterium avium subsp. paratuberculosis
gcugaacgggcagccacgcg

SEQ ID NO: 2852726 - RNA, 23 nt, Mycobacterium avium subsp. paratuberculosis
gcugaacgucgucagcaccgugg

SEQ ID NO: 2852727 - RNA, 16 nt, Mycobacterium avium subsp. paratuberculosis
gcugaacucgacgucg

SEQ ID NO: 2852728 - RNA, 17 nt, Mycobacterium avium subsp. paratuberculosis
gcugaagaagaugggcg

SEQ ID NO: 2852729 - RNA, 18 nt, Mycobacterium avium subsp. paratuberculosis
gcugaagaucaacagccg

SEQ ID NO: 2852730 - RNA, 14 nt, Mycobacterium avium subsp. paratuberculosis
gcugaagcccaccg

SEQ ID NO: 2852731 - RNA, 16 nt, Mycobacterium avium subsp. paratuberculosis
gcugaagcccaccgcc

SEQ ID NO: 2852732 - RNA, 17 nt, Mycobacterium avium subsp. paratuberculosis
gcugaagcccaccgccg

SEQ ID NO: 2852733 - RNA, 18 nt, Mycobacterium avium subsp. paratuberculosis
gcugaagcccaccgccgu

SEQ ID NO: 2852734 - RNA, 17 nt, Mycobacterium avium subsp. paratuberculosis
gcugaagccgaacgcgc

SEQ ID NO: 2852735 - RNA, 20 nt, Mycobacterium avium subsp. paratuberculosis
gcugaagccgaacgcgcugu

SEQ ID NO: 2852736 - RNA, 19 nt, Mycobacterium avium subsp. paratuberculosis
gcugaagugcacucggcga

SEQ ID NO: 2852737 - RNA, 20 nt, Mycobacterium avium subsp. paratuberculosis
gcugaagugcacucggcgau

SEQ ID NO: 2852738 - RNA, 21 nt, Mycobacterium avium subsp. paratuberculosis
gcugaagugcacucggcgaug

SEQ ID NO: 2852739 - RNA, 17 nt, Mycobacterium avium subsp. paratuberculosis
gcugaaguucaccaccg

SEQ ID NO: 2852740 - RNA, 20 nt, Mycobacterium avium subsp. paratuberculosis
gcugaaucccuccggcaggc

SEQ ID NO: 2852741 - RNA, 23 nt, Mycobacterium avium subsp. paratuberculosis
gcugaauucuguugucggcucgc

SEQ ID NO: 2852742 - RNA, 20 nt, Mycobacterium avium subsp. paratuberculosis
gcugacacccgacgaagccg

SEQ ID NO: 2852743 - RNA, 20 nt, Mycobacterium avium subsp. paratuberculosis
gcugaccacgcuccagaugc

SEQ ID NO: 2852744 - RNA, 11 nt, Mycobacterium avium subsp. paratuberculosis
gcugaccagcg

SEQ ID NO: 2852745 - RNA, 14 nt, Mycobacterium avium subsp. paratuberculosis
gcugaccagcgccu

SEQ ID NO: 2852746 - RNA, 15 nt, Mycobacterium avium subsp. paratuberculosis
gcugaccagcgccuc

SEQ ID NO: 2852747 - RNA, 19 nt, Mycobacterium avium subsp. paratuberculosis
gcugaccagcgccucgcgg

SEQ ID NO: 2852748 - RNA, 14 nt, Mycobacterium avium subsp. paratuberculosis
gcugaccagcguga

SEQ ID NO: 2852749 - RNA, 16 nt, Mycobacterium avium subsp. paratuberculosis
gcugaccagcgugacc

SEQ ID NO: 2852750 - RNA, 18 nt, Mycobacterium avium subsp. paratuberculosis
gcugaccaggaagaugcc

SEQ ID NO: 2852751 - RNA, 19 nt, Mycobacterium avium subsp. paratuberculosis
gcugaccaggaagaugccg

SEQ ID NO: 2852752 - RNA, 19 nt, Mycobacterium avium subsp. paratuberculosis
gcugaccaggccguccacc

SEQ ID NO: 2852753 - RNA, 15 nt, Mycobacterium avium subsp. paratuberculosis
gcugaccccgcucgg

SEQ ID NO: 2852754 - RNA, 17 nt, Mycobacterium avium subsp. paratuberculosis
gcugaccccgcucggcg

SEQ ID NO: 2852755 - RNA, 14 nt, Mycobacterium avium subsp. paratuberculosis
gcugacccgccgca

SEQ ID NO: 2852756 - RNA, 13 nt, Mycobacterium avium subsp. paratuberculosis
gcugacccgggcg

SEQ ID NO: 2852757 - RNA, 14 nt, Mycobacterium avium subsp. paratuberculosis
gcugacccgggcgg

SEQ ID NO: 2852758 - RNA, 17 nt, Mycobacterium avium subsp. paratuberculosis
gcugacccgggcggccu

SEQ ID NO: 2852759 - RNA, 16 nt, Mycobacterium avium subsp. paratuberculosis
gcugacccggucgcgg

SEQ ID NO: 2852760 - RNA, 17 nt, Mycobacterium avium subsp. paratuberculosis
gcugacccggucgcggc

SEQ ID NO: 2852761 - RNA, 14 nt, Mycobacterium avium subsp. paratuberculosis
gcugaccgacggcg

SEQ ID NO: 2852762 - RNA, 15 nt, Mycobacterium avium subsp. paratuberculosis
gcugaccgacggcga

SEQ ID NO: 2852763 - RNA, 14 nt, Mycobacterium avium subsp. paratuberculosis
gcugaccgagcggc

SEQ ID NO: 2852764 - RNA, 13 nt, Mycobacterium avium subsp. paratuberculosis
gcugaccgccauu

SEQ ID NO: 2852765 - RNA, 14 nt, Mycobacterium avium subsp. paratuberculosis
gcugaccgccgcgc

SEQ ID NO: 2852766 - RNA, 20 nt, Mycobacterium avium subsp. paratuberculosis
gcugaccgccgcgcucggcc

SEQ ID NO: 2852767 - RNA, 15 nt, Mycobacterium avium subsp. paratuberculosis
gcugaccggccaccu

SEQ ID NO: 2852768 - RNA, 13 nt, Mycobacterium avium subsp. paratuberculosis
gcugaccggcgau

SEQ ID NO: 2852769 - RNA, 19 nt, Mycobacterium avium subsp. paratuberculosis
gcugaccggcgaucgucag

SEQ ID NO: 2852770 - RNA, 12 nt, Mycobacterium avium subsp. paratuberculosis
gcugaccggcgg

SEQ ID NO: 2852771 - RNA, 18 nt, Mycobacterium avium subsp. paratuberculosis
gcugagguagucccgcgc

SEQ ID NO: 2852772 - RNA, 19 nt, Mycobacterium avium subsp. paratuberculosis
gcugagguagucccgcgcc

SEQ ID NO: 2852773 - RNA, 22 nt, Mycobacterium avium subsp. paratuberculosis
gcugagguagucccgcgccugg

SEQ ID NO: 2852774 - RNA, 12 nt, Mycobacterium avium subsp. paratuberculosis
gcugaguaugca

SEQ ID NO: 2852775 - RNA, 19 nt, Mycobacterium avium subsp. paratuberculosis
gcugaguaugcagaugaug

SEQ ID NO: 2852776 - RNA, 20 nt, Mycobacterium avium subsp. paratuberculosis
gcugagucuacuuggccagc

SEQ ID NO: 2852777 - RNA, 23 nt, Mycobacterium avium subsp. paratuberculosis
gcugaguucggugaacugcagcc

SEQ ID NO: 2852778 - RNA, 16 nt, Mycobacterium avium subsp. paratuberculosis
gcugauacccgcgcgg

SEQ ID NO: 2852779 - RNA, 17 nt, Mycobacterium avium subsp. paratuberculosis
gcugauagcccgccgcg

SEQ ID NO: 2852780 - RNA, 19 nt, Mycobacterium avium subsp. paratuberculosis
gcugauagcccgccgcggc

SEQ ID NO: 2852781 - RNA, 21 nt, Mycobacterium avium subsp. paratuberculosis
gcugauagcccgccgcggcga

SEQ ID NO: 2852782 - RNA, 13 nt, Mycobacterium avium subsp. paratuberculosis
gcugauagccgcc

SEQ ID NO: 2852783 - RNA, 23 nt, Mycobacterium avium subsp. paratuberculosis
gcugaucaccaaauagccgucgg

SEQ ID NO: 2852784 - RNA, 17 nt, Mycobacterium avium subsp. paratuberculosis
gcugaucagccggcgag

SEQ ID NO: 2852785 - RNA, 18 nt, Mycobacterium avium subsp. paratuberculosis
gcugaucagccggcgagc

SEQ ID NO: 2852786 - RNA, 22 nt, Mycobacterium avium subsp. paratuberculosis
gcugaucagcucuucgauggcc

SEQ ID NO: 2852787 - RNA, 23 nt, Mycobacterium avium subsp. paratuberculosis
gcugaucagcucuucgauggcca

SEQ ID NO: 2852788 - RNA, 13 nt, Mycobacterium avium subsp. paratuberculosis
gcugaucaugaag

SEQ ID NO: 2852789 - RNA, 14 nt, Mycobacterium avium subsp. paratuberculosis
gcugauccacgccc

SEQ ID NO: 2852790 - RNA, 22 nt, Mycobacterium avium subsp. paratuberculosis
gcugauccacgcccggacccgc

SEQ ID NO: 2852791 - RNA, 17 nt, Mycobacterium avium subsp. paratuberculosis
gcugauccagcagcgcc

SEQ ID NO: 2852792 - RNA, 19 nt, Mycobacterium avium subsp. paratuberculosis
gcugauccagcagcgccuc

SEQ ID NO: 2852793 - RNA, 19 nt, Mycobacterium avium subsp. paratuberculosis
gcugaucccacauucggcg

SEQ ID NO: 2852794 - RNA, 14 nt, Mycobacterium avium subsp. paratuberculosis
gcugauccccagcg

SEQ ID NO: 2852795 - RNA, 15 nt, Mycobacterium avium subsp. paratuberculosis
gcugauccccagcgg

SEQ ID NO: 2852796 - RNA, 19 nt, Mycobacterium avium subsp. paratuberculosis
gcugauccgcaggaugccg

SEQ ID NO: 2852797 - RNA, 13 nt, Mycobacterium avium subsp. paratuberculosis
gcugaucgaccgg

SEQ ID NO: 2852798 - RNA, 17 nt, Mycobacterium avium subsp. paratuberculosis
gcugaucgaguccucgc

SEQ ID NO: 2852799 - RNA, 18 nt, Mycobacterium avium subsp. paratuberculosis
gcugaucgcgauccgggc

SEQ ID NO: 2852800 - RNA, 19 nt, Mycobacterium avium subsp. paratuberculosis
gcugaucgcgauccgggcg

SEQ ID NO: 2852801 - RNA, 22 nt, Mycobacterium avium subsp. paratuberculosis
gcugaucgcgauccgggcgccg

SEQ ID NO: 2852802 - RNA, 14 nt, Mycobacterium avium subsp. paratuberculosis
gcugaucgcggccg

SEQ ID NO: 2852803 - RNA, 19 nt, Mycobacterium avium subsp. paratuberculosis
gcugaucgcggccggcgag

SEQ ID NO: 2852804 - RNA, 12 nt, Mycobacterium avium subsp. paratuberculosis
gcugaucggcgu

SEQ ID NO: 2852805 - RNA, 17 nt, Mycobacterium avium subsp. paratuberculosis
gcugaucggggcccacc

SEQ ID NO: 2852806 - RNA, 20 nt, Mycobacterium avium subsp. paratuberculosis
gcugaucggggcccaccccg

SEQ ID NO: 2852807 - RNA, 19 nt, Mycobacterium avium subsp. paratuberculosis
gcugaucuacgucggcugg

SEQ ID NO: 2852808 - RNA, 14 nt, Mycobacterium avium subsp. paratuberculosis
gcugaucucgacgg

SEQ ID NO: 2852809 - RNA, 15 nt, Mycobacterium avium subsp. paratuberculosis
gcugaucucggcggu

SEQ ID NO: 2852810 - RNA, 18 nt, Mycobacterium avium subsp. paratuberculosis
gcugaucucggcggucug

SEQ ID NO: 2852811 - RNA, 22 nt, Mycobacterium avium subsp. paratuberculosis
gcugaucucggcggucugucgc

SEQ ID NO: 2852812 - RNA, 18 nt, Mycobacterium avium subsp. paratuberculosis
gcugaucugcggcaccac

SEQ ID NO: 2852813 - RNA, 20 nt, Mycobacterium avium subsp. paratuberculosis
gcugaucugcggcaccacgc

SEQ ID NO: 2852814 - RNA, 20 nt, Mycobacterium avium subsp. paratuberculosis
gcugaucuggaugcggcccu

SEQ ID NO: 2852815 - RNA, 22 nt, Mycobacterium avium subsp. paratuberculosis
gcugaugccgccgaagcggcgc

SEQ ID NO: 2852816 - RNA, 16 nt, Mycobacterium avium subsp. paratuberculosis
gcugaugcgcaacagc

SEQ ID NO: 2852817 - RNA, 13 nt, Mycobacterium avium subsp. paratuberculosis
gcugauguucagu

SEQ ID NO: 2852818 - RNA, 15 nt, Mycobacterium avium subsp. paratuberculosis
gcugcaacgcgucgg

SEQ ID NO: 2852819 - RNA, 17 nt, Mycobacterium avium subsp. paratuberculosis
gcugcaacgcgucggcg

SEQ ID NO: 2852820 - RNA, 20 nt, Mycobacterium avium subsp. paratuberculosis
gcugcaacgcgucggcgccg

SEQ ID NO: 2852821 - RNA, 21 nt, Mycobacterium avium subsp. paratuberculosis
gcugcaacgcgucggcgccgg

SEQ ID NO: 2852822 - RNA, 13 nt, Mycobacterium avium subsp. paratuberculosis
gcugcaacggcug

SEQ ID NO: 2852823 - RNA, 21 nt, Mycobacterium avium subsp. paratuberculosis
gcugcaacggcuggcgcaggu

SEQ ID NO: 2852824 - RNA, 12 nt, Mycobacterium avium subsp. paratuberculosis
gcugcaccagcc

SEQ ID NO: 2852825 - RNA, 15 nt, Mycobacterium avium subsp. paratuberculosis
gcugcaccagcccgu

SEQ ID NO: 2852826 - RNA, 21 nt, Mycobacterium avium subsp. paratuberculosis
gcugcaccagcccgucggccu

SEQ ID NO: 2852827 - RNA, 14 nt, Mycobacterium avium subsp. paratuberculosis
gcugcaccagggcg

SEQ ID NO: 2852828 - RNA, 17 nt, Mycobacterium avium subsp. paratuberculosis
gcugcaccagggcgucg

SEQ ID NO: 2852829 - RNA, 18 nt, Mycobacterium avium subsp. paratuberculosis
gcugcaccagggcgucga

SEQ ID NO: 2852830 - RNA, 16 nt, Mycobacterium avium subsp. paratuberculosis
gcugcacccaccggcc

SEQ ID NO: 2852831 - RNA, 19 nt, Mycobacterium avium subsp. paratuberculosis
gcugcacccucugccacgg

SEQ ID NO: 2852832 - RNA, 13 nt, Mycobacterium avium subsp. paratuberculosis
gcugcaccggggc

SEQ ID NO: 2852833 - RNA, 15 nt, Mycobacterium avium subsp. paratuberculosis
gcugcaccggggccg

SEQ ID NO: 2852834 - RNA, 16 nt, Mycobacterium avium subsp. paratuberculosis
gcugcaccggggccgg

SEQ ID NO: 2852835 - RNA, 17 nt, Mycobacterium avium subsp. paratuberculosis
gcugcaccggggccggc

SEQ ID NO: 2852836 - RNA, 17 nt, Mycobacterium avium subsp. paratuberculosis
gcugcaccguuuccggu

SEQ ID NO: 2852837 - RNA, 16 nt, Mycobacterium avium subsp. paratuberculosis
gcugcacgacgaccgc

SEQ ID NO: 2852838 - RNA, 19 nt, Mycobacterium avium subsp. paratuberculosis
gcugcacgacgaccgcgac

SEQ ID NO: 2852839 - RNA, 20 nt, Mycobacterium avium subsp. paratuberculosis
gcugcacgacgaccgcgacg

SEQ ID NO: 2852840 - RNA, 20 nt, Mycobacterium avium subsp. paratuberculosis
gcugcacgcguugcagcgcc

SEQ ID NO: 2852841 - RNA, 24 nt, Mycobacterium avium subsp. paratuberculosis
gcugcacgcguugcagcgccgcgg

SEQ ID NO: 2852842 - RNA, 19 nt, Mycobacterium avium subsp. paratuberculosis
gcugcacgcugcgcacccg

SEQ ID NO: 2852843 - RNA, 14 nt, Mycobacterium avium subsp. paratuberculosis
gcugcacggggugc

SEQ ID NO: 2852844 - RNA, 14 nt, Mycobacterium avium subsp. paratuberculosis
gcugcacgucacgg

SEQ ID NO: 2852845 - RNA, 20 nt, Mycobacterium avium subsp. paratuberculosis
gcugcacgucacgggccagg

SEQ ID NO: 2852846 - RNA, 22 nt, Mycobacterium avium subsp. paratuberculosis
gcugcacguccgccuccgacca

SEQ ID NO: 2852847 - RNA, 17 nt, Mycobacterium avium subsp. paratuberculosis
gcugcacgucgccggcg

SEQ ID NO: 2852848 - RNA, 21 nt, Mycobacterium avium subsp. paratuberculosis
gcugcagaccgaacgucacgg

SEQ ID NO: 2852849 - RNA, 19 nt, Mycobacterium avium subsp. paratuberculosis
gcugcagauccgcucgccg

SEQ ID NO: 2852850 - RNA, 22 nt, Mycobacterium avium subsp. paratuberculosis
gcugcagcagaugcgccucgau

SEQ ID NO: 2852851 - RNA, 13 nt, Mycobacterium avium subsp. paratuberculosis
gcugcagcagcga

SEQ ID NO: 2852852 - RNA, 15 nt, Mycobacterium avium subsp. paratuberculosis
gcugcagcauccagg

SEQ ID NO: 2852853 - RNA, 20 nt, Mycobacterium avium subsp. paratuberculosis
gcugcagcauccagguggcg

SEQ ID NO: 2852854 - RNA, 19 nt, Mycobacterium avium subsp. paratuberculosis
gcugcagcauggacccgaa

SEQ ID NO: 2852855 - RNA, 22 nt, Mycobacterium avium subsp. paratuberculosis
gcugcccgagcggcgacuccag

SEQ ID NO: 2852856 - RNA, 14 nt, Mycobacterium avium subsp. paratuberculosis
gcugcccgauggug

SEQ ID NO: 2852857 - RNA, 14 nt, Mycobacterium avium subsp. paratuberculosis
gcugcccgcacugg

SEQ ID NO: 2852858 - RNA, 16 nt, Mycobacterium avium subsp. paratuberculosis
gcugcccgcacugguc

SEQ ID NO: 2852859 - RNA, 15 nt, Mycobacterium avium subsp. paratuberculosis
gcugcccgcccgaga

SEQ ID NO: 2852860 - RNA, 14 nt, Mycobacterium avium subsp. paratuberculosis
gcugcccgccgacg

SEQ ID NO: 2852861 - RNA, 15 nt, Mycobacterium avium subsp. paratuberculosis
gcugcccgccgacgc

SEQ ID NO: 2852862 - RNA, 16 nt, Mycobacterium avium subsp. paratuberculosis
gcugcccgccgacgcc

SEQ ID NO: 2852863 - RNA, 19 nt, Mycobacterium avium subsp. paratuberculosis
gcugcccgccgcguacagc

SEQ ID NO: 2852864 - RNA, 14 nt, Mycobacterium avium subsp. paratuberculosis
gcugcccgcgacug

SEQ ID NO: 2852865 - RNA, 20 nt, Mycobacterium avium subsp. paratuberculosis
gcugcccgcgacugucggcg

SEQ ID NO: 2852866 - RNA, 23 nt, Mycobacterium avium subsp. paratuberculosis
gcugcccgcgacugucggcgccc

SEQ ID NO: 2852867 - RNA, 21 nt, Mycobacterium avium subsp. paratuberculosis
gcugcccgcgaucgccagcgc

SEQ ID NO: 2852868 - RNA, 18 nt, Mycobacterium avium subsp. paratuberculosis
gcugcccgcggccgccgc

SEQ ID NO: 2852869 - RNA, 19 nt, Mycobacterium avium subsp. paratuberculosis
gcugcccgcggccgccgcc

SEQ ID NO: 2852870 - RNA, 20 nt, Mycobacterium avium subsp. paratuberculosis
gcugcccgcggccgccgccg

SEQ ID NO: 2852871 - RNA, 23 nt, Mycobacterium avium subsp. paratuberculosis
gcugcccggaguccggcucggug

SEQ ID NO: 2852872 - RNA, 11 nt, Mycobacterium avium subsp. paratuberculosis
gcugcccggca

SEQ ID NO: 2852873 - RNA, 17 nt, Mycobacterium avium subsp. paratuberculosis
gcugcccggcgccacgc

SEQ ID NO: 2852874 - RNA, 14 nt, Mycobacterium avium subsp. paratuberculosis
gcugcccggcgcgg

SEQ ID NO: 2852875 - RNA, 20 nt, Mycobacterium avium subsp. paratuberculosis
gcugcccggcgcuaaagccg

SEQ ID NO: 2852876 - RNA, 22 nt, Mycobacterium avium subsp. paratuberculosis
gcugcccggcgcuaaagccgac

SEQ ID NO: 2852877 - RNA, 15 nt, Mycobacterium avium subsp. paratuberculosis
gcugcccgggcaucc

SEQ ID NO: 2852878 - RNA, 13 nt, Mycobacterium avium subsp. paratuberculosis
gcugcccgucgac

SEQ ID NO: 2852879 - RNA, 14 nt, Mycobacterium avium subsp. paratuberculosis
gcugcccgucgacc

SEQ ID NO: 2852880 - RNA, 22 nt, Mycobacterium avium subsp. paratuberculosis
gcugcccgucggaggacaacgc

SEQ ID NO: 2852881 - RNA, 15 nt, Mycobacterium avium subsp. paratuberculosis
gcugcccgugccgca

SEQ ID NO: 2852882 - RNA, 13 nt, Mycobacterium avium subsp. paratuberculosis
gcugcccucgguc

SEQ ID NO: 2852883 - RNA, 16 nt, Mycobacterium avium subsp. paratuberculosis
gcugcccucggucgcc

SEQ ID NO: 2852884 - RNA, 15 nt, Mycobacterium avium subsp. paratuberculosis
gcugcccucuuccuc

SEQ ID NO: 2852885 - RNA, 22 nt, Mycobacterium avium subsp. paratuberculosis
gcugcccucuuccucgcugucc

SEQ ID NO: 2852886 - RNA, 20 nt, Mycobacterium avium subsp. paratuberculosis
gcugcccugaagcugggcgc

SEQ ID NO: 2852887 - RNA, 23 nt, Mycobacterium avium subsp. paratuberculosis
gcugcccugaagcugggcgccca

SEQ ID NO: 2852888 - RNA, 20 nt, Mycobacterium avium subsp. paratuberculosis
gcugcccuuguugacguacc

SEQ ID NO: 2852889 - RNA, 15 nt, Mycobacterium avium subsp. paratuberculosis
gcugccgaacaucag

SEQ ID NO: 2852890 - RNA, 19 nt, Mycobacterium avium subsp. paratuberculosis
gcugccgaacaucagccga

SEQ ID NO: 2852891 - RNA, 14 nt, Mycobacterium avium subsp. paratuberculosis
gcugccgaccagga

SEQ ID NO: 2852892 - RNA, 15 nt, Mycobacterium avium subsp. paratuberculosis
gcugccgaccaggaa

SEQ ID NO: 2852893 - RNA, 19 nt, Mycobacterium avium subsp. paratuberculosis
gcugccgaccucgauggcg

SEQ ID NO: 2852894 - RNA, 21 nt, Mycobacterium avium subsp. paratuberculosis
gcugccgaccucgauggcgac

SEQ ID NO: 2852895 - RNA, 22 nt, Mycobacterium avium subsp. paratuberculosis
gcugccgagcaccucgucgccg

SEQ ID NO: 2852896 - RNA, 18 nt, Mycobacterium avium subsp. paratuberculosis
gcugccgcccccgcuggc

SEQ ID NO: 2852897 - RNA, 14 nt, Mycobacterium avium subsp. paratuberculosis
gcugccgccgcagc

SEQ ID NO: 2852898 - RNA, 19 nt, Mycobacterium avium subsp. paratuberculosis
gcugccgccgcagcagccg

SEQ ID NO: 2852899 - RNA, 17 nt, Mycobacterium avium subsp. paratuberculosis
gcugccgccgccgcugu

SEQ ID NO: 2852900 - RNA, 15 nt, Mycobacterium avium subsp. paratuberculosis
gcugccgccgccggc

SEQ ID NO: 2852901 - RNA, 21 nt, Mycobacterium avium subsp. paratuberculosis
gcugccgccgccggcgguggc

SEQ ID NO: 2852902 - RNA, 13 nt, Mycobacterium avium subsp. paratuberculosis
gcugccgccggcg

SEQ ID NO: 2852903 - RNA, 16 nt, Mycobacterium avium subsp. paratuberculosis
gcugccgcgacucggu

SEQ ID NO: 2852904 - RNA, 15 nt, Mycobacterium avium subsp. paratuberculosis
gcugccgcgccccga

SEQ ID NO: 2852905 - RNA, 17 nt, Mycobacterium avium subsp. paratuberculosis
gcugccgcgccccgagc

SEQ ID NO: 2852906 - RNA, 20 nt, Mycobacterium avium subsp. paratuberculosis
gcugccgcgccccgagcagc

SEQ ID NO: 2852907 - RNA, 21 nt, Mycobacterium avium subsp. paratuberculosis
gcugccgcgccccgagcagcg

SEQ ID NO: 2852908 - RNA, 22 nt, Mycobacterium avium subsp. paratuberculosis
gcugccgcgccccgagcagcgg

SEQ ID NO: 2852909 - RNA, 12 nt, Mycobacterium avium subsp. paratuberculosis
gcugccgcgccg

SEQ ID NO: 2852910 - RNA, 14 nt, Mycobacterium avium subsp. paratuberculosis
gcugccgcgcgccg

SEQ ID NO: 2852911 - RNA, 17 nt, Mycobacterium avium subsp. paratuberculosis
gcugccgcgcgccgaca

SEQ ID NO: 2852912 - RNA, 21 nt, Mycobacterium avium subsp. paratuberculosis
gcugccgcgcgccgacagacc

SEQ ID NO: 2852913 - RNA, 17 nt, Mycobacterium avium subsp. paratuberculosis
gcugccgcugcgccggc

SEQ ID NO: 2852914 - RNA, 20 nt, Mycobacterium avium subsp. paratuberculosis
gcugccggaacgagccggac

SEQ ID NO: 2852915 - RNA, 21 nt, Mycobacterium avium subsp. paratuberculosis
gcugccggacaccccggccag

SEQ ID NO: 2852916 - RNA, 17 nt, Mycobacterium avium subsp. paratuberculosis
gcugccggaccucgacc

SEQ ID NO: 2852917 - RNA, 12 nt, Mycobacterium avium subsp. paratuberculosis
gcugccggccaa

SEQ ID NO: 2852918 - RNA, 13 nt, Mycobacterium avium subsp. paratuberculosis
gcugccggcccga

SEQ ID NO: 2852919 - RNA, 15 nt, Mycobacterium avium subsp. paratuberculosis
gcugccggcccgaua

SEQ ID NO: 2852920 - RNA, 13 nt, Mycobacterium avium subsp. paratuberculosis
gcugccggccggc

SEQ ID NO: 2852921 - RNA, 16 nt, Mycobacterium avium subsp. paratuberculosis
gcugccggccggcagc

SEQ ID NO: 2852922 - RNA, 21 nt, Mycobacterium avium subsp. paratuberculosis
gcugccggccggcagcugccc

SEQ ID NO: 2852923 - RNA, 21 nt, Mycobacterium avium subsp. paratuberculosis
gcugccggccggggcggcggu

SEQ ID NO: 2852924 - RNA, 12 nt, Mycobacterium avium subsp. paratuberculosis
gcugccggccgu

SEQ ID NO: 2852925 - RNA, 18 nt, Mycobacterium avium subsp. paratuberculosis
gcugccggcgaccagccc

SEQ ID NO: 2852926 - RNA, 19 nt, Mycobacterium avium subsp. paratuberculosis
gcugccggcgaccagcccc

SEQ ID NO: 2852927 - RNA, 17 nt, Mycobacterium avium subsp. paratuberculosis
gcugccggcgcacccgc

SEQ ID NO: 2852928 - RNA, 13 nt, Mycobacterium avium subsp. paratuberculosis
gcugccggcggcc

SEQ ID NO: 2852929 - RNA, 15 nt, Mycobacterium avium subsp. paratuberculosis
gcugccggcggccgc

SEQ ID NO: 2852930 - RNA, 21 nt, Mycobacterium avium subsp. paratuberculosis
gcugccggcggccgccggcac

SEQ ID NO: 2852931 - RNA, 14 nt, Mycobacterium avium subsp. paratuberculosis
gcugccggggcgca

SEQ ID NO: 2852932 - RNA, 21 nt, Mycobacterium avium subsp. paratuberculosis
gcugccggggcgcagcugcag

SEQ ID NO: 2852933 - RNA, 16 nt, Mycobacterium avium subsp. paratuberculosis
gcugccggggugcagc

SEQ ID NO: 2852934 - RNA, 22 nt, Mycobacterium avium subsp. paratuberculosis
gcugccggugcugcucgagggc

SEQ ID NO: 2852935 - RNA, 23 nt, Mycobacterium avium subsp. paratuberculosis
gcugccggugcugcucgagggcc

SEQ ID NO: 2852936 - RNA, 18 nt, Mycobacterium avium subsp. paratuberculosis
gcugccggugcugcugua

SEQ ID NO: 2852937 - RNA, 18 nt, Mycobacterium avium subsp. paratuberculosis
gcugccgguggucccggu

SEQ ID NO: 2852938 - RNA, 16 nt, Mycobacterium avium subsp. paratuberculosis
gcugccguagcgcugg

SEQ ID NO: 2852939 - RNA, 21 nt, Mycobacterium avium subsp. paratuberculosis
gcugccguagcgcugggugaa

SEQ ID NO: 2852940 - RNA, 15 nt, Mycobacterium avium subsp. paratuberculosis
gcugcgcguucggcg

SEQ ID NO: 2852941 - RNA, 23 nt, Mycobacterium avium subsp. paratuberculosis
gcugcgcguucggcgccaccccg

SEQ ID NO: 2852942 - RNA, 18 nt, Mycobacterium avium subsp. paratuberculosis
gcugcgcucgccgucggc

SEQ ID NO: 2852943 - RNA, 21 nt, Mycobacterium avium subsp. paratuberculosis
gcugcgcuugcggcgcagcca

SEQ ID NO: 2852944 - RNA, 17 nt, Mycobacterium avium subsp. paratuberculosis
gcugcggaaaugcccgc

SEQ ID NO: 2852945 - RNA, 20 nt, Mycobacterium avium subsp. paratuberculosis
gcugcggaaaugcccgcgcc

SEQ ID NO: 2852946 - RNA, 21 nt, Mycobacterium avium subsp. paratuberculosis
gcugcggaaaugcccgcgccc

SEQ ID NO: 2852947 - RNA, 19 nt, Mycobacterium avium subsp. paratuberculosis
gcugcggaacccacgugcg

SEQ ID NO: 2852948 - RNA, 20 nt, Mycobacterium avium subsp. paratuberculosis
gcugcggaacccacgugcgg

SEQ ID NO: 2852949 - RNA, 22 nt, Mycobacterium avium subsp. paratuberculosis
gcugcggaacccacgugcggcg

SEQ ID NO: 2852950 - RNA, 21 nt, Mycobacterium avium subsp. paratuberculosis
gcugcggaaucacuuccgcgg

SEQ ID NO: 2852951 - RNA, 22 nt, Mycobacterium avium subsp. paratuberculosis
gcugcggaaucacuuccgcggc

SEQ ID NO: 2852952 - RNA, 23 nt, Mycobacterium avium subsp. paratuberculosis
gcugcggaaucacuuccgcggca

SEQ ID NO: 2852953 - RNA, 15 nt, Mycobacterium avium subsp. paratuberculosis
gcugcggccccggug

SEQ ID NO: 2852954 - RNA, 14 nt, Mycobacterium avium subsp. paratuberculosis
gcugcggcgccggg

SEQ ID NO: 2852955 - RNA, 15 nt, Mycobacterium avium subsp. paratuberculosis
gcugcggcgccgggc

SEQ ID NO: 2852956 - RNA, 12 nt, Mycobacterium avium subsp. paratuberculosis
gcugcggcucca

SEQ ID NO: 2852957 - RNA, 17 nt, Mycobacterium avium subsp. paratuberculosis
gcugcggcuccacgaag

SEQ ID NO: 2852958 - RNA, 15 nt, Mycobacterium avium subsp. paratuberculosis
gcugcggcugggaga

SEQ ID NO: 2852959 - RNA, 21 nt, Mycobacterium avium subsp. paratuberculosis
gcugcgggaccagcgccucgg

SEQ ID NO: 2852960 - RNA, 14 nt, Mycobacterium avium subsp. paratuberculosis
gcugcgggcaucgc

SEQ ID NO: 2852961 - RNA, 19 nt, Mycobacterium avium subsp. paratuberculosis
gcugcgggcaucgcuggug

SEQ ID NO: 2852962 - RNA, 21 nt, Mycobacterium avium subsp. paratuberculosis
gcugcgggcaucgcugguggc

SEQ ID NO: 2852963 - RNA, 23 nt, Mycobacterium avium subsp. paratuberculosis
gcugcgggcaucgcugguggccg

SEQ ID NO: 2852964 - RNA, 15 nt, Mycobacterium avium subsp. paratuberculosis
gcugcgggccaggcg

SEQ ID NO: 2852965 - RNA, 16 nt, Mycobacterium avium subsp. paratuberculosis
gcugcgggccaggcgg

SEQ ID NO: 2852966 - RNA, 23 nt, Mycobacterium avium subsp. paratuberculosis
gcugcgggccaucgacuccagca

SEQ ID NO: 2852967 - RNA, 17 nt, Mycobacterium avium subsp. paratuberculosis
gcugcgggucagcagcu

SEQ ID NO: 2852968 - RNA, 18 nt, Mycobacterium avium subsp. paratuberculosis
gcugcgggucagcagcuu

SEQ ID NO: 2852969 - RNA, 23 nt, Mycobacterium avium subsp. paratuberculosis
gcugcgggucucgcccaccuugg

SEQ ID NO: 2852970 - RNA, 17 nt, Mycobacterium avium subsp. paratuberculosis
gcugcggguugcgggcc

SEQ ID NO: 2852971 - RNA, 19 nt, Mycobacterium avium subsp. paratuberculosis
gcugcggguugcgggccag

SEQ ID NO: 2852972 - RNA, 19 nt, Mycobacterium avium subsp. paratuberculosis
gcugcgguacacguggccg

SEQ ID NO: 2852973 - RNA, 22 nt, Mycobacterium avium subsp. paratuberculosis
gcugcgguagggcagauaggcg

SEQ ID NO: 2852974 - RNA, 20 nt, Mycobacterium avium subsp. paratuberculosis
gcugcgguuccgggcgcucu

SEQ ID NO: 2852975 - RNA, 21 nt, Mycobacterium avium subsp. paratuberculosis
gcugcgguuggccggccgggc

SEQ ID NO: 2852976 - RNA, 23 nt, Mycobacterium avium subsp. paratuberculosis
gcugcgucggcaccagcggcauc

SEQ ID NO: 2852977 - RNA, 15 nt, Mycobacterium avium subsp. paratuberculosis
gcugcguucggcgau

SEQ ID NO: 2852978 - RNA, 18 nt, Mycobacterium avium subsp. paratuberculosis
gcugcguucggcgaucag

SEQ ID NO: 2852979 - RNA, 19 nt, Mycobacterium avium subsp. paratuberculosis
gcugcucaugagcccucca

SEQ ID NO: 2852980 - RNA, 14 nt, Mycobacterium avium subsp. paratuberculosis
gcugcucccgaaag

SEQ ID NO: 2852981 - RNA, 23 nt, Mycobacterium avium subsp. paratuberculosis
gcugcuccggguccgcggugaug

SEQ ID NO: 2852982 - RNA, 14 nt, Mycobacterium avium subsp. paratuberculosis
gcugcucgaaccgc

SEQ ID NO: 2852983 - RNA, 19 nt, Mycobacterium avium subsp. paratuberculosis
gcugcucgagcaucuccag

SEQ ID NO: 2852984 - RNA, 20 nt, Mycobacterium avium subsp. paratuberculosis
gcugcucgagcaucuccagc

SEQ ID NO: 2852985 - RNA, 15 nt, Mycobacterium avium subsp. paratuberculosis
gcugcucgcgcugcc

SEQ ID NO: 2852986 - RNA, 16 nt, Mycobacterium avium subsp. paratuberculosis
gcugcucgcgcugccg

SEQ ID NO: 2852987 - RNA, 16 nt, Mycobacterium avium subsp. paratuberculosis
gcugcucggccaccgc

SEQ ID NO: 2852988 - RNA, 21 nt, Mycobacterium avium subsp. paratuberculosis
gcugcucggccaccgcgcggu

SEQ ID NO: 2852989 - RNA, 15 nt, Mycobacterium avium subsp. paratuberculosis
gcugcucggcgggcu

SEQ ID NO: 2852990 - RNA, 15 nt, Mycobacterium avium subsp. paratuberculosis
gcugcucguccuggc

SEQ ID NO: 2852991 - RNA, 17 nt, Mycobacterium avium subsp. paratuberculosis
gcugcucguccuggcgc

SEQ ID NO: 2852992 - RNA, 18 nt, Mycobacterium avium subsp. paratuberculosis
gcugcucgucgcgggcgc

SEQ ID NO: 2852993 - RNA, 19 nt, Mycobacterium avium subsp. paratuberculosis
gcugcucgucgcgggcgcc

SEQ ID NO: 2852994 - RNA, 22 nt, Mycobacterium avium subsp. paratuberculosis
gcugcucguugugcauguggcc

SEQ ID NO: 2852995 - RNA, 23 nt, Mycobacterium avium subsp. paratuberculosis
gcugcucguugugcauguggccg

SEQ ID NO: 2852996 - RNA, 14 nt, Mycobacterium avium subsp. paratuberculosis
gcugcucugcgcgc

SEQ ID NO: 2852997 - RNA, 17 nt, Mycobacterium avium subsp. paratuberculosis
gcugcucugcgcgcggu

SEQ ID NO: 2852998 - RNA, 16 nt, Mycobacterium avium subsp. paratuberculosis
gcugcucuuguccgcg

SEQ ID NO: 2852999 - RNA, 16 nt, Mycobacterium avium subsp. paratuberculosis
gcugcugaugcggaca

SEQ ID NO: 2853000 - RNA, 12 nt, Mycobacterium avium subsp. paratuberculosis
gcugcugcacga

SEQ ID NO: 2853001 - RNA, 16 nt, Mycobacterium avium subsp. paratuberculosis
gcugcugcacgucgcc

SEQ ID NO: 2853002 - RNA, 19 nt, Mycobacterium avium subsp. paratuberculosis
gcugcugcacgucgccggc

SEQ ID NO: 2853003 - RNA, 20 nt, Mycobacterium avium subsp. paratuberculosis
gcugcugcacgucgccggcg

SEQ ID NO: 2853004 - RNA, 15 nt, Mycobacterium avium subsp. paratuberculosis
gcugcugccgccgca

SEQ ID NO: 2853005 - RNA, 21 nt, Mycobacterium avium subsp. paratuberculosis
gcugcugccgccgcagcagcc

SEQ ID NO: 2853006 - RNA, 14 nt, Mycobacterium avium subsp. paratuberculosis
gcugcugcgcggca

SEQ ID NO: 2853007 - RNA, 17 nt, Mycobacterium avium subsp. paratuberculosis
gcugcugcgcggcacgg

SEQ ID NO: 2853008 - RNA, 15 nt, Mycobacterium avium subsp. paratuberculosis
gcugcugcgcggcgg

SEQ ID NO: 2853009 - RNA, 18 nt, Mycobacterium avium subsp. paratuberculosis
gcugcugcgcggcggcgg

SEQ ID NO: 2853010 - RNA, 13 nt, Mycobacterium avium subsp. paratuberculosis
gcugcugcggccg

SEQ ID NO: 2853011 - RNA, 15 nt, Mycobacterium avium subsp. paratuberculosis
gcugcugcggccgga

SEQ ID NO: 2853012 - RNA, 13 nt, Mycobacterium avium subsp. paratuberculosis
gcugcugcucggc

SEQ ID NO: 2853013 - RNA, 15 nt, Mycobacterium avium subsp. paratuberculosis
gcugcugcucggccg

SEQ ID NO: 2853014 - RNA, 21 nt, Mycobacterium avium subsp. paratuberculosis
gcugcugcucggccgcaucgu

SEQ ID NO: 2853015 - RNA, 15 nt, Mycobacterium avium subsp. paratuberculosis
gcugcuggcgcuggg

SEQ ID NO: 2853016 - RNA, 18 nt, Mycobacterium avium subsp. paratuberculosis
gcugcugggacgggucgg

SEQ ID NO: 2853017 - RNA, 13 nt, Mycobacterium avium subsp. paratuberculosis
gcugcugggugcc

SEQ ID NO: 2853018 - RNA, 16 nt, Mycobacterium avium subsp. paratuberculosis
gcugcuggucgacguc

SEQ ID NO: 2853019 - RNA, 23 nt, Mycobacterium avium subsp. paratuberculosis
gcugcuggucgacgucauccggc

SEQ ID NO: 2853020 - RNA, 21 nt, Mycobacterium avium subsp. paratuberculosis
gcugcuguagcucacgguguc

SEQ ID NO: 2853021 - RNA, 14 nt, Mycobacterium avium subsp. paratuberculosis
gcugcugucgaaca

SEQ ID NO: 2853022 - RNA, 23 nt, Mycobacterium avium subsp. paratuberculosis
gcugcuguucguccgugcugccg

SEQ ID NO: 2853023 - RNA, 15 nt, Mycobacterium avium subsp. paratuberculosis
gcugcuuagccccuc

SEQ ID NO: 2853024 - RNA, 15 nt, Mycobacterium avium subsp. paratuberculosis
gcuggccgggcucga

SEQ ID NO: 2853025 - RNA, 22 nt, Mycobacterium avium subsp. paratuberculosis
gcuggccggguuggcauccagg

SEQ ID NO: 2853026 - RNA, 13 nt, Mycobacterium avium subsp. paratuberculosis
gcuggccguccgg

SEQ ID NO: 2853027 - RNA, 20 nt, Mycobacterium avium subsp. paratuberculosis
gcuggccguccggauagccg

SEQ ID NO: 2853028 - RNA, 16 nt, Mycobacterium avium subsp. paratuberculosis
gcuggccgucggcgau

SEQ ID NO: 2853029 - RNA, 17 nt, Mycobacterium avium subsp. paratuberculosis
gcuggccgucggcgaug

SEQ ID NO: 2853030 - RNA, 15 nt, Mycobacterium avium subsp. paratuberculosis
gcuggccgucgucga

SEQ ID NO: 2853031 - RNA, 20 nt, Mycobacterium avium subsp. paratuberculosis
gcuggccgucgucgaggccg

SEQ ID NO: 2853032 - RNA, 15 nt, Mycobacterium avium subsp. paratuberculosis
gcuggccgugcaccg

SEQ ID NO: 2853033 - RNA, 16 nt, Mycobacterium avium subsp. paratuberculosis
gcuggcgaauccgggc

SEQ ID NO: 2853034 - RNA, 22 nt, Mycobacterium avium subsp. paratuberculosis
gcuggcgaccaucagccugcgg

SEQ ID NO: 2853035 - RNA, 19 nt, Mycobacterium avium subsp. paratuberculosis
gcuggcgaucaccuugcgg

SEQ ID NO: 2853036 - RNA, 18 nt, Mycobacterium avium subsp. paratuberculosis
gcuggcgaucaucgucgu

SEQ ID NO: 2853037 - RNA, 13 nt, Mycobacterium avium subsp. paratuberculosis
gcuggcgauggug

SEQ ID NO: 2853038 - RNA, 21 nt, Mycobacterium avium subsp. paratuberculosis
gcuggcgaugugaucgcggcc

SEQ ID NO: 2853039 - RNA, 23 nt, Mycobacterium avium subsp. paratuberculosis
gcuggcgaugugaucgcggccca

SEQ ID NO: 2853040 - RNA, 18 nt, Mycobacterium avium subsp. paratuberculosis
gcuggcgcaggcgcuggg

SEQ ID NO: 2853041 - RNA, 23 nt, Mycobacterium avium subsp. paratuberculosis
gcuggcgcaggcgcuggguguuc

SEQ ID NO: 2853042 - RNA, 13 nt, Mycobacterium avium subsp. paratuberculosis
gcuggcgcaggug

SEQ ID NO: 2853043 - RNA, 15 nt, Mycobacterium avium subsp. paratuberculosis
gcuggcgccggcguc

SEQ ID NO: 2853044 - RNA, 18 nt, Mycobacterium avium subsp. paratuberculosis
gcuggcgcgauagccggu

SEQ ID NO: 2853045 - RNA, 23 nt, Mycobacterium avium subsp. paratuberculosis
gcuggcgcgccguaccgcuuggc

SEQ ID NO: 2853046 - RNA, 13 nt, Mycobacterium avium subsp. paratuberculosis
gcuggcgcgcuug

SEQ ID NO: 2853047 - RNA, 14 nt, Mycobacterium avium subsp. paratuberculosis
gcuggcgcugccag

SEQ ID NO: 2853048 - RNA, 12 nt, Mycobacterium avium subsp. paratuberculosis
gcuggcgcugga

SEQ ID NO: 2853049 - RNA, 21 nt, Mycobacterium avium subsp. paratuberculosis
gcuggcgcuggaucugcccga

SEQ ID NO: 2853050 - RNA, 12 nt, Mycobacterium avium subsp. paratuberculosis
gcuggcgcuggg

SEQ ID NO: 2853051 - RNA, 15 nt, Mycobacterium avium subsp. paratuberculosis
gcuggcgcuguaggc

SEQ ID NO: 2853052 - RNA, 17 nt, Mycobacterium avium subsp. paratuberculosis
gcuggcgcuguaggcgg

SEQ ID NO: 2853053 - RNA, 19 nt, Mycobacterium avium subsp. paratuberculosis
gcuggcggcgaucaccgcc

SEQ ID NO: 2853054 - RNA, 23 nt, Mycobacterium avium subsp. paratuberculosis
gcuggcggcgaucaccgccgcgg

SEQ ID NO: 2853055 - RNA, 13 nt, Mycobacterium avium subsp. paratuberculosis
gcuggcggcgcgg

SEQ ID NO: 2853056 - RNA, 14 nt, Mycobacterium avium subsp. paratuberculosis
gcuggcggcgcggu

SEQ ID NO: 2853057 - RNA, 16 nt, Mycobacterium avium subsp. paratuberculosis
gcuggcgggcgaucgc

SEQ ID NO: 2853058 - RNA, 22 nt, Mycobacterium avium subsp. paratuberculosis
gcuggcgggcgaucgccucggc

SEQ ID NO: 2853059 - RNA, 23 nt, Mycobacterium avium subsp. paratuberculosis
gcuggcgggcgaucgccucggcc

SEQ ID NO: 2853060 - RNA, 22 nt, Mycobacterium avium subsp. paratuberculosis
gcuggcggggcgugcccggcgc

SEQ ID NO: 2853061 - RNA, 14 nt, Mycobacterium avium subsp. paratuberculosis
gcuggcggugucga

SEQ ID NO: 2853062 - RNA, 22 nt, Mycobacterium avium subsp. paratuberculosis
gcuggcggugucgaagaccggu

SEQ ID NO: 2853063 - RNA, 19 nt, Mycobacterium avium subsp. paratuberculosis
gcuggcguacgccaugaac

SEQ ID NO: 2853064 - RNA, 18 nt, Mycobacterium avium subsp. paratuberculosis
gcuggcguaggacagcag

SEQ ID NO: 2853065 - RNA, 20 nt, Mycobacterium avium subsp. paratuberculosis
gcuggcguaggacagcagcc

SEQ ID NO: 2853066 - RNA, 13 nt, Mycobacterium avium subsp. paratuberculosis
gcuggcgucgauc

SEQ ID NO: 2853067 - RNA, 16 nt, Mycobacterium avium subsp. paratuberculosis
gcuggcgucgaucgcg

SEQ ID NO: 2853068 - RNA, 16 nt, Mycobacterium avium subsp. paratuberculosis
gcuggcgucguuggcg

SEQ ID NO: 2853069 - RNA, 19 nt, Mycobacterium avium subsp. paratuberculosis
gcuggcgugaaucuuggcc

SEQ ID NO: 2853070 - RNA, 14 nt, Mycobacterium avium subsp. paratuberculosis
gcuggcgugacagu

SEQ ID NO: 2853071 - RNA, 20 nt, Mycobacterium avium subsp. paratuberculosis
gcuggcgugacgcucgaggc

SEQ ID NO: 2853072 - RNA, 22 nt, Mycobacterium avium subsp. paratuberculosis
gcuggcgugacgcucgccggcg

SEQ ID NO: 2853073 - RNA, 17 nt, Mycobacterium avium subsp. paratuberculosis
gcuggcgugacgcucgg

SEQ ID NO: 2853074 - RNA, 19 nt, Mycobacterium avium subsp. paratuberculosis
gcuggcgugacgcucggcg

SEQ ID NO: 2853075 - RNA, 22 nt, Mycobacterium avium subsp. paratuberculosis
gcuggcgugacgcucggcgccg

SEQ ID NO: 2853076 - RNA, 20 nt, Mycobacterium avium subsp. paratuberculosis
gcuggcgugacgcucggcgg

SEQ ID NO: 2853077 - RNA, 23 nt, Mycobacterium avium subsp. paratuberculosis
gcuggcgugacgcucggcggccg

SEQ ID NO: 2853078 - RNA, 19 nt, Mycobacterium avium subsp. paratuberculosis
gcuggcgugcggcgcgguc

SEQ ID NO: 2853079 - RNA, 14 nt, Mycobacterium avium subsp. paratuberculosis
gcuggcguggcgcc

SEQ ID NO: 2853080 - RNA, 18 nt, Mycobacterium avium subsp. paratuberculosis
gcuggcguggcgccggcg

SEQ ID NO: 2853081 - RNA, 17 nt, Mycobacterium avium subsp. paratuberculosis
gcuggcguggcucggcc

SEQ ID NO: 2853082 - RNA, 20 nt, Mycobacterium avium subsp. paratuberculosis
gcuggcguggcucggcccgc

SEQ ID NO: 2853083 - RNA, 23 nt, Mycobacterium avium subsp. paratuberculosis
gcuggcguggcucggcccgccgg

SEQ ID NO: 2853084 - RNA, 19 nt, Mycobacterium avium subsp. paratuberculosis
gcuggcguugagcacgcgg

SEQ ID NO: 2853085 - RNA, 20 nt, Mycobacterium avium subsp. paratuberculosis
gcuggcguugagcacgcgga

SEQ ID NO: 2853086 - RNA, 17 nt, Mycobacterium avium subsp. paratuberculosis
gcuggcguugggcggga

SEQ ID NO: 2853087 - RNA, 22 nt, Mycobacterium avium subsp. paratuberculosis
gcuggcguugggcgggaucgcg

SEQ ID NO: 2853088 - RNA, 12 nt, Mycobacterium avium subsp. paratuberculosis
gcuggcugcggc

SEQ ID NO: 2853089 - RNA, 16 nt, Mycobacterium avium subsp. paratuberculosis
gcuggcugcggccccg

SEQ ID NO: 2853090 - RNA, 22 nt, Mycobacterium avium subsp. paratuberculosis
gcugggacagcgucaccaaugc

SEQ ID NO: 2853091 - RNA, 17 nt, Mycobacterium avium subsp. paratuberculosis
gcugggacgggucggcg

SEQ ID NO: 2853092 - RNA, 14 nt, Mycobacterium avium subsp. paratuberculosis
gcugggagagcagg

SEQ ID NO: 2853093 - RNA, 15 nt, Mycobacterium avium subsp. paratuberculosis
gcugggagcacguga

SEQ ID NO: 2853094 - RNA, 18 nt, Mycobacterium avium subsp. paratuberculosis
gcugggagcgggccacgc

SEQ ID NO: 2853095 - RNA, 13 nt, Mycobacterium avium subsp. paratuberculosis
gcugggcaccguc

SEQ ID NO: 2853096 - RNA, 14 nt, Mycobacterium avium subsp. paratuberculosis
gcugggcaccgucg

SEQ ID NO: 2853097 - RNA, 19 nt, Mycobacterium avium subsp. paratuberculosis
gcugggcagccagaucucc

SEQ ID NO: 2853098 - RNA, 16 nt, Mycobacterium avium subsp. paratuberculosis
gcugggcagccgcgcg

SEQ ID NO: 2853099 - RNA, 19 nt, Mycobacterium avium subsp. paratuberculosis
gcugggcaucaucggcacg

SEQ ID NO: 2853100 - RNA, 20 nt, Mycobacterium avium subsp. paratuberculosis
gcugggcaucaucggcacgc

SEQ ID NO: 2853101 - RNA, 22 nt, Mycobacterium avium subsp. paratuberculosis
gcugggcaucaucggcacgccg

SEQ ID NO: 2853102 - RNA, 15 nt, Mycobacterium avium subsp. paratuberculosis
gcugggccacgaucc

SEQ ID NO: 2853103 - RNA, 18 nt, Mycobacterium avium subsp. paratuberculosis
gcugggccacgauccgcg

SEQ ID NO: 2853104 - RNA, 21 nt, Mycobacterium avium subsp. paratuberculosis
gcugggccacgauccgcgcgg

SEQ ID NO: 2853105 - RNA, 15 nt, Mycobacterium avium subsp. paratuberculosis
gcugggccagcgcgg

SEQ ID NO: 2853106 - RNA, 16 nt, Mycobacterium avium subsp. paratuberculosis
gcugggccagcgcggu

SEQ ID NO: 2853107 - RNA, 17 nt, Mycobacterium avium subsp. paratuberculosis
gcugggccagcgcggug

SEQ ID NO: 2853108 - RNA, 21 nt, Mycobacterium avium subsp. paratuberculosis
gcuggucuugccgugcagcag

SEQ ID NO: 2853109 - RNA, 17 nt, Mycobacterium avium subsp. paratuberculosis
gcuggugaacucgccga

SEQ ID NO: 2853110 - RNA, 22 nt, Mycobacterium avium subsp. paratuberculosis
gcuggugaacucgccgaucggg

SEQ ID NO: 2853111 - RNA, 22 nt, Mycobacterium avium subsp. paratuberculosis
gcuggugaaguucuccagcacg

SEQ ID NO: 2853112 - RNA, 16 nt, Mycobacterium avium subsp. paratuberculosis
gcuggugacgccgcug

SEQ ID NO: 2853113 - RNA, 18 nt, Mycobacterium avium subsp. paratuberculosis
gcuggugacgugcaccug

SEQ ID NO: 2853114 - RNA, 15 nt, Mycobacterium avium subsp. paratuberculosis
gcuggugaggucgcg

SEQ ID NO: 2853115 - RNA, 17 nt, Mycobacterium avium subsp. paratuberculosis
gcuggugauggccaucu

SEQ ID NO: 2853116 - RNA, 19 nt, Mycobacterium avium subsp. paratuberculosis
gcuggugauggccaucugg

SEQ ID NO: 2853117 - RNA, 13 nt, Mycobacterium avium subsp. paratuberculosis
gcuggugcagcag

SEQ ID NO: 2853118 - RNA, 15 nt, Mycobacterium avium subsp. paratuberculosis
gcuggugcagcaggg

SEQ ID NO: 2853119 - RNA, 17 nt, Mycobacterium avium subsp. paratuberculosis
gcuggugcagcagggcg

SEQ ID NO: 2853120 - RNA, 20 nt, Mycobacterium avium subsp. paratuberculosis
gcuggugcagcagggcgcgc

SEQ ID NO: 2853121 - RNA, 17 nt, Mycobacterium avium subsp. paratuberculosis
gcuggugccgccgauga

SEQ ID NO: 2853122 - RNA, 16 nt, Mycobacterium avium subsp. paratuberculosis
gcuggugccgccggcg

SEQ ID NO: 2853123 - RNA, 17 nt, Mycobacterium avium subsp. paratuberculosis
gcuggugcgcagcccgc

SEQ ID NO: 2853124 - RNA, 20 nt, Mycobacterium avium subsp. paratuberculosis
gcuggugcgcagcccgccgg

SEQ ID NO: 2853125 - RNA, 15 nt, Mycobacterium avium subsp. paratuberculosis
gcuggugcgcgccgg

SEQ ID NO: 2853126 - RNA, 15 nt, Mycobacterium avium subsp. paratuberculosis
gcuggugcgggccag

SEQ ID NO: 2853127 - RNA, 16 nt, Mycobacterium avium subsp. paratuberculosis
gcuggugcgggccagc

SEQ ID NO: 2853128 - RNA, 19 nt, Mycobacterium avium subsp. paratuberculosis
gcuggugcgggccagcacg

SEQ ID NO: 2853129 - RNA, 20 nt, Mycobacterium avium subsp. paratuberculosis
gcuggugcgggccagcacga

SEQ ID NO: 2853130 - RNA, 23 nt, Mycobacterium avium subsp. paratuberculosis
gcuggugcugcugccccucgacg

SEQ ID NO: 2853131 - RNA, 15 nt, Mycobacterium avium subsp. paratuberculosis
gcugguggccgacgu

SEQ ID NO: 2853132 - RNA, 20 nt, Mycobacterium avium subsp. paratuberculosis
gcugguggccgacgugccgg

SEQ ID NO: 2853133 - RNA, 16 nt, Mycobacterium avium subsp. paratuberculosis
gcuggugggccaucgc

SEQ ID NO: 2853134 - RNA, 14 nt, Mycobacterium avium subsp. paratuberculosis
gcugguggugauca

SEQ ID NO: 2853135 - RNA, 18 nt, Mycobacterium avium subsp. paratuberculosis
gcugguggugaucaccca

SEQ ID NO: 2853136 - RNA, 20 nt, Mycobacterium avium subsp. paratuberculosis
gcugguggugaucacccagc

SEQ ID NO: 2853137 - RNA, 16 nt, Mycobacterium avium subsp. paratuberculosis
gcugguggugaucggc

SEQ ID NO: 2853138 - RNA, 17 nt, Mycobacterium avium subsp. paratuberculosis
gcugguggugaucggcc

SEQ ID NO: 2853139 - RNA, 14 nt, Mycobacterium avium subsp. paratuberculosis
gcuggugugacgcu

SEQ ID NO: 2853140 - RNA, 17 nt, Mycobacterium avium subsp. paratuberculosis
gcuggugugacgcucgc

SEQ ID NO: 2853141 - RNA, 17 nt, Mycobacterium avium subsp. paratuberculosis
gcugguugucgacgcug

SEQ ID NO: 2853142 - RNA, 17 nt, Mycobacterium avium subsp. paratuberculosis
gcuguaccgcgagauca

SEQ ID NO: 2853143 - RNA, 13 nt, Mycobacterium avium subsp. paratuberculosis
gcuguagcacccg

SEQ ID NO: 2853144 - RNA, 14 nt, Mycobacterium avium subsp. paratuberculosis
gcuguagcacccgg

SEQ ID NO: 2853145 - RNA, 18 nt, Mycobacterium avium subsp. paratuberculosis
gcuguagcacccggccgg

SEQ ID NO: 2853146 - RNA, 14 nt, Mycobacterium avium subsp. paratuberculosis
gcuguagcggucgu

SEQ ID NO: 2853147 - RNA, 23 nt, Mycobacterium avium subsp. paratuberculosis
gcuguagcucacggugucggcgg

SEQ ID NO: 2853148 - RNA, 18 nt, Mycobacterium avium subsp. paratuberculosis
gcuguaggccagccggga

SEQ ID NO: 2853149 - RNA, 23 nt, Mycobacterium avium subsp. paratuberculosis
gcugucaauccccgcgguucgag

SEQ ID NO: 2853150 - RNA, 13 nt, Mycobacterium avium subsp. paratuberculosis
gcuguccaccugc

SEQ ID NO: 2853151 - RNA, 14 nt, Mycobacterium avium subsp. paratuberculosis
gcuguccaccugca

SEQ ID NO: 2853152 - RNA, 15 nt, Mycobacterium avium subsp. paratuberculosis
gcuguccaccugcac

SEQ ID NO: 2853153 - RNA, 16 nt, Mycobacterium avium subsp. paratuberculosis
gcuguccaccugcacc

SEQ ID NO: 2853154 - RNA, 19 nt, Mycobacterium avium subsp. paratuberculosis
gcuguccaccugcaccugg

SEQ ID NO: 2853155 - RNA, 14 nt, Mycobacterium avium subsp. paratuberculosis
gcuguccagcagcg

SEQ ID NO: 2853156 - RNA, 14 nt, Mycobacterium avium subsp. paratuberculosis
gcugucccggccgc

SEQ ID NO: 2853157 - RNA, 18 nt, Mycobacterium avium subsp. paratuberculosis
gcugucccggccgcgaca

SEQ ID NO: 2853158 - RNA, 13 nt, Mycobacterium avium subsp. paratuberculosis
gcuguccgcgugg

SEQ ID NO: 2853159 - RNA, 16 nt, Mycobacterium avium subsp. paratuberculosis
gcuguccgcguggccg

SEQ ID NO: 2853160 - RNA, 15 nt, Mycobacterium avium subsp. paratuberculosis
gcuguccucccagcg

SEQ ID NO: 2853161 - RNA, 16 nt, Mycobacterium avium subsp. paratuberculosis
gcuguccucccagcgc

SEQ ID NO: 2853162 - RNA, 14 nt, Mycobacterium avium subsp. paratuberculosis
gcuguccucgagcg

SEQ ID NO: 2853163 - RNA, 14 nt, Mycobacterium avium subsp. paratuberculosis
gcuguccucgucgg

SEQ ID NO: 2853164 - RNA, 20 nt, Mycobacterium avium subsp. paratuberculosis
gcuguccucgucggaggcgu

SEQ ID NO: 2853165 - RNA, 11 nt, Mycobacterium avium subsp. paratuberculosis
gcuguccugcc

SEQ ID NO: 2853166 - RNA, 15 nt, Mycobacterium avium subsp. paratuberculosis
gcuguccugccgggc

SEQ ID NO: 2853167 - RNA, 22 nt, Mycobacterium avium subsp. paratuberculosis
gcuguccugccgggcgucgacg

SEQ ID NO: 2853168 - RNA, 14 nt, Mycobacterium avium subsp. paratuberculosis
gcuguccuggucgc

SEQ ID NO: 2853169 - RNA, 23 nt, Mycobacterium avium subsp. paratuberculosis
gcugucgacaggaucgacaacgc

SEQ ID NO: 2853170 - RNA, 19 nt, Mycobacterium avium subsp. paratuberculosis
gcugucgcccucgaucgcg

SEQ ID NO: 2853171 - RNA, 12 nt, Mycobacterium avium subsp. paratuberculosis
gcugucgccgag

SEQ ID NO: 2853172 - RNA, 16 nt, Mycobacterium avium subsp. paratuberculosis
gcugucgccgaggucc

SEQ ID NO: 2853173 - RNA, 16 nt, Mycobacterium avium subsp. paratuberculosis
gcugucgcgggcccgc

SEQ ID NO: 2853174 - RNA, 22 nt, Mycobacterium avium subsp. paratuberculosis
gcugucgcgggucuggcucggc

SEQ ID NO: 2853175 - RNA, 20 nt, Mycobacterium avium subsp. paratuberculosis
gcugucggcgcccagaucgg

SEQ ID NO: 2853176 - RNA, 19 nt, Mycobacterium avium subsp. paratuberculosis
gcugucggggaccgucccc

SEQ ID NO: 2853177 - RNA, 13 nt, Mycobacterium avium subsp. paratuberculosis
gcugucggggucg

SEQ ID NO: 2853178 - RNA, 21 nt, Mycobacterium avium subsp. paratuberculosis
gcugucgggugccgccuuggu

SEQ ID NO: 2853179 - RNA, 18 nt, Mycobacterium avium subsp. paratuberculosis
gcugucggugacgaggag

SEQ ID NO: 2853180 - RNA, 18 nt, Mycobacterium avium subsp. paratuberculosis
gcugucggugugagcggu

SEQ ID NO: 2853181 - RNA, 21 nt, Mycobacterium avium subsp. paratuberculosis
gcugucggugugagcggugac

SEQ ID NO: 2853182 - RNA, 13 nt, Mycobacterium avium subsp. paratuberculosis
gcugucguagcgg

SEQ ID NO: 2853183 - RNA, 17 nt, Mycobacterium avium subsp. paratuberculosis
gcugucguagcggccca

SEQ ID NO: 2853184 - RNA, 17 nt, Mycobacterium avium subsp. paratuberculosis
gcugucgucgaagagcu

SEQ ID NO: 2853185 - RNA, 14 nt, Mycobacterium avium subsp. paratuberculosis
gcugucgucgcccu

SEQ ID NO: 2853186 - RNA, 15 nt, Mycobacterium avium subsp. paratuberculosis
gcugugcgccuugcc

SEQ ID NO: 2853187 - RNA, 15 nt, Mycobacterium avium subsp. paratuberculosis
gcugugcggcccggc

SEQ ID NO: 2853188 - RNA, 17 nt, Mycobacterium avium subsp. paratuberculosis
gcugugcggcccggcac

SEQ ID NO: 2853189 - RNA, 22 nt, Mycobacterium avium subsp. paratuberculosis
gcugugcucgacgaagauggcg

SEQ ID NO: 2853190 - RNA, 18 nt, Mycobacterium avium subsp. paratuberculosis
gcuguggaacacgucggc

SEQ ID NO: 2853191 - RNA, 19 nt, Mycobacterium avium subsp. paratuberculosis
gcuguggaacacgucggcg

SEQ ID NO: 2853192 - RNA, 15 nt, Mycobacterium avium subsp. paratuberculosis
gcuguggaugacgca

SEQ ID NO: 2853193 - RNA, 18 nt, Mycobacterium avium subsp. paratuberculosis
gcuugaccacccggucga

SEQ ID NO: 2853194 - RNA, 21 nt, Mycobacterium avium subsp. paratuberculosis
gcuugacccgcuccagcggcc

SEQ ID NO: 2853195 - RNA, 13 nt, Mycobacterium avium subsp. paratuberculosis
gcuugaccgccag

SEQ ID NO: 2853196 - RNA, 20 nt, Mycobacterium avium subsp. paratuberculosis
gcuugaccggcucgccggcg

SEQ ID NO: 2853197 - RNA, 15 nt, Mycobacterium avium subsp. paratuberculosis
gcuugaccgugacgg

SEQ ID NO: 2853198 - RNA, 14 nt, Mycobacterium avium subsp. paratuberculosis
gcuugaccucgccg

SEQ ID NO: 2853199 - RNA, 15 nt, Mycobacterium avium subsp. paratuberculosis
gcuugacgaacgcca

SEQ ID NO: 2853200 - RNA, 18 nt, Mycobacterium avium subsp. paratuberculosis
gcuugacgaacgccacca

SEQ ID NO: 2853201 - RNA, 23 nt, Mycobacterium avium subsp. paratuberculosis
gcuugacgaacgccaccacggcg

SEQ ID NO: 2853202 - RNA, 14 nt, Mycobacterium avium subsp. paratuberculosis
gcuugacgccgccg

SEQ ID NO: 2853203 - RNA, 16 nt, Mycobacterium avium subsp. paratuberculosis
gcuugacgccgccgaa

SEQ ID NO: 2853204 - RNA, 16 nt, Mycobacterium avium subsp. paratuberculosis
gcuugacggccgggcc

SEQ ID NO: 2853205 - RNA, 13 nt, Mycobacterium avium subsp. paratuberculosis
gcuugacgucggu

SEQ ID NO: 2853206 - RNA, 22 nt, Mycobacterium avium subsp. paratuberculosis
gcuugagccccgccgggguccg

SEQ ID NO: 2853207 - RNA, 16 nt, Mycobacterium avium subsp. paratuberculosis
gcuugagcccgucgac

SEQ ID NO: 2853208 - RNA, 17 nt, Mycobacterium avium subsp. paratuberculosis
gcuugagcccgucgacg

SEQ ID NO: 2853209 - RNA, 22 nt, Mycobacterium avium subsp. paratuberculosis
gcuugagccggaucggggugga

SEQ ID NO: 2853210 - RNA, 17 nt, Mycobacterium avium subsp. paratuberculosis
gcuugagcgccagcgcg

SEQ ID NO: 2853211 - RNA, 18 nt, Mycobacterium avium subsp. paratuberculosis
gcuugagcgccagcgcgg

SEQ ID NO: 2853212 - RNA, 17 nt, Mycobacterium avium subsp. paratuberculosis
gcuugaucgccggggcg

SEQ ID NO: 2853213 - RNA, 19 nt, Mycobacterium avium subsp. paratuberculosis
gcuugaugaugccggccgc

SEQ ID NO: 2853214 - RNA, 19 nt, Mycobacterium avium subsp. paratuberculosis
gcuugaugaugucggcggc

SEQ ID NO: 2853215 - RNA, 14 nt, Mycobacterium avium subsp. paratuberculosis
gcuugauggcggcg

SEQ ID NO: 2853216 - RNA, 16 nt, Mycobacterium avium subsp. paratuberculosis
gcuugcagcuuggcgg

SEQ ID NO: 2853217 - RNA, 20 nt, Mycobacterium avium subsp. paratuberculosis
gcuugcagcuuggcgguggc

SEQ ID NO: 2853218 - RNA, 17 nt, Mycobacterium avium subsp. paratuberculosis
gcuugccagccgggccg

SEQ ID NO: 2853219 - RNA, 16 nt, Mycobacterium avium subsp. paratuberculosis
gcuugccccggucccg

SEQ ID NO: 2853220 - RNA, 16 nt, Mycobacterium avium subsp. paratuberculosis
gcuugcccguucgaug

SEQ ID NO: 2853221 - RNA, 21 nt, Mycobacterium avium subsp. paratuberculosis
gcuugcccugguacgcgccgu

SEQ ID NO: 2853222 - RNA, 23 nt, Mycobacterium avium subsp. paratuberculosis
gcuugccgaaguccuugacccgc

SEQ ID NO: 2853223 - RNA, 22 nt, Mycobacterium avium subsp. paratuberculosis
gcuugccgacgugaugcacccg

SEQ ID NO: 2853224 - RNA, 17 nt, Mycobacterium avium subsp. paratuberculosis
gcuugccgaugucggcg

SEQ ID NO: 2853225 - RNA, 20 nt, Mycobacterium avium subsp. paratuberculosis
gcuugccgccgcagcgcagc

SEQ ID NO: 2853226 - RNA, 15 nt, Mycobacterium avium subsp. paratuberculosis
gcuugccgccgggcc

SEQ ID NO: 2853227 - RNA, 17 nt, Mycobacterium avium subsp. paratuberculosis
gcuugccgccgggccag

SEQ ID NO: 2853228 - RNA, 16 nt, Mycobacterium avium subsp. paratuberculosis
gcuugccgcgacccgg

SEQ ID NO: 2853229 - RNA, 20 nt, Mycobacterium avium subsp. paratuberculosis
gcuugccgcgacccgggccg

SEQ ID NO: 2853230 - RNA, 23 nt, Mycobacterium avium subsp. paratuberculosis
gcuugccggagcccagcuuggcg

SEQ ID NO: 2853231 - RNA, 20 nt, Mycobacterium avium subsp. paratuberculosis
gcuugccggauugcgagccg

SEQ ID NO: 2853232 - RNA, 13 nt, Mycobacterium avium subsp. paratuberculosis
gcuugccgucgac

SEQ ID NO: 2853233 - RNA, 18 nt, Mycobacterium avium subsp. paratuberculosis
gcuugccguugucgaaga

SEQ ID NO: 2853234 - RNA, 15 nt, Mycobacterium avium subsp. paratuberculosis
gcuugcgaccgccgc

SEQ ID NO: 2853235 - RNA, 19 nt, Mycobacterium avium subsp. paratuberculosis
gcuugcgaccgccgcuaga

SEQ ID NO: 2853236 - RNA, 11 nt, Mycobacterium avium subsp. paratuberculosis
gcuugcgccgc

SEQ ID NO: 2853237 - RNA, 15 nt, Mycobacterium avium subsp. paratuberculosis
gcuugcgccgcagcg

SEQ ID NO: 2853238 - RNA, 15 nt, Mycobacterium avium subsp. paratuberculosis
gcuugcgcucggccg

SEQ ID NO: 2853239 - RNA, 21 nt, Mycobacterium avium subsp. paratuberculosis
gcuugcguucccagcccggcc

SEQ ID NO: 2853240 - RNA, 21 nt, Mycobacterium avium subsp. paratuberculosis
gcuugcucuucaggaacccga

SEQ ID NO: 2853241 - RNA, 15 nt, Mycobacterium avium subsp. paratuberculosis
gcuuggccacgauga

SEQ ID NO: 2853242 - RNA, 17 nt, Mycobacterium avium subsp. paratuberculosis
gcuuggccagcucggcg

SEQ ID NO: 2853243 - RNA, 19 nt, Mycobacterium avium subsp. paratuberculosis
gcuuggccagcucggcggc

SEQ ID NO: 2853244 - RNA, 14 nt, Mycobacterium avium subsp. paratuberculosis
gcuuggcccgccgc

SEQ ID NO: 2853245 - RNA, 16 nt, Mycobacterium avium subsp. paratuberculosis
gcuuggcccgccgccg

SEQ ID NO: 2853246 - RNA, 15 nt, Mycobacterium avium subsp. paratuberculosis
gcuuggccgggcgga

SEQ ID NO: 2853247 - RNA, 18 nt, Mycobacterium avium subsp. paratuberculosis
gcuuggcgacgaagucga

SEQ ID NO: 2853248 - RNA, 18 nt, Mycobacterium avium subsp. paratuberculosis
gcuuggcgcagccgguca

SEQ ID NO: 2853249 - RNA, 12 nt, Mycobacterium avium subsp. paratuberculosis
gcuuggcgcccu

SEQ ID NO: 2853250 - RNA, 13 nt, Mycobacterium avium subsp. paratuberculosis
gcuuggcggccug

SEQ ID NO: 2853251 - RNA, 15 nt, Mycobacterium avium subsp. paratuberculosis
gcuuggcgggcguca

SEQ ID NO: 2853252 - RNA, 12 nt, Mycobacterium avium subsp. paratuberculosis
gcuuggcggucu

SEQ ID NO: 2853253 - RNA, 20 nt, Mycobacterium avium subsp. paratuberculosis
gcuugggcacguacgcgcug

SEQ ID NO: 2853254 - RNA, 15 nt, Mycobacterium avium subsp. paratuberculosis
gcuugggccggugca

SEQ ID NO: 2853255 - RNA, 19 nt, Mycobacterium avium subsp. paratuberculosis
gcuuggggaagccggccag

SEQ ID NO: 2853256 - RNA, 14 nt, Mycobacterium avium subsp. paratuberculosis
gcuugggucgccgg

SEQ ID NO: 2853257 - RNA, 16 nt, Mycobacterium avium subsp. paratuberculosis
gcuugggucgccgggu

SEQ ID NO: 2853258 - RNA, 19 nt, Mycobacterium avium subsp. paratuberculosis
gcuuggucaccagcucgcc

SEQ ID NO: 2853259 - RNA, 20 nt, Mycobacterium avium subsp. paratuberculosis
gcuuggucaccagcucgccg

SEQ ID NO: 2853260 - RNA, 19 nt, Mycobacterium avium subsp. paratuberculosis
gcuuggucagcgcggcccg

SEQ ID NO: 2853261 - RNA, 14 nt, Mycobacterium avium subsp. paratuberculosis
gcuuggucaugaac

SEQ ID NO: 2853262 - RNA, 19 nt, Mycobacterium avium subsp. paratuberculosis
gcuuggucaugaacgccgg

SEQ ID NO: 2853263 - RNA, 15 nt, Mycobacterium avium subsp. paratuberculosis
gcuuggucgccugca

SEQ ID NO: 2853264 - RNA, 18 nt, Mycobacterium avium subsp. paratuberculosis
gcuuggucgccugcacga

SEQ ID NO: 2853265 - RNA, 16 nt, Mycobacterium avium subsp. paratuberculosis
gcuuggucgcggcguu

SEQ ID NO: 2853266 - RNA, 20 nt, Mycobacterium avium subsp. paratuberculosis
gcuuggucgcggcguugccc

SEQ ID NO: 2853267 - RNA, 18 nt, Mycobacterium avium subsp. paratuberculosis
gcuuggucuccggccccg

SEQ ID NO: 2853268 - RNA, 19 nt, Mycobacterium avium subsp. paratuberculosis
gcuuggucuccggccccga

SEQ ID NO: 2853269 - RNA, 13 nt, Mycobacterium avium subsp. paratuberculosis
gcuugguggcgcc

SEQ ID NO: 2853270 - RNA, 16 nt, Mycobacterium avium subsp. paratuberculosis
gcuugucagcggccuc

SEQ ID NO: 2853271 - RNA, 16 nt, Mycobacterium avium subsp. paratuberculosis
gcuugucguagcggcg

SEQ ID NO: 2853272 - RNA, 21 nt, Mycobacterium avium subsp. paratuberculosis
gcuugucguagcggcgccacc

SEQ ID NO: 2853273 - RNA, 23 nt, Mycobacterium avium subsp. paratuberculosis
gcuugucguagcggcgccaccgg

SEQ ID NO: 2853274 - RNA, 22 nt, Mycobacterium avium subsp. paratuberculosis
gcuugugaaugggcugcgcguc

SEQ ID NO: 2853275 - RNA, 23 nt, Mycobacterium avium subsp. paratuberculosis
gcuugugaaugggcugcgcgucg

SEQ ID NO: 2853276 - RNA, 17 nt, Mycobacterium avium subsp. paratuberculosis
gcuuguucgggcccaca

SEQ ID NO: 2853277 - RNA, 18 nt, Mycobacterium avium subsp. paratuberculosis
gcuuuacgaggcgugcag

SEQ ID NO: 2853278 - RNA, 15 nt, Mycobacterium avium subsp. paratuberculosis
ggaacgcgccgggca

SEQ ID NO: 2853279 - RNA, 22 nt, Mycobacterium avium subsp. paratuberculosis
ggaacgcgccgggcaacagcgc

SEQ ID NO: 2853280 - RNA, 20 nt, Mycobacterium avium subsp. paratuberculosis
ggaacgcggacagcucgccg

SEQ ID NO: 2853281 - RNA, 20 nt, Mycobacterium avium subsp. paratuberculosis
ggaacgcggcgaaggccagc

SEQ ID NO: 2853282 - RNA, 17 nt, Mycobacterium avium subsp. paratuberculosis
ggaacgcgucgaacacc

SEQ ID NO: 2853283 - RNA, 12 nt, Mycobacterium avium subsp. paratuberculosis
ggaacgcgucgc

SEQ ID NO: 2853284 - RNA, 18 nt, Mycobacterium avium subsp. paratuberculosis
ggaacgcgucgcccacgc

SEQ ID NO: 2853285 - RNA, 18 nt, Mycobacterium avium subsp. paratuberculosis
ggaacgcgucgcgccagc

SEQ ID NO: 2853286 - RNA, 16 nt, Mycobacterium avium subsp. paratuberculosis
ggaacggcacccgcag

SEQ ID NO: 2853287 - RNA, 20 nt, Mycobacterium avium subsp. paratuberculosis
ggaacggccggauggccagc

SEQ ID NO: 2853288 - RNA, 18 nt, Mycobacterium avium subsp. paratuberculosis
ggaacggcgggcccgucg

SEQ ID NO: 2853289 - RNA, 12 nt, Mycobacterium avium subsp. paratuberculosis
ggaacgggccgg

SEQ ID NO: 2853290 - RNA, 22 nt, Mycobacterium avium subsp. paratuberculosis
ggaacgggccggcguccaguug

SEQ ID NO: 2853291 - RNA, 16 nt, Mycobacterium avium subsp. paratuberculosis
ggaacggucagccgcg

SEQ ID NO: 2853292 - RNA, 17 nt, Mycobacterium avium subsp. paratuberculosis
ggaacggucagccgcgg

SEQ ID NO: 2853293 - RNA, 18 nt, Mycobacterium avium subsp. paratuberculosis
ggaacggucggggcggcg

SEQ ID NO: 2853294 - RNA, 18 nt, Mycobacterium avium subsp. paratuberculosis
ggaacgucauggccagcu

SEQ ID NO: 2853295 - RNA, 14 nt, Mycobacterium avium subsp. paratuberculosis
ggaacucccgcgcc

SEQ ID NO: 2853296 - RNA, 16 nt, Mycobacterium avium subsp. paratuberculosis
ggaacucccgcgccgc

SEQ ID NO: 2853297 - RNA, 15 nt, Mycobacterium avium subsp. paratuberculosis
ggaacuccugcagga

SEQ ID NO: 2853298 - RNA, 13 nt, Mycobacterium avium subsp. paratuberculosis
ggaacucgaugcg

SEQ ID NO: 2853299 - RNA, 17 nt, Mycobacterium avium subsp. paratuberculosis
ggaacugcagcgacugg

SEQ ID NO: 2853300 - RNA, 21 nt, Mycobacterium avium subsp. paratuberculosis
ggaacugcucccaggcgucgu

SEQ ID NO: 2853301 - RNA, 17 nt, Mycobacterium avium subsp. paratuberculosis
ggaagaacccggcgugc

SEQ ID NO: 2853302 - RNA, 20 nt, Mycobacterium avium subsp. paratuberculosis
ggaagaaggacaagccggag

SEQ ID NO: 2853303 - RNA, 15 nt, Mycobacterium avium subsp. paratuberculosis
ggaagaccguugacg

SEQ ID NO: 2853304 - RNA, 16 nt, Mycobacterium avium subsp. paratuberculosis
ggaagaucgcagcggu

SEQ ID NO: 2853305 - RNA, 21 nt, Mycobacterium avium subsp. paratuberculosis
ggaagaugccgaucaggcugg

SEQ ID NO: 2853306 - RNA, 14 nt, Mycobacterium avium subsp. paratuberculosis
ggaagauguccucg

SEQ ID NO: 2853307 - RNA, 15 nt, Mycobacterium avium subsp. paratuberculosis
ggaagccaugccggg

SEQ ID NO: 2853308 - RNA, 14 nt, Mycobacterium avium subsp. paratuberculosis
ggaagccccaggcc

SEQ ID NO: 2853309 - RNA, 23 nt, Mycobacterium avium subsp. paratuberculosis
ggaagccgagcuugggccggugc

SEQ ID NO: 2853310 - RNA, 19 nt, Mycobacterium avium subsp. paratuberculosis
ggaagccgaggucgccgac

SEQ ID NO: 2853311 - RNA, 20 nt, Mycobacterium avium subsp. paratuberculosis
ggaagccgaguuuggcgucg

SEQ ID NO: 2853312 - RNA, 13 nt, Mycobacterium avium subsp. paratuberculosis
ggaagccgcagca

SEQ ID NO: 2853313 - RNA, 22 nt, Mycobacterium avium subsp. paratuberculosis
ggaagccgcauggugcgggugu

SEQ ID NO: 2853314 - RNA, 14 nt, Mycobacterium avium subsp. paratuberculosis
ggaagccgccgccc

SEQ ID NO: 2853315 - RNA, 15 nt, Mycobacterium avium subsp. paratuberculosis
ggaagccggcgacga

SEQ ID NO: 2853316 - RNA, 16 nt, Mycobacterium avium subsp. paratuberculosis
ggaagccggcgacgac

SEQ ID NO: 2853317 - RNA, 16 nt, Mycobacterium avium subsp. paratuberculosis
ggaagccuggcacgac

SEQ ID NO: 2853318 - RNA, 23 nt, Mycobacterium avium subsp. paratuberculosis
ggaagcgaauccgggugucgacg

SEQ ID NO: 2853319 - RNA, 18 nt, Mycobacterium avium subsp. paratuberculosis
ggaagcgcaucgccggcg

SEQ ID NO: 2853320 - RNA, 22 nt, Mycobacterium avium subsp. paratuberculosis
ggaagcgcaucgccggcgcgcu

SEQ ID NO: 2853321 - RNA, 21 nt, Mycobacterium avium subsp. paratuberculosis
ggaagcugccguugcgccagc

SEQ ID NO: 2853322 - RNA, 17 nt, Mycobacterium avium subsp. paratuberculosis
ggaaggacgucaggccg

SEQ ID NO: 2853323 - RNA, 13 nt, Mycobacterium avium subsp. paratuberculosis
ggaaggagguggu

SEQ ID NO: 2853324 - RNA, 18 nt, Mycobacterium avium subsp. paratuberculosis
ggaaggaggugguccgcg

SEQ ID NO: 2853325 - RNA, 17 nt, Mycobacterium avium subsp. paratuberculosis
ggaaggccgcgcgggcg

SEQ ID NO: 2853326 - RNA, 15 nt, Mycobacterium avium subsp. paratuberculosis
ggaaggcgaccgcgu

SEQ ID NO: 2853327 - RNA, 21 nt, Mycobacterium avium subsp. paratuberculosis
ggaagggcuuuagaaggccgc

SEQ ID NO: 2853328 - RNA, 19 nt, Mycobacterium avium subsp. paratuberculosis
ggaaggugguccuggcggu

SEQ ID NO: 2853329 - RNA, 15 nt, Mycobacterium avium subsp. paratuberculosis
ggaaguagcccggag

SEQ ID NO: 2853330 - RNA, 24 nt, Mycobacterium avium subsp. paratuberculosis
ggaaguagcccuuggacuccccca

SEQ ID NO: 2853331 - RNA, 17 nt, Mycobacterium avium subsp. paratuberculosis
ggaaguagccggccagc

SEQ ID NO: 2853332 - RNA, 15 nt, Mycobacterium avium subsp. paratuberculosis
ggaaguagggcagcc

SEQ ID NO: 2853333 - RNA, 16 nt, Mycobacterium avium subsp. paratuberculosis
ggaaguagggcagccc

SEQ ID NO: 2853334 - RNA, 23 nt, Mycobacterium avium subsp. paratuberculosis
ggaaguaguccagggugucgucg

SEQ ID NO: 2853335 - RNA, 16 nt, Mycobacterium avium subsp. paratuberculosis
ggaagucagcgcguga

SEQ ID NO: 2853336 - RNA, 22 nt, Mycobacterium avium subsp. paratuberculosis
ggaaguccuuguucgccgggua

SEQ ID NO: 2853337 - RNA, 21 nt, Mycobacterium avium subsp. paratuberculosis
ggaagucgaccggggcgcccc

SEQ ID NO: 2853338 - RNA, 15 nt, Mycobacterium avium subsp. paratuberculosis
ggaagugcacgccga

SEQ ID NO: 2853339 - RNA, 20 nt, Mycobacterium avium subsp. paratuberculosis
ggaaguucgcuggcggggcg

SEQ ID NO: 2853340 - RNA, 13 nt, Mycobacterium avium subsp. paratuberculosis
ggaaguuggccuc

SEQ ID NO: 2853341 - RNA, 16 nt, Mycobacterium avium subsp. paratuberculosis
ggaaguuggccuccca

SEQ ID NO: 2853342 - RNA, 23 nt, Mycobacterium avium subsp. paratuberculosis
ggaauagcuugggagacuuccac

SEQ ID NO: 2853343 - RNA, 18 nt, Mycobacterium avium subsp. paratuberculosis
ggaaucacuuccgcggca

SEQ ID NO: 2853344 - RNA, 14 nt, Mycobacterium avium subsp. paratuberculosis
ggaaucgagggcgc

SEQ ID NO: 2853345 - RNA, 18 nt, Mycobacterium avium subsp. paratuberculosis
ggaaucgauuggugcgca

SEQ ID NO: 2853346 - RNA, 18 nt, Mycobacterium avium subsp. paratuberculosis
ggaaucgcccgggccagg

SEQ ID NO: 2853347 - RNA, 22 nt, Mycobacterium avium subsp. paratuberculosis
ggaaucgcggaucgaacagggc

SEQ ID NO: 2853348 - RNA, 12 nt, Mycobacterium avium subsp. paratuberculosis
ggaaucgcggca

SEQ ID NO: 2853349 - RNA, 21 nt, Mycobacterium avium subsp. paratuberculosis
ggaaucgcggcaggcgacccg

SEQ ID NO: 2853350 - RNA, 11 nt, Mycobacterium avium subsp. paratuberculosis
ggaaucgucgg

SEQ ID NO: 2853351 - RNA, 17 nt, Mycobacterium avium subsp. paratuberculosis
ggaaucgucggccacgc

SEQ ID NO: 2853352 - RNA, 19 nt, Mycobacterium avium subsp. paratuberculosis
ggaaucuuccuucuugaac

SEQ ID NO: 2853353 - RNA, 19 nt, Mycobacterium avium subsp. paratuberculosis
ggaaugaacugccgcggca

SEQ ID NO: 2853354 - RNA, 18 nt, Mycobacterium avium subsp. paratuberculosis
ggaauggcaaggccagca

SEQ ID NO: 2853355 - RNA, 20 nt, Mycobacterium avium subsp. paratuberculosis
ggaauggcaaggccagcaac

SEQ ID NO: 2853356 - RNA, 12 nt, Mycobacterium avium subsp. paratuberculosis
ggaauggcagca

SEQ ID NO: 2853357 - RNA, 13 nt, Mycobacterium avium subsp. paratuberculosis
ggaauggcagcag

SEQ ID NO: 2853358 - RNA, 16 nt, Mycobacterium avium subsp. paratuberculosis
ggaauggcagcagccg

SEQ ID NO: 2853359 - RNA, 15 nt, Mycobacterium avium subsp. paratuberculosis
ggaaugucgcgcagc

SEQ ID NO: 2853360 - RNA, 16 nt, Mycobacterium avium subsp. paratuberculosis
ggaaugucgcgcagca

SEQ ID NO: 2853361 - RNA, 14 nt, Mycobacterium avium subsp. paratuberculosis
ggaaugucggcguu

SEQ ID NO: 2853362 - RNA, 18 nt, Mycobacterium avium subsp. paratuberculosis
ggaauucagugaggccag

SEQ ID NO: 2853363 - RNA, 22 nt, Mycobacterium avium subsp. paratuberculosis
ggacaggugcauccagucggcg

SEQ ID NO: 2853364 - RNA, 20 nt, Mycobacterium avium subsp. paratuberculosis
ggacaggugugggcguacgg

SEQ ID NO: 2853365 - RNA, 16 nt, Mycobacterium avium subsp. paratuberculosis
ggacagugcgggcucg

SEQ ID NO: 2853366 - RNA, 19 nt, Mycobacterium avium subsp. paratuberculosis
ggacaguucgguggggccg

SEQ ID NO: 2853367 - RNA, 22 nt, Mycobacterium avium subsp. paratuberculosis
ggacaguucgguggggccgccg

SEQ ID NO: 2853368 - RNA, 19 nt, Mycobacterium avium subsp. paratuberculosis
ggacaucgccucggcgucc

SEQ ID NO: 2853369 - RNA, 13 nt, Mycobacterium avium subsp. paratuberculosis
ggacaucggcagc

SEQ ID NO: 2853370 - RNA, 19 nt, Mycobacterium avium subsp. paratuberculosis
ggacaucggcagcagggug

SEQ ID NO: 2853371 - RNA, 13 nt, Mycobacterium avium subsp. paratuberculosis
ggacaucgucgcg

SEQ ID NO: 2853372 - RNA, 16 nt, Mycobacterium avium subsp. paratuberculosis
ggacaucuccggcacg

SEQ ID NO: 2853373 - RNA, 17 nt, Mycobacterium avium subsp. paratuberculosis
ggacaucuccggcacgu

SEQ ID NO: 2853374 - RNA, 21 nt, Mycobacterium avium subsp. paratuberculosis
ggacaugcagccgccgcggag

SEQ ID NO: 2853375 - RNA, 13 nt, Mycobacterium avium subsp. paratuberculosis
ggacaugccgagc

SEQ ID NO: 2853376 - RNA, 20 nt, Mycobacterium avium subsp. paratuberculosis
ggacaugccgagcagcaccg

SEQ ID NO: 2853377 - RNA, 21 nt, Mycobacterium avium subsp. paratuberculosis
ggacaugccgagcagcaccgc

SEQ ID NO: 2853378 - RNA, 17 nt, Mycobacterium avium subsp. paratuberculosis
ggacaugccggcgccga

SEQ ID NO: 2853379 - RNA, 16 nt, Mycobacterium avium subsp. paratuberculosis
ggacaugugagguggc

SEQ ID NO: 2853380 - RNA, 21 nt, Mycobacterium avium subsp. paratuberculosis
ggacauucacgaggccgggcu

SEQ ID NO: 2853381 - RNA, 22 nt, Mycobacterium avium subsp. paratuberculosis
ggacauucacgaggccgggcug

SEQ ID NO: 2853382 - RNA, 14 nt, Mycobacterium avium subsp. paratuberculosis
ggacauucggacgg

SEQ ID NO: 2853383 - RNA, 22 nt, Mycobacterium avium subsp. paratuberculosis
ggaccaccaggaaggucccggu

SEQ ID NO: 2853384 - RNA, 19 nt, Mycobacterium avium subsp. paratuberculosis
ggaccacccacucccagcc

SEQ ID NO: 2853385 - RNA, 15 nt, Mycobacterium avium subsp. paratuberculosis
ggaccacccaggugg

SEQ ID NO: 2853386 - RNA, 14 nt, Mycobacterium avium subsp. paratuberculosis
ggaccaccgcgugc

SEQ ID NO: 2853387 - RNA, 18 nt, Mycobacterium avium subsp. paratuberculosis
ggaccagcgccucggccu

SEQ ID NO: 2853388 - RNA, 15 nt, Mycobacterium avium subsp. paratuberculosis
ggaccagcgcggugc

SEQ ID NO: 2853389 - RNA, 22 nt, Mycobacterium avium subsp. paratuberculosis
ggaccagcgggucgauggcgac

SEQ ID NO: 2853390 - RNA, 15 nt, Mycobacterium avium subsp. paratuberculosis
ggaccagggcggugg

SEQ ID NO: 2853391 - RNA, 17 nt, Mycobacterium avium subsp. paratuberculosis
ggaccaggguggcccca

SEQ ID NO: 2853392 - RNA, 22 nt, Mycobacterium avium subsp. paratuberculosis
ggaccagguauucaucgcggcc

SEQ ID NO: 2853393 - RNA, 18 nt, Mycobacterium avium subsp. paratuberculosis
ggaccaucuacgaccucg

SEQ ID NO: 2853394 - RNA, 22 nt, Mycobacterium avium subsp. paratuberculosis
ggacccagcuccucggccagca

SEQ ID NO: 2853395 - RNA, 19 nt, Mycobacterium avium subsp. paratuberculosis
ggacccauucgucggcggu

SEQ ID NO: 2853396 - RNA, 19 nt, Mycobacterium avium subsp. paratuberculosis
ggaccccagugcaggcuga

SEQ ID NO: 2853397 - RNA, 16 nt, Mycobacterium avium subsp. paratuberculosis
ggacccccucggggcu

SEQ ID NO: 2853398 - RNA, 13 nt, Mycobacterium avium subsp. paratuberculosis
ggaccccgaugcg

SEQ ID NO: 2853399 - RNA, 20 nt, Mycobacterium avium subsp. paratuberculosis
ggacccgacggucgggccca

SEQ ID NO: 2853400 - RNA, 16 nt, Mycobacterium avium subsp. paratuberculosis
ggacccggaggcggcg

SEQ ID NO: 2853401 - RNA, 14 nt, Mycobacterium avium subsp. paratuberculosis
ggacccggcgagcg

SEQ ID NO: 2853402 - RNA, 16 nt, Mycobacterium avium subsp. paratuberculosis
ggacccguugggccag

SEQ ID NO: 2853403 - RNA, 17 nt, Mycobacterium avium subsp. paratuberculosis
ggacccuggccagcacc

SEQ ID NO: 2853404 - RNA, 18 nt, Mycobacterium avium subsp. paratuberculosis
ggacccuggccagcaccg

SEQ ID NO: 2853405 - RNA, 13 nt, Mycobacterium avium subsp. paratuberculosis
ggaccgagccgcg

SEQ ID NO: 2853406 - RNA, 14 nt, Mycobacterium avium subsp. paratuberculosis
ggaccgagccgcgc

SEQ ID NO: 2853407 - RNA, 15 nt, Mycobacterium avium subsp. paratuberculosis
ggaccgagccgcgcg

SEQ ID NO: 2853408 - RNA, 16 nt, Mycobacterium avium subsp. paratuberculosis
ggaccgagccgcgcgc

SEQ ID NO: 2853409 - RNA, 19 nt, Mycobacterium avium subsp. paratuberculosis
ggaccgagccgcgcgccga

SEQ ID NO: 2853410 - RNA, 15 nt, Mycobacterium avium subsp. paratuberculosis
ggaccgaggugccgc

SEQ ID NO: 2853411 - RNA, 16 nt, Mycobacterium avium subsp. paratuberculosis
ggaccgauccggcgcc

SEQ ID NO: 2853412 - RNA, 19 nt, Mycobacterium avium subsp. paratuberculosis
ggaccgauccggcgcccga

SEQ ID NO: 2853413 - RNA, 13 nt, Mycobacterium avium subsp. paratuberculosis
ggaccgccgcggc

SEQ ID NO: 2853414 - RNA, 16 nt, Mycobacterium avium subsp. paratuberculosis
ggaccgccgcggcggc

SEQ ID NO: 2853415 - RNA, 17 nt, Mycobacterium avium subsp. paratuberculosis
ggaccgccgcggcggcc

SEQ ID NO: 2853416 - RNA, 20 nt, Mycobacterium avium subsp. paratuberculosis
ggaccgccgcggcggccugc

SEQ ID NO: 2853417 - RNA, 14 nt, Mycobacterium avium subsp. paratuberculosis
ggaccgcgcagucg

SEQ ID NO: 2853418 - RNA, 15 nt, Mycobacterium avium subsp. paratuberculosis
ggaccgcgcagucgg

SEQ ID NO: 2853419 - RNA, 17 nt, Mycobacterium avium subsp. paratuberculosis
ggaccgcgcagucggcg

SEQ ID NO: 2853420 - RNA, 19 nt, Mycobacterium avium subsp. paratuberculosis
ggaccgcgcagucggcguc

SEQ ID NO: 2853421 - RNA, 14 nt, Mycobacterium avium subsp. paratuberculosis
ggaccgcgcgccgg

SEQ ID NO: 2853422 - RNA, 20 nt, Mycobacterium avium subsp. paratuberculosis
ggaccgcgcgccggccagca

SEQ ID NO: 2853423 - RNA, 15 nt, Mycobacterium avium subsp. paratuberculosis
ggaccgcgcgggcca

SEQ ID NO: 2853424 - RNA, 16 nt, Mycobacterium avium subsp. paratuberculosis
ggaccgcgcgggccag

SEQ ID NO: 2853425 - RNA, 18 nt, Mycobacterium avium subsp. paratuberculosis
ggaccgcgcgggccagcg

SEQ ID NO: 2853426 - RNA, 20 nt, Mycobacterium avium subsp. paratuberculosis
ggaccgcgcgggccagcgcc

SEQ ID NO: 2853427 - RNA, 14 nt, Mycobacterium avium subsp. paratuberculosis
ggaccgcgggcgca

SEQ ID NO: 2853428 - RNA, 20 nt, Mycobacterium avium subsp. paratuberculosis
ggaccgcggucgggucccgg

SEQ ID NO: 2853429 - RNA, 22 nt, Mycobacterium avium subsp. paratuberculosis
ggaccgcggucgggucccggca

SEQ ID NO: 2853430 - RNA, 18 nt, Mycobacterium avium subsp. paratuberculosis
ggaccgcuugacgccgcc

SEQ ID NO: 2853431 - RNA, 20 nt, Mycobacterium avium subsp. paratuberculosis
ggaccgcuugacgccgccga

SEQ ID NO: 2853432 - RNA, 23 nt, Mycobacterium avium subsp. paratuberculosis
ggaccggauccaccaauucgcgc

SEQ ID NO: 2853433 - RNA, 16 nt, Mycobacterium avium subsp. paratuberculosis
ggaccggccagcagcc

SEQ ID NO: 2853434 - RNA, 20 nt, Mycobacterium avium subsp. paratuberculosis
ggaccggccgugcgcgucga

SEQ ID NO: 2853435 - RNA, 15 nt, Mycobacterium avium subsp. paratuberculosis
ggaccggcgccggcc

SEQ ID NO: 2853436 - RNA, 17 nt, Mycobacterium avium subsp. paratuberculosis
ggaccggcgccggccgc

SEQ ID NO: 2853437 - RNA, 13 nt, Mycobacterium avium subsp. paratuberculosis
ggaccggcggccg

SEQ ID NO: 2853438 - RNA, 17 nt, Mycobacterium avium subsp. paratuberculosis
ggaccggcucguagcug

SEQ ID NO: 2853439 - RNA, 17 nt, Mycobacterium avium subsp. paratuberculosis
ggaccgggacgacggcg

SEQ ID NO: 2853440 - RNA, 22 nt, Mycobacterium avium subsp. paratuberculosis
ggaccgggacgacggcgccgcc

SEQ ID NO: 2853441 - RNA, 14 nt, Mycobacterium avium subsp. paratuberculosis
ggaccgggcccggc

SEQ ID NO: 2853442 - RNA, 17 nt, Mycobacterium avium subsp. paratuberculosis
ggaccgggcccggcgcc

SEQ ID NO: 2853443 - RNA, 13 nt, Mycobacterium avium subsp. paratuberculosis
ggaccgggcgggc

SEQ ID NO: 2853444 - RNA, 15 nt, Mycobacterium avium subsp. paratuberculosis
ggaccgggcgggcug

SEQ ID NO: 2853445 - RNA, 19 nt, Mycobacterium avium subsp. paratuberculosis
ggaccggggacuugacgau

SEQ ID NO: 2853446 - RNA, 15 nt, Mycobacterium avium subsp. paratuberculosis
ggaccgggugaccgg

SEQ ID NO: 2853447 - RNA, 18 nt, Mycobacterium avium subsp. paratuberculosis
ggaccgggugaccggcgc

SEQ ID NO: 2853448 - RNA, 13 nt, Mycobacterium avium subsp. paratuberculosis
ggacgcggccagc

SEQ ID NO: 2853449 - RNA, 15 nt, Mycobacterium avium subsp. paratuberculosis
ggacgcggccagcgc

SEQ ID NO: 2853450 - RNA, 19 nt, Mycobacterium avium subsp. paratuberculosis
ggacgcggccagcgcccgc

SEQ ID NO: 2853451 - RNA, 14 nt, Mycobacterium avium subsp. paratuberculosis
ggacgcggccgagc

SEQ ID NO: 2853452 - RNA, 19 nt, Mycobacterium avium subsp. paratuberculosis
ggacgcggccucaccgcgg

SEQ ID NO: 2853453 - RNA, 15 nt, Mycobacterium avium subsp. paratuberculosis
ggacgcggucgccgc

SEQ ID NO: 2853454 - RNA, 16 nt, Mycobacterium avium subsp. paratuberculosis
ggacgcggucgccgcc

SEQ ID NO: 2853455 - RNA, 19 nt, Mycobacterium avium subsp. paratuberculosis
ggacgcggucgccgcccac

SEQ ID NO: 2853456 - RNA, 17 nt, Mycobacterium avium subsp. paratuberculosis
ggacgcgguggugcucg

SEQ ID NO: 2853457 - RNA, 14 nt, Mycobacterium avium subsp. paratuberculosis
ggacgcugaacagc

SEQ ID NO: 2853458 - RNA, 19 nt, Mycobacterium avium subsp. paratuberculosis
ggacgcugaacagcccgag

SEQ ID NO: 2853459 - RNA, 21 nt, Mycobacterium avium subsp. paratuberculosis
ggacgcugaacagcccgagca

SEQ ID NO: 2853460 - RNA, 16 nt, Mycobacterium avium subsp. paratuberculosis
ggacggaaaucgccug

SEQ ID NO: 2853461 - RNA, 18 nt, Mycobacterium avium subsp. paratuberculosis
ggacggagccgugcccga

SEQ ID NO: 2853462 - RNA, 19 nt, Mycobacterium avium subsp. paratuberculosis
ggacggagccgugcccgag

SEQ ID NO: 2853463 - RNA, 22 nt, Mycobacterium avium subsp. paratuberculosis
ggacggaucgagucccgcgcgg

SEQ ID NO: 2853464 - RNA, 14 nt, Mycobacterium avium subsp. paratuberculosis
ggacggccagcagg

SEQ ID NO: 2853465 - RNA, 16 nt, Mycobacterium avium subsp. paratuberculosis
ggacggccagcagggc

SEQ ID NO: 2853466 - RNA, 17 nt, Mycobacterium avium subsp. paratuberculosis
ggacggccagcagggcg

SEQ ID NO: 2853467 - RNA, 12 nt, Mycobacterium avium subsp. paratuberculosis
ggacggcccgac

SEQ ID NO: 2853468 - RNA, 17 nt, Mycobacterium avium subsp. paratuberculosis
ggacggcccgacgacgc

SEQ ID NO: 2853469 - RNA, 21 nt, Mycobacterium avium subsp. paratuberculosis
ggacggcccgacgacgccguc

SEQ ID NO: 2853470 - RNA, 20 nt, Mycobacterium avium subsp. paratuberculosis
ggacggccgaaacgcccggc

SEQ ID NO: 2853471 - RNA, 18 nt, Mycobacterium avium subsp. paratuberculosis
ggacggcgaacuuggccg

SEQ ID NO: 2853472 - RNA, 12 nt, Mycobacterium avium subsp. paratuberculosis
ggacggcgacgg

SEQ ID NO: 2853473 - RNA, 17 nt, Mycobacterium avium subsp. paratuberculosis
ggacggcgacggcagcg

SEQ ID NO: 2853474 - RNA, 23 nt, Mycobacterium avium subsp. paratuberculosis
ggacggcgagcggcccugcgcgg

SEQ ID NO: 2853475 - RNA, 16 nt, Mycobacterium avium subsp. paratuberculosis
ggacggcgcgguggcg

SEQ ID NO: 2853476 - RNA, 20 nt, Mycobacterium avium subsp. paratuberculosis
ggacggcgcgguggcgugca

SEQ ID NO: 2853477 - RNA, 19 nt, Mycobacterium avium subsp. paratuberculosis
ggacggcuuggguguggcg

SEQ ID NO: 2853478 - RNA, 23 nt, Mycobacterium avium subsp. paratuberculosis
ggacgggaccacccgcagcgcgg

SEQ ID NO: 2853479 - RNA, 15 nt, Mycobacterium avium subsp. paratuberculosis
ggacgggaucggcgc

SEQ ID NO: 2853480 - RNA, 19 nt, Mycobacterium avium subsp. paratuberculosis
ggacgggcauccggcucag

SEQ ID NO: 2853481 - RNA, 22 nt, Mycobacterium avium subsp. paratuberculosis
ggacgggcauccggcucagaag

SEQ ID NO: 2853482 - RNA, 20 nt, Mycobacterium avium subsp. paratuberculosis
ggacgggccuagugccgggg

SEQ ID NO: 2853483 - RNA, 14 nt, Mycobacterium avium subsp. paratuberculosis
ggacggggcgaugc

SEQ ID NO: 2853484 - RNA, 17 nt, Mycobacterium avium subsp. paratuberculosis
ggacgggggugccgacc

SEQ ID NO: 2853485 - RNA, 15 nt, Mycobacterium avium subsp. paratuberculosis
ggacgggucgaccgc

SEQ ID NO: 2853486 - RNA, 16 nt, Mycobacterium avium subsp. paratuberculosis
ggacgggucggcggcg

SEQ ID NO: 2853487 - RNA, 17 nt, Mycobacterium avium subsp. paratuberculosis
ggacggguugcaggcca

SEQ ID NO: 2853488 - RNA, 17 nt, Mycobacterium avium subsp. paratuberculosis
ggacggguugggcgcca

SEQ ID NO: 2853489 - RNA, 15 nt, Mycobacterium avium subsp. paratuberculosis
ggacggucagcgcgc

SEQ ID NO: 2853490 - RNA, 13 nt, Mycobacterium avium subsp. paratuberculosis
ggacggucgccga

SEQ ID NO: 2853491 - RNA, 12 nt, Mycobacterium avium subsp. paratuberculosis
ggacggugcagc

SEQ ID NO: 2853492 - RNA, 13 nt, Mycobacterium avium subsp. paratuberculosis
ggacggugcagcc

SEQ ID NO: 2853493 - RNA, 15 nt, Mycobacterium avium subsp. paratuberculosis
ggacggugcagccgg

SEQ ID NO: 2853494 - RNA, 17 nt, Mycobacterium avium subsp. paratuberculosis
ggacggugcagccgggg

SEQ ID NO: 2853495 - RNA, 15 nt, Mycobacterium avium subsp. paratuberculosis
ggacgguuucaccgc

SEQ ID NO: 2853496 - RNA, 19 nt, Mycobacterium avium subsp. paratuberculosis
ggacgguuucaccgccguc

SEQ ID NO: 2853497 - RNA, 19 nt, Mycobacterium avium subsp. paratuberculosis
ggacgguuucugccggccg

SEQ ID NO: 2853498 - RNA, 20 nt, Mycobacterium avium subsp. paratuberculosis
ggacgguuucugccggccgc

SEQ ID NO: 2853499 - RNA, 21 nt, Mycobacterium avium subsp. paratuberculosis
ggacgguuucugccggccgcc

SEQ ID NO: 2853500 - RNA, 24 nt, Mycobacterium avium subsp. paratuberculosis
ggacgucagcccgcgucgcgcagc

SEQ ID NO: 2853501 - RNA, 14 nt, Mycobacterium avium subsp. paratuberculosis
ggacgucaggccgg

SEQ ID NO: 2853502 - RNA, 17 nt, Mycobacterium avium subsp. paratuberculosis
ggacgucaggccgguca

SEQ ID NO: 2853503 - RNA, 18 nt, Mycobacterium avium subsp. paratuberculosis
ggacgucaggccggucag

SEQ ID NO: 2853504 - RNA, 18 nt, Mycobacterium avium subsp. paratuberculosis
ggacguccagcggcccuc

SEQ ID NO: 2853505 - RNA, 14 nt, Mycobacterium avium subsp. paratuberculosis
ggacguccgcgcga

SEQ ID NO: 2853506 - RNA, 20 nt, Mycobacterium avium subsp. paratuberculosis
ggacgucgacgugggcggcc

SEQ ID NO: 2853507 - RNA, 14 nt, Mycobacterium avium subsp. paratuberculosis
ggacgucggccggc

SEQ ID NO: 2853508 - RNA, 21 nt, Mycobacterium avium subsp. paratuberculosis
ggacgucggccggcugcagcc

SEQ ID NO: 2853509 - RNA, 14 nt, Mycobacterium avium subsp. paratuberculosis
ggacgucggcgcgc

SEQ ID NO: 2853510 - RNA, 12 nt, Mycobacterium avium subsp. paratuberculosis
ggacgucgucga

SEQ ID NO: 2853511 - RNA, 14 nt, Mycobacterium avium subsp. paratuberculosis
ggacgucgucgacg

SEQ ID NO: 2853512 - RNA, 15 nt, Mycobacterium avium subsp. paratuberculosis
ggacgucgucgacgu

SEQ ID NO: 2853513 - RNA, 16 nt, Mycobacterium avium subsp. paratuberculosis
ggacgucgucgacguc

SEQ ID NO: 2853514 - RNA, 12 nt, Mycobacterium avium subsp. paratuberculosis
ggacgucgucgc

SEQ ID NO: 2853515 - RNA, 13 nt, Mycobacterium avium subsp. paratuberculosis
ggacgucgucgcu

SEQ ID NO: 2853516 - RNA, 12 nt, Mycobacterium avium subsp. paratuberculosis
ggacgucgucgu

SEQ ID NO: 2853517 - RNA, 16 nt, Mycobacterium avium subsp. paratuberculosis
ggacgucgucguccca

SEQ ID NO: 2853518 - RNA, 13 nt, Mycobacterium avium subsp. paratuberculosis
ggacgugaucgcg

SEQ ID NO: 2853519 - RNA, 15 nt, Mycobacterium avium subsp. paratuberculosis
ggacgugaucgcggu

SEQ ID NO: 2853520 - RNA, 16 nt, Mycobacterium avium subsp. paratuberculosis
ggacgugaucgcggug

SEQ ID NO: 2853521 - RNA, 17 nt, Mycobacterium avium subsp. paratuberculosis
ggacgugcacgcguucg

SEQ ID NO: 2853522 - RNA, 18 nt, Mycobacterium avium subsp. paratuberculosis
ggacguggcucagcggca

SEQ ID NO: 2853523 - RNA, 13 nt, Mycobacterium avium subsp. paratuberculosis
ggacgugucgggg

SEQ ID NO: 2853524 - RNA, 18 nt, Mycobacterium avium subsp. paratuberculosis
ggacguugaggcggcggc

SEQ ID NO: 2853525 - RNA, 19 nt, Mycobacterium avium subsp. paratuberculosis
ggacguugaggcggcggcg

SEQ ID NO: 2853526 - RNA, 21 nt, Mycobacterium avium subsp. paratuberculosis
ggacguuggggugguuguuga

SEQ ID NO: 2853527 - RNA, 18 nt, Mycobacterium avium subsp. paratuberculosis
ggacucaaucggucaggg

SEQ ID NO: 2853528 - RNA, 17 nt, Mycobacterium avium subsp. paratuberculosis
ggacuccaccgccaccg

SEQ ID NO: 2853529 - RNA, 15 nt, Mycobacterium avium subsp. paratuberculosis
ggacuccagcaccag

SEQ ID NO: 2853530 - RNA, 17 nt, Mycobacterium avium subsp. paratuberculosis
ggacuccagcaccagca

SEQ ID NO: 2853531 - RNA, 19 nt, Mycobacterium avium subsp. paratuberculosis
ggacuccagcaccagcacg

SEQ ID NO: 2853532 - RNA, 14 nt, Mycobacterium avium subsp. paratuberculosis
ggacucccccacca

SEQ ID NO: 2853533 - RNA, 23 nt, Mycobacterium avium subsp. paratuberculosis
ggagccguccggguucgacgccu

SEQ ID NO: 2853534 - RNA, 22 nt, Mycobacterium avium subsp. paratuberculosis
ggagccgucggcuuccuccucg

SEQ ID NO: 2853535 - RNA, 17 nt, Mycobacterium avium subsp. paratuberculosis
ggagccgugcagcgccc

SEQ ID NO: 2853536 - RNA, 18 nt, Mycobacterium avium subsp. paratuberculosis
ggagccgugcagcgccca

SEQ ID NO: 2853537 - RNA, 20 nt, Mycobacterium avium subsp. paratuberculosis
ggagccgugcagcgcccagc

SEQ ID NO: 2853538 - RNA, 21 nt, Mycobacterium avium subsp. paratuberculosis
ggagccgugcagcgcccagcc

SEQ ID NO: 2853539 - RNA, 17 nt, Mycobacterium avium subsp. paratuberculosis
ggagccuucuucgccgc

SEQ ID NO: 2853540 - RNA, 21 nt, Mycobacterium avium subsp. paratuberculosis
ggagccuucuucgccgcagcc

SEQ ID NO: 2853541 - RNA, 18 nt, Mycobacterium avium subsp. paratuberculosis
ggagccuugcuggcggcc

SEQ ID NO: 2853542 - RNA, 17 nt, Mycobacterium avium subsp. paratuberculosis
ggagccuuggucgcggc

SEQ ID NO: 2853543 - RNA, 19 nt, Mycobacterium avium subsp. paratuberculosis
ggagccuuggucgcggccu

SEQ ID NO: 2853544 - RNA, 16 nt, Mycobacterium avium subsp. paratuberculosis
ggagcgaaggugccgc

SEQ ID NO: 2853545 - RNA, 17 nt, Mycobacterium avium subsp. paratuberculosis
ggagcgaaggugccgcg

SEQ ID NO: 2853546 - RNA, 22 nt, Mycobacterium avium subsp. paratuberculosis
ggagcgccccagggccucggcg

SEQ ID NO: 2853547 - RNA, 15 nt, Mycobacterium avium subsp. paratuberculosis
ggagcgcccggccag

SEQ ID NO: 2853548 - RNA, 17 nt, Mycobacterium avium subsp. paratuberculosis
ggagcgcccggccagcc

SEQ ID NO: 2853549 - RNA, 17 nt, Mycobacterium avium subsp. paratuberculosis
ggagcgcggcaugccgc

SEQ ID NO: 2853550 - RNA, 22 nt, Mycobacterium avium subsp. paratuberculosis
ggagcgcggcaugccgcccggg

SEQ ID NO: 2853551 - RNA, 18 nt, Mycobacterium avium subsp. paratuberculosis
ggagcgcgguccacggug

SEQ ID NO: 2853552 - RNA, 16 nt, Mycobacterium avium subsp. paratuberculosis
ggagcgcuggucggcg

SEQ ID NO: 2853553 - RNA, 13 nt, Mycobacterium avium subsp. paratuberculosis
ggagcggauggcg

SEQ ID NO: 2853554 - RNA, 13 nt, Mycobacterium avium subsp. paratuberculosis
ggagcggcccaac

SEQ ID NO: 2853555 - RNA, 22 nt, Mycobacterium avium subsp. paratuberculosis
ggagcggcccaacacgcccugc

SEQ ID NO: 2853556 - RNA, 17 nt, Mycobacterium avium subsp. paratuberculosis
ggagcggcccagcucgg

SEQ ID NO: 2853557 - RNA, 18 nt, Mycobacterium avium subsp. paratuberculosis
ggagcggcggaggggccc

SEQ ID NO: 2853558 - RNA, 14 nt, Mycobacterium avium subsp. paratuberculosis
ggagcgggccacgc

SEQ ID NO: 2853559 - RNA, 15 nt, Mycobacterium avium subsp. paratuberculosis
ggagcgggccacgca

SEQ ID NO: 2853560 - RNA, 14 nt, Mycobacterium avium subsp. paratuberculosis
ggagcgggucagcg

SEQ ID NO: 2853561 - RNA, 20 nt, Mycobacterium avium subsp. paratuberculosis
ggagcggugcggcucgggcg

SEQ ID NO: 2853562 - RNA, 23 nt, Mycobacterium avium subsp. paratuberculosis
ggagcggugcggcucgggcggug

SEQ ID NO: 2853563 - RNA, 16 nt, Mycobacterium avium subsp. paratuberculosis
ggagcuaggcggccgg

SEQ ID NO: 2853564 - RNA, 17 nt, Mycobacterium avium subsp. paratuberculosis
ggagcuaggcggccggg

SEQ ID NO: 2853565 - RNA, 21 nt, Mycobacterium avium subsp. paratuberculosis
ggagcuaggcggccgggcggc

SEQ ID NO: 2853566 - RNA, 17 nt, Mycobacterium avium subsp. paratuberculosis
ggagcugcccgcacugg

SEQ ID NO: 2853567 - RNA, 17 nt, Mycobacterium avium subsp. paratuberculosis
ggagcugccggcgacca

SEQ ID NO: 2853568 - RNA, 13 nt, Mycobacterium avium subsp. paratuberculosis
ggagcugcgcgcc

SEQ ID NO: 2853569 - RNA, 20 nt, Mycobacterium avium subsp. paratuberculosis
ggaggaagugcacgccgagg

SEQ ID NO: 2853570 - RNA, 22 nt, Mycobacterium avium subsp. paratuberculosis
ggaggaagugcacgccgaggcg

SEQ ID NO: 2853571 - RNA, 19 nt, Mycobacterium avium subsp. paratuberculosis
ggaggaauucgccgacgcg

SEQ ID NO: 2853572 - RNA, 22 nt, Mycobacterium avium subsp. paratuberculosis
ggaggacaagucaugccgcgcu

SEQ ID NO: 2853573 - RNA, 13 nt, Mycobacterium avium subsp. paratuberculosis
ggaggacagcacc

SEQ ID NO: 2853574 - RNA, 14 nt, Mycobacterium avium subsp. paratuberculosis
ggaggacagcaccg

SEQ ID NO: 2853575 - RNA, 15 nt, Mycobacterium avium subsp. paratuberculosis
ggaggacgaggcccg

SEQ ID NO: 2853576 - RNA, 14 nt, Mycobacterium avium subsp. paratuberculosis
ggaggcacuggcgc

SEQ ID NO: 2853577 - RNA, 15 nt, Mycobacterium avium subsp. paratuberculosis
ggaggcacuggcgcu

SEQ ID NO: 2853578 - RNA, 13 nt, Mycobacterium avium subsp. paratuberculosis
ggaggcagcgcgg

SEQ ID NO: 2853579 - RNA, 14 nt, Mycobacterium avium subsp. paratuberculosis
ggaggcagcgcgga

SEQ ID NO: 2853580 - RNA, 13 nt, Mycobacterium avium subsp. paratuberculosis
ggaggccaccgcg

SEQ ID NO: 2853581 - RNA, 14 nt, Mycobacterium avium subsp. paratuberculosis
ggaggccaccgcgc

SEQ ID NO: 2853582 - RNA, 23 nt, Mycobacterium avium subsp. paratuberculosis
ggaggccagcaccuucagcgggc

SEQ ID NO: 2853583 - RNA, 14 nt, Mycobacterium avium subsp. paratuberculosis
ggaggccagcucga

SEQ ID NO: 2853584 - RNA, 16 nt, Mycobacterium avium subsp. paratuberculosis
ggaggccagcucgacc

SEQ ID NO: 2853585 - RNA, 22 nt, Mycobacterium avium subsp. paratuberculosis
ggaggccagcucgaccgcggcg

SEQ ID NO: 2853586 - RNA, 20 nt, Mycobacterium avium subsp. paratuberculosis
ggaggcccagcccgccgcgu

SEQ ID NO: 2853587 - RNA, 22 nt, Mycobacterium avium subsp. paratuberculosis
ggaggccgcggcgacacccagc

SEQ ID NO: 2853588 - RNA, 12 nt, Mycobacterium avium subsp. paratuberculosis
ggaggccugcgc

SEQ ID NO: 2853589 - RNA, 20 nt, Mycobacterium avium subsp. paratuberculosis
ggaggccugcgcggccgcgu

SEQ ID NO: 2853590 - RNA, 22 nt, Mycobacterium avium subsp. paratuberculosis
ggaggccugcgcggccgcgucg

SEQ ID NO: 2853591 - RNA, 18 nt, Mycobacterium avium subsp. paratuberculosis
ggaggcgagcagccgggu

SEQ ID NO: 2853592 - RNA, 20 nt, Mycobacterium avium subsp. paratuberculosis
ggaggcgagcagccgggugc

SEQ ID NO: 2853593 - RNA, 23 nt, Mycobacterium avium subsp. paratuberculosis
ggaggcgagcagccgggugccca

SEQ ID NO: 2853594 - RNA, 19 nt, Mycobacterium avium subsp. paratuberculosis
ggaggcgaucagguggggc

SEQ ID NO: 2853595 - RNA, 16 nt, Mycobacterium avium subsp. paratuberculosis
ggaggcgaugcggguc

SEQ ID NO: 2853596 - RNA, 21 nt, Mycobacterium avium subsp. paratuberculosis
ggaggcgcacaacgaggcccg

SEQ ID NO: 2853597 - RNA, 15 nt, Mycobacterium avium subsp. paratuberculosis
ggaggcggccaacaa

SEQ ID NO: 2853598 - RNA, 15 nt, Mycobacterium avium subsp. paratuberculosis
ggaggcggcgggggc

SEQ ID NO: 2853599 - RNA, 12 nt, Mycobacterium avium subsp. paratuberculosis
ggaggcggcggu

SEQ ID NO: 2853600 - RNA, 11 nt, Mycobacterium avium subsp. paratuberculosis
ggaggcggcgu

SEQ ID NO: 2853601 - RNA, 20 nt, Mycobacterium avium subsp. paratuberculosis
ggaggcuucgcucaucccua

SEQ ID NO: 2853602 - RNA, 20 nt, Mycobacterium avium subsp. paratuberculosis
ggagggagcacucgauggcg

SEQ ID NO: 2853603 - RNA, 23 nt, Mycobacterium avium subsp. paratuberculosis
ggagggagcacucgauggcggcg

SEQ ID NO: 2853604 - RNA, 13 nt, Mycobacterium avium subsp. paratuberculosis
ggagggccagggc

SEQ ID NO: 2853605 - RNA, 14 nt, Mycobacterium avium subsp. paratuberculosis
ggaggggucggugc

SEQ ID NO: 2853606 - RNA, 16 nt, Mycobacterium avium subsp. paratuberculosis
ggagggucgguggccc

SEQ ID NO: 2853607 - RNA, 18 nt, Mycobacterium avium subsp. paratuberculosis
ggagggucgguggcccag

SEQ ID NO: 2853608 - RNA, 19 nt, Mycobacterium avium subsp. paratuberculosis
ggagggucgguggcccagc

SEQ ID NO: 2853609 - RNA, 16 nt, Mycobacterium avium subsp. paratuberculosis
ggagggugucggcggg

SEQ ID NO: 2853610 - RNA, 18 nt, Mycobacterium avium subsp. paratuberculosis
ggagggugucggcggggc

SEQ ID NO: 2853611 - RNA, 21 nt, Mycobacterium avium subsp. paratuberculosis
ggaggguuuucggggcgugug

SEQ ID NO: 2853612 - RNA, 14 nt, Mycobacterium avium subsp. paratuberculosis
ggaggucagcaggg

SEQ ID NO: 2853613 - RNA, 17 nt, Mycobacterium avium subsp. paratuberculosis
ggaggucauggcgaccg

SEQ ID NO: 2853614 - RNA, 18 nt, Mycobacterium avium subsp. paratuberculosis
ggaggucauggcgaccgc

SEQ ID NO: 2853615 - RNA, 22 nt, Mycobacterium avium subsp. paratuberculosis
ggaggucgcggauacgcccggc

SEQ ID NO: 2853616 - RNA, 19 nt, Mycobacterium avium subsp. paratuberculosis
ggaggucgucgcguccagc

SEQ ID NO: 2853617 - RNA, 20 nt, Mycobacterium avium subsp. paratuberculosis
ggauccgcccgccgguggcc

SEQ ID NO: 2853618 - RNA, 22 nt, Mycobacterium avium subsp. paratuberculosis
ggauccgcccgccgguggccgc

SEQ ID NO: 2853619 - RNA, 16 nt, Mycobacterium avium subsp. paratuberculosis
ggauccgccugcgcgg

SEQ ID NO: 2853620 - RNA, 21 nt, Mycobacterium avium subsp. paratuberculosis
ggauccgccugcgcgggcgcg

SEQ ID NO: 2853621 - RNA, 16 nt, Mycobacterium avium subsp. paratuberculosis
ggauccgcucgacgag

SEQ ID NO: 2853622 - RNA, 20 nt, Mycobacterium avium subsp. paratuberculosis
ggauccggacgaccugggcg

SEQ ID NO: 2853623 - RNA, 23 nt, Mycobacterium avium subsp. paratuberculosis
ggauccggacgaccugggcgccg

SEQ ID NO: 2853624 - RNA, 18 nt, Mycobacterium avium subsp. paratuberculosis
ggauccggauugccgggc

SEQ ID NO: 2853625 - RNA, 19 nt, Mycobacterium avium subsp. paratuberculosis
ggauccggauugccgggca

SEQ ID NO: 2853626 - RNA, 22 nt, Mycobacterium avium subsp. paratuberculosis
ggauccggauugccgggcagcg

SEQ ID NO: 2853627 - RNA, 15 nt, Mycobacterium avium subsp. paratuberculosis
ggauccggcgcgccg

SEQ ID NO: 2853628 - RNA, 15 nt, Mycobacterium avium subsp. paratuberculosis
ggauccgggccgccu

SEQ ID NO: 2853629 - RNA, 23 nt, Mycobacterium avium subsp. paratuberculosis
ggauccgggccggcgucgcggug

SEQ ID NO: 2853630 - RNA, 15 nt, Mycobacterium avium subsp. paratuberculosis
ggauccgggcgccgg

SEQ ID NO: 2853631 - RNA, 16 nt, Mycobacterium avium subsp. paratuberculosis
ggauccgucgccccgc

SEQ ID NO: 2853632 - RNA, 20 nt, Mycobacterium avium subsp. paratuberculosis
ggauccgucgccccgcaccg

SEQ ID NO: 2853633 - RNA, 14 nt, Mycobacterium avium subsp. paratuberculosis
ggauccgucgcuac

SEQ ID NO: 2853634 - RNA, 13 nt, Mycobacterium avium subsp. paratuberculosis
ggauccucgccgc

SEQ ID NO: 2853635 - RNA, 14 nt, Mycobacterium avium subsp. paratuberculosis
ggaucgaacagggc

SEQ ID NO: 2853636 - RNA, 18 nt, Mycobacterium avium subsp. paratuberculosis
ggaucgaacagggcggcg

SEQ ID NO: 2853637 - RNA, 20 nt, Mycobacterium avium subsp. paratuberculosis
ggaucgaacagggcggcggg

SEQ ID NO: 2853638 - RNA, 21 nt, Mycobacterium avium subsp. paratuberculosis
ggaucgaacagggcggcgggc

SEQ ID NO: 2853639 - RNA, 16 nt, Mycobacterium avium subsp. paratuberculosis
ggaucgaaggcgugcu

SEQ ID NO: 2853640 - RNA, 18 nt, Mycobacterium avium subsp. paratuberculosis
ggaucgaauccggcggcg

SEQ ID NO: 2853641 - RNA, 23 nt, Mycobacterium avium subsp. paratuberculosis
ggaucgacaacgcgugaugcagc

SEQ ID NO: 2853642 - RNA, 13 nt, Mycobacterium avium subsp. paratuberculosis
ggaucgacgucga

SEQ ID NO: 2853643 - RNA, 17 nt, Mycobacterium avium subsp. paratuberculosis
ggaucgacuccgggugg

SEQ ID NO: 2853644 - RNA, 13 nt, Mycobacterium avium subsp. paratuberculosis
ggaucgagcaccc

SEQ ID NO: 2853645 - RNA, 14 nt, Mycobacterium avium subsp. paratuberculosis
ggaucgagccggcc

SEQ ID NO: 2853646 - RNA, 15 nt, Mycobacterium avium subsp. paratuberculosis
ggaucgagcgcaccg

SEQ ID NO: 2853647 - RNA, 21 nt, Mycobacterium avium subsp. paratuberculosis
ggaucgcaggauggccugcac

SEQ ID NO: 2853648 - RNA, 17 nt, Mycobacterium avium subsp. paratuberculosis
ggaucgcccacccgcac

SEQ ID NO: 2853649 - RNA, 20 nt, Mycobacterium avium subsp. paratuberculosis
ggaucgcccauuugccggug

SEQ ID NO: 2853650 - RNA, 18 nt, Mycobacterium avium subsp. paratuberculosis
ggaucgccggacagcggg

SEQ ID NO: 2853651 - RNA, 16 nt, Mycobacterium avium subsp. paratuberculosis
ggaucgcgcagccgcg

SEQ ID NO: 2853652 - RNA, 20 nt, Mycobacterium avium subsp. paratuberculosis
ggaucgcgccuugggccauc

SEQ ID NO: 2853653 - RNA, 18 nt, Mycobacterium avium subsp. paratuberculosis
ggaucgcgcugaccaggc

SEQ ID NO: 2853654 - RNA, 16 nt, Mycobacterium avium subsp. paratuberculosis
ggaucgcggccacgcc

SEQ ID NO: 2853655 - RNA, 12 nt, Mycobacterium avium subsp. paratuberculosis
ggaucgcggcgg

SEQ ID NO: 2853656 - RNA, 14 nt, Mycobacterium avium subsp. paratuberculosis
ggaucgcggcgguc

SEQ ID NO: 2853657 - RNA, 17 nt, Mycobacterium avium subsp. paratuberculosis
ggaucgcgggcgacccg

SEQ ID NO: 2853658 - RNA, 20 nt, Mycobacterium avium subsp. paratuberculosis
ggaucgcgggcgacccgcug

SEQ ID NO: 2853659 - RNA, 11 nt, Mycobacterium avium subsp. paratuberculosis
ggaucgcggug

SEQ ID NO: 2853660 - RNA, 20 nt, Mycobacterium avium subsp. paratuberculosis
ggaucgcgugcgucacgcug

SEQ ID NO: 2853661 - RNA, 16 nt, Mycobacterium avium subsp. paratuberculosis
ggaucgcuucggccag

SEQ ID NO: 2853662 - RNA, 17 nt, Mycobacterium avium subsp. paratuberculosis
ggaucgcuucggccagc

SEQ ID NO: 2853663 - RNA, 22 nt, Mycobacterium avium subsp. paratuberculosis
ggaucgcuugaccagcaacacc

SEQ ID NO: 2853664 - RNA, 14 nt, Mycobacterium avium subsp. paratuberculosis
ggaucggaccgcac

SEQ ID NO: 2853665 - RNA, 16 nt, Mycobacterium avium subsp. paratuberculosis
ggaucggaccgcacca

SEQ ID NO: 2853666 - RNA, 13 nt, Mycobacterium avium subsp. paratuberculosis
ggaucggccagca

SEQ ID NO: 2853667 - RNA, 13 nt, Mycobacterium avium subsp. paratuberculosis
ggaucggcccgau

SEQ ID NO: 2853668 - RNA, 13 nt, Mycobacterium avium subsp. paratuberculosis
ggaucggccggcg

SEQ ID NO: 2853669 - RNA, 18 nt, Mycobacterium avium subsp. paratuberculosis
ggaucggcgcccaccgcg

SEQ ID NO: 2853670 - RNA, 12 nt, Mycobacterium avium subsp. paratuberculosis
ggaucggcggcg

SEQ ID NO: 2853671 - RNA, 19 nt, Mycobacterium avium subsp. paratuberculosis
ggaucggcggcgacggcga

SEQ ID NO: 2853672 - RNA, 18 nt, Mycobacterium avium subsp. paratuberculosis
ggaucggcgggacccgcg

SEQ ID NO: 2853673 - RNA, 16 nt, Mycobacterium avium subsp. paratuberculosis
ggaucggcgggcgccg

SEQ ID NO: 2853674 - RNA, 19 nt, Mycobacterium avium subsp. paratuberculosis
ggaucggcgggcgccgaau

SEQ ID NO: 2853675 - RNA, 23 nt, Mycobacterium avium subsp. paratuberculosis
ggaucggcuagcagcuccggucg

SEQ ID NO: 2853676 - RNA, 17 nt, Mycobacterium avium subsp. paratuberculosis
ggaucggcugcgggcca

SEQ ID NO: 2853677 - RNA, 18 nt, Mycobacterium avium subsp. paratuberculosis
ggaucggcugcgggccag

SEQ ID NO: 2853678 - RNA, 22 nt, Mycobacterium avium subsp. paratuberculosis
ggaucggcuuggugggcgccgg

SEQ ID NO: 2853679 - RNA, 16 nt, Mycobacterium avium subsp. paratuberculosis
ggaucgggaccgggaa

SEQ ID NO: 2853680 - RNA, 18 nt, Mycobacterium avium subsp. paratuberculosis
ggaucgggaccgggaagc

SEQ ID NO: 2853681 - RNA, 19 nt, Mycobacterium avium subsp. paratuberculosis
ggaucgggcgguccaccga

SEQ ID NO: 2853682 - RNA, 15 nt, Mycobacterium avium subsp. paratuberculosis
ggaucggggugccgc

SEQ ID NO: 2853683 - RNA, 18 nt, Mycobacterium avium subsp. paratuberculosis
ggaucggggugccgccgg

SEQ ID NO: 2853684 - RNA, 22 nt, Mycobacterium avium subsp. paratuberculosis
ggaucgguaacugcguguggcg

SEQ ID NO: 2853685 - RNA, 14 nt, Mycobacterium avium subsp. paratuberculosis
ggaucggugcaggc

SEQ ID NO: 2853686 - RNA, 19 nt, Mycobacterium avium subsp. paratuberculosis
ggaucgguggacgcggucg

SEQ ID NO: 2853687 - RNA, 23 nt, Mycobacterium avium subsp. paratuberculosis
ggaucgguggacgcggucgccgc

SEQ ID NO: 2853688 - RNA, 13 nt, Mycobacterium avium subsp. paratuberculosis
ggaucgucaccga

SEQ ID NO: 2853689 - RNA, 23 nt, Mycobacterium avium subsp. paratuberculosis
ggaucgucaccgaccccucggcg

SEQ ID NO: 2853690 - RNA, 16 nt, Mycobacterium avium subsp. paratuberculosis
ggaucgucgccgggcu

SEQ ID NO: 2853691 - RNA, 18 nt, Mycobacterium avium subsp. paratuberculosis
ggaucgugucccggcgcc

SEQ ID NO: 2853692 - RNA, 16 nt, Mycobacterium avium subsp. paratuberculosis
ggaucguguggccgcc

SEQ ID NO: 2853693 - RNA, 12 nt, Mycobacterium avium subsp. paratuberculosis
ggaucuccagca

SEQ ID NO: 2853694 - RNA, 15 nt, Mycobacterium avium subsp. paratuberculosis
ggaucucccgggugg

SEQ ID NO: 2853695 - RNA, 16 nt, Mycobacterium avium subsp. paratuberculosis
ggaucuccggccggug

SEQ ID NO: 2853696 - RNA, 20 nt, Mycobacterium avium subsp. paratuberculosis
ggaucucgaccucgucggcg

SEQ ID NO: 2853697 - RNA, 23 nt, Mycobacterium avium subsp. paratuberculosis
ggaucucgaccucgucggcggcg

SEQ ID NO: 2853698 - RNA, 13 nt, Mycobacterium avium subsp. paratuberculosis
ggaucucgcgggc

SEQ ID NO: 2853699 - RNA, 15 nt, Mycobacterium avium subsp. paratuberculosis
ggaucucgcgggccc

SEQ ID NO: 2853700 - RNA, 23 nt, Mycobacterium avium subsp. paratuberculosis
ggaucucgucgggaaugucggcg

SEQ ID NO: 2853701 - RNA, 21 nt, Mycobacterium avium subsp. paratuberculosis
ggaucugcacgucggcggccg

SEQ ID NO: 2853702 - RNA, 17 nt, Mycobacterium avium subsp. paratuberculosis
ggauggcguucugcacc

SEQ ID NO: 2853703 - RNA, 20 nt, Mycobacterium avium subsp. paratuberculosis
ggauggggucgcgggcgccg

SEQ ID NO: 2853704 - RNA, 14 nt, Mycobacterium avium subsp. paratuberculosis
ggaugguccccggg

SEQ ID NO: 2853705 - RNA, 18 nt, Mycobacterium avium subsp. paratuberculosis
ggaugguccgcaugucga

SEQ ID NO: 2853706 - RNA, 20 nt, Mycobacterium avium subsp. paratuberculosis
ggauggugcccaccgggcag

SEQ ID NO: 2853707 - RNA, 17 nt, Mycobacterium avium subsp. paratuberculosis
ggauguagccgccggug

SEQ ID NO: 2853708 - RNA, 18 nt, Mycobacterium avium subsp. paratuberculosis
ggauguccaggccgucga

SEQ ID NO: 2853709 - RNA, 22 nt, Mycobacterium avium subsp. paratuberculosis
ggauguccaggccgucgaggcg

SEQ ID NO: 2853710 - RNA, 16 nt, Mycobacterium avium subsp. paratuberculosis
ggauguccuacggcgg

SEQ ID NO: 2853711 - RNA, 17 nt, Mycobacterium avium subsp. paratuberculosis
ggaugucgacgacaccc

SEQ ID NO: 2853712 - RNA, 19 nt, Mycobacterium avium subsp. paratuberculosis
ggaugucgacgaugcgcug

SEQ ID NO: 2853713 - RNA, 20 nt, Mycobacterium avium subsp. paratuberculosis
ggaugucggacucgcgccgg

SEQ ID NO: 2853714 - RNA, 16 nt, Mycobacterium avium subsp. paratuberculosis
ggaugucgggcgaggu

SEQ ID NO: 2853715 - RNA, 20 nt, Mycobacterium avium subsp. paratuberculosis
ggaugucguaggcgcggucg

SEQ ID NO: 2853716 - RNA, 21 nt, Mycobacterium avium subsp. paratuberculosis
ggaugugacgcgggaccgggc

SEQ ID NO: 2853717 - RNA, 20 nt, Mycobacterium avium subsp. paratuberculosis
ggaugugccuggcccagaca

SEQ ID NO: 2853718 - RNA, 19 nt, Mycobacterium avium subsp. paratuberculosis
ggauguggcaucaccgccu

SEQ ID NO: 2853719 - RNA, 13 nt, Mycobacterium avium subsp. paratuberculosis
ggauguggucggc

SEQ ID NO: 2853720 - RNA, 18 nt, Mycobacterium avium subsp. paratuberculosis
ggauguucaccccggcgc

SEQ ID NO: 2853721 - RNA, 13 nt, Mycobacterium avium subsp. paratuberculosis
ggauuccagcgcg

SEQ ID NO: 2853722 - RNA, 21 nt, Mycobacterium avium subsp. paratuberculosis
ggauucccgaacagggcgacg

SEQ ID NO: 2853723 - RNA, 22 nt, Mycobacterium avium subsp. paratuberculosis
ggauucccgaacagggcgacgg

SEQ ID NO: 2853724 - RNA, 20 nt, Mycobacterium avium subsp. paratuberculosis
ggauucccgaccccgccagc

SEQ ID NO: 2853725 - RNA, 18 nt, Mycobacterium avium subsp. paratuberculosis
ggauuccgucggcggccg

SEQ ID NO: 2853726 - RNA, 16 nt, Mycobacterium avium subsp. paratuberculosis
ggauucgcggcggcgc

SEQ ID NO: 2853727 - RNA, 18 nt, Mycobacterium avium subsp. paratuberculosis
ggauucggccaugccgcg

SEQ ID NO: 2853728 - RNA, 14 nt, Mycobacterium avium subsp. paratuberculosis
ggauucggguggcg

SEQ ID NO: 2853729 - RNA, 21 nt, Mycobacterium avium subsp. paratuberculosis
ggauucggguggcgucgccgc

SEQ ID NO: 2853730 - RNA, 15 nt, Mycobacterium avium subsp. paratuberculosis
ggauucucagcagcg

SEQ ID NO: 2853731 - RNA, 17 nt, Mycobacterium avium subsp. paratuberculosis
ggauucucagcagcggg

SEQ ID NO: 2853732 - RNA, 14 nt, Mycobacterium avium subsp. paratuberculosis
ggauucucgcucug

SEQ ID NO: 2853733 - RNA, 21 nt, Mycobacterium avium subsp. paratuberculosis
ggauucucgcucugccgggcc

SEQ ID NO: 2853734 - RNA, 17 nt, Mycobacterium avium subsp. paratuberculosis
ggauugaccagcacguu

SEQ ID NO: 2853735 - RNA, 19 nt, Mycobacterium avium subsp. paratuberculosis
ggauugccgggcaccagcg

SEQ ID NO: 2853736 - RNA, 21 nt, Mycobacterium avium subsp. paratuberculosis
ggauugccgggcaccagcgac

SEQ ID NO: 2853737 - RNA, 15 nt, Mycobacterium avium subsp. paratuberculosis
ggauugcgagccggu

SEQ ID NO: 2853738 - RNA, 16 nt, Mycobacterium avium subsp. paratuberculosis
ggauugcgagccgguc

SEQ ID NO: 2853739 - RNA, 13 nt, Mycobacterium avium subsp. paratuberculosis
ggauuggcggcca

SEQ ID NO: 2853740 - RNA, 21 nt, Mycobacterium avium subsp. paratuberculosis
ggauuggcgucgguggcggcg

SEQ ID NO: 2853741 - RNA, 22 nt, Mycobacterium avium subsp. paratuberculosis
ggauuggugccgaucaccucgc

SEQ ID NO: 2853742 - RNA, 19 nt, Mycobacterium avium subsp. paratuberculosis
ggauuucacgucugcucgg

SEQ ID NO: 2853743 - RNA, 20 nt, Mycobacterium avium subsp. paratuberculosis
ggcaaaauagcugcgacaga

SEQ ID NO: 2853744 - RNA, 19 nt, Mycobacterium avium subsp. paratuberculosis
ggcaaagcguugccgcgcg

SEQ ID NO: 2853745 - RNA, 14 nt, Mycobacterium avium subsp. paratuberculosis
ggcaaagggcuagg

SEQ ID NO: 2853746 - RNA, 14 nt, Mycobacterium avium subsp. paratuberculosis
ggcaacaacgccag

SEQ ID NO: 2853747 - RNA, 16 nt, Mycobacterium avium subsp. paratuberculosis
ggcaacaacgccagcg

SEQ ID NO: 2853748 - RNA, 22 nt, Mycobacterium avium subsp. paratuberculosis
ggcaacacagccaaucgccgau

SEQ ID NO: 2853749 - RNA, 14 nt, Mycobacterium avium subsp. paratuberculosis
ggcaacacgccggc

SEQ ID NO: 2853750 - RNA, 17 nt, Mycobacterium avium subsp. paratuberculosis
ggcaacacgccggcggc

SEQ ID NO: 2853751 - RNA, 18 nt, Mycobacterium avium subsp. paratuberculosis
ggcaacacgccggcggcc

SEQ ID NO: 2853752 - RNA, 14 nt, Mycobacterium avium subsp. paratuberculosis
ggcaacacgucguc

SEQ ID NO: 2853753 - RNA, 20 nt, Mycobacterium avium subsp. paratuberculosis
ggcaacacgucguccggcgc

SEQ ID NO: 2853754 - RNA, 22 nt, Mycobacterium avium subsp. paratuberculosis
ggcaacacgucguccggcgcgc

SEQ ID NO: 2853755 - RNA, 22 nt, Mycobacterium avium subsp. paratuberculosis
ggcaacagcaccagcaccaccg

SEQ ID NO: 2853756 - RNA, 22 nt, Mycobacterium avium subsp. paratuberculosis
ggcaacagcgcgccggccggca

SEQ ID NO: 2853757 - RNA, 17 nt, Mycobacterium avium subsp. paratuberculosis
ggcaaccacagcggcgc

SEQ ID NO: 2853758 - RNA, 12 nt, Mycobacterium avium subsp. paratuberculosis
ggcaacccgacc

SEQ ID NO: 2853759 - RNA, 21 nt, Mycobacterium avium subsp. paratuberculosis
ggcaacccgaccucgucgacg

SEQ ID NO: 2853760 - RNA, 22 nt, Mycobacterium avium subsp. paratuberculosis
ggcaacccgaccucgucgacgg

SEQ ID NO: 2853761 - RNA, 23 nt, Mycobacterium avium subsp. paratuberculosis
ggcaacccgaccucgucgacggc

SEQ ID NO: 2853762 - RNA, 15 nt, Mycobacterium avium subsp. paratuberculosis
ggcaacccgaucgcc

SEQ ID NO: 2853763 - RNA, 16 nt, Mycobacterium avium subsp. paratuberculosis
ggcaacccgaucgccg

SEQ ID NO: 2853764 - RNA, 17 nt, Mycobacterium avium subsp. paratuberculosis
ggcaacccgaucgccga

SEQ ID NO: 2853765 - RNA, 16 nt, Mycobacterium avium subsp. paratuberculosis
ggcaaccgcagcaucu

SEQ ID NO: 2853766 - RNA, 19 nt, Mycobacterium avium subsp. paratuberculosis
ggcaaccugggcggcggcg

SEQ ID NO: 2853767 - RNA, 17 nt, Mycobacterium avium subsp. paratuberculosis
ggcaacgaacgcggcgc

SEQ ID NO: 2853768 - RNA, 18 nt, Mycobacterium avium subsp. paratuberculosis
ggcaacgaacgcggcgcc

SEQ ID NO: 2853769 - RNA, 21 nt, Mycobacterium avium subsp. paratuberculosis
ggcaacgacccgucggggugc

SEQ ID NO: 2853770 - RNA, 14 nt, Mycobacterium avium subsp. paratuberculosis
ggcaacgaggccag

SEQ ID NO: 2853771 - RNA, 13 nt, Mycobacterium avium subsp. paratuberculosis
ggcaacgcgccgg

SEQ ID NO: 2853772 - RNA, 14 nt, Mycobacterium avium subsp. paratuberculosis
ggcaacgcgccggc

SEQ ID NO: 2853773 - RNA, 17 nt, Mycobacterium avium subsp. paratuberculosis
ggcaacgcgccggcggu

SEQ ID NO: 2853774 - RNA, 18 nt, Mycobacterium avium subsp. paratuberculosis
ggcaacgcgccggcgguc

SEQ ID NO: 2853775 - RNA, 20 nt, Mycobacterium avium subsp. paratuberculosis
ggcaacgcggcaugaccggc

SEQ ID NO: 2853776 - RNA, 23 nt, Mycobacterium avium subsp. paratuberculosis
ggcaacggccaugaagccguugc

SEQ ID NO: 2853777 - RNA, 13 nt, Mycobacterium avium subsp. paratuberculosis
ggcaacggcggcg

SEQ ID NO: 2853778 - RNA, 16 nt, Mycobacterium avium subsp. paratuberculosis
ggcaacgucuggccac

SEQ ID NO: 2853779 - RNA, 18 nt, Mycobacterium avium subsp. paratuberculosis
ggcaacgucuggccaccg

SEQ ID NO: 2853780 - RNA, 23 nt, Mycobacterium avium subsp. paratuberculosis
ggcaacgugccacaggccgaaca

SEQ ID NO: 2853781 - RNA, 16 nt, Mycobacterium avium subsp. paratuberculosis
ggcaacugggcggccu

SEQ ID NO: 2853782 - RNA, 14 nt, Mycobacterium avium subsp. paratuberculosis
ggcaagcagcggca

SEQ ID NO: 2853783 - RNA, 18 nt, Mycobacterium avium subsp. paratuberculosis
ggcaagcagcggcagcca

SEQ ID NO: 2853784 - RNA, 22 nt, Mycobacterium avium subsp. paratuberculosis
ggcaagcagcggcagccacggc

SEQ ID NO: 2853785 - RNA, 23 nt, Mycobacterium avium subsp. paratuberculosis
ggcaagcagcggcagccacggca

SEQ ID NO: 2853786 - RNA, 15 nt, Mycobacterium avium subsp. paratuberculosis
ggcacccgccagccc

SEQ ID NO: 2853787 - RNA, 15 nt, Mycobacterium avium subsp. paratuberculosis
ggcacccgcgcgucg

SEQ ID NO: 2853788 - RNA, 16 nt, Mycobacterium avium subsp. paratuberculosis
ggcacccgcugcacca

SEQ ID NO: 2853789 - RNA, 18 nt, Mycobacterium avium subsp. paratuberculosis
ggcacccgcugcaccagc

SEQ ID NO: 2853790 - RNA, 14 nt, Mycobacterium avium subsp. paratuberculosis
ggcacccggcgcgg

SEQ ID NO: 2853791 - RNA, 16 nt, Mycobacterium avium subsp. paratuberculosis
ggcacccggcgcggcc

SEQ ID NO: 2853792 - RNA, 20 nt, Mycobacterium avium subsp. paratuberculosis
ggcacccggcgcggccgccc

SEQ ID NO: 2853793 - RNA, 16 nt, Mycobacterium avium subsp. paratuberculosis
ggcacccgggccuuga

SEQ ID NO: 2853794 - RNA, 14 nt, Mycobacterium avium subsp. paratuberculosis
ggcacccgggcgcg

SEQ ID NO: 2853795 - RNA, 19 nt, Mycobacterium avium subsp. paratuberculosis
ggcacccgggcgcgacggu

SEQ ID NO: 2853796 - RNA, 18 nt, Mycobacterium avium subsp. paratuberculosis
ggcacccgggugcccggc

SEQ ID NO: 2853797 - RNA, 19 nt, Mycobacterium avium subsp. paratuberculosis
ggcacccgguccggcccgg

SEQ ID NO: 2853798 - RNA, 17 nt, Mycobacterium avium subsp. paratuberculosis
ggcaccgaacgccagca

SEQ ID NO: 2853799 - RNA, 19 nt, Mycobacterium avium subsp. paratuberculosis
ggcaccgaacgccagcagc

SEQ ID NO: 2853800 - RNA, 19 nt, Mycobacterium avium subsp. paratuberculosis
ggcaccgacagggccagcg

SEQ ID NO: 2853801 - RNA, 20 nt, Mycobacterium avium subsp. paratuberculosis
ggcaccgacagggccagcgc

SEQ ID NO: 2853802 - RNA, 22 nt, Mycobacterium avium subsp. paratuberculosis
ggcaccgacagggccagcgcca

SEQ ID NO: 2853803 - RNA, 18 nt, Mycobacterium avium subsp. paratuberculosis
ggcaccgacaucagaucg

SEQ ID NO: 2853804 - RNA, 23 nt, Mycobacterium avium subsp. paratuberculosis
ggcaccgacaucagaucgccgac

SEQ ID NO: 2853805 - RNA, 21 nt, Mycobacterium avium subsp. paratuberculosis
ggcaccgacgaggagaccucc

SEQ ID NO: 2853806 - RNA, 14 nt, Mycobacterium avium subsp. paratuberculosis
ggcaccgacggagc

SEQ ID NO: 2853807 - RNA, 23 nt, Mycobacterium avium subsp. paratuberculosis
ggcaccgacggagccgagcacca

SEQ ID NO: 2853808 - RNA, 16 nt, Mycobacterium avium subsp. paratuberculosis
ggcaccgacggccgca

SEQ ID NO: 2853809 - RNA, 22 nt, Mycobacterium avium subsp. paratuberculosis
ggcaccgacggccgcaccccac

SEQ ID NO: 2853810 - RNA, 19 nt, Mycobacterium avium subsp. paratuberculosis
ggcaccgauaguagccagc

SEQ ID NO: 2853811 - RNA, 15 nt, Mycobacterium avium subsp. paratuberculosis
ggcaccgaucggcac

SEQ ID NO: 2853812 - RNA, 16 nt, Mycobacterium avium subsp. paratuberculosis
ggcaccgaucggcacg

SEQ ID NO: 2853813 - RNA, 19 nt, Mycobacterium avium subsp. paratuberculosis
ggcaccgaucggcacgucg

SEQ ID NO: 2853814 - RNA, 22 nt, Mycobacterium avium subsp. paratuberculosis
ggcaccgaucggcacgucgagc

SEQ ID NO: 2853815 - RNA, 12 nt, Mycobacterium avium subsp. paratuberculosis
ggcaccgccagc

SEQ ID NO: 2853816 - RNA, 21 nt, Mycobacterium avium subsp. paratuberculosis
ggcaccgccaggaaggccagu

SEQ ID NO: 2853817 - RNA, 15 nt, Mycobacterium avium subsp. paratuberculosis
ggcaccgcccccgcg

SEQ ID NO: 2853818 - RNA, 16 nt, Mycobacterium avium subsp. paratuberculosis
ggcaccgcccccgcgg

SEQ ID NO: 2853819 - RNA, 18 nt, Mycobacterium avium subsp. paratuberculosis
ggcaccgcccccgcggcg

SEQ ID NO: 2853820 - RNA, 19 nt, Mycobacterium avium subsp. paratuberculosis
ggcaccgcccccgcggcgg

SEQ ID NO: 2853821 - RNA, 20 nt, Mycobacterium avium subsp. paratuberculosis
ggcaccgcccccgcggcggc

SEQ ID NO: 2853822 - RNA, 23 nt, Mycobacterium avium subsp. paratuberculosis
ggcaccgcccggguugucgacgu

SEQ ID NO: 2853823 - RNA, 13 nt, Mycobacterium avium subsp. paratuberculosis
ggcaccgccgcgc

SEQ ID NO: 2853824 - RNA, 17 nt, Mycobacterium avium subsp. paratuberculosis
ggcaccgccgcgcggcc

SEQ ID NO: 2853825 - RNA, 14 nt, Mycobacterium avium subsp. paratuberculosis
ggcaccgccgcggu

SEQ ID NO: 2853826 - RNA, 16 nt, Mycobacterium avium subsp. paratuberculosis
ggcaccgcgagcaccg

SEQ ID NO: 2853827 - RNA, 16 nt, Mycobacterium avium subsp. paratuberculosis
ggcaccgcggcgauga

SEQ ID NO: 2853828 - RNA, 23 nt, Mycobacterium avium subsp. paratuberculosis
ggcaccgcggcgaugauccgcgg

SEQ ID NO: 2853829 - RNA, 14 nt, Mycobacterium avium subsp. paratuberculosis
ggcaccgcggcggu

SEQ ID NO: 2853830 - RNA, 18 nt, Mycobacterium avium subsp. paratuberculosis
ggcaccgcggcggugucg

SEQ ID NO: 2853831 - RNA, 21 nt, Mycobacterium avium subsp. paratuberculosis
ggcaccgcggcggugucggcg

SEQ ID NO: 2853832 - RNA, 12 nt, Mycobacterium avium subsp. paratuberculosis
ggcaccgcggcu

SEQ ID NO: 2853833 - RNA, 14 nt, Mycobacterium avium subsp. paratuberculosis
ggcaccgcggcucg

SEQ ID NO: 2853834 - RNA, 13 nt, Mycobacterium avium subsp. paratuberculosis
ggcaccgcggucu

SEQ ID NO: 2853835 - RNA, 23 nt, Mycobacterium avium subsp. paratuberculosis
ggcaccgcggucugcgccagcuc

SEQ ID NO: 2853836 - RNA, 18 nt, Mycobacterium avium subsp. paratuberculosis
ggcaccggaccgccgaga

SEQ ID NO: 2853837 - RNA, 14 nt, Mycobacterium avium subsp. paratuberculosis
ggcaccgggugggc

SEQ ID NO: 2853838 - RNA, 18 nt, Mycobacterium avium subsp. paratuberculosis
ggcaccgggugggccgac

SEQ ID NO: 2853839 - RNA, 14 nt, Mycobacterium avium subsp. paratuberculosis
ggcaccggugcggc

SEQ ID NO: 2853840 - RNA, 17 nt, Mycobacterium avium subsp. paratuberculosis
ggcaccggugcggcggu

SEQ ID NO: 2853841 - RNA, 13 nt, Mycobacterium avium subsp. paratuberculosis
ggcaccgucgacc

SEQ ID NO: 2853842 - RNA, 21 nt, Mycobacterium avium subsp. paratuberculosis
ggcaccgucgaccucgaugcg

SEQ ID NO: 2853843 - RNA, 23 nt, Mycobacterium avium subsp. paratuberculosis
ggcaccgucgaccucgaugcgca

SEQ ID NO: 2853844 - RNA, 13 nt, Mycobacterium avium subsp. paratuberculosis
ggcaccgugccgc

SEQ ID NO: 2853845 - RNA, 17 nt, Mycobacterium avium subsp. paratuberculosis
ggcaccgugccgcgcgg

SEQ ID NO: 2853846 - RNA, 16 nt, Mycobacterium avium subsp. paratuberculosis
ggcaccuccagcccgg

SEQ ID NO: 2853847 - RNA, 19 nt, Mycobacterium avium subsp. paratuberculosis
ggcaccuccagcccggcga

SEQ ID NO: 2853848 - RNA, 19 nt, Mycobacterium avium subsp. paratuberculosis
ggcaccuccugcacccguc

SEQ ID NO: 2853849 - RNA, 16 nt, Mycobacterium avium subsp. paratuberculosis
ggcaccucgaucaccg

SEQ ID NO: 2853850 - RNA, 17 nt, Mycobacterium avium subsp. paratuberculosis
ggcaccucgaucaccgg

SEQ ID NO: 2853851 - RNA, 15 nt, Mycobacterium avium subsp. paratuberculosis
ggcaccucgaugccg

SEQ ID NO: 2853852 - RNA, 14 nt, Mycobacterium avium subsp. paratuberculosis
ggcaccucggccag

SEQ ID NO: 2853853 - RNA, 13 nt, Mycobacterium avium subsp. paratuberculosis
ggcaccucggccu

SEQ ID NO: 2853854 - RNA, 16 nt, Mycobacterium avium subsp. paratuberculosis
ggcaccucggccuuga

SEQ ID NO: 2853855 - RNA, 23 nt, Mycobacterium avium subsp. paratuberculosis
ggcaccucggccuugaccacggu

SEQ ID NO: 2853856 - RNA, 19 nt, Mycobacterium avium subsp. paratuberculosis
ggcaccucggcgucggcgc

SEQ ID NO: 2853857 - RNA, 22 nt, Mycobacterium avium subsp. paratuberculosis
ggcaccugauaggggucggcga

SEQ ID NO: 2853858 - RNA, 14 nt, Mycobacterium avium subsp. paratuberculosis
ggcaccuggccguc

SEQ ID NO: 2853859 - RNA, 20 nt, Mycobacterium avium subsp. paratuberculosis
ggcaccuucaccgaccagcu

SEQ ID NO: 2853860 - RNA, 21 nt, Mycobacterium avium subsp. paratuberculosis
ggcaccuucaccgaccagcug

SEQ ID NO: 2853861 - RNA, 22 nt, Mycobacterium avium subsp. paratuberculosis
ggcaccuucaccgaccagcugu

SEQ ID NO: 2853862 - RNA, 16 nt, Mycobacterium avium subsp. paratuberculosis
ggcacgaacgcgacga

SEQ ID NO: 2853863 - RNA, 16 nt, Mycobacterium avium subsp. paratuberculosis
ggcacgaauucggugg

SEQ ID NO: 2853864 - RNA, 18 nt, Mycobacterium avium subsp. paratuberculosis
ggcacgaauucgguggcg

SEQ ID NO: 2853865 - RNA, 21 nt, Mycobacterium avium subsp. paratuberculosis
ggcacgaauucgguggcgaug

SEQ ID NO: 2853866 - RNA, 15 nt, Mycobacterium avium subsp. paratuberculosis
ggcacgacgccgccg

SEQ ID NO: 2853867 - RNA, 16 nt, Mycobacterium avium subsp. paratuberculosis
ggcacgacgccgccga

SEQ ID NO: 2853868 - RNA, 15 nt, Mycobacterium avium subsp. paratuberculosis
ggcacgacggucagc

SEQ ID NO: 2853869 - RNA, 16 nt, Mycobacterium avium subsp. paratuberculosis
ggcacgacggucagca

SEQ ID NO: 2853870 - RNA, 21 nt, Mycobacterium avium subsp. paratuberculosis
ggcacgagcgaacacgugcag

SEQ ID NO: 2853871 - RNA, 15 nt, Mycobacterium avium subsp. paratuberculosis
ggcagacccagcagc

SEQ ID NO: 2853872 - RNA, 17 nt, Mycobacterium avium subsp. paratuberculosis
ggcagacccagcagcgg

SEQ ID NO: 2853873 - RNA, 18 nt, Mycobacterium avium subsp. paratuberculosis
ggcagacccagcagcggc

SEQ ID NO: 2853874 - RNA, 14 nt, Mycobacterium avium subsp. paratuberculosis
ggcagacccccagc

SEQ ID NO: 2853875 - RNA, 17 nt, Mycobacterium avium subsp. paratuberculosis
ggcagacccccagcagc

SEQ ID NO: 2853876 - RNA, 15 nt, Mycobacterium avium subsp. paratuberculosis
ggcagacccgcgucg

SEQ ID NO: 2853877 - RNA, 15 nt, Mycobacterium avium subsp. paratuberculosis
ggcagaccgguggcg

SEQ ID NO: 2853878 - RNA, 19 nt, Mycobacterium avium subsp. paratuberculosis
ggcagaccgguggcgaagu

SEQ ID NO: 2853879 - RNA, 18 nt, Mycobacterium avium subsp. paratuberculosis
ggcagaccguccgguucg

SEQ ID NO: 2853880 - RNA, 21 nt, Mycobacterium avium subsp. paratuberculosis
ggcagaccgugugccagcccg

SEQ ID NO: 2853881 - RNA, 18 nt, Mycobacterium avium subsp. paratuberculosis
ggcagauaggcggcgacg

SEQ ID NO: 2853882 - RNA, 17 nt, Mycobacterium avium subsp. paratuberculosis
ggcagaucgcggcccgc

SEQ ID NO: 2853883 - RNA, 19 nt, Mycobacterium avium subsp. paratuberculosis
ggcagaucgcggcccgccg

SEQ ID NO: 2853884 - RNA, 19 nt, Mycobacterium avium subsp. paratuberculosis
ggcagaucugcaggguuuc

SEQ ID NO: 2853885 - RNA, 16 nt, Mycobacterium avium subsp. paratuberculosis
ggcagaugcccgcuga

SEQ ID NO: 2853886 - RNA, 14 nt, Mycobacterium avium subsp. paratuberculosis
ggcagauggucgcc

SEQ ID NO: 2853887 - RNA, 15 nt, Mycobacterium avium subsp. paratuberculosis
ggcagauggucgccg

SEQ ID NO: 2853888 - RNA, 16 nt, Mycobacterium avium subsp. paratuberculosis
ggcagauggucgccga

SEQ ID NO: 2853889 - RNA, 22 nt, Mycobacterium avium subsp. paratuberculosis
ggcagauggucgccgacggugg

SEQ ID NO: 2853890 - RNA, 15 nt, Mycobacterium avium subsp. paratuberculosis
ggcagauggucucga

SEQ ID NO: 2853891 - RNA, 14 nt, Mycobacterium avium subsp. paratuberculosis
ggcagcaaccgcga

SEQ ID NO: 2853892 - RNA, 15 nt, Mycobacterium avium subsp. paratuberculosis
ggcagcaaccggcgg

SEQ ID NO: 2853893 - RNA, 16 nt, Mycobacterium avium subsp. paratuberculosis
ggcagcaaccggcggc

SEQ ID NO: 2853894 - RNA, 17 nt, Mycobacterium avium subsp. paratuberculosis
ggcagcaaccggcggcu

SEQ ID NO: 2853895 - RNA, 15 nt, Mycobacterium avium subsp. paratuberculosis
ggcagcaaccggguc

SEQ ID NO: 2853896 - RNA, 17 nt, Mycobacterium avium subsp. paratuberculosis
ggcagcaaccgggucac

SEQ ID NO: 2853897 - RNA, 22 nt, Mycobacterium avium subsp. paratuberculosis
ggcagcacaccuuccaccaccg

SEQ ID NO: 2853898 - RNA, 12 nt, Mycobacterium avium subsp. paratuberculosis
ggcagcacccgc

SEQ ID NO: 2853899 - RNA, 16 nt, Mycobacterium avium subsp. paratuberculosis
ggcagcaccgccgaca

SEQ ID NO: 2853900 - RNA, 19 nt, Mycobacterium avium subsp. paratuberculosis
ggcagcaccgccgacaucg

SEQ ID NO: 2853901 - RNA, 16 nt, Mycobacterium avium subsp. paratuberculosis
ggcagcaccggcagca

SEQ ID NO: 2853902 - RNA, 18 nt, Mycobacterium avium subsp. paratuberculosis
ggcagcaccucgcgcagc

SEQ ID NO: 2853903 - RNA, 19 nt, Mycobacterium avium subsp. paratuberculosis
ggcagcaccucgcgcagca

SEQ ID NO: 2853904 - RNA, 13 nt, Mycobacterium avium subsp. paratuberculosis
ggcagcagcacca

SEQ ID NO: 2853905 - RNA, 15 nt, Mycobacterium avium subsp. paratuberculosis
ggcagcagcaccagc

SEQ ID NO: 2853906 - RNA, 13 nt, Mycobacterium avium subsp. paratuberculosis
ggcagcagcaccc

SEQ ID NO: 2853907 - RNA, 15 nt, Mycobacterium avium subsp. paratuberculosis
ggcagcagcaccccg

SEQ ID NO: 2853908 - RNA, 20 nt, Mycobacterium avium subsp. paratuberculosis
ggcagcagcagaucggcguc

SEQ ID NO: 2853909 - RNA, 21 nt, Mycobacterium avium subsp. paratuberculosis
ggcagcagcagaucggcguca

SEQ ID NO: 2853910 - RNA, 17 nt, Mycobacterium avium subsp. paratuberculosis
ggcagcagccaugacua

SEQ ID NO: 2853911 - RNA, 17 nt, Mycobacterium avium subsp. paratuberculosis
ggcagcagccggaaggc

SEQ ID NO: 2853912 - RNA, 22 nt, Mycobacterium avium subsp. paratuberculosis
ggcagcagccggaaggccaagg

SEQ ID NO: 2853913 - RNA, 16 nt, Mycobacterium avium subsp. paratuberculosis
ggcagcagcgcgucgu

SEQ ID NO: 2853914 - RNA, 19 nt, Mycobacterium avium subsp. paratuberculosis
ggcagcagcuccaucgacg

SEQ ID NO: 2853915 - RNA, 22 nt, Mycobacterium avium subsp. paratuberculosis
ggcagcagcugcgucggcacca

SEQ ID NO: 2853916 - RNA, 16 nt, Mycobacterium avium subsp. paratuberculosis
ggcagcaggugcacca

SEQ ID NO: 2853917 - RNA, 19 nt, Mycobacterium avium subsp. paratuberculosis
ggcagcaggugcaccaccc

SEQ ID NO: 2853918 - RNA, 22 nt, Mycobacterium avium subsp. paratuberculosis
ggcagcaggugcaccacccagg

SEQ ID NO: 2853919 - RNA, 16 nt, Mycobacterium avium subsp. paratuberculosis
ggcagcauccgccgac

SEQ ID NO: 2853920 - RNA, 17 nt, Mycobacterium avium subsp. paratuberculosis
ggcagcauccgccgacg

SEQ ID NO: 2853921 - RNA, 18 nt, Mycobacterium avium subsp. paratuberculosis
ggcagcauccgccgacga

SEQ ID NO: 2853922 - RNA, 21 nt, Mycobacterium avium subsp. paratuberculosis
ggcagcaucgggacgccugcc

SEQ ID NO: 2853923 - RNA, 20 nt, Mycobacterium avium subsp. paratuberculosis
ggcagcauucgccggggucg

SEQ ID NO: 2853924 - RNA, 19 nt, Mycobacterium avium subsp. paratuberculosis
ggcagccaaccgccgggga

SEQ ID NO: 2853925 - RNA, 13 nt, Mycobacterium avium subsp. paratuberculosis
ggcagccacaucu

SEQ ID NO: 2853926 - RNA, 15 nt, Mycobacterium avium subsp. paratuberculosis
ggcagccacgcgcaa

SEQ ID NO: 2853927 - RNA, 14 nt, Mycobacterium avium subsp. paratuberculosis
ggcagccacggcag

SEQ ID NO: 2853928 - RNA, 20 nt, Mycobacterium avium subsp. paratuberculosis
ggcagccacggcagcugcag

SEQ ID NO: 2853929 - RNA, 19 nt, Mycobacterium avium subsp. paratuberculosis
ggcagccagaugucgcguu

SEQ ID NO: 2853930 - RNA, 15 nt, Mycobacterium avium subsp. paratuberculosis
ggcagccagcccgcg

SEQ ID NO: 2853931 - RNA, 16 nt, Mycobacterium avium subsp. paratuberculosis
ggcagccagcccgcgc

SEQ ID NO: 2853932 - RNA, 17 nt, Mycobacterium avium subsp. paratuberculosis
ggcagccagccuggcgg

SEQ ID NO: 2853933 - RNA, 20 nt, Mycobacterium avium subsp. paratuberculosis
ggcagccagccuggcggcga

SEQ ID NO: 2853934 - RNA, 13 nt, Mycobacterium avium subsp. paratuberculosis
ggcagccccagcg

SEQ ID NO: 2853935 - RNA, 22 nt, Mycobacterium avium subsp. paratuberculosis
ggcagccccagcgagcagguca

SEQ ID NO: 2853936 - RNA, 14 nt, Mycobacterium avium subsp. paratuberculosis
ggcagccccgucgg

SEQ ID NO: 2853937 - RNA, 18 nt, Mycobacterium avium subsp. paratuberculosis
ggcagccccgucgguccc

SEQ ID NO: 2853938 - RNA, 12 nt, Mycobacterium avium subsp. paratuberculosis
ggcagcccgaac

SEQ ID NO: 2853939 - RNA, 18 nt, Mycobacterium avium subsp. paratuberculosis
ggcagcccgaacagccgg

SEQ ID NO: 2853940 - RNA, 22 nt, Mycobacterium avium subsp. paratuberculosis
ggcagcccgaacagccgggcca

SEQ ID NO: 2853941 - RNA, 16 nt, Mycobacterium avium subsp. paratuberculosis
ggcagcccgacguccu

SEQ ID NO: 2853942 - RNA, 13 nt, Mycobacterium avium subsp. paratuberculosis
ggcagcccgagca

SEQ ID NO: 2853943 - RNA, 15 nt, Mycobacterium avium subsp. paratuberculosis
ggcagcccgccgcgg

SEQ ID NO: 2853944 - RNA, 16 nt, Mycobacterium avium subsp. paratuberculosis
ggcagcccgccgcgga

SEQ ID NO: 2853945 - RNA, 15 nt, Mycobacterium avium subsp. paratuberculosis
ggcagcccggaggcg

SEQ ID NO: 2853946 - RNA, 17 nt, Mycobacterium avium subsp. paratuberculosis
ggcagcccggcugcgca

SEQ ID NO: 2853947 - RNA, 16 nt, Mycobacterium avium subsp. paratuberculosis
ggcagccgcacaccgc

SEQ ID NO: 2853948 - RNA, 18 nt, Mycobacterium avium subsp. paratuberculosis
ggcagccgcacaccgcgg

SEQ ID NO: 2853949 - RNA, 20 nt, Mycobacterium avium subsp. paratuberculosis
ggcagccgcacaccgcggcg

SEQ ID NO: 2853950 - RNA, 22 nt, Mycobacterium avium subsp. paratuberculosis
ggcagccgcacaccgcggcggc

SEQ ID NO: 2853951 - RNA, 23 nt, Mycobacterium avium subsp. paratuberculosis
ggcagccgcacaccgcggcggcg

SEQ ID NO: 2853952 - RNA, 13 nt, Mycobacterium avium subsp. paratuberculosis
ggcagccgcgccc

SEQ ID NO: 2853953 - RNA, 20 nt, Mycobacterium avium subsp. paratuberculosis
ggcagccgcgcccacccgcg

SEQ ID NO: 2853954 - RNA, 15 nt, Mycobacterium avium subsp. paratuberculosis
ggcagccgcgcgugc

SEQ ID NO: 2853955 - RNA, 15 nt, Mycobacterium avium subsp. paratuberculosis
ggcagccgcuccggc

SEQ ID NO: 2853956 - RNA, 18 nt, Mycobacterium avium subsp. paratuberculosis
ggcagcugcccgucggag

SEQ ID NO: 2853957 - RNA, 16 nt, Mycobacterium avium subsp. paratuberculosis
ggcagcuugaugcugg

SEQ ID NO: 2853958 - RNA, 12 nt, Mycobacterium avium subsp. paratuberculosis
ggcaggaaagcg

SEQ ID NO: 2853959 - RNA, 19 nt, Mycobacterium avium subsp. paratuberculosis
ggcaggaaccgggucagca

SEQ ID NO: 2853960 - RNA, 22 nt, Mycobacterium avium subsp. paratuberculosis
ggcaggaaccgggucagcacca

SEQ ID NO: 2853961 - RNA, 15 nt, Mycobacterium avium subsp. paratuberculosis
ggcaggaacgccuug

SEQ ID NO: 2853962 - RNA, 23 nt, Mycobacterium avium subsp. paratuberculosis
ggcaggaagcgaauccggguguc

SEQ ID NO: 2853963 - RNA, 15 nt, Mycobacterium avium subsp. paratuberculosis
ggcaggacgggggcc

SEQ ID NO: 2853964 - RNA, 17 nt, Mycobacterium avium subsp. paratuberculosis
ggcaggauccggucgau

SEQ ID NO: 2853965 - RNA, 13 nt, Mycobacterium avium subsp. paratuberculosis
ggcaggaugccgc

SEQ ID NO: 2853966 - RNA, 16 nt, Mycobacterium avium subsp. paratuberculosis
ggcaggauggucagcg

SEQ ID NO: 2853967 - RNA, 15 nt, Mycobacterium avium subsp. paratuberculosis
ggcaggcacgagcga

SEQ ID NO: 2853968 - RNA, 14 nt, Mycobacterium avium subsp. paratuberculosis
ggcaggcacggugu

SEQ ID NO: 2853969 - RNA, 15 nt, Mycobacterium avium subsp. paratuberculosis
ggcaggcacgguguc

SEQ ID NO: 2853970 - RNA, 16 nt, Mycobacterium avium subsp. paratuberculosis
ggcaggcacggugucg

SEQ ID NO: 2853971 - RNA, 16 nt, Mycobacterium avium subsp. paratuberculosis
ggcaggcacugauccc

SEQ ID NO: 2853972 - RNA, 14 nt, Mycobacterium avium subsp. paratuberculosis
ggcaggcccgagcc

SEQ ID NO: 2853973 - RNA, 14 nt, Mycobacterium avium subsp. paratuberculosis
ggcaggccgcccga

SEQ ID NO: 2853974 - RNA, 14 nt, Mycobacterium avium subsp. paratuberculosis
ggcaggccgcggcc

SEQ ID NO: 2853975 - RNA, 15 nt, Mycobacterium avium subsp. paratuberculosis
ggcaggccgcggccg

SEQ ID NO: 2853976 - RNA, 14 nt, Mycobacterium avium subsp. paratuberculosis
ggcaggccggcagc

SEQ ID NO: 2853977 - RNA, 13 nt, Mycobacterium avium subsp. paratuberculosis
ggcaggccggugc

SEQ ID NO: 2853978 - RNA, 15 nt, Mycobacterium avium subsp. paratuberculosis
ggcaggccggugcug

SEQ ID NO: 2853979 - RNA, 20 nt, Mycobacterium avium subsp. paratuberculosis
ggcaggcgauggcgucggcc

SEQ ID NO: 2853980 - RNA, 12 nt, Mycobacterium avium subsp. paratuberculosis
ggcaggcgaugu

SEQ ID NO: 2853981 - RNA, 18 nt, Mycobacterium avium subsp. paratuberculosis
ggcaggcgaugugggugg

SEQ ID NO: 2853982 - RNA, 23 nt, Mycobacterium avium subsp. paratuberculosis
ggcaggcgauguggguggucagc

SEQ ID NO: 2853983 - RNA, 14 nt, Mycobacterium avium subsp. paratuberculosis
ggcaggcggccagg

SEQ ID NO: 2853984 - RNA, 22 nt, Mycobacterium avium subsp. paratuberculosis
ggcaggcggcccgcucgauguc

SEQ ID NO: 2853985 - RNA, 13 nt, Mycobacterium avium subsp. paratuberculosis
ggcaggcggcgcg

SEQ ID NO: 2853986 - RNA, 15 nt, Mycobacterium avium subsp. paratuberculosis
ggcaggcggcgcgcc

SEQ ID NO: 2853987 - RNA, 16 nt, Mycobacterium avium subsp. paratuberculosis
ggcaggcggcgcgcca

SEQ ID NO: 2853988 - RNA, 21 nt, Mycobacterium avium subsp. paratuberculosis
ggcaggcgguuucaccgaggc

SEQ ID NO: 2853989 - RNA, 15 nt, Mycobacterium avium subsp. paratuberculosis
ggcaggcucagcagc

SEQ ID NO: 2853990 - RNA, 16 nt, Mycobacterium avium subsp. paratuberculosis
ggcagggccaccguca

SEQ ID NO: 2853991 - RNA, 12 nt, Mycobacterium avium subsp. paratuberculosis
ggcagggccagc

SEQ ID NO: 2853992 - RNA, 13 nt, Mycobacterium avium subsp. paratuberculosis
ggcagggccagca

SEQ ID NO: 2853993 - RNA, 15 nt, Mycobacterium avium subsp. paratuberculosis
ggcagggccagcagc

SEQ ID NO: 2853994 - RNA, 19 nt, Mycobacterium avium subsp. paratuberculosis
ggcagggccagcagcccgg

SEQ ID NO: 2853995 - RNA, 15 nt, Mycobacterium avium subsp. paratuberculosis
ggcagggugaccgag

SEQ ID NO: 2853996 - RNA, 20 nt, Mycobacterium avium subsp. paratuberculosis
ggcagggugaccgaggccgc

SEQ ID NO: 2853997 - RNA, 21 nt, Mycobacterium avium subsp. paratuberculosis
ggcagggugaccgaggccgcc

SEQ ID NO: 2853998 - RNA, 23 nt, Mycobacterium avium subsp. paratuberculosis
ggcaggguugccccaaaacgggc

SEQ ID NO: 2853999 - RNA, 19 nt, Mycobacterium avium subsp. paratuberculosis
ggcaggguuuucacgucga

SEQ ID NO: 2854000 - RNA, 21 nt, Mycobacterium avium subsp. paratuberculosis
ggcagguacugcuugccgccg

SEQ ID NO: 2854001 - RNA, 15 nt, Mycobacterium avium subsp. paratuberculosis
ggcaggucgaggccg

SEQ ID NO: 2854002 - RNA, 17 nt, Mycobacterium avium subsp. paratuberculosis
ggcaggucgaggccggc

SEQ ID NO: 2854003 - RNA, 15 nt, Mycobacterium avium subsp. paratuberculosis
ggcaggucgcgccgg

SEQ ID NO: 2854004 - RNA, 18 nt, Mycobacterium avium subsp. paratuberculosis
ggcaggucgcgccggagc

SEQ ID NO: 2854005 - RNA, 20 nt, Mycobacterium avium subsp. paratuberculosis
ggcaggucggccagcgccgc

SEQ ID NO: 2854006 - RNA, 22 nt, Mycobacterium avium subsp. paratuberculosis
ggcaggucggccagcgccgccc

SEQ ID NO: 2854007 - RNA, 13 nt, Mycobacterium avium subsp. paratuberculosis
ggcaggucggcgg

SEQ ID NO: 2854008 - RNA, 16 nt, Mycobacterium avium subsp. paratuberculosis
ggcaggucggugcgcg

SEQ ID NO: 2854009 - RNA, 18 nt, Mycobacterium avium subsp. paratuberculosis
ggcaggucggugcgcggg

SEQ ID NO: 2854010 - RNA, 16 nt, Mycobacterium avium subsp. paratuberculosis
ggcaggucgucgacgu

SEQ ID NO: 2854011 - RNA, 15 nt, Mycobacterium avium subsp. paratuberculosis
ggcaggucgucgucg

SEQ ID NO: 2854012 - RNA, 22 nt, Mycobacterium avium subsp. paratuberculosis
ggcaggucgucgucgccgcgcg

SEQ ID NO: 2854013 - RNA, 20 nt, Mycobacterium avium subsp. paratuberculosis
ggcaggugaaggugccccac

SEQ ID NO: 2854014 - RNA, 12 nt, Mycobacterium avium subsp. paratuberculosis
ggcaggugagcc

SEQ ID NO: 2854015 - RNA, 15 nt, Mycobacterium avium subsp. paratuberculosis
ggcaggugagccggg

SEQ ID NO: 2854016 - RNA, 18 nt, Mycobacterium avium subsp. paratuberculosis
ggcaggugagccgggugc

SEQ ID NO: 2854017 - RNA, 20 nt, Mycobacterium avium subsp. paratuberculosis
ggcagguggauugucggccg

SEQ ID NO: 2854018 - RNA, 22 nt, Mycobacterium avium subsp. paratuberculosis
ggcagguggauugucggccgcc

SEQ ID NO: 2854019 - RNA, 23 nt, Mycobacterium avium subsp. paratuberculosis
ggcagguggauugucggccgccc

SEQ ID NO: 2854020 - RNA, 21 nt, Mycobacterium avium subsp. paratuberculosis
ggcagguggcguagucggugc

SEQ ID NO: 2854021 - RNA, 16 nt, Mycobacterium avium subsp. paratuberculosis
ggcagguggggcagca

SEQ ID NO: 2854022 - RNA, 13 nt, Mycobacterium avium subsp. paratuberculosis
ggcagguggucgg

SEQ ID NO: 2854023 - RNA, 17 nt, Mycobacterium avium subsp. paratuberculosis
ggcagguggucggcgaa

SEQ ID NO: 2854024 - RNA, 18 nt, Mycobacterium avium subsp. paratuberculosis
ggcagguucauccccgcg

SEQ ID NO: 2854025 - RNA, 19 nt, Mycobacterium avium subsp. paratuberculosis
ggcagguucauccccgcgg

SEQ ID NO: 2854026 - RNA, 15 nt, Mycobacterium avium subsp. paratuberculosis
ggcagguugcgcugg

SEQ ID NO: 2854027 - RNA, 21 nt, Mycobacterium avium subsp. paratuberculosis
ggcagguuggggacggcgagg

SEQ ID NO: 2854028 - RNA, 16 nt, Mycobacterium avium subsp. paratuberculosis
ggcagguugucgcuga

SEQ ID NO: 2854029 - RNA, 15 nt, Mycobacterium avium subsp. paratuberculosis
ggcaguacgcgccgg

SEQ ID NO: 2854030 - RNA, 17 nt, Mycobacterium avium subsp. paratuberculosis
ggcaguacgcgccggcc

SEQ ID NO: 2854031 - RNA, 19 nt, Mycobacterium avium subsp. paratuberculosis
ggcaguagcaucggggaug

SEQ ID NO: 2854032 - RNA, 15 nt, Mycobacterium avium subsp. paratuberculosis
ggcaguagcgacgcg

SEQ ID NO: 2854033 - RNA, 16 nt, Mycobacterium avium subsp. paratuberculosis
ggcaguagcgcaccgg

SEQ ID NO: 2854034 - RNA, 17 nt, Mycobacterium avium subsp. paratuberculosis
ggcaguagcgcaccggu

SEQ ID NO: 2854035 - RNA, 18 nt, Mycobacterium avium subsp. paratuberculosis
ggcaguagugguccaccg

SEQ ID NO: 2854036 - RNA, 19 nt, Mycobacterium avium subsp. paratuberculosis
ggcaguccgcgccgguccc

SEQ ID NO: 2854037 - RNA, 21 nt, Mycobacterium avium subsp. paratuberculosis
ggcaguccggacacggccagc

SEQ ID NO: 2854038 - RNA, 23 nt, Mycobacterium avium subsp. paratuberculosis
ggcaguccggacacggccagcgc

SEQ ID NO: 2854039 - RNA, 15 nt, Mycobacterium avium subsp. paratuberculosis
ggcagucugccggug

SEQ ID NO: 2854040 - RNA, 23 nt, Mycobacterium avium subsp. paratuberculosis
ggcagugagggaacgccgaucac

SEQ ID NO: 2854041 - RNA, 17 nt, Mycobacterium avium subsp. paratuberculosis
ggcaugggaucagcagc

SEQ ID NO: 2854042 - RNA, 18 nt, Mycobacterium avium subsp. paratuberculosis
ggcaugggaucagcagca

SEQ ID NO: 2854043 - RNA, 15 nt, Mycobacterium avium subsp. paratuberculosis
ggcauggucaccgga

SEQ ID NO: 2854044 - RNA, 15 nt, Mycobacterium avium subsp. paratuberculosis
ggcaugguucccccc

SEQ ID NO: 2854045 - RNA, 16 nt, Mycobacterium avium subsp. paratuberculosis
ggcaugguuccucguu

SEQ ID NO: 2854046 - RNA, 18 nt, Mycobacterium avium subsp. paratuberculosis
ggcaugucgccgaacgcc

SEQ ID NO: 2854047 - RNA, 13 nt, Mycobacterium avium subsp. paratuberculosis
ggcaugucggugg

SEQ ID NO: 2854048 - RNA, 21 nt, Mycobacterium avium subsp. paratuberculosis
ggcaugucgguggacagcgcg

SEQ ID NO: 2854049 - RNA, 15 nt, Mycobacterium avium subsp. paratuberculosis
ggcauuccaccgcgc

SEQ ID NO: 2854050 - RNA, 16 nt, Mycobacterium avium subsp. paratuberculosis
ggcauucguguggcgc

SEQ ID NO: 2854051 - RNA, 14 nt, Mycobacterium avium subsp. paratuberculosis
ggcauuggcagcuc

SEQ ID NO: 2854052 - RNA, 19 nt, Mycobacterium avium subsp. paratuberculosis
ggccaaaaagugccggacc

SEQ ID NO: 2854053 - RNA, 14 nt, Mycobacterium avium subsp. paratuberculosis
ggccaacagcagca

SEQ ID NO: 2854054 - RNA, 23 nt, Mycobacterium avium subsp. paratuberculosis
ggccaacagugcgcaggcggcgc

SEQ ID NO: 2854055 - RNA, 16 nt, Mycobacterium avium subsp. paratuberculosis
ggccaacccgggcgcc

SEQ ID NO: 2854056 - RNA, 20 nt, Mycobacterium avium subsp. paratuberculosis
ggccaacccgggcgccaucc

SEQ ID NO: 2854057 - RNA, 16 nt, Mycobacterium avium subsp. paratuberculosis
ggccaaccgcccggcg

SEQ ID NO: 2854058 - RNA, 20 nt, Mycobacterium avium subsp. paratuberculosis
ggccaaccgcccggcgccga

SEQ ID NO: 2854059 - RNA, 18 nt, Mycobacterium avium subsp. paratuberculosis
ggccaaccgggcaggcac

SEQ ID NO: 2854060 - RNA, 14 nt, Mycobacterium avium subsp. paratuberculosis
ggccaacgagcgcg

SEQ ID NO: 2854061 - RNA, 17 nt, Mycobacterium avium subsp. paratuberculosis
ggccaacgagcgcgccg

SEQ ID NO: 2854062 - RNA, 21 nt, Mycobacterium avium subsp. paratuberculosis
ggccaacgagcgcgccgaggu

SEQ ID NO: 2854063 - RNA, 23 nt, Mycobacterium avium subsp. paratuberculosis
ggccaacgagcgcgccgaggugg

SEQ ID NO: 2854064 - RNA, 19 nt, Mycobacterium avium subsp. paratuberculosis
ggccaacgggaagagcggc

SEQ ID NO: 2854065 - RNA, 22 nt, Mycobacterium avium subsp. paratuberculosis
ggccaacgggaagagcggcgug

SEQ ID NO: 2854066 - RNA, 20 nt, Mycobacterium avium subsp. paratuberculosis
ggccaacucgcgaagaucgg

SEQ ID NO: 2854067 - RNA, 20 nt, Mycobacterium avium subsp. paratuberculosis
ggccaacugcaucgccagca

SEQ ID NO: 2854068 - RNA, 20 nt, Mycobacterium avium subsp. paratuberculosis
ggccaacugggugggugcgg

SEQ ID NO: 2854069 - RNA, 14 nt, Mycobacterium avium subsp. paratuberculosis
ggccaaggccagca

SEQ ID NO: 2854070 - RNA, 16 nt, Mycobacterium avium subsp. paratuberculosis
ggccaaggccagcaac

SEQ ID NO: 2854071 - RNA, 22 nt, Mycobacterium avium subsp. paratuberculosis
ggccaaguagacucagcgucga

SEQ ID NO: 2854072 - RNA, 13 nt, Mycobacterium avium subsp. paratuberculosis
ggccaagugcggu

SEQ ID NO: 2854073 - RNA, 21 nt, Mycobacterium avium subsp. paratuberculosis
ggccaauuccucagcccggca

SEQ ID NO: 2854074 - RNA, 21 nt, Mycobacterium avium subsp. paratuberculosis
ggccacaacgucucugucguc

SEQ ID NO: 2854075 - RNA, 22 nt, Mycobacterium avium subsp. paratuberculosis
ggccacaacgucucugucgucg

SEQ ID NO: 2854076 - RNA, 15 nt, Mycobacterium avium subsp. paratuberculosis
ggccacacccgucga

SEQ ID NO: 2854077 - RNA, 16 nt, Mycobacterium avium subsp. paratuberculosis
ggccacacccgucgac

SEQ ID NO: 2854078 - RNA, 17 nt, Mycobacterium avium subsp. paratuberculosis
ggccacacccgucgacu

SEQ ID NO: 2854079 - RNA, 19 nt, Mycobacterium avium subsp. paratuberculosis
ggccacacccgucgacucg

SEQ ID NO: 2854080 - RNA, 21 nt, Mycobacterium avium subsp. paratuberculosis
ggccacacccgucgacucggc

SEQ ID NO: 2854081 - RNA, 16 nt, Mycobacterium avium subsp. paratuberculosis
ggccacaccgaucagc

SEQ ID NO: 2854082 - RNA, 18 nt, Mycobacterium avium subsp. paratuberculosis
ggccacaccggggccagg

SEQ ID NO: 2854083 - RNA, 19 nt, Mycobacterium avium subsp. paratuberculosis
ggccacaccggggccaggu

SEQ ID NO: 2854084 - RNA, 16 nt, Mycobacterium avium subsp. paratuberculosis
ggccacacuggcguga

SEQ ID NO: 2854085 - RNA, 20 nt, Mycobacterium avium subsp. paratuberculosis
ggccacacuggcgugacgcu

SEQ ID NO: 2854086 - RNA, 20 nt, Mycobacterium avium subsp. paratuberculosis
ggccacagcggcgacagcgg

SEQ ID NO: 2854087 - RNA, 18 nt, Mycobacterium avium subsp. paratuberculosis
ggccacaugggccacggc

SEQ ID NO: 2854088 - RNA, 20 nt, Mycobacterium avium subsp. paratuberculosis
ggccaccaacaggucggcgu

SEQ ID NO: 2854089 - RNA, 19 nt, Mycobacterium avium subsp. paratuberculosis
ggccaccaacggcagcagc

SEQ ID NO: 2854090 - RNA, 20 nt, Mycobacterium avium subsp. paratuberculosis
ggccaccacaguggccgcca

SEQ ID NO: 2854091 - RNA, 22 nt, Mycobacterium avium subsp. paratuberculosis
ggccaccacaguggccgccagu

SEQ ID NO: 2854092 - RNA, 21 nt, Mycobacterium avium subsp. paratuberculosis
ggccaccacauuggcgaccgc

SEQ ID NO: 2854093 - RNA, 15 nt, Mycobacterium avium subsp. paratuberculosis
ggccaccaccacgga

SEQ ID NO: 2854094 - RNA, 16 nt, Mycobacterium avium subsp. paratuberculosis
ggccaccaccacggag

SEQ ID NO: 2854095 - RNA, 17 nt, Mycobacterium avium subsp. paratuberculosis
ggccaccaccacggcca

SEQ ID NO: 2854096 - RNA, 19 nt, Mycobacterium avium subsp. paratuberculosis
ggccaccaccacggccaug

SEQ ID NO: 2854097 - RNA, 20 nt, Mycobacterium avium subsp. paratuberculosis
ggccaccaccacggccgccg

SEQ ID NO: 2854098 - RNA, 23 nt, Mycobacterium avium subsp. paratuberculosis
ggccaccaccacggccgccgagg

SEQ ID NO: 2854099 - RNA, 14 nt, Mycobacterium avium subsp. paratuberculosis
ggccaccaccgcca

SEQ ID NO: 2854100 - RNA, 15 nt, Mycobacterium avium subsp. paratuberculosis
ggccaccaccgccac

SEQ ID NO: 2854101 - RNA, 19 nt, Mycobacterium avium subsp. paratuberculosis
ggccaccaccgccacggcg

SEQ ID NO: 2854102 - RNA, 19 nt, Mycobacterium avium subsp. paratuberculosis
ggccaccacgacgccgggc

SEQ ID NO: 2854103 - RNA, 22 nt, Mycobacterium avium subsp. paratuberculosis
ggccaccacgacgccgggcgcc

SEQ ID NO: 2854104 - RNA, 13 nt, Mycobacterium avium subsp. paratuberculosis
ggccaccacgcca

SEQ ID NO: 2854105 - RNA, 15 nt, Mycobacterium avium subsp. paratuberculosis
ggccaccacgccagc

SEQ ID NO: 2854106 - RNA, 18 nt, Mycobacterium avium subsp. paratuberculosis
ggccaccacgccagccuc

SEQ ID NO: 2854107 - RNA, 16 nt, Mycobacterium avium subsp. paratuberculosis
ggccaccacggcaccg

SEQ ID NO: 2854108 - RNA, 13 nt, Mycobacterium avium subsp. paratuberculosis
ggccaccacgggu

SEQ ID NO: 2854109 - RNA, 15 nt, Mycobacterium avium subsp. paratuberculosis
ggccaccacgggucg

SEQ ID NO: 2854110 - RNA, 19 nt, Mycobacterium avium subsp. paratuberculosis
ggccaccacgggucggucg

SEQ ID NO: 2854111 - RNA, 21 nt, Mycobacterium avium subsp. paratuberculosis
ggccaccacgggucggucggc

SEQ ID NO: 2854112 - RNA, 22 nt, Mycobacterium avium subsp. paratuberculosis
ggccaccacgggucggucggcc

SEQ ID NO: 2854113 - RNA, 13 nt, Mycobacterium avium subsp. paratuberculosis
ggccaccagcagc

SEQ ID NO: 2854114 - RNA, 13 nt, Mycobacterium avium subsp. paratuberculosis
ggccaccagcgca

SEQ ID NO: 2854115 - RNA, 14 nt, Mycobacterium avium subsp. paratuberculosis
ggccaccagcgccc

SEQ ID NO: 2854116 - RNA, 14 nt, Mycobacterium avium subsp. paratuberculosis
ggccaccagcgcgg

SEQ ID NO: 2854117 - RNA, 20 nt, Mycobacterium avium subsp. paratuberculosis
ggccaccagcgcggccacca

SEQ ID NO: 2854118 - RNA, 21 nt, Mycobacterium avium subsp. paratuberculosis
ggccaccagcgcggccaccac

SEQ ID NO: 2854119 - RNA, 23 nt, Mycobacterium avium subsp. paratuberculosis
ggccaccagcgcggccaccacca

SEQ ID NO: 2854120 - RNA, 14 nt, Mycobacterium avium subsp. paratuberculosis
ggccaccaggcgcc

SEQ ID NO: 2854121 - RNA, 20 nt, Mycobacterium avium subsp. paratuberculosis
ggccaccagggacaugccga

SEQ ID NO: 2854122 - RNA, 22 nt, Mycobacterium avium subsp. paratuberculosis
ggccaccagggacaugccgagc

SEQ ID NO: 2854123 - RNA, 22 nt, Mycobacterium avium subsp. paratuberculosis
ggccaccagggucucgcgcagc

SEQ ID NO: 2854124 - RNA, 17 nt, Mycobacterium avium subsp. paratuberculosis
ggccaccaggucgcaca

SEQ ID NO: 2854125 - RNA, 13 nt, Mycobacterium avium subsp. paratuberculosis
ggccaccugggcg

SEQ ID NO: 2854126 - RNA, 15 nt, Mycobacterium avium subsp. paratuberculosis
ggccaccugggcggg

SEQ ID NO: 2854127 - RNA, 21 nt, Mycobacterium avium subsp. paratuberculosis
ggccaccuugcgcgggucgcc

SEQ ID NO: 2854128 - RNA, 21 nt, Mycobacterium avium subsp. paratuberculosis
ggccaccuuggacaggcccag

SEQ ID NO: 2854129 - RNA, 23 nt, Mycobacterium avium subsp. paratuberculosis
ggccaccuuggacaggcccagcg

SEQ ID NO: 2854130 - RNA, 16 nt, Mycobacterium avium subsp. paratuberculosis
ggccaccuugucggcg

SEQ ID NO: 2854131 - RNA, 18 nt, Mycobacterium avium subsp. paratuberculosis
ggccaccuugucggcgcc

SEQ ID NO: 2854132 - RNA, 20 nt, Mycobacterium avium subsp. paratuberculosis
ggccaccuugucggcgccca

SEQ ID NO: 2854133 - RNA, 14 nt, Mycobacterium avium subsp. paratuberculosis
ggccacgaccucgg

SEQ ID NO: 2854134 - RNA, 19 nt, Mycobacterium avium subsp. paratuberculosis
ggccacgaccucggggucg

SEQ ID NO: 2854135 - RNA, 12 nt, Mycobacterium avium subsp. paratuberculosis
ggccacgacgcg

SEQ ID NO: 2854136 - RNA, 19 nt, Mycobacterium avium subsp. paratuberculosis
ggccacgacgcggcgcgcg

SEQ ID NO: 2854137 - RNA, 21 nt, Mycobacterium avium subsp. paratuberculosis
ggccacgacgcggcgcgcgau

SEQ ID NO: 2854138 - RNA, 16 nt, Mycobacterium avium subsp. paratuberculosis
ggccacgacggcgcug

SEQ ID NO: 2854139 - RNA, 20 nt, Mycobacterium avium subsp. paratuberculosis
ggccacgacggcgcuggccg

SEQ ID NO: 2854140 - RNA, 19 nt, Mycobacterium avium subsp. paratuberculosis
ggccacgauccgcgcggcc

SEQ ID NO: 2854141 - RNA, 20 nt, Mycobacterium avium subsp. paratuberculosis
ggccacgauccgcgcggcca

SEQ ID NO: 2854142 - RNA, 14 nt, Mycobacterium avium subsp. paratuberculosis
ggccacgauccggg

SEQ ID NO: 2854143 - RNA, 20 nt, Mycobacterium avium subsp. paratuberculosis
ggccacgaucgcgaucgccg

SEQ ID NO: 2854144 - RNA, 21 nt, Mycobacterium avium subsp. paratuberculosis
ggccacgaucgcgaucgccga

SEQ ID NO: 2854145 - RNA, 19 nt, Mycobacterium avium subsp. paratuberculosis
ggccacgaucgcggccagc

SEQ ID NO: 2854146 - RNA, 20 nt, Mycobacterium avium subsp. paratuberculosis
ggccacgaucgcggccagcg

SEQ ID NO: 2854147 - RNA, 19 nt, Mycobacterium avium subsp. paratuberculosis
ggccacgaugaucgucggc

SEQ ID NO: 2854148 - RNA, 20 nt, Mycobacterium avium subsp. paratuberculosis
ggccacgauggggacgucga

SEQ ID NO: 2854149 - RNA, 14 nt, Mycobacterium avium subsp. paratuberculosis
ggccacgcaggcgu

SEQ ID NO: 2854150 - RNA, 19 nt, Mycobacterium avium subsp. paratuberculosis
ggccacgcaggcguccagg

SEQ ID NO: 2854151 - RNA, 19 nt, Mycobacterium avium subsp. paratuberculosis
ggccacgcagguccaggau

SEQ ID NO: 2854152 - RNA, 15 nt, Mycobacterium avium subsp. paratuberculosis
ggccacgcagucguc

SEQ ID NO: 2854153 - RNA, 16 nt, Mycobacterium avium subsp. paratuberculosis
ggccacgcagucgucg

SEQ ID NO: 2854154 - RNA, 22 nt, Mycobacterium avium subsp. paratuberculosis
ggccacgccccauugccgcgcc

SEQ ID NO: 2854155 - RNA, 18 nt, Mycobacterium avium subsp. paratuberculosis
ggccacgcccuggccgcc

SEQ ID NO: 2854156 - RNA, 12 nt, Mycobacterium avium subsp. paratuberculosis
ggccacgccgac

SEQ ID NO: 2854157 - RNA, 13 nt, Mycobacterium avium subsp. paratuberculosis
ggccacgccgacu

SEQ ID NO: 2854158 - RNA, 23 nt, Mycobacterium avium subsp. paratuberculosis
ggccacgccgacuagcgcggcgg

SEQ ID NO: 2854159 - RNA, 14 nt, Mycobacterium avium subsp. paratuberculosis
ggccacgcucgcca

SEQ ID NO: 2854160 - RNA, 17 nt, Mycobacterium avium subsp. paratuberculosis
ggccacgcucgccagac

SEQ ID NO: 2854161 - RNA, 19 nt, Mycobacterium avium subsp. paratuberculosis
ggccacgcucgccagaccg

SEQ ID NO: 2854162 - RNA, 14 nt, Mycobacterium avium subsp. paratuberculosis
ggccacgcucggcg

SEQ ID NO: 2854163 - RNA, 16 nt, Mycobacterium avium subsp. paratuberculosis
ggccacgcucggcggc

SEQ ID NO: 2854164 - RNA, 13 nt, Mycobacterium avium subsp. paratuberculosis
ggccacgcucggg

SEQ ID NO: 2854165 - RNA, 19 nt, Mycobacterium avium subsp. paratuberculosis
ggccacgcucgggccggcg

SEQ ID NO: 2854166 - RNA, 23 nt, Mycobacterium avium subsp. paratuberculosis
ggccacgcucgggccggcgccga

SEQ ID NO: 2854167 - RNA, 19 nt, Mycobacterium avium subsp. paratuberculosis
ggccacgcucucgccgguc

SEQ ID NO: 2854168 - RNA, 12 nt, Mycobacterium avium subsp. paratuberculosis
ggccacgcuggc

SEQ ID NO: 2854169 - RNA, 18 nt, Mycobacterium avium subsp. paratuberculosis
ggccacgcuggcguccag

SEQ ID NO: 2854170 - RNA, 13 nt, Mycobacterium avium subsp. paratuberculosis
ggccacggcgcga

SEQ ID NO: 2854171 - RNA, 16 nt, Mycobacterium avium subsp. paratuberculosis
ggccacggcgcgagga

SEQ ID NO: 2854172 - RNA, 23 nt, Mycobacterium avium subsp. paratuberculosis
ggccacggcguugaccaacgccg

SEQ ID NO: 2854173 - RNA, 17 nt, Mycobacterium avium subsp. paratuberculosis
ggccacguaguccgacg

SEQ ID NO: 2854174 - RNA, 18 nt, Mycobacterium avium subsp. paratuberculosis
ggccacgucgaagcccgg

SEQ ID NO: 2854175 - RNA, 14 nt, Mycobacterium avium subsp. paratuberculosis
ggccacgucgaugc

SEQ ID NO: 2854176 - RNA, 16 nt, Mycobacterium avium subsp. paratuberculosis
ggccacgucgaugccg

SEQ ID NO: 2854177 - RNA, 16 nt, Mycobacterium avium subsp. paratuberculosis
ggccacguugccgggu

SEQ ID NO: 2854178 - RNA, 13 nt, Mycobacterium avium subsp. paratuberculosis
ggccacucgccgc

SEQ ID NO: 2854179 - RNA, 15 nt, Mycobacterium avium subsp. paratuberculosis
ggccacucgccgcga

SEQ ID NO: 2854180 - RNA, 20 nt, Mycobacterium avium subsp. paratuberculosis
ggccacucgccgcgaacgac

SEQ ID NO: 2854181 - RNA, 13 nt, Mycobacterium avium subsp. paratuberculosis
ggccacucgcguc

SEQ ID NO: 2854182 - RNA, 15 nt, Mycobacterium avium subsp. paratuberculosis
ggccacugccccggc

SEQ ID NO: 2854183 - RNA, 17 nt, Mycobacterium avium subsp. paratuberculosis
ggccacugccccggcga

SEQ ID NO: 2854184 - RNA, 23 nt, Mycobacterium avium subsp. paratuberculosis
ggccagaccgcacaauccgguca

SEQ ID NO: 2854185 - RNA, 21 nt, Mycobacterium avium subsp. paratuberculosis
ggccagacugcgcaccgccag

SEQ ID NO: 2854186 - RNA, 22 nt, Mycobacterium avium subsp. paratuberculosis
ggccagauagaugagccgcagc

SEQ ID NO: 2854187 - RNA, 23 nt, Mycobacterium avium subsp. paratuberculosis
ggccagaucgacccccaccgcga

SEQ ID NO: 2854188 - RNA, 17 nt, Mycobacterium avium subsp. paratuberculosis
ggccagaucggccaggu

SEQ ID NO: 2854189 - RNA, 17 nt, Mycobacterium avium subsp. paratuberculosis
ggccagaugcccgcccc

SEQ ID NO: 2854190 - RNA, 22 nt, Mycobacterium avium subsp. paratuberculosis
ggccagaugcccgccccgcccg

SEQ ID NO: 2854191 - RNA, 16 nt, Mycobacterium avium subsp. paratuberculosis
ggccagcaacaccagc

SEQ ID NO: 2854192 - RNA, 22 nt, Mycobacterium avium subsp. paratuberculosis
ggccagcaacagcagcggcaug

SEQ ID NO: 2854193 - RNA, 12 nt, Mycobacterium avium subsp. paratuberculosis
ggccagcaaccg

SEQ ID NO: 2854194 - RNA, 21 nt, Mycobacterium avium subsp. paratuberculosis
ggccagcacacccucgacccg

SEQ ID NO: 2854195 - RNA, 22 nt, Mycobacterium avium subsp. paratuberculosis
ggccagcacacccucgacccgu

SEQ ID NO: 2854196 - RNA, 23 nt, Mycobacterium avium subsp. paratuberculosis
ggccagcacacccucgacccguu

SEQ ID NO: 2854197 - RNA, 11 nt, Mycobacterium avium subsp. paratuberculosis
ggccagcacca

SEQ ID NO: 2854198 - RNA, 14 nt, Mycobacterium avium subsp. paratuberculosis
ggccagcaccacca

SEQ ID NO: 2854199 - RNA, 16 nt, Mycobacterium avium subsp. paratuberculosis
ggccagcaccaccgcg

SEQ ID NO: 2854200 - RNA, 17 nt, Mycobacterium avium subsp. paratuberculosis
ggccagcaccaccgcga

SEQ ID NO: 2854201 - RNA, 21 nt, Mycobacterium avium subsp. paratuberculosis
ggccagcaccaccgcgagcgg

SEQ ID NO: 2854202 - RNA, 19 nt, Mycobacterium avium subsp. paratuberculosis
ggccagcaccacggugauc

SEQ ID NO: 2854203 - RNA, 14 nt, Mycobacterium avium subsp. paratuberculosis
ggccagcaccacgu

SEQ ID NO: 2854204 - RNA, 20 nt, Mycobacterium avium subsp. paratuberculosis
ggccagcaccacguccgcgg

SEQ ID NO: 2854205 - RNA, 21 nt, Mycobacterium avium subsp. paratuberculosis
ggccagcaccacguccgcggu

SEQ ID NO: 2854206 - RNA, 22 nt, Mycobacterium avium subsp. paratuberculosis
ggccagcaccacguccgcggug

SEQ ID NO: 2854207 - RNA, 16 nt, Mycobacterium avium subsp. paratuberculosis
ggccagcaccagcagc

SEQ ID NO: 2854208 - RNA, 19 nt, Mycobacterium avium subsp. paratuberculosis
ggccagcaccagcagccgg

SEQ ID NO: 2854209 - RNA, 22 nt, Mycobacterium avium subsp. paratuberculosis
ggccagcagguagaucgccagc

SEQ ID NO: 2854210 - RNA, 23 nt, Mycobacterium avium subsp. paratuberculosis
ggccagcagguagaucgccagcg

SEQ ID NO: 2854211 - RNA, 23 nt, Mycobacterium avium subsp. paratuberculosis
ggccagcaggucgaaggcggccg

SEQ ID NO: 2854212 - RNA, 23 nt, Mycobacterium avium subsp. paratuberculosis
ggccagcaggucgucgacguccu

SEQ ID NO: 2854213 - RNA, 15 nt, Mycobacterium avium subsp. paratuberculosis
ggccagcagucguga

SEQ ID NO: 2854214 - RNA, 20 nt, Mycobacterium avium subsp. paratuberculosis
ggccagcagucgugacgcgg

SEQ ID NO: 2854215 - RNA, 22 nt, Mycobacterium avium subsp. paratuberculosis
ggccagcagucgugacgcggcg

SEQ ID NO: 2854216 - RNA, 23 nt, Mycobacterium avium subsp. paratuberculosis
ggccagcagucgugacgcggcgu

SEQ ID NO: 2854217 - RNA, 22 nt, Mycobacterium avium subsp. paratuberculosis
ggccagcagugccaacacggcg

SEQ ID NO: 2854218 - RNA, 23 nt, Mycobacterium avium subsp. paratuberculosis
ggccagcagugccaacacggcgg

SEQ ID NO: 2854219 - RNA, 20 nt, Mycobacterium avium subsp. paratuberculosis
ggccagcagugccaccacca

SEQ ID NO: 2854220 - RNA, 17 nt, Mycobacterium avium subsp. paratuberculosis
ggccagcaguucgucca

SEQ ID NO: 2854221 - RNA, 22 nt, Mycobacterium avium subsp. paratuberculosis
ggccagcaguucguccacgcug

SEQ ID NO: 2854222 - RNA, 23 nt, Mycobacterium avium subsp. paratuberculosis
ggccagcaguucguccacgcugg

SEQ ID NO: 2854223 - RNA, 13 nt, Mycobacterium avium subsp. paratuberculosis
ggccagcaucucg

SEQ ID NO: 2854224 - RNA, 19 nt, Mycobacterium avium subsp. paratuberculosis
ggccagcaucucggcgaag

SEQ ID NO: 2854225 - RNA, 22 nt, Mycobacterium avium subsp. paratuberculosis
ggccagcaucucggcgaagguc

SEQ ID NO: 2854226 - RNA, 16 nt, Mycobacterium avium subsp. paratuberculosis
ggccagccacgccgac

SEQ ID NO: 2854227 - RNA, 19 nt, Mycobacterium avium subsp. paratuberculosis
ggccagccagccgcccagc

SEQ ID NO: 2854228 - RNA, 22 nt, Mycobacterium avium subsp. paratuberculosis
ggccagccaggccgucggcgcg

SEQ ID NO: 2854229 - RNA, 17 nt, Mycobacterium avium subsp. paratuberculosis
ggccagcccaucccgau

SEQ ID NO: 2854230 - RNA, 15 nt, Mycobacterium avium subsp. paratuberculosis
ggccagccccaccac

SEQ ID NO: 2854231 - RNA, 17 nt, Mycobacterium avium subsp. paratuberculosis
ggccagccccaccaccg

SEQ ID NO: 2854232 - RNA, 20 nt, Mycobacterium avium subsp. paratuberculosis
ggccagccccaccaccgcca

SEQ ID NO: 2854233 - RNA, 21 nt, Mycobacterium avium subsp. paratuberculosis
ggccagccccaccaccgccac

SEQ ID NO: 2854234 - RNA, 23 nt, Mycobacterium avium subsp. paratuberculosis
ggccagccccaccaccgccacca

SEQ ID NO: 2854235 - RNA, 24 nt, Mycobacterium avium subsp. paratuberculosis
ggccagccccgggaaccagcccag

SEQ ID NO: 2854236 - RNA, 13 nt, Mycobacterium avium subsp. paratuberculosis
ggccagcccgcgg

SEQ ID NO: 2854237 - RNA, 15 nt, Mycobacterium avium subsp. paratuberculosis
ggccagcccgcggca

SEQ ID NO: 2854238 - RNA, 13 nt, Mycobacterium avium subsp. paratuberculosis
ggccagcccggcg

SEQ ID NO: 2854239 - RNA, 14 nt, Mycobacterium avium subsp. paratuberculosis
ggccagcccggcgu

SEQ ID NO: 2854240 - RNA, 12 nt, Mycobacterium avium subsp. paratuberculosis
ggccagcccggg

SEQ ID NO: 2854241 - RNA, 13 nt, Mycobacterium avium subsp. paratuberculosis
ggccagcccggga

SEQ ID NO: 2854242 - RNA, 19 nt, Mycobacterium avium subsp. paratuberculosis
ggccagccgaugcgcccgc

SEQ ID NO: 2854243 - RNA, 20 nt, Mycobacterium avium subsp. paratuberculosis
ggccagccgaugcgcccgcg

SEQ ID NO: 2854244 - RNA, 12 nt, Mycobacterium avium subsp. paratuberculosis
ggccagccgcgc

SEQ ID NO: 2854245 - RNA, 15 nt, Mycobacterium avium subsp. paratuberculosis
ggccagccgcgcgac

SEQ ID NO: 2854246 - RNA, 18 nt, Mycobacterium avium subsp. paratuberculosis
ggccagccgcgcggcguc

SEQ ID NO: 2854247 - RNA, 21 nt, Mycobacterium avium subsp. paratuberculosis
ggccagccgcgcggcgucggc

SEQ ID NO: 2854248 - RNA, 23 nt, Mycobacterium avium subsp. paratuberculosis
ggccagccgcgcggcgucggccg

SEQ ID NO: 2854249 - RNA, 18 nt, Mycobacterium avium subsp. paratuberculosis
ggccagccgcucccggcg

SEQ ID NO: 2854250 - RNA, 15 nt, Mycobacterium avium subsp. paratuberculosis
ggccagccggccgcu

SEQ ID NO: 2854251 - RNA, 14 nt, Mycobacterium avium subsp. paratuberculosis
ggccagccgggcga

SEQ ID NO: 2854252 - RNA, 15 nt, Mycobacterium avium subsp. paratuberculosis
ggccagccgggcgac

SEQ ID NO: 2854253 - RNA, 17 nt, Mycobacterium avium subsp. paratuberculosis
ggccagccgggcgaccg

SEQ ID NO: 2854254 - RNA, 16 nt, Mycobacterium avium subsp. paratuberculosis
ggccagccgggcggcc

SEQ ID NO: 2854255 - RNA, 12 nt, Mycobacterium avium subsp. paratuberculosis
ggccagccgggg

SEQ ID NO: 2854256 - RNA, 21 nt, Mycobacterium avium subsp. paratuberculosis
ggccagccgggguagggcggc

SEQ ID NO: 2854257 - RNA, 16 nt, Mycobacterium avium subsp. paratuberculosis
ggccagccggucgucg

SEQ ID NO: 2854258 - RNA, 19 nt, Mycobacterium avium subsp. paratuberculosis
ggccagccggucgucgggg

SEQ ID NO: 2854259 - RNA, 20 nt, Mycobacterium avium subsp. paratuberculosis
ggccagccgguugcgguggc

SEQ ID NO: 2854260 - RNA, 23 nt, Mycobacterium avium subsp. paratuberculosis
ggccagccgguugcgguggccga

SEQ ID NO: 2854261 - RNA, 14 nt, Mycobacterium avium subsp. paratuberculosis
ggccagcgaauggc

SEQ ID NO: 2854262 - RNA, 20 nt, Mycobacterium avium subsp. paratuberculosis
ggccagcgaauggcaauacg

SEQ ID NO: 2854263 - RNA, 19 nt, Mycobacterium avium subsp. paratuberculosis
ggccagcgagaagucgcuc

SEQ ID NO: 2854264 - RNA, 22 nt, Mycobacterium avium subsp. paratuberculosis
ggccagcgagaagucgcucagc

SEQ ID NO: 2854265 - RNA, 19 nt, Mycobacterium avium subsp. paratuberculosis
ggccagcgaguccagccag

SEQ ID NO: 2854266 - RNA, 20 nt, Mycobacterium avium subsp. paratuberculosis
ggccagcgaguccagccagc

SEQ ID NO: 2854267 - RNA, 21 nt, Mycobacterium avium subsp. paratuberculosis
ggccagcgaguccagccagcc

SEQ ID NO: 2854268 - RNA, 17 nt, Mycobacterium avium subsp. paratuberculosis
ggccagcgagucgauga

SEQ ID NO: 2854269 - RNA, 18 nt, Mycobacterium avium subsp. paratuberculosis
ggccagcgagucgaugac

SEQ ID NO: 2854270 - RNA, 14 nt, Mycobacterium avium subsp. paratuberculosis
ggccagcgcaucgg

SEQ ID NO: 2854271 - RNA, 13 nt, Mycobacterium avium subsp. paratuberculosis
ggccagcgccagc

SEQ ID NO: 2854272 - RNA, 14 nt, Mycobacterium avium subsp. paratuberculosis
ggccagcgccagcg

SEQ ID NO: 2854273 - RNA, 17 nt, Mycobacterium avium subsp. paratuberculosis
ggccagcgccagcgcca

SEQ ID NO: 2854274 - RNA, 19 nt, Mycobacterium avium subsp. paratuberculosis
ggccagcgccagcgccagc

SEQ ID NO: 2854275 - RNA, 22 nt, Mycobacterium avium subsp. paratuberculosis
ggccagcgccaugccgccgacc

SEQ ID NO: 2854276 - RNA, 17 nt, Mycobacterium avium subsp. paratuberculosis
ggccagcgcccgcgcga

SEQ ID NO: 2854277 - RNA, 18 nt, Mycobacterium avium subsp. paratuberculosis
ggccagcgcccgcgcgau

SEQ ID NO: 2854278 - RNA, 15 nt, Mycobacterium avium subsp. paratuberculosis
ggccagcgcccgcgg

SEQ ID NO: 2854279 - RNA, 17 nt, Mycobacterium avium subsp. paratuberculosis
ggccagcgcccgcgggu

SEQ ID NO: 2854280 - RNA, 19 nt, Mycobacterium avium subsp. paratuberculosis
ggccagcgcccgcgggugc

SEQ ID NO: 2854281 - RNA, 12 nt, Mycobacterium avium subsp. paratuberculosis
ggccagcgccga

SEQ ID NO: 2854282 - RNA, 21 nt, Mycobacterium avium subsp. paratuberculosis
ggccagcgccgagaucgcggu

SEQ ID NO: 2854283 - RNA, 15 nt, Mycobacterium avium subsp. paratuberculosis
ggccagcgccgagcc

SEQ ID NO: 2854284 - RNA, 13 nt, Mycobacterium avium subsp. paratuberculosis
ggccagcgccgcc

SEQ ID NO: 2854285 - RNA, 15 nt, Mycobacterium avium subsp. paratuberculosis
ggccagcgccgcccg

SEQ ID NO: 2854286 - RNA, 16 nt, Mycobacterium avium subsp. paratuberculosis
ggccagcgccgcccgg

SEQ ID NO: 2854287 - RNA, 18 nt, Mycobacterium avium subsp. paratuberculosis
ggccagcgccgcccgggc

SEQ ID NO: 2854288 - RNA, 14 nt, Mycobacterium avium subsp. paratuberculosis
ggccagcgccguca

SEQ ID NO: 2854289 - RNA, 16 nt, Mycobacterium avium subsp. paratuberculosis
ggccagcgccuccagc

SEQ ID NO: 2854290 - RNA, 17 nt, Mycobacterium avium subsp. paratuberculosis
ggccagcgccuccagcc

SEQ ID NO: 2854291 - RNA, 19 nt, Mycobacterium avium subsp. paratuberculosis
ggccagcgccuccagccgc

SEQ ID NO: 2854292 - RNA, 16 nt, Mycobacterium avium subsp. paratuberculosis
ggccagcgccuucggc

SEQ ID NO: 2854293 - RNA, 16 nt, Mycobacterium avium subsp. paratuberculosis
ggccagcucgaccgcg

SEQ ID NO: 2854294 - RNA, 13 nt, Mycobacterium avium subsp. paratuberculosis
ggccagcucgccg

SEQ ID NO: 2854295 - RNA, 15 nt, Mycobacterium avium subsp. paratuberculosis
ggccagcucgccgcc

SEQ ID NO: 2854296 - RNA, 17 nt, Mycobacterium avium subsp. paratuberculosis
ggccagcucgccgccga

SEQ ID NO: 2854297 - RNA, 11 nt, Mycobacterium avium subsp. paratuberculosis
ggccagcucgg

SEQ ID NO: 2854298 - RNA, 14 nt, Mycobacterium avium subsp. paratuberculosis
ggccagcucggccc

SEQ ID NO: 2854299 - RNA, 17 nt, Mycobacterium avium subsp. paratuberculosis
ggccagcucggcccgcu

SEQ ID NO: 2854300 - RNA, 19 nt, Mycobacterium avium subsp. paratuberculosis
ggccagcucggcccgcugc

SEQ ID NO: 2854301 - RNA, 16 nt, Mycobacterium avium subsp. paratuberculosis
ggccagcucggcggcc

SEQ ID NO: 2854302 - RNA, 22 nt, Mycobacterium avium subsp. paratuberculosis
ggccagcucggcggccaugucg

SEQ ID NO: 2854303 - RNA, 15 nt, Mycobacterium avium subsp. paratuberculosis
ggccagcucggcgug

SEQ ID NO: 2854304 - RNA, 17 nt, Mycobacterium avium subsp. paratuberculosis
ggccagcucggcguggu

SEQ ID NO: 2854305 - RNA, 19 nt, Mycobacterium avium subsp. paratuberculosis
ggccagcucggcguggucg

SEQ ID NO: 2854306 - RNA, 19 nt, Mycobacterium avium subsp. paratuberculosis
ggccagcucggucgcgguc

SEQ ID NO: 2854307 - RNA, 23 nt, Mycobacterium avium subsp. paratuberculosis
ggccagcucggucgcggucggcg

SEQ ID NO: 2854308 - RNA, 18 nt, Mycobacterium avium subsp. paratuberculosis
ggccagcucgucgagccg

SEQ ID NO: 2854309 - RNA, 19 nt, Mycobacterium avium subsp. paratuberculosis
ggccagcucgucgagccgg

SEQ ID NO: 2854310 - RNA, 21 nt, Mycobacterium avium subsp. paratuberculosis
ggccagcucgucgagccggcc

SEQ ID NO: 2854311 - RNA, 15 nt, Mycobacterium avium subsp. paratuberculosis
ggccagcucgucgcg

SEQ ID NO: 2854312 - RNA, 15 nt, Mycobacterium avium subsp. paratuberculosis
ggccagcugauagcc

SEQ ID NO: 2854313 - RNA, 16 nt, Mycobacterium avium subsp. paratuberculosis
ggccagcugcaccggg

SEQ ID NO: 2854314 - RNA, 17 nt, Mycobacterium avium subsp. paratuberculosis
ggccagcugcaccgggg

SEQ ID NO: 2854315 - RNA, 19 nt, Mycobacterium avium subsp. paratuberculosis
ggccagcugcaccggggcc

SEQ ID NO: 2854316 - RNA, 16 nt, Mycobacterium avium subsp. paratuberculosis
ggccagcugcccgccg

SEQ ID NO: 2854317 - RNA, 18 nt, Mycobacterium avium subsp. paratuberculosis
ggccagcugcccgccgac

SEQ ID NO: 2854318 - RNA, 17 nt, Mycobacterium avium subsp. paratuberculosis
ggccagcugcgacagca

SEQ ID NO: 2854319 - RNA, 21 nt, Mycobacterium avium subsp. paratuberculosis
ggccagcugcgacagcacggg

SEQ ID NO: 2854320 - RNA, 22 nt, Mycobacterium avium subsp. paratuberculosis
ggccagcugcggguugcgggcc

SEQ ID NO: 2854321 - RNA, 13 nt, Mycobacterium avium subsp. paratuberculosis
ggccagcugcucg

SEQ ID NO: 2854322 - RNA, 20 nt, Mycobacterium avium subsp. paratuberculosis
ggccagcuucaccggucggg

SEQ ID NO: 2854323 - RNA, 18 nt, Mycobacterium avium subsp. paratuberculosis
ggccagcuuuccggccgc

SEQ ID NO: 2854324 - RNA, 14 nt, Mycobacterium avium subsp. paratuberculosis
ggccaggaacggcg

SEQ ID NO: 2854325 - RNA, 17 nt, Mycobacterium avium subsp. paratuberculosis
ggccaggaacggcgcca

SEQ ID NO: 2854326 - RNA, 21 nt, Mycobacterium avium subsp. paratuberculosis
ggccaggaagaacuccgcgau

SEQ ID NO: 2854327 - RNA, 22 nt, Mycobacterium avium subsp. paratuberculosis
ggccaggaagaacuccgcgaug

SEQ ID NO: 2854328 - RNA, 18 nt, Mycobacterium avium subsp. paratuberculosis
ggccaggaagccggcgac

SEQ ID NO: 2854329 - RNA, 21 nt, Mycobacterium avium subsp. paratuberculosis
ggccaggaccgggacgacggc

SEQ ID NO: 2854330 - RNA, 17 nt, Mycobacterium avium subsp. paratuberculosis
ggccaggaucgcguuga

SEQ ID NO: 2854331 - RNA, 19 nt, Mycobacterium avium subsp. paratuberculosis
ggccaggaucucgcgggcc

SEQ ID NO: 2854332 - RNA, 16 nt, Mycobacterium avium subsp. paratuberculosis
ggccaggaucucgucg

SEQ ID NO: 2854333 - RNA, 18 nt, Mycobacterium avium subsp. paratuberculosis
ggccaggaucucgucggg

SEQ ID NO: 2854334 - RNA, 19 nt, Mycobacterium avium subsp. paratuberculosis
ggccaggaucucgucggga

SEQ ID NO: 2854335 - RNA, 19 nt, Mycobacterium avium subsp. paratuberculosis
ggccaggaucuugucggcg

SEQ ID NO: 2854336 - RNA, 21 nt, Mycobacterium avium subsp. paratuberculosis
ggccaggaucuugucggcggc

SEQ ID NO: 2854337 - RNA, 22 nt, Mycobacterium avium subsp. paratuberculosis
ggccaggaucuugucggcggcc

SEQ ID NO: 2854338 - RNA, 17 nt, Mycobacterium avium subsp. paratuberculosis
ggccaggaugaaccggg

SEQ ID NO: 2854339 - RNA, 18 nt, Mycobacterium avium subsp. paratuberculosis
ggccaggaugaaccggga

SEQ ID NO: 2854340 - RNA, 15 nt, Mycobacterium avium subsp. paratuberculosis
ggccaggaugaccgc

SEQ ID NO: 2854341 - RNA, 16 nt, Mycobacterium avium subsp. paratuberculosis
ggccaggaugaccgcc

SEQ ID NO: 2854342 - RNA, 15 nt, Mycobacterium avium subsp. paratuberculosis
ggccaggaugccgaa

SEQ ID NO: 2854343 - RNA, 17 nt, Mycobacterium avium subsp. paratuberculosis
ggccaggaugccgaacg

SEQ ID NO: 2854344 - RNA, 23 nt, Mycobacterium avium subsp. paratuberculosis
ggccaggauggagcugaccuggc

SEQ ID NO: 2854345 - RNA, 22 nt, Mycobacterium avium subsp. paratuberculosis
ggccaggauguucaccccggcg

SEQ ID NO: 2854346 - RNA, 23 nt, Mycobacterium avium subsp. paratuberculosis
ggccaggauguucaccccggcgc

SEQ ID NO: 2854347 - RNA, 17 nt, Mycobacterium avium subsp. paratuberculosis
ggccaggcccaccgucg

SEQ ID NO: 2854348 - RNA, 14 nt, Mycobacterium avium subsp. paratuberculosis
ggccaggcccagcc

SEQ ID NO: 2854349 - RNA, 16 nt, Mycobacterium avium subsp. paratuberculosis
ggccaggcccugccag

SEQ ID NO: 2854350 - RNA, 17 nt, Mycobacterium avium subsp. paratuberculosis
ggccaggcccugccagc

SEQ ID NO: 2854351 - RNA, 19 nt, Mycobacterium avium subsp. paratuberculosis
ggccaggcccugccagcgc

SEQ ID NO: 2854352 - RNA, 13 nt, Mycobacterium avium subsp. paratuberculosis
ggccaggccggcc

SEQ ID NO: 2854353 - RNA, 14 nt, Mycobacterium avium subsp. paratuberculosis
ggccaggccggcga

SEQ ID NO: 2854354 - RNA, 15 nt, Mycobacterium avium subsp. paratuberculosis
ggccaggccggcgac

SEQ ID NO: 2854355 - RNA, 16 nt, Mycobacterium avium subsp. paratuberculosis
ggccaggccggcgacg

SEQ ID NO: 2854356 - RNA, 17 nt, Mycobacterium avium subsp. paratuberculosis
ggccaggccggcgacga

SEQ ID NO: 2854357 - RNA, 15 nt, Mycobacterium avium subsp. paratuberculosis
ggccaggcgcccagc

SEQ ID NO: 2854358 - RNA, 16 nt, Mycobacterium avium subsp. paratuberculosis
ggccaggcgcccagca

SEQ ID NO: 2854359 - RNA, 17 nt, Mycobacterium avium subsp. paratuberculosis
ggccaggcgcccagcac

SEQ ID NO: 2854360 - RNA, 17 nt, Mycobacterium avium subsp. paratuberculosis
ggccaggcgcgcgcugg

SEQ ID NO: 2854361 - RNA, 11 nt, Mycobacterium avium subsp. paratuberculosis
ggccaggcggg

SEQ ID NO: 2854362 - RNA, 17 nt, Mycobacterium avium subsp. paratuberculosis
ggccaggcgggacguug

SEQ ID NO: 2854363 - RNA, 18 nt, Mycobacterium avium subsp. paratuberculosis
ggccaggcgggacguugu

SEQ ID NO: 2854364 - RNA, 13 nt, Mycobacterium avium subsp. paratuberculosis
ggccaggcgggcc

SEQ ID NO: 2854365 - RNA, 14 nt, Mycobacterium avium subsp. paratuberculosis
ggccaggcgggcca

SEQ ID NO: 2854366 - RNA, 16 nt, Mycobacterium avium subsp. paratuberculosis
ggccaggcguuuggug

SEQ ID NO: 2854367 - RNA, 15 nt, Mycobacterium avium subsp. paratuberculosis
ggccagggcccgcag

SEQ ID NO: 2854368 - RNA, 16 nt, Mycobacterium avium subsp. paratuberculosis
ggccagggcccgcagc

SEQ ID NO: 2854369 - RNA, 18 nt, Mycobacterium avium subsp. paratuberculosis
ggccagggcccgcagccg

SEQ ID NO: 2854370 - RNA, 14 nt, Mycobacterium avium subsp. paratuberculosis
ggccagggccgccg

SEQ ID NO: 2854371 - RNA, 14 nt, Mycobacterium avium subsp. paratuberculosis
ggccagggcgagga

SEQ ID NO: 2854372 - RNA, 13 nt, Mycobacterium avium subsp. paratuberculosis
ggccagggcggcc

SEQ ID NO: 2854373 - RNA, 14 nt, Mycobacterium avium subsp. paratuberculosis
ggccagggcggcgc

SEQ ID NO: 2854374 - RNA, 13 nt, Mycobacterium avium subsp. paratuberculosis
ggccagggcgugg

SEQ ID NO: 2854375 - RNA, 22 nt, Mycobacterium avium subsp. paratuberculosis
ggccagggcguggaacgcgucg

SEQ ID NO: 2854376 - RNA, 17 nt, Mycobacterium avium subsp. paratuberculosis
ggccagggugacgguca

SEQ ID NO: 2854377 - RNA, 22 nt, Mycobacterium avium subsp. paratuberculosis
ggccaggguggggaucacgucg

SEQ ID NO: 2854378 - RNA, 20 nt, Mycobacterium avium subsp. paratuberculosis
ggccaucgccugagcaaccg

SEQ ID NO: 2854379 - RNA, 13 nt, Mycobacterium avium subsp. paratuberculosis
ggccaucgcggcc

SEQ ID NO: 2854380 - RNA, 13 nt, Mycobacterium avium subsp. paratuberculosis
ggccaucgcgggu

SEQ ID NO: 2854381 - RNA, 14 nt, Mycobacterium avium subsp. paratuberculosis
ggccaucgcgggug

SEQ ID NO: 2854382 - RNA, 15 nt, Mycobacterium avium subsp. paratuberculosis
ggccaucgcggguga

SEQ ID NO: 2854383 - RNA, 14 nt, Mycobacterium avium subsp. paratuberculosis
ggccaucggcagac

SEQ ID NO: 2854384 - RNA, 21 nt, Mycobacterium avium subsp. paratuberculosis
ggccaucggcagacccagcag

SEQ ID NO: 2854385 - RNA, 14 nt, Mycobacterium avium subsp. paratuberculosis
ggccaucuggccgc

SEQ ID NO: 2854386 - RNA, 15 nt, Mycobacterium avium subsp. paratuberculosis
ggccaucuggccgcg

SEQ ID NO: 2854387 - RNA, 13 nt, Mycobacterium avium subsp. paratuberculosis
ggccaucuucagu

SEQ ID NO: 2854388 - RNA, 15 nt, Mycobacterium avium subsp. paratuberculosis
ggccaugaagccguu

SEQ ID NO: 2854389 - RNA, 17 nt, Mycobacterium avium subsp. paratuberculosis
ggccaugaagccguugc

SEQ ID NO: 2854390 - RNA, 22 nt, Mycobacterium avium subsp. paratuberculosis
ggccaugaagccguugccgccg

SEQ ID NO: 2854391 - RNA, 23 nt, Mycobacterium avium subsp. paratuberculosis
ggccaugaauucgaacugggugg

SEQ ID NO: 2854392 - RNA, 16 nt, Mycobacterium avium subsp. paratuberculosis
ggccaugaccaugucg

SEQ ID NO: 2854393 - RNA, 19 nt, Mycobacterium avium subsp. paratuberculosis
ggccaugaccaugucgacg

SEQ ID NO: 2854394 - RNA, 20 nt, Mycobacterium avium subsp. paratuberculosis
ggccaugaccaugucgacgc

SEQ ID NO: 2854395 - RNA, 22 nt, Mycobacterium avium subsp. paratuberculosis
ggccaugcagaccagcccgucg

SEQ ID NO: 2854396 - RNA, 13 nt, Mycobacterium avium subsp. paratuberculosis
ggccaugccggcc

SEQ ID NO: 2854397 - RNA, 16 nt, Mycobacterium avium subsp. paratuberculosis
ggccaugccggccuga

SEQ ID NO: 2854398 - RNA, 19 nt, Mycobacterium avium subsp. paratuberculosis
ggccaugccucuucggcgc

SEQ ID NO: 2854399 - RNA, 20 nt, Mycobacterium avium subsp. paratuberculosis
ggccaugccucuucggcgcg

SEQ ID NO: 2854400 - RNA, 21 nt, Mycobacterium avium subsp. paratuberculosis
ggccaugccucuucggcgcgc

SEQ ID NO: 2854401 - RNA, 16 nt, Mycobacterium avium subsp. paratuberculosis
ggccaugcgcgagucg

SEQ ID NO: 2854402 - RNA, 23 nt, Mycobacterium avium subsp. paratuberculosis
ggccaugcgcgagucgagcaccg

SEQ ID NO: 2854403 - RNA, 14 nt, Mycobacterium avium subsp. paratuberculosis
ggccauggccagga

SEQ ID NO: 2854404 - RNA, 19 nt, Mycobacterium avium subsp. paratuberculosis
ggccauggugccgccguug

SEQ ID NO: 2854405 - RNA, 20 nt, Mycobacterium avium subsp. paratuberculosis
ggccauguccccgaccauca

SEQ ID NO: 2854406 - RNA, 20 nt, Mycobacterium avium subsp. paratuberculosis
ggcccaacacgcccugcagg

SEQ ID NO: 2854407 - RNA, 22 nt, Mycobacterium avium subsp. paratuberculosis
ggcccaaccgcauucggccgcc

SEQ ID NO: 2854408 - RNA, 23 nt, Mycobacterium avium subsp. paratuberculosis
ggcccaaccgcauucggccgcca

SEQ ID NO: 2854409 - RNA, 17 nt, Mycobacterium avium subsp. paratuberculosis
ggcccaagacccgcguc

SEQ ID NO: 2854410 - RNA, 21 nt, Mycobacterium avium subsp. paratuberculosis
ggcccaauaccguuccgcccc

SEQ ID NO: 2854411 - RNA, 17 nt, Mycobacterium avium subsp. paratuberculosis
ggcccaauucguaggcg

SEQ ID NO: 2854412 - RNA, 12 nt, Mycobacterium avium subsp. paratuberculosis
ggcccacacgcg

SEQ ID NO: 2854413 - RNA, 10 nt, Mycobacterium avium subsp. paratuberculosis
ggcccacagc

SEQ ID NO: 2854414 - RNA, 14 nt, Mycobacterium avium subsp. paratuberculosis
ggcccacagcagcc

SEQ ID NO: 2854415 - RNA, 14 nt, Mycobacterium avium subsp. paratuberculosis
ggcccaccaccgcc

SEQ ID NO: 2854416 - RNA, 22 nt, Mycobacterium avium subsp. paratuberculosis
ggcccaccaccgccucgacggu

SEQ ID NO: 2854417 - RNA, 20 nt, Mycobacterium avium subsp. paratuberculosis
ggcccacccacucggacagg

SEQ ID NO: 2854418 - RNA, 16 nt, Mycobacterium avium subsp. paratuberculosis
ggcccacccgcagggc

SEQ ID NO: 2854419 - RNA, 17 nt, Mycobacterium avium subsp. paratuberculosis
ggcccacccggaugucg

SEQ ID NO: 2854420 - RNA, 19 nt, Mycobacterium avium subsp. paratuberculosis
ggcccacccggaugucgug

SEQ ID NO: 2854421 - RNA, 22 nt, Mycobacterium avium subsp. paratuberculosis
ggcccacccggaugucgugcgg

SEQ ID NO: 2854422 - RNA, 23 nt, Mycobacterium avium subsp. paratuberculosis
ggcccacccggaugucgugcggu

SEQ ID NO: 2854423 - RNA, 15 nt, Mycobacterium avium subsp. paratuberculosis
ggcccaccgccacca

SEQ ID NO: 2854424 - RNA, 14 nt, Mycobacterium avium subsp. paratuberculosis
ggcccaccgcgacc

SEQ ID NO: 2854425 - RNA, 18 nt, Mycobacterium avium subsp. paratuberculosis
ggcccaccgcgacccggc

SEQ ID NO: 2854426 - RNA, 15 nt, Mycobacterium avium subsp. paratuberculosis
ggcccaccgcgcgcu

SEQ ID NO: 2854427 - RNA, 16 nt, Mycobacterium avium subsp. paratuberculosis
ggcccaccgcgcgcug

SEQ ID NO: 2854428 - RNA, 13 nt, Mycobacterium avium subsp. paratuberculosis
ggcccaccgcguc

SEQ ID NO: 2854429 - RNA, 15 nt, Mycobacterium avium subsp. paratuberculosis
ggcccaccggcccgg

SEQ ID NO: 2854430 - RNA, 16 nt, Mycobacterium avium subsp. paratuberculosis
ggcccaccggcccggc

SEQ ID NO: 2854431 - RNA, 17 nt, Mycobacterium avium subsp. paratuberculosis
ggcccaccggcccggcg

SEQ ID NO: 2854432 - RNA, 15 nt, Mycobacterium avium subsp. paratuberculosis
ggcccaccgucgcca

SEQ ID NO: 2854433 - RNA, 15 nt, Mycobacterium avium subsp. paratuberculosis
ggcccacgacgucug

SEQ ID NO: 2854434 - RNA, 23 nt, Mycobacterium avium subsp. paratuberculosis
ggcccacgacgucugggccgccg

SEQ ID NO: 2854435 - RNA, 16 nt, Mycobacterium avium subsp. paratuberculosis
ggcccacgcucgacgc

SEQ ID NO: 2854436 - RNA, 17 nt, Mycobacterium avium subsp. paratuberculosis
ggcccacgcucgacgcg

SEQ ID NO: 2854437 - RNA, 18 nt, Mycobacterium avium subsp. paratuberculosis
ggcccacgggaugcggca

SEQ ID NO: 2854438 - RNA, 15 nt, Mycobacterium avium subsp. paratuberculosis
ggcccacggugauuc

SEQ ID NO: 2854439 - RNA, 20 nt, Mycobacterium avium subsp. paratuberculosis
ggcccacgucgcgccgaugu

SEQ ID NO: 2854440 - RNA, 20 nt, Mycobacterium avium subsp. paratuberculosis
ggcccacguugagcacgccc

SEQ ID NO: 2854441 - RNA, 23 nt, Mycobacterium avium subsp. paratuberculosis
ggcccacguugagcacgcccgcg

SEQ ID NO: 2854442 - RNA, 19 nt, Mycobacterium avium subsp. paratuberculosis
ggcccacugccugacccgg

SEQ ID NO: 2854443 - RNA, 19 nt, Mycobacterium avium subsp. paratuberculosis
ggcccagacaggccggccg

SEQ ID NO: 2854444 - RNA, 20 nt, Mycobacterium avium subsp. paratuberculosis
ggcccagacaggccggccgc

SEQ ID NO: 2854445 - RNA, 22 nt, Mycobacterium avium subsp. paratuberculosis
ggcccagacgaugucgucgccg

SEQ ID NO: 2854446 - RNA, 15 nt, Mycobacterium avium subsp. paratuberculosis
ggcccagaucgcggu

SEQ ID NO: 2854447 - RNA, 16 nt, Mycobacterium avium subsp. paratuberculosis
ggcccagaucgcgguc

SEQ ID NO: 2854448 - RNA, 14 nt, Mycobacterium avium subsp. paratuberculosis
ggcccagcaccacc

SEQ ID NO: 2854449 - RNA, 21 nt, Mycobacterium avium subsp. paratuberculosis
ggcccagcagauagcccagcc

SEQ ID NO: 2854450 - RNA, 22 nt, Mycobacterium avium subsp. paratuberculosis
ggcccagcagauagcccagcca

SEQ ID NO: 2854451 - RNA, 15 nt, Mycobacterium avium subsp. paratuberculosis
ggcccagcagcaccg

SEQ ID NO: 2854452 - RNA, 18 nt, Mycobacterium avium subsp. paratuberculosis
ggcccagcagcaccgcga

SEQ ID NO: 2854453 - RNA, 12 nt, Mycobacterium avium subsp. paratuberculosis
ggcccagcagcc

SEQ ID NO: 2854454 - RNA, 13 nt, Mycobacterium avium subsp. paratuberculosis
ggcccagcagccu

SEQ ID NO: 2854455 - RNA, 19 nt, Mycobacterium avium subsp. paratuberculosis
ggcccagcagccugccccc

SEQ ID NO: 2854456 - RNA, 22 nt, Mycobacterium avium subsp. paratuberculosis
ggcccagcagcgcaccggcgau

SEQ ID NO: 2854457 - RNA, 22 nt, Mycobacterium avium subsp. paratuberculosis
ggcccagcccaccgaucgcgag

SEQ ID NO: 2854458 - RNA, 14 nt, Mycobacterium avium subsp. paratuberculosis
ggcccagcccgccg

SEQ ID NO: 2854459 - RNA, 16 nt, Mycobacterium avium subsp. paratuberculosis
ggcccagcccgccgcg

SEQ ID NO: 2854460 - RNA, 14 nt, Mycobacterium avium subsp. paratuberculosis
ggcccagcccggcc

SEQ ID NO: 2854461 - RNA, 17 nt, Mycobacterium avium subsp. paratuberculosis
ggcccagcccggccagc

SEQ ID NO: 2854462 - RNA, 18 nt, Mycobacterium avium subsp. paratuberculosis
ggcccagcccggccagca

SEQ ID NO: 2854463 - RNA, 16 nt, Mycobacterium avium subsp. paratuberculosis
ggccccggccggcggg

SEQ ID NO: 2854464 - RNA, 14 nt, Mycobacterium avium subsp. paratuberculosis
ggccccggccgggc

SEQ ID NO: 2854465 - RNA, 18 nt, Mycobacterium avium subsp. paratuberculosis
ggccccggccgggcgacu

SEQ ID NO: 2854466 - RNA, 18 nt, Mycobacterium avium subsp. paratuberculosis
ggccccggcguuucgugc

SEQ ID NO: 2854467 - RNA, 17 nt, Mycobacterium avium subsp. paratuberculosis
ggccccggcucgggcca

SEQ ID NO: 2854468 - RNA, 19 nt, Mycobacterium avium subsp. paratuberculosis
ggccccgguagccagcacc

SEQ ID NO: 2854469 - RNA, 20 nt, Mycobacterium avium subsp. paratuberculosis
ggccccgguagccagcaccg

SEQ ID NO: 2854470 - RNA, 23 nt, Mycobacterium avium subsp. paratuberculosis
ggccccgguagccagcaccgccc

SEQ ID NO: 2854471 - RNA, 20 nt, Mycobacterium avium subsp. paratuberculosis
ggccccgguuuucgccucgg

SEQ ID NO: 2854472 - RNA, 17 nt, Mycobacterium avium subsp. paratuberculosis
ggccccguucgguggcc

SEQ ID NO: 2854473 - RNA, 21 nt, Mycobacterium avium subsp. paratuberculosis
ggccccguucgguggccaccg

SEQ ID NO: 2854474 - RNA, 18 nt, Mycobacterium avium subsp. paratuberculosis
ggccccguuggugcggug

SEQ ID NO: 2854475 - RNA, 22 nt, Mycobacterium avium subsp. paratuberculosis
ggccccguuggugcggugcauc

SEQ ID NO: 2854476 - RNA, 19 nt, Mycobacterium avium subsp. paratuberculosis
ggccccuccagccgccggu

SEQ ID NO: 2854477 - RNA, 20 nt, Mycobacterium avium subsp. paratuberculosis
ggccccuccagccgccgguc

SEQ ID NO: 2854478 - RNA, 16 nt, Mycobacterium avium subsp. paratuberculosis
ggccccuucgaugucg

SEQ ID NO: 2854479 - RNA, 20 nt, Mycobacterium avium subsp. paratuberculosis
ggccccuucgaugucgccgg

SEQ ID NO: 2854480 - RNA, 15 nt, Mycobacterium avium subsp. paratuberculosis
ggcccgaacaccucc

SEQ ID NO: 2854481 - RNA, 21 nt, Mycobacterium avium subsp. paratuberculosis
ggcccgaacaucgccucggcc

SEQ ID NO: 2854482 - RNA, 18 nt, Mycobacterium avium subsp. paratuberculosis
ggcccgaccagcgggccg

SEQ ID NO: 2854483 - RNA, 23 nt, Mycobacterium avium subsp. paratuberculosis
ggcccgacccggucagcucgccg

SEQ ID NO: 2854484 - RNA, 16 nt, Mycobacterium avium subsp. paratuberculosis
ggcccgagcaccacca

SEQ ID NO: 2854485 - RNA, 20 nt, Mycobacterium avium subsp. paratuberculosis
ggcccgagcccgacggcagc

SEQ ID NO: 2854486 - RNA, 21 nt, Mycobacterium avium subsp. paratuberculosis
ggcccgagcccgacggcagca

SEQ ID NO: 2854487 - RNA, 17 nt, Mycobacterium avium subsp. paratuberculosis
ggcccgagcccugcgcc

SEQ ID NO: 2854488 - RNA, 18 nt, Mycobacterium avium subsp. paratuberculosis
ggcccgagguccucgcgc

SEQ ID NO: 2854489 - RNA, 23 nt, Mycobacterium avium subsp. paratuberculosis
ggcccgagguccucgcgcaacug

SEQ ID NO: 2854490 - RNA, 21 nt, Mycobacterium avium subsp. paratuberculosis
ggcccgauagcuugagccccg

SEQ ID NO: 2854491 - RNA, 22 nt, Mycobacterium avium subsp. paratuberculosis
ggcccgauagcuugagccccgc

SEQ ID NO: 2854492 - RNA, 22 nt, Mycobacterium avium subsp. paratuberculosis
ggcccgaucaccaggcccaggc

SEQ ID NO: 2854493 - RNA, 16 nt, Mycobacterium avium subsp. paratuberculosis
ggcccgaucaccgccg

SEQ ID NO: 2854494 - RNA, 23 nt, Mycobacterium avium subsp. paratuberculosis
ggcccgaucaggguccagggcgg

SEQ ID NO: 2854495 - RNA, 18 nt, Mycobacterium avium subsp. paratuberculosis
ggcccgaucgcggcgagc

SEQ ID NO: 2854496 - RNA, 13 nt, Mycobacterium avium subsp. paratuberculosis
ggcccgaucgcgu

SEQ ID NO: 2854497 - RNA, 15 nt, Mycobacterium avium subsp. paratuberculosis
ggcccgaugcggacc

SEQ ID NO: 2854498 - RNA, 18 nt, Mycobacterium avium subsp. paratuberculosis
ggcccgaugcggaccggg

SEQ ID NO: 2854499 - RNA, 20 nt, Mycobacterium avium subsp. paratuberculosis
ggcccgauggcggccugcag

SEQ ID NO: 2854500 - RNA, 13 nt, Mycobacterium avium subsp. paratuberculosis
ggcccgcaccacc

SEQ ID NO: 2854501 - RNA, 14 nt, Mycobacterium avium subsp. paratuberculosis
ggcccgcaccaccc

SEQ ID NO: 2854502 - RNA, 17 nt, Mycobacterium avium subsp. paratuberculosis
ggcccgcaccacccagc

SEQ ID NO: 2854503 - RNA, 18 nt, Mycobacterium avium subsp. paratuberculosis
ggcccgcaccacccagcc

SEQ ID NO: 2854504 - RNA, 19 nt, Mycobacterium avium subsp. paratuberculosis
ggcccgcaccacccagccc

SEQ ID NO: 2854505 - RNA, 12 nt, Mycobacterium avium subsp. paratuberculosis
ggcccgcacccg

SEQ ID NO: 2854506 - RNA, 15 nt, Mycobacterium avium subsp. paratuberculosis
ggcccgcacccgccg

SEQ ID NO: 2854507 - RNA, 19 nt, Mycobacterium avium subsp. paratuberculosis
ggcccgcacccgccgcccg

SEQ ID NO: 2854508 - RNA, 20 nt, Mycobacterium avium subsp. paratuberculosis
ggcccgcaccgauggguugg

SEQ ID NO: 2854509 - RNA, 18 nt, Mycobacterium avium subsp. paratuberculosis
ggcccgcacggccgccag

SEQ ID NO: 2854510 - RNA, 15 nt, Mycobacterium avium subsp. paratuberculosis
ggcccgcagccagcg

SEQ ID NO: 2854511 - RNA, 16 nt, Mycobacterium avium subsp. paratuberculosis
ggcccgcagccagcgc

SEQ ID NO: 2854512 - RNA, 18 nt, Mycobacterium avium subsp. paratuberculosis
ggcccgcagccagcgcag

SEQ ID NO: 2854513 - RNA, 20 nt, Mycobacterium avium subsp. paratuberculosis
ggcccgcagccagcgcagca

SEQ ID NO: 2854514 - RNA, 15 nt, Mycobacterium avium subsp. paratuberculosis
ggcccgcagcgccuc

SEQ ID NO: 2854515 - RNA, 16 nt, Mycobacterium avium subsp. paratuberculosis
ggcccgcaggaucgag

SEQ ID NO: 2854516 - RNA, 16 nt, Mycobacterium avium subsp. paratuberculosis
ggcccgcaucgcggcg

SEQ ID NO: 2854517 - RNA, 23 nt, Mycobacterium avium subsp. paratuberculosis
ggcccgcaucgcggcgauggugu

SEQ ID NO: 2854518 - RNA, 13 nt, Mycobacterium avium subsp. paratuberculosis
ggcccgcaugcac

SEQ ID NO: 2854519 - RNA, 16 nt, Mycobacterium avium subsp. paratuberculosis
ggcccgcaugcaccgg

SEQ ID NO: 2854520 - RNA, 20 nt, Mycobacterium avium subsp. paratuberculosis
ggcccgccaaaacggggugg

SEQ ID NO: 2854521 - RNA, 17 nt, Mycobacterium avium subsp. paratuberculosis
ggcccgccacgugcggc

SEQ ID NO: 2854522 - RNA, 21 nt, Mycobacterium avium subsp. paratuberculosis
ggcccgccacgugcggcugcg

SEQ ID NO: 2854523 - RNA, 16 nt, Mycobacterium avium subsp. paratuberculosis
ggcccgccagaucgcc

SEQ ID NO: 2854524 - RNA, 18 nt, Mycobacterium avium subsp. paratuberculosis
ggcccgccaguucccggc

SEQ ID NO: 2854525 - RNA, 14 nt, Mycobacterium avium subsp. paratuberculosis
ggcccgcccagcgc

SEQ ID NO: 2854526 - RNA, 22 nt, Mycobacterium avium subsp. paratuberculosis
ggcccgccccugagggugucgg

SEQ ID NO: 2854527 - RNA, 18 nt, Mycobacterium avium subsp. paratuberculosis
ggcccgcccgcagcggcg

SEQ ID NO: 2854528 - RNA, 23 nt, Mycobacterium avium subsp. paratuberculosis
ggcccgcccgcagcggcgguugc

SEQ ID NO: 2854529 - RNA, 12 nt, Mycobacterium avium subsp. paratuberculosis
ggcccgcccggc

SEQ ID NO: 2854530 - RNA, 15 nt, Mycobacterium avium subsp. paratuberculosis
ggcccgcccggcggc

SEQ ID NO: 2854531 - RNA, 16 nt, Mycobacterium avium subsp. paratuberculosis
ggcccgcccggcggcg

SEQ ID NO: 2854532 - RNA, 18 nt, Mycobacterium avium subsp. paratuberculosis
ggcccgcccggcggcgcu

SEQ ID NO: 2854533 - RNA, 14 nt, Mycobacterium avium subsp. paratuberculosis
ggcccgcccgggca

SEQ ID NO: 2854534 - RNA, 19 nt, Mycobacterium avium subsp. paratuberculosis
ggcccgcccguagacccac

SEQ ID NO: 2854535 - RNA, 14 nt, Mycobacterium avium subsp. paratuberculosis
ggcccgccgaacgc

SEQ ID NO: 2854536 - RNA, 15 nt, Mycobacterium avium subsp. paratuberculosis
ggcccgccgaacgcc

SEQ ID NO: 2854537 - RNA, 18 nt, Mycobacterium avium subsp. paratuberculosis
ggcccgccgaacgccucc

SEQ ID NO: 2854538 - RNA, 13 nt, Mycobacterium avium subsp. paratuberculosis
ggcccgccgccgg

SEQ ID NO: 2854539 - RNA, 14 nt, Mycobacterium avium subsp. paratuberculosis
ggcccgccgccggc

SEQ ID NO: 2854540 - RNA, 15 nt, Mycobacterium avium subsp. paratuberculosis
ggcccgccgccggcg

SEQ ID NO: 2854541 - RNA, 18 nt, Mycobacterium avium subsp. paratuberculosis
ggcccgccgccggcggcg

SEQ ID NO: 2854542 - RNA, 13 nt, Mycobacterium avium subsp. paratuberculosis
ggcccgccgcgcc

SEQ ID NO: 2854543 - RNA, 21 nt, Mycobacterium avium subsp. paratuberculosis
ggcccgccgcgcccggcuucg

SEQ ID NO: 2854544 - RNA, 13 nt, Mycobacterium avium subsp. paratuberculosis
ggcccgccgcggc

SEQ ID NO: 2854545 - RNA, 22 nt, Mycobacterium avium subsp. paratuberculosis
ggcccgccgcggcuccagcagc

SEQ ID NO: 2854546 - RNA, 23 nt, Mycobacterium avium subsp. paratuberculosis
ggcccgccgcggcuccagcagcg

SEQ ID NO: 2854547 - RNA, 12 nt, Mycobacterium avium subsp. paratuberculosis
ggcccggccacu

SEQ ID NO: 2854548 - RNA, 14 nt, Mycobacterium avium subsp. paratuberculosis
ggcccggccacucg

SEQ ID NO: 2854549 - RNA, 17 nt, Mycobacterium avium subsp. paratuberculosis
ggcccggccacucgccg

SEQ ID NO: 2854550 - RNA, 13 nt, Mycobacterium avium subsp. paratuberculosis
ggcccggcccgcu

SEQ ID NO: 2854551 - RNA, 12 nt, Mycobacterium avium subsp. paratuberculosis
ggcccggcccgg

SEQ ID NO: 2854552 - RNA, 16 nt, Mycobacterium avium subsp. paratuberculosis
ggcccggcccggcgau

SEQ ID NO: 2854553 - RNA, 15 nt, Mycobacterium avium subsp. paratuberculosis
ggcccggccgccagc

SEQ ID NO: 2854554 - RNA, 16 nt, Mycobacterium avium subsp. paratuberculosis
ggcccggccggcgcga

SEQ ID NO: 2854555 - RNA, 18 nt, Mycobacterium avium subsp. paratuberculosis
ggcccggcgaaucagcag

SEQ ID NO: 2854556 - RNA, 19 nt, Mycobacterium avium subsp. paratuberculosis
ggcccggcgaaucagcagc

SEQ ID NO: 2854557 - RNA, 15 nt, Mycobacterium avium subsp. paratuberculosis
ggcccggcgaugccg

SEQ ID NO: 2854558 - RNA, 18 nt, Mycobacterium avium subsp. paratuberculosis
ggcccggcgaugccgagc

SEQ ID NO: 2854559 - RNA, 22 nt, Mycobacterium avium subsp. paratuberculosis
ggcccggcgaugccgagcccuu

SEQ ID NO: 2854560 - RNA, 12 nt, Mycobacterium avium subsp. paratuberculosis
ggcccggcgcca

SEQ ID NO: 2854561 - RNA, 15 nt, Mycobacterium avium subsp. paratuberculosis
ggcccggcgcggccg

SEQ ID NO: 2854562 - RNA, 16 nt, Mycobacterium avium subsp. paratuberculosis
ggcccggcgcggccgg

SEQ ID NO: 2854563 - RNA, 14 nt, Mycobacterium avium subsp. paratuberculosis
ggcccggcgcggcg

SEQ ID NO: 2854564 - RNA, 17 nt, Mycobacterium avium subsp. paratuberculosis
ggcccggcgcggcggcg

SEQ ID NO: 2854565 - RNA, 23 nt, Mycobacterium avium subsp. paratuberculosis
ggcccggcgcggcggcgccgcgg

SEQ ID NO: 2854566 - RNA, 13 nt, Mycobacterium avium subsp. paratuberculosis
ggcccggcggccg

SEQ ID NO: 2854567 - RNA, 15 nt, Mycobacterium avium subsp. paratuberculosis
ggcccggcggccggc

SEQ ID NO: 2854568 - RNA, 16 nt, Mycobacterium avium subsp. paratuberculosis
ggcccggcggccggcc

SEQ ID NO: 2854569 - RNA, 13 nt, Mycobacterium avium subsp. paratuberculosis
ggcccggcgggca

SEQ ID NO: 2854570 - RNA, 14 nt, Mycobacterium avium subsp. paratuberculosis
ggcccggcggguca

SEQ ID NO: 2854571 - RNA, 20 nt, Mycobacterium avium subsp. paratuberculosis
ggcccggcgggucagcaccg

SEQ ID NO: 2854572 - RNA, 12 nt, Mycobacterium avium subsp. paratuberculosis
ggcccggcgucg

SEQ ID NO: 2854573 - RNA, 18 nt, Mycobacterium avium subsp. paratuberculosis
ggcccggcgugggccgca

SEQ ID NO: 2854574 - RNA, 21 nt, Mycobacterium avium subsp. paratuberculosis
ggcccggcgugggccgcagcg

SEQ ID NO: 2854575 - RNA, 19 nt, Mycobacterium avium subsp. paratuberculosis
ggcccggcucggaaccguu

SEQ ID NO: 2854576 - RNA, 16 nt, Mycobacterium avium subsp. paratuberculosis
ggcccgggaagccgca

SEQ ID NO: 2854577 - RNA, 21 nt, Mycobacterium avium subsp. paratuberculosis
ggcccgggaagccgcagcagg

SEQ ID NO: 2854578 - RNA, 13 nt, Mycobacterium avium subsp. paratuberculosis
ggcccgggcaggc

SEQ ID NO: 2854579 - RNA, 21 nt, Mycobacterium avium subsp. paratuberculosis
ggcccgggccacccgcgaucg

SEQ ID NO: 2854580 - RNA, 18 nt, Mycobacterium avium subsp. paratuberculosis
ggcccgggccggaggugc

SEQ ID NO: 2854581 - RNA, 19 nt, Mycobacterium avium subsp. paratuberculosis
ggcccgggcgauucgucgu

SEQ ID NO: 2854582 - RNA, 12 nt, Mycobacterium avium subsp. paratuberculosis
ggcccgggcggc

SEQ ID NO: 2854583 - RNA, 23 nt, Mycobacterium avium subsp. paratuberculosis
ggcccgggcggcgaguccggcca

SEQ ID NO: 2854584 - RNA, 14 nt, Mycobacterium avium subsp. paratuberculosis
ggcccgggcugccc

SEQ ID NO: 2854585 - RNA, 17 nt, Mycobacterium avium subsp. paratuberculosis
ggcccgggcugcccggg

SEQ ID NO: 2854586 - RNA, 22 nt, Mycobacterium avium subsp. paratuberculosis
ggcccggggacacccucggggu

SEQ ID NO: 2854587 - RNA, 18 nt, Mycobacterium avium subsp. paratuberculosis
ggcccgggguggauccgu

SEQ ID NO: 2854588 - RNA, 21 nt, Mycobacterium avium subsp. paratuberculosis
ggcccgggguggauccgucgc

SEQ ID NO: 2854589 - RNA, 21 nt, Mycobacterium avium subsp. paratuberculosis
ggcccggggugugcccgaacg

SEQ ID NO: 2854590 - RNA, 20 nt, Mycobacterium avium subsp. paratuberculosis
ggcccgguacagcgccgcgg

SEQ ID NO: 2854591 - RNA, 23 nt, Mycobacterium avium subsp. paratuberculosis
ggcccggucggaguccagcacgc

SEQ ID NO: 2854592 - RNA, 16 nt, Mycobacterium avium subsp. paratuberculosis
ggcccggucgucgagc

SEQ ID NO: 2854593 - RNA, 20 nt, Mycobacterium avium subsp. paratuberculosis
ggcccggucgucgagcaccg

SEQ ID NO: 2854594 - RNA, 17 nt, Mycobacterium avium subsp. paratuberculosis
ggcccggucgucgccgg

SEQ ID NO: 2854595 - RNA, 19 nt, Mycobacterium avium subsp. paratuberculosis
ggcccggucuugccggcuu

SEQ ID NO: 2854596 - RNA, 17 nt, Mycobacterium avium subsp. paratuberculosis
ggcccggugcgacgccg

SEQ ID NO: 2854597 - RNA, 20 nt, Mycobacterium avium subsp. paratuberculosis
ggcccggugcgacgccgcgc

SEQ ID NO: 2854598 - RNA, 23 nt, Mycobacterium avium subsp. paratuberculosis
ggcccggugcgacgccgcgcagc

SEQ ID NO: 2854599 - RNA, 17 nt, Mycobacterium avium subsp. paratuberculosis
ggcccgguuccagcggc

SEQ ID NO: 2854600 - RNA, 20 nt, Mycobacterium avium subsp. paratuberculosis
ggcccgguugagugcgccgu

SEQ ID NO: 2854601 - RNA, 16 nt, Mycobacterium avium subsp. paratuberculosis
ggcccguacucgggug

SEQ ID NO: 2854602 - RNA, 16 nt, Mycobacterium avium subsp. paratuberculosis
ggcccguagcucgcgc

SEQ ID NO: 2854603 - RNA, 14 nt, Mycobacterium avium subsp. paratuberculosis
ggcccgucaggccu

SEQ ID NO: 2854604 - RNA, 17 nt, Mycobacterium avium subsp. paratuberculosis
ggcccgucaggccucga

SEQ ID NO: 2854605 - RNA, 21 nt, Mycobacterium avium subsp. paratuberculosis
ggcccguccagaucggccagc

SEQ ID NO: 2854606 - RNA, 12 nt, Mycobacterium avium subsp. paratuberculosis
ggcccgucccca

SEQ ID NO: 2854607 - RNA, 15 nt, Mycobacterium avium subsp. paratuberculosis
ggcccguccccacca

SEQ ID NO: 2854608 - RNA, 21 nt, Mycobacterium avium subsp. paratuberculosis
ggcccguccccaccaccgaca

SEQ ID NO: 2854609 - RNA, 21 nt, Mycobacterium avium subsp. paratuberculosis
ggcccguccgccccgcugccg

SEQ ID NO: 2854610 - RNA, 17 nt, Mycobacterium avium subsp. paratuberculosis
ggcccgucgccaccacg

SEQ ID NO: 2854611 - RNA, 20 nt, Mycobacterium avium subsp. paratuberculosis
ggcccgucgccaccacggcg

SEQ ID NO: 2854612 - RNA, 16 nt, Mycobacterium avium subsp. paratuberculosis
ggcccgucgccgauca

SEQ ID NO: 2854613 - RNA, 19 nt, Mycobacterium avium subsp. paratuberculosis
ggcccgucgccgaucagca

SEQ ID NO: 2854614 - RNA, 24 nt, Mycobacterium avium subsp. paratuberculosis
ggcccgucgccgaucagcaccagg

SEQ ID NO: 2854615 - RNA, 14 nt, Mycobacterium avium subsp. paratuberculosis
ggcccgucgccggc

SEQ ID NO: 2854616 - RNA, 16 nt, Mycobacterium avium subsp. paratuberculosis
ggcccgucgccggcgc

SEQ ID NO: 2854617 - RNA, 19 nt, Mycobacterium avium subsp. paratuberculosis
ggcccgucgccggcgcgca

SEQ ID NO: 2854618 - RNA, 22 nt, Mycobacterium avium subsp. paratuberculosis
ggcccgucgccggcgcgcagcg

SEQ ID NO: 2854619 - RNA, 13 nt, Mycobacterium avium subsp. paratuberculosis
ggcccgucggcgu

SEQ ID NO: 2854620 - RNA, 14 nt, Mycobacterium avium subsp. paratuberculosis
ggcccgugcgggug

SEQ ID NO: 2854621 - RNA, 17 nt, Mycobacterium avium subsp. paratuberculosis
ggcccgugucgcggccu

SEQ ID NO: 2854622 - RNA, 16 nt, Mycobacterium avium subsp. paratuberculosis
ggcccguugagcaccg

SEQ ID NO: 2854623 - RNA, 16 nt, Mycobacterium avium subsp. paratuberculosis
ggcccuauggcaucgc

SEQ ID NO: 2854624 - RNA, 17 nt, Mycobacterium avium subsp. paratuberculosis
ggcccucaucgucgacc

SEQ ID NO: 2854625 - RNA, 21 nt, Mycobacterium avium subsp. paratuberculosis
ggcccucaucgucgacccggc

SEQ ID NO: 2854626 - RNA, 18 nt, Mycobacterium avium subsp. paratuberculosis
ggcccuccacggugcgca

SEQ ID NO: 2854627 - RNA, 21 nt, Mycobacterium avium subsp. paratuberculosis
ggcccuccacggugcgcaccg

SEQ ID NO: 2854628 - RNA, 15 nt, Mycobacterium avium subsp. paratuberculosis
ggcccuccgcggcgc

SEQ ID NO: 2854629 - RNA, 16 nt, Mycobacterium avium subsp. paratuberculosis
ggcccuccgcggcgcc

SEQ ID NO: 2854630 - RNA, 23 nt, Mycobacterium avium subsp. paratuberculosis
ggcccucgacguaguccggccag

SEQ ID NO: 2854631 - RNA, 15 nt, Mycobacterium avium subsp. paratuberculosis
ggcccucgccgcggu

SEQ ID NO: 2854632 - RNA, 14 nt, Mycobacterium avium subsp. paratuberculosis
ggccgacgcccagc

SEQ ID NO: 2854633 - RNA, 15 nt, Mycobacterium avium subsp. paratuberculosis
ggccgacgcccagca

SEQ ID NO: 2854634 - RNA, 13 nt, Mycobacterium avium subsp. paratuberculosis
ggccgacgccggc

SEQ ID NO: 2854635 - RNA, 15 nt, Mycobacterium avium subsp. paratuberculosis
ggccgacgccggcca

SEQ ID NO: 2854636 - RNA, 16 nt, Mycobacterium avium subsp. paratuberculosis
ggccgacgccggccac

SEQ ID NO: 2854637 - RNA, 16 nt, Mycobacterium avium subsp. paratuberculosis
ggccgacgcgccgucg

SEQ ID NO: 2854638 - RNA, 18 nt, Mycobacterium avium subsp. paratuberculosis
ggccgacgcgccgucggc

SEQ ID NO: 2854639 - RNA, 21 nt, Mycobacterium avium subsp. paratuberculosis
ggccgacgcgccgucggccca

SEQ ID NO: 2854640 - RNA, 14 nt, Mycobacterium avium subsp. paratuberculosis
ggccgacgcggccu

SEQ ID NO: 2854641 - RNA, 15 nt, Mycobacterium avium subsp. paratuberculosis
ggccgacgcggccuc

SEQ ID NO: 2854642 - RNA, 15 nt, Mycobacterium avium subsp. paratuberculosis
ggccgacgcuggccg

SEQ ID NO: 2854643 - RNA, 16 nt, Mycobacterium avium subsp. paratuberculosis
ggccgacgugccggug

SEQ ID NO: 2854644 - RNA, 23 nt, Mycobacterium avium subsp. paratuberculosis
ggccgacgugcuuggccagcucg

SEQ ID NO: 2854645 - RNA, 20 nt, Mycobacterium avium subsp. paratuberculosis
ggccgacuuggucagcccgc

SEQ ID NO: 2854646 - RNA, 13 nt, Mycobacterium avium subsp. paratuberculosis
ggccgagagccgg

SEQ ID NO: 2854647 - RNA, 14 nt, Mycobacterium avium subsp. paratuberculosis
ggccgagagccggu

SEQ ID NO: 2854648 - RNA, 17 nt, Mycobacterium avium subsp. paratuberculosis
ggccgagcagccgggcc

SEQ ID NO: 2854649 - RNA, 21 nt, Mycobacterium avium subsp. paratuberculosis
ggccgagcagccgggccagca

SEQ ID NO: 2854650 - RNA, 14 nt, Mycobacterium avium subsp. paratuberculosis
ggccgagccgagcc

SEQ ID NO: 2854651 - RNA, 23 nt, Mycobacterium avium subsp. paratuberculosis
ggccgagccgagccgacccgggc

SEQ ID NO: 2854652 - RNA, 14 nt, Mycobacterium avium subsp. paratuberculosis
ggccgagccgaggc

SEQ ID NO: 2854653 - RNA, 20 nt, Mycobacterium avium subsp. paratuberculosis
ggccgagccgaugcccagca

SEQ ID NO: 2854654 - RNA, 14 nt, Mycobacterium avium subsp. paratuberculosis
ggccgagccgccgg

SEQ ID NO: 2854655 - RNA, 13 nt, Mycobacterium avium subsp. paratuberculosis
ggccgagccggcg

SEQ ID NO: 2854656 - RNA, 13 nt, Mycobacterium avium subsp. paratuberculosis
ggccgagccgggc

SEQ ID NO: 2854657 - RNA, 14 nt, Mycobacterium avium subsp. paratuberculosis
ggccgagccgggcg

SEQ ID NO: 2854658 - RNA, 17 nt, Mycobacterium avium subsp. paratuberculosis
ggccgagccgggcggcc

SEQ ID NO: 2854659 - RNA, 23 nt, Mycobacterium avium subsp. paratuberculosis
ggccgagccgggcggccagcgug

SEQ ID NO: 2854660 - RNA, 21 nt, Mycobacterium avium subsp. paratuberculosis
ggccgagcgcaagggccgaca

SEQ ID NO: 2854661 - RNA, 15 nt, Mycobacterium avium subsp. paratuberculosis
ggccgagcgcaccgc

SEQ ID NO: 2854662 - RNA, 23 nt, Mycobacterium avium subsp. paratuberculosis
ggccgagcgcaccgcggagcgca

SEQ ID NO: 2854663 - RNA, 16 nt, Mycobacterium avium subsp. paratuberculosis
ggccgagcgcagcggg

SEQ ID NO: 2854664 - RNA, 19 nt, Mycobacterium avium subsp. paratuberculosis
ggccgagcgcagcggggag

SEQ ID NO: 2854665 - RNA, 12 nt, Mycobacterium avium subsp. paratuberculosis
ggccgagcgcgc

SEQ ID NO: 2854666 - RNA, 13 nt, Mycobacterium avium subsp. paratuberculosis
ggccgagcgcgcc

SEQ ID NO: 2854667 - RNA, 19 nt, Mycobacterium avium subsp. paratuberculosis
ggccgagcgcgccgagcag

SEQ ID NO: 2854668 - RNA, 15 nt, Mycobacterium avium subsp. paratuberculosis
ggccgagcgcgccgc

SEQ ID NO: 2854669 - RNA, 16 nt, Mycobacterium avium subsp. paratuberculosis
ggccgagcgcgccgcc

SEQ ID NO: 2854670 - RNA, 17 nt, Mycobacterium avium subsp. paratuberculosis
ggccgagcgcgccgccg

SEQ ID NO: 2854671 - RNA, 14 nt, Mycobacterium avium subsp. paratuberculosis
ggccgagcggcugc

SEQ ID NO: 2854672 - RNA, 16 nt, Mycobacterium avium subsp. paratuberculosis
ggccgagcggcugcug

SEQ ID NO: 2854673 - RNA, 18 nt, Mycobacterium avium subsp. paratuberculosis
ggccgagcguucggcgcg

SEQ ID NO: 2854674 - RNA, 19 nt, Mycobacterium avium subsp. paratuberculosis
ggccgagcguucggcgcgg

SEQ ID NO: 2854675 - RNA, 21 nt, Mycobacterium avium subsp. paratuberculosis
ggccgaggauggggucgcggg

SEQ ID NO: 2854676 - RNA, 17 nt, Mycobacterium avium subsp. paratuberculosis
ggccgaggcgagugagg

SEQ ID NO: 2854677 - RNA, 21 nt, Mycobacterium avium subsp. paratuberculosis
ggccgaggcugacgaucgucg

SEQ ID NO: 2854678 - RNA, 23 nt, Mycobacterium avium subsp. paratuberculosis
ggccgaggcugacgaucgucgac

SEQ ID NO: 2854679 - RNA, 12 nt, Mycobacterium avium subsp. paratuberculosis
ggccgaggcugu

SEQ ID NO: 2854680 - RNA, 22 nt, Mycobacterium avium subsp. paratuberculosis
ggccgagggcuucccacgccuu

SEQ ID NO: 2854681 - RNA, 13 nt, Mycobacterium avium subsp. paratuberculosis
ggccgaggggucc

SEQ ID NO: 2854682 - RNA, 21 nt, Mycobacterium avium subsp. paratuberculosis
ggccgaggucggucgcggcau

SEQ ID NO: 2854683 - RNA, 19 nt, Mycobacterium avium subsp. paratuberculosis
ggccgaguauccgcgcagc

SEQ ID NO: 2854684 - RNA, 20 nt, Mycobacterium avium subsp. paratuberculosis
ggccgaguauccgcgcagcg

SEQ ID NO: 2854685 - RNA, 15 nt, Mycobacterium avium subsp. paratuberculosis
ggccgagucgacgug

SEQ ID NO: 2854686 - RNA, 19 nt, Mycobacterium avium subsp. paratuberculosis
ggccgagucgacgugcucg

SEQ ID NO: 2854687 - RNA, 13 nt, Mycobacterium avium subsp. paratuberculosis
ggccgaucaccuc

SEQ ID NO: 2854688 - RNA, 14 nt, Mycobacterium avium subsp. paratuberculosis
ggccgaucacgcgg

SEQ ID NO: 2854689 - RNA, 15 nt, Mycobacterium avium subsp. paratuberculosis
ggccgaucagcggcg

SEQ ID NO: 2854690 - RNA, 16 nt, Mycobacterium avium subsp. paratuberculosis
ggccgaucagcggcgg

SEQ ID NO: 2854691 - RNA, 18 nt, Mycobacterium avium subsp. paratuberculosis
ggccgaucagcggcgggc

SEQ ID NO: 2854692 - RNA, 19 nt, Mycobacterium avium subsp. paratuberculosis
ggccgaucagcggcgggcc

SEQ ID NO: 2854693 - RNA, 16 nt, Mycobacterium avium subsp. paratuberculosis
ggccgaucagcugcuc

SEQ ID NO: 2854694 - RNA, 17 nt, Mycobacterium avium subsp. paratuberculosis
ggccgaucagcugcucg

SEQ ID NO: 2854695 - RNA, 22 nt, Mycobacterium avium subsp. paratuberculosis
ggccgaucagcugcucggccac

SEQ ID NO: 2854696 - RNA, 23 nt, Mycobacterium avium subsp. paratuberculosis
ggccgaucagcugcucggccacc

SEQ ID NO: 2854697 - RNA, 20 nt, Mycobacterium avium subsp. paratuberculosis
ggccgaucagguaguacagg

SEQ ID NO: 2854698 - RNA, 22 nt, Mycobacterium avium subsp. paratuberculosis
ggccgaucagguaguacaggug

SEQ ID NO: 2854699 - RNA, 17 nt, Mycobacterium avium subsp. paratuberculosis
ggccgaucagugccgcg

SEQ ID NO: 2854700 - RNA, 18 nt, Mycobacterium avium subsp. paratuberculosis
ggccgaucagugccgcgc

SEQ ID NO: 2854701 - RNA, 20 nt, Mycobacterium avium subsp. paratuberculosis
ggccgaucagugccgcgcca

SEQ ID NO: 2854702 - RNA, 14 nt, Mycobacterium avium subsp. paratuberculosis
ggccgaucaugguc

SEQ ID NO: 2854703 - RNA, 21 nt, Mycobacterium avium subsp. paratuberculosis
ggccgaucauggucggcgacg

SEQ ID NO: 2854704 - RNA, 17 nt, Mycobacterium avium subsp. paratuberculosis
ggccgaucuugucgacc

SEQ ID NO: 2854705 - RNA, 20 nt, Mycobacterium avium subsp. paratuberculosis
ggccgaucuugucgaccuug

SEQ ID NO: 2854706 - RNA, 20 nt, Mycobacterium avium subsp. paratuberculosis
ggccgaugaacaugcccugc

SEQ ID NO: 2854707 - RNA, 14 nt, Mycobacterium avium subsp. paratuberculosis
ggccgaugaccgcg

SEQ ID NO: 2854708 - RNA, 15 nt, Mycobacterium avium subsp. paratuberculosis
ggccgaugaccgcgg

SEQ ID NO: 2854709 - RNA, 16 nt, Mycobacterium avium subsp. paratuberculosis
ggccgaugaccgcggc

SEQ ID NO: 2854710 - RNA, 19 nt, Mycobacterium avium subsp. paratuberculosis
ggccgaugaccgcggcggg

SEQ ID NO: 2854711 - RNA, 20 nt, Mycobacterium avium subsp. paratuberculosis
ggccgaugaccgcggcgggc

SEQ ID NO: 2854712 - RNA, 20 nt, Mycobacterium avium subsp. paratuberculosis
ggccgaugaccucgcacagc

SEQ ID NO: 2854713 - RNA, 20 nt, Mycobacterium avium subsp. paratuberculosis
ggccgaugagccucagcgcg

SEQ ID NO: 2854714 - RNA, 18 nt, Mycobacterium avium subsp. paratuberculosis
ggccgaugaugaugccgc

SEQ ID NO: 2854715 - RNA, 20 nt, Mycobacterium avium subsp. paratuberculosis
ggccgaugaugaugccgccc

SEQ ID NO: 2854716 - RNA, 14 nt, Mycobacterium avium subsp. paratuberculosis
ggccgauggcccag

SEQ ID NO: 2854717 - RNA, 17 nt, Mycobacterium avium subsp. paratuberculosis
ggccgccagcagcacgg

SEQ ID NO: 2854718 - RNA, 13 nt, Mycobacterium avium subsp. paratuberculosis
ggccgccagcagu

SEQ ID NO: 2854719 - RNA, 12 nt, Mycobacterium avium subsp. paratuberculosis
ggccgccagccg

SEQ ID NO: 2854720 - RNA, 13 nt, Mycobacterium avium subsp. paratuberculosis
ggccgccagccgg

SEQ ID NO: 2854721 - RNA, 14 nt, Mycobacterium avium subsp. paratuberculosis
ggccgccagccggu

SEQ ID NO: 2854722 - RNA, 22 nt, Mycobacterium avium subsp. paratuberculosis
ggccgccagccgguacggaucg

SEQ ID NO: 2854723 - RNA, 12 nt, Mycobacterium avium subsp. paratuberculosis
ggccgccagcgc

SEQ ID NO: 2854724 - RNA, 16 nt, Mycobacterium avium subsp. paratuberculosis
ggccgccagcgcaccg

SEQ ID NO: 2854725 - RNA, 18 nt, Mycobacterium avium subsp. paratuberculosis
ggccgccagcgcccgcgc

SEQ ID NO: 2854726 - RNA, 14 nt, Mycobacterium avium subsp. paratuberculosis
ggccgccagcucgu

SEQ ID NO: 2854727 - RNA, 22 nt, Mycobacterium avium subsp. paratuberculosis
ggccgccaggaucugcucggcg

SEQ ID NO: 2854728 - RNA, 23 nt, Mycobacterium avium subsp. paratuberculosis
ggccgccaggaugucguccucgg

SEQ ID NO: 2854729 - RNA, 17 nt, Mycobacterium avium subsp. paratuberculosis
ggccgccagggccaggu

SEQ ID NO: 2854730 - RNA, 19 nt, Mycobacterium avium subsp. paratuberculosis
ggccgccagguuggcggcg

SEQ ID NO: 2854731 - RNA, 18 nt, Mycobacterium avium subsp. paratuberculosis
ggccgccaucauccgcug

SEQ ID NO: 2854732 - RNA, 24 nt, Mycobacterium avium subsp. paratuberculosis
ggccgccaucgaucgggcgucgca

SEQ ID NO: 2854733 - RNA, 18 nt, Mycobacterium avium subsp. paratuberculosis
ggccgcccaccacgaacc

SEQ ID NO: 2854734 - RNA, 23 nt, Mycobacterium avium subsp. paratuberculosis
ggccgcccaccacgaaccaggcg

SEQ ID NO: 2854735 - RNA, 17 nt, Mycobacterium avium subsp. paratuberculosis
ggccgcccacguagggg

SEQ ID NO: 2854736 - RNA, 16 nt, Mycobacterium avium subsp. paratuberculosis
ggccgcccagcccgcg

SEQ ID NO: 2854737 - RNA, 14 nt, Mycobacterium avium subsp. paratuberculosis
ggccgcccagucgc

SEQ ID NO: 2854738 - RNA, 22 nt, Mycobacterium avium subsp. paratuberculosis
ggccgcccagucgccgccgcgc

SEQ ID NO: 2854739 - RNA, 20 nt, Mycobacterium avium subsp. paratuberculosis
ggccgccccgaacagcgcca

SEQ ID NO: 2854740 - RNA, 23 nt, Mycobacterium avium subsp. paratuberculosis
ggccgccccgaacagcgccaggg

SEQ ID NO: 2854741 - RNA, 12 nt, Mycobacterium avium subsp. paratuberculosis
ggccgccccggc

SEQ ID NO: 2854742 - RNA, 14 nt, Mycobacterium avium subsp. paratuberculosis
ggccgccccggccg

SEQ ID NO: 2854743 - RNA, 18 nt, Mycobacterium avium subsp. paratuberculosis
ggccgccccggccgcgca

SEQ ID NO: 2854744 - RNA, 15 nt, Mycobacterium avium subsp. paratuberculosis
ggccgcccgacccgu

SEQ ID NO: 2854745 - RNA, 18 nt, Mycobacterium avium subsp. paratuberculosis
ggccgcccgacccgucca

SEQ ID NO: 2854746 - RNA, 21 nt, Mycobacterium avium subsp. paratuberculosis
ggccgcccgacccguccagca

SEQ ID NO: 2854747 - RNA, 17 nt, Mycobacterium avium subsp. paratuberculosis
ggccgcccgcaccagca

SEQ ID NO: 2854748 - RNA, 13 nt, Mycobacterium avium subsp. paratuberculosis
ggccgcccgcgcg

SEQ ID NO: 2854749 - RNA, 20 nt, Mycobacterium avium subsp. paratuberculosis
ggccgcccgcuccugcaggc

SEQ ID NO: 2854750 - RNA, 22 nt, Mycobacterium avium subsp. paratuberculosis
ggccgcccgcuccugcaggccg

SEQ ID NO: 2854751 - RNA, 19 nt, Mycobacterium avium subsp. paratuberculosis
ggccgcccgcuggggcgca

SEQ ID NO: 2854752 - RNA, 21 nt, Mycobacterium avium subsp. paratuberculosis
ggccgcccgcuggggcgcacc

SEQ ID NO: 2854753 - RNA, 11 nt, Mycobacterium avium subsp. paratuberculosis
ggccgcccggc

SEQ ID NO: 2854754 - RNA, 14 nt, Mycobacterium avium subsp. paratuberculosis
ggccgcccggccca

SEQ ID NO: 2854755 - RNA, 22 nt, Mycobacterium avium subsp. paratuberculosis
ggccgcccggcccaagacccgc

SEQ ID NO: 2854756 - RNA, 12 nt, Mycobacterium avium subsp. paratuberculosis
ggccgcccggcg

SEQ ID NO: 2854757 - RNA, 19 nt, Mycobacterium avium subsp. paratuberculosis
ggccgcccggcgagcagcc

SEQ ID NO: 2854758 - RNA, 13 nt, Mycobacterium avium subsp. paratuberculosis
ggccgcccggcgc

SEQ ID NO: 2854759 - RNA, 14 nt, Mycobacterium avium subsp. paratuberculosis
ggccgcccggcgcg

SEQ ID NO: 2854760 - RNA, 16 nt, Mycobacterium avium subsp. paratuberculosis
ggccgcccggcgcgcc

SEQ ID NO: 2854761 - RNA, 20 nt, Mycobacterium avium subsp. paratuberculosis
ggccgcccggcgcgccgcag

SEQ ID NO: 2854762 - RNA, 13 nt, Mycobacterium avium subsp. paratuberculosis
ggccgcccgggcg

SEQ ID NO: 2854763 - RNA, 19 nt, Mycobacterium avium subsp. paratuberculosis
ggccgcccgggcggcccgc

SEQ ID NO: 2854764 - RNA, 20 nt, Mycobacterium avium subsp. paratuberculosis
ggccgcccgggcggcccgca

SEQ ID NO: 2854765 - RNA, 14 nt, Mycobacterium avium subsp. paratuberculosis
ggccgcccgguccg

SEQ ID NO: 2854766 - RNA, 19 nt, Mycobacterium avium subsp. paratuberculosis
ggccgcccgguccgggucg

SEQ ID NO: 2854767 - RNA, 17 nt, Mycobacterium avium subsp. paratuberculosis
ggccgcccguccgggcc

SEQ ID NO: 2854768 - RNA, 23 nt, Mycobacterium avium subsp. paratuberculosis
ggccgcccguccgggccggccag

SEQ ID NO: 2854769 - RNA, 14 nt, Mycobacterium avium subsp. paratuberculosis
ggccgcccgucggg

SEQ ID NO: 2854770 - RNA, 21 nt, Mycobacterium avium subsp. paratuberculosis
ggccgcccgucggggcccggc

SEQ ID NO: 2854771 - RNA, 17 nt, Mycobacterium avium subsp. paratuberculosis
ggccgcccucgcugccg

SEQ ID NO: 2854772 - RNA, 20 nt, Mycobacterium avium subsp. paratuberculosis
ggccgcccucgcugccgccc

SEQ ID NO: 2854773 - RNA, 19 nt, Mycobacterium avium subsp. paratuberculosis
ggccgccgaagccggcucg

SEQ ID NO: 2854774 - RNA, 16 nt, Mycobacterium avium subsp. paratuberculosis
ggccgccgacgacggc

SEQ ID NO: 2854775 - RNA, 21 nt, Mycobacterium avium subsp. paratuberculosis
ggccgccgacgacggcgaacg

SEQ ID NO: 2854776 - RNA, 15 nt, Mycobacterium avium subsp. paratuberculosis
ggccgccgaggacac

SEQ ID NO: 2854777 - RNA, 23 nt, Mycobacterium avium subsp. paratuberculosis
ggccgccgaugcgcccgcugcgg

SEQ ID NO: 2854778 - RNA, 18 nt, Mycobacterium avium subsp. paratuberculosis
ggccgccgcauaccgccc

SEQ ID NO: 2854779 - RNA, 20 nt, Mycobacterium avium subsp. paratuberculosis
ggccgccgcauaccgcccgc

SEQ ID NO: 2854780 - RNA, 18 nt, Mycobacterium avium subsp. paratuberculosis
ggccgccgcauuccucgg

SEQ ID NO: 2854781 - RNA, 23 nt, Mycobacterium avium subsp. paratuberculosis
ggccgccgcauuccucggccagc

SEQ ID NO: 2854782 - RNA, 18 nt, Mycobacterium avium subsp. paratuberculosis
ggccgccgcccgcgcggc

SEQ ID NO: 2854783 - RNA, 19 nt, Mycobacterium avium subsp. paratuberculosis
ggccgccgcccgcgcggcg

SEQ ID NO: 2854784 - RNA, 23 nt, Mycobacterium avium subsp. paratuberculosis
ggccgccgcccgcgcggcggcca

SEQ ID NO: 2854785 - RNA, 14 nt, Mycobacterium avium subsp. paratuberculosis
ggccgccgccgcgg

SEQ ID NO: 2854786 - RNA, 17 nt, Mycobacterium avium subsp. paratuberculosis
ggccgccgccgcggccg

SEQ ID NO: 2854787 - RNA, 15 nt, Mycobacterium avium subsp. paratuberculosis
ggccgccgccugagc

SEQ ID NO: 2854788 - RNA, 18 nt, Mycobacterium avium subsp. paratuberculosis
ggccgccgccugagcccg

SEQ ID NO: 2854789 - RNA, 13 nt, Mycobacterium avium subsp. paratuberculosis
ggccgccgcgacc

SEQ ID NO: 2854790 - RNA, 19 nt, Mycobacterium avium subsp. paratuberculosis
ggccgccgcgacggccgcc

SEQ ID NO: 2854791 - RNA, 13 nt, Mycobacterium avium subsp. paratuberculosis
ggccgccgcgaua

SEQ ID NO: 2854792 - RNA, 14 nt, Mycobacterium avium subsp. paratuberculosis
ggccgccgcgauac

SEQ ID NO: 2854793 - RNA, 14 nt, Mycobacterium avium subsp. paratuberculosis
ggccgccgcgauca

SEQ ID NO: 2854794 - RNA, 20 nt, Mycobacterium avium subsp. paratuberculosis
ggccgccgcgaucagggccc

SEQ ID NO: 2854795 - RNA, 12 nt, Mycobacterium avium subsp. paratuberculosis
ggccgccgcgca

SEQ ID NO: 2854796 - RNA, 18 nt, Mycobacterium avium subsp. paratuberculosis
ggccgccgcgcauccgca

SEQ ID NO: 2854797 - RNA, 19 nt, Mycobacterium avium subsp. paratuberculosis
ggccgccgcgcauccgcac

SEQ ID NO: 2854798 - RNA, 14 nt, Mycobacterium avium subsp. paratuberculosis
ggccgccgcgcggg

SEQ ID NO: 2854799 - RNA, 14 nt, Mycobacterium avium subsp. paratuberculosis
ggccgccgcggcca

SEQ ID NO: 2854800 - RNA, 14 nt, Mycobacterium avium subsp. paratuberculosis
ggccgccgcggcgg

SEQ ID NO: 2854801 - RNA, 22 nt, Mycobacterium avium subsp. paratuberculosis
ggccgccgcggcggcaaguccg

SEQ ID NO: 2854802 - RNA, 22 nt, Mycobacterium avium subsp. paratuberculosis
ggccgcgcccaucgcggccgcc

SEQ ID NO: 2854803 - RNA, 20 nt, Mycobacterium avium subsp. paratuberculosis
ggccgcgccgaacaccacgc

SEQ ID NO: 2854804 - RNA, 23 nt, Mycobacterium avium subsp. paratuberculosis
ggccgcgccgaacaccacgccga

SEQ ID NO: 2854805 - RNA, 13 nt, Mycobacterium avium subsp. paratuberculosis
ggccgcgccgagg

SEQ ID NO: 2854806 - RNA, 14 nt, Mycobacterium avium subsp. paratuberculosis
ggccgcgccgauca

SEQ ID NO: 2854807 - RNA, 15 nt, Mycobacterium avium subsp. paratuberculosis
ggccgcgccgaucac

SEQ ID NO: 2854808 - RNA, 12 nt, Mycobacterium avium subsp. paratuberculosis
ggccgcgccgcc

SEQ ID NO: 2854809 - RNA, 16 nt, Mycobacterium avium subsp. paratuberculosis
ggccgcgccgccgacc

SEQ ID NO: 2854810 - RNA, 20 nt, Mycobacterium avium subsp. paratuberculosis
ggccgcgccgccgaccacgc

SEQ ID NO: 2854811 - RNA, 19 nt, Mycobacterium avium subsp. paratuberculosis
ggccgcgccgccgcccugg

SEQ ID NO: 2854812 - RNA, 14 nt, Mycobacterium avium subsp. paratuberculosis
ggccgcgccggaug

SEQ ID NO: 2854813 - RNA, 12 nt, Mycobacterium avium subsp. paratuberculosis
ggccgcgccggc

SEQ ID NO: 2854814 - RNA, 14 nt, Mycobacterium avium subsp. paratuberculosis
ggccgcgccggccu

SEQ ID NO: 2854815 - RNA, 18 nt, Mycobacterium avium subsp. paratuberculosis
ggccgcgccggccuuggc

SEQ ID NO: 2854816 - RNA, 13 nt, Mycobacterium avium subsp. paratuberculosis
ggccgcgccgggc

SEQ ID NO: 2854817 - RNA, 14 nt, Mycobacterium avium subsp. paratuberculosis
ggccgcgccguagc

SEQ ID NO: 2854818 - RNA, 19 nt, Mycobacterium avium subsp. paratuberculosis
ggccgcgccguagcggccc

SEQ ID NO: 2854819 - RNA, 20 nt, Mycobacterium avium subsp. paratuberculosis
ggccgcgccguagcggccca

SEQ ID NO: 2854820 - RNA, 23 nt, Mycobacterium avium subsp. paratuberculosis
ggccgcgccguagcggcccaggu

SEQ ID NO: 2854821 - RNA, 14 nt, Mycobacterium avium subsp. paratuberculosis
ggccgcgccguuga

SEQ ID NO: 2854822 - RNA, 19 nt, Mycobacterium avium subsp. paratuberculosis
ggccgcgccguugaccgcg

SEQ ID NO: 2854823 - RNA, 20 nt, Mycobacterium avium subsp. paratuberculosis
ggccgcgccguugaccgcgg

SEQ ID NO: 2854824 - RNA, 13 nt, Mycobacterium avium subsp. paratuberculosis
ggccgcgcgcauc

SEQ ID NO: 2854825 - RNA, 16 nt, Mycobacterium avium subsp. paratuberculosis
ggccgcgcgcaucucg

SEQ ID NO: 2854826 - RNA, 12 nt, Mycobacterium avium subsp. paratuberculosis
ggccgcgcgcgg

SEQ ID NO: 2854827 - RNA, 14 nt, Mycobacterium avium subsp. paratuberculosis
ggccgcgcgcggcg

SEQ ID NO: 2854828 - RNA, 18 nt, Mycobacterium avium subsp. paratuberculosis
ggccgcgcgcggcgcgga

SEQ ID NO: 2854829 - RNA, 19 nt, Mycobacterium avium subsp. paratuberculosis
ggccgcgcgggcggcgucg

SEQ ID NO: 2854830 - RNA, 15 nt, Mycobacterium avium subsp. paratuberculosis
ggccgcgcggugcuc

SEQ ID NO: 2854831 - RNA, 19 nt, Mycobacterium avium subsp. paratuberculosis
ggccgcgcggugcucgccc

SEQ ID NO: 2854832 - RNA, 19 nt, Mycobacterium avium subsp. paratuberculosis
ggccgcgcguagaucaucu

SEQ ID NO: 2854833 - RNA, 17 nt, Mycobacterium avium subsp. paratuberculosis
ggccgcgcgugcccgcg

SEQ ID NO: 2854834 - RNA, 17 nt, Mycobacterium avium subsp. paratuberculosis
ggccgcgcugaacgcgg

SEQ ID NO: 2854835 - RNA, 21 nt, Mycobacterium avium subsp. paratuberculosis
ggccgcgcugaacgcgguggg

SEQ ID NO: 2854836 - RNA, 14 nt, Mycobacterium avium subsp. paratuberculosis
ggccgcgcuggcgc

SEQ ID NO: 2854837 - RNA, 18 nt, Mycobacterium avium subsp. paratuberculosis
ggccgcgcuggcgcaggc

SEQ ID NO: 2854838 - RNA, 14 nt, Mycobacterium avium subsp. paratuberculosis
ggccgcgcugucca

SEQ ID NO: 2854839 - RNA, 16 nt, Mycobacterium avium subsp. paratuberculosis
ggccgcgcuguccacg

SEQ ID NO: 2854840 - RNA, 21 nt, Mycobacterium avium subsp. paratuberculosis
ggccgcgcuguccacguccug

SEQ ID NO: 2854841 - RNA, 21 nt, Mycobacterium avium subsp. paratuberculosis
ggccgcggaguaggcgccgcc

SEQ ID NO: 2854842 - RNA, 15 nt, Mycobacterium avium subsp. paratuberculosis
ggccgcggaugacca

SEQ ID NO: 2854843 - RNA, 19 nt, Mycobacterium avium subsp. paratuberculosis
ggccgcggauggugacggc

SEQ ID NO: 2854844 - RNA, 20 nt, Mycobacterium avium subsp. paratuberculosis
ggccgcggauuccggcaucg

SEQ ID NO: 2854845 - RNA, 23 nt, Mycobacterium avium subsp. paratuberculosis
ggccgcggccaagugcggucggu

SEQ ID NO: 2854846 - RNA, 13 nt, Mycobacterium avium subsp. paratuberculosis
ggccgcggccagc

SEQ ID NO: 2854847 - RNA, 14 nt, Mycobacterium avium subsp. paratuberculosis
ggccgcggccagcg

SEQ ID NO: 2854848 - RNA, 14 nt, Mycobacterium avium subsp. paratuberculosis
ggccgcggccagcu

SEQ ID NO: 2854849 - RNA, 15 nt, Mycobacterium avium subsp. paratuberculosis
ggccgcggccagcug

SEQ ID NO: 2854850 - RNA, 16 nt, Mycobacterium avium subsp. paratuberculosis
ggccgcggccagcugc

SEQ ID NO: 2854851 - RNA, 17 nt, Mycobacterium avium subsp. paratuberculosis
ggccgcggccagcugcc

SEQ ID NO: 2854852 - RNA, 14 nt, Mycobacterium avium subsp. paratuberculosis
ggccgcggcccggc

SEQ ID NO: 2854853 - RNA, 15 nt, Mycobacterium avium subsp. paratuberculosis
ggccgcggcccggcc

SEQ ID NO: 2854854 - RNA, 17 nt, Mycobacterium avium subsp. paratuberculosis
ggccgcggcccggccac

SEQ ID NO: 2854855 - RNA, 20 nt, Mycobacterium avium subsp. paratuberculosis
ggccgcggcccggccaccag

SEQ ID NO: 2854856 - RNA, 13 nt, Mycobacterium avium subsp. paratuberculosis
ggccgcggccgcc

SEQ ID NO: 2854857 - RNA, 14 nt, Mycobacterium avium subsp. paratuberculosis
ggccgcggccgccg

SEQ ID NO: 2854858 - RNA, 19 nt, Mycobacterium avium subsp. paratuberculosis
ggccgcggccgccgcgacg

SEQ ID NO: 2854859 - RNA, 14 nt, Mycobacterium avium subsp. paratuberculosis
ggccgcggccgccu

SEQ ID NO: 2854860 - RNA, 14 nt, Mycobacterium avium subsp. paratuberculosis
ggccgcggccggca

SEQ ID NO: 2854861 - RNA, 21 nt, Mycobacterium avium subsp. paratuberculosis
ggccgcggccggcacuaccgc

SEQ ID NO: 2854862 - RNA, 17 nt, Mycobacterium avium subsp. paratuberculosis
ggccgcggccggcggca

SEQ ID NO: 2854863 - RNA, 18 nt, Mycobacterium avium subsp. paratuberculosis
ggccgcggccgucgucgu

SEQ ID NO: 2854864 - RNA, 19 nt, Mycobacterium avium subsp. paratuberculosis
ggccgcggccuugcgagcc

SEQ ID NO: 2854865 - RNA, 14 nt, Mycobacterium avium subsp. paratuberculosis
ggccgcggcgaucg

SEQ ID NO: 2854866 - RNA, 12 nt, Mycobacterium avium subsp. paratuberculosis
ggccgcggcgcc

SEQ ID NO: 2854867 - RNA, 13 nt, Mycobacterium avium subsp. paratuberculosis
ggccgcggcgccg

SEQ ID NO: 2854868 - RNA, 15 nt, Mycobacterium avium subsp. paratuberculosis
ggccgcggcgcggcc

SEQ ID NO: 2854869 - RNA, 13 nt, Mycobacterium avium subsp. paratuberculosis
ggccgcggcggcc

SEQ ID NO: 2854870 - RNA, 13 nt, Mycobacterium avium subsp. paratuberculosis
ggccgcggcgggc

SEQ ID NO: 2854871 - RNA, 17 nt, Mycobacterium avium subsp. paratuberculosis
ggccgcggcgggcgcgu

SEQ ID NO: 2854872 - RNA, 22 nt, Mycobacterium avium subsp. paratuberculosis
ggccgcggcgggcgcgucgagg

SEQ ID NO: 2854873 - RNA, 23 nt, Mycobacterium avium subsp. paratuberculosis
ggccgcggcgggcgcgucgaggu

SEQ ID NO: 2854874 - RNA, 14 nt, Mycobacterium avium subsp. paratuberculosis
ggccgcggcggugc

SEQ ID NO: 2854875 - RNA, 15 nt, Mycobacterium avium subsp. paratuberculosis
ggccgcggcggugcc

SEQ ID NO: 2854876 - RNA, 19 nt, Mycobacterium avium subsp. paratuberculosis
ggccgcggcggugccggug

SEQ ID NO: 2854877 - RNA, 16 nt, Mycobacterium avium subsp. paratuberculosis
ggccgcggcucgcgac

SEQ ID NO: 2854878 - RNA, 19 nt, Mycobacterium avium subsp. paratuberculosis
ggccgcggcucgcgacgcg

SEQ ID NO: 2854879 - RNA, 19 nt, Mycobacterium avium subsp. paratuberculosis
ggccgcgggcccaccgcca

SEQ ID NO: 2854880 - RNA, 20 nt, Mycobacterium avium subsp. paratuberculosis
ggccgcgggcccaccgccac

SEQ ID NO: 2854881 - RNA, 21 nt, Mycobacterium avium subsp. paratuberculosis
ggccgcgggcgauucccggau

SEQ ID NO: 2854882 - RNA, 16 nt, Mycobacterium avium subsp. paratuberculosis
ggccgcgggcgggccg

SEQ ID NO: 2854883 - RNA, 13 nt, Mycobacterium avium subsp. paratuberculosis
ggccgcggggccg

SEQ ID NO: 2854884 - RNA, 16 nt, Mycobacterium avium subsp. paratuberculosis
ggccgcggggccggcg

SEQ ID NO: 2854885 - RNA, 18 nt, Mycobacterium avium subsp. paratuberculosis
ggccgcggguauccguga

SEQ ID NO: 2854886 - RNA, 17 nt, Mycobacterium avium subsp. paratuberculosis
ggccgcggguggcgcca

SEQ ID NO: 2854887 - RNA, 13 nt, Mycobacterium avium subsp. paratuberculosis
ggccggagcggau

SEQ ID NO: 2854888 - RNA, 14 nt, Mycobacterium avium subsp. paratuberculosis
ggccggagcggaug

SEQ ID NO: 2854889 - RNA, 21 nt, Mycobacterium avium subsp. paratuberculosis
ggccggagcggauggcgccgu

SEQ ID NO: 2854890 - RNA, 23 nt, Mycobacterium avium subsp. paratuberculosis
ggccggagcggauggcgccgucg

SEQ ID NO: 2854891 - RNA, 19 nt, Mycobacterium avium subsp. paratuberculosis
ggccggagcggugcggcuc

SEQ ID NO: 2854892 - RNA, 20 nt, Mycobacterium avium subsp. paratuberculosis
ggccggagcggugcggcucg

SEQ ID NO: 2854893 - RNA, 15 nt, Mycobacterium avium subsp. paratuberculosis
ggccggaggugcggg

SEQ ID NO: 2854894 - RNA, 21 nt, Mycobacterium avium subsp. paratuberculosis
ggccggaggugcgggucucga

SEQ ID NO: 2854895 - RNA, 22 nt, Mycobacterium avium subsp. paratuberculosis
ggccggaucccgguacggcuca

SEQ ID NO: 2854896 - RNA, 22 nt, Mycobacterium avium subsp. paratuberculosis
ggccggaucgaaaaggucgaac

SEQ ID NO: 2854897 - RNA, 21 nt, Mycobacterium avium subsp. paratuberculosis
ggccggaucgaacuugaucac

SEQ ID NO: 2854898 - RNA, 14 nt, Mycobacterium avium subsp. paratuberculosis
ggccggaucgcgca

SEQ ID NO: 2854899 - RNA, 16 nt, Mycobacterium avium subsp. paratuberculosis
ggccggauggccagca

SEQ ID NO: 2854900 - RNA, 19 nt, Mycobacterium avium subsp. paratuberculosis
ggccggauguuguccggaa

SEQ ID NO: 2854901 - RNA, 19 nt, Mycobacterium avium subsp. paratuberculosis
ggccggauucucgcccggc

SEQ ID NO: 2854902 - RNA, 16 nt, Mycobacterium avium subsp. paratuberculosis
ggccggcaacgacccg

SEQ ID NO: 2854903 - RNA, 19 nt, Mycobacterium avium subsp. paratuberculosis
ggccggcaacgacccgucg

SEQ ID NO: 2854904 - RNA, 21 nt, Mycobacterium avium subsp. paratuberculosis
ggccggcaacgacccgucggg

SEQ ID NO: 2854905 - RNA, 20 nt, Mycobacterium avium subsp. paratuberculosis
ggccggcacccgggccuuga

SEQ ID NO: 2854906 - RNA, 14 nt, Mycobacterium avium subsp. paratuberculosis
ggccggcaccucga

SEQ ID NO: 2854907 - RNA, 17 nt, Mycobacterium avium subsp. paratuberculosis
ggccggcacucgccucg

SEQ ID NO: 2854908 - RNA, 23 nt, Mycobacterium avium subsp. paratuberculosis
ggccggcacucgccucggaggcc

SEQ ID NO: 2854909 - RNA, 16 nt, Mycobacterium avium subsp. paratuberculosis
ggccggcagccggcca

SEQ ID NO: 2854910 - RNA, 19 nt, Mycobacterium avium subsp. paratuberculosis
ggccggcagccggccaccu

SEQ ID NO: 2854911 - RNA, 15 nt, Mycobacterium avium subsp. paratuberculosis
ggccggcagccggcg

SEQ ID NO: 2854912 - RNA, 17 nt, Mycobacterium avium subsp. paratuberculosis
ggccggcagccggcgcg

SEQ ID NO: 2854913 - RNA, 21 nt, Mycobacterium avium subsp. paratuberculosis
ggccggcagccggcgcgguga

SEQ ID NO: 2854914 - RNA, 24 nt, Mycobacterium avium subsp. paratuberculosis
ggccggcagccggcgcggugauuc

SEQ ID NO: 2854915 - RNA, 15 nt, Mycobacterium avium subsp. paratuberculosis
ggccggcaggccgcc

SEQ ID NO: 2854916 - RNA, 16 nt, Mycobacterium avium subsp. paratuberculosis
ggccggcaggccgccc

SEQ ID NO: 2854917 - RNA, 20 nt, Mycobacterium avium subsp. paratuberculosis
ggccggcaggccgcccgacc

SEQ ID NO: 2854918 - RNA, 14 nt, Mycobacterium avium subsp. paratuberculosis
ggccggcaggucga

SEQ ID NO: 2854919 - RNA, 16 nt, Mycobacterium avium subsp. paratuberculosis
ggccggcaguugcggc

SEQ ID NO: 2854920 - RNA, 17 nt, Mycobacterium avium subsp. paratuberculosis
ggccggcaguugcggcc

SEQ ID NO: 2854921 - RNA, 18 nt, Mycobacterium avium subsp. paratuberculosis
ggccggcaguugcggccg

SEQ ID NO: 2854922 - RNA, 12 nt, Mycobacterium avium subsp. paratuberculosis
ggccggccacca

SEQ ID NO: 2854923 - RNA, 13 nt, Mycobacterium avium subsp. paratuberculosis
ggccggccaccag

SEQ ID NO: 2854924 - RNA, 15 nt, Mycobacterium avium subsp. paratuberculosis
ggccggccaccagcg

SEQ ID NO: 2854925 - RNA, 17 nt, Mycobacterium avium subsp. paratuberculosis
ggccggccaccagcggc

SEQ ID NO: 2854926 - RNA, 21 nt, Mycobacterium avium subsp. paratuberculosis
ggccggccaccagcggccgga

SEQ ID NO: 2854927 - RNA, 23 nt, Mycobacterium avium subsp. paratuberculosis
ggccggccaccagcggccggaac

SEQ ID NO: 2854928 - RNA, 22 nt, Mycobacterium avium subsp. paratuberculosis
ggccggccacgcucggcggcgc

SEQ ID NO: 2854929 - RNA, 14 nt, Mycobacterium avium subsp. paratuberculosis
ggccggccagcagc

SEQ ID NO: 2854930 - RNA, 12 nt, Mycobacterium avium subsp. paratuberculosis
ggccggccagcg

SEQ ID NO: 2854931 - RNA, 13 nt, Mycobacterium avium subsp. paratuberculosis
ggccggccagcgc

SEQ ID NO: 2854932 - RNA, 19 nt, Mycobacterium avium subsp. paratuberculosis
ggccggccagcgcgcggcc

SEQ ID NO: 2854933 - RNA, 21 nt, Mycobacterium avium subsp. paratuberculosis
ggccggccagcgcgcggccca

SEQ ID NO: 2854934 - RNA, 14 nt, Mycobacterium avium subsp. paratuberculosis
ggccggccagcggg

SEQ ID NO: 2854935 - RNA, 15 nt, Mycobacterium avium subsp. paratuberculosis
ggccggccaguccug

SEQ ID NO: 2854936 - RNA, 12 nt, Mycobacterium avium subsp. paratuberculosis
ggccggcccagc

SEQ ID NO: 2854937 - RNA, 22 nt, Mycobacterium avium subsp. paratuberculosis
ggccggcccagccuucgccgca

SEQ ID NO: 2854938 - RNA, 15 nt, Mycobacterium avium subsp. paratuberculosis
ggccggcccagcgcg

SEQ ID NO: 2854939 - RNA, 16 nt, Mycobacterium avium subsp. paratuberculosis
ggccggcccagcgcgc

SEQ ID NO: 2854940 - RNA, 20 nt, Mycobacterium avium subsp. paratuberculosis
ggccggcccagcgcgcggcg

SEQ ID NO: 2854941 - RNA, 16 nt, Mycobacterium avium subsp. paratuberculosis
ggccggccccgcccgg

SEQ ID NO: 2854942 - RNA, 17 nt, Mycobacterium avium subsp. paratuberculosis
ggccggccccgcccggc

SEQ ID NO: 2854943 - RNA, 19 nt, Mycobacterium avium subsp. paratuberculosis
ggccggccccgcccggcgc

SEQ ID NO: 2854944 - RNA, 21 nt, Mycobacterium avium subsp. paratuberculosis
ggccggccccgcccggcgcgc

SEQ ID NO: 2854945 - RNA, 22 nt, Mycobacterium avium subsp. paratuberculosis
ggccggccccgcccggcgcgca

SEQ ID NO: 2854946 - RNA, 19 nt, Mycobacterium avium subsp. paratuberculosis
ggccggccccggccgggcg

SEQ ID NO: 2854947 - RNA, 20 nt, Mycobacterium avium subsp. paratuberculosis
ggccggcccgcccggcggcg

SEQ ID NO: 2854948 - RNA, 15 nt, Mycobacterium avium subsp. paratuberculosis
ggccggcccgcccgu

SEQ ID NO: 2854949 - RNA, 12 nt, Mycobacterium avium subsp. paratuberculosis
ggccggcccugc

SEQ ID NO: 2854950 - RNA, 14 nt, Mycobacterium avium subsp. paratuberculosis
ggccggccgagccg

SEQ ID NO: 2854951 - RNA, 13 nt, Mycobacterium avium subsp. paratuberculosis
ggccggccgcagc

SEQ ID NO: 2854952 - RNA, 15 nt, Mycobacterium avium subsp. paratuberculosis
ggccggccgcagcug

SEQ ID NO: 2854953 - RNA, 14 nt, Mycobacterium avium subsp. paratuberculosis
ggccggccgcccgc

SEQ ID NO: 2854954 - RNA, 15 nt, Mycobacterium avium subsp. paratuberculosis
ggccggccgcccgca

SEQ ID NO: 2854955 - RNA, 12 nt, Mycobacterium avium subsp. paratuberculosis
ggccggccgccg

SEQ ID NO: 2854956 - RNA, 15 nt, Mycobacterium avium subsp. paratuberculosis
ggccggccgcuaccc

SEQ ID NO: 2854957 - RNA, 14 nt, Mycobacterium avium subsp. paratuberculosis
ggccggccggacag

SEQ ID NO: 2854958 - RNA, 13 nt, Mycobacterium avium subsp. paratuberculosis
ggccggccggccg

SEQ ID NO: 2854959 - RNA, 14 nt, Mycobacterium avium subsp. paratuberculosis
ggccggccggccga

SEQ ID NO: 2854960 - RNA, 16 nt, Mycobacterium avium subsp. paratuberculosis
ggccggccggccgugc

SEQ ID NO: 2854961 - RNA, 12 nt, Mycobacterium avium subsp. paratuberculosis
ggccggccgggu

SEQ ID NO: 2854962 - RNA, 13 nt, Mycobacterium avium subsp. paratuberculosis
ggccggccggguc

SEQ ID NO: 2854963 - RNA, 20 nt, Mycobacterium avium subsp. paratuberculosis
ggccggccugccaccgcgaa

SEQ ID NO: 2854964 - RNA, 21 nt, Mycobacterium avium subsp. paratuberculosis
ggccggccugccaccgcgaau

SEQ ID NO: 2854965 - RNA, 14 nt, Mycobacterium avium subsp. paratuberculosis
ggccggccuggugc

SEQ ID NO: 2854966 - RNA, 20 nt, Mycobacterium avium subsp. paratuberculosis
ggccggcgaaggacagccgg

SEQ ID NO: 2854967 - RNA, 17 nt, Mycobacterium avium subsp. paratuberculosis
ggccggcgacgauaucg

SEQ ID NO: 2854968 - RNA, 23 nt, Mycobacterium avium subsp. paratuberculosis
ggccggcgacgauaucggccgcg

SEQ ID NO: 2854969 - RNA, 20 nt, Mycobacterium avium subsp. paratuberculosis
ggccggcgacgccgcgcugg

SEQ ID NO: 2854970 - RNA, 13 nt, Mycobacterium avium subsp. paratuberculosis
ggccggcgacggc

SEQ ID NO: 2854971 - RNA, 14 nt, Mycobacterium avium subsp. paratuberculosis
ggccggcgacggcg

SEQ ID NO: 2854972 - RNA, 19 nt, Mycobacterium avium subsp. paratuberculosis
ggccgggcgugcccggcgc

SEQ ID NO: 2854973 - RNA, 13 nt, Mycobacterium avium subsp. paratuberculosis
ggccgggcucccg

SEQ ID NO: 2854974 - RNA, 20 nt, Mycobacterium avium subsp. paratuberculosis
ggccgggcucgagggcggcg

SEQ ID NO: 2854975 - RNA, 17 nt, Mycobacterium avium subsp. paratuberculosis
ggccgggcugcccacca

SEQ ID NO: 2854976 - RNA, 20 nt, Mycobacterium avium subsp. paratuberculosis
ggccgggcugcccaccacca

SEQ ID NO: 2854977 - RNA, 15 nt, Mycobacterium avium subsp. paratuberculosis
ggccgggcugguccg

SEQ ID NO: 2854978 - RNA, 18 nt, Mycobacterium avium subsp. paratuberculosis
ggccggggaguucgcggu

SEQ ID NO: 2854979 - RNA, 21 nt, Mycobacterium avium subsp. paratuberculosis
ggccggggaguucgcgguuga

SEQ ID NO: 2854980 - RNA, 22 nt, Mycobacterium avium subsp. paratuberculosis
ggccggggcagacccgcgucga

SEQ ID NO: 2854981 - RNA, 14 nt, Mycobacterium avium subsp. paratuberculosis
ggccggggccagca

SEQ ID NO: 2854982 - RNA, 20 nt, Mycobacterium avium subsp. paratuberculosis
ggccggggcgaccaguaggc

SEQ ID NO: 2854983 - RNA, 13 nt, Mycobacterium avium subsp. paratuberculosis
ggccggggcgcca

SEQ ID NO: 2854984 - RNA, 17 nt, Mycobacterium avium subsp. paratuberculosis
ggccggggcggcgguac

SEQ ID NO: 2854985 - RNA, 13 nt, Mycobacterium avium subsp. paratuberculosis
ggccggggcgggc

SEQ ID NO: 2854986 - RNA, 19 nt, Mycobacterium avium subsp. paratuberculosis
ggccggggcuucgaacgcc

SEQ ID NO: 2854987 - RNA, 23 nt, Mycobacterium avium subsp. paratuberculosis
ggccggggcuucgaacgcccgca

SEQ ID NO: 2854988 - RNA, 14 nt, Mycobacterium avium subsp. paratuberculosis
ggccgggggcgcgg

SEQ ID NO: 2854989 - RNA, 22 nt, Mycobacterium avium subsp. paratuberculosis
ggccgggggcggcggcgcgugc

SEQ ID NO: 2854990 - RNA, 19 nt, Mycobacterium avium subsp. paratuberculosis
ggccggguccacgccgagg

SEQ ID NO: 2854991 - RNA, 16 nt, Mycobacterium avium subsp. paratuberculosis
ggccgggucgaacggc

SEQ ID NO: 2854992 - RNA, 22 nt, Mycobacterium avium subsp. paratuberculosis
ggccgggucgaacggcaaccug

SEQ ID NO: 2854993 - RNA, 13 nt, Mycobacterium avium subsp. paratuberculosis
ggccgggucgacc

SEQ ID NO: 2854994 - RNA, 19 nt, Mycobacterium avium subsp. paratuberculosis
ggccgggucgagcgcgccg

SEQ ID NO: 2854995 - RNA, 16 nt, Mycobacterium avium subsp. paratuberculosis
ggccgggucgcaggca

SEQ ID NO: 2854996 - RNA, 18 nt, Mycobacterium avium subsp. paratuberculosis
ggccgggucgcaggcagc

SEQ ID NO: 2854997 - RNA, 15 nt, Mycobacterium avium subsp. paratuberculosis
ggccgggucgccguc

SEQ ID NO: 2854998 - RNA, 16 nt, Mycobacterium avium subsp. paratuberculosis
ggccgggucgccgucg

SEQ ID NO: 2854999 - RNA, 13 nt, Mycobacterium avium subsp. paratuberculosis
ggccgggucggga

SEQ ID NO: 2855000 - RNA, 14 nt, Mycobacterium avium subsp. paratuberculosis
ggccggguguagcu

SEQ ID NO: 2855001 - RNA, 14 nt, Mycobacterium avium subsp. paratuberculosis
ggccggguuggcau

SEQ ID NO: 2855002 - RNA, 17 nt, Mycobacterium avium subsp. paratuberculosis
ggccggguuguccuggc

SEQ ID NO: 2855003 - RNA, 18 nt, Mycobacterium avium subsp. paratuberculosis
ggccggguuguccuggcc

SEQ ID NO: 2855004 - RNA, 17 nt, Mycobacterium avium subsp. paratuberculosis
ggccgguaucgggucac

SEQ ID NO: 2855005 - RNA, 19 nt, Mycobacterium avium subsp. paratuberculosis
ggccgguaucgggucaccg

SEQ ID NO: 2855006 - RNA, 17 nt, Mycobacterium avium subsp. paratuberculosis
ggccgguauuggccacg

SEQ ID NO: 2855007 - RNA, 22 nt, Mycobacterium avium subsp. paratuberculosis
ggccggucaccggucgcguuga

SEQ ID NO: 2855008 - RNA, 15 nt, Mycobacterium avium subsp. paratuberculosis
ggccggucagcgcga

SEQ ID NO: 2855009 - RNA, 16 nt, Mycobacterium avium subsp. paratuberculosis
ggccggucagcgcgac

SEQ ID NO: 2855010 - RNA, 23 nt, Mycobacterium avium subsp. paratuberculosis
ggccggucagcgcgacaucgccg

SEQ ID NO: 2855011 - RNA, 13 nt, Mycobacterium avium subsp. paratuberculosis
ggccgguccccgg

SEQ ID NO: 2855012 - RNA, 14 nt, Mycobacterium avium subsp. paratuberculosis
ggccgguccccggc

SEQ ID NO: 2855013 - RNA, 13 nt, Mycobacterium avium subsp. paratuberculosis
ggccgguccgccc

SEQ ID NO: 2855014 - RNA, 16 nt, Mycobacterium avium subsp. paratuberculosis
ggccgguccgcccaga

SEQ ID NO: 2855015 - RNA, 17 nt, Mycobacterium avium subsp. paratuberculosis
ggccgguccgcccagac

SEQ ID NO: 2855016 - RNA, 20 nt, Mycobacterium avium subsp. paratuberculosis
ggccgguccgugcacggcca

SEQ ID NO: 2855017 - RNA, 21 nt, Mycobacterium avium subsp. paratuberculosis
ggccgguccucugcgaccacc

SEQ ID NO: 2855018 - RNA, 23 nt, Mycobacterium avium subsp. paratuberculosis
ggccgguccucugcgaccacccg

SEQ ID NO: 2855019 - RNA, 18 nt, Mycobacterium avium subsp. paratuberculosis
ggccggucgaaggccccg

SEQ ID NO: 2855020 - RNA, 13 nt, Mycobacterium avium subsp. paratuberculosis
ggccggucgccga

SEQ ID NO: 2855021 - RNA, 14 nt, Mycobacterium avium subsp. paratuberculosis
ggccggucgccugc

SEQ ID NO: 2855022 - RNA, 18 nt, Mycobacterium avium subsp. paratuberculosis
ggccggucggucagucgc

SEQ ID NO: 2855023 - RNA, 16 nt, Mycobacterium avium subsp. paratuberculosis
ggccggucggucggcc

SEQ ID NO: 2855024 - RNA, 17 nt, Mycobacterium avium subsp. paratuberculosis
ggccggucggucggccg

SEQ ID NO: 2855025 - RNA, 18 nt, Mycobacterium avium subsp. paratuberculosis
ggccggucggucggccgc

SEQ ID NO: 2855026 - RNA, 23 nt, Mycobacterium avium subsp. paratuberculosis
ggccggucggucggccgcacguc

SEQ ID NO: 2855027 - RNA, 20 nt, Mycobacterium avium subsp. paratuberculosis
ggccggugacuccuccucgg

SEQ ID NO: 2855028 - RNA, 23 nt, Mycobacterium avium subsp. paratuberculosis
ggccggugacuccuccucggcca

SEQ ID NO: 2855029 - RNA, 17 nt, Mycobacterium avium subsp. paratuberculosis
ggccggugcgccgaccg

SEQ ID NO: 2855030 - RNA, 18 nt, Mycobacterium avium subsp. paratuberculosis
ggccggugcgcgucagcc

SEQ ID NO: 2855031 - RNA, 20 nt, Mycobacterium avium subsp. paratuberculosis
ggccggugcgcgucagccgu

SEQ ID NO: 2855032 - RNA, 14 nt, Mycobacterium avium subsp. paratuberculosis
ggccggugcguccg

SEQ ID NO: 2855033 - RNA, 20 nt, Mycobacterium avium subsp. paratuberculosis
ggccggugcguccgccggcg

SEQ ID NO: 2855034 - RNA, 21 nt, Mycobacterium avium subsp. paratuberculosis
ggccggugcguccgccggcgg

SEQ ID NO: 2855035 - RNA, 22 nt, Mycobacterium avium subsp. paratuberculosis
ggccggugcguccgccggcggu

SEQ ID NO: 2855036 - RNA, 22 nt, Mycobacterium avium subsp. paratuberculosis
ggccggugcgugaugaccaggg

SEQ ID NO: 2855037 - RNA, 23 nt, Mycobacterium avium subsp. paratuberculosis
ggccggugcgugaugaccagggc

SEQ ID NO: 2855038 - RNA, 19 nt, Mycobacterium avium subsp. paratuberculosis
ggccggugcuuggcguuga

SEQ ID NO: 2855039 - RNA, 22 nt, Mycobacterium avium subsp. paratuberculosis
ggccgguggaaugcaucgcgau

SEQ ID NO: 2855040 - RNA, 13 nt, Mycobacterium avium subsp. paratuberculosis
ggccgguggcgac

SEQ ID NO: 2855041 - RNA, 15 nt, Mycobacterium avium subsp. paratuberculosis
ggccggugggcggcg

SEQ ID NO: 2855042 - RNA, 14 nt, Mycobacterium avium subsp. paratuberculosis
ggccgguuccacga

SEQ ID NO: 2855043 - RNA, 23 nt, Mycobacterium avium subsp. paratuberculosis
ggccgguugccuuuccgcgcggc

SEQ ID NO: 2855044 - RNA, 24 nt, Mycobacterium avium subsp. paratuberculosis
ggccgguugccuuuccgcgcggcg

SEQ ID NO: 2855045 - RNA, 15 nt, Mycobacterium avium subsp. paratuberculosis
ggccgguuggcggcc

SEQ ID NO: 2855046 - RNA, 17 nt, Mycobacterium avium subsp. paratuberculosis
ggccgguuggcggccgg

SEQ ID NO: 2855047 - RNA, 19 nt, Mycobacterium avium subsp. paratuberculosis
ggccgguuggcggccgggu

SEQ ID NO: 2855048 - RNA, 21 nt, Mycobacterium avium subsp. paratuberculosis
ggccgguuggcggccgggucg

SEQ ID NO: 2855049 - RNA, 16 nt, Mycobacterium avium subsp. paratuberculosis
ggccgguuggugcgcc

SEQ ID NO: 2855050 - RNA, 18 nt, Mycobacterium avium subsp. paratuberculosis
ggccgguuguugcggucc

SEQ ID NO: 2855051 - RNA, 14 nt, Mycobacterium avium subsp. paratuberculosis
ggccguaccggcgu

SEQ ID NO: 2855052 - RNA, 17 nt, Mycobacterium avium subsp. paratuberculosis
ggccguaccggcguacg

SEQ ID NO: 2855053 - RNA, 16 nt, Mycobacterium avium subsp. paratuberculosis
ggccguagagcacgaa

SEQ ID NO: 2855054 - RNA, 17 nt, Mycobacterium avium subsp. paratuberculosis
ggccguagccggaccgc

SEQ ID NO: 2855055 - RNA, 20 nt, Mycobacterium avium subsp. paratuberculosis
ggccguagcggcucgccacc

SEQ ID NO: 2855056 - RNA, 12 nt, Mycobacterium avium subsp. paratuberculosis
ggccgugccggc

SEQ ID NO: 2855057 - RNA, 14 nt, Mycobacterium avium subsp. paratuberculosis
ggccgugccggcuc

SEQ ID NO: 2855058 - RNA, 15 nt, Mycobacterium avium subsp. paratuberculosis
ggccgugccggcucg

SEQ ID NO: 2855059 - RNA, 20 nt, Mycobacterium avium subsp. paratuberculosis
ggccgugccggcucggcggc

SEQ ID NO: 2855060 - RNA, 20 nt, Mycobacterium avium subsp. paratuberculosis
ggccgugccguggucggugc

SEQ ID NO: 2855061 - RNA, 12 nt, Mycobacterium avium subsp. paratuberculosis
ggccgugcgcgu

SEQ ID NO: 2855062 - RNA, 14 nt, Mycobacterium avium subsp. paratuberculosis
ggccgugcgcgucg

SEQ ID NO: 2855063 - RNA, 12 nt, Mycobacterium avium subsp. paratuberculosis
ggccguggaccc

SEQ ID NO: 2855064 - RNA, 20 nt, Mycobacterium avium subsp. paratuberculosis
ggccguggccgucacgcugg

SEQ ID NO: 2855065 - RNA, 14 nt, Mycobacterium avium subsp. paratuberculosis
ggccguggccguga

SEQ ID NO: 2855066 - RNA, 14 nt, Mycobacterium avium subsp. paratuberculosis
ggccguggcgaacu

SEQ ID NO: 2855067 - RNA, 17 nt, Mycobacterium avium subsp. paratuberculosis
ggccguguacagcaggg

SEQ ID NO: 2855068 - RNA, 19 nt, Mycobacterium avium subsp. paratuberculosis
ggccgugugcgcaucggcg

SEQ ID NO: 2855069 - RNA, 20 nt, Mycobacterium avium subsp. paratuberculosis
ggccgugugcgcaucggcga

SEQ ID NO: 2855070 - RNA, 15 nt, Mycobacterium avium subsp. paratuberculosis
ggccguucagcgggc

SEQ ID NO: 2855071 - RNA, 19 nt, Mycobacterium avium subsp. paratuberculosis
ggccguucaggucgaucag

SEQ ID NO: 2855072 - RNA, 14 nt, Mycobacterium avium subsp. paratuberculosis
ggccguucgccggc

SEQ ID NO: 2855073 - RNA, 16 nt, Mycobacterium avium subsp. paratuberculosis
ggccguucgccggcca

SEQ ID NO: 2855074 - RNA, 17 nt, Mycobacterium avium subsp. paratuberculosis
ggccguucgccggccag

SEQ ID NO: 2855075 - RNA, 18 nt, Mycobacterium avium subsp. paratuberculosis
ggccguucgccggccagc

SEQ ID NO: 2855076 - RNA, 19 nt, Mycobacterium avium subsp. paratuberculosis
ggccguucgccggccagca

SEQ ID NO: 2855077 - RNA, 19 nt, Mycobacterium avium subsp. paratuberculosis
ggccguugaucgagcaccg

SEQ ID NO: 2855078 - RNA, 21 nt, Mycobacterium avium subsp. paratuberculosis
ggccguugaucgagcaccggg

SEQ ID NO: 2855079 - RNA, 22 nt, Mycobacterium avium subsp. paratuberculosis
ggccguugcgggugucgccggu

SEQ ID NO: 2855080 - RNA, 15 nt, Mycobacterium avium subsp. paratuberculosis
ggccguuggccuuga

SEQ ID NO: 2855081 - RNA, 15 nt, Mycobacterium avium subsp. paratuberculosis
ggccguugggccagc

SEQ ID NO: 2855082 - RNA, 16 nt, Mycobacterium avium subsp. paratuberculosis
ggccguugggccagcg

SEQ ID NO: 2855083 - RNA, 13 nt, Mycobacterium avium subsp. paratuberculosis
ggccguuguggcc

SEQ ID NO: 2855084 - RNA, 17 nt, Mycobacterium avium subsp. paratuberculosis
ggccguuguggccaccc

SEQ ID NO: 2855085 - RNA, 14 nt, Mycobacterium avium subsp. paratuberculosis
ggccucaccgcggg

SEQ ID NO: 2855086 - RNA, 20 nt, Mycobacterium avium subsp. paratuberculosis
ggccucaccgcgggccaggc

SEQ ID NO: 2855087 - RNA, 21 nt, Mycobacterium avium subsp. paratuberculosis
ggccucaccgcgggccaggcc

SEQ ID NO: 2855088 - RNA, 14 nt, Mycobacterium avium subsp. paratuberculosis
ggccuccaccacca

SEQ ID NO: 2855089 - RNA, 19 nt, Mycobacterium avium subsp. paratuberculosis
ggccuccaccaccaugucg

SEQ ID NO: 2855090 - RNA, 21 nt, Mycobacterium avium subsp. paratuberculosis
ggccuccaccaccaugucguu

SEQ ID NO: 2855091 - RNA, 16 nt, Mycobacterium avium subsp. paratuberculosis
ggccuccaccagcggc

SEQ ID NO: 2855092 - RNA, 13 nt, Mycobacterium avium subsp. paratuberculosis
ggccuccaccggc

SEQ ID NO: 2855093 - RNA, 14 nt, Mycobacterium avium subsp. paratuberculosis
ggccuccaccggca

SEQ ID NO: 2855094 - RNA, 15 nt, Mycobacterium avium subsp. paratuberculosis
ggccuccagccagcg

SEQ ID NO: 2855095 - RNA, 16 nt, Mycobacterium avium subsp. paratuberculosis
ggccuccagccagcgc

SEQ ID NO: 2855096 - RNA, 20 nt, Mycobacterium avium subsp. paratuberculosis
ggccuccagccagcgcgcga

SEQ ID NO: 2855097 - RNA, 20 nt, Mycobacterium avium subsp. paratuberculosis
ggccuccagccgcgcggccg

SEQ ID NO: 2855098 - RNA, 21 nt, Mycobacterium avium subsp. paratuberculosis
ggccuccagccgcgcggccgc

SEQ ID NO: 2855099 - RNA, 18 nt, Mycobacterium avium subsp. paratuberculosis
ggccuccagccggcggau

SEQ ID NO: 2855100 - RNA, 22 nt, Mycobacterium avium subsp. paratuberculosis
ggccuccagcuuugccagcaga

SEQ ID NO: 2855101 - RNA, 23 nt, Mycobacterium avium subsp. paratuberculosis
ggccuccccauccgcggccaccg

SEQ ID NO: 2855102 - RNA, 19 nt, Mycobacterium avium subsp. paratuberculosis
ggccucccgguagaucgcc

SEQ ID NO: 2855103 - RNA, 22 nt, Mycobacterium avium subsp. paratuberculosis
ggccucccgguagaucgccgga

SEQ ID NO: 2855104 - RNA, 13 nt, Mycobacterium avium subsp. paratuberculosis
ggccuccgacccg

SEQ ID NO: 2855105 - RNA, 20 nt, Mycobacterium avium subsp. paratuberculosis
ggccuccgagcggcgcaggc

SEQ ID NO: 2855106 - RNA, 20 nt, Mycobacterium avium subsp. paratuberculosis
ggccuccgcgcgcggcccgu

SEQ ID NO: 2855107 - RNA, 23 nt, Mycobacterium avium subsp. paratuberculosis
ggccuccgcgcgcggcccguacu

SEQ ID NO: 2855108 - RNA, 19 nt, Mycobacterium avium subsp. paratuberculosis
ggccuccggauggcggucg

SEQ ID NO: 2855109 - RNA, 24 nt, Mycobacterium avium subsp. paratuberculosis
ggccuccggauggcggucgcgcca

SEQ ID NO: 2855110 - RNA, 14 nt, Mycobacterium avium subsp. paratuberculosis
ggccuccggcggca

SEQ ID NO: 2855111 - RNA, 20 nt, Mycobacterium avium subsp. paratuberculosis
ggccuccgugcuggccgggu

SEQ ID NO: 2855112 - RNA, 13 nt, Mycobacterium avium subsp. paratuberculosis
ggccuccuccucg

SEQ ID NO: 2855113 - RNA, 16 nt, Mycobacterium avium subsp. paratuberculosis
ggccuccucggugacc

SEQ ID NO: 2855114 - RNA, 13 nt, Mycobacterium avium subsp. paratuberculosis
ggccucgacgauu

SEQ ID NO: 2855115 - RNA, 22 nt, Mycobacterium avium subsp. paratuberculosis
ggccucgaggaucgcggccacg

SEQ ID NO: 2855116 - RNA, 12 nt, Mycobacterium avium subsp. paratuberculosis
ggccucgaugcg

SEQ ID NO: 2855117 - RNA, 22 nt, Mycobacterium avium subsp. paratuberculosis
ggccucgaugcggccgucggga

SEQ ID NO: 2855118 - RNA, 13 nt, Mycobacterium avium subsp. paratuberculosis
ggccucgaugucg

SEQ ID NO: 2855119 - RNA, 16 nt, Mycobacterium avium subsp. paratuberculosis
ggccucgaugucgucg

SEQ ID NO: 2855120 - RNA, 20 nt, Mycobacterium avium subsp. paratuberculosis
ggccucgaugucgucgauga

SEQ ID NO: 2855121 - RNA, 13 nt, Mycobacterium avium subsp. paratuberculosis
ggccucgcccagc

SEQ ID NO: 2855122 - RNA, 17 nt, Mycobacterium avium subsp. paratuberculosis
ggccucgcccagcgccg

SEQ ID NO: 2855123 - RNA, 19 nt, Mycobacterium avium subsp. paratuberculosis
ggccucgcccagcgccgcg

SEQ ID NO: 2855124 - RNA, 20 nt, Mycobacterium avium subsp. paratuberculosis
ggccucgcccagcgccgcgg

SEQ ID NO: 2855125 - RNA, 12 nt, Mycobacterium avium subsp. paratuberculosis
ggccucgccggc

SEQ ID NO: 2855126 - RNA, 18 nt, Mycobacterium avium subsp. paratuberculosis
ggccucgccgucgaaggc

SEQ ID NO: 2855127 - RNA, 23 nt, Mycobacterium avium subsp. paratuberculosis
ggccucgccgucgcgaucgcggu

SEQ ID NO: 2855128 - RNA, 23 nt, Mycobacterium avium subsp. paratuberculosis
ggccucgccguugccggcccgca

SEQ ID NO: 2855129 - RNA, 20 nt, Mycobacterium avium subsp. paratuberculosis
ggccucgcgcaaugccgccg

SEQ ID NO: 2855130 - RNA, 14 nt, Mycobacterium avium subsp. paratuberculosis
ggccucggcgaccg

SEQ ID NO: 2855131 - RNA, 15 nt, Mycobacterium avium subsp. paratuberculosis
ggccucggcgaccgc

SEQ ID NO: 2855132 - RNA, 16 nt, Mycobacterium avium subsp. paratuberculosis
ggccucggcgaccgcc

SEQ ID NO: 2855133 - RNA, 13 nt, Mycobacterium avium subsp. paratuberculosis
ggccucggcgaug

SEQ ID NO: 2855134 - RNA, 15 nt, Mycobacterium avium subsp. paratuberculosis
ggccucggcgcgggc

SEQ ID NO: 2855135 - RNA, 18 nt, Mycobacterium avium subsp. paratuberculosis
ggccucggcgcugcccgc

SEQ ID NO: 2855136 - RNA, 16 nt, Mycobacterium avium subsp. paratuberculosis
ggccucggcggccggg

SEQ ID NO: 2855137 - RNA, 19 nt, Mycobacterium avium subsp. paratuberculosis
ggccucggcgguggccucg

SEQ ID NO: 2855138 - RNA, 16 nt, Mycobacterium avium subsp. paratuberculosis
ggccucggcguccgcg

SEQ ID NO: 2855139 - RNA, 21 nt, Mycobacterium avium subsp. paratuberculosis
ggccucggcguccgcggcgga

SEQ ID NO: 2855140 - RNA, 14 nt, Mycobacterium avium subsp. paratuberculosis
ggccucggcgucga

SEQ ID NO: 2855141 - RNA, 14 nt, Mycobacterium avium subsp. paratuberculosis
ggccuggcccagcc

SEQ ID NO: 2855142 - RNA, 15 nt, Mycobacterium avium subsp. paratuberculosis
ggccuggcccagccg

SEQ ID NO: 2855143 - RNA, 23 nt, Mycobacterium avium subsp. paratuberculosis
ggccuggccgucgcggcgcgggu

SEQ ID NO: 2855144 - RNA, 23 nt, Mycobacterium avium subsp. paratuberculosis
ggccugguagcugagcagcaggu

SEQ ID NO: 2855145 - RNA, 17 nt, Mycobacterium avium subsp. paratuberculosis
ggccuggucgaacagca

SEQ ID NO: 2855146 - RNA, 18 nt, Mycobacterium avium subsp. paratuberculosis
ggccuggucgaacagcac

SEQ ID NO: 2855147 - RNA, 24 nt, Mycobacterium avium subsp. paratuberculosis
ggccuggucgaacagcacgccggc

SEQ ID NO: 2855148 - RNA, 15 nt, Mycobacterium avium subsp. paratuberculosis
ggccuggucggccgg

SEQ ID NO: 2855149 - RNA, 16 nt, Mycobacterium avium subsp. paratuberculosis
ggccuggucggccggc

SEQ ID NO: 2855150 - RNA, 19 nt, Mycobacterium avium subsp. paratuberculosis
ggccuuacgcugcgcgacc

SEQ ID NO: 2855151 - RNA, 15 nt, Mycobacterium avium subsp. paratuberculosis
ggccuucacgcuggc

SEQ ID NO: 2855152 - RNA, 12 nt, Mycobacterium avium subsp. paratuberculosis
ggccuucagcgu

SEQ ID NO: 2855153 - RNA, 19 nt, Mycobacterium avium subsp. paratuberculosis
ggccuucaucaccgccccg

SEQ ID NO: 2855154 - RNA, 14 nt, Mycobacterium avium subsp. paratuberculosis
ggccuuccgcaaca

SEQ ID NO: 2855155 - RNA, 18 nt, Mycobacterium avium subsp. paratuberculosis
ggccuucucgcgcaccgc

SEQ ID NO: 2855156 - RNA, 20 nt, Mycobacterium avium subsp. paratuberculosis
ggccuucucgcgcaccgcgg

SEQ ID NO: 2855157 - RNA, 23 nt, Mycobacterium avium subsp. paratuberculosis
ggccuucuggaagccuggcacga

SEQ ID NO: 2855158 - RNA, 18 nt, Mycobacterium avium subsp. paratuberculosis
ggccuucuucugccacuc

SEQ ID NO: 2855159 - RNA, 22 nt, Mycobacterium avium subsp. paratuberculosis
ggccuucuuggccggagccuug

SEQ ID NO: 2855160 - RNA, 16 nt, Mycobacterium avium subsp. paratuberculosis
ggccuucuuggcggcg

SEQ ID NO: 2855161 - RNA, 18 nt, Mycobacterium avium subsp. paratuberculosis
ggccuucuuggcggcggc

SEQ ID NO: 2855162 - RNA, 19 nt, Mycobacterium avium subsp. paratuberculosis
ggccuucuuggcggcggcc

SEQ ID NO: 2855163 - RNA, 20 nt, Mycobacterium avium subsp. paratuberculosis
ggccuucuuucguucgaugu

SEQ ID NO: 2855164 - RNA, 22 nt, Mycobacterium avium subsp. paratuberculosis
ggccuucuuucguucgaugucg

SEQ ID NO: 2855165 - RNA, 14 nt, Mycobacterium avium subsp. paratuberculosis
ggccuugaccacgg

SEQ ID NO: 2855166 - RNA, 23 nt, Mycobacterium avium subsp. paratuberculosis
ggccuugaccacggugcgcucgu

SEQ ID NO: 2855167 - RNA, 16 nt, Mycobacterium avium subsp. paratuberculosis
ggccuugagcaccgcg

SEQ ID NO: 2855168 - RNA, 15 nt, Mycobacterium avium subsp. paratuberculosis
ggccuugcagcccgc

SEQ ID NO: 2855169 - RNA, 16 nt, Mycobacterium avium subsp. paratuberculosis
ggccuugcgagccgga

SEQ ID NO: 2855170 - RNA, 21 nt, Mycobacterium avium subsp. paratuberculosis
ggccuugcgagccggagccuu

SEQ ID NO: 2855171 - RNA, 22 nt, Mycobacterium avium subsp. paratuberculosis
ggccuugcgagccggagccuug

SEQ ID NO: 2855172 - RNA, 16 nt, Mycobacterium avium subsp. paratuberculosis
ggccuugcucgccgcg

SEQ ID NO: 2855173 - RNA, 19 nt, Mycobacterium avium subsp. paratuberculosis
ggccuugcugagccggccc

SEQ ID NO: 2855174 - RNA, 22 nt, Mycobacterium avium subsp. paratuberculosis
ggccuugcugagccggcccugc

SEQ ID NO: 2855175 - RNA, 15 nt, Mycobacterium avium subsp. paratuberculosis
ggccuugcugauccc

SEQ ID NO: 2855176 - RNA, 19 nt, Mycobacterium avium subsp. paratuberculosis
ggccuugcugauccccagc

SEQ ID NO: 2855177 - RNA, 16 nt, Mycobacterium avium subsp. paratuberculosis
ggccuuggccaacgcg

SEQ ID NO: 2855178 - RNA, 17 nt, Mycobacterium avium subsp. paratuberculosis
ggccuuggccaccacgc

SEQ ID NO: 2855179 - RNA, 13 nt, Mycobacterium avium subsp. paratuberculosis
ggccuuguccuug

SEQ ID NO: 2855180 - RNA, 15 nt, Mycobacterium avium subsp. paratuberculosis
ggccuugucgugucg

SEQ ID NO: 2855181 - RNA, 17 nt, Mycobacterium avium subsp. paratuberculosis
ggccuuguugcggcgca

SEQ ID NO: 2855182 - RNA, 22 nt, Mycobacterium avium subsp. paratuberculosis
ggccuuguugcggcgcaccccg

SEQ ID NO: 2855183 - RNA, 19 nt, Mycobacterium avium subsp. paratuberculosis
ggcgaaaacgccugcgccg

SEQ ID NO: 2855184 - RNA, 21 nt, Mycobacterium avium subsp. paratuberculosis
ggcgaaaacgccugcgccgcc

SEQ ID NO: 2855185 - RNA, 21 nt, Mycobacterium avium subsp. paratuberculosis
ggcgaaauaacccaccccgau

SEQ ID NO: 2855186 - RNA, 17 nt, Mycobacterium avium subsp. paratuberculosis
ggcgaaaucgcgggccu

SEQ ID NO: 2855187 - RNA, 14 nt, Mycobacterium avium subsp. paratuberculosis
ggcgaaaucucgaa

SEQ ID NO: 2855188 - RNA, 16 nt, Mycobacterium avium subsp. paratuberculosis
ggcgaacaacgccaca

SEQ ID NO: 2855189 - RNA, 12 nt, Mycobacterium avium subsp. paratuberculosis
ggcgaacaccac

SEQ ID NO: 2855190 - RNA, 18 nt, Mycobacterium avium subsp. paratuberculosis
ggcgaacaccacgguccc

SEQ ID NO: 2855191 - RNA, 23 nt, Mycobacterium avium subsp. paratuberculosis
ggcgaacaccagcccggccgagg

SEQ ID NO: 2855192 - RNA, 18 nt, Mycobacterium avium subsp. paratuberculosis
ggcgaacaccucggcgau

SEQ ID NO: 2855193 - RNA, 18 nt, Mycobacterium avium subsp. paratuberculosis
ggcgaacaccucggugau

SEQ ID NO: 2855194 - RNA, 18 nt, Mycobacterium avium subsp. paratuberculosis
ggcgaacacgucggccag

SEQ ID NO: 2855195 - RNA, 20 nt, Mycobacterium avium subsp. paratuberculosis
ggcgaacacgucggccagcg

SEQ ID NO: 2855196 - RNA, 14 nt, Mycobacterium avium subsp. paratuberculosis
ggcgaacagcgggu

SEQ ID NO: 2855197 - RNA, 24 nt, Mycobacterium avium subsp. paratuberculosis
ggcgaacaggaugcgggugaugcc

SEQ ID NO: 2855198 - RNA, 22 nt, Mycobacterium avium subsp. paratuberculosis
ggcgaacaucuuggucagccgc

SEQ ID NO: 2855199 - RNA, 16 nt, Mycobacterium avium subsp. paratuberculosis
ggcgaacauggcggcc

SEQ ID NO: 2855200 - RNA, 19 nt, Mycobacterium avium subsp. paratuberculosis
ggcgaacauggcggccagc

SEQ ID NO: 2855201 - RNA, 20 nt, Mycobacterium avium subsp. paratuberculosis
ggcgaacauggcggccagcc

SEQ ID NO: 2855202 - RNA, 21 nt, Mycobacterium avium subsp. paratuberculosis
ggcgaacauggcggccagccg

SEQ ID NO: 2855203 - RNA, 16 nt, Mycobacterium avium subsp. paratuberculosis
ggcgaacauggucgcc

SEQ ID NO: 2855204 - RNA, 19 nt, Mycobacterium avium subsp. paratuberculosis
ggcgaacauggucgcccac

SEQ ID NO: 2855205 - RNA, 20 nt, Mycobacterium avium subsp. paratuberculosis
ggcgaaccacgggucgcugu

SEQ ID NO: 2855206 - RNA, 11 nt, Mycobacterium avium subsp. paratuberculosis
ggcgaaccagc

SEQ ID NO: 2855207 - RNA, 20 nt, Mycobacterium avium subsp. paratuberculosis
ggcgaaccagcaugcgccag

SEQ ID NO: 2855208 - RNA, 23 nt, Mycobacterium avium subsp. paratuberculosis
ggcgaaccagcaugcgccagagc

SEQ ID NO: 2855209 - RNA, 20 nt, Mycobacterium avium subsp. paratuberculosis
ggcgaaccagggcagccagc

SEQ ID NO: 2855210 - RNA, 23 nt, Mycobacterium avium subsp. paratuberculosis
ggcgaaccagggcagccagcccg

SEQ ID NO: 2855211 - RNA, 13 nt, Mycobacterium avium subsp. paratuberculosis
ggcgaacccgagc

SEQ ID NO: 2855212 - RNA, 19 nt, Mycobacterium avium subsp. paratuberculosis
ggcgaacccgagcaccccg

SEQ ID NO: 2855213 - RNA, 22 nt, Mycobacterium avium subsp. paratuberculosis
ggcgaacccgagcaccccggcg

SEQ ID NO: 2855214 - RNA, 18 nt, Mycobacterium avium subsp. paratuberculosis
ggcgaacccggcgcccgg

SEQ ID NO: 2855215 - RNA, 17 nt, Mycobacterium avium subsp. paratuberculosis
ggcgaaccgcggcggca

SEQ ID NO: 2855216 - RNA, 15 nt, Mycobacterium avium subsp. paratuberculosis
ggcgaaccgggcccg

SEQ ID NO: 2855217 - RNA, 14 nt, Mycobacterium avium subsp. paratuberculosis
ggcgaacgaccggg

SEQ ID NO: 2855218 - RNA, 15 nt, Mycobacterium avium subsp. paratuberculosis
ggcgaacgaccgggu

SEQ ID NO: 2855219 - RNA, 14 nt, Mycobacterium avium subsp. paratuberculosis
ggcgaacgacgucg

SEQ ID NO: 2855220 - RNA, 18 nt, Mycobacterium avium subsp. paratuberculosis
ggcgaacgaggccgacgu

SEQ ID NO: 2855221 - RNA, 14 nt, Mycobacterium avium subsp. paratuberculosis
ggcgaacgcccggu

SEQ ID NO: 2855222 - RNA, 13 nt, Mycobacterium avium subsp. paratuberculosis
ggcgaacggcgga

SEQ ID NO: 2855223 - RNA, 14 nt, Mycobacterium avium subsp. paratuberculosis
ggcgaacgucgaug

SEQ ID NO: 2855224 - RNA, 16 nt, Mycobacterium avium subsp. paratuberculosis
ggcgaacuccacccug

SEQ ID NO: 2855225 - RNA, 15 nt, Mycobacterium avium subsp. paratuberculosis
ggcgaccccggccag

SEQ ID NO: 2855226 - RNA, 15 nt, Mycobacterium avium subsp. paratuberculosis
ggcgaccccguucgc

SEQ ID NO: 2855227 - RNA, 17 nt, Mycobacterium avium subsp. paratuberculosis
ggcgaccccguucgccg

SEQ ID NO: 2855228 - RNA, 18 nt, Mycobacterium avium subsp. paratuberculosis
ggcgaccccguucgccga

SEQ ID NO: 2855229 - RNA, 23 nt, Mycobacterium avium subsp. paratuberculosis
ggcgaccccguucgccgacagca

SEQ ID NO: 2855230 - RNA, 14 nt, Mycobacterium avium subsp. paratuberculosis
ggcgacccgcaccg

SEQ ID NO: 2855231 - RNA, 15 nt, Mycobacterium avium subsp. paratuberculosis
ggcgacccgcaccga

SEQ ID NO: 2855232 - RNA, 20 nt, Mycobacterium avium subsp. paratuberculosis
ggcgacccgcuucgcccggc

SEQ ID NO: 2855233 - RNA, 21 nt, Mycobacterium avium subsp. paratuberculosis
ggcgacccgcuucgcccggcu

SEQ ID NO: 2855234 - RNA, 18 nt, Mycobacterium avium subsp. paratuberculosis
ggcgaccgccaccucgag

SEQ ID NO: 2855235 - RNA, 14 nt, Mycobacterium avium subsp. paratuberculosis
ggcgaccgcccggg

SEQ ID NO: 2855236 - RNA, 19 nt, Mycobacterium avium subsp. paratuberculosis
ggcgaccgccuugucggcg

SEQ ID NO: 2855237 - RNA, 20 nt, Mycobacterium avium subsp. paratuberculosis
ggcgaccgccuugucggcga

SEQ ID NO: 2855238 - RNA, 16 nt, Mycobacterium avium subsp. paratuberculosis
ggcgaccgcgacggug

SEQ ID NO: 2855239 - RNA, 15 nt, Mycobacterium avium subsp. paratuberculosis
ggcgaccgcgcgcgg

SEQ ID NO: 2855240 - RNA, 17 nt, Mycobacterium avium subsp. paratuberculosis
ggcgaccgcggccgcga

SEQ ID NO: 2855241 - RNA, 20 nt, Mycobacterium avium subsp. paratuberculosis
ggcgaccggccccaacggcg

SEQ ID NO: 2855242 - RNA, 14 nt, Mycobacterium avium subsp. paratuberculosis
ggcgaccgugccca

SEQ ID NO: 2855243 - RNA, 19 nt, Mycobacterium avium subsp. paratuberculosis
ggcgaccgugcccaccagc

SEQ ID NO: 2855244 - RNA, 19 nt, Mycobacterium avium subsp. paratuberculosis
ggcgaccuccugcaaggcc

SEQ ID NO: 2855245 - RNA, 16 nt, Mycobacterium avium subsp. paratuberculosis
ggcgaccucguggucc

SEQ ID NO: 2855246 - RNA, 21 nt, Mycobacterium avium subsp. paratuberculosis
ggcgaccugcggcucgucggc

SEQ ID NO: 2855247 - RNA, 14 nt, Mycobacterium avium subsp. paratuberculosis
ggcgaccugcgggc

SEQ ID NO: 2855248 - RNA, 15 nt, Mycobacterium avium subsp. paratuberculosis
ggcgaccugcgggcc

SEQ ID NO: 2855249 - RNA, 17 nt, Mycobacterium avium subsp. paratuberculosis
ggcgaccugcgggccca

SEQ ID NO: 2855250 - RNA, 19 nt, Mycobacterium avium subsp. paratuberculosis
ggcgaccugcgggcccacc

SEQ ID NO: 2855251 - RNA, 20 nt, Mycobacterium avium subsp. paratuberculosis
ggcgaccugcgggcccaccg

SEQ ID NO: 2855252 - RNA, 19 nt, Mycobacterium avium subsp. paratuberculosis
ggcgaccuggacgccgcac

SEQ ID NO: 2855253 - RNA, 23 nt, Mycobacterium avium subsp. paratuberculosis
ggcgaccuggacgccgcacgcga

SEQ ID NO: 2855254 - RNA, 19 nt, Mycobacterium avium subsp. paratuberculosis
ggcgaccuggugcucgaug

SEQ ID NO: 2855255 - RNA, 21 nt, Mycobacterium avium subsp. paratuberculosis
ggcgaccuggugcucgaugcg

SEQ ID NO: 2855256 - RNA, 16 nt, Mycobacterium avium subsp. paratuberculosis
ggcgaccuugcgcagc

SEQ ID NO: 2855257 - RNA, 19 nt, Mycobacterium avium subsp. paratuberculosis
ggcgaccuugcgcagccgg

SEQ ID NO: 2855258 - RNA, 20 nt, Mycobacterium avium subsp. paratuberculosis
ggcgaccuugcgcagccggc

SEQ ID NO: 2855259 - RNA, 21 nt, Mycobacterium avium subsp. paratuberculosis
ggcgaccuugcggcgcgaugc

SEQ ID NO: 2855260 - RNA, 24 nt, Mycobacterium avium subsp. paratuberculosis
ggcgacgaaauugggcugggucac

SEQ ID NO: 2855261 - RNA, 16 nt, Mycobacterium avium subsp. paratuberculosis
ggcgacgaacgccggc

SEQ ID NO: 2855262 - RNA, 14 nt, Mycobacterium avium subsp. paratuberculosis
ggcgacgaagcagc

SEQ ID NO: 2855263 - RNA, 16 nt, Mycobacterium avium subsp. paratuberculosis
ggcgacgaagcagcuc

SEQ ID NO: 2855264 - RNA, 19 nt, Mycobacterium avium subsp. paratuberculosis
ggcgacgaagucgacggcg

SEQ ID NO: 2855265 - RNA, 23 nt, Mycobacterium avium subsp. paratuberculosis
ggcgacgaagucgacggcgguga

SEQ ID NO: 2855266 - RNA, 15 nt, Mycobacterium avium subsp. paratuberculosis
ggcgacgaccaccag

SEQ ID NO: 2855267 - RNA, 17 nt, Mycobacterium avium subsp. paratuberculosis
ggcgacgaccaccagga

SEQ ID NO: 2855268 - RNA, 15 nt, Mycobacterium avium subsp. paratuberculosis
ggcgacgaccgcacc

SEQ ID NO: 2855269 - RNA, 17 nt, Mycobacterium avium subsp. paratuberculosis
ggcgacgaccgcaccga

SEQ ID NO: 2855270 - RNA, 13 nt, Mycobacterium avium subsp. paratuberculosis
ggcgacgaccguc

SEQ ID NO: 2855271 - RNA, 12 nt, Mycobacterium avium subsp. paratuberculosis
ggcgacgacgcc

SEQ ID NO: 2855272 - RNA, 13 nt, Mycobacterium avium subsp. paratuberculosis
ggcgacgacgcgg

SEQ ID NO: 2855273 - RNA, 16 nt, Mycobacterium avium subsp. paratuberculosis
ggcgacgacggcggag

SEQ ID NO: 2855274 - RNA, 15 nt, Mycobacterium avium subsp. paratuberculosis
ggcgacgagguaggu

SEQ ID NO: 2855275 - RNA, 20 nt, Mycobacterium avium subsp. paratuberculosis
ggcgacgauaucggccgcgg

SEQ ID NO: 2855276 - RNA, 20 nt, Mycobacterium avium subsp. paratuberculosis
ggcgacgaugaagacccgcc

SEQ ID NO: 2855277 - RNA, 17 nt, Mycobacterium avium subsp. paratuberculosis
ggcgacgaugccggccg

SEQ ID NO: 2855278 - RNA, 18 nt, Mycobacterium avium subsp. paratuberculosis
ggcgacgaugccggccgg

SEQ ID NO: 2855279 - RNA, 16 nt, Mycobacterium avium subsp. paratuberculosis
ggcgacgauggccagg

SEQ ID NO: 2855280 - RNA, 12 nt, Mycobacterium avium subsp. paratuberculosis
ggcgacgccgcg

SEQ ID NO: 2855281 - RNA, 15 nt, Mycobacterium avium subsp. paratuberculosis
ggcgacgccgcgcug

SEQ ID NO: 2855282 - RNA, 16 nt, Mycobacterium avium subsp. paratuberculosis
ggcgacgccgcgcugg

SEQ ID NO: 2855283 - RNA, 17 nt, Mycobacterium avium subsp. paratuberculosis
ggcgacgccgcgcuggc

SEQ ID NO: 2855284 - RNA, 14 nt, Mycobacterium avium subsp. paratuberculosis
ggcgacgccgcgga

SEQ ID NO: 2855285 - RNA, 20 nt, Mycobacterium avium subsp. paratuberculosis
ggcgacgccgcggaagcccc

SEQ ID NO: 2855286 - RNA, 15 nt, Mycobacterium avium subsp. paratuberculosis
ggcgacgccggcgag

SEQ ID NO: 2855287 - RNA, 16 nt, Mycobacterium avium subsp. paratuberculosis
ggcgacgccggcgagg

SEQ ID NO: 2855288 - RNA, 14 nt, Mycobacterium avium subsp. paratuberculosis
ggcgacgcggcggg

SEQ ID NO: 2855289 - RNA, 16 nt, Mycobacterium avium subsp. paratuberculosis
ggcgacgcucaggcgu

SEQ ID NO: 2855290 - RNA, 22 nt, Mycobacterium avium subsp. paratuberculosis
ggcgacgcucaggcguccagcc

SEQ ID NO: 2855291 - RNA, 12 nt, Mycobacterium avium subsp. paratuberculosis
ggcgacgcugaa

SEQ ID NO: 2855292 - RNA, 20 nt, Mycobacterium avium subsp. paratuberculosis
ggcgacgcugaacagcagca

SEQ ID NO: 2855293 - RNA, 15 nt, Mycobacterium avium subsp. paratuberculosis
ggcgacgcugguggc

SEQ ID NO: 2855294 - RNA, 16 nt, Mycobacterium avium subsp. paratuberculosis
ggcgacgcugugcucg

SEQ ID NO: 2855295 - RNA, 18 nt, Mycobacterium avium subsp. paratuberculosis
ggcgacggcaccgccggc

SEQ ID NO: 2855296 - RNA, 20 nt, Mycobacterium avium subsp. paratuberculosis
ggcgacggcaccgccggcgg

SEQ ID NO: 2855297 - RNA, 14 nt, Mycobacterium avium subsp. paratuberculosis
ggcgacggcagcgc

SEQ ID NO: 2855298 - RNA, 16 nt, Mycobacterium avium subsp. paratuberculosis
ggcgacggcagcgcga

SEQ ID NO: 2855299 - RNA, 14 nt, Mycobacterium avium subsp. paratuberculosis
ggcgacggccagcg

SEQ ID NO: 2855300 - RNA, 16 nt, Mycobacterium avium subsp. paratuberculosis
ggcgacggccagcgcg

SEQ ID NO: 2855301 - RNA, 20 nt, Mycobacterium avium subsp. paratuberculosis
ggcgacggccguccggucgc

SEQ ID NO: 2855302 - RNA, 21 nt, Mycobacterium avium subsp. paratuberculosis
ggcgacggcgaccacaccguc

SEQ ID NO: 2855303 - RNA, 16 nt, Mycobacterium avium subsp. paratuberculosis
ggcgacggcgacgacc

SEQ ID NO: 2855304 - RNA, 17 nt, Mycobacterium avium subsp. paratuberculosis
ggcgacggcgacggcca

SEQ ID NO: 2855305 - RNA, 16 nt, Mycobacterium avium subsp. paratuberculosis
ggcgacggcgacggcg

SEQ ID NO: 2855306 - RNA, 12 nt, Mycobacterium avium subsp. paratuberculosis
ggcgacggcgag

SEQ ID NO: 2855307 - RNA, 19 nt, Mycobacterium avium subsp. paratuberculosis
ggcgacggcgaguucgaug

SEQ ID NO: 2855308 - RNA, 11 nt, Mycobacterium avium subsp. paratuberculosis
ggcgacggcgc

SEQ ID NO: 2855309 - RNA, 12 nt, Mycobacterium avium subsp. paratuberculosis
ggcgacggcgcu

SEQ ID NO: 2855310 - RNA, 13 nt, Mycobacterium avium subsp. paratuberculosis
ggcgagcggcccu

SEQ ID NO: 2855311 - RNA, 13 nt, Mycobacterium avium subsp. paratuberculosis
ggcgagcgucgcc

SEQ ID NO: 2855312 - RNA, 14 nt, Mycobacterium avium subsp. paratuberculosis
ggcgagcgucgccg

SEQ ID NO: 2855313 - RNA, 15 nt, Mycobacterium avium subsp. paratuberculosis
ggcgagcucaacagc

SEQ ID NO: 2855314 - RNA, 15 nt, Mycobacterium avium subsp. paratuberculosis
ggcgagcucgcggcc

SEQ ID NO: 2855315 - RNA, 21 nt, Mycobacterium avium subsp. paratuberculosis
ggcgagcucguucucggcgaa

SEQ ID NO: 2855316 - RNA, 22 nt, Mycobacterium avium subsp. paratuberculosis
ggcgagcucguucucggcgaac

SEQ ID NO: 2855317 - RNA, 19 nt, Mycobacterium avium subsp. paratuberculosis
ggcgagcugaucggcguug

SEQ ID NO: 2855318 - RNA, 21 nt, Mycobacterium avium subsp. paratuberculosis
ggcgagcugaucggcguuggc

SEQ ID NO: 2855319 - RNA, 22 nt, Mycobacterium avium subsp. paratuberculosis
ggcgagcugcgggugcucagcc

SEQ ID NO: 2855320 - RNA, 13 nt, Mycobacterium avium subsp. paratuberculosis
ggcgagcuggccg

SEQ ID NO: 2855321 - RNA, 14 nt, Mycobacterium avium subsp. paratuberculosis
ggcgagcuggccgc

SEQ ID NO: 2855322 - RNA, 16 nt, Mycobacterium avium subsp. paratuberculosis
ggcgagcuggccgccc

SEQ ID NO: 2855323 - RNA, 15 nt, Mycobacterium avium subsp. paratuberculosis
ggcgagcuuggcggg

SEQ ID NO: 2855324 - RNA, 17 nt, Mycobacterium avium subsp. paratuberculosis
ggcgaggaacccgaccg

SEQ ID NO: 2855325 - RNA, 20 nt, Mycobacterium avium subsp. paratuberculosis
ggcgaggaacccgaccgcga

SEQ ID NO: 2855326 - RNA, 17 nt, Mycobacterium avium subsp. paratuberculosis
ggcgaggaaguccggcg

SEQ ID NO: 2855327 - RNA, 21 nt, Mycobacterium avium subsp. paratuberculosis
ggcgaggaaguccggcgcgcc

SEQ ID NO: 2855328 - RNA, 23 nt, Mycobacterium avium subsp. paratuberculosis
ggcgaggaaguccggcgcgcccg

SEQ ID NO: 2855329 - RNA, 16 nt, Mycobacterium avium subsp. paratuberculosis
ggcgaggaauugcgcu

SEQ ID NO: 2855330 - RNA, 20 nt, Mycobacterium avium subsp. paratuberculosis
ggcgaggacgucgucgacgu

SEQ ID NO: 2855331 - RNA, 17 nt, Mycobacterium avium subsp. paratuberculosis
ggcgaggaucgcgaugu

SEQ ID NO: 2855332 - RNA, 15 nt, Mycobacterium avium subsp. paratuberculosis
ggcgaggauggcgau

SEQ ID NO: 2855333 - RNA, 15 nt, Mycobacterium avium subsp. paratuberculosis
ggcgaggccaggcgu

SEQ ID NO: 2855334 - RNA, 16 nt, Mycobacterium avium subsp. paratuberculosis
ggcgaggcggucggcg

SEQ ID NO: 2855335 - RNA, 15 nt, Mycobacterium avium subsp. paratuberculosis
ggcgagggcaacguc

SEQ ID NO: 2855336 - RNA, 23 nt, Mycobacterium avium subsp. paratuberculosis
ggcgagggcaacgucuggccacc

SEQ ID NO: 2855337 - RNA, 14 nt, Mycobacterium avium subsp. paratuberculosis
ggcgaggucgggau

SEQ ID NO: 2855338 - RNA, 20 nt, Mycobacterium avium subsp. paratuberculosis
ggcgaggucgucgagggcca

SEQ ID NO: 2855339 - RNA, 16 nt, Mycobacterium avium subsp. paratuberculosis
ggcgaggucguucgac

SEQ ID NO: 2855340 - RNA, 20 nt, Mycobacterium avium subsp. paratuberculosis
ggcgaggugggcaccagcug

SEQ ID NO: 2855341 - RNA, 17 nt, Mycobacterium avium subsp. paratuberculosis
ggcgaguaaggccgagg

SEQ ID NO: 2855342 - RNA, 18 nt, Mycobacterium avium subsp. paratuberculosis
ggcgaguaaggccgaggc

SEQ ID NO: 2855343 - RNA, 17 nt, Mycobacterium avium subsp. paratuberculosis
ggcgaguacccgccgca

SEQ ID NO: 2855344 - RNA, 14 nt, Mycobacterium avium subsp. paratuberculosis
ggcgagucccggcg

SEQ ID NO: 2855345 - RNA, 19 nt, Mycobacterium avium subsp. paratuberculosis
ggcgagucccggcgcacca

SEQ ID NO: 2855346 - RNA, 22 nt, Mycobacterium avium subsp. paratuberculosis
ggcgagucccggcgcaccaggc

SEQ ID NO: 2855347 - RNA, 18 nt, Mycobacterium avium subsp. paratuberculosis
ggcgaguccgcggaggcg

SEQ ID NO: 2855348 - RNA, 19 nt, Mycobacterium avium subsp. paratuberculosis
ggcgaguccgcggaggcga

SEQ ID NO: 2855349 - RNA, 13 nt, Mycobacterium avium subsp. paratuberculosis
ggcgagugaggac

SEQ ID NO: 2855350 - RNA, 18 nt, Mycobacterium avium subsp. paratuberculosis
ggcgagugaggccgaggc

SEQ ID NO: 2855351 - RNA, 22 nt, Mycobacterium avium subsp. paratuberculosis
ggcgagugcgaaacucaccgcg

SEQ ID NO: 2855352 - RNA, 23 nt, Mycobacterium avium subsp. paratuberculosis
ggcgaguuaugccgucacccaga

SEQ ID NO: 2855353 - RNA, 21 nt, Mycobacterium avium subsp. paratuberculosis
ggcgaguucagaagucgcccg

SEQ ID NO: 2855354 - RNA, 23 nt, Mycobacterium avium subsp. paratuberculosis
ggcgaguucagaagucgcccgcg

SEQ ID NO: 2855355 - RNA, 19 nt, Mycobacterium avium subsp. paratuberculosis
ggcgaguucggcggcccgc

SEQ ID NO: 2855356 - RNA, 21 nt, Mycobacterium avium subsp. paratuberculosis
ggcgauaaccucggcggcggc

SEQ ID NO: 2855357 - RNA, 17 nt, Mycobacterium avium subsp. paratuberculosis
ggcgauaggcggccagc

SEQ ID NO: 2855358 - RNA, 18 nt, Mycobacterium avium subsp. paratuberculosis
ggcgauaggcggccagcu

SEQ ID NO: 2855359 - RNA, 19 nt, Mycobacterium avium subsp. paratuberculosis
ggcgaucaccccggcgacg

SEQ ID NO: 2855360 - RNA, 23 nt, Mycobacterium avium subsp. paratuberculosis
ggcgaucaccgccgcggcgacca

SEQ ID NO: 2855361 - RNA, 14 nt, Mycobacterium avium subsp. paratuberculosis
ggcgaucaccgcgg

SEQ ID NO: 2855362 - RNA, 22 nt, Mycobacterium avium subsp. paratuberculosis
ggcgaucaccgcguucucggcg

SEQ ID NO: 2855363 - RNA, 19 nt, Mycobacterium avium subsp. paratuberculosis
ggcgaucaccgggacaccg

SEQ ID NO: 2855364 - RNA, 18 nt, Mycobacterium avium subsp. paratuberculosis
ggcgaucaccuugcggcc

SEQ ID NO: 2855365 - RNA, 20 nt, Mycobacterium avium subsp. paratuberculosis
ggcgaucaccuugcggccgg

SEQ ID NO: 2855366 - RNA, 22 nt, Mycobacterium avium subsp. paratuberculosis
ggcgaucaccuugcggccggcg

SEQ ID NO: 2855367 - RNA, 14 nt, Mycobacterium avium subsp. paratuberculosis
ggcgaucagcagca

SEQ ID NO: 2855368 - RNA, 21 nt, Mycobacterium avium subsp. paratuberculosis
ggcgaucagcagcacccgggc

SEQ ID NO: 2855369 - RNA, 13 nt, Mycobacterium avium subsp. paratuberculosis
ggcgaucagcccg

SEQ ID NO: 2855370 - RNA, 14 nt, Mycobacterium avium subsp. paratuberculosis
ggcgaucagcccgc

SEQ ID NO: 2855371 - RNA, 16 nt, Mycobacterium avium subsp. paratuberculosis
ggcgaucagcccgccc

SEQ ID NO: 2855372 - RNA, 14 nt, Mycobacterium avium subsp. paratuberculosis
ggcgaucagcgcgc

SEQ ID NO: 2855373 - RNA, 16 nt, Mycobacterium avium subsp. paratuberculosis
ggcgaucagcgcgcac

SEQ ID NO: 2855374 - RNA, 23 nt, Mycobacterium avium subsp. paratuberculosis
ggcgaucagcgcgcacagcgcca

SEQ ID NO: 2855375 - RNA, 17 nt, Mycobacterium avium subsp. paratuberculosis
ggcgaucagcugcucgu

SEQ ID NO: 2855376 - RNA, 17 nt, Mycobacterium avium subsp. paratuberculosis
ggcgaucagggcggcgc

SEQ ID NO: 2855377 - RNA, 16 nt, Mycobacterium avium subsp. paratuberculosis
ggcgaucauccaggug

SEQ ID NO: 2855378 - RNA, 17 nt, Mycobacterium avium subsp. paratuberculosis
ggcgaucaucgccccgg

SEQ ID NO: 2855379 - RNA, 18 nt, Mycobacterium avium subsp. paratuberculosis
ggcgaucaucgucgucac

SEQ ID NO: 2855380 - RNA, 16 nt, Mycobacterium avium subsp. paratuberculosis
ggcgauccacgccucc

SEQ ID NO: 2855381 - RNA, 21 nt, Mycobacterium avium subsp. paratuberculosis
ggcgauccacgccuccggcag

SEQ ID NO: 2855382 - RNA, 23 nt, Mycobacterium avium subsp. paratuberculosis
ggcgauccgcaggccgucgccgg

SEQ ID NO: 2855383 - RNA, 12 nt, Mycobacterium avium subsp. paratuberculosis
ggcgauccgcgc

SEQ ID NO: 2855384 - RNA, 15 nt, Mycobacterium avium subsp. paratuberculosis
ggcgauccgcgcggc

SEQ ID NO: 2855385 - RNA, 16 nt, Mycobacterium avium subsp. paratuberculosis
ggcgauccgcgcggcg

SEQ ID NO: 2855386 - RNA, 20 nt, Mycobacterium avium subsp. paratuberculosis
ggcgauccgcgcggcgacga

SEQ ID NO: 2855387 - RNA, 15 nt, Mycobacterium avium subsp. paratuberculosis
ggcgauccggccggc

SEQ ID NO: 2855388 - RNA, 18 nt, Mycobacterium avium subsp. paratuberculosis
ggcgauccggccggcggc

SEQ ID NO: 2855389 - RNA, 14 nt, Mycobacterium avium subsp. paratuberculosis
ggcgauccgggcac

SEQ ID NO: 2855390 - RNA, 17 nt, Mycobacterium avium subsp. paratuberculosis
ggcgaucgacaccagcg

SEQ ID NO: 2855391 - RNA, 12 nt, Mycobacterium avium subsp. paratuberculosis
ggcgaucgacgu

SEQ ID NO: 2855392 - RNA, 19 nt, Mycobacterium avium subsp. paratuberculosis
ggcgaucgacgucaccacc

SEQ ID NO: 2855393 - RNA, 20 nt, Mycobacterium avium subsp. paratuberculosis
ggcgaucgaucccuuggcgg

SEQ ID NO: 2855394 - RNA, 17 nt, Mycobacterium avium subsp. paratuberculosis
ggcgauggugccggcca

SEQ ID NO: 2855395 - RNA, 20 nt, Mycobacterium avium subsp. paratuberculosis
ggcgauggugcugcccggcg

SEQ ID NO: 2855396 - RNA, 18 nt, Mycobacterium avium subsp. paratuberculosis
ggcgaugguggcgcugcc

SEQ ID NO: 2855397 - RNA, 19 nt, Mycobacterium avium subsp. paratuberculosis
ggcgaugguggcgcugccg

SEQ ID NO: 2855398 - RNA, 21 nt, Mycobacterium avium subsp. paratuberculosis
ggcgaugguggcgcugccgag

SEQ ID NO: 2855399 - RNA, 13 nt, Mycobacterium avium subsp. paratuberculosis
ggcgauggugggc

SEQ ID NO: 2855400 - RNA, 20 nt, Mycobacterium avium subsp. paratuberculosis
ggcgauggugggcagccggc

SEQ ID NO: 2855401 - RNA, 23 nt, Mycobacterium avium subsp. paratuberculosis
ggcgauggugggcagccggcaac

SEQ ID NO: 2855402 - RNA, 19 nt, Mycobacterium avium subsp. paratuberculosis
ggcgauguaggacgccgca

SEQ ID NO: 2855403 - RNA, 22 nt, Mycobacterium avium subsp. paratuberculosis
ggcgauguaggacgccgcaccg

SEQ ID NO: 2855404 - RNA, 14 nt, Mycobacterium avium subsp. paratuberculosis
ggcgaugucgggca

SEQ ID NO: 2855405 - RNA, 18 nt, Mycobacterium avium subsp. paratuberculosis
ggcgaugucgggcaccug

SEQ ID NO: 2855406 - RNA, 16 nt, Mycobacterium avium subsp. paratuberculosis
ggcgaugucgucgacg

SEQ ID NO: 2855407 - RNA, 17 nt, Mycobacterium avium subsp. paratuberculosis
ggcgaugucgucgacgc

SEQ ID NO: 2855408 - RNA, 15 nt, Mycobacterium avium subsp. paratuberculosis
ggcgaugugaucgcg

SEQ ID NO: 2855409 - RNA, 20 nt, Mycobacterium avium subsp. paratuberculosis
ggcgauguggguggucagcg

SEQ ID NO: 2855410 - RNA, 23 nt, Mycobacterium avium subsp. paratuberculosis
ggcgauguugaccacccgcagcg

SEQ ID NO: 2855411 - RNA, 22 nt, Mycobacterium avium subsp. paratuberculosis
ggcgauucccggaugcugcggg

SEQ ID NO: 2855412 - RNA, 14 nt, Mycobacterium avium subsp. paratuberculosis
ggcgcaacagcacc

SEQ ID NO: 2855413 - RNA, 19 nt, Mycobacterium avium subsp. paratuberculosis
ggcgcaaccaacucgcgau

SEQ ID NO: 2855414 - RNA, 21 nt, Mycobacterium avium subsp. paratuberculosis
ggcgcaaccucuucgggggug

SEQ ID NO: 2855415 - RNA, 19 nt, Mycobacterium avium subsp. paratuberculosis
ggcgcaacgggauggcuca

SEQ ID NO: 2855416 - RNA, 23 nt, Mycobacterium avium subsp. paratuberculosis
ggcgcacaacccggacagcgcga

SEQ ID NO: 2855417 - RNA, 22 nt, Mycobacterium avium subsp. paratuberculosis
ggcgcacaacgaggcccggacg

SEQ ID NO: 2855418 - RNA, 13 nt, Mycobacterium avium subsp. paratuberculosis
ggcgcacagaucg

SEQ ID NO: 2855419 - RNA, 14 nt, Mycobacterium avium subsp. paratuberculosis
ggcgcacagcuagg

SEQ ID NO: 2855420 - RNA, 22 nt, Mycobacterium avium subsp. paratuberculosis
ggcgcacagcuuucgggcggcc

SEQ ID NO: 2855421 - RNA, 19 nt, Mycobacterium avium subsp. paratuberculosis
ggcgcacaucguggcgacg

SEQ ID NO: 2855422 - RNA, 20 nt, Mycobacterium avium subsp. paratuberculosis
ggcgcacaucguggcgacga

SEQ ID NO: 2855423 - RNA, 23 nt, Mycobacterium avium subsp. paratuberculosis
ggcgcacaucguggcgacgacgc

SEQ ID NO: 2855424 - RNA, 23 nt, Mycobacterium avium subsp. paratuberculosis
ggcgcaccaaccggccccgagcg

SEQ ID NO: 2855425 - RNA, 14 nt, Mycobacterium avium subsp. paratuberculosis
ggcgcaccagcuga

SEQ ID NO: 2855426 - RNA, 15 nt, Mycobacterium avium subsp. paratuberculosis
ggcgcaccaggcgcc

SEQ ID NO: 2855427 - RNA, 17 nt, Mycobacterium avium subsp. paratuberculosis
ggcgcaccaggcgccac

SEQ ID NO: 2855428 - RNA, 22 nt, Mycobacterium avium subsp. paratuberculosis
ggcgcaccaggcgccacagcag

SEQ ID NO: 2855429 - RNA, 14 nt, Mycobacterium avium subsp. paratuberculosis
ggcgcaccgagucg

SEQ ID NO: 2855430 - RNA, 13 nt, Mycobacterium avium subsp. paratuberculosis
ggcgcaccgccac

SEQ ID NO: 2855431 - RNA, 16 nt, Mycobacterium avium subsp. paratuberculosis
ggcgcaccgccaccgc

SEQ ID NO: 2855432 - RNA, 18 nt, Mycobacterium avium subsp. paratuberculosis
ggcgcaccgccaccgcgc

SEQ ID NO: 2855433 - RNA, 19 nt, Mycobacterium avium subsp. paratuberculosis
ggcgcaccgccaccgcgca

SEQ ID NO: 2855434 - RNA, 16 nt, Mycobacterium avium subsp. paratuberculosis
ggcgcaccgcccgcgg

SEQ ID NO: 2855435 - RNA, 16 nt, Mycobacterium avium subsp. paratuberculosis
ggcgcaccgccgcggg

SEQ ID NO: 2855436 - RNA, 13 nt, Mycobacterium avium subsp. paratuberculosis
ggcgcaccgccgg

SEQ ID NO: 2855437 - RNA, 13 nt, Mycobacterium avium subsp. paratuberculosis
ggcgcaccgcgcg

SEQ ID NO: 2855438 - RNA, 15 nt, Mycobacterium avium subsp. paratuberculosis
ggcgcaccgcgcgcc

SEQ ID NO: 2855439 - RNA, 14 nt, Mycobacterium avium subsp. paratuberculosis
ggcgcaccgcggcc

SEQ ID NO: 2855440 - RNA, 20 nt, Mycobacterium avium subsp. paratuberculosis
ggcgcaccgcggccucggcg

SEQ ID NO: 2855441 - RNA, 12 nt, Mycobacterium avium subsp. paratuberculosis
ggcgcaccgcgu

SEQ ID NO: 2855442 - RNA, 17 nt, Mycobacterium avium subsp. paratuberculosis
ggcgcaccgcgucgaug

SEQ ID NO: 2855443 - RNA, 19 nt, Mycobacterium avium subsp. paratuberculosis
ggcgcaccgugucgucgcu

SEQ ID NO: 2855444 - RNA, 20 nt, Mycobacterium avium subsp. paratuberculosis
ggcgcaccgugucgucgcug

SEQ ID NO: 2855445 - RNA, 22 nt, Mycobacterium avium subsp. paratuberculosis
ggcgcaccuggcgcagcaccga

SEQ ID NO: 2855446 - RNA, 21 nt, Mycobacterium avium subsp. paratuberculosis
ggcgcacgcagugccgcacca

SEQ ID NO: 2855447 - RNA, 24 nt, Mycobacterium avium subsp. paratuberculosis
ggcgcacgcagugccgcaccagca

SEQ ID NO: 2855448 - RNA, 22 nt, Mycobacterium avium subsp. paratuberculosis
ggcgcacgcccaugaucacacc

SEQ ID NO: 2855449 - RNA, 14 nt, Mycobacterium avium subsp. paratuberculosis
ggcgcacggcgccc

SEQ ID NO: 2855450 - RNA, 15 nt, Mycobacterium avium subsp. paratuberculosis
ggcgcacggcgccca

SEQ ID NO: 2855451 - RNA, 17 nt, Mycobacterium avium subsp. paratuberculosis
ggcgcacggcgcccagg

SEQ ID NO: 2855452 - RNA, 18 nt, Mycobacterium avium subsp. paratuberculosis
ggcgcacggcgcccaggu

SEQ ID NO: 2855453 - RNA, 13 nt, Mycobacterium avium subsp. paratuberculosis
ggcgcacggugcc

SEQ ID NO: 2855454 - RNA, 17 nt, Mycobacterium avium subsp. paratuberculosis
ggcgcacggugcccguc

SEQ ID NO: 2855455 - RNA, 16 nt, Mycobacterium avium subsp. paratuberculosis
ggcgcacguggcugac

SEQ ID NO: 2855456 - RNA, 20 nt, Mycobacterium avium subsp. paratuberculosis
ggcgcacguggcugaccgac

SEQ ID NO: 2855457 - RNA, 19 nt, Mycobacterium avium subsp. paratuberculosis
ggcgcacuccaucacgacc

SEQ ID NO: 2855458 - RNA, 23 nt, Mycobacterium avium subsp. paratuberculosis
ggcgcagaaaugggccaugccgg

SEQ ID NO: 2855459 - RNA, 21 nt, Mycobacterium avium subsp. paratuberculosis
ggcgcagaagcuaacgccagc

SEQ ID NO: 2855460 - RNA, 13 nt, Mycobacterium avium subsp. paratuberculosis
ggcgcagcaccga

SEQ ID NO: 2855461 - RNA, 15 nt, Mycobacterium avium subsp. paratuberculosis
ggcgcagcaccgacu

SEQ ID NO: 2855462 - RNA, 16 nt, Mycobacterium avium subsp. paratuberculosis
ggcgcagcacggccac

SEQ ID NO: 2855463 - RNA, 18 nt, Mycobacterium avium subsp. paratuberculosis
ggcgcagcacggccacug

SEQ ID NO: 2855464 - RNA, 14 nt, Mycobacterium avium subsp. paratuberculosis
ggcgcagccagcgg

SEQ ID NO: 2855465 - RNA, 18 nt, Mycobacterium avium subsp. paratuberculosis
ggcgcagccagcucggcg

SEQ ID NO: 2855466 - RNA, 11 nt, Mycobacterium avium subsp. paratuberculosis
ggcgcagcccg

SEQ ID NO: 2855467 - RNA, 21 nt, Mycobacterium avium subsp. paratuberculosis
ggcgcagcccgagcggcauca

SEQ ID NO: 2855468 - RNA, 14 nt, Mycobacterium avium subsp. paratuberculosis
ggcgcagcccggcg

SEQ ID NO: 2855469 - RNA, 14 nt, Mycobacterium avium subsp. paratuberculosis
ggcgcagccgaucg

SEQ ID NO: 2855470 - RNA, 14 nt, Mycobacterium avium subsp. paratuberculosis
ggcgcagccggcca

SEQ ID NO: 2855471 - RNA, 21 nt, Mycobacterium avium subsp. paratuberculosis
ggcgcagccggccaccgcccc

SEQ ID NO: 2855472 - RNA, 14 nt, Mycobacterium avium subsp. paratuberculosis
ggcgcagccgguca

SEQ ID NO: 2855473 - RNA, 18 nt, Mycobacterium avium subsp. paratuberculosis
ggcgcagcgcacgucgcc

SEQ ID NO: 2855474 - RNA, 19 nt, Mycobacterium avium subsp. paratuberculosis
ggcgcagcgcacgucgccg

SEQ ID NO: 2855475 - RNA, 21 nt, Mycobacterium avium subsp. paratuberculosis
ggcgcagcgcacgucgccgcc

SEQ ID NO: 2855476 - RNA, 12 nt, Mycobacterium avium subsp. paratuberculosis
ggcgcagcgccg

SEQ ID NO: 2855477 - RNA, 18 nt, Mycobacterium avium subsp. paratuberculosis
ggcgcagcgccgucucga

SEQ ID NO: 2855478 - RNA, 13 nt, Mycobacterium avium subsp. paratuberculosis
ggcgcccagcaaa

SEQ ID NO: 2855479 - RNA, 22 nt, Mycobacterium avium subsp. paratuberculosis
ggcgcccagcaaacccagcacc

SEQ ID NO: 2855480 - RNA, 12 nt, Mycobacterium avium subsp. paratuberculosis
ggcgcccagcac

SEQ ID NO: 2855481 - RNA, 15 nt, Mycobacterium avium subsp. paratuberculosis
ggcgcccagcccgag

SEQ ID NO: 2855482 - RNA, 22 nt, Mycobacterium avium subsp. paratuberculosis
ggcgcccagcccgagcaccagc

SEQ ID NO: 2855483 - RNA, 14 nt, Mycobacterium avium subsp. paratuberculosis
ggcgcccagcgucu

SEQ ID NO: 2855484 - RNA, 14 nt, Mycobacterium avium subsp. paratuberculosis
ggcgcccagcgugg

SEQ ID NO: 2855485 - RNA, 15 nt, Mycobacterium avium subsp. paratuberculosis
ggcgcccagcguggu

SEQ ID NO: 2855486 - RNA, 15 nt, Mycobacterium avium subsp. paratuberculosis
ggcgcccagguccac

SEQ ID NO: 2855487 - RNA, 15 nt, Mycobacterium avium subsp. paratuberculosis
ggcgccccagcuccu

SEQ ID NO: 2855488 - RNA, 22 nt, Mycobacterium avium subsp. paratuberculosis
ggcgccccagcuccucggcccc

SEQ ID NO: 2855489 - RNA, 18 nt, Mycobacterium avium subsp. paratuberculosis
ggcgccccccugcucgcu

SEQ ID NO: 2855490 - RNA, 12 nt, Mycobacterium avium subsp. paratuberculosis
ggcgcccccgcg

SEQ ID NO: 2855491 - RNA, 15 nt, Mycobacterium avium subsp. paratuberculosis
ggcgcccccgcgacg

SEQ ID NO: 2855492 - RNA, 20 nt, Mycobacterium avium subsp. paratuberculosis
ggcgccccgacaucgccauc

SEQ ID NO: 2855493 - RNA, 14 nt, Mycobacterium avium subsp. paratuberculosis
ggcgccccgcuggu

SEQ ID NO: 2855494 - RNA, 20 nt, Mycobacterium avium subsp. paratuberculosis
ggcgccccgcugguagcugc

SEQ ID NO: 2855495 - RNA, 16 nt, Mycobacterium avium subsp. paratuberculosis
ggcgccccgggcagcg

SEQ ID NO: 2855496 - RNA, 14 nt, Mycobacterium avium subsp. paratuberculosis
ggcgcccgccccga

SEQ ID NO: 2855497 - RNA, 15 nt, Mycobacterium avium subsp. paratuberculosis
ggcgcccgccccgac

SEQ ID NO: 2855498 - RNA, 12 nt, Mycobacterium avium subsp. paratuberculosis
ggcgcccgcggc

SEQ ID NO: 2855499 - RNA, 14 nt, Mycobacterium avium subsp. paratuberculosis
ggcgcccgcggccu

SEQ ID NO: 2855500 - RNA, 17 nt, Mycobacterium avium subsp. paratuberculosis
ggcgcccgcggccucca

SEQ ID NO: 2855501 - RNA, 23 nt, Mycobacterium avium subsp. paratuberculosis
ggcgcccgcggccuccagccgcu

SEQ ID NO: 2855502 - RNA, 13 nt, Mycobacterium avium subsp. paratuberculosis
ggcgcccgcggcg

SEQ ID NO: 2855503 - RNA, 19 nt, Mycobacterium avium subsp. paratuberculosis
ggcgcccgcggcgcgcagg

SEQ ID NO: 2855504 - RNA, 13 nt, Mycobacterium avium subsp. paratuberculosis
ggcgcccgcggug

SEQ ID NO: 2855505 - RNA, 16 nt, Mycobacterium avium subsp. paratuberculosis
ggcgcccgcuccggcg

SEQ ID NO: 2855506 - RNA, 18 nt, Mycobacterium avium subsp. paratuberculosis
ggcgcccgcuccggcgga

SEQ ID NO: 2855507 - RNA, 13 nt, Mycobacterium avium subsp. paratuberculosis
ggcgcccggcagc

SEQ ID NO: 2855508 - RNA, 20 nt, Mycobacterium avium subsp. paratuberculosis
ggcgcccggcccagccgcug

SEQ ID NO: 2855509 - RNA, 14 nt, Mycobacterium avium subsp. paratuberculosis
ggcgcccggccggc

SEQ ID NO: 2855510 - RNA, 14 nt, Mycobacterium avium subsp. paratuberculosis
ggcgcccggccggu

SEQ ID NO: 2855511 - RNA, 13 nt, Mycobacterium avium subsp. paratuberculosis
ggcgcccggcgcg

SEQ ID NO: 2855512 - RNA, 14 nt, Mycobacterium avium subsp. paratuberculosis
ggcgcccggcgcgc

SEQ ID NO: 2855513 - RNA, 16 nt, Mycobacterium avium subsp. paratuberculosis
ggcgcccggcgcgcca

SEQ ID NO: 2855514 - RNA, 13 nt, Mycobacterium avium subsp. paratuberculosis
ggcgcccggcucc

SEQ ID NO: 2855515 - RNA, 16 nt, Mycobacterium avium subsp. paratuberculosis
ggcgcccggcuccccg

SEQ ID NO: 2855516 - RNA, 15 nt, Mycobacterium avium subsp. paratuberculosis
ggcgcccgucacgcu

SEQ ID NO: 2855517 - RNA, 16 nt, Mycobacterium avium subsp. paratuberculosis
ggcgcccgucacgcug

SEQ ID NO: 2855518 - RNA, 17 nt, Mycobacterium avium subsp. paratuberculosis
ggcgcccgucacgcugg

SEQ ID NO: 2855519 - RNA, 20 nt, Mycobacterium avium subsp. paratuberculosis
ggcgcccgucacgcuggcgu

SEQ ID NO: 2855520 - RNA, 21 nt, Mycobacterium avium subsp. paratuberculosis
ggcgcccgucacgcuggcgug

SEQ ID NO: 2855521 - RNA, 22 nt, Mycobacterium avium subsp. paratuberculosis
ggcgcccgucacgcuggcguga

SEQ ID NO: 2855522 - RNA, 22 nt, Mycobacterium avium subsp. paratuberculosis
ggcgcccuccacgucgucggac

SEQ ID NO: 2855523 - RNA, 19 nt, Mycobacterium avium subsp. paratuberculosis
ggcgcccucgaugcgcacc

SEQ ID NO: 2855524 - RNA, 15 nt, Mycobacterium avium subsp. paratuberculosis
ggcgcccucgccgac

SEQ ID NO: 2855525 - RNA, 15 nt, Mycobacterium avium subsp. paratuberculosis
ggcgcccucgccggc

SEQ ID NO: 2855526 - RNA, 16 nt, Mycobacterium avium subsp. paratuberculosis
ggcgcccucgccggcg

SEQ ID NO: 2855527 - RNA, 18 nt, Mycobacterium avium subsp. paratuberculosis
ggcgcccucgccggcggc

SEQ ID NO: 2855528 - RNA, 19 nt, Mycobacterium avium subsp. paratuberculosis
ggcgcccucgccggcggcg

SEQ ID NO: 2855529 - RNA, 21 nt, Mycobacterium avium subsp. paratuberculosis
ggcgcccucgccggcggcgcc

SEQ ID NO: 2855530 - RNA, 13 nt, Mycobacterium avium subsp. paratuberculosis
ggcgcccucggcg

SEQ ID NO: 2855531 - RNA, 23 nt, Mycobacterium avium subsp. paratuberculosis
ggcgcccucggcgaucucguccc

SEQ ID NO: 2855532 - RNA, 16 nt, Mycobacterium avium subsp. paratuberculosis
ggcgcccugcacccag

SEQ ID NO: 2855533 - RNA, 18 nt, Mycobacterium avium subsp. paratuberculosis
ggcgcccugcacccagcc

SEQ ID NO: 2855534 - RNA, 21 nt, Mycobacterium avium subsp. paratuberculosis
ggcgcccugcacccagccgug

SEQ ID NO: 2855535 - RNA, 15 nt, Mycobacterium avium subsp. paratuberculosis
ggcgcccugcgagcc

SEQ ID NO: 2855536 - RNA, 17 nt, Mycobacterium avium subsp. paratuberculosis
ggcgcccugcgagcccg

SEQ ID NO: 2855537 - RNA, 18 nt, Mycobacterium avium subsp. paratuberculosis
ggcgcccugcgagcccgg

SEQ ID NO: 2855538 - RNA, 12 nt, Mycobacterium avium subsp. paratuberculosis
ggcgcccugcgc

SEQ ID NO: 2855539 - RNA, 16 nt, Mycobacterium avium subsp. paratuberculosis
ggcgcccuucggcgcc

SEQ ID NO: 2855540 - RNA, 16 nt, Mycobacterium avium subsp. paratuberculosis
ggcgcccuugaucguc

SEQ ID NO: 2855541 - RNA, 22 nt, Mycobacterium avium subsp. paratuberculosis
ggcgcccuugccgaugccggcg

SEQ ID NO: 2855542 - RNA, 16 nt, Mycobacterium avium subsp. paratuberculosis
ggcgcccuuggccucc

SEQ ID NO: 2855543 - RNA, 22 nt, Mycobacterium avium subsp. paratuberculosis
ggcgccgaacagaugccugccc

SEQ ID NO: 2855544 - RNA, 16 nt, Mycobacterium avium subsp. paratuberculosis
ggcgccgaaccgggug

SEQ ID NO: 2855545 - RNA, 21 nt, Mycobacterium avium subsp. paratuberculosis
ggcgccgaaccgggugacgac

SEQ ID NO: 2855546 - RNA, 21 nt, Mycobacterium avium subsp. paratuberculosis
ggcgccgaacgucgagcgcgg

SEQ ID NO: 2855547 - RNA, 23 nt, Mycobacterium avium subsp. paratuberculosis
ggcgccgaacucggcgccgccgg

SEQ ID NO: 2855548 - RNA, 22 nt, Mycobacterium avium subsp. paratuberculosis
ggcgccgaagauggccaggaac

SEQ ID NO: 2855549 - RNA, 17 nt, Mycobacterium avium subsp. paratuberculosis
ggcgccgaagcccgcag

SEQ ID NO: 2855550 - RNA, 19 nt, Mycobacterium avium subsp. paratuberculosis
ggcgccgaagcccgcagcg

SEQ ID NO: 2855551 - RNA, 20 nt, Mycobacterium avium subsp. paratuberculosis
ggcgccgaagcccgcagcga

SEQ ID NO: 2855552 - RNA, 22 nt, Mycobacterium avium subsp. paratuberculosis
ggcgccgaagccgucgaccccg

SEQ ID NO: 2855553 - RNA, 12 nt, Mycobacterium avium subsp. paratuberculosis
ggcgccgaaggc

SEQ ID NO: 2855554 - RNA, 22 nt, Mycobacterium avium subsp. paratuberculosis
ggcgccgacagucgcgggcagc

SEQ ID NO: 2855555 - RNA, 13 nt, Mycobacterium avium subsp. paratuberculosis
ggcgccgaccccc

SEQ ID NO: 2855556 - RNA, 18 nt, Mycobacterium avium subsp. paratuberculosis
ggcgccgacccccgccgc

SEQ ID NO: 2855557 - RNA, 20 nt, Mycobacterium avium subsp. paratuberculosis
ggcgccgaccucggccagcg

SEQ ID NO: 2855558 - RNA, 21 nt, Mycobacterium avium subsp. paratuberculosis
ggcgccgaccucggccagcgu

SEQ ID NO: 2855559 - RNA, 14 nt, Mycobacterium avium subsp. paratuberculosis
ggcgccgacgacgu

SEQ ID NO: 2855560 - RNA, 16 nt, Mycobacterium avium subsp. paratuberculosis
ggcgccgacgacgucg

SEQ ID NO: 2855561 - RNA, 24 nt, Mycobacterium avium subsp. paratuberculosis
ggcgccgacgacgucgcgcaggua

SEQ ID NO: 2855562 - RNA, 21 nt, Mycobacterium avium subsp. paratuberculosis
ggcgccgacgaucccggcgag

SEQ ID NO: 2855563 - RNA, 19 nt, Mycobacterium avium subsp. paratuberculosis
ggcgccggcccgcggcgga

SEQ ID NO: 2855564 - RNA, 14 nt, Mycobacterium avium subsp. paratuberculosis
ggcgccggccgccg

SEQ ID NO: 2855565 - RNA, 15 nt, Mycobacterium avium subsp. paratuberculosis
ggcgccggccgccgg

SEQ ID NO: 2855566 - RNA, 15 nt, Mycobacterium avium subsp. paratuberculosis
ggcgccggccggcgc

SEQ ID NO: 2855567 - RNA, 17 nt, Mycobacterium avium subsp. paratuberculosis
ggcgccggccggcgguc

SEQ ID NO: 2855568 - RNA, 20 nt, Mycobacterium avium subsp. paratuberculosis
ggcgccggccgucacgcugg

SEQ ID NO: 2855569 - RNA, 14 nt, Mycobacterium avium subsp. paratuberculosis
ggcgccggcgauga

SEQ ID NO: 2855570 - RNA, 13 nt, Mycobacterium avium subsp. paratuberculosis
ggcgccggcgcgc

SEQ ID NO: 2855571 - RNA, 14 nt, Mycobacterium avium subsp. paratuberculosis
ggcgccggcgcgca

SEQ ID NO: 2855572 - RNA, 23 nt, Mycobacterium avium subsp. paratuberculosis
ggcgccggcgcgcaacagcgucu

SEQ ID NO: 2855573 - RNA, 17 nt, Mycobacterium avium subsp. paratuberculosis
ggcgccggcgcgcgagc

SEQ ID NO: 2855574 - RNA, 17 nt, Mycobacterium avium subsp. paratuberculosis
ggcgccggcgcgggggc

SEQ ID NO: 2855575 - RNA, 18 nt, Mycobacterium avium subsp. paratuberculosis
ggcgccggcgcguccgga

SEQ ID NO: 2855576 - RNA, 20 nt, Mycobacterium avium subsp. paratuberculosis
ggcgccggcgcguccggagg

SEQ ID NO: 2855577 - RNA, 12 nt, Mycobacterium avium subsp. paratuberculosis
ggcgccggcggc

SEQ ID NO: 2855578 - RNA, 15 nt, Mycobacterium avium subsp. paratuberculosis
ggcgccggcggccac

SEQ ID NO: 2855579 - RNA, 17 nt, Mycobacterium avium subsp. paratuberculosis
ggcgccggcggccacgc

SEQ ID NO: 2855580 - RNA, 18 nt, Mycobacterium avium subsp. paratuberculosis
ggcgccggcggccacgcu

SEQ ID NO: 2855581 - RNA, 12 nt, Mycobacterium avium subsp. paratuberculosis
ggcgccggcggu

SEQ ID NO: 2855582 - RNA, 16 nt, Mycobacterium avium subsp. paratuberculosis
ggcgccggcggucagc

SEQ ID NO: 2855583 - RNA, 17 nt, Mycobacterium avium subsp. paratuberculosis
ggcgccggcggucagcu

SEQ ID NO: 2855584 - RNA, 19 nt, Mycobacterium avium subsp. paratuberculosis
ggcgccggcggucagcuca

SEQ ID NO: 2855585 - RNA, 13 nt, Mycobacterium avium subsp. paratuberculosis
ggcgccggcguca

SEQ ID NO: 2855586 - RNA, 13 nt, Mycobacterium avium subsp. paratuberculosis
ggcgccggcgucc

SEQ ID NO: 2855587 - RNA, 23 nt, Mycobacterium avium subsp. paratuberculosis
ggcgccggcguccagcgccgcca

SEQ ID NO: 2855588 - RNA, 14 nt, Mycobacterium avium subsp. paratuberculosis
ggcgccggcuccgc

SEQ ID NO: 2855589 - RNA, 17 nt, Mycobacterium avium subsp. paratuberculosis
ggcgccggcugcccgcg

SEQ ID NO: 2855590 - RNA, 18 nt, Mycobacterium avium subsp. paratuberculosis
ggcgccggcugcccgcga

SEQ ID NO: 2855591 - RNA, 17 nt, Mycobacterium avium subsp. paratuberculosis
ggcgccgggcggcccgc

SEQ ID NO: 2855592 - RNA, 19 nt, Mycobacterium avium subsp. paratuberculosis
ggcgccgggcggcccgccu

SEQ ID NO: 2855593 - RNA, 20 nt, Mycobacterium avium subsp. paratuberculosis
ggcgccgggcggcccgccuc

SEQ ID NO: 2855594 - RNA, 13 nt, Mycobacterium avium subsp. paratuberculosis
ggcgccgggcggg

SEQ ID NO: 2855595 - RNA, 21 nt, Mycobacterium avium subsp. paratuberculosis
ggcgccggggcgggcggcggc

SEQ ID NO: 2855596 - RNA, 12 nt, Mycobacterium avium subsp. paratuberculosis
ggcgccggggcu

SEQ ID NO: 2855597 - RNA, 23 nt, Mycobacterium avium subsp. paratuberculosis
ggcgccggguuguagcaggcggu

SEQ ID NO: 2855598 - RNA, 17 nt, Mycobacterium avium subsp. paratuberculosis
ggcgccgguaggcgcgg

SEQ ID NO: 2855599 - RNA, 22 nt, Mycobacterium avium subsp. paratuberculosis
ggcgccgguaucgagcaccagc

SEQ ID NO: 2855600 - RNA, 23 nt, Mycobacterium avium subsp. paratuberculosis
ggcgccgguaucgagcaccagca

SEQ ID NO: 2855601 - RNA, 19 nt, Mycobacterium avium subsp. paratuberculosis
ggcgccggucagcggcaac

SEQ ID NO: 2855602 - RNA, 17 nt, Mycobacterium avium subsp. paratuberculosis
ggcgccggucgacgcgg

SEQ ID NO: 2855603 - RNA, 20 nt, Mycobacterium avium subsp. paratuberculosis
ggcgccggucgacgcggggc

SEQ ID NO: 2855604 - RNA, 21 nt, Mycobacterium avium subsp. paratuberculosis
ggcgccggucgacgcggggcg

SEQ ID NO: 2855605 - RNA, 12 nt, Mycobacterium avium subsp. paratuberculosis
ggcgccggugcc

SEQ ID NO: 2855606 - RNA, 14 nt, Mycobacterium avium subsp. paratuberculosis
ggcgccggugccca

SEQ ID NO: 2855607 - RNA, 14 nt, Mycobacterium avium subsp. paratuberculosis
ggcgccggugccgc

SEQ ID NO: 2855608 - RNA, 19 nt, Mycobacterium avium subsp. paratuberculosis
ggcgccggugccgcagccg

SEQ ID NO: 2855609 - RNA, 20 nt, Mycobacterium avium subsp. paratuberculosis
ggcgccgguuuccaggacga

SEQ ID NO: 2855610 - RNA, 22 nt, Mycobacterium avium subsp. paratuberculosis
ggcgccgguuuccaggacgaug

SEQ ID NO: 2855611 - RNA, 20 nt, Mycobacterium avium subsp. paratuberculosis
ggcgccgguuuucggcgugu

SEQ ID NO: 2855612 - RNA, 21 nt, Mycobacterium avium subsp. paratuberculosis
ggcgccgguuuucggcguguc

SEQ ID NO: 2855613 - RNA, 22 nt, Mycobacterium avium subsp. paratuberculosis
ggcgccgguuuucggcgugucg

SEQ ID NO: 2855614 - RNA, 16 nt, Mycobacterium avium subsp. paratuberculosis
ggcgccguaggccgcg

SEQ ID NO: 2855615 - RNA, 20 nt, Mycobacterium avium subsp. paratuberculosis
ggcgccguaggccgcgcuga

SEQ ID NO: 2855616 - RNA, 23 nt, Mycobacterium avium subsp. paratuberculosis
ggcgccguauuggcaggcgaugu

SEQ ID NO: 2855617 - RNA, 14 nt, Mycobacterium avium subsp. paratuberculosis
ggcgccgucaaugg

SEQ ID NO: 2855618 - RNA, 20 nt, Mycobacterium avium subsp. paratuberculosis
ggcgccguccgcggcggcca

SEQ ID NO: 2855619 - RNA, 21 nt, Mycobacterium avium subsp. paratuberculosis
ggcgccguccgcggcggccag

SEQ ID NO: 2855620 - RNA, 23 nt, Mycobacterium avium subsp. paratuberculosis
ggcgccguccgcggcggccagga

SEQ ID NO: 2855621 - RNA, 17 nt, Mycobacterium avium subsp. paratuberculosis
ggcgccgucgaccagcu

SEQ ID NO: 2855622 - RNA, 21 nt, Mycobacterium avium subsp. paratuberculosis
ggcgccgucgauggcgcggcc

SEQ ID NO: 2855623 - RNA, 13 nt, Mycobacterium avium subsp. paratuberculosis
ggcgccgucgccg

SEQ ID NO: 2855624 - RNA, 14 nt, Mycobacterium avium subsp. paratuberculosis
ggcgccgucgccga

SEQ ID NO: 2855625 - RNA, 14 nt, Mycobacterium avium subsp. paratuberculosis
ggcgccgucgccgc

SEQ ID NO: 2855626 - RNA, 23 nt, Mycobacterium avium subsp. paratuberculosis
ggcgccgucgcgggagagcgcgg

SEQ ID NO: 2855627 - RNA, 14 nt, Mycobacterium avium subsp. paratuberculosis
ggcgccgucggcgg

SEQ ID NO: 2855628 - RNA, 15 nt, Mycobacterium avium subsp. paratuberculosis
ggcgccgucggcggg

SEQ ID NO: 2855629 - RNA, 13 nt, Mycobacterium avium subsp. paratuberculosis
ggcgccgucgggg

SEQ ID NO: 2855630 - RNA, 20 nt, Mycobacterium avium subsp. paratuberculosis
ggcgccgucggugggggcca

SEQ ID NO: 2855631 - RNA, 22 nt, Mycobacterium avium subsp. paratuberculosis
ggcgccgucggugggggccagg

SEQ ID NO: 2855632 - RNA, 17 nt, Mycobacterium avium subsp. paratuberculosis
ggcgccgugccgcgcgg

SEQ ID NO: 2855633 - RNA, 19 nt, Mycobacterium avium subsp. paratuberculosis
ggcgccgugccgcgcggcg

SEQ ID NO: 2855634 - RNA, 13 nt, Mycobacterium avium subsp. paratuberculosis
ggcgccgugcgcc

SEQ ID NO: 2855635 - RNA, 21 nt, Mycobacterium avium subsp. paratuberculosis
ggcgccguuguaggccgcgcg

SEQ ID NO: 2855636 - RNA, 16 nt, Mycobacterium avium subsp. paratuberculosis
ggcgccuaccgggugg

SEQ ID NO: 2855637 - RNA, 14 nt, Mycobacterium avium subsp. paratuberculosis
ggcgccuccgcccg

SEQ ID NO: 2855638 - RNA, 16 nt, Mycobacterium avium subsp. paratuberculosis
ggcgccuccgcccggg

SEQ ID NO: 2855639 - RNA, 18 nt, Mycobacterium avium subsp. paratuberculosis
ggcgccuccgcccgggug

SEQ ID NO: 2855640 - RNA, 19 nt, Mycobacterium avium subsp. paratuberculosis
ggcgccuccgcccgggugc

SEQ ID NO: 2855641 - RNA, 14 nt, Mycobacterium avium subsp. paratuberculosis
ggcgccucgaugcg

SEQ ID NO: 2855642 - RNA, 19 nt, Mycobacterium avium subsp. paratuberculosis
ggcgccucgaugcgggugu

SEQ ID NO: 2855643 - RNA, 15 nt, Mycobacterium avium subsp. paratuberculosis
ggcgccucgccgacc

SEQ ID NO: 2855644 - RNA, 14 nt, Mycobacterium avium subsp. paratuberculosis
ggcgccucggcgcc

SEQ ID NO: 2855645 - RNA, 15 nt, Mycobacterium avium subsp. paratuberculosis
ggcgccucggcgccu

SEQ ID NO: 2855646 - RNA, 21 nt, Mycobacterium avium subsp. paratuberculosis
ggcgccucggcgccucggcgu

SEQ ID NO: 2855647 - RNA, 14 nt, Mycobacterium avium subsp. paratuberculosis
ggcgccucggcguc

SEQ ID NO: 2855648 - RNA, 15 nt, Mycobacterium avium subsp. paratuberculosis
ggcgcggcagggcca

SEQ ID NO: 2855649 - RNA, 13 nt, Mycobacterium avium subsp. paratuberculosis
ggcgcggcaucgg

SEQ ID NO: 2855650 - RNA, 13 nt, Mycobacterium avium subsp. paratuberculosis
ggcgcggccaccc

SEQ ID NO: 2855651 - RNA, 15 nt, Mycobacterium avium subsp. paratuberculosis
ggcgcggccaccccg

SEQ ID NO: 2855652 - RNA, 12 nt, Mycobacterium avium subsp. paratuberculosis
ggcgcggccagc

SEQ ID NO: 2855653 - RNA, 13 nt, Mycobacterium avium subsp. paratuberculosis
ggcgcggccagcg

SEQ ID NO: 2855654 - RNA, 14 nt, Mycobacterium avium subsp. paratuberculosis
ggcgcggccagcug

SEQ ID NO: 2855655 - RNA, 16 nt, Mycobacterium avium subsp. paratuberculosis
ggcgcggccagcugaa

SEQ ID NO: 2855656 - RNA, 13 nt, Mycobacterium avium subsp. paratuberculosis
ggcgcggcccggc

SEQ ID NO: 2855657 - RNA, 14 nt, Mycobacterium avium subsp. paratuberculosis
ggcgcggcccggcc

SEQ ID NO: 2855658 - RNA, 16 nt, Mycobacterium avium subsp. paratuberculosis
ggcgcggcccggcccg

SEQ ID NO: 2855659 - RNA, 18 nt, Mycobacterium avium subsp. paratuberculosis
ggcgcggcccggcccgcu

SEQ ID NO: 2855660 - RNA, 19 nt, Mycobacterium avium subsp. paratuberculosis
ggcgcggcccggcccgcug

SEQ ID NO: 2855661 - RNA, 12 nt, Mycobacterium avium subsp. paratuberculosis
ggcgcggccgcc

SEQ ID NO: 2855662 - RNA, 19 nt, Mycobacterium avium subsp. paratuberculosis
ggcgcggccgcccagcccg

SEQ ID NO: 2855663 - RNA, 23 nt, Mycobacterium avium subsp. paratuberculosis
ggcgcggccgcccagcccgcgcc

SEQ ID NO: 2855664 - RNA, 14 nt, Mycobacterium avium subsp. paratuberculosis
ggcgcggcgaaucg

SEQ ID NO: 2855665 - RNA, 12 nt, Mycobacterium avium subsp. paratuberculosis
ggcgcggcgacg

SEQ ID NO: 2855666 - RNA, 13 nt, Mycobacterium avium subsp. paratuberculosis
ggcgcggcgcacc

SEQ ID NO: 2855667 - RNA, 17 nt, Mycobacterium avium subsp. paratuberculosis
ggcgcggcgcaccgccc

SEQ ID NO: 2855668 - RNA, 20 nt, Mycobacterium avium subsp. paratuberculosis
ggcgcggcgcaccgcccgcg

SEQ ID NO: 2855669 - RNA, 14 nt, Mycobacterium avium subsp. paratuberculosis
ggcgcggcgcagcg

SEQ ID NO: 2855670 - RNA, 17 nt, Mycobacterium avium subsp. paratuberculosis
ggcgcggcgcagcgcga

SEQ ID NO: 2855671 - RNA, 12 nt, Mycobacterium avium subsp. paratuberculosis
ggcgcggcggca

SEQ ID NO: 2855672 - RNA, 13 nt, Mycobacterium avium subsp. paratuberculosis
ggcgcggcggcaa

SEQ ID NO: 2855673 - RNA, 22 nt, Mycobacterium avium subsp. paratuberculosis
ggcgcggcggcaaccagcuccg

SEQ ID NO: 2855674 - RNA, 12 nt, Mycobacterium avium subsp. paratuberculosis
ggcgcggcggcc

SEQ ID NO: 2855675 - RNA, 16 nt, Mycobacterium avium subsp. paratuberculosis
ggcgcggcggcgacgu

SEQ ID NO: 2855676 - RNA, 16 nt, Mycobacterium avium subsp. paratuberculosis
ggcgcggcggcgccgc

SEQ ID NO: 2855677 - RNA, 20 nt, Mycobacterium avium subsp. paratuberculosis
ggcgcggcggcgccgcggua

SEQ ID NO: 2855678 - RNA, 11 nt, Mycobacterium avium subsp. paratuberculosis
ggcgcggcgua

SEQ ID NO: 2855679 - RNA, 18 nt, Mycobacterium avium subsp. paratuberculosis
ggcgcggcguagccgccg

SEQ ID NO: 2855680 - RNA, 20 nt, Mycobacterium avium subsp. paratuberculosis
ggcgcggcguagccgccggu

SEQ ID NO: 2855681 - RNA, 19 nt, Mycobacterium avium subsp. paratuberculosis
ggcgcggcucacgacuccu

SEQ ID NO: 2855682 - RNA, 13 nt, Mycobacterium avium subsp. paratuberculosis
ggcgcgggaucgg

SEQ ID NO: 2855683 - RNA, 15 nt, Mycobacterium avium subsp. paratuberculosis
ggcgcgggaucggug

SEQ ID NO: 2855684 - RNA, 17 nt, Mycobacterium avium subsp. paratuberculosis
ggcgcgggaucggugcc

SEQ ID NO: 2855685 - RNA, 19 nt, Mycobacterium avium subsp. paratuberculosis
ggcgcgggaucggugccga

SEQ ID NO: 2855686 - RNA, 14 nt, Mycobacterium avium subsp. paratuberculosis
ggcgcgggccagca

SEQ ID NO: 2855687 - RNA, 17 nt, Mycobacterium avium subsp. paratuberculosis
ggcgcgggccagcagca

SEQ ID NO: 2855688 - RNA, 13 nt, Mycobacterium avium subsp. paratuberculosis
ggcgcgggccgca

SEQ ID NO: 2855689 - RNA, 13 nt, Mycobacterium avium subsp. paratuberculosis
ggcgcgggccgcg

SEQ ID NO: 2855690 - RNA, 16 nt, Mycobacterium avium subsp. paratuberculosis
ggcgcgggcgcccucc

SEQ ID NO: 2855691 - RNA, 16 nt, Mycobacterium avium subsp. paratuberculosis
ggcgcgggcggcaggu

SEQ ID NO: 2855692 - RNA, 13 nt, Mycobacterium avium subsp. paratuberculosis
ggcgcgggcggcg

SEQ ID NO: 2855693 - RNA, 17 nt, Mycobacterium avium subsp. paratuberculosis
ggcgcggggcgcgaggc

SEQ ID NO: 2855694 - RNA, 22 nt, Mycobacterium avium subsp. paratuberculosis
ggcgcgggggcggccugagccg

SEQ ID NO: 2855695 - RNA, 17 nt, Mycobacterium avium subsp. paratuberculosis
ggcgcgggucgcuggcc

SEQ ID NO: 2855696 - RNA, 21 nt, Mycobacterium avium subsp. paratuberculosis
ggcgcgggucgcuggccgcga

SEQ ID NO: 2855697 - RNA, 19 nt, Mycobacterium avium subsp. paratuberculosis
ggcgcgguccacggucagc

SEQ ID NO: 2855698 - RNA, 20 nt, Mycobacterium avium subsp. paratuberculosis
ggcgcgguccacggucagcg

SEQ ID NO: 2855699 - RNA, 14 nt, Mycobacterium avium subsp. paratuberculosis
ggcgcggucgaaaa

SEQ ID NO: 2855700 - RNA, 22 nt, Mycobacterium avium subsp. paratuberculosis
ggcgcggucgaaaaaugcggaa

SEQ ID NO: 2855701 - RNA, 17 nt, Mycobacterium avium subsp. paratuberculosis
ggcgcggucgcaggccg

SEQ ID NO: 2855702 - RNA, 14 nt, Mycobacterium avium subsp. paratuberculosis
ggcgcggucggugg

SEQ ID NO: 2855703 - RNA, 13 nt, Mycobacterium avium subsp. paratuberculosis
ggcgcggugcgcc

SEQ ID NO: 2855704 - RNA, 17 nt, Mycobacterium avium subsp. paratuberculosis
ggcgcggugcgccgaca

SEQ ID NO: 2855705 - RNA, 16 nt, Mycobacterium avium subsp. paratuberculosis
ggcgcggugcucggcg

SEQ ID NO: 2855706 - RNA, 16 nt, Mycobacterium avium subsp. paratuberculosis
ggcgcgguggcgugca

SEQ ID NO: 2855707 - RNA, 20 nt, Mycobacterium avium subsp. paratuberculosis
ggcgcgguugaccgccgaca

SEQ ID NO: 2855708 - RNA, 20 nt, Mycobacterium avium subsp. paratuberculosis
ggcgcgguugcccgcacccu

SEQ ID NO: 2855709 - RNA, 23 nt, Mycobacterium avium subsp. paratuberculosis
ggcgcgguugcgguugucgguca

SEQ ID NO: 2855710 - RNA, 15 nt, Mycobacterium avium subsp. paratuberculosis
ggcgcgguugucguu

SEQ ID NO: 2855711 - RNA, 21 nt, Mycobacterium avium subsp. paratuberculosis
ggcgcguccgcgggcggggcc

SEQ ID NO: 2855712 - RNA, 21 nt, Mycobacterium avium subsp. paratuberculosis
ggcgcguccggaggugccggc

SEQ ID NO: 2855713 - RNA, 22 nt, Mycobacterium avium subsp. paratuberculosis
ggcgcguccggaggugccggcc

SEQ ID NO: 2855714 - RNA, 12 nt, Mycobacterium avium subsp. paratuberculosis
ggcgcgucgagg

SEQ ID NO: 2855715 - RNA, 22 nt, Mycobacterium avium subsp. paratuberculosis
ggcgcgucgaggucgucgggcg

SEQ ID NO: 2855716 - RNA, 15 nt, Mycobacterium avium subsp. paratuberculosis
ggcgcgucgaucgcg

SEQ ID NO: 2855717 - RNA, 20 nt, Mycobacterium avium subsp. paratuberculosis
ggcgcgucgcugggcagccg

SEQ ID NO: 2855718 - RNA, 21 nt, Mycobacterium avium subsp. paratuberculosis
ggcgcgucgguaaucggcggu

SEQ ID NO: 2855719 - RNA, 16 nt, Mycobacterium avium subsp. paratuberculosis
ggcgcgucguagccgg

SEQ ID NO: 2855720 - RNA, 18 nt, Mycobacterium avium subsp. paratuberculosis
ggcgcgucguagccggca

SEQ ID NO: 2855721 - RNA, 22 nt, Mycobacterium avium subsp. paratuberculosis
ggcgcgucguagccggcacgca

SEQ ID NO: 2855722 - RNA, 18 nt, Mycobacterium avium subsp. paratuberculosis
ggcgcgugcacaccggcc

SEQ ID NO: 2855723 - RNA, 12 nt, Mycobacterium avium subsp. paratuberculosis
ggcgcgugcgcc

SEQ ID NO: 2855724 - RNA, 15 nt, Mycobacterium avium subsp. paratuberculosis
ggcgcgugcgccgcg

SEQ ID NO: 2855725 - RNA, 16 nt, Mycobacterium avium subsp. paratuberculosis
ggcgcgugcgccgcgg

SEQ ID NO: 2855726 - RNA, 18 nt, Mycobacterium avium subsp. paratuberculosis
ggcgcgugcgccgcggcg

SEQ ID NO: 2855727 - RNA, 13 nt, Mycobacterium avium subsp. paratuberculosis
ggcgcgugcgcga

SEQ ID NO: 2855728 - RNA, 21 nt, Mycobacterium avium subsp. paratuberculosis
ggcgcgugcuguugcaggugc

SEQ ID NO: 2855729 - RNA, 22 nt, Mycobacterium avium subsp. paratuberculosis
ggcgcgugcuguugcaggugcg

SEQ ID NO: 2855730 - RNA, 17 nt, Mycobacterium avium subsp. paratuberculosis
ggcgcguuccaucagcg

SEQ ID NO: 2855731 - RNA, 20 nt, Mycobacterium avium subsp. paratuberculosis
ggcgcguuccaucagcgccc

SEQ ID NO: 2855732 - RNA, 12 nt, Mycobacterium avium subsp. paratuberculosis
ggcgcguucggg

SEQ ID NO: 2855733 - RNA, 12 nt, Mycobacterium avium subsp. paratuberculosis
ggcggaacucga

SEQ ID NO: 2855734 - RNA, 17 nt, Mycobacterium avium subsp. paratuberculosis
ggcggaacucgaugauc

SEQ ID NO: 2855735 - RNA, 15 nt, Mycobacterium avium subsp. paratuberculosis
ggcggaaggccgcgc

SEQ ID NO: 2855736 - RNA, 21 nt, Mycobacterium avium subsp. paratuberculosis
ggcggacagccccgagccgcg

SEQ ID NO: 2855737 - RNA, 20 nt, Mycobacterium avium subsp. paratuberculosis
ggcggacaucgccucggcgu

SEQ ID NO: 2855738 - RNA, 12 nt, Mycobacterium avium subsp. paratuberculosis
ggcggacccagc

SEQ ID NO: 2855739 - RNA, 14 nt, Mycobacterium avium subsp. paratuberculosis
ggcggacccagcuc

SEQ ID NO: 2855740 - RNA, 16 nt, Mycobacterium avium subsp. paratuberculosis
ggcggacccagcuccu

SEQ ID NO: 2855741 - RNA, 17 nt, Mycobacterium avium subsp. paratuberculosis
ggcggacccagcuccuc

SEQ ID NO: 2855742 - RNA, 19 nt, Mycobacterium avium subsp. paratuberculosis
ggcggacccagcuccucgg

SEQ ID NO: 2855743 - RNA, 20 nt, Mycobacterium avium subsp. paratuberculosis
ggcggacccagcuccucggc

SEQ ID NO: 2855744 - RNA, 12 nt, Mycobacterium avium subsp. paratuberculosis
ggcggacccgcu

SEQ ID NO: 2855745 - RNA, 15 nt, Mycobacterium avium subsp. paratuberculosis
ggcggacccgcuccc

SEQ ID NO: 2855746 - RNA, 16 nt, Mycobacterium avium subsp. paratuberculosis
ggcggacccgcucccg

SEQ ID NO: 2855747 - RNA, 16 nt, Mycobacterium avium subsp. paratuberculosis
ggcggacccggaggcg

SEQ ID NO: 2855748 - RNA, 19 nt, Mycobacterium avium subsp. paratuberculosis
ggcggacccggaggcggcg

SEQ ID NO: 2855749 - RNA, 15 nt, Mycobacterium avium subsp. paratuberculosis
ggcggaccggcggcc

SEQ ID NO: 2855750 - RNA, 16 nt, Mycobacterium avium subsp. paratuberculosis
ggcggaccggcggccg

SEQ ID NO: 2855751 - RNA, 19 nt, Mycobacterium avium subsp. paratuberculosis
ggcggaccggcggccgcca

SEQ ID NO: 2855752 - RNA, 17 nt, Mycobacterium avium subsp. paratuberculosis
ggcggaccgucgguguc

SEQ ID NO: 2855753 - RNA, 17 nt, Mycobacterium avium subsp. paratuberculosis
ggcggacgcggccagcg

SEQ ID NO: 2855754 - RNA, 14 nt, Mycobacterium avium subsp. paratuberculosis
ggcggacggcaccg

SEQ ID NO: 2855755 - RNA, 17 nt, Mycobacterium avium subsp. paratuberculosis
ggcggacggcaccgacg

SEQ ID NO: 2855756 - RNA, 17 nt, Mycobacterium avium subsp. paratuberculosis
ggcggacggcgaccucu

SEQ ID NO: 2855757 - RNA, 13 nt, Mycobacterium avium subsp. paratuberculosis
ggcggacgguccc

SEQ ID NO: 2855758 - RNA, 15 nt, Mycobacterium avium subsp. paratuberculosis
ggcggacggucccga

SEQ ID NO: 2855759 - RNA, 16 nt, Mycobacterium avium subsp. paratuberculosis
ggcggacugcccgacc

SEQ ID NO: 2855760 - RNA, 17 nt, Mycobacterium avium subsp. paratuberculosis
ggcggacugcccgaccg

SEQ ID NO: 2855761 - RNA, 18 nt, Mycobacterium avium subsp. paratuberculosis
ggcggacugcccgaccgc

SEQ ID NO: 2855762 - RNA, 19 nt, Mycobacterium avium subsp. paratuberculosis
ggcggacugcccgaccgcg

SEQ ID NO: 2855763 - RNA, 21 nt, Mycobacterium avium subsp. paratuberculosis
ggcggacugcccgaccgcgcc

SEQ ID NO: 2855764 - RNA, 22 nt, Mycobacterium avium subsp. paratuberculosis
ggcggacugcccgaccgcgccg

SEQ ID NO: 2855765 - RNA, 20 nt, Mycobacterium avium subsp. paratuberculosis
ggcggacuggcugagcagca

SEQ ID NO: 2855766 - RNA, 16 nt, Mycobacterium avium subsp. paratuberculosis
ggcggaggccugcgcg

SEQ ID NO: 2855767 - RNA, 20 nt, Mycobacterium avium subsp. paratuberculosis
ggcggaggggcccaauaccg

SEQ ID NO: 2855768 - RNA, 14 nt, Mycobacterium avium subsp. paratuberculosis
ggcggaggucagcg

SEQ ID NO: 2855769 - RNA, 18 nt, Mycobacterium avium subsp. paratuberculosis
ggcggaggucagcggccc

SEQ ID NO: 2855770 - RNA, 23 nt, Mycobacterium avium subsp. paratuberculosis
ggcggaggucauggcgaccgcga

SEQ ID NO: 2855771 - RNA, 22 nt, Mycobacterium avium subsp. paratuberculosis
ggcggauauagccgacgggauc

SEQ ID NO: 2855772 - RNA, 20 nt, Mycobacterium avium subsp. paratuberculosis
ggcggaucagcaccgacgcg

SEQ ID NO: 2855773 - RNA, 14 nt, Mycobacterium avium subsp. paratuberculosis
ggcggauccagcac

SEQ ID NO: 2855774 - RNA, 19 nt, Mycobacterium avium subsp. paratuberculosis
ggcggauccagcaccgcca

SEQ ID NO: 2855775 - RNA, 21 nt, Mycobacterium avium subsp. paratuberculosis
ggcggauccagcaccgccacg

SEQ ID NO: 2855776 - RNA, 18 nt, Mycobacterium avium subsp. paratuberculosis
ggcggauccccgcgcugg

SEQ ID NO: 2855777 - RNA, 19 nt, Mycobacterium avium subsp. paratuberculosis
ggcggauccccgcgcuggg

SEQ ID NO: 2855778 - RNA, 18 nt, Mycobacterium avium subsp. paratuberculosis
ggcggaucgcgugcguca

SEQ ID NO: 2855779 - RNA, 15 nt, Mycobacterium avium subsp. paratuberculosis
ggcggaucggcccga

SEQ ID NO: 2855780 - RNA, 17 nt, Mycobacterium avium subsp. paratuberculosis
ggcggaucggcccgauc

SEQ ID NO: 2855781 - RNA, 22 nt, Mycobacterium avium subsp. paratuberculosis
ggcggaucuucucgcugcucug

SEQ ID NO: 2855782 - RNA, 14 nt, Mycobacterium avium subsp. paratuberculosis
ggcggaugcgcugg

SEQ ID NO: 2855783 - RNA, 16 nt, Mycobacterium avium subsp. paratuberculosis
ggcggaugcgcuggug

SEQ ID NO: 2855784 - RNA, 16 nt, Mycobacterium avium subsp. paratuberculosis
ggcggauggcgcccuu

SEQ ID NO: 2855785 - RNA, 14 nt, Mycobacterium avium subsp. paratuberculosis
ggcggaugggugcg

SEQ ID NO: 2855786 - RNA, 18 nt, Mycobacterium avium subsp. paratuberculosis
ggcggaugggugcgguug

SEQ ID NO: 2855787 - RNA, 13 nt, Mycobacterium avium subsp. paratuberculosis
ggcggauuggugc

SEQ ID NO: 2855788 - RNA, 20 nt, Mycobacterium avium subsp. paratuberculosis
ggcggauuggugccgaucac

SEQ ID NO: 2855789 - RNA, 21 nt, Mycobacterium avium subsp. paratuberculosis
ggcggauuggugccgaucacc

SEQ ID NO: 2855790 - RNA, 19 nt, Mycobacterium avium subsp. paratuberculosis
ggcggcaaaacgcugggcg

SEQ ID NO: 2855791 - RNA, 22 nt, Mycobacterium avium subsp. paratuberculosis
ggcggcaaaacgcugggcgccg

SEQ ID NO: 2855792 - RNA, 22 nt, Mycobacterium avium subsp. paratuberculosis
ggcggcaaagcguugccgcgcg

SEQ ID NO: 2855793 - RNA, 23 nt, Mycobacterium avium subsp. paratuberculosis
ggcggcaaccagcuccggcaacg

SEQ ID NO: 2855794 - RNA, 24 nt, Mycobacterium avium subsp. paratuberculosis
ggcggcaagcccuuuggcggccag

SEQ ID NO: 2855795 - RNA, 12 nt, Mycobacterium avium subsp. paratuberculosis
ggcggcacaccg

SEQ ID NO: 2855796 - RNA, 14 nt, Mycobacterium avium subsp. paratuberculosis
ggcggcaccacccg

SEQ ID NO: 2855797 - RNA, 15 nt, Mycobacterium avium subsp. paratuberculosis
ggcggcaccacccgc

SEQ ID NO: 2855798 - RNA, 14 nt, Mycobacterium avium subsp. paratuberculosis
ggcggcacccaggu

SEQ ID NO: 2855799 - RNA, 19 nt, Mycobacterium avium subsp. paratuberculosis
ggcggcaccgauaguagcc

SEQ ID NO: 2855800 - RNA, 14 nt, Mycobacterium avium subsp. paratuberculosis
ggcggcaccgaucg

SEQ ID NO: 2855801 - RNA, 19 nt, Mycobacterium avium subsp. paratuberculosis
ggcggcaccgaucggcacg

SEQ ID NO: 2855802 - RNA, 13 nt, Mycobacterium avium subsp. paratuberculosis
ggcggcaccgccc

SEQ ID NO: 2855803 - RNA, 17 nt, Mycobacterium avium subsp. paratuberculosis
ggcggcaccgcccgggu

SEQ ID NO: 2855804 - RNA, 17 nt, Mycobacterium avium subsp. paratuberculosis
ggcggcaccgccgcggu

SEQ ID NO: 2855805 - RNA, 13 nt, Mycobacterium avium subsp. paratuberculosis
ggcggcaccgcgg

SEQ ID NO: 2855806 - RNA, 20 nt, Mycobacterium avium subsp. paratuberculosis
ggcggcaccgcugccggccg

SEQ ID NO: 2855807 - RNA, 14 nt, Mycobacterium avium subsp. paratuberculosis
ggcggcacgguugg

SEQ ID NO: 2855808 - RNA, 16 nt, Mycobacterium avium subsp. paratuberculosis
ggcggcacgguuggcc

SEQ ID NO: 2855809 - RNA, 18 nt, Mycobacterium avium subsp. paratuberculosis
ggcggcacgguuggccgg

SEQ ID NO: 2855810 - RNA, 21 nt, Mycobacterium avium subsp. paratuberculosis
ggcggcacgguuggccggccc

SEQ ID NO: 2855811 - RNA, 15 nt, Mycobacterium avium subsp. paratuberculosis
ggcggcagcagcugc

SEQ ID NO: 2855812 - RNA, 16 nt, Mycobacterium avium subsp. paratuberculosis
ggcggcagcagcugcg

SEQ ID NO: 2855813 - RNA, 15 nt, Mycobacterium avium subsp. paratuberculosis
ggcggcagccaggcg

SEQ ID NO: 2855814 - RNA, 14 nt, Mycobacterium avium subsp. paratuberculosis
ggcggcagccaggu

SEQ ID NO: 2855815 - RNA, 13 nt, Mycobacterium avium subsp. paratuberculosis
ggcggcagcgcgg

SEQ ID NO: 2855816 - RNA, 15 nt, Mycobacterium avium subsp. paratuberculosis
ggcggcagcgcggcg

SEQ ID NO: 2855817 - RNA, 16 nt, Mycobacterium avium subsp. paratuberculosis
ggcggcagggccagca

SEQ ID NO: 2855818 - RNA, 23 nt, Mycobacterium avium subsp. paratuberculosis
ggcggcccgccucggcggccgcc

SEQ ID NO: 2855819 - RNA, 12 nt, Mycobacterium avium subsp. paratuberculosis
ggcggcccgcgc

SEQ ID NO: 2855820 - RNA, 15 nt, Mycobacterium avium subsp. paratuberculosis
ggcggcccgcgccgg

SEQ ID NO: 2855821 - RNA, 17 nt, Mycobacterium avium subsp. paratuberculosis
ggcggcccgcgccggcg

SEQ ID NO: 2855822 - RNA, 13 nt, Mycobacterium avium subsp. paratuberculosis
ggcggcccgcucg

SEQ ID NO: 2855823 - RNA, 15 nt, Mycobacterium avium subsp. paratuberculosis
ggcggcccgcuugcc

SEQ ID NO: 2855824 - RNA, 19 nt, Mycobacterium avium subsp. paratuberculosis
ggcggcccgcuugccgacg

SEQ ID NO: 2855825 - RNA, 22 nt, Mycobacterium avium subsp. paratuberculosis
ggcggcccggguggacgcccgc

SEQ ID NO: 2855826 - RNA, 17 nt, Mycobacterium avium subsp. paratuberculosis
ggcggcccgguacaucg

SEQ ID NO: 2855827 - RNA, 20 nt, Mycobacterium avium subsp. paratuberculosis
ggcggcccguccgccccgcu

SEQ ID NO: 2855828 - RNA, 23 nt, Mycobacterium avium subsp. paratuberculosis
ggcggcccguccgccccgcugcc

SEQ ID NO: 2855829 - RNA, 12 nt, Mycobacterium avium subsp. paratuberculosis
ggcggcccgucg

SEQ ID NO: 2855830 - RNA, 22 nt, Mycobacterium avium subsp. paratuberculosis
ggcggcccgucgccaccacggc

SEQ ID NO: 2855831 - RNA, 20 nt, Mycobacterium avium subsp. paratuberculosis
ggcggcccuucucggacgcc

SEQ ID NO: 2855832 - RNA, 15 nt, Mycobacterium avium subsp. paratuberculosis
ggcggccgacccugc

SEQ ID NO: 2855833 - RNA, 12 nt, Mycobacterium avium subsp. paratuberculosis
ggcggccgagcg

SEQ ID NO: 2855834 - RNA, 13 nt, Mycobacterium avium subsp. paratuberculosis
ggcggccgagcgc

SEQ ID NO: 2855835 - RNA, 18 nt, Mycobacterium avium subsp. paratuberculosis
ggcggccgagcgcaccgc

SEQ ID NO: 2855836 - RNA, 20 nt, Mycobacterium avium subsp. paratuberculosis
ggcggccgagcgcaccgcgg

SEQ ID NO: 2855837 - RNA, 14 nt, Mycobacterium avium subsp. paratuberculosis
ggcggccgcagcgu

SEQ ID NO: 2855838 - RNA, 23 nt, Mycobacterium avium subsp. paratuberculosis
ggcggccgccacgcuggugugac

SEQ ID NO: 2855839 - RNA, 13 nt, Mycobacterium avium subsp. paratuberculosis
ggcggccgccagc

SEQ ID NO: 2855840 - RNA, 23 nt, Mycobacterium avium subsp. paratuberculosis
ggcggccgccaucauccgcuggg

SEQ ID NO: 2855841 - RNA, 16 nt, Mycobacterium avium subsp. paratuberculosis
ggcggccgcccgggcg

SEQ ID NO: 2855842 - RNA, 12 nt, Mycobacterium avium subsp. paratuberculosis
ggcggccgccgc

SEQ ID NO: 2855843 - RNA, 14 nt, Mycobacterium avium subsp. paratuberculosis
ggcggccgccgccc

SEQ ID NO: 2855844 - RNA, 19 nt, Mycobacterium avium subsp. paratuberculosis
ggcggccgccgcccgcgcg

SEQ ID NO: 2855845 - RNA, 14 nt, Mycobacterium avium subsp. paratuberculosis
ggcggccgccgcga

SEQ ID NO: 2855846 - RNA, 14 nt, Mycobacterium avium subsp. paratuberculosis
ggcggccgccggca

SEQ ID NO: 2855847 - RNA, 12 nt, Mycobacterium avium subsp. paratuberculosis
ggcggccgcgaa

SEQ ID NO: 2855848 - RNA, 15 nt, Mycobacterium avium subsp. paratuberculosis
ggcggccgcgacgga

SEQ ID NO: 2855849 - RNA, 13 nt, Mycobacterium avium subsp. paratuberculosis
ggcggccgcgagc

SEQ ID NO: 2855850 - RNA, 14 nt, Mycobacterium avium subsp. paratuberculosis
ggcggccgcgagcc

SEQ ID NO: 2855851 - RNA, 13 nt, Mycobacterium avium subsp. paratuberculosis
ggcggccgcggau

SEQ ID NO: 2855852 - RNA, 17 nt, Mycobacterium avium subsp. paratuberculosis
ggcggccgcgucggcgg

SEQ ID NO: 2855853 - RNA, 15 nt, Mycobacterium avium subsp. paratuberculosis
ggcggccggccagcg

SEQ ID NO: 2855854 - RNA, 14 nt, Mycobacterium avium subsp. paratuberculosis
ggcggccggccagu

SEQ ID NO: 2855855 - RNA, 22 nt, Mycobacterium avium subsp. paratuberculosis
ggcggccggccccggccgggcg

SEQ ID NO: 2855856 - RNA, 21 nt, Mycobacterium avium subsp. paratuberculosis
ggcggccggcccggcccgacg

SEQ ID NO: 2855857 - RNA, 12 nt, Mycobacterium avium subsp. paratuberculosis
ggcggccggccg

SEQ ID NO: 2855858 - RNA, 20 nt, Mycobacterium avium subsp. paratuberculosis
ggcggccggccgcgcccauc

SEQ ID NO: 2855859 - RNA, 21 nt, Mycobacterium avium subsp. paratuberculosis
ggcggccggccgcgcgcggcg

SEQ ID NO: 2855860 - RNA, 13 nt, Mycobacterium avium subsp. paratuberculosis
ggcggccggcgcc

SEQ ID NO: 2855861 - RNA, 15 nt, Mycobacterium avium subsp. paratuberculosis
ggcggccggcgccga

SEQ ID NO: 2855862 - RNA, 15 nt, Mycobacterium avium subsp. paratuberculosis
ggcggccggcggcag

SEQ ID NO: 2855863 - RNA, 17 nt, Mycobacterium avium subsp. paratuberculosis
ggcggccggcggcagug

SEQ ID NO: 2855864 - RNA, 12 nt, Mycobacterium avium subsp. paratuberculosis
ggcggccgggau

SEQ ID NO: 2855865 - RNA, 23 nt, Mycobacterium avium subsp. paratuberculosis
ggcggccgggaucuggccgguga

SEQ ID NO: 2855866 - RNA, 13 nt, Mycobacterium avium subsp. paratuberculosis
ggcggccgggccg

SEQ ID NO: 2855867 - RNA, 18 nt, Mycobacterium avium subsp. paratuberculosis
ggcggccgggccgcggcg

SEQ ID NO: 2855868 - RNA, 14 nt, Mycobacterium avium subsp. paratuberculosis
ggcggccgggccgg

SEQ ID NO: 2855869 - RNA, 15 nt, Mycobacterium avium subsp. paratuberculosis
ggcggccgggcggcc

SEQ ID NO: 2855870 - RNA, 13 nt, Mycobacterium avium subsp. paratuberculosis
ggcggccgggggg

SEQ ID NO: 2855871 - RNA, 23 nt, Mycobacterium avium subsp. paratuberculosis
ggcggccggggggaggucgcgga

SEQ ID NO: 2855872 - RNA, 23 nt, Mycobacterium avium subsp. paratuberculosis
ggcggccgggucgagcgcgccga

SEQ ID NO: 2855873 - RNA, 14 nt, Mycobacterium avium subsp. paratuberculosis
ggcggccgggugua

SEQ ID NO: 2855874 - RNA, 23 nt, Mycobacterium avium subsp. paratuberculosis
ggcggccggguguagcugggccc

SEQ ID NO: 2855875 - RNA, 14 nt, Mycobacterium avium subsp. paratuberculosis
ggcggccguggucg

SEQ ID NO: 2855876 - RNA, 15 nt, Mycobacterium avium subsp. paratuberculosis
ggcggccguggucga

SEQ ID NO: 2855877 - RNA, 13 nt, Mycobacterium avium subsp. paratuberculosis
ggcggccucgccg

SEQ ID NO: 2855878 - RNA, 14 nt, Mycobacterium avium subsp. paratuberculosis
ggcggccucgccgu

SEQ ID NO: 2855879 - RNA, 22 nt, Mycobacterium avium subsp. paratuberculosis
ggcggccucggugcucaucagc

SEQ ID NO: 2855880 - RNA, 16 nt, Mycobacterium avium subsp. paratuberculosis
ggcggccucggugguc

SEQ ID NO: 2855881 - RNA, 17 nt, Mycobacterium avium subsp. paratuberculosis
ggcggccugcaccucgg

SEQ ID NO: 2855882 - RNA, 14 nt, Mycobacterium avium subsp. paratuberculosis
ggcggccugcagga

SEQ ID NO: 2855883 - RNA, 16 nt, Mycobacterium avium subsp. paratuberculosis
ggcggccugccggccg

SEQ ID NO: 2855884 - RNA, 23 nt, Mycobacterium avium subsp. paratuberculosis
ggcggccugccggccgccgcgca

SEQ ID NO: 2855885 - RNA, 12 nt, Mycobacterium avium subsp. paratuberculosis
ggcggccugcgc

SEQ ID NO: 2855886 - RNA, 21 nt, Mycobacterium avium subsp. paratuberculosis
ggcggccugcgcgucgucgcc

SEQ ID NO: 2855887 - RNA, 20 nt, Mycobacterium avium subsp. paratuberculosis
ggcggccugcggcggcaacg

SEQ ID NO: 2855888 - RNA, 23 nt, Mycobacterium avium subsp. paratuberculosis
ggcggccugcuccagcgagucga

SEQ ID NO: 2855889 - RNA, 13 nt, Mycobacterium avium subsp. paratuberculosis
ggcggccugcucg

SEQ ID NO: 2855890 - RNA, 15 nt, Mycobacterium avium subsp. paratuberculosis
ggcggccugcucgaa

SEQ ID NO: 2855891 - RNA, 18 nt, Mycobacterium avium subsp. paratuberculosis
ggcggccugcuugaccgc

SEQ ID NO: 2855892 - RNA, 21 nt, Mycobacterium avium subsp. paratuberculosis
ggcggccuggccgucgcggcg

SEQ ID NO: 2855893 - RNA, 20 nt, Mycobacterium avium subsp. paratuberculosis
ggcggccuuuuccggcgaca

SEQ ID NO: 2855894 - RNA, 17 nt, Mycobacterium avium subsp. paratuberculosis
ggcggcgaacaccagca

SEQ ID NO: 2855895 - RNA, 23 nt, Mycobacterium avium subsp. paratuberculosis
ggcggcgaacaccagcacccagc

SEQ ID NO: 2855896 - RNA, 17 nt, Mycobacterium avium subsp. paratuberculosis
ggcggcgaacgccgccg

SEQ ID NO: 2855897 - RNA, 19 nt, Mycobacterium avium subsp. paratuberculosis
ggcggcgaagccggccccg

SEQ ID NO: 2855898 - RNA, 21 nt, Mycobacterium avium subsp. paratuberculosis
ggcggcgaagccggccccgcc

SEQ ID NO: 2855899 - RNA, 22 nt, Mycobacterium avium subsp. paratuberculosis
ggcggcgaagccggccccgccc

SEQ ID NO: 2855900 - RNA, 23 nt, Mycobacterium avium subsp. paratuberculosis
ggcggcgaauaccagggcgagga

SEQ ID NO: 2855901 - RNA, 16 nt, Mycobacterium avium subsp. paratuberculosis
ggcggcgacacgccga

SEQ ID NO: 2855902 - RNA, 21 nt, Mycobacterium avium subsp. paratuberculosis
ggcggcgacaucgccgagacg

SEQ ID NO: 2855903 - RNA, 21 nt, Mycobacterium avium subsp. paratuberculosis
ggcggcggaucagcaccgacg

SEQ ID NO: 2855904 - RNA, 16 nt, Mycobacterium avium subsp. paratuberculosis
ggcggcggcagguugg

SEQ ID NO: 2855905 - RNA, 14 nt, Mycobacterium avium subsp. paratuberculosis
ggcggcggccaccu

SEQ ID NO: 2855906 - RNA, 13 nt, Mycobacterium avium subsp. paratuberculosis
ggcggcggccagg

SEQ ID NO: 2855907 - RNA, 11 nt, Mycobacterium avium subsp. paratuberculosis
ggcggcggccc

SEQ ID NO: 2855908 - RNA, 15 nt, Mycobacterium avium subsp. paratuberculosis
ggcggcggcccgccg

SEQ ID NO: 2855909 - RNA, 16 nt, Mycobacterium avium subsp. paratuberculosis
ggcggcggcccgccgc

SEQ ID NO: 2855910 - RNA, 23 nt, Mycobacterium avium subsp. paratuberculosis
ggcggcggcccgccgcgcccggc

SEQ ID NO: 2855911 - RNA, 21 nt, Mycobacterium avium subsp. paratuberculosis
ggcggcggcccguccgccccg

SEQ ID NO: 2855912 - RNA, 13 nt, Mycobacterium avium subsp. paratuberculosis
ggcggcggccgcg

SEQ ID NO: 2855913 - RNA, 12 nt, Mycobacterium avium subsp. paratuberculosis
ggcggcggccuu

SEQ ID NO: 2855914 - RNA, 13 nt, Mycobacterium avium subsp. paratuberculosis
ggcggcggcgccg

SEQ ID NO: 2855915 - RNA, 14 nt, Mycobacterium avium subsp. paratuberculosis
ggcggcggcgccgg

SEQ ID NO: 2855916 - RNA, 15 nt, Mycobacterium avium subsp. paratuberculosis
ggcggcggcgccggg

SEQ ID NO: 2855917 - RNA, 14 nt, Mycobacterium avium subsp. paratuberculosis
ggcggcggcgcgcc

SEQ ID NO: 2855918 - RNA, 14 nt, Mycobacterium avium subsp. paratuberculosis
ggcggcggcgcggg

SEQ ID NO: 2855919 - RNA, 15 nt, Mycobacterium avium subsp. paratuberculosis
ggcggcggcgguccc

SEQ ID NO: 2855920 - RNA, 15 nt, Mycobacterium avium subsp. paratuberculosis
ggcggcggcggucgg

SEQ ID NO: 2855921 - RNA, 16 nt, Mycobacterium avium subsp. paratuberculosis
ggcggcggcggucggc

SEQ ID NO: 2855922 - RNA, 13 nt, Mycobacterium avium subsp. paratuberculosis
ggcggcggcugcc

SEQ ID NO: 2855923 - RNA, 19 nt, Mycobacterium avium subsp. paratuberculosis
ggcggcggcugggccgcgg

SEQ ID NO: 2855924 - RNA, 15 nt, Mycobacterium avium subsp. paratuberculosis
ggcggcgggccagcu

SEQ ID NO: 2855925 - RNA, 13 nt, Mycobacterium avium subsp. paratuberculosis
ggcggcggggcug

SEQ ID NO: 2855926 - RNA, 20 nt, Mycobacterium avium subsp. paratuberculosis
ggcggcggggcugcccaggu

SEQ ID NO: 2855927 - RNA, 13 nt, Mycobacterium avium subsp. paratuberculosis
ggcggcgggggcg

SEQ ID NO: 2855928 - RNA, 16 nt, Mycobacterium avium subsp. paratuberculosis
ggcggcgggggcgaga

SEQ ID NO: 2855929 - RNA, 23 nt, Mycobacterium avium subsp. paratuberculosis
ggcggcgggggcgagaccgucgg

SEQ ID NO: 2855930 - RNA, 20 nt, Mycobacterium avium subsp. paratuberculosis
ggcggcgggggcgggcccca

SEQ ID NO: 2855931 - RNA, 23 nt, Mycobacterium avium subsp. paratuberculosis
ggcggcgggggcgggccccacgc

SEQ ID NO: 2855932 - RNA, 15 nt, Mycobacterium avium subsp. paratuberculosis
ggcggcggggugacg

SEQ ID NO: 2855933 - RNA, 20 nt, Mycobacterium avium subsp. paratuberculosis
ggcggcggggugacggucac

SEQ ID NO: 2855934 - RNA, 13 nt, Mycobacterium avium subsp. paratuberculosis
ggcggcgguauuc

SEQ ID NO: 2855935 - RNA, 20 nt, Mycobacterium avium subsp. paratuberculosis
ggcggcgguccguucggcgg

SEQ ID NO: 2855936 - RNA, 20 nt, Mycobacterium avium subsp. paratuberculosis
ggcggcggucuucuuggcgg

SEQ ID NO: 2855937 - RNA, 13 nt, Mycobacterium avium subsp. paratuberculosis
ggcggcggugagc

SEQ ID NO: 2855938 - RNA, 16 nt, Mycobacterium avium subsp. paratuberculosis
ggcggcggugaucgcc

SEQ ID NO: 2855939 - RNA, 22 nt, Mycobacterium avium subsp. paratuberculosis
ggcggcggugaucucgucggcg

SEQ ID NO: 2855940 - RNA, 12 nt, Mycobacterium avium subsp. paratuberculosis
ggcggcggugcc

SEQ ID NO: 2855941 - RNA, 14 nt, Mycobacterium avium subsp. paratuberculosis
ggcggcggugccgc

SEQ ID NO: 2855942 - RNA, 18 nt, Mycobacterium avium subsp. paratuberculosis
ggcggcggugccgcaggc

SEQ ID NO: 2855943 - RNA, 16 nt, Mycobacterium avium subsp. paratuberculosis
ggcggcggugccuggu

SEQ ID NO: 2855944 - RNA, 13 nt, Mycobacterium avium subsp. paratuberculosis
ggcggcggugcuc

SEQ ID NO: 2855945 - RNA, 18 nt, Mycobacterium avium subsp. paratuberculosis
ggcggcgguggcgaugac

SEQ ID NO: 2855946 - RNA, 12 nt, Mycobacterium avium subsp. paratuberculosis
ggcggcgguguc

SEQ ID NO: 2855947 - RNA, 17 nt, Mycobacterium avium subsp. paratuberculosis
ggcggcggugucgccca

SEQ ID NO: 2855948 - RNA, 12 nt, Mycobacterium avium subsp. paratuberculosis
ggcggcgguuuc

SEQ ID NO: 2855949 - RNA, 23 nt, Mycobacterium avium subsp. paratuberculosis
ggcggcguagucgccgguguaga

SEQ ID NO: 2855950 - RNA, 18 nt, Mycobacterium avium subsp. paratuberculosis
ggcggcguagucggcgca

SEQ ID NO: 2855951 - RNA, 21 nt, Mycobacterium avium subsp. paratuberculosis
ggcggcguagucggcgcagcg

SEQ ID NO: 2855952 - RNA, 20 nt, Mycobacterium avium subsp. paratuberculosis
ggcggcgucccagugcucga

SEQ ID NO: 2855953 - RNA, 19 nt, Mycobacterium avium subsp. paratuberculosis
ggcggcguccgcggccgcg

SEQ ID NO: 2855954 - RNA, 21 nt, Mycobacterium avium subsp. paratuberculosis
ggcggcguccucgaccacccg

SEQ ID NO: 2855955 - RNA, 22 nt, Mycobacterium avium subsp. paratuberculosis
ggcggcgucgaccgccccgccg

SEQ ID NO: 2855956 - RNA, 15 nt, Mycobacterium avium subsp. paratuberculosis
ggcggcgucgagcac

SEQ ID NO: 2855957 - RNA, 22 nt, Mycobacterium avium subsp. paratuberculosis
ggcggcgucgaugucgcccggc

SEQ ID NO: 2855958 - RNA, 23 nt, Mycobacterium avium subsp. paratuberculosis
ggcggcgucgaugucgcccggcg

SEQ ID NO: 2855959 - RNA, 23 nt, Mycobacterium avium subsp. paratuberculosis
ggcggcgucggcgacggcgucca

SEQ ID NO: 2855960 - RNA, 14 nt, Mycobacterium avium subsp. paratuberculosis
ggcggcgucggcgu

SEQ ID NO: 2855961 - RNA, 22 nt, Mycobacterium avium subsp. paratuberculosis
ggcggcgucggcguagggcagc

SEQ ID NO: 2855962 - RNA, 16 nt, Mycobacterium avium subsp. paratuberculosis
ggcggcgucggcgucc

SEQ ID NO: 2855963 - RNA, 13 nt, Mycobacterium avium subsp. paratuberculosis
ggcggcgucgucg

SEQ ID NO: 2855964 - RNA, 16 nt, Mycobacterium avium subsp. paratuberculosis
ggcggcgucgucgccg

SEQ ID NO: 2855965 - RNA, 22 nt, Mycobacterium avium subsp. paratuberculosis
ggcggcgucgugaccgaccucc

SEQ ID NO: 2855966 - RNA, 20 nt, Mycobacterium avium subsp. paratuberculosis
ggcggcgugcaccgcccgcg

SEQ ID NO: 2855967 - RNA, 14 nt, Mycobacterium avium subsp. paratuberculosis
ggcggcgugccagg

SEQ ID NO: 2855968 - RNA, 19 nt, Mycobacterium avium subsp. paratuberculosis
ggcggcgugccagggcagc

SEQ ID NO: 2855969 - RNA, 15 nt, Mycobacterium avium subsp. paratuberculosis
ggcggcgugccgccc

SEQ ID NO: 2855970 - RNA, 22 nt, Mycobacterium avium subsp. paratuberculosis
ggcggcgugggguucccggccg

SEQ ID NO: 2855971 - RNA, 23 nt, Mycobacterium avium subsp. paratuberculosis
ggcggcuccgaucuccugguguc

SEQ ID NO: 2855972 - RNA, 19 nt, Mycobacterium avium subsp. paratuberculosis
ggcggcucgggggugucgu

SEQ ID NO: 2855973 - RNA, 13 nt, Mycobacterium avium subsp. paratuberculosis
ggcggcucgucca

SEQ ID NO: 2855974 - RNA, 18 nt, Mycobacterium avium subsp. paratuberculosis
ggcggcugaaccaccgcg

SEQ ID NO: 2855975 - RNA, 14 nt, Mycobacterium avium subsp. paratuberculosis
ggcggcugaagcgc

SEQ ID NO: 2855976 - RNA, 15 nt, Mycobacterium avium subsp. paratuberculosis
ggcggcugaagcgcu

SEQ ID NO: 2855977 - RNA, 20 nt, Mycobacterium avium subsp. paratuberculosis
ggcggcugccucgacgaugg

SEQ ID NO: 2855978 - RNA, 15 nt, Mycobacterium avium subsp. paratuberculosis
ggcggcugggcagcc

SEQ ID NO: 2855979 - RNA, 20 nt, Mycobacterium avium subsp. paratuberculosis
ggcggcugggcagccgcgcg

SEQ ID NO: 2855980 - RNA, 17 nt, Mycobacterium avium subsp. paratuberculosis
ggcggcugggccgcggc

SEQ ID NO: 2855981 - RNA, 19 nt, Mycobacterium avium subsp. paratuberculosis
ggcgggaaaccaccugccg

SEQ ID NO: 2855982 - RNA, 20 nt, Mycobacterium avium subsp. paratuberculosis
ggcgggaaaccaccugccgc

SEQ ID NO: 2855983 - RNA, 12 nt, Mycobacterium avium subsp. paratuberculosis
ggcgggacccgc

SEQ ID NO: 2855984 - RNA, 14 nt, Mycobacterium avium subsp. paratuberculosis
ggcgggacccgcga

SEQ ID NO: 2855985 - RNA, 19 nt, Mycobacterium avium subsp. paratuberculosis
ggcgggacccgcgaccccu

SEQ ID NO: 2855986 - RNA, 21 nt, Mycobacterium avium subsp. paratuberculosis
ggcgggacguggcucagcggc

SEQ ID NO: 2855987 - RNA, 13 nt, Mycobacterium avium subsp. paratuberculosis
ggcgggacguugu

SEQ ID NO: 2855988 - RNA, 23 nt, Mycobacterium avium subsp. paratuberculosis
ggcgggagcuaggcggccgggcg

SEQ ID NO: 2855989 - RNA, 18 nt, Mycobacterium avium subsp. paratuberculosis
ggcgggaucgcggcgguc

SEQ ID NO: 2855990 - RNA, 15 nt, Mycobacterium avium subsp. paratuberculosis
ggcgggauggguggu

SEQ ID NO: 2855991 - RNA, 18 nt, Mycobacterium avium subsp. paratuberculosis
ggcgggauggguggucac

SEQ ID NO: 2855992 - RNA, 17 nt, Mycobacterium avium subsp. paratuberculosis
ggcgggauguggcauca

SEQ ID NO: 2855993 - RNA, 16 nt, Mycobacterium avium subsp. paratuberculosis
ggcgggcacccgggcg

SEQ ID NO: 2855994 - RNA, 11 nt, Mycobacterium avium subsp. paratuberculosis
ggcgggcaccu

SEQ ID NO: 2855995 - RNA, 19 nt, Mycobacterium avium subsp. paratuberculosis
ggcgggcaccucgaugccg

SEQ ID NO: 2855996 - RNA, 11 nt, Mycobacterium avium subsp. paratuberculosis
ggcgggcacgu

SEQ ID NO: 2855997 - RNA, 19 nt, Mycobacterium avium subsp. paratuberculosis
ggcgggcacgucgcgcggg

SEQ ID NO: 2855998 - RNA, 23 nt, Mycobacterium avium subsp. paratuberculosis
ggcgggcacgucgcgcggggucg

SEQ ID NO: 2855999 - RNA, 23 nt, Mycobacterium avium subsp. paratuberculosis
ggcgggcacuuaacaccucgccu

SEQ ID NO: 2856000 - RNA, 14 nt, Mycobacterium avium subsp. paratuberculosis
ggcgggcagcacca

SEQ ID NO: 2856001 - RNA, 23 nt, Mycobacterium avium subsp. paratuberculosis
ggcgggcagcaccagcggcacca

SEQ ID NO: 2856002 - RNA, 13 nt, Mycobacterium avium subsp. paratuberculosis
ggcgggcaggccg

SEQ ID NO: 2856003 - RNA, 14 nt, Mycobacterium avium subsp. paratuberculosis
ggcgggcaggccga

SEQ ID NO: 2856004 - RNA, 11 nt, Mycobacterium avium subsp. paratuberculosis
ggcgggcaggu

SEQ ID NO: 2856005 - RNA, 17 nt, Mycobacterium avium subsp. paratuberculosis
ggcgggcagguucauca

SEQ ID NO: 2856006 - RNA, 23 nt, Mycobacterium avium subsp. paratuberculosis
ggcgggcagguucaucaccacga

SEQ ID NO: 2856007 - RNA, 13 nt, Mycobacterium avium subsp. paratuberculosis
ggcgggccagcuc

SEQ ID NO: 2856008 - RNA, 19 nt, Mycobacterium avium subsp. paratuberculosis
ggcgggccagcucgaaccu

SEQ ID NO: 2856009 - RNA, 22 nt, Mycobacterium avium subsp. paratuberculosis
ggcgggccagcucgucgagccg

SEQ ID NO: 2856010 - RNA, 12 nt, Mycobacterium avium subsp. paratuberculosis
ggcgggccaggc

SEQ ID NO: 2856011 - RNA, 13 nt, Mycobacterium avium subsp. paratuberculosis
ggcgggccaggcg

SEQ ID NO: 2856012 - RNA, 17 nt, Mycobacterium avium subsp. paratuberculosis
ggcgggccagucgccgc

SEQ ID NO: 2856013 - RNA, 20 nt, Mycobacterium avium subsp. paratuberculosis
ggcgggccagucgccgcgca

SEQ ID NO: 2856014 - RNA, 14 nt, Mycobacterium avium subsp. paratuberculosis
ggcgggcccagcag

SEQ ID NO: 2856015 - RNA, 13 nt, Mycobacterium avium subsp. paratuberculosis
ggcgggcccgggc

SEQ ID NO: 2856016 - RNA, 19 nt, Mycobacterium avium subsp. paratuberculosis
ggcgggcccgggcgcugag

SEQ ID NO: 2856017 - RNA, 13 nt, Mycobacterium avium subsp. paratuberculosis
ggcgggcccgucg

SEQ ID NO: 2856018 - RNA, 14 nt, Mycobacterium avium subsp. paratuberculosis
ggcgggccgcagca

SEQ ID NO: 2856019 - RNA, 20 nt, Mycobacterium avium subsp. paratuberculosis
ggcgggccgccagguuggcg

SEQ ID NO: 2856020 - RNA, 14 nt, Mycobacterium avium subsp. paratuberculosis
ggcgggccgcccgg

SEQ ID NO: 2856021 - RNA, 16 nt, Mycobacterium avium subsp. paratuberculosis
ggcgggccgcccggcg

SEQ ID NO: 2856022 - RNA, 15 nt, Mycobacterium avium subsp. paratuberculosis
ggcgggccgccgggu

SEQ ID NO: 2856023 - RNA, 12 nt, Mycobacterium avium subsp. paratuberculosis
ggcgggccggcg

SEQ ID NO: 2856024 - RNA, 23 nt, Mycobacterium avium subsp. paratuberculosis
ggcgggccgguccccggcgacca

SEQ ID NO: 2856025 - RNA, 22 nt, Mycobacterium avium subsp. paratuberculosis
ggcgggcgaaguagccggcgau

SEQ ID NO: 2856026 - RNA, 23 nt, Mycobacterium avium subsp. paratuberculosis
ggcgggcgacuucuucgccggcg

SEQ ID NO: 2856027 - RNA, 14 nt, Mycobacterium avium subsp. paratuberculosis
ggcgggcgaucgcc

SEQ ID NO: 2856028 - RNA, 11 nt, Mycobacterium avium subsp. paratuberculosis
ggcgggcgcgc

SEQ ID NO: 2856029 - RNA, 16 nt, Mycobacterium avium subsp. paratuberculosis
ggcgggcgcgccggcg

SEQ ID NO: 2856030 - RNA, 20 nt, Mycobacterium avium subsp. paratuberculosis
ggcgggcgcgccggcgcgca

SEQ ID NO: 2856031 - RNA, 14 nt, Mycobacterium avium subsp. paratuberculosis
ggcgggcgcguuga

SEQ ID NO: 2856032 - RNA, 15 nt, Mycobacterium avium subsp. paratuberculosis
ggcgggcggcccgca

SEQ ID NO: 2856033 - RNA, 14 nt, Mycobacterium avium subsp. paratuberculosis
ggcgggcggcggcu

SEQ ID NO: 2856034 - RNA, 16 nt, Mycobacterium avium subsp. paratuberculosis
ggcgggcggcggcugg

SEQ ID NO: 2856035 - RNA, 20 nt, Mycobacterium avium subsp. paratuberculosis
ggcgggcggcggcugggccg

SEQ ID NO: 2856036 - RNA, 23 nt, Mycobacterium avium subsp. paratuberculosis
ggcgggcgugcgaaugacgcgca

SEQ ID NO: 2856037 - RNA, 22 nt, Mycobacterium avium subsp. paratuberculosis
ggcgggcucccucgucgcuacc

SEQ ID NO: 2856038 - RNA, 20 nt, Mycobacterium avium subsp. paratuberculosis
ggcgggcucgccggcccgac

SEQ ID NO: 2856039 - RNA, 21 nt, Mycobacterium avium subsp. paratuberculosis
ggcgggcucgccggcccgacc

SEQ ID NO: 2856040 - RNA, 16 nt, Mycobacterium avium subsp. paratuberculosis
ggcgggcucgcgcugg

SEQ ID NO: 2856041 - RNA, 17 nt, Mycobacterium avium subsp. paratuberculosis
ggcgggcugcagcgacu

SEQ ID NO: 2856042 - RNA, 16 nt, Mycobacterium avium subsp. paratuberculosis
ggcgggcuggugcgca

SEQ ID NO: 2856043 - RNA, 20 nt, Mycobacterium avium subsp. paratuberculosis
ggcggggacgugucggggug

SEQ ID NO: 2856044 - RNA, 13 nt, Mycobacterium avium subsp. paratuberculosis
ggcggggcagcag

SEQ ID NO: 2856045 - RNA, 17 nt, Mycobacterium avium subsp. paratuberculosis
ggcggggcaugguguca

SEQ ID NO: 2856046 - RNA, 14 nt, Mycobacterium avium subsp. paratuberculosis
ggcggggcccgggc

SEQ ID NO: 2856047 - RNA, 18 nt, Mycobacterium avium subsp. paratuberculosis
ggcggggccggugauggu

SEQ ID NO: 2856048 - RNA, 13 nt, Mycobacterium avium subsp. paratuberculosis
ggcggggccucca

SEQ ID NO: 2856049 - RNA, 18 nt, Mycobacterium avium subsp. paratuberculosis
ggcggggccuccaccagc

SEQ ID NO: 2856050 - RNA, 19 nt, Mycobacterium avium subsp. paratuberculosis
ggcggggccuccaccagcg

SEQ ID NO: 2856051 - RNA, 20 nt, Mycobacterium avium subsp. paratuberculosis
ggcggggccuccaccagcgg

SEQ ID NO: 2856052 - RNA, 22 nt, Mycobacterium avium subsp. paratuberculosis
ggcggggccuccaccagcggcg

SEQ ID NO: 2856053 - RNA, 23 nt, Mycobacterium avium subsp. paratuberculosis
ggcggggccuccaccagcggcgc

SEQ ID NO: 2856054 - RNA, 15 nt, Mycobacterium avium subsp. paratuberculosis
ggcggggcgccgaca

SEQ ID NO: 2856055 - RNA, 20 nt, Mycobacterium avium subsp. paratuberculosis
ggcggggcgccgacagucgc

SEQ ID NO: 2856056 - RNA, 15 nt, Mycobacterium avium subsp. paratuberculosis
ggcggggcgucucga

SEQ ID NO: 2856057 - RNA, 21 nt, Mycobacterium avium subsp. paratuberculosis
ggcggggcgugcccggcgccg

SEQ ID NO: 2856058 - RNA, 13 nt, Mycobacterium avium subsp. paratuberculosis
ggcggggcguugc

SEQ ID NO: 2856059 - RNA, 13 nt, Mycobacterium avium subsp. paratuberculosis
ggcgggggagccg

SEQ ID NO: 2856060 - RNA, 15 nt, Mycobacterium avium subsp. paratuberculosis
ggcgggggcugucca

SEQ ID NO: 2856061 - RNA, 18 nt, Mycobacterium avium subsp. paratuberculosis
ggcggggggagaggcgcg

SEQ ID NO: 2856062 - RNA, 21 nt, Mycobacterium avium subsp. paratuberculosis
ggcggggggagaggcgcggcg

SEQ ID NO: 2856063 - RNA, 13 nt, Mycobacterium avium subsp. paratuberculosis
ggcggggguucga

SEQ ID NO: 2856064 - RNA, 16 nt, Mycobacterium avium subsp. paratuberculosis
ggcgggguccacgcag

SEQ ID NO: 2856065 - RNA, 24 nt, Mycobacterium avium subsp. paratuberculosis
ggcggggucgaaguccugcgccgc

SEQ ID NO: 2856066 - RNA, 14 nt, Mycobacterium avium subsp. paratuberculosis
ggcggggucguugc

SEQ ID NO: 2856067 - RNA, 11 nt, Mycobacterium avium subsp. paratuberculosis
ggcggggucuc

SEQ ID NO: 2856068 - RNA, 16 nt, Mycobacterium avium subsp. paratuberculosis
ggcggggugacgguca

SEQ ID NO: 2856069 - RNA, 17 nt, Mycobacterium avium subsp. paratuberculosis
ggcggggugugcggcac

SEQ ID NO: 2856070 - RNA, 21 nt, Mycobacterium avium subsp. paratuberculosis
ggcggggugugcggcacggcg

SEQ ID NO: 2856071 - RNA, 19 nt, Mycobacterium avium subsp. paratuberculosis
ggcgggguuguagaacgac

SEQ ID NO: 2856072 - RNA, 21 nt, Mycobacterium avium subsp. paratuberculosis
ggcggguaggcgccgaugccc

SEQ ID NO: 2856073 - RNA, 14 nt, Mycobacterium avium subsp. paratuberculosis
ggcggugcgggugg

SEQ ID NO: 2856074 - RNA, 15 nt, Mycobacterium avium subsp. paratuberculosis
ggcggugcggguggu

SEQ ID NO: 2856075 - RNA, 21 nt, Mycobacterium avium subsp. paratuberculosis
ggcggugcgggugguguggcg

SEQ ID NO: 2856076 - RNA, 23 nt, Mycobacterium avium subsp. paratuberculosis
ggcggugcgggugguguggcguc

SEQ ID NO: 2856077 - RNA, 16 nt, Mycobacterium avium subsp. paratuberculosis
ggcggugcggugcgcc

SEQ ID NO: 2856078 - RNA, 19 nt, Mycobacterium avium subsp. paratuberculosis
ggcggugcggugcgccgca

SEQ ID NO: 2856079 - RNA, 14 nt, Mycobacterium avium subsp. paratuberculosis
ggcggugcgucggg

SEQ ID NO: 2856080 - RNA, 20 nt, Mycobacterium avium subsp. paratuberculosis
ggcggugcucgcgccgggcg

SEQ ID NO: 2856081 - RNA, 23 nt, Mycobacterium avium subsp. paratuberculosis
ggcggugcucucgucgucggcgg

SEQ ID NO: 2856082 - RNA, 16 nt, Mycobacterium avium subsp. paratuberculosis
ggcgguggccacggcg

SEQ ID NO: 2856083 - RNA, 20 nt, Mycobacterium avium subsp. paratuberculosis
ggcgguggccugcccggcgg

SEQ ID NO: 2856084 - RNA, 15 nt, Mycobacterium avium subsp. paratuberculosis
ggcgguggcgcacaa

SEQ ID NO: 2856085 - RNA, 22 nt, Mycobacterium avium subsp. paratuberculosis
ggcgguggcgcacaacccggac

SEQ ID NO: 2856086 - RNA, 17 nt, Mycobacterium avium subsp. paratuberculosis
ggcgguggcgccggggc

SEQ ID NO: 2856087 - RNA, 13 nt, Mycobacterium avium subsp. paratuberculosis
ggcgguggcggcg

SEQ ID NO: 2856088 - RNA, 19 nt, Mycobacterium avium subsp. paratuberculosis
ggcgguggcggcgaacgcg

SEQ ID NO: 2856089 - RNA, 12 nt, Mycobacterium avium subsp. paratuberculosis
ggcgguggcgua

SEQ ID NO: 2856090 - RNA, 18 nt, Mycobacterium avium subsp. paratuberculosis
ggcggugggcucggccau

SEQ ID NO: 2856091 - RNA, 22 nt, Mycobacterium avium subsp. paratuberculosis
ggcgguggugauggacggggcg

SEQ ID NO: 2856092 - RNA, 15 nt, Mycobacterium avium subsp. paratuberculosis
ggcgguggugccgcc

SEQ ID NO: 2856093 - RNA, 18 nt, Mycobacterium avium subsp. paratuberculosis
ggcggugguugggguugg

SEQ ID NO: 2856094 - RNA, 15 nt, Mycobacterium avium subsp. paratuberculosis
ggcggugucgaagac

SEQ ID NO: 2856095 - RNA, 20 nt, Mycobacterium avium subsp. paratuberculosis
ggcggugucgaaggccgggg

SEQ ID NO: 2856096 - RNA, 22 nt, Mycobacterium avium subsp. paratuberculosis
ggcggugucgaaggccggggug

SEQ ID NO: 2856097 - RNA, 15 nt, Mycobacterium avium subsp. paratuberculosis
ggcggugucggcgcc

SEQ ID NO: 2856098 - RNA, 20 nt, Mycobacterium avium subsp. paratuberculosis
ggcggugucggugcccaggu

SEQ ID NO: 2856099 - RNA, 20 nt, Mycobacterium avium subsp. paratuberculosis
ggcggugucggugccgagca

SEQ ID NO: 2856100 - RNA, 21 nt, Mycobacterium avium subsp. paratuberculosis
ggcggugucggugccgagcac

SEQ ID NO: 2856101 - RNA, 23 nt, Mycobacterium avium subsp. paratuberculosis
ggcggugucggugccgagcacgc

SEQ ID NO: 2856102 - RNA, 22 nt, Mycobacterium avium subsp. paratuberculosis
ggcggugucguaguugcgcgcc

SEQ ID NO: 2856103 - RNA, 20 nt, Mycobacterium avium subsp. paratuberculosis
ggcgguucgaagcgcagcgu

SEQ ID NO: 2856104 - RNA, 20 nt, Mycobacterium avium subsp. paratuberculosis
ggcgguucggaguccaccgg

SEQ ID NO: 2856105 - RNA, 14 nt, Mycobacterium avium subsp. paratuberculosis
ggcgguucggcggg

SEQ ID NO: 2856106 - RNA, 15 nt, Mycobacterium avium subsp. paratuberculosis
ggcgguugcucgucg

SEQ ID NO: 2856107 - RNA, 19 nt, Mycobacterium avium subsp. paratuberculosis
ggcgguugcucgucggccg

SEQ ID NO: 2856108 - RNA, 20 nt, Mycobacterium avium subsp. paratuberculosis
ggcgguuggacaggccggcg

SEQ ID NO: 2856109 - RNA, 20 nt, Mycobacterium avium subsp. paratuberculosis
ggcgguuucggugccggccc

SEQ ID NO: 2856110 - RNA, 21 nt, Mycobacterium avium subsp. paratuberculosis
ggcgguuucggugccggccca

SEQ ID NO: 2856111 - RNA, 22 nt, Mycobacterium avium subsp. paratuberculosis
ggcgguuucggugccggcccag

SEQ ID NO: 2856112 - RNA, 17 nt, Mycobacterium avium subsp. paratuberculosis
ggcgguuuuggucggca

SEQ ID NO: 2856113 - RNA, 19 nt, Mycobacterium avium subsp. paratuberculosis
ggcgguuuuguugaccguu

SEQ ID NO: 2856114 - RNA, 13 nt, Mycobacterium avium subsp. paratuberculosis
ggcguaaccggug

SEQ ID NO: 2856115 - RNA, 24 nt, Mycobacterium avium subsp. paratuberculosis
ggcguacacguagaaggcgccguc

SEQ ID NO: 2856116 - RNA, 16 nt, Mycobacterium avium subsp. paratuberculosis
ggcguacagcccgcgg

SEQ ID NO: 2856117 - RNA, 17 nt, Mycobacterium avium subsp. paratuberculosis
ggcguacagcccgcgga

SEQ ID NO: 2856118 - RNA, 19 nt, Mycobacterium avium subsp. paratuberculosis
ggcguacagcggcgccagg

SEQ ID NO: 2856119 - RNA, 14 nt, Mycobacterium avium subsp. paratuberculosis
ggcguacaggccgu

SEQ ID NO: 2856120 - RNA, 17 nt, Mycobacterium avium subsp. paratuberculosis
ggcguaccgcggcggcg

SEQ ID NO: 2856121 - RNA, 20 nt, Mycobacterium avium subsp. paratuberculosis
ggcguacgacaucucgacgg

SEQ ID NO: 2856122 - RNA, 22 nt, Mycobacterium avium subsp. paratuberculosis
ggcguacgacaucucgacggug

SEQ ID NO: 2856123 - RNA, 16 nt, Mycobacterium avium subsp. paratuberculosis
ggcguacgcgcugccg

SEQ ID NO: 2856124 - RNA, 16 nt, Mycobacterium avium subsp. paratuberculosis
ggcguacugcgcgacc

SEQ ID NO: 2856125 - RNA, 16 nt, Mycobacterium avium subsp. paratuberculosis
ggcguacugcucggcg

SEQ ID NO: 2856126 - RNA, 14 nt, Mycobacterium avium subsp. paratuberculosis
ggcguagaccagcg

SEQ ID NO: 2856127 - RNA, 17 nt, Mycobacterium avium subsp. paratuberculosis
ggcguagaggugcagcg

SEQ ID NO: 2856128 - RNA, 22 nt, Mycobacterium avium subsp. paratuberculosis
ggcguagaggugcagcgggcug

SEQ ID NO: 2856129 - RNA, 17 nt, Mycobacterium avium subsp. paratuberculosis
ggcguagcagucggccu

SEQ ID NO: 2856130 - RNA, 19 nt, Mycobacterium avium subsp. paratuberculosis
ggcguagcggaagcugccg

SEQ ID NO: 2856131 - RNA, 15 nt, Mycobacterium avium subsp. paratuberculosis
ggcguagcgggucag

SEQ ID NO: 2856132 - RNA, 19 nt, Mycobacterium avium subsp. paratuberculosis
ggcguagcgggucagcucc

SEQ ID NO: 2856133 - RNA, 19 nt, Mycobacterium avium subsp. paratuberculosis
ggcguagucgauggccucg

SEQ ID NO: 2856134 - RNA, 15 nt, Mycobacterium avium subsp. paratuberculosis
ggcguagucgccggu

SEQ ID NO: 2856135 - RNA, 16 nt, Mycobacterium avium subsp. paratuberculosis
ggcguagucggcgcag

SEQ ID NO: 2856136 - RNA, 14 nt, Mycobacterium avium subsp. paratuberculosis
ggcguagugcagcu

SEQ ID NO: 2856137 - RNA, 14 nt, Mycobacterium avium subsp. paratuberculosis
ggcguagugcgccc

SEQ ID NO: 2856138 - RNA, 19 nt, Mycobacterium avium subsp. paratuberculosis
ggcguagugggucggcggc

SEQ ID NO: 2856139 - RNA, 20 nt, Mycobacterium avium subsp. paratuberculosis
ggcguagugggucggcggcu

SEQ ID NO: 2856140 - RNA, 21 nt, Mycobacterium avium subsp. paratuberculosis
ggcguagugggucggcggcug

SEQ ID NO: 2856141 - RNA, 17 nt, Mycobacterium avium subsp. paratuberculosis
ggcguaguggugcaggu

SEQ ID NO: 2856142 - RNA, 23 nt, Mycobacterium avium subsp. paratuberculosis
ggcguaugccuccucggugagcg

SEQ ID NO: 2856143 - RNA, 17 nt, Mycobacterium avium subsp. paratuberculosis
ggcguauucccggggga

SEQ ID NO: 2856144 - RNA, 16 nt, Mycobacterium avium subsp. paratuberculosis
ggcguauucggcgcgc

SEQ ID NO: 2856145 - RNA, 17 nt, Mycobacterium avium subsp. paratuberculosis
ggcguauucggcgcgca

SEQ ID NO: 2856146 - RNA, 22 nt, Mycobacterium avium subsp. paratuberculosis
ggcgucacauacgccucacccc

SEQ ID NO: 2856147 - RNA, 13 nt, Mycobacterium avium subsp. paratuberculosis
ggcgucaccaggc

SEQ ID NO: 2856148 - RNA, 12 nt, Mycobacterium avium subsp. paratuberculosis
ggcgucaccgcg

SEQ ID NO: 2856149 - RNA, 19 nt, Mycobacterium avium subsp. paratuberculosis
ggcgucaccgcgggugauc

SEQ ID NO: 2856150 - RNA, 16 nt, Mycobacterium avium subsp. paratuberculosis
ggcgucacgccagcgu

SEQ ID NO: 2856151 - RNA, 19 nt, Mycobacterium avium subsp. paratuberculosis
ggcgucacgccagcgugac

SEQ ID NO: 2856152 - RNA, 20 nt, Mycobacterium avium subsp. paratuberculosis
ggcgucacgccagcgugacg

SEQ ID NO: 2856153 - RNA, 22 nt, Mycobacterium avium subsp. paratuberculosis
ggcgucacgccagcgugacgcc

SEQ ID NO: 2856154 - RNA, 23 nt, Mycobacterium avium subsp. paratuberculosis
ggcgucacgccagcgugacgccc

SEQ ID NO: 2856155 - RNA, 20 nt, Mycobacterium avium subsp. paratuberculosis
ggcgucacgcuggcgugacg

SEQ ID NO: 2856156 - RNA, 14 nt, Mycobacterium avium subsp. paratuberculosis
ggcgucacucuggc

SEQ ID NO: 2856157 - RNA, 17 nt, Mycobacterium avium subsp. paratuberculosis
ggcgucgaucgccguca

SEQ ID NO: 2856158 - RNA, 18 nt, Mycobacterium avium subsp. paratuberculosis
ggcgucgaugaugccggc

SEQ ID NO: 2856159 - RNA, 19 nt, Mycobacterium avium subsp. paratuberculosis
ggcgucgaugaugccggcg

SEQ ID NO: 2856160 - RNA, 12 nt, Mycobacterium avium subsp. paratuberculosis
ggcgucgaugcc

SEQ ID NO: 2856161 - RNA, 16 nt, Mycobacterium avium subsp. paratuberculosis
ggcgucgaugcgcgcc

SEQ ID NO: 2856162 - RNA, 17 nt, Mycobacterium avium subsp. paratuberculosis
ggcgucgaugcgcgcca

SEQ ID NO: 2856163 - RNA, 16 nt, Mycobacterium avium subsp. paratuberculosis
ggcgucgcagaucccg

SEQ ID NO: 2856164 - RNA, 17 nt, Mycobacterium avium subsp. paratuberculosis
ggcgucgcccgccgacg

SEQ ID NO: 2856165 - RNA, 14 nt, Mycobacterium avium subsp. paratuberculosis
ggcgucgccgagcc

SEQ ID NO: 2856166 - RNA, 20 nt, Mycobacterium avium subsp. paratuberculosis
ggcgucgccgagccgcgcca

SEQ ID NO: 2856167 - RNA, 14 nt, Mycobacterium avium subsp. paratuberculosis
ggcgucgccgagcu

SEQ ID NO: 2856168 - RNA, 13 nt, Mycobacterium avium subsp. paratuberculosis
ggcgucgccgccc

SEQ ID NO: 2856169 - RNA, 20 nt, Mycobacterium avium subsp. paratuberculosis
ggcgucgccgcccccgauag

SEQ ID NO: 2856170 - RNA, 15 nt, Mycobacterium avium subsp. paratuberculosis
ggcgucgccgccggu

SEQ ID NO: 2856171 - RNA, 19 nt, Mycobacterium avium subsp. paratuberculosis
ggcgucgccgccggugccg

SEQ ID NO: 2856172 - RNA, 20 nt, Mycobacterium avium subsp. paratuberculosis
ggcgucgccgccggugccga

SEQ ID NO: 2856173 - RNA, 15 nt, Mycobacterium avium subsp. paratuberculosis
ggcgucgccgcuggu

SEQ ID NO: 2856174 - RNA, 19 nt, Mycobacterium avium subsp. paratuberculosis
ggcgucgccuuccugcgcg

SEQ ID NO: 2856175 - RNA, 13 nt, Mycobacterium avium subsp. paratuberculosis
ggcgucgcgcagc

SEQ ID NO: 2856176 - RNA, 14 nt, Mycobacterium avium subsp. paratuberculosis
ggcgucgcgcagca

SEQ ID NO: 2856177 - RNA, 18 nt, Mycobacterium avium subsp. paratuberculosis
ggcgucgcgcagcagcgg

SEQ ID NO: 2856178 - RNA, 12 nt, Mycobacterium avium subsp. paratuberculosis
ggcgucgcgcuc

SEQ ID NO: 2856179 - RNA, 16 nt, Mycobacterium avium subsp. paratuberculosis
ggcgucgcggucggcg

SEQ ID NO: 2856180 - RNA, 17 nt, Mycobacterium avium subsp. paratuberculosis
ggcgucgcggucggcgu

SEQ ID NO: 2856181 - RNA, 22 nt, Mycobacterium avium subsp. paratuberculosis
ggcgucggacaugccggcgccg

SEQ ID NO: 2856182 - RNA, 23 nt, Mycobacterium avium subsp. paratuberculosis
ggcgucggagaugcgggccaccg

SEQ ID NO: 2856183 - RNA, 17 nt, Mycobacterium avium subsp. paratuberculosis
ggcgucggaggcggcgu

SEQ ID NO: 2856184 - RNA, 14 nt, Mycobacterium avium subsp. paratuberculosis
ggcgucggagucgc

SEQ ID NO: 2856185 - RNA, 17 nt, Mycobacterium avium subsp. paratuberculosis
ggcgucggagucgcugu

SEQ ID NO: 2856186 - RNA, 18 nt, Mycobacterium avium subsp. paratuberculosis
ggcgucggccaccgcgcc

SEQ ID NO: 2856187 - RNA, 13 nt, Mycobacterium avium subsp. paratuberculosis
ggcgucggccagc

SEQ ID NO: 2856188 - RNA, 14 nt, Mycobacterium avium subsp. paratuberculosis
ggcgucggccagcg

SEQ ID NO: 2856189 - RNA, 15 nt, Mycobacterium avium subsp. paratuberculosis
ggcgucggccgggcu

SEQ ID NO: 2856190 - RNA, 14 nt, Mycobacterium avium subsp. paratuberculosis
ggcgucggccgggg

SEQ ID NO: 2856191 - RNA, 13 nt, Mycobacterium avium subsp. paratuberculosis
ggcgucggccugc

SEQ ID NO: 2856192 - RNA, 18 nt, Mycobacterium avium subsp. paratuberculosis
ggcgucggccugcccgcg

SEQ ID NO: 2856193 - RNA, 22 nt, Mycobacterium avium subsp. paratuberculosis
ggcgucggccugcccgcgggug

SEQ ID NO: 2856194 - RNA, 16 nt, Mycobacterium avium subsp. paratuberculosis
ggcgucggcgagcggu

SEQ ID NO: 2856195 - RNA, 19 nt, Mycobacterium avium subsp. paratuberculosis
ggcgucggcgagcgguucg

SEQ ID NO: 2856196 - RNA, 13 nt, Mycobacterium avium subsp. paratuberculosis
ggcgucggcgccc

SEQ ID NO: 2856197 - RNA, 14 nt, Mycobacterium avium subsp. paratuberculosis
ggcgucggcgcgca

SEQ ID NO: 2856198 - RNA, 19 nt, Mycobacterium avium subsp. paratuberculosis
ggcgucggcgcgcaccgcg

SEQ ID NO: 2856199 - RNA, 13 nt, Mycobacterium avium subsp. paratuberculosis
ggcgucggcgcgu

SEQ ID NO: 2856200 - RNA, 16 nt, Mycobacterium avium subsp. paratuberculosis
ggcgucggcggccugc

SEQ ID NO: 2856201 - RNA, 21 nt, Mycobacterium avium subsp. paratuberculosis
ggcgucggcggccugcucgca

SEQ ID NO: 2856202 - RNA, 23 nt, Mycobacterium avium subsp. paratuberculosis
ggcgucggcggccugcucgcaga

SEQ ID NO: 2856203 - RNA, 17 nt, Mycobacterium avium subsp. paratuberculosis
ggcgucggcggccuuga

SEQ ID NO: 2856204 - RNA, 12 nt, Mycobacterium avium subsp. paratuberculosis
ggcgucggcguc

SEQ ID NO: 2856205 - RNA, 15 nt, Mycobacterium avium subsp. paratuberculosis
ggcgucgggaccguc

SEQ ID NO: 2856206 - RNA, 20 nt, Mycobacterium avium subsp. paratuberculosis
ggcgucgggaccgucgcgca

SEQ ID NO: 2856207 - RNA, 14 nt, Mycobacterium avium subsp. paratuberculosis
ggcgucgggcaccu

SEQ ID NO: 2856208 - RNA, 16 nt, Mycobacterium avium subsp. paratuberculosis
ggcgucgggcagcagc

SEQ ID NO: 2856209 - RNA, 13 nt, Mycobacterium avium subsp. paratuberculosis
ggcgucgggcggg

SEQ ID NO: 2856210 - RNA, 15 nt, Mycobacterium avium subsp. paratuberculosis
ggcgucgggcggggu

SEQ ID NO: 2856211 - RNA, 16 nt, Mycobacterium avium subsp. paratuberculosis
ggcgucgggcgggugg

SEQ ID NO: 2856212 - RNA, 15 nt, Mycobacterium avium subsp. paratuberculosis
ggcgucggggcccuc

SEQ ID NO: 2856213 - RNA, 16 nt, Mycobacterium avium subsp. paratuberculosis
ggcgucggggcccucc

SEQ ID NO: 2856214 - RNA, 20 nt, Mycobacterium avium subsp. paratuberculosis
ggcgucggggcccuccgcgg

SEQ ID NO: 2856215 - RNA, 21 nt, Mycobacterium avium subsp. paratuberculosis
ggcgucggggcccuccgcggc

SEQ ID NO: 2856216 - RNA, 19 nt, Mycobacterium avium subsp. paratuberculosis
ggcgucggguagggcgccg

SEQ ID NO: 2856217 - RNA, 20 nt, Mycobacterium avium subsp. paratuberculosis
ggcgucggguagggcgccgu

SEQ ID NO: 2856218 - RNA, 13 nt, Mycobacterium avium subsp. paratuberculosis
ggcgucggugaug

SEQ ID NO: 2856219 - RNA, 19 nt, Mycobacterium avium subsp. paratuberculosis
ggcgucggugaugccggac

SEQ ID NO: 2856220 - RNA, 16 nt, Mycobacterium avium subsp. paratuberculosis
ggcgucgguggcggcg

SEQ ID NO: 2856221 - RNA, 19 nt, Mycobacterium avium subsp. paratuberculosis
ggcgucgguggcggcggcg

SEQ ID NO: 2856222 - RNA, 23 nt, Mycobacterium avium subsp. paratuberculosis
ggcgucgguggcggcggcgacga

SEQ ID NO: 2856223 - RNA, 22 nt, Mycobacterium avium subsp. paratuberculosis
ggcgucguaaugcgucaugccg

SEQ ID NO: 2856224 - RNA, 17 nt, Mycobacterium avium subsp. paratuberculosis
ggcgucguaguugcggc

SEQ ID NO: 2856225 - RNA, 20 nt, Mycobacterium avium subsp. paratuberculosis
ggcgucguaguugcggccgg

SEQ ID NO: 2856226 - RNA, 22 nt, Mycobacterium avium subsp. paratuberculosis
ggcgucguaguugcggccggcg

SEQ ID NO: 2856227 - RNA, 16 nt, Mycobacterium avium subsp. paratuberculosis
ggcgucgucgagcacc

SEQ ID NO: 2856228 - RNA, 18 nt, Mycobacterium avium subsp. paratuberculosis
ggcgucgucgagcaccgg

SEQ ID NO: 2856229 - RNA, 20 nt, Mycobacterium avium subsp. paratuberculosis
ggcgucgucgagcaccggca

SEQ ID NO: 2856230 - RNA, 14 nt, Mycobacterium avium subsp. paratuberculosis
ggcgucgucgauga

SEQ ID NO: 2856231 - RNA, 14 nt, Mycobacterium avium subsp. paratuberculosis
ggcgucgucgccgu

SEQ ID NO: 2856232 - RNA, 15 nt, Mycobacterium avium subsp. paratuberculosis
ggcgucgucgccgug

SEQ ID NO: 2856233 - RNA, 21 nt, Mycobacterium avium subsp. paratuberculosis
ggcgucgucgccguggcggcc

SEQ ID NO: 2856234 - RNA, 11 nt, Mycobacterium avium subsp. paratuberculosis
ggcgucgucgg

SEQ ID NO: 2856235 - RNA, 15 nt, Mycobacterium avium subsp. paratuberculosis
ggcgucgucggccca

SEQ ID NO: 2856236 - RNA, 16 nt, Mycobacterium avium subsp. paratuberculosis
ggcgucgucggcggcg

SEQ ID NO: 2856237 - RNA, 12 nt, Mycobacterium avium subsp. paratuberculosis
ggcgucgucguc

SEQ ID NO: 2856238 - RNA, 20 nt, Mycobacterium avium subsp. paratuberculosis
ggcgucgucgucgagccgcu

SEQ ID NO: 2856239 - RNA, 21 nt, Mycobacterium avium subsp. paratuberculosis
ggcgucgucgucgcagugccc

SEQ ID NO: 2856240 - RNA, 22 nt, Mycobacterium avium subsp. paratuberculosis
ggcgucguugaacgcgcgggug

SEQ ID NO: 2856241 - RNA, 17 nt, Mycobacterium avium subsp. paratuberculosis
ggcgucguuggcgccgu

SEQ ID NO: 2856242 - RNA, 23 nt, Mycobacterium avium subsp. paratuberculosis
ggcguggcacccgggcgcgacgg

SEQ ID NO: 2856243 - RNA, 15 nt, Mycobacterium avium subsp. paratuberculosis
ggcguggcccagccg

SEQ ID NO: 2856244 - RNA, 17 nt, Mycobacterium avium subsp. paratuberculosis
ggcguggcccagccggu

SEQ ID NO: 2856245 - RNA, 15 nt, Mycobacterium avium subsp. paratuberculosis
ggcguggcgccggcg

SEQ ID NO: 2856246 - RNA, 22 nt, Mycobacterium avium subsp. paratuberculosis
ggcguggcgcucagcggcagcg

SEQ ID NO: 2856247 - RNA, 23 nt, Mycobacterium avium subsp. paratuberculosis
ggcguggcgcucagcggcagcgu

SEQ ID NO: 2856248 - RNA, 16 nt, Mycobacterium avium subsp. paratuberculosis
ggcguggcggaagcgc

SEQ ID NO: 2856249 - RNA, 17 nt, Mycobacterium avium subsp. paratuberculosis
ggcguggcgggccaggc

SEQ ID NO: 2856250 - RNA, 18 nt, Mycobacterium avium subsp. paratuberculosis
ggcguggcgggccaggcg

SEQ ID NO: 2856251 - RNA, 20 nt, Mycobacterium avium subsp. paratuberculosis
ggcguggcgggccaggcgga

SEQ ID NO: 2856252 - RNA, 23 nt, Mycobacterium avium subsp. paratuberculosis
ggcguggcggucggugcgcagca

SEQ ID NO: 2856253 - RNA, 19 nt, Mycobacterium avium subsp. paratuberculosis
ggcguggcucggcccgccg

SEQ ID NO: 2856254 - RNA, 20 nt, Mycobacterium avium subsp. paratuberculosis
ggcguggcucggcccgccgg

SEQ ID NO: 2856255 - RNA, 15 nt, Mycobacterium avium subsp. paratuberculosis
ggcguggcugaggcc

SEQ ID NO: 2856256 - RNA, 22 nt, Mycobacterium avium subsp. paratuberculosis
ggcguggcugaggccgccccgg

SEQ ID NO: 2856257 - RNA, 21 nt, Mycobacterium avium subsp. paratuberculosis
ggcgugggccgcagcgcggcg

SEQ ID NO: 2856258 - RNA, 15 nt, Mycobacterium avium subsp. paratuberculosis
ggcguggucggcgcg

SEQ ID NO: 2856259 - RNA, 23 nt, Mycobacterium avium subsp. paratuberculosis
ggcguguagccguaacgaugccg

SEQ ID NO: 2856260 - RNA, 19 nt, Mycobacterium avium subsp. paratuberculosis
ggcguguagccugcggccu

SEQ ID NO: 2856261 - RNA, 19 nt, Mycobacterium avium subsp. paratuberculosis
ggcguguaguacugcucga

SEQ ID NO: 2856262 - RNA, 18 nt, Mycobacterium avium subsp. paratuberculosis
ggcgugucggugauggcc

SEQ ID NO: 2856263 - RNA, 14 nt, Mycobacterium avium subsp. paratuberculosis
ggcgugugggcucg

SEQ ID NO: 2856264 - RNA, 19 nt, Mycobacterium avium subsp. paratuberculosis
ggcguguuccuugcggccg

SEQ ID NO: 2856265 - RNA, 20 nt, Mycobacterium avium subsp. paratuberculosis
ggcguguuccuugcggccgc

SEQ ID NO: 2856266 - RNA, 18 nt, Mycobacterium avium subsp. paratuberculosis
ggcguguugcaggcggac

SEQ ID NO: 2856267 - RNA, 19 nt, Mycobacterium avium subsp. paratuberculosis
ggcguuacccgaacccagc

SEQ ID NO: 2856268 - RNA, 18 nt, Mycobacterium avium subsp. paratuberculosis
ggcguucagcagcgcggu

SEQ ID NO: 2856269 - RNA, 13 nt, Mycobacterium avium subsp. paratuberculosis
ggcguucaucacc

SEQ ID NO: 2856270 - RNA, 17 nt, Mycobacterium avium subsp. paratuberculosis
ggcguucaucaccuggu

SEQ ID NO: 2856271 - RNA, 23 nt, Mycobacterium avium subsp. paratuberculosis
ggcguucaucaccuggucggguu

SEQ ID NO: 2856272 - RNA, 19 nt, Mycobacterium avium subsp. paratuberculosis
ggcguucaucguccacacc

SEQ ID NO: 2856273 - RNA, 18 nt, Mycobacterium avium subsp. paratuberculosis
ggcguucgacguccaccg

SEQ ID NO: 2856274 - RNA, 19 nt, Mycobacterium avium subsp. paratuberculosis
ggcguucgacguccaccgg

SEQ ID NO: 2856275 - RNA, 19 nt, Mycobacterium avium subsp. paratuberculosis
ggcguucgauugccggacg

SEQ ID NO: 2856276 - RNA, 14 nt, Mycobacterium avium subsp. paratuberculosis
ggcguucgccgagg

SEQ ID NO: 2856277 - RNA, 18 nt, Mycobacterium avium subsp. paratuberculosis
ggcguucugcaccgacug

SEQ ID NO: 2856278 - RNA, 13 nt, Mycobacterium avium subsp. paratuberculosis
ggcguugaccggg

SEQ ID NO: 2856279 - RNA, 17 nt, Mycobacterium avium subsp. paratuberculosis
ggcguugaccgggccgc

SEQ ID NO: 2856280 - RNA, 19 nt, Mycobacterium avium subsp. paratuberculosis
ggcguugagcacgcggacc

SEQ ID NO: 2856281 - RNA, 15 nt, Mycobacterium avium subsp. paratuberculosis
ggcguugaucacgau

SEQ ID NO: 2856282 - RNA, 16 nt, Mycobacterium avium subsp. paratuberculosis
ggcguugaugcgggcg

SEQ ID NO: 2856283 - RNA, 19 nt, Mycobacterium avium subsp. paratuberculosis
ggcguugaugcgggcgugc

SEQ ID NO: 2856284 - RNA, 20 nt, Mycobacterium avium subsp. paratuberculosis
ggcguugaugcgggcgugcg

SEQ ID NO: 2856285 - RNA, 15 nt, Mycobacterium avium subsp. paratuberculosis
ggcguugcaccgcgg

SEQ ID NO: 2856286 - RNA, 15 nt, Mycobacterium avium subsp. paratuberculosis
ggcguugcccgccgc

SEQ ID NO: 2856287 - RNA, 19 nt, Mycobacterium avium subsp. paratuberculosis
ggcguugcccgccgcggcg

SEQ ID NO: 2856288 - RNA, 15 nt, Mycobacterium avium subsp. paratuberculosis
ggcguugcccgcugc

SEQ ID NO: 2856289 - RNA, 16 nt, Mycobacterium avium subsp. paratuberculosis
ggcguugcccgucgcc

SEQ ID NO: 2856290 - RNA, 16 nt, Mycobacterium avium subsp. paratuberculosis
ggcguugccgccggcg

SEQ ID NO: 2856291 - RNA, 20 nt, Mycobacterium avium subsp. paratuberculosis
ggcguugcgccgcgagcgca

SEQ ID NO: 2856292 - RNA, 14 nt, Mycobacterium avium subsp. paratuberculosis
ggcguugcgggugg

SEQ ID NO: 2856293 - RNA, 15 nt, Mycobacterium avium subsp. paratuberculosis
ggcguugcgucccgc

SEQ ID NO: 2856294 - RNA, 19 nt, Mycobacterium avium subsp. paratuberculosis
ggcguuggacagcucgacg

SEQ ID NO: 2856295 - RNA, 17 nt, Mycobacterium avium subsp. paratuberculosis
ggcguuggacuccaccg

SEQ ID NO: 2856296 - RNA, 18 nt, Mycobacterium avium subsp. paratuberculosis
ggcguuggacuccaccgc

SEQ ID NO: 2856297 - RNA, 20 nt, Mycobacterium avium subsp. paratuberculosis
ggcguuggacuccaccgcca

SEQ ID NO: 2856298 - RNA, 22 nt, Mycobacterium avium subsp. paratuberculosis
ggcguuggacuccaccgccacc

SEQ ID NO: 2856299 - RNA, 23 nt, Mycobacterium avium subsp. paratuberculosis
ggcguuggagccgaccagcgcga

SEQ ID NO: 2856300 - RNA, 12 nt, Mycobacterium avium subsp. paratuberculosis
ggcguuggcccg

SEQ ID NO: 2856301 - RNA, 13 nt, Mycobacterium avium subsp. paratuberculosis
ggcguuggcccgc

SEQ ID NO: 2856302 - RNA, 15 nt, Mycobacterium avium subsp. paratuberculosis
ggcguuggcccgcac

SEQ ID NO: 2856303 - RNA, 16 nt, Mycobacterium avium subsp. paratuberculosis
ggcguuggcccgcacc

SEQ ID NO: 2856304 - RNA, 17 nt, Mycobacterium avium subsp. paratuberculosis
ggcguuggcccgcaccc

SEQ ID NO: 2856305 - RNA, 13 nt, Mycobacterium avium subsp. paratuberculosis
ggcguuggccgcc

SEQ ID NO: 2856306 - RNA, 14 nt, Mycobacterium avium subsp. paratuberculosis
ggcguuggccgccg

SEQ ID NO: 2856307 - RNA, 18 nt, Mycobacterium avium subsp. paratuberculosis
ggcguuggcgaucucgau

SEQ ID NO: 2856308 - RNA, 16 nt, Mycobacterium avium subsp. paratuberculosis
ggcguuggcggcgucg

SEQ ID NO: 2856309 - RNA, 21 nt, Mycobacterium avium subsp. paratuberculosis
ggcguugggcgggaucgcggc

SEQ ID NO: 2856310 - RNA, 13 nt, Mycobacterium avium subsp. paratuberculosis
ggcguuggucacc

SEQ ID NO: 2856311 - RNA, 20 nt, Mycobacterium avium subsp. paratuberculosis
ggcguuguugaggaacgcga

SEQ ID NO: 2856312 - RNA, 20 nt, Mycobacterium avium subsp. paratuberculosis
ggcuaaacaauggccccggc

SEQ ID NO: 2856313 - RNA, 22 nt, Mycobacterium avium subsp. paratuberculosis
ggcuaaacaauggccccggcgu

SEQ ID NO: 2856314 - RNA, 14 nt, Mycobacterium avium subsp. paratuberculosis
ggcuaagccggcgu

SEQ ID NO: 2856315 - RNA, 12 nt, Mycobacterium avium subsp. paratuberculosis
ggcuaagucguu

SEQ ID NO: 2856316 - RNA, 20 nt, Mycobacterium avium subsp. paratuberculosis
ggcuaauucgggccgccgcg

SEQ ID NO: 2856317 - RNA, 21 nt, Mycobacterium avium subsp. paratuberculosis
ggcuaauucgggccgccgcgc

SEQ ID NO: 2856318 - RNA, 17 nt, Mycobacterium avium subsp. paratuberculosis
ggcuacagcaacauccu

SEQ ID NO: 2856319 - RNA, 20 nt, Mycobacterium avium subsp. paratuberculosis
ggcuacagcaacauccuggu

SEQ ID NO: 2856320 - RNA, 18 nt, Mycobacterium avium subsp. paratuberculosis
ggcuaccagccccaggag

SEQ ID NO: 2856321 - RNA, 21 nt, Mycobacterium avium subsp. paratuberculosis
ggcuaccuaggcgucgucggc

SEQ ID NO: 2856322 - RNA, 22 nt, Mycobacterium avium subsp. paratuberculosis
ggcuaccuaggcgucgucggcc

SEQ ID NO: 2856323 - RNA, 17 nt, Mycobacterium avium subsp. paratuberculosis
ggcuaccugaccagcgg

SEQ ID NO: 2856324 - RNA, 19 nt, Mycobacterium avium subsp. paratuberculosis
ggcuaccugaccagcggcg

SEQ ID NO: 2856325 - RNA, 20 nt, Mycobacterium avium subsp. paratuberculosis
ggcuaccugaccagcggcgc

SEQ ID NO: 2856326 - RNA, 13 nt, Mycobacterium avium subsp. paratuberculosis
ggcucgcgagggc

SEQ ID NO: 2856327 - RNA, 13 nt, Mycobacterium avium subsp. paratuberculosis
ggcucgcgcuggc

SEQ ID NO: 2856328 - RNA, 19 nt, Mycobacterium avium subsp. paratuberculosis
ggcucgcggccugcgggcg

SEQ ID NO: 2856329 - RNA, 21 nt, Mycobacterium avium subsp. paratuberculosis
ggcucgcggccugcgggcgcc

SEQ ID NO: 2856330 - RNA, 22 nt, Mycobacterium avium subsp. paratuberculosis
ggcucgcgggcgaugcggcccg

SEQ ID NO: 2856331 - RNA, 14 nt, Mycobacterium avium subsp. paratuberculosis
ggcucgcgggggcc

SEQ ID NO: 2856332 - RNA, 14 nt, Mycobacterium avium subsp. paratuberculosis
ggcucgcggguguc

SEQ ID NO: 2856333 - RNA, 11 nt, Mycobacterium avium subsp. paratuberculosis
ggcucgcgguc

SEQ ID NO: 2856334 - RNA, 22 nt, Mycobacterium avium subsp. paratuberculosis
ggcucgcguucgcuuucgcguu

SEQ ID NO: 2856335 - RNA, 15 nt, Mycobacterium avium subsp. paratuberculosis
ggcucgcucccgcgc

SEQ ID NO: 2856336 - RNA, 16 nt, Mycobacterium avium subsp. paratuberculosis
ggcucgcucccgcgcg

SEQ ID NO: 2856337 - RNA, 18 nt, Mycobacterium avium subsp. paratuberculosis
ggcucgcucccgcgcggg

SEQ ID NO: 2856338 - RNA, 11 nt, Mycobacterium avium subsp. paratuberculosis
ggcucgcugau

SEQ ID NO: 2856339 - RNA, 19 nt, Mycobacterium avium subsp. paratuberculosis
ggcucgcugaucugcggca

SEQ ID NO: 2856340 - RNA, 22 nt, Mycobacterium avium subsp. paratuberculosis
ggcucgcugaucugcggcacca

SEQ ID NO: 2856341 - RNA, 14 nt, Mycobacterium avium subsp. paratuberculosis
ggcucggcagccgg

SEQ ID NO: 2856342 - RNA, 17 nt, Mycobacterium avium subsp. paratuberculosis
ggcucggcagccggcug

SEQ ID NO: 2856343 - RNA, 17 nt, Mycobacterium avium subsp. paratuberculosis
ggcucggccaucccggu

SEQ ID NO: 2856344 - RNA, 15 nt, Mycobacterium avium subsp. paratuberculosis
ggcucggcccgccgg

SEQ ID NO: 2856345 - RNA, 21 nt, Mycobacterium avium subsp. paratuberculosis
ggcucggcccgccgggcgcca

SEQ ID NO: 2856346 - RNA, 13 nt, Mycobacterium avium subsp. paratuberculosis
ggcucggccgccg

SEQ ID NO: 2856347 - RNA, 16 nt, Mycobacterium avium subsp. paratuberculosis
ggcucggccgccgaca

SEQ ID NO: 2856348 - RNA, 22 nt, Mycobacterium avium subsp. paratuberculosis
ggcucggccggccggccgugcc

SEQ ID NO: 2856349 - RNA, 21 nt, Mycobacterium avium subsp. paratuberculosis
ggcucggcgacaacagcgccg

SEQ ID NO: 2856350 - RNA, 15 nt, Mycobacterium avium subsp. paratuberculosis
ggcucggcgccccac

SEQ ID NO: 2856351 - RNA, 18 nt, Mycobacterium avium subsp. paratuberculosis
ggcucggcgccccacgcc

SEQ ID NO: 2856352 - RNA, 12 nt, Mycobacterium avium subsp. paratuberculosis
ggcucggcgccg

SEQ ID NO: 2856353 - RNA, 24 nt, Mycobacterium avium subsp. paratuberculosis
ggcucggcgccgaccucggccagc

SEQ ID NO: 2856354 - RNA, 20 nt, Mycobacterium avium subsp. paratuberculosis
ggcucggcggcgucguaguu

SEQ ID NO: 2856355 - RNA, 18 nt, Mycobacterium avium subsp. paratuberculosis
ggcucgggaacggucagc

SEQ ID NO: 2856356 - RNA, 19 nt, Mycobacterium avium subsp. paratuberculosis
ggcucgggaacggucagcc

SEQ ID NO: 2856357 - RNA, 24 nt, Mycobacterium avium subsp. paratuberculosis
ggcucgggaacggucagccgcggc

SEQ ID NO: 2856358 - RNA, 18 nt, Mycobacterium avium subsp. paratuberculosis
ggcucgggcgguggcgcc

SEQ ID NO: 2856359 - RNA, 18 nt, Mycobacterium avium subsp. paratuberculosis
ggcucgguaugcggcgac

SEQ ID NO: 2856360 - RNA, 17 nt, Mycobacterium avium subsp. paratuberculosis
ggcucggucaagccggc

SEQ ID NO: 2856361 - RNA, 19 nt, Mycobacterium avium subsp. paratuberculosis
ggcucggucaagccggcca

SEQ ID NO: 2856362 - RNA, 22 nt, Mycobacterium avium subsp. paratuberculosis
ggcucggucaagccggccagca

SEQ ID NO: 2856363 - RNA, 17 nt, Mycobacterium avium subsp. paratuberculosis
ggcucggucaccccgga

SEQ ID NO: 2856364 - RNA, 19 nt, Mycobacterium avium subsp. paratuberculosis
ggcucggugcgccagauca

SEQ ID NO: 2856365 - RNA, 19 nt, Mycobacterium avium subsp. paratuberculosis
ggcucguagcuggugcgca

SEQ ID NO: 2856366 - RNA, 22 nt, Mycobacterium avium subsp. paratuberculosis
ggcucguagcuggugcgcagcc

SEQ ID NO: 2856367 - RNA, 20 nt, Mycobacterium avium subsp. paratuberculosis
ggcucguccagcccggucac

SEQ ID NO: 2856368 - RNA, 14 nt, Mycobacterium avium subsp. paratuberculosis
ggcucguccucgaa

SEQ ID NO: 2856369 - RNA, 22 nt, Mycobacterium avium subsp. paratuberculosis
ggcucgucgaacucguggaugu

SEQ ID NO: 2856370 - RNA, 22 nt, Mycobacterium avium subsp. paratuberculosis
ggcucgucggcgaacagugcac

SEQ ID NO: 2856371 - RNA, 14 nt, Mycobacterium avium subsp. paratuberculosis
ggcucgucguugcg

SEQ ID NO: 2856372 - RNA, 15 nt, Mycobacterium avium subsp. paratuberculosis
ggcucgugcagccgg

SEQ ID NO: 2856373 - RNA, 19 nt, Mycobacterium avium subsp. paratuberculosis
ggcucgugcagccggcggc

SEQ ID NO: 2856374 - RNA, 20 nt, Mycobacterium avium subsp. paratuberculosis
ggcucgugcagccggcggcg

SEQ ID NO: 2856375 - RNA, 23 nt, Mycobacterium avium subsp. paratuberculosis
ggcucgugcagccggcggcgccu

SEQ ID NO: 2856376 - RNA, 18 nt, Mycobacterium avium subsp. paratuberculosis
ggcucguggaacgacgcc

SEQ ID NO: 2856377 - RNA, 18 nt, Mycobacterium avium subsp. paratuberculosis
ggcucguguccgaugacg

SEQ ID NO: 2856378 - RNA, 16 nt, Mycobacterium avium subsp. paratuberculosis
ggcucguugagcacac

SEQ ID NO: 2856379 - RNA, 19 nt, Mycobacterium avium subsp. paratuberculosis
ggcucugaugguguacacg

SEQ ID NO: 2856380 - RNA, 19 nt, Mycobacterium avium subsp. paratuberculosis
ggcucugcagagcggugac

SEQ ID NO: 2856381 - RNA, 15 nt, Mycobacterium avium subsp. paratuberculosis
ggcucugccugcagg

SEQ ID NO: 2856382 - RNA, 16 nt, Mycobacterium avium subsp. paratuberculosis
ggcucuucgcggcggg

SEQ ID NO: 2856383 - RNA, 14 nt, Mycobacterium avium subsp. paratuberculosis
ggcucuucggcgcc

SEQ ID NO: 2856384 - RNA, 18 nt, Mycobacterium avium subsp. paratuberculosis
ggcucuucggcgccgagc

SEQ ID NO: 2856385 - RNA, 17 nt, Mycobacterium avium subsp. paratuberculosis
ggcucuuggcgaccucg

SEQ ID NO: 2856386 - RNA, 21 nt, Mycobacterium avium subsp. paratuberculosis
ggcugaacaccaccaggccgu

SEQ ID NO: 2856387 - RNA, 16 nt, Mycobacterium avium subsp. paratuberculosis
ggcugaacagcgcgcc

SEQ ID NO: 2856388 - RNA, 18 nt, Mycobacterium avium subsp. paratuberculosis
ggcugaacagcgcgccga

SEQ ID NO: 2856389 - RNA, 21 nt, Mycobacterium avium subsp. paratuberculosis
ggcugaacagcgcgccgaaca

SEQ ID NO: 2856390 - RNA, 16 nt, Mycobacterium avium subsp. paratuberculosis
ggcugaaccaccgcgc

SEQ ID NO: 2856391 - RNA, 23 nt, Mycobacterium avium subsp. paratuberculosis
ggcugaaccugcugggcggcacc

SEQ ID NO: 2856392 - RNA, 15 nt, Mycobacterium avium subsp. paratuberculosis
ggcugaacgccagca

SEQ ID NO: 2856393 - RNA, 16 nt, Mycobacterium avium subsp. paratuberculosis
ggcugaacgccagcag

SEQ ID NO: 2856394 - RNA, 18 nt, Mycobacterium avium subsp. paratuberculosis
ggcugaacgccagcagcc

SEQ ID NO: 2856395 - RNA, 18 nt, Mycobacterium avium subsp. paratuberculosis
ggcugaacgucgucagca

SEQ ID NO: 2856396 - RNA, 21 nt, Mycobacterium avium subsp. paratuberculosis
ggcugaacucgacgucgacgu

SEQ ID NO: 2856397 - RNA, 13 nt, Mycobacterium avium subsp. paratuberculosis
ggcugaagcgcug

SEQ ID NO: 2856398 - RNA, 14 nt, Mycobacterium avium subsp. paratuberculosis
ggcugaaucccucc

SEQ ID NO: 2856399 - RNA, 13 nt, Mycobacterium avium subsp. paratuberculosis
ggcugaccagcgc

SEQ ID NO: 2856400 - RNA, 16 nt, Mycobacterium avium subsp. paratuberculosis
ggcugacccgcccggg

SEQ ID NO: 2856401 - RNA, 14 nt, Mycobacterium avium subsp. paratuberculosis
ggcugaccgacggc

SEQ ID NO: 2856402 - RNA, 20 nt, Mycobacterium avium subsp. paratuberculosis
ggcugaccgagcggcgcugc

SEQ ID NO: 2856403 - RNA, 15 nt, Mycobacterium avium subsp. paratuberculosis
ggcugaccgccagga

SEQ ID NO: 2856404 - RNA, 14 nt, Mycobacterium avium subsp. paratuberculosis
ggcugaccggcggu

SEQ ID NO: 2856405 - RNA, 19 nt, Mycobacterium avium subsp. paratuberculosis
ggcugaccggcggugccgg

SEQ ID NO: 2856406 - RNA, 20 nt, Mycobacterium avium subsp. paratuberculosis
ggcugaccggcggugccggc

SEQ ID NO: 2856407 - RNA, 13 nt, Mycobacterium avium subsp. paratuberculosis
ggcugaccucgcc

SEQ ID NO: 2856408 - RNA, 17 nt, Mycobacterium avium subsp. paratuberculosis
ggcugaccucgcgcacc

SEQ ID NO: 2856409 - RNA, 18 nt, Mycobacterium avium subsp. paratuberculosis
ggcugaccucgcgcaccg

SEQ ID NO: 2856410 - RNA, 16 nt, Mycobacterium avium subsp. paratuberculosis
ggcugacgcgaccgcg

SEQ ID NO: 2856411 - RNA, 21 nt, Mycobacterium avium subsp. paratuberculosis
ggcuggcccggcgcggcggcg

SEQ ID NO: 2856412 - RNA, 22 nt, Mycobacterium avium subsp. paratuberculosis
ggcuggcccggcgcggcggcgc

SEQ ID NO: 2856413 - RNA, 13 nt, Mycobacterium avium subsp. paratuberculosis
ggcuggccgagcg

SEQ ID NO: 2856414 - RNA, 23 nt, Mycobacterium avium subsp. paratuberculosis
ggcuggccgagcggcugcugguc

SEQ ID NO: 2856415 - RNA, 14 nt, Mycobacterium avium subsp. paratuberculosis
ggcuggccgcacgg

SEQ ID NO: 2856416 - RNA, 15 nt, Mycobacterium avium subsp. paratuberculosis
ggcuggccgcacggu

SEQ ID NO: 2856417 - RNA, 21 nt, Mycobacterium avium subsp. paratuberculosis
ggcuggccgcacggugcagca

SEQ ID NO: 2856418 - RNA, 13 nt, Mycobacterium avium subsp. paratuberculosis
ggcuggccguccg

SEQ ID NO: 2856419 - RNA, 16 nt, Mycobacterium avium subsp. paratuberculosis
ggcuggccgucggcga

SEQ ID NO: 2856420 - RNA, 21 nt, Mycobacterium avium subsp. paratuberculosis
ggcuggcgcaggugugcggca

SEQ ID NO: 2856421 - RNA, 14 nt, Mycobacterium avium subsp. paratuberculosis
ggcuggcggcaacg

SEQ ID NO: 2856422 - RNA, 11 nt, Mycobacterium avium subsp. paratuberculosis
ggcuggcggcg

SEQ ID NO: 2856423 - RNA, 13 nt, Mycobacterium avium subsp. paratuberculosis
ggcuggcggcgau

SEQ ID NO: 2856424 - RNA, 18 nt, Mycobacterium avium subsp. paratuberculosis
ggcuggcgggcgaucgcc

SEQ ID NO: 2856425 - RNA, 20 nt, Mycobacterium avium subsp. paratuberculosis
ggcuggcguaggacagcagc

SEQ ID NO: 2856426 - RNA, 16 nt, Mycobacterium avium subsp. paratuberculosis
ggcuggcgugcggcgc

SEQ ID NO: 2856427 - RNA, 17 nt, Mycobacterium avium subsp. paratuberculosis
ggcuggcgugcggcgcg

SEQ ID NO: 2856428 - RNA, 14 nt, Mycobacterium avium subsp. paratuberculosis
ggcugggcgaagcc

SEQ ID NO: 2856429 - RNA, 16 nt, Mycobacterium avium subsp. paratuberculosis
ggcugggucaccacgg

SEQ ID NO: 2856430 - RNA, 22 nt, Mycobacterium avium subsp. paratuberculosis
ggcuggguccgauugcccgacu

SEQ ID NO: 2856431 - RNA, 22 nt, Mycobacterium avium subsp. paratuberculosis
ggcuggguggacaccuuggcgg

SEQ ID NO: 2856432 - RNA, 15 nt, Mycobacterium avium subsp. paratuberculosis
ggcuggguggcgaaa

SEQ ID NO: 2856433 - RNA, 17 nt, Mycobacterium avium subsp. paratuberculosis
ggcuggguugcucgccg

SEQ ID NO: 2856434 - RNA, 14 nt, Mycobacterium avium subsp. paratuberculosis
ggcuggucacccac

SEQ ID NO: 2856435 - RNA, 16 nt, Mycobacterium avium subsp. paratuberculosis
ggcugguccggaaccg

SEQ ID NO: 2856436 - RNA, 22 nt, Mycobacterium avium subsp. paratuberculosis
ggcugguccggaaccgcgccuu

SEQ ID NO: 2856437 - RNA, 13 nt, Mycobacterium avium subsp. paratuberculosis
ggcuggucggccu

SEQ ID NO: 2856438 - RNA, 13 nt, Mycobacterium avium subsp. paratuberculosis
ggcuggucggcgg

SEQ ID NO: 2856439 - RNA, 15 nt, Mycobacterium avium subsp. paratuberculosis
ggcuggucggcggcc

SEQ ID NO: 2856440 - RNA, 14 nt, Mycobacterium avium subsp. paratuberculosis
ggcuggucggcggg

SEQ ID NO: 2856441 - RNA, 15 nt, Mycobacterium avium subsp. paratuberculosis
ggcuggugcagcagc

SEQ ID NO: 2856442 - RNA, 18 nt, Mycobacterium avium subsp. paratuberculosis
ggcuggugcagcagcugg

SEQ ID NO: 2856443 - RNA, 19 nt, Mycobacterium avium subsp. paratuberculosis
ggcuguagcacccggccgg

SEQ ID NO: 2856444 - RNA, 14 nt, Mycobacterium avium subsp. paratuberculosis
ggcuguccaccugc

SEQ ID NO: 2856445 - RNA, 17 nt, Mycobacterium avium subsp. paratuberculosis
ggcuguccaccugcacc

SEQ ID NO: 2856446 - RNA, 13 nt, Mycobacterium avium subsp. paratuberculosis
ggcuguccagcag

SEQ ID NO: 2856447 - RNA, 15 nt, Mycobacterium avium subsp. paratuberculosis
ggcuguccucccagc

SEQ ID NO: 2856448 - RNA, 19 nt, Mycobacterium avium subsp. paratuberculosis
ggcuguccucccagcgccc

SEQ ID NO: 2856449 - RNA, 21 nt, Mycobacterium avium subsp. paratuberculosis
ggcuguccucccagcgcccgg

SEQ ID NO: 2856450 - RNA, 12 nt, Mycobacterium avium subsp. paratuberculosis
ggcugucgcgcu

SEQ ID NO: 2856451 - RNA, 14 nt, Mycobacterium avium subsp. paratuberculosis
ggcugucggaggcc

SEQ ID NO: 2856452 - RNA, 15 nt, Mycobacterium avium subsp. paratuberculosis
ggcugucggaggccu

SEQ ID NO: 2856453 - RNA, 13 nt, Mycobacterium avium subsp. paratuberculosis
ggcugucggcgcc

SEQ ID NO: 2856454 - RNA, 14 nt, Mycobacterium avium subsp. paratuberculosis
ggcugucggcgccc

SEQ ID NO: 2856455 - RNA, 16 nt, Mycobacterium avium subsp. paratuberculosis
ggcugugaucgcugac

SEQ ID NO: 2856456 - RNA, 14 nt, Mycobacterium avium subsp. paratuberculosis
ggcugugccggcgg

SEQ ID NO: 2856457 - RNA, 17 nt, Mycobacterium avium subsp. paratuberculosis
ggcugugggccagcagc

SEQ ID NO: 2856458 - RNA, 15 nt, Mycobacterium avium subsp. paratuberculosis
ggcugugggcgcagg

SEQ ID NO: 2856459 - RNA, 18 nt, Mycobacterium avium subsp. paratuberculosis
ggcugugggcgcagggcc

SEQ ID NO: 2856460 - RNA, 16 nt, Mycobacterium avium subsp. paratuberculosis
ggcuguugaccacggc

SEQ ID NO: 2856461 - RNA, 14 nt, Mycobacterium avium subsp. paratuberculosis
ggcuuccaccugcg

SEQ ID NO: 2856462 - RNA, 22 nt, Mycobacterium avium subsp. paratuberculosis
ggcuucccacgccuugcgguug

SEQ ID NO: 2856463 - RNA, 23 nt, Mycobacterium avium subsp. paratuberculosis
ggcuuccgccgagacggcguggc

SEQ ID NO: 2856464 - RNA, 14 nt, Mycobacterium avium subsp. paratuberculosis
ggcuuccgcggacg

SEQ ID NO: 2856465 - RNA, 15 nt, Mycobacterium avium subsp. paratuberculosis
ggcuuccuccucggc

SEQ ID NO: 2856466 - RNA, 19 nt, Mycobacterium avium subsp. paratuberculosis
ggcuucgaacgcccgcacc

SEQ ID NO: 2856467 - RNA, 22 nt, Mycobacterium avium subsp. paratuberculosis
ggcuucgaacgcccgcaccacg

SEQ ID NO: 2856468 - RNA, 23 nt, Mycobacterium avium subsp. paratuberculosis
ggcuucguaacacccucggucgg

SEQ ID NO: 2856469 - RNA, 19 nt, Mycobacterium avium subsp. paratuberculosis
ggcuugaaaguccgccgac

SEQ ID NO: 2856470 - RNA, 20 nt, Mycobacterium avium subsp. paratuberculosis
ggcuugaaaguccgccgaca

SEQ ID NO: 2856471 - RNA, 20 nt, Mycobacterium avium subsp. paratuberculosis
ggcuugaccggcucgccggc

SEQ ID NO: 2856472 - RNA, 16 nt, Mycobacterium avium subsp. paratuberculosis
ggcuugagcgccagcg

SEQ ID NO: 2856473 - RNA, 16 nt, Mycobacterium avium subsp. paratuberculosis
ggcuugaucucgaccu

SEQ ID NO: 2856474 - RNA, 23 nt, Mycobacterium avium subsp. paratuberculosis
ggcuugaugaugcugucggugaa

SEQ ID NO: 2856475 - RNA, 23 nt, Mycobacterium avium subsp. paratuberculosis
ggcuugccccggucccggggcuc

SEQ ID NO: 2856476 - RNA, 22 nt, Mycobacterium avium subsp. paratuberculosis
ggcuugcgcagguugucggcca

SEQ ID NO: 2856477 - RNA, 14 nt, Mycobacterium avium subsp. paratuberculosis
ggcuugcgcucggc

SEQ ID NO: 2856478 - RNA, 16 nt, Mycobacterium avium subsp. paratuberculosis
ggcuugcugcgguagg

SEQ ID NO: 2856479 - RNA, 13 nt, Mycobacterium avium subsp. paratuberculosis
ggcuuggccacca

SEQ ID NO: 2856480 - RNA, 15 nt, Mycobacterium avium subsp. paratuberculosis
ggcuuggcccgccgc

SEQ ID NO: 2856481 - RNA, 21 nt, Mycobacterium avium subsp. paratuberculosis
ggcuuggcccgccgccggcgc

SEQ ID NO: 2856482 - RNA, 19 nt, Mycobacterium avium subsp. paratuberculosis
ggcuugggcccgucggcgu

SEQ ID NO: 2856483 - RNA, 16 nt, Mycobacterium avium subsp. paratuberculosis
ggcuuggguguggcgu

SEQ ID NO: 2856484 - RNA, 20 nt, Mycobacterium avium subsp. paratuberculosis
ggcuuggugggcgccggcgu

SEQ ID NO: 2856485 - RNA, 18 nt, Mycobacterium avium subsp. paratuberculosis
ggcuuuagaaggccgccu

SEQ ID NO: 2856486 - RNA, 17 nt, Mycobacterium avium subsp. paratuberculosis
ggcuuucggcgccaaca

SEQ ID NO: 2856487 - RNA, 19 nt, Mycobacterium avium subsp. paratuberculosis
ggcuuuugcgucugcucgc

SEQ ID NO: 2856488 - RNA, 20 nt, Mycobacterium avium subsp. paratuberculosis
ggcuuuugcgucugcucgcg

SEQ ID NO: 2856489 - RNA, 14 nt, Mycobacterium avium subsp. paratuberculosis
gggaaacgcgucgc

SEQ ID NO: 2856490 - RNA, 15 nt, Mycobacterium avium subsp. paratuberculosis
gggaaaggcagcagc

SEQ ID NO: 2856491 - RNA, 16 nt, Mycobacterium avium subsp. paratuberculosis
gggaaaggcagcagcc

SEQ ID NO: 2856492 - RNA, 13 nt, Mycobacterium avium subsp. paratuberculosis
gggaacaacgcgc

SEQ ID NO: 2856493 - RNA, 14 nt, Mycobacterium avium subsp. paratuberculosis
gggaacaccacguc

SEQ ID NO: 2856494 - RNA, 12 nt, Mycobacterium avium subsp. paratuberculosis
gggaacagccag

SEQ ID NO: 2856495 - RNA, 22 nt, Mycobacterium avium subsp. paratuberculosis
gggaacagcgggaacaccacgu

SEQ ID NO: 2856496 - RNA, 17 nt, Mycobacterium avium subsp. paratuberculosis
gggagcacucgauggcg

SEQ ID NO: 2856497 - RNA, 21 nt, Mycobacterium avium subsp. paratuberculosis
gggagcacucgauggcggcga

SEQ ID NO: 2856498 - RNA, 18 nt, Mycobacterium avium subsp. paratuberculosis
gggagcaggacgguggcc

SEQ ID NO: 2856499 - RNA, 20 nt, Mycobacterium avium subsp. paratuberculosis
gggagccgaagaucaccgcg

SEQ ID NO: 2856500 - RNA, 13 nt, Mycobacterium avium subsp. paratuberculosis
gggagccggcggc

SEQ ID NO: 2856501 - RNA, 14 nt, Mycobacterium avium subsp. paratuberculosis
gggagccggcggcg

SEQ ID NO: 2856502 - RNA, 18 nt, Mycobacterium avium subsp. paratuberculosis
gggagccgugcagcgccc

SEQ ID NO: 2856503 - RNA, 21 nt, Mycobacterium avium subsp. paratuberculosis
gggagccgugcagcgcccagc

SEQ ID NO: 2856504 - RNA, 22 nt, Mycobacterium avium subsp. paratuberculosis
gggagccgugcagcgcccagcc

SEQ ID NO: 2856505 - RNA, 20 nt, Mycobacterium avium subsp. paratuberculosis
gggagcgcuggucggcgaac

SEQ ID NO: 2856506 - RNA, 18 nt, Mycobacterium avium subsp. paratuberculosis
gggagcggcccaacacgc

SEQ ID NO: 2856507 - RNA, 13 nt, Mycobacterium avium subsp. paratuberculosis
gggagcggcggag

SEQ ID NO: 2856508 - RNA, 22 nt, Mycobacterium avium subsp. paratuberculosis
gggaggaagugcacgccgaggc

SEQ ID NO: 2856509 - RNA, 11 nt, Mycobacterium avium subsp. paratuberculosis
gggaggacagc

SEQ ID NO: 2856510 - RNA, 16 nt, Mycobacterium avium subsp. paratuberculosis
gggaggacagcgcggu

SEQ ID NO: 2856511 - RNA, 14 nt, Mycobacterium avium subsp. paratuberculosis
gggaggacagggag

SEQ ID NO: 2856512 - RNA, 13 nt, Mycobacterium avium subsp. paratuberculosis
gggaggccagcac

SEQ ID NO: 2856513 - RNA, 19 nt, Mycobacterium avium subsp. paratuberculosis
gggaggcccagcccgccgc

SEQ ID NO: 2856514 - RNA, 12 nt, Mycobacterium avium subsp. paratuberculosis
gggaggcggcgg

SEQ ID NO: 2856515 - RNA, 16 nt, Mycobacterium avium subsp. paratuberculosis
gggagggucgguggcc

SEQ ID NO: 2856516 - RNA, 21 nt, Mycobacterium avium subsp. paratuberculosis
gggagguacucgagcgugccc

SEQ ID NO: 2856517 - RNA, 18 nt, Mycobacterium avium subsp. paratuberculosis
gggaggucgucgcgucca

SEQ ID NO: 2856518 - RNA, 20 nt, Mycobacterium avium subsp. paratuberculosis
gggaggucgucgcguccagc

SEQ ID NO: 2856519 - RNA, 17 nt, Mycobacterium avium subsp. paratuberculosis
gggagucgggcccgccc

SEQ ID NO: 2856520 - RNA, 22 nt, Mycobacterium avium subsp. paratuberculosis
gggagugacguugagcacccgg

SEQ ID NO: 2856521 - RNA, 13 nt, Mycobacterium avium subsp. paratuberculosis
gggagugcggccc

SEQ ID NO: 2856522 - RNA, 15 nt, Mycobacterium avium subsp. paratuberculosis
gggagugcggcccac

SEQ ID NO: 2856523 - RNA, 14 nt, Mycobacterium avium subsp. paratuberculosis
gggauaccgcgacc

SEQ ID NO: 2856524 - RNA, 16 nt, Mycobacterium avium subsp. paratuberculosis
gggauagagcaccgcg

SEQ ID NO: 2856525 - RNA, 21 nt, Mycobacterium avium subsp. paratuberculosis
gggauagauguugcggccggc

SEQ ID NO: 2856526 - RNA, 18 nt, Mycobacterium avium subsp. paratuberculosis
gggauagccgagcggcgc

SEQ ID NO: 2856527 - RNA, 20 nt, Mycobacterium avium subsp. paratuberculosis
gggauagccgagcggcgcca

SEQ ID NO: 2856528 - RNA, 14 nt, Mycobacterium avium subsp. paratuberculosis
gggauagggcguga

SEQ ID NO: 2856529 - RNA, 18 nt, Mycobacterium avium subsp. paratuberculosis
gggauaguucgccgccgc

SEQ ID NO: 2856530 - RNA, 23 nt, Mycobacterium avium subsp. paratuberculosis
gggauaguucgccgccgccagca

SEQ ID NO: 2856531 - RNA, 15 nt, Mycobacterium avium subsp. paratuberculosis
gggaucacgucggcg

SEQ ID NO: 2856532 - RNA, 22 nt, Mycobacterium avium subsp. paratuberculosis
gggaucagccguaccgauccgc

SEQ ID NO: 2856533 - RNA, 19 nt, Mycobacterium avium subsp. paratuberculosis
gggaucagcuccucgcgga

SEQ ID NO: 2856534 - RNA, 14 nt, Mycobacterium avium subsp. paratuberculosis
gggaucaggaugac

SEQ ID NO: 2856535 - RNA, 20 nt, Mycobacterium avium subsp. paratuberculosis
gggaucaggaugacgccgcg

SEQ ID NO: 2856536 - RNA, 22 nt, Mycobacterium avium subsp. paratuberculosis
gggaucaggaugacgccgcggu

SEQ ID NO: 2856537 - RNA, 20 nt, Mycobacterium avium subsp. paratuberculosis
gggaucagguagaggcuguc

SEQ ID NO: 2856538 - RNA, 14 nt, Mycobacterium avium subsp. paratuberculosis
gggauccagcggcg

SEQ ID NO: 2856539 - RNA, 23 nt, Mycobacterium avium subsp. paratuberculosis
gggauccaggaauucgggcaccc

SEQ ID NO: 2856540 - RNA, 22 nt, Mycobacterium avium subsp. paratuberculosis
gggaucccgaaaccgucgacca

SEQ ID NO: 2856541 - RNA, 20 nt, Mycobacterium avium subsp. paratuberculosis
gggauccggauugccgggca

SEQ ID NO: 2856542 - RNA, 22 nt, Mycobacterium avium subsp. paratuberculosis
gggauccucgccgcgggccagc

SEQ ID NO: 2856543 - RNA, 12 nt, Mycobacterium avium subsp. paratuberculosis
gggaucgccgaa

SEQ ID NO: 2856544 - RNA, 16 nt, Mycobacterium avium subsp. paratuberculosis
gggaucggaccgcacc

SEQ ID NO: 2856545 - RNA, 18 nt, Mycobacterium avium subsp. paratuberculosis
gggaucggaccgcaccac

SEQ ID NO: 2856546 - RNA, 13 nt, Mycobacterium avium subsp. paratuberculosis
gggaucggccggc

SEQ ID NO: 2856547 - RNA, 14 nt, Mycobacterium avium subsp. paratuberculosis
gggaucggccggcg

SEQ ID NO: 2856548 - RNA, 16 nt, Mycobacterium avium subsp. paratuberculosis
gggaucggccggcgag

SEQ ID NO: 2856549 - RNA, 15 nt, Mycobacterium avium subsp. paratuberculosis
gggaucggcgcccac

SEQ ID NO: 2856550 - RNA, 23 nt, Mycobacterium avium subsp. paratuberculosis
gggaucggcgcccaccgcggcgc

SEQ ID NO: 2856551 - RNA, 12 nt, Mycobacterium avium subsp. paratuberculosis
gggaucggcggc

SEQ ID NO: 2856552 - RNA, 14 nt, Mycobacterium avium subsp. paratuberculosis
gggaucggcggcgg

SEQ ID NO: 2856553 - RNA, 14 nt, Mycobacterium avium subsp. paratuberculosis
gggaucggcggggc

SEQ ID NO: 2856554 - RNA, 15 nt, Mycobacterium avium subsp. paratuberculosis
gggaucggcggggcg

SEQ ID NO: 2856555 - RNA, 22 nt, Mycobacterium avium subsp. paratuberculosis
gggaucggcuuggugggcgccg

SEQ ID NO: 2856556 - RNA, 13 nt, Mycobacterium avium subsp. paratuberculosis
gggaucgucgccg

SEQ ID NO: 2856557 - RNA, 21 nt, Mycobacterium avium subsp. paratuberculosis
gggaucugcgccgccuccggg

SEQ ID NO: 2856558 - RNA, 18 nt, Mycobacterium avium subsp. paratuberculosis
gggaucugcggugagcgu

SEQ ID NO: 2856559 - RNA, 22 nt, Mycobacterium avium subsp. paratuberculosis
gggaugaacucgugcggcgccg

SEQ ID NO: 2856560 - RNA, 15 nt, Mycobacterium avium subsp. paratuberculosis
gggaugacaaccauc

SEQ ID NO: 2856561 - RNA, 19 nt, Mycobacterium avium subsp. paratuberculosis
gggaugacaccgcggacca

SEQ ID NO: 2856562 - RNA, 13 nt, Mycobacterium avium subsp. paratuberculosis
gggaugaucggcg

SEQ ID NO: 2856563 - RNA, 15 nt, Mycobacterium avium subsp. paratuberculosis
gggaugaucggcgcc

SEQ ID NO: 2856564 - RNA, 16 nt, Mycobacterium avium subsp. paratuberculosis
gggaugaucggcgccu

SEQ ID NO: 2856565 - RNA, 14 nt, Mycobacterium avium subsp. paratuberculosis
gggaugcccggggg

SEQ ID NO: 2856566 - RNA, 15 nt, Mycobacterium avium subsp. paratuberculosis
gggaugccgagcagc

SEQ ID NO: 2856567 - RNA, 17 nt, Mycobacterium avium subsp. paratuberculosis
gggaugccugcccgcgc

SEQ ID NO: 2856568 - RNA, 13 nt, Mycobacterium avium subsp. paratuberculosis
gggaugcgcaucc

SEQ ID NO: 2856569 - RNA, 14 nt, Mycobacterium avium subsp. paratuberculosis
gggaugcgccaccg

SEQ ID NO: 2856570 - RNA, 21 nt, Mycobacterium avium subsp. paratuberculosis
gggaugcgccaccgacaccac

SEQ ID NO: 2856571 - RNA, 16 nt, Mycobacterium avium subsp. paratuberculosis
gggaugcggucgauca

SEQ ID NO: 2856572 - RNA, 13 nt, Mycobacterium avium subsp. paratuberculosis
gggauggacgacg

SEQ ID NO: 2856573 - RNA, 12 nt, Mycobacterium avium subsp. paratuberculosis
gggauggcggcg

SEQ ID NO: 2856574 - RNA, 14 nt, Mycobacterium avium subsp. paratuberculosis
gggaugggugguca

SEQ ID NO: 2856575 - RNA, 22 nt, Mycobacterium avium subsp. paratuberculosis
gggauggucgauccacucccgc

SEQ ID NO: 2856576 - RNA, 16 nt, Mycobacterium avium subsp. paratuberculosis
gggauggugaccagcg

SEQ ID NO: 2856577 - RNA, 13 nt, Mycobacterium avium subsp. paratuberculosis
gggauggugagcc

SEQ ID NO: 2856578 - RNA, 23 nt, Mycobacterium avium subsp. paratuberculosis
gggauggugagcccgaugcuggc

SEQ ID NO: 2856579 - RNA, 21 nt, Mycobacterium avium subsp. paratuberculosis
gggauggugcgccgggucgcg

SEQ ID NO: 2856580 - RNA, 18 nt, Mycobacterium avium subsp. paratuberculosis
gggaugucgugggcgugc

SEQ ID NO: 2856581 - RNA, 21 nt, Mycobacterium avium subsp. paratuberculosis
gggcagcagcaucggucccag

SEQ ID NO: 2856582 - RNA, 16 nt, Mycobacterium avium subsp. paratuberculosis
gggcagcagcgcccac

SEQ ID NO: 2856583 - RNA, 12 nt, Mycobacterium avium subsp. paratuberculosis
gggcagccagcc

SEQ ID NO: 2856584 - RNA, 15 nt, Mycobacterium avium subsp. paratuberculosis
gggcagccagcccgc

SEQ ID NO: 2856585 - RNA, 13 nt, Mycobacterium avium subsp. paratuberculosis
gggcagcccaggu

SEQ ID NO: 2856586 - RNA, 12 nt, Mycobacterium avium subsp. paratuberculosis
gggcagccccag

SEQ ID NO: 2856587 - RNA, 18 nt, Mycobacterium avium subsp. paratuberculosis
gggcagccccagcgagca

SEQ ID NO: 2856588 - RNA, 19 nt, Mycobacterium avium subsp. paratuberculosis
gggcagcccgaacagccgg

SEQ ID NO: 2856589 - RNA, 18 nt, Mycobacterium avium subsp. paratuberculosis
gggcagcccgagcaacug

SEQ ID NO: 2856590 - RNA, 13 nt, Mycobacterium avium subsp. paratuberculosis
gggcagcccgccg

SEQ ID NO: 2856591 - RNA, 16 nt, Mycobacterium avium subsp. paratuberculosis
gggcagcccgccgcgg

SEQ ID NO: 2856592 - RNA, 12 nt, Mycobacterium avium subsp. paratuberculosis
gggcagcccggg

SEQ ID NO: 2856593 - RNA, 22 nt, Mycobacterium avium subsp. paratuberculosis
gggcagccgcuuggccgggcgg

SEQ ID NO: 2856594 - RNA, 12 nt, Mycobacterium avium subsp. paratuberculosis
gggcagccggcg

SEQ ID NO: 2856595 - RNA, 13 nt, Mycobacterium avium subsp. paratuberculosis
gggcagccggcgc

SEQ ID NO: 2856596 - RNA, 20 nt, Mycobacterium avium subsp. paratuberculosis
gggcagccgucgaugccggc

SEQ ID NO: 2856597 - RNA, 23 nt, Mycobacterium avium subsp. paratuberculosis
gggcagcgaauacaccguccagc

SEQ ID NO: 2856598 - RNA, 14 nt, Mycobacterium avium subsp. paratuberculosis
gggcagcgccacca

SEQ ID NO: 2856599 - RNA, 17 nt, Mycobacterium avium subsp. paratuberculosis
gggcagcgccucgagca

SEQ ID NO: 2856600 - RNA, 14 nt, Mycobacterium avium subsp. paratuberculosis
gggcagcgcgacca

SEQ ID NO: 2856601 - RNA, 16 nt, Mycobacterium avium subsp. paratuberculosis
gggcagcgcgaccagc

SEQ ID NO: 2856602 - RNA, 20 nt, Mycobacterium avium subsp. paratuberculosis
gggcagcgcgaccagcccgg

SEQ ID NO: 2856603 - RNA, 21 nt, Mycobacterium avium subsp. paratuberculosis
gggcagcgcgaccagcccggc

SEQ ID NO: 2856604 - RNA, 19 nt, Mycobacterium avium subsp. paratuberculosis
gggcagcgcgauccgcgcg

SEQ ID NO: 2856605 - RNA, 13 nt, Mycobacterium avium subsp. paratuberculosis
gggcagcgcggcc

SEQ ID NO: 2856606 - RNA, 16 nt, Mycobacterium avium subsp. paratuberculosis
gggcagcgcggccagc

SEQ ID NO: 2856607 - RNA, 18 nt, Mycobacterium avium subsp. paratuberculosis
gggcagcgcggccagcac

SEQ ID NO: 2856608 - RNA, 11 nt, Mycobacterium avium subsp. paratuberculosis
gggcagcgcgu

SEQ ID NO: 2856609 - RNA, 14 nt, Mycobacterium avium subsp. paratuberculosis
gggcagcgcgugcu

SEQ ID NO: 2856610 - RNA, 22 nt, Mycobacterium avium subsp. paratuberculosis
gggcagcggccccacguugauc

SEQ ID NO: 2856611 - RNA, 21 nt, Mycobacterium avium subsp. paratuberculosis
gggcagcggugucaccgacgc

SEQ ID NO: 2856612 - RNA, 13 nt, Mycobacterium avium subsp. paratuberculosis
gggcagcucggcg

SEQ ID NO: 2856613 - RNA, 14 nt, Mycobacterium avium subsp. paratuberculosis
gggcagcucggcgg

SEQ ID NO: 2856614 - RNA, 15 nt, Mycobacterium avium subsp. paratuberculosis
gggcagcucggcggg

SEQ ID NO: 2856615 - RNA, 13 nt, Mycobacterium avium subsp. paratuberculosis
gggcagcucgucg

SEQ ID NO: 2856616 - RNA, 18 nt, Mycobacterium avium subsp. paratuberculosis
gggcagcucgucggcgcg

SEQ ID NO: 2856617 - RNA, 22 nt, Mycobacterium avium subsp. paratuberculosis
gggcagcucgucggcgcgccac

SEQ ID NO: 2856618 - RNA, 23 nt, Mycobacterium avium subsp. paratuberculosis
gggcagcucgucggcgcgccacc

SEQ ID NO: 2856619 - RNA, 23 nt, Mycobacterium avium subsp. paratuberculosis
gggcagcugauagcccgccgcgg

SEQ ID NO: 2856620 - RNA, 20 nt, Mycobacterium avium subsp. paratuberculosis
gggcagcuuccgccucggcg

SEQ ID NO: 2856621 - RNA, 23 nt, Mycobacterium avium subsp. paratuberculosis
gggcagcuuccgccucggcgagg

SEQ ID NO: 2856622 - RNA, 16 nt, Mycobacterium avium subsp. paratuberculosis
gggcaggauggucagc

SEQ ID NO: 2856623 - RNA, 16 nt, Mycobacterium avium subsp. paratuberculosis
gggcaggcacgguguc

SEQ ID NO: 2856624 - RNA, 15 nt, Mycobacterium avium subsp. paratuberculosis
gggcaggcccgagcc

SEQ ID NO: 2856625 - RNA, 23 nt, Mycobacterium avium subsp. paratuberculosis
gggcaggccgggauagagcaccg

SEQ ID NO: 2856626 - RNA, 17 nt, Mycobacterium avium subsp. paratuberculosis
gggcaggccggugcugu

SEQ ID NO: 2856627 - RNA, 17 nt, Mycobacterium avium subsp. paratuberculosis
gggcaggcggcgcgcca

SEQ ID NO: 2856628 - RNA, 21 nt, Mycobacterium avium subsp. paratuberculosis
gggcaggcggcgcgccagcgu

SEQ ID NO: 2856629 - RNA, 21 nt, Mycobacterium avium subsp. paratuberculosis
gggcagggggacgaaccagug

SEQ ID NO: 2856630 - RNA, 17 nt, Mycobacterium avium subsp. paratuberculosis
gggcagggucgcggagc

SEQ ID NO: 2856631 - RNA, 19 nt, Mycobacterium avium subsp. paratuberculosis
gggcagggucgcggagcgg

SEQ ID NO: 2856632 - RNA, 21 nt, Mycobacterium avium subsp. paratuberculosis
gggcagggugaccgaggccgc

SEQ ID NO: 2856633 - RNA, 20 nt, Mycobacterium avium subsp. paratuberculosis
gggcagguucaucaccacga

SEQ ID NO: 2856634 - RNA, 20 nt, Mycobacterium avium subsp. paratuberculosis
gggcagugcacgacgaccgc

SEQ ID NO: 2856635 - RNA, 20 nt, Mycobacterium avium subsp. paratuberculosis
gggcaguuccuugcgcagca

SEQ ID NO: 2856636 - RNA, 13 nt, Mycobacterium avium subsp. paratuberculosis
gggcaguugccgg

SEQ ID NO: 2856637 - RNA, 18 nt, Mycobacterium avium subsp. paratuberculosis
gggcaguugccggccauc

SEQ ID NO: 2856638 - RNA, 17 nt, Mycobacterium avium subsp. paratuberculosis
gggcauacugcuugccg

SEQ ID NO: 2856639 - RNA, 21 nt, Mycobacterium avium subsp. paratuberculosis
gggcaucaucgcuacacccca

SEQ ID NO: 2856640 - RNA, 19 nt, Mycobacterium avium subsp. paratuberculosis
gggcaucaucggcacgccg

SEQ ID NO: 2856641 - RNA, 20 nt, Mycobacterium avium subsp. paratuberculosis
gggcaucaucggcacgccgg

SEQ ID NO: 2856642 - RNA, 14 nt, Mycobacterium avium subsp. paratuberculosis
gggcaucccgccga

SEQ ID NO: 2856643 - RNA, 15 nt, Mycobacterium avium subsp. paratuberculosis
gggcaucccgccgaa

SEQ ID NO: 2856644 - RNA, 16 nt, Mycobacterium avium subsp. paratuberculosis
gggcauccgcucgccg

SEQ ID NO: 2856645 - RNA, 17 nt, Mycobacterium avium subsp. paratuberculosis
gggcauccgggaggcca

SEQ ID NO: 2856646 - RNA, 17 nt, Mycobacterium avium subsp. paratuberculosis
gggcauccgggccgccg

SEQ ID NO: 2856647 - RNA, 12 nt, Mycobacterium avium subsp. paratuberculosis
gggcaucgcagc

SEQ ID NO: 2856648 - RNA, 20 nt, Mycobacterium avium subsp. paratuberculosis
gggcaucggcuggucggcgg

SEQ ID NO: 2856649 - RNA, 22 nt, Mycobacterium avium subsp. paratuberculosis
gggcaucggcuggucggcggcc

SEQ ID NO: 2856650 - RNA, 20 nt, Mycobacterium avium subsp. paratuberculosis
gggcaugaaccaggccgcgc

SEQ ID NO: 2856651 - RNA, 21 nt, Mycobacterium avium subsp. paratuberculosis
gggcaugaaccaggccgcgcu

SEQ ID NO: 2856652 - RNA, 22 nt, Mycobacterium avium subsp. paratuberculosis
gggcaugaaccaggccgcgcug

SEQ ID NO: 2856653 - RNA, 16 nt, Mycobacterium avium subsp. paratuberculosis
gggcaugccggccggc

SEQ ID NO: 2856654 - RNA, 17 nt, Mycobacterium avium subsp. paratuberculosis
gggcaugccggccggca

SEQ ID NO: 2856655 - RNA, 18 nt, Mycobacterium avium subsp. paratuberculosis
gggcaugccguucagcgc

SEQ ID NO: 2856656 - RNA, 20 nt, Mycobacterium avium subsp. paratuberculosis
gggcaugccguucagcgcgg

SEQ ID NO: 2856657 - RNA, 22 nt, Mycobacterium avium subsp. paratuberculosis
gggcaugccguucagcgcggcc

SEQ ID NO: 2856658 - RNA, 24 nt, Mycobacterium avium subsp. paratuberculosis
gggcaugccguucagcgcggccac

SEQ ID NO: 2856659 - RNA, 12 nt, Mycobacterium avium subsp. paratuberculosis
gggcauggcugg

SEQ ID NO: 2856660 - RNA, 13 nt, Mycobacterium avium subsp. paratuberculosis
gggcaugucgccg

SEQ ID NO: 2856661 - RNA, 22 nt, Mycobacterium avium subsp. paratuberculosis
gggccaaaucgcuugcgccgca

SEQ ID NO: 2856662 - RNA, 23 nt, Mycobacterium avium subsp. paratuberculosis
gggccaaaucgcuugcgccgcag

SEQ ID NO: 2856663 - RNA, 24 nt, Mycobacterium avium subsp. paratuberculosis
gggccaaaucgcuugcgccgcagc

SEQ ID NO: 2856664 - RNA, 15 nt, Mycobacterium avium subsp. paratuberculosis
gggccaacuccggcg

SEQ ID NO: 2856665 - RNA, 12 nt, Mycobacterium avium subsp. paratuberculosis
gggccaggcgcg

SEQ ID NO: 2856666 - RNA, 16 nt, Mycobacterium avium subsp. paratuberculosis
gggccaggcgcgcgcu

SEQ ID NO: 2856667 - RNA, 21 nt, Mycobacterium avium subsp. paratuberculosis
gggccaggcgcgcgcuggugc

SEQ ID NO: 2856668 - RNA, 15 nt, Mycobacterium avium subsp. paratuberculosis
gggccaggcggguga

SEQ ID NO: 2856669 - RNA, 17 nt, Mycobacterium avium subsp. paratuberculosis
gggccagggcgaggacg

SEQ ID NO: 2856670 - RNA, 15 nt, Mycobacterium avium subsp. paratuberculosis
gggccaggucgguga

SEQ ID NO: 2856671 - RNA, 16 nt, Mycobacterium avium subsp. paratuberculosis
gggccaggucggugac

SEQ ID NO: 2856672 - RNA, 17 nt, Mycobacterium avium subsp. paratuberculosis
gggccaggucggugaca

SEQ ID NO: 2856673 - RNA, 18 nt, Mycobacterium avium subsp. paratuberculosis
gggccaggugugcccgcc

SEQ ID NO: 2856674 - RNA, 15 nt, Mycobacterium avium subsp. paratuberculosis
gggccagguucaggc

SEQ ID NO: 2856675 - RNA, 18 nt, Mycobacterium avium subsp. paratuberculosis
gggccagguucaggcccg

SEQ ID NO: 2856676 - RNA, 22 nt, Mycobacterium avium subsp. paratuberculosis
gggccagguucaggcccgcgcc

SEQ ID NO: 2856677 - RNA, 14 nt, Mycobacterium avium subsp. paratuberculosis
gggccagucgccgc

SEQ ID NO: 2856678 - RNA, 17 nt, Mycobacterium avium subsp. paratuberculosis
gggccauauuucgugaa

SEQ ID NO: 2856679 - RNA, 22 nt, Mycobacterium avium subsp. paratuberculosis
gggccauauuucgugaagccgg

SEQ ID NO: 2856680 - RNA, 22 nt, Mycobacterium avium subsp. paratuberculosis
gggccaucaccuccuuggccag

SEQ ID NO: 2856681 - RNA, 23 nt, Mycobacterium avium subsp. paratuberculosis
gggccaucaccuccuuggccagg

SEQ ID NO: 2856682 - RNA, 22 nt, Mycobacterium avium subsp. paratuberculosis
gggccaucccggggacaccggg

SEQ ID NO: 2856683 - RNA, 13 nt, Mycobacterium avium subsp. paratuberculosis
gggccauccggcc

SEQ ID NO: 2856684 - RNA, 14 nt, Mycobacterium avium subsp. paratuberculosis
gggccauccggccg

SEQ ID NO: 2856685 - RNA, 15 nt, Mycobacterium avium subsp. paratuberculosis
gggccauccggccgg

SEQ ID NO: 2856686 - RNA, 16 nt, Mycobacterium avium subsp. paratuberculosis
gggccauccggccggc

SEQ ID NO: 2856687 - RNA, 15 nt, Mycobacterium avium subsp. paratuberculosis
gggccaucgacucca

SEQ ID NO: 2856688 - RNA, 22 nt, Mycobacterium avium subsp. paratuberculosis
gggccaucgacuccagcaccgg

SEQ ID NO: 2856689 - RNA, 16 nt, Mycobacterium avium subsp. paratuberculosis
gggccaugccggccug

SEQ ID NO: 2856690 - RNA, 17 nt, Mycobacterium avium subsp. paratuberculosis
gggccaugccggccuga

SEQ ID NO: 2856691 - RNA, 13 nt, Mycobacterium avium subsp. paratuberculosis
gggcccacagcag

SEQ ID NO: 2856692 - RNA, 17 nt, Mycobacterium avium subsp. paratuberculosis
gggcccacagcagccgc

SEQ ID NO: 2856693 - RNA, 18 nt, Mycobacterium avium subsp. paratuberculosis
gggcccacagcagccgca

SEQ ID NO: 2856694 - RNA, 14 nt, Mycobacterium avium subsp. paratuberculosis
gggcccaccagguc

SEQ ID NO: 2856695 - RNA, 13 nt, Mycobacterium avium subsp. paratuberculosis
gggcccaccgcca

SEQ ID NO: 2856696 - RNA, 16 nt, Mycobacterium avium subsp. paratuberculosis
gggcccaccgccacca

SEQ ID NO: 2856697 - RNA, 17 nt, Mycobacterium avium subsp. paratuberculosis
gggcccaccgccaccag

SEQ ID NO: 2856698 - RNA, 18 nt, Mycobacterium avium subsp. paratuberculosis
gggcccacgcucgacgcg

SEQ ID NO: 2856699 - RNA, 15 nt, Mycobacterium avium subsp. paratuberculosis
gggcccagcagccug

SEQ ID NO: 2856700 - RNA, 13 nt, Mycobacterium avium subsp. paratuberculosis
gggcccagcgcga

SEQ ID NO: 2856701 - RNA, 10 nt, Mycobacterium avium subsp. paratuberculosis
gggccccggc

SEQ ID NO: 2856702 - RNA, 13 nt, Mycobacterium avium subsp. paratuberculosis
gggccccggcauc

SEQ ID NO: 2856703 - RNA, 15 nt, Mycobacterium avium subsp. paratuberculosis
gggccccggcaucga

SEQ ID NO: 2856704 - RNA, 15 nt, Mycobacterium avium subsp. paratuberculosis
gggccccuccagccg

SEQ ID NO: 2856705 - RNA, 22 nt, Mycobacterium avium subsp. paratuberculosis
gggccccuccagccgccggucc

SEQ ID NO: 2856706 - RNA, 17 nt, Mycobacterium avium subsp. paratuberculosis
gggcccgauggcggccu

SEQ ID NO: 2856707 - RNA, 19 nt, Mycobacterium avium subsp. paratuberculosis
gggcccgauggcggccugc

SEQ ID NO: 2856708 - RNA, 20 nt, Mycobacterium avium subsp. paratuberculosis
gggcccgauggcggccugca

SEQ ID NO: 2856709 - RNA, 15 nt, Mycobacterium avium subsp. paratuberculosis
gggcccgcagccgcu

SEQ ID NO: 2856710 - RNA, 15 nt, Mycobacterium avium subsp. paratuberculosis
gggcccgcagcucgg

SEQ ID NO: 2856711 - RNA, 18 nt, Mycobacterium avium subsp. paratuberculosis
gggcccgcagcucggagu

SEQ ID NO: 2856712 - RNA, 19 nt, Mycobacterium avium subsp. paratuberculosis
gggcccgcccgcagcggcg

SEQ ID NO: 2856713 - RNA, 21 nt, Mycobacterium avium subsp. paratuberculosis
gggcccgcccgcagcggcggu

SEQ ID NO: 2856714 - RNA, 12 nt, Mycobacterium avium subsp. paratuberculosis
gggcccgccggu

SEQ ID NO: 2856715 - RNA, 23 nt, Mycobacterium avium subsp. paratuberculosis
gggcccgccguagcgccggcaac

SEQ ID NO: 2856716 - RNA, 16 nt, Mycobacterium avium subsp. paratuberculosis
gggcccgccgucgacc

SEQ ID NO: 2856717 - RNA, 17 nt, Mycobacterium avium subsp. paratuberculosis
gggcccgccgucgacca

SEQ ID NO: 2856718 - RNA, 12 nt, Mycobacterium avium subsp. paratuberculosis
gggcccgcgcac

SEQ ID NO: 2856719 - RNA, 14 nt, Mycobacterium avium subsp. paratuberculosis
gggcccgcgcaccg

SEQ ID NO: 2856720 - RNA, 17 nt, Mycobacterium avium subsp. paratuberculosis
gggcccgcgcaccguca

SEQ ID NO: 2856721 - RNA, 13 nt, Mycobacterium avium subsp. paratuberculosis
gggcccgcgcauc

SEQ ID NO: 2856722 - RNA, 14 nt, Mycobacterium avium subsp. paratuberculosis
gggcccgcgcaucc

SEQ ID NO: 2856723 - RNA, 13 nt, Mycobacterium avium subsp. paratuberculosis
gggcccgcgccgc

SEQ ID NO: 2856724 - RNA, 14 nt, Mycobacterium avium subsp. paratuberculosis
gggcccgcgcggcg

SEQ ID NO: 2856725 - RNA, 16 nt, Mycobacterium avium subsp. paratuberculosis
gggcccgcgcggcggu

SEQ ID NO: 2856726 - RNA, 19 nt, Mycobacterium avium subsp. paratuberculosis
gggcccgcgcggcgguguc

SEQ ID NO: 2856727 - RNA, 20 nt, Mycobacterium avium subsp. paratuberculosis
gggcccgcucaccugcggcc

SEQ ID NO: 2856728 - RNA, 15 nt, Mycobacterium avium subsp. paratuberculosis
gggcccgcugcagcg

SEQ ID NO: 2856729 - RNA, 15 nt, Mycobacterium avium subsp. paratuberculosis
gggcccggcccggcg

SEQ ID NO: 2856730 - RNA, 13 nt, Mycobacterium avium subsp. paratuberculosis
gggcccggcccgu

SEQ ID NO: 2856731 - RNA, 13 nt, Mycobacterium avium subsp. paratuberculosis
gggcccggccgcc

SEQ ID NO: 2856732 - RNA, 15 nt, Mycobacterium avium subsp. paratuberculosis
gggcccggccgccag

SEQ ID NO: 2856733 - RNA, 16 nt, Mycobacterium avium subsp. paratuberculosis
gggcccggccgccagc

SEQ ID NO: 2856734 - RNA, 16 nt, Mycobacterium avium subsp. paratuberculosis
gggcccggcgccaaca

SEQ ID NO: 2856735 - RNA, 15 nt, Mycobacterium avium subsp. paratuberculosis
gggcccgggcgcuga

SEQ ID NO: 2856736 - RNA, 18 nt, Mycobacterium avium subsp. paratuberculosis
gggcccggguggcgucca

SEQ ID NO: 2856737 - RNA, 14 nt, Mycobacterium avium subsp. paratuberculosis
gggcccggucccgc

SEQ ID NO: 2856738 - RNA, 19 nt, Mycobacterium avium subsp. paratuberculosis
gggcccggucccgcgucac

SEQ ID NO: 2856739 - RNA, 19 nt, Mycobacterium avium subsp. paratuberculosis
gggcccggucgucgccgga

SEQ ID NO: 2856740 - RNA, 13 nt, Mycobacterium avium subsp. paratuberculosis
gggcccgucccca

SEQ ID NO: 2856741 - RNA, 20 nt, Mycobacterium avium subsp. paratuberculosis
gggcccgucgccggcgcgca

SEQ ID NO: 2856742 - RNA, 21 nt, Mycobacterium avium subsp. paratuberculosis
gggcccgucgccggcgcgcag

SEQ ID NO: 2856743 - RNA, 14 nt, Mycobacterium avium subsp. paratuberculosis
gggcccuccgcggc

SEQ ID NO: 2856744 - RNA, 21 nt, Mycobacterium avium subsp. paratuberculosis
gggccgaaaaaccugcggugc

SEQ ID NO: 2856745 - RNA, 22 nt, Mycobacterium avium subsp. paratuberculosis
gggccgaaccggaagaucagca

SEQ ID NO: 2856746 - RNA, 13 nt, Mycobacterium avium subsp. paratuberculosis
gggccgaacgaug

SEQ ID NO: 2856747 - RNA, 22 nt, Mycobacterium avium subsp. paratuberculosis
gggccgaacgauggugugcagc

SEQ ID NO: 2856748 - RNA, 23 nt, Mycobacterium avium subsp. paratuberculosis
gggccgaacugccgaugcugagc

SEQ ID NO: 2856749 - RNA, 20 nt, Mycobacterium avium subsp. paratuberculosis
gggccgaagccgacaccggg

SEQ ID NO: 2856750 - RNA, 13 nt, Mycobacterium avium subsp. paratuberculosis
gggccggcgccgg

SEQ ID NO: 2856751 - RNA, 21 nt, Mycobacterium avium subsp. paratuberculosis
gggccggcgcggugggcggcg

SEQ ID NO: 2856752 - RNA, 13 nt, Mycobacterium avium subsp. paratuberculosis
gggccggcggcca

SEQ ID NO: 2856753 - RNA, 13 nt, Mycobacterium avium subsp. paratuberculosis
gggccggcggcgg

SEQ ID NO: 2856754 - RNA, 16 nt, Mycobacterium avium subsp. paratuberculosis
gggccggcgggggcgc

SEQ ID NO: 2856755 - RNA, 20 nt, Mycobacterium avium subsp. paratuberculosis
gggccggcggugauccgccc

SEQ ID NO: 2856756 - RNA, 14 nt, Mycobacterium avium subsp. paratuberculosis
gggccggcguccag

SEQ ID NO: 2856757 - RNA, 18 nt, Mycobacterium avium subsp. paratuberculosis
gggccggcgugcugggcc

SEQ ID NO: 2856758 - RNA, 23 nt, Mycobacterium avium subsp. paratuberculosis
gggccggcgugcugggccacgau

SEQ ID NO: 2856759 - RNA, 13 nt, Mycobacterium avium subsp. paratuberculosis
gggccgggcaccg

SEQ ID NO: 2856760 - RNA, 15 nt, Mycobacterium avium subsp. paratuberculosis
gggccgggcaccgcg

SEQ ID NO: 2856761 - RNA, 12 nt, Mycobacterium avium subsp. paratuberculosis
gggccgggcacg

SEQ ID NO: 2856762 - RNA, 19 nt, Mycobacterium avium subsp. paratuberculosis
gggccgggcacgucgacgc

SEQ ID NO: 2856763 - RNA, 12 nt, Mycobacterium avium subsp. paratuberculosis
gggccgggcggg

SEQ ID NO: 2856764 - RNA, 19 nt, Mycobacterium avium subsp. paratuberculosis
gggccgggcgggcacccca

SEQ ID NO: 2856765 - RNA, 20 nt, Mycobacterium avium subsp. paratuberculosis
gggccgggcgugcccggcgc

SEQ ID NO: 2856766 - RNA, 21 nt, Mycobacterium avium subsp. paratuberculosis
gggccgggcgugcccggcgca

SEQ ID NO: 2856767 - RNA, 13 nt, Mycobacterium avium subsp. paratuberculosis
gggccgggcuacc

SEQ ID NO: 2856768 - RNA, 12 nt, Mycobacterium avium subsp. paratuberculosis
gggccgggggcg

SEQ ID NO: 2856769 - RNA, 13 nt, Mycobacterium avium subsp. paratuberculosis
gggccgggggcgg

SEQ ID NO: 2856770 - RNA, 17 nt, Mycobacterium avium subsp. paratuberculosis
gggccggguccacgccg

SEQ ID NO: 2856771 - RNA, 20 nt, Mycobacterium avium subsp. paratuberculosis
gggccgggucgaacggcaac

SEQ ID NO: 2856772 - RNA, 22 nt, Mycobacterium avium subsp. paratuberculosis
gggccgguaaaacuggccagca

SEQ ID NO: 2856773 - RNA, 14 nt, Mycobacterium avium subsp. paratuberculosis
gggccggucaccgg

SEQ ID NO: 2856774 - RNA, 16 nt, Mycobacterium avium subsp. paratuberculosis
gggccggucagcgcga

SEQ ID NO: 2856775 - RNA, 24 nt, Mycobacterium avium subsp. paratuberculosis
gggccggucagcgcgacaucgccg

SEQ ID NO: 2856776 - RNA, 18 nt, Mycobacterium avium subsp. paratuberculosis
gggccgguccccggcgac

SEQ ID NO: 2856777 - RNA, 19 nt, Mycobacterium avium subsp. paratuberculosis
gggccggucggucggccgc

SEQ ID NO: 2856778 - RNA, 20 nt, Mycobacterium avium subsp. paratuberculosis
gggccggucggucggccgca

SEQ ID NO: 2856779 - RNA, 18 nt, Mycobacterium avium subsp. paratuberculosis
gggccggugcagcacgug

SEQ ID NO: 2856780 - RNA, 12 nt, Mycobacterium avium subsp. paratuberculosis
gggccggugcgu

SEQ ID NO: 2856781 - RNA, 21 nt, Mycobacterium avium subsp. paratuberculosis
gggccggugcguccgccggcg

SEQ ID NO: 2856782 - RNA, 23 nt, Mycobacterium avium subsp. paratuberculosis
gggccggugcguccgccggcggu

SEQ ID NO: 2856783 - RNA, 17 nt, Mycobacterium avium subsp. paratuberculosis
gggccguaucggccccg

SEQ ID NO: 2856784 - RNA, 23 nt, Mycobacterium avium subsp. paratuberculosis
gggccgucacaggccgccugcgg

SEQ ID NO: 2856785 - RNA, 15 nt, Mycobacterium avium subsp. paratuberculosis
gggccguccgccggc

SEQ ID NO: 2856786 - RNA, 12 nt, Mycobacterium avium subsp. paratuberculosis
gggccgucgccc

SEQ ID NO: 2856787 - RNA, 13 nt, Mycobacterium avium subsp. paratuberculosis
gggccgucgcccg

SEQ ID NO: 2856788 - RNA, 15 nt, Mycobacterium avium subsp. paratuberculosis
gggccgucgcccgga

SEQ ID NO: 2856789 - RNA, 19 nt, Mycobacterium avium subsp. paratuberculosis
gggccguucagcgggcggu

SEQ ID NO: 2856790 - RNA, 15 nt, Mycobacterium avium subsp. paratuberculosis
gggccguugcggcca

SEQ ID NO: 2856791 - RNA, 16 nt, Mycobacterium avium subsp. paratuberculosis
gggccuaggaccccgg

SEQ ID NO: 2856792 - RNA, 20 nt, Mycobacterium avium subsp. paratuberculosis
gggccuaggaccccggcugc

SEQ ID NO: 2856793 - RNA, 19 nt, Mycobacterium avium subsp. paratuberculosis
gggccuagugccgggggcc

SEQ ID NO: 2856794 - RNA, 19 nt, Mycobacterium avium subsp. paratuberculosis
gggccuaugccgcgugaca

SEQ ID NO: 2856795 - RNA, 12 nt, Mycobacterium avium subsp. paratuberculosis
gggccuccacca

SEQ ID NO: 2856796 - RNA, 13 nt, Mycobacterium avium subsp. paratuberculosis
gggccuccaccag

SEQ ID NO: 2856797 - RNA, 14 nt, Mycobacterium avium subsp. paratuberculosis
gggccuccaccagc

SEQ ID NO: 2856798 - RNA, 15 nt, Mycobacterium avium subsp. paratuberculosis
gggccuccaccagcg

SEQ ID NO: 2856799 - RNA, 17 nt, Mycobacterium avium subsp. paratuberculosis
gggccuccaccagcggc

SEQ ID NO: 2856800 - RNA, 12 nt, Mycobacterium avium subsp. paratuberculosis
gggccuccagcc

SEQ ID NO: 2856801 - RNA, 20 nt, Mycobacterium avium subsp. paratuberculosis
gggccuccggcggcagauag

SEQ ID NO: 2856802 - RNA, 23 nt, Mycobacterium avium subsp. paratuberculosis
gggccucgccguugccggcccgc

SEQ ID NO: 2856803 - RNA, 24 nt, Mycobacterium avium subsp. paratuberculosis
gggccucgccguugccggcccgca

SEQ ID NO: 2856804 - RNA, 12 nt, Mycobacterium avium subsp. paratuberculosis
gggccucgucca

SEQ ID NO: 2856805 - RNA, 23 nt, Mycobacterium avium subsp. paratuberculosis
gggccucguccagggacuccggg

SEQ ID NO: 2856806 - RNA, 17 nt, Mycobacterium avium subsp. paratuberculosis
gggccugaccaaggaca

SEQ ID NO: 2856807 - RNA, 16 nt, Mycobacterium avium subsp. paratuberculosis
gggccugcagcaccag

SEQ ID NO: 2856808 - RNA, 17 nt, Mycobacterium avium subsp. paratuberculosis
gggccugcagcaccagg

SEQ ID NO: 2856809 - RNA, 16 nt, Mycobacterium avium subsp. paratuberculosis
gggccugcgcgccgau

SEQ ID NO: 2856810 - RNA, 17 nt, Mycobacterium avium subsp. paratuberculosis
gggccugcggcgcggcc

SEQ ID NO: 2856811 - RNA, 14 nt, Mycobacterium avium subsp. paratuberculosis
gggccugcggcggc

SEQ ID NO: 2856812 - RNA, 20 nt, Mycobacterium avium subsp. paratuberculosis
gggccugcggcggccgcagc

SEQ ID NO: 2856813 - RNA, 21 nt, Mycobacterium avium subsp. paratuberculosis
gggccugcgggacgccguuga

SEQ ID NO: 2856814 - RNA, 20 nt, Mycobacterium avium subsp. paratuberculosis
gggccugcucgcuugccagc

SEQ ID NO: 2856815 - RNA, 21 nt, Mycobacterium avium subsp. paratuberculosis
gggccugcucgcuugccagcc

SEQ ID NO: 2856816 - RNA, 22 nt, Mycobacterium avium subsp. paratuberculosis
gggccugcucgcuugccagccg

SEQ ID NO: 2856817 - RNA, 16 nt, Mycobacterium avium subsp. paratuberculosis
gggccuggcgcuccag

SEQ ID NO: 2856818 - RNA, 21 nt, Mycobacterium avium subsp. paratuberculosis
gggccuucacgcuggccucca

SEQ ID NO: 2856819 - RNA, 17 nt, Mycobacterium avium subsp. paratuberculosis
gggccuucuuggcggcg

SEQ ID NO: 2856820 - RNA, 19 nt, Mycobacterium avium subsp. paratuberculosis
gggccuucuuggcggcggc

SEQ ID NO: 2856821 - RNA, 22 nt, Mycobacterium avium subsp. paratuberculosis
gggccuucuuggcggcggccuu

SEQ ID NO: 2856822 - RNA, 17 nt, Mycobacterium avium subsp. paratuberculosis
gggccuugacggccugg

SEQ ID NO: 2856823 - RNA, 14 nt, Mycobacterium avium subsp. paratuberculosis
gggccuugagcacc

SEQ ID NO: 2856824 - RNA, 15 nt, Mycobacterium avium subsp. paratuberculosis
gggccuugagcaccg

SEQ ID NO: 2856825 - RNA, 16 nt, Mycobacterium avium subsp. paratuberculosis
gggccuugagcaccgc

SEQ ID NO: 2856826 - RNA, 15 nt, Mycobacterium avium subsp. paratuberculosis
gggccuuggccaacg

SEQ ID NO: 2856827 - RNA, 18 nt, Mycobacterium avium subsp. paratuberculosis
gggcgaacagcagcaccc

SEQ ID NO: 2856828 - RNA, 22 nt, Mycobacterium avium subsp. paratuberculosis
gggcgaaccacgggucgcugug

SEQ ID NO: 2856829 - RNA, 15 nt, Mycobacterium avium subsp. paratuberculosis
gggcgaacccggcgc

SEQ ID NO: 2856830 - RNA, 22 nt, Mycobacterium avium subsp. paratuberculosis
gggcgaacgaggccgacgugga

SEQ ID NO: 2856831 - RNA, 15 nt, Mycobacterium avium subsp. paratuberculosis
gggcgaacggcaacg

SEQ ID NO: 2856832 - RNA, 20 nt, Mycobacterium avium subsp. paratuberculosis
gggcgaacggcaacggcggc

SEQ ID NO: 2856833 - RNA, 15 nt, Mycobacterium avium subsp. paratuberculosis
gggcgaagccgaggu

SEQ ID NO: 2856834 - RNA, 21 nt, Mycobacterium avium subsp. paratuberculosis
gggcgaagcgaaagacguuga

SEQ ID NO: 2856835 - RNA, 18 nt, Mycobacterium avium subsp. paratuberculosis
gggcgccgcggcgccgcc

SEQ ID NO: 2856836 - RNA, 20 nt, Mycobacterium avium subsp. paratuberculosis
gggcgccggccggcgcgugc

SEQ ID NO: 2856837 - RNA, 21 nt, Mycobacterium avium subsp. paratuberculosis
gggcgccggccggcgcgugcg

SEQ ID NO: 2856838 - RNA, 12 nt, Mycobacterium avium subsp. paratuberculosis
gggcgccggcgc

SEQ ID NO: 2856839 - RNA, 14 nt, Mycobacterium avium subsp. paratuberculosis
gggcgccggcguca

SEQ ID NO: 2856840 - RNA, 13 nt, Mycobacterium avium subsp. paratuberculosis
gggcgccggcugc

SEQ ID NO: 2856841 - RNA, 17 nt, Mycobacterium avium subsp. paratuberculosis
gggcgccgggucauccc

SEQ ID NO: 2856842 - RNA, 13 nt, Mycobacterium avium subsp. paratuberculosis
gggcgccgguauc

SEQ ID NO: 2856843 - RNA, 21 nt, Mycobacterium avium subsp. paratuberculosis
gggcgccgguaucgagcacca

SEQ ID NO: 2856844 - RNA, 22 nt, Mycobacterium avium subsp. paratuberculosis
gggcgccgguaucgagcaccag

SEQ ID NO: 2856845 - RNA, 14 nt, Mycobacterium avium subsp. paratuberculosis
gggcgccggucggc

SEQ ID NO: 2856846 - RNA, 21 nt, Mycobacterium avium subsp. paratuberculosis
gggcgccguaggccgcgcuga

SEQ ID NO: 2856847 - RNA, 15 nt, Mycobacterium avium subsp. paratuberculosis
gggcgccgucgccgc

SEQ ID NO: 2856848 - RNA, 16 nt, Mycobacterium avium subsp. paratuberculosis
gggcgccgucgccgcc

SEQ ID NO: 2856849 - RNA, 13 nt, Mycobacterium avium subsp. paratuberculosis
gggcgccgucggc

SEQ ID NO: 2856850 - RNA, 15 nt, Mycobacterium avium subsp. paratuberculosis
gggcgccgucggcgg

SEQ ID NO: 2856851 - RNA, 23 nt, Mycobacterium avium subsp. paratuberculosis
gggcgccuaccggguggccagca

SEQ ID NO: 2856852 - RNA, 20 nt, Mycobacterium avium subsp. paratuberculosis
gggcgccucgaacaucggca

SEQ ID NO: 2856853 - RNA, 22 nt, Mycobacterium avium subsp. paratuberculosis
gggcgccucgaacaucggcacg

SEQ ID NO: 2856854 - RNA, 13 nt, Mycobacterium avium subsp. paratuberculosis
gggcgccucgccg

SEQ ID NO: 2856855 - RNA, 14 nt, Mycobacterium avium subsp. paratuberculosis
gggcgccucgccga

SEQ ID NO: 2856856 - RNA, 15 nt, Mycobacterium avium subsp. paratuberculosis
gggcgccucgccgac

SEQ ID NO: 2856857 - RNA, 17 nt, Mycobacterium avium subsp. paratuberculosis
gggcgccucgccgaccu

SEQ ID NO: 2856858 - RNA, 21 nt, Mycobacterium avium subsp. paratuberculosis
gggcgcgaagguggcgccggu

SEQ ID NO: 2856859 - RNA, 14 nt, Mycobacterium avium subsp. paratuberculosis
gggcgcgacgguca

SEQ ID NO: 2856860 - RNA, 15 nt, Mycobacterium avium subsp. paratuberculosis
gggcgcgaggcgcga

SEQ ID NO: 2856861 - RNA, 21 nt, Mycobacterium avium subsp. paratuberculosis
gggcgcgaucaggcugccgcu

SEQ ID NO: 2856862 - RNA, 16 nt, Mycobacterium avium subsp. paratuberculosis
gggcgcgaucggcagg

SEQ ID NO: 2856863 - RNA, 23 nt, Mycobacterium avium subsp. paratuberculosis
gggcgcgaucggcaggucgucga

SEQ ID NO: 2856864 - RNA, 13 nt, Mycobacterium avium subsp. paratuberculosis
gggcgcgcaccgg

SEQ ID NO: 2856865 - RNA, 15 nt, Mycobacterium avium subsp. paratuberculosis
gggcgcgcagcacca

SEQ ID NO: 2856866 - RNA, 16 nt, Mycobacterium avium subsp. paratuberculosis
gggcgcgcagcaccag

SEQ ID NO: 2856867 - RNA, 14 nt, Mycobacterium avium subsp. paratuberculosis
gggcgcgcagccac

SEQ ID NO: 2856868 - RNA, 23 nt, Mycobacterium avium subsp. paratuberculosis
gggcgcgcagccacgagcccagc

SEQ ID NO: 2856869 - RNA, 12 nt, Mycobacterium avium subsp. paratuberculosis
gggcgcgcagcg

SEQ ID NO: 2856870 - RNA, 20 nt, Mycobacterium avium subsp. paratuberculosis
gggcgcgcaucugcucggcg

SEQ ID NO: 2856871 - RNA, 12 nt, Mycobacterium avium subsp. paratuberculosis
gggcgcgcccac

SEQ ID NO: 2856872 - RNA, 13 nt, Mycobacterium avium subsp. paratuberculosis
gggcgcgcccacc

SEQ ID NO: 2856873 - RNA, 23 nt, Mycobacterium avium subsp. paratuberculosis
gggcgcgcgccgcccccgcggcg

SEQ ID NO: 2856874 - RNA, 13 nt, Mycobacterium avium subsp. paratuberculosis
gggcgcgcgccgg

SEQ ID NO: 2856875 - RNA, 17 nt, Mycobacterium avium subsp. paratuberculosis
gggcgcgcgccgggauc

SEQ ID NO: 2856876 - RNA, 15 nt, Mycobacterium avium subsp. paratuberculosis
gggcgcgcgcgccac

SEQ ID NO: 2856877 - RNA, 16 nt, Mycobacterium avium subsp. paratuberculosis
gggcgcgcgcgccacg

SEQ ID NO: 2856878 - RNA, 18 nt, Mycobacterium avium subsp. paratuberculosis
gggcgcgcugggcuaacg

SEQ ID NO: 2856879 - RNA, 18 nt, Mycobacterium avium subsp. paratuberculosis
gggcgcgcugucgacgcg

SEQ ID NO: 2856880 - RNA, 12 nt, Mycobacterium avium subsp. paratuberculosis
gggcgcggcggc

SEQ ID NO: 2856881 - RNA, 19 nt, Mycobacterium avium subsp. paratuberculosis
gggcgcggcggcaaccagc

SEQ ID NO: 2856882 - RNA, 19 nt, Mycobacterium avium subsp. paratuberculosis
gggcgcggcguagccgccg

SEQ ID NO: 2856883 - RNA, 12 nt, Mycobacterium avium subsp. paratuberculosis
gggcgcgggauc

SEQ ID NO: 2856884 - RNA, 18 nt, Mycobacterium avium subsp. paratuberculosis
gggcgcgggcggcagguc

SEQ ID NO: 2856885 - RNA, 19 nt, Mycobacterium avium subsp. paratuberculosis
gggcgcguccgcgggcggg

SEQ ID NO: 2856886 - RNA, 21 nt, Mycobacterium avium subsp. paratuberculosis
gggcgcgucguagccggcacg

SEQ ID NO: 2856887 - RNA, 19 nt, Mycobacterium avium subsp. paratuberculosis
gggcgcgugcacaccggcc

SEQ ID NO: 2856888 - RNA, 19 nt, Mycobacterium avium subsp. paratuberculosis
gggcgcguuggccggcugg

SEQ ID NO: 2856889 - RNA, 20 nt, Mycobacterium avium subsp. paratuberculosis
gggcgcuagcugcgccggcu

SEQ ID NO: 2856890 - RNA, 18 nt, Mycobacterium avium subsp. paratuberculosis
gggcgcucaucaggcggc

SEQ ID NO: 2856891 - RNA, 22 nt, Mycobacterium avium subsp. paratuberculosis
gggcgcucaucaggcggccggc

SEQ ID NO: 2856892 - RNA, 13 nt, Mycobacterium avium subsp. paratuberculosis
gggcgcucgaugg

SEQ ID NO: 2856893 - RNA, 13 nt, Mycobacterium avium subsp. paratuberculosis
gggcgcucggcca

SEQ ID NO: 2856894 - RNA, 14 nt, Mycobacterium avium subsp. paratuberculosis
gggcgcucggccag

SEQ ID NO: 2856895 - RNA, 15 nt, Mycobacterium avium subsp. paratuberculosis
gggcgcucggccagc

SEQ ID NO: 2856896 - RNA, 16 nt, Mycobacterium avium subsp. paratuberculosis
gggcgcucggccagca

SEQ ID NO: 2856897 - RNA, 18 nt, Mycobacterium avium subsp. paratuberculosis
gggcgcugccguccuucu

SEQ ID NO: 2856898 - RNA, 14 nt, Mycobacterium avium subsp. paratuberculosis
gggcgcugcgcggu

SEQ ID NO: 2856899 - RNA, 23 nt, Mycobacterium avium subsp. paratuberculosis
gggcgcugcgcgguggcgcgggu

SEQ ID NO: 2856900 - RNA, 19 nt, Mycobacterium avium subsp. paratuberculosis
gggcggauccccgcgcugg

SEQ ID NO: 2856901 - RNA, 17 nt, Mycobacterium avium subsp. paratuberculosis
gggcggaugucggugug

SEQ ID NO: 2856902 - RNA, 19 nt, Mycobacterium avium subsp. paratuberculosis
gggcggaugucggugugga

SEQ ID NO: 2856903 - RNA, 23 nt, Mycobacterium avium subsp. paratuberculosis
gggcggaugugccuggcccagac

SEQ ID NO: 2856904 - RNA, 17 nt, Mycobacterium avium subsp. paratuberculosis
gggcggauuggugccga

SEQ ID NO: 2856905 - RNA, 20 nt, Mycobacterium avium subsp. paratuberculosis
gggcggauuggugccgauca

SEQ ID NO: 2856906 - RNA, 21 nt, Mycobacterium avium subsp. paratuberculosis
gggcggauuggugccgaucac

SEQ ID NO: 2856907 - RNA, 16 nt, Mycobacterium avium subsp. paratuberculosis
gggcggcaagccgagu

SEQ ID NO: 2856908 - RNA, 22 nt, Mycobacterium avium subsp. paratuberculosis
gggcggcaccgcugccggccga

SEQ ID NO: 2856909 - RNA, 16 nt, Mycobacterium avium subsp. paratuberculosis
gggcggcagccaggua

SEQ ID NO: 2856910 - RNA, 17 nt, Mycobacterium avium subsp. paratuberculosis
gggcggcagggccagca

SEQ ID NO: 2856911 - RNA, 18 nt, Mycobacterium avium subsp. paratuberculosis
gggcggcagggccagcac

SEQ ID NO: 2856912 - RNA, 20 nt, Mycobacterium avium subsp. paratuberculosis
gggcggcagggccagcacca

SEQ ID NO: 2856913 - RNA, 18 nt, Mycobacterium avium subsp. paratuberculosis
gggcggcaggucggcggg

SEQ ID NO: 2856914 - RNA, 20 nt, Mycobacterium avium subsp. paratuberculosis
gggcggcagguggggcagca

SEQ ID NO: 2856915 - RNA, 15 nt, Mycobacterium avium subsp. paratuberculosis
gggcggcaucgcgcc

SEQ ID NO: 2856916 - RNA, 17 nt, Mycobacterium avium subsp. paratuberculosis
gggcggcaucgcgccgc

SEQ ID NO: 2856917 - RNA, 18 nt, Mycobacterium avium subsp. paratuberculosis
gggcggcaucgcgcgcgg

SEQ ID NO: 2856918 - RNA, 19 nt, Mycobacterium avium subsp. paratuberculosis
gggcggcaucgcgcgcggc

SEQ ID NO: 2856919 - RNA, 20 nt, Mycobacterium avium subsp. paratuberculosis
gggcggcaucgcgcgcggcg

SEQ ID NO: 2856920 - RNA, 21 nt, Mycobacterium avium subsp. paratuberculosis
gggcgugaucuguucggcggc

SEQ ID NO: 2856921 - RNA, 22 nt, Mycobacterium avium subsp. paratuberculosis
gggcgugaucuguucggcggcg

SEQ ID NO: 2856922 - RNA, 20 nt, Mycobacterium avium subsp. paratuberculosis
gggcgugcaggccgcgggug

SEQ ID NO: 2856923 - RNA, 18 nt, Mycobacterium avium subsp. paratuberculosis
gggcgugcccggcgccga

SEQ ID NO: 2856924 - RNA, 19 nt, Mycobacterium avium subsp. paratuberculosis
gggcgugcccggcgccgac

SEQ ID NO: 2856925 - RNA, 22 nt, Mycobacterium avium subsp. paratuberculosis
gggcgugccggacaccggcacg

SEQ ID NO: 2856926 - RNA, 13 nt, Mycobacterium avium subsp. paratuberculosis
gggcgugccggcg

SEQ ID NO: 2856927 - RNA, 16 nt, Mycobacterium avium subsp. paratuberculosis
gggcgugccggcggcg

SEQ ID NO: 2856928 - RNA, 14 nt, Mycobacterium avium subsp. paratuberculosis
gggcgugcgcggcc

SEQ ID NO: 2856929 - RNA, 15 nt, Mycobacterium avium subsp. paratuberculosis
gggcgugcggccgca

SEQ ID NO: 2856930 - RNA, 19 nt, Mycobacterium avium subsp. paratuberculosis
gggcgugcgguuggcccgc

SEQ ID NO: 2856931 - RNA, 12 nt, Mycobacterium avium subsp. paratuberculosis
gggcguggaacg

SEQ ID NO: 2856932 - RNA, 14 nt, Mycobacterium avium subsp. paratuberculosis
gggcguggcggaag

SEQ ID NO: 2856933 - RNA, 19 nt, Mycobacterium avium subsp. paratuberculosis
gggcguggcgggccaggcg

SEQ ID NO: 2856934 - RNA, 14 nt, Mycobacterium avium subsp. paratuberculosis
gggcguggcgucgg

SEQ ID NO: 2856935 - RNA, 19 nt, Mycobacterium avium subsp. paratuberculosis
gggcguggcgucggugaac

SEQ ID NO: 2856936 - RNA, 12 nt, Mycobacterium avium subsp. paratuberculosis
gggcguggcuug

SEQ ID NO: 2856937 - RNA, 14 nt, Mycobacterium avium subsp. paratuberculosis
gggcguggucgccg

SEQ ID NO: 2856938 - RNA, 12 nt, Mycobacterium avium subsp. paratuberculosis
gggcguggugcg

SEQ ID NO: 2856939 - RNA, 17 nt, Mycobacterium avium subsp. paratuberculosis
gggcguguagccugcgg

SEQ ID NO: 2856940 - RNA, 19 nt, Mycobacterium avium subsp. paratuberculosis
gggcguguagccugcggcc

SEQ ID NO: 2856941 - RNA, 22 nt, Mycobacterium avium subsp. paratuberculosis
gggcguguagccugcggccugc

SEQ ID NO: 2856942 - RNA, 21 nt, Mycobacterium avium subsp. paratuberculosis
gggcguguugcaggcggaccu

SEQ ID NO: 2856943 - RNA, 15 nt, Mycobacterium avium subsp. paratuberculosis
gggcguucgacgucc

SEQ ID NO: 2856944 - RNA, 20 nt, Mycobacterium avium subsp. paratuberculosis
gggcguucgacguccaccgg

SEQ ID NO: 2856945 - RNA, 21 nt, Mycobacterium avium subsp. paratuberculosis
gggcguucgacguccaccgga

SEQ ID NO: 2856946 - RNA, 15 nt, Mycobacterium avium subsp. paratuberculosis
gggcguucgcggugg

SEQ ID NO: 2856947 - RNA, 22 nt, Mycobacterium avium subsp. paratuberculosis
gggcguugcgccgcgagcgcag

SEQ ID NO: 2856948 - RNA, 22 nt, Mycobacterium avium subsp. paratuberculosis
gggcguugcgcucuguuggccg

SEQ ID NO: 2856949 - RNA, 18 nt, Mycobacterium avium subsp. paratuberculosis
gggcguugguugcggccc

SEQ ID NO: 2856950 - RNA, 19 nt, Mycobacterium avium subsp. paratuberculosis
gggcguugguugcggcccc

SEQ ID NO: 2856951 - RNA, 20 nt, Mycobacterium avium subsp. paratuberculosis
gggcguugguugcggccccg

SEQ ID NO: 2856952 - RNA, 20 nt, Mycobacterium avium subsp. paratuberculosis
gggcguuguaauaccugcgu

SEQ ID NO: 2856953 - RNA, 21 nt, Mycobacterium avium subsp. paratuberculosis
gggcguuugccacugagcgca

SEQ ID NO: 2856954 - RNA, 18 nt, Mycobacterium avium subsp. paratuberculosis
gggcuaaccaccggugac

SEQ ID NO: 2856955 - RNA, 16 nt, Mycobacterium avium subsp. paratuberculosis
gggcuaacgcuggucg

SEQ ID NO: 2856956 - RNA, 22 nt, Mycobacterium avium subsp. paratuberculosis
gggcuaacgcuggucgaacgcc

SEQ ID NO: 2856957 - RNA, 22 nt, Mycobacterium avium subsp. paratuberculosis
gggcuaagucguugcccgccag

SEQ ID NO: 2856958 - RNA, 23 nt, Mycobacterium avium subsp. paratuberculosis
gggcuaagucguugcccgccagc

SEQ ID NO: 2856959 - RNA, 17 nt, Mycobacterium avium subsp. paratuberculosis
gggcuagacgcgcacca

SEQ ID NO: 2856960 - RNA, 18 nt, Mycobacterium avium subsp. paratuberculosis
gggcuaggcucggcagcc

SEQ ID NO: 2856961 - RNA, 12 nt, Mycobacterium avium subsp. paratuberculosis
gggcucaccaca

SEQ ID NO: 2856962 - RNA, 15 nt, Mycobacterium avium subsp. paratuberculosis
gggcucagcaccaca

SEQ ID NO: 2856963 - RNA, 12 nt, Mycobacterium avium subsp. paratuberculosis
gggcucagccga

SEQ ID NO: 2856964 - RNA, 22 nt, Mycobacterium avium subsp. paratuberculosis
gggcucagccgaagccggcgca

SEQ ID NO: 2856965 - RNA, 11 nt, Mycobacterium avium subsp. paratuberculosis
gggcuccagcg

SEQ ID NO: 2856966 - RNA, 21 nt, Mycobacterium avium subsp. paratuberculosis
gggcuccagcggguccagccg

SEQ ID NO: 2856967 - RNA, 21 nt, Mycobacterium avium subsp. paratuberculosis
gggcucccagucccagcacag

SEQ ID NO: 2856968 - RNA, 15 nt, Mycobacterium avium subsp. paratuberculosis
gggcucccgcucgcc

SEQ ID NO: 2856969 - RNA, 12 nt, Mycobacterium avium subsp. paratuberculosis
gggcuccgcgcu

SEQ ID NO: 2856970 - RNA, 14 nt, Mycobacterium avium subsp. paratuberculosis
gggcuccgcgcuga

SEQ ID NO: 2856971 - RNA, 16 nt, Mycobacterium avium subsp. paratuberculosis
gggcuccucgaccacg

SEQ ID NO: 2856972 - RNA, 21 nt, Mycobacterium avium subsp. paratuberculosis
gggcucgaacaacccggccgc

SEQ ID NO: 2856973 - RNA, 23 nt, Mycobacterium avium subsp. paratuberculosis
gggcucgaacaacccggccgcga

SEQ ID NO: 2856974 - RNA, 14 nt, Mycobacterium avium subsp. paratuberculosis
gggcucgagcccca

SEQ ID NO: 2856975 - RNA, 17 nt, Mycobacterium avium subsp. paratuberculosis
gggcucgagggcggcga

SEQ ID NO: 2856976 - RNA, 20 nt, Mycobacterium avium subsp. paratuberculosis
gggcucgagggcggcgaccu

SEQ ID NO: 2856977 - RNA, 18 nt, Mycobacterium avium subsp. paratuberculosis
gggcucgagugccggcag

SEQ ID NO: 2856978 - RNA, 22 nt, Mycobacterium avium subsp. paratuberculosis
gggcucgagugccggcagcccg

SEQ ID NO: 2856979 - RNA, 14 nt, Mycobacterium avium subsp. paratuberculosis
gggcucgcccgggc

SEQ ID NO: 2856980 - RNA, 16 nt, Mycobacterium avium subsp. paratuberculosis
gggcucgcggccugcg

SEQ ID NO: 2856981 - RNA, 18 nt, Mycobacterium avium subsp. paratuberculosis
gggcucgcggccugcggg

SEQ ID NO: 2856982 - RNA, 21 nt, Mycobacterium avium subsp. paratuberculosis
gggcucggaguugcgcagccg

SEQ ID NO: 2856983 - RNA, 18 nt, Mycobacterium avium subsp. paratuberculosis
gggcucggccaucccggu

SEQ ID NO: 2856984 - RNA, 14 nt, Mycobacterium avium subsp. paratuberculosis
gggcucggccgccg

SEQ ID NO: 2856985 - RNA, 15 nt, Mycobacterium avium subsp. paratuberculosis
gggcucggccgccga

SEQ ID NO: 2856986 - RNA, 18 nt, Mycobacterium avium subsp. paratuberculosis
gggcucggccgccgacac

SEQ ID NO: 2856987 - RNA, 23 nt, Mycobacterium avium subsp. paratuberculosis
gggcucggccgccgacaccacca

SEQ ID NO: 2856988 - RNA, 16 nt, Mycobacterium avium subsp. paratuberculosis
gggcucggcgccgacc

SEQ ID NO: 2856989 - RNA, 17 nt, Mycobacterium avium subsp. paratuberculosis
gggcucggcgccgaccu

SEQ ID NO: 2856990 - RNA, 16 nt, Mycobacterium avium subsp. paratuberculosis
gggcucggcguacagg

SEQ ID NO: 2856991 - RNA, 14 nt, Mycobacterium avium subsp. paratuberculosis
gggcucggcgucgu

SEQ ID NO: 2856992 - RNA, 22 nt, Mycobacterium avium subsp. paratuberculosis
gggcucggucaccccggagauc

SEQ ID NO: 2856993 - RNA, 23 nt, Mycobacterium avium subsp. paratuberculosis
gggcucguccucgaaagccgcug

SEQ ID NO: 2856994 - RNA, 14 nt, Mycobacterium avium subsp. paratuberculosis
gggcucgugcagcc

SEQ ID NO: 2856995 - RNA, 16 nt, Mycobacterium avium subsp. paratuberculosis
gggcucgugcagccgg

SEQ ID NO: 2856996 - RNA, 18 nt, Mycobacterium avium subsp. paratuberculosis
gggcucgugcagccggcg

SEQ ID NO: 2856997 - RNA, 14 nt, Mycobacterium avium subsp. paratuberculosis
gggcugaccgccag

SEQ ID NO: 2856998 - RNA, 16 nt, Mycobacterium avium subsp. paratuberculosis
gggcugaccucgccgc

SEQ ID NO: 2856999 - RNA, 17 nt, Mycobacterium avium subsp. paratuberculosis
gggcugcaccagggcgu

SEQ ID NO: 2857000 - RNA, 19 nt, Mycobacterium avium subsp. paratuberculosis
gggcugcaccagggcgucg

SEQ ID NO: 2857001 - RNA, 19 nt, Mycobacterium avium subsp. paratuberculosis
gggcugcacgcugcgcacc

SEQ ID NO: 2857002 - RNA, 11 nt, Mycobacterium avium subsp. paratuberculosis
gggcugcagca

SEQ ID NO: 2857003 - RNA, 16 nt, Mycobacterium avium subsp. paratuberculosis
gggcugcagcgacugg

SEQ ID NO: 2857004 - RNA, 15 nt, Mycobacterium avium subsp. paratuberculosis
gggcugcagggccgg

SEQ ID NO: 2857005 - RNA, 18 nt, Mycobacterium avium subsp. paratuberculosis
ggggcagcagcgcccacc

SEQ ID NO: 2857006 - RNA, 22 nt, Mycobacterium avium subsp. paratuberculosis
ggggcagccgucgaugccggcg

SEQ ID NO: 2857007 - RNA, 23 nt, Mycobacterium avium subsp. paratuberculosis
ggggcagccgucgaugccggcga

SEQ ID NO: 2857008 - RNA, 20 nt, Mycobacterium avium subsp. paratuberculosis
ggggcagcugauagcccgcc

SEQ ID NO: 2857009 - RNA, 21 nt, Mycobacterium avium subsp. paratuberculosis
ggggcaggaacgccuuggugc

SEQ ID NO: 2857010 - RNA, 22 nt, Mycobacterium avium subsp. paratuberculosis
ggggcagggaauucagccugcc

SEQ ID NO: 2857011 - RNA, 16 nt, Mycobacterium avium subsp. paratuberculosis
ggggcagggcauccgg

SEQ ID NO: 2857012 - RNA, 17 nt, Mycobacterium avium subsp. paratuberculosis
ggggcaucccugacacg

SEQ ID NO: 2857013 - RNA, 13 nt, Mycobacterium avium subsp. paratuberculosis
ggggcaucgcagc

SEQ ID NO: 2857014 - RNA, 19 nt, Mycobacterium avium subsp. paratuberculosis
ggggcaucgcagcgcgcgg

SEQ ID NO: 2857015 - RNA, 14 nt, Mycobacterium avium subsp. paratuberculosis
ggggcaugguguca

SEQ ID NO: 2857016 - RNA, 18 nt, Mycobacterium avium subsp. paratuberculosis
ggggcauggugucaggau

SEQ ID NO: 2857017 - RNA, 17 nt, Mycobacterium avium subsp. paratuberculosis
ggggccaacuccggcgg

SEQ ID NO: 2857018 - RNA, 14 nt, Mycobacterium avium subsp. paratuberculosis
ggggccaccaggcg

SEQ ID NO: 2857019 - RNA, 15 nt, Mycobacterium avium subsp. paratuberculosis
ggggccaccaggcgc

SEQ ID NO: 2857020 - RNA, 15 nt, Mycobacterium avium subsp. paratuberculosis
ggggccagcacccag

SEQ ID NO: 2857021 - RNA, 20 nt, Mycobacterium avium subsp. paratuberculosis
ggggcccaauaccguuccgc

SEQ ID NO: 2857022 - RNA, 23 nt, Mycobacterium avium subsp. paratuberculosis
ggggccccaaccccccuuggcgg

SEQ ID NO: 2857023 - RNA, 19 nt, Mycobacterium avium subsp. paratuberculosis
ggggcccguccccaccacc

SEQ ID NO: 2857024 - RNA, 23 nt, Mycobacterium avium subsp. paratuberculosis
ggggcccguccccaccaccgaca

SEQ ID NO: 2857025 - RNA, 16 nt, Mycobacterium avium subsp. paratuberculosis
ggggcccuccgcggcg

SEQ ID NO: 2857026 - RNA, 18 nt, Mycobacterium avium subsp. paratuberculosis
ggggcccuccgcggcgcc

SEQ ID NO: 2857027 - RNA, 21 nt, Mycobacterium avium subsp. paratuberculosis
ggggccgaagccgacaccggg

SEQ ID NO: 2857028 - RNA, 24 nt, Mycobacterium avium subsp. paratuberculosis
ggggccgagcagagcuacggacgc

SEQ ID NO: 2857029 - RNA, 19 nt, Mycobacterium avium subsp. paratuberculosis
ggggccgaugaccgcggcg

SEQ ID NO: 2857030 - RNA, 22 nt, Mycobacterium avium subsp. paratuberculosis
ggggccgaugaccgcggcgggc

SEQ ID NO: 2857031 - RNA, 22 nt, Mycobacterium avium subsp. paratuberculosis
ggggccgcaccugaucgaugcc

SEQ ID NO: 2857032 - RNA, 20 nt, Mycobacterium avium subsp. paratuberculosis
ggggccgcacucuugcgugc

SEQ ID NO: 2857033 - RNA, 13 nt, Mycobacterium avium subsp. paratuberculosis
ggggccgccgucg

SEQ ID NO: 2857034 - RNA, 13 nt, Mycobacterium avium subsp. paratuberculosis
ggggccgcggccg

SEQ ID NO: 2857035 - RNA, 14 nt, Mycobacterium avium subsp. paratuberculosis
ggggccgcggccgg

SEQ ID NO: 2857036 - RNA, 15 nt, Mycobacterium avium subsp. paratuberculosis
ggggccgcggccggc

SEQ ID NO: 2857037 - RNA, 16 nt, Mycobacterium avium subsp. paratuberculosis
ggggccgcggccggca

SEQ ID NO: 2857038 - RNA, 19 nt, Mycobacterium avium subsp. paratuberculosis
ggggccgcggccggcacua

SEQ ID NO: 2857039 - RNA, 12 nt, Mycobacterium avium subsp. paratuberculosis
ggggccgcucca

SEQ ID NO: 2857040 - RNA, 17 nt, Mycobacterium avium subsp. paratuberculosis
ggggccggacggugacg

SEQ ID NO: 2857041 - RNA, 14 nt, Mycobacterium avium subsp. paratuberculosis
ggggccggccgccc

SEQ ID NO: 2857042 - RNA, 14 nt, Mycobacterium avium subsp. paratuberculosis
ggggccggcgcggu

SEQ ID NO: 2857043 - RNA, 19 nt, Mycobacterium avium subsp. paratuberculosis
ggggccggcgcggugggcg

SEQ ID NO: 2857044 - RNA, 15 nt, Mycobacterium avium subsp. paratuberculosis
ggggccggcggcggc

SEQ ID NO: 2857045 - RNA, 18 nt, Mycobacterium avium subsp. paratuberculosis
ggggccggcggcggccag

SEQ ID NO: 2857046 - RNA, 13 nt, Mycobacterium avium subsp. paratuberculosis
ggggccggugaug

SEQ ID NO: 2857047 - RNA, 14 nt, Mycobacterium avium subsp. paratuberculosis
ggggccuccaccag

SEQ ID NO: 2857048 - RNA, 16 nt, Mycobacterium avium subsp. paratuberculosis
ggggccuccaccagcg

SEQ ID NO: 2857049 - RNA, 14 nt, Mycobacterium avium subsp. paratuberculosis
ggggccuccagcca

SEQ ID NO: 2857050 - RNA, 19 nt, Mycobacterium avium subsp. paratuberculosis
ggggccuccagccagcgcg

SEQ ID NO: 2857051 - RNA, 19 nt, Mycobacterium avium subsp. paratuberculosis
ggggccucgaugcggccgu

SEQ ID NO: 2857052 - RNA, 21 nt, Mycobacterium avium subsp. paratuberculosis
ggggccucgaugcggccgucg

SEQ ID NO: 2857053 - RNA, 19 nt, Mycobacterium avium subsp. paratuberculosis
ggggccucgucgccgcggu

SEQ ID NO: 2857054 - RNA, 12 nt, Mycobacterium avium subsp. paratuberculosis
ggggccugcggg

SEQ ID NO: 2857055 - RNA, 13 nt, Mycobacterium avium subsp. paratuberculosis
ggggccugcggga

SEQ ID NO: 2857056 - RNA, 18 nt, Mycobacterium avium subsp. paratuberculosis
ggggccuucuuggcggcg

SEQ ID NO: 2857057 - RNA, 20 nt, Mycobacterium avium subsp. paratuberculosis
ggggccuucuuggcggcggc

SEQ ID NO: 2857058 - RNA, 19 nt, Mycobacterium avium subsp. paratuberculosis
ggggcgaccuggacgccgc

SEQ ID NO: 2857059 - RNA, 18 nt, Mycobacterium avium subsp. paratuberculosis
ggggcgaccuugcgcagc

SEQ ID NO: 2857060 - RNA, 14 nt, Mycobacterium avium subsp. paratuberculosis
ggggcgacgggccg

SEQ ID NO: 2857061 - RNA, 15 nt, Mycobacterium avium subsp. paratuberculosis
ggggcgagccggccc

SEQ ID NO: 2857062 - RNA, 15 nt, Mycobacterium avium subsp. paratuberculosis
ggggcgagcuggccg

SEQ ID NO: 2857063 - RNA, 20 nt, Mycobacterium avium subsp. paratuberculosis
ggggcgagcuggccgcccac

SEQ ID NO: 2857064 - RNA, 20 nt, Mycobacterium avium subsp. paratuberculosis
ggggcgaugccgacacccca

SEQ ID NO: 2857065 - RNA, 14 nt, Mycobacterium avium subsp. paratuberculosis
ggggcgcagcccgg

SEQ ID NO: 2857066 - RNA, 16 nt, Mycobacterium avium subsp. paratuberculosis
ggggcgcagcccggcg

SEQ ID NO: 2857067 - RNA, 17 nt, Mycobacterium avium subsp. paratuberculosis
ggggcgcagcccggcgg

SEQ ID NO: 2857068 - RNA, 18 nt, Mycobacterium avium subsp. paratuberculosis
ggggcgcagcccggcggu

SEQ ID NO: 2857069 - RNA, 13 nt, Mycobacterium avium subsp. paratuberculosis
ggggcgcagccga

SEQ ID NO: 2857070 - RNA, 20 nt, Mycobacterium avium subsp. paratuberculosis
ggggcgccacuucuccacgc

SEQ ID NO: 2857071 - RNA, 14 nt, Mycobacterium avium subsp. paratuberculosis
ggggcgccgacagu

SEQ ID NO: 2857072 - RNA, 18 nt, Mycobacterium avium subsp. paratuberculosis
ggggcgccgacagucgcg

SEQ ID NO: 2857073 - RNA, 22 nt, Mycobacterium avium subsp. paratuberculosis
ggggcgccgacagucgcgggca

SEQ ID NO: 2857074 - RNA, 12 nt, Mycobacterium avium subsp. paratuberculosis
ggggcgccgccg

SEQ ID NO: 2857075 - RNA, 22 nt, Mycobacterium avium subsp. paratuberculosis
ggggcgccgccgaacagcagcg

SEQ ID NO: 2857076 - RNA, 19 nt, Mycobacterium avium subsp. paratuberculosis
ggggcgccgcggcgccgcc

SEQ ID NO: 2857077 - RNA, 19 nt, Mycobacterium avium subsp. paratuberculosis
ggggcgccuaccggguggc

SEQ ID NO: 2857078 - RNA, 14 nt, Mycobacterium avium subsp. paratuberculosis
ggggcgcgaggcgc

SEQ ID NO: 2857079 - RNA, 12 nt, Mycobacterium avium subsp. paratuberculosis
ggggcgcgcgcc

SEQ ID NO: 2857080 - RNA, 12 nt, Mycobacterium avium subsp. paratuberculosis
ggggcgcgcugg

SEQ ID NO: 2857081 - RNA, 15 nt, Mycobacterium avium subsp. paratuberculosis
ggggcgcggaccgca

SEQ ID NO: 2857082 - RNA, 15 nt, Mycobacterium avium subsp. paratuberculosis
ggggcgcgggcggca

SEQ ID NO: 2857083 - RNA, 16 nt, Mycobacterium avium subsp. paratuberculosis
ggggcggauccccgcg

SEQ ID NO: 2857084 - RNA, 23 nt, Mycobacterium avium subsp. paratuberculosis
ggggcggccgccgggccggcggc

SEQ ID NO: 2857085 - RNA, 14 nt, Mycobacterium avium subsp. paratuberculosis
ggggcggccugagc

SEQ ID NO: 2857086 - RNA, 13 nt, Mycobacterium avium subsp. paratuberculosis
ggggcggcggcgc

SEQ ID NO: 2857087 - RNA, 17 nt, Mycobacterium avium subsp. paratuberculosis
ggggcggcggcgccggg

SEQ ID NO: 2857088 - RNA, 12 nt, Mycobacterium avium subsp. paratuberculosis
ggggcggcgggc

SEQ ID NO: 2857089 - RNA, 17 nt, Mycobacterium avium subsp. paratuberculosis
ggggcggcggggugacg

SEQ ID NO: 2857090 - RNA, 17 nt, Mycobacterium avium subsp. paratuberculosis
ggggugcagcaccacga

SEQ ID NO: 2857091 - RNA, 19 nt, Mycobacterium avium subsp. paratuberculosis
ggggugccagccgugcggc

SEQ ID NO: 2857092 - RNA, 15 nt, Mycobacterium avium subsp. paratuberculosis
ggggugcccaccagc

SEQ ID NO: 2857093 - RNA, 16 nt, Mycobacterium avium subsp. paratuberculosis
ggggugcccaccagca

SEQ ID NO: 2857094 - RNA, 20 nt, Mycobacterium avium subsp. paratuberculosis
ggggugccgcagcggcggca

SEQ ID NO: 2857095 - RNA, 22 nt, Mycobacterium avium subsp. paratuberculosis
ggggugccgcccaacgacgucg

SEQ ID NO: 2857096 - RNA, 15 nt, Mycobacterium avium subsp. paratuberculosis
ggggugccgccgggg

SEQ ID NO: 2857097 - RNA, 21 nt, Mycobacterium avium subsp. paratuberculosis
ggggugccgccggggacccgc

SEQ ID NO: 2857098 - RNA, 14 nt, Mycobacterium avium subsp. paratuberculosis
ggggugccggaggc

SEQ ID NO: 2857099 - RNA, 13 nt, Mycobacterium avium subsp. paratuberculosis
gggguggccagcu

SEQ ID NO: 2857100 - RNA, 16 nt, Mycobacterium avium subsp. paratuberculosis
gggguggccggccagc

SEQ ID NO: 2857101 - RNA, 19 nt, Mycobacterium avium subsp. paratuberculosis
gggguguaggcgucggcgg

SEQ ID NO: 2857102 - RNA, 18 nt, Mycobacterium avium subsp. paratuberculosis
ggggugugcggcacggcg

SEQ ID NO: 2857103 - RNA, 15 nt, Mycobacterium avium subsp. paratuberculosis
ggggugugcucggcg

SEQ ID NO: 2857104 - RNA, 15 nt, Mycobacterium avium subsp. paratuberculosis
gggguucccggccgg

SEQ ID NO: 2857105 - RNA, 16 nt, Mycobacterium avium subsp. paratuberculosis
gggguucccggccggu

SEQ ID NO: 2857106 - RNA, 21 nt, Mycobacterium avium subsp. paratuberculosis
gggguucguugcgccgccagg

SEQ ID NO: 2857107 - RNA, 17 nt, Mycobacterium avium subsp. paratuberculosis
gggguugaagucuucgg

SEQ ID NO: 2857108 - RNA, 14 nt, Mycobacterium avium subsp. paratuberculosis
gggguugacccggc

SEQ ID NO: 2857109 - RNA, 17 nt, Mycobacterium avium subsp. paratuberculosis
gggguuggaaggggucg

SEQ ID NO: 2857110 - RNA, 14 nt, Mycobacterium avium subsp. paratuberculosis
gggguuggcgcgca

SEQ ID NO: 2857111 - RNA, 19 nt, Mycobacterium avium subsp. paratuberculosis
ggguaaaccgccagcagcg

SEQ ID NO: 2857112 - RNA, 16 nt, Mycobacterium avium subsp. paratuberculosis
ggguaacccuccggcg

SEQ ID NO: 2857113 - RNA, 19 nt, Mycobacterium avium subsp. paratuberculosis
ggguaacccuccggcgccu

SEQ ID NO: 2857114 - RNA, 17 nt, Mycobacterium avium subsp. paratuberculosis
ggguaaccgcagccggg

SEQ ID NO: 2857115 - RNA, 14 nt, Mycobacterium avium subsp. paratuberculosis
ggguacagccgcag

SEQ ID NO: 2857116 - RNA, 15 nt, Mycobacterium avium subsp. paratuberculosis
ggguacagccgcagg

SEQ ID NO: 2857117 - RNA, 14 nt, Mycobacterium avium subsp. paratuberculosis
ggguacggcggccg

SEQ ID NO: 2857118 - RNA, 15 nt, Mycobacterium avium subsp. paratuberculosis
ggguacucggcggcg

SEQ ID NO: 2857119 - RNA, 16 nt, Mycobacterium avium subsp. paratuberculosis
ggguacucggcggcgg

SEQ ID NO: 2857120 - RNA, 23 nt, Mycobacterium avium subsp. paratuberculosis
ggguagaaccagcccggcccguc

SEQ ID NO: 2857121 - RNA, 22 nt, Mycobacterium avium subsp. paratuberculosis
ggguagacguucuccccgccgg

SEQ ID NO: 2857122 - RNA, 21 nt, Mycobacterium avium subsp. paratuberculosis
ggguagaucuccucggacccg

SEQ ID NO: 2857123 - RNA, 23 nt, Mycobacterium avium subsp. paratuberculosis
ggguagcccgucgacgggccacc

SEQ ID NO: 2857124 - RNA, 15 nt, Mycobacterium avium subsp. paratuberculosis
ggguagccggcccgc

SEQ ID NO: 2857125 - RNA, 14 nt, Mycobacterium avium subsp. paratuberculosis
ggguagcgccgccg

SEQ ID NO: 2857126 - RNA, 15 nt, Mycobacterium avium subsp. paratuberculosis
ggguagcgccgccgg

SEQ ID NO: 2857127 - RNA, 13 nt, Mycobacterium avium subsp. paratuberculosis
ggguagggcggcg

SEQ ID NO: 2857128 - RNA, 17 nt, Mycobacterium avium subsp. paratuberculosis
ggguaguucugcucgau

SEQ ID NO: 2857129 - RNA, 23 nt, Mycobacterium avium subsp. paratuberculosis
gggucaauugccacagccgguca

SEQ ID NO: 2857130 - RNA, 18 nt, Mycobacterium avium subsp. paratuberculosis
gggucacacccucggccc

SEQ ID NO: 2857131 - RNA, 17 nt, Mycobacterium avium subsp. paratuberculosis
gggucaccggccgagcc

SEQ ID NO: 2857132 - RNA, 20 nt, Mycobacterium avium subsp. paratuberculosis
gggucaccggccgagccgau

SEQ ID NO: 2857133 - RNA, 14 nt, Mycobacterium avium subsp. paratuberculosis
gggucaccgugcgg

SEQ ID NO: 2857134 - RNA, 18 nt, Mycobacterium avium subsp. paratuberculosis
gggucaccgugcgggucg

SEQ ID NO: 2857135 - RNA, 20 nt, Mycobacterium avium subsp. paratuberculosis
gggucaccuuggccggaucg

SEQ ID NO: 2857136 - RNA, 14 nt, Mycobacterium avium subsp. paratuberculosis
gggucacggucagg

SEQ ID NO: 2857137 - RNA, 18 nt, Mycobacterium avium subsp. paratuberculosis
gggucagaccgcggcggu

SEQ ID NO: 2857138 - RNA, 23 nt, Mycobacterium avium subsp. paratuberculosis
gggucagaccgcggcggucgcca

SEQ ID NO: 2857139 - RNA, 22 nt, Mycobacterium avium subsp. paratuberculosis
gggucagcaccaccaacagcag

SEQ ID NO: 2857140 - RNA, 24 nt, Mycobacterium avium subsp. paratuberculosis
gggucagcacccgcagccgcgagu

SEQ ID NO: 2857141 - RNA, 22 nt, Mycobacterium avium subsp. paratuberculosis
gggucagcagcgucugcgccag

SEQ ID NO: 2857142 - RNA, 20 nt, Mycobacterium avium subsp. paratuberculosis
gggucagccacgggcggucg

SEQ ID NO: 2857143 - RNA, 15 nt, Mycobacterium avium subsp. paratuberculosis
gggucagcgacaacg

SEQ ID NO: 2857144 - RNA, 21 nt, Mycobacterium avium subsp. paratuberculosis
gggucagcgcuuccagcgcgg

SEQ ID NO: 2857145 - RNA, 15 nt, Mycobacterium avium subsp. paratuberculosis
gggucagcgucgcca

SEQ ID NO: 2857146 - RNA, 12 nt, Mycobacterium avium subsp. paratuberculosis
gggucagcgugc

SEQ ID NO: 2857147 - RNA, 22 nt, Mycobacterium avium subsp. paratuberculosis
gggucagcucccccgucgggcc

SEQ ID NO: 2857148 - RNA, 23 nt, Mycobacterium avium subsp. paratuberculosis
gggucagcuuggagccgagcacc

SEQ ID NO: 2857149 - RNA, 22 nt, Mycobacterium avium subsp. paratuberculosis
gggucaggucgaagcccgccgu

SEQ ID NO: 2857150 - RNA, 18 nt, Mycobacterium avium subsp. paratuberculosis
gggucaguucgcggcgca

SEQ ID NO: 2857151 - RNA, 17 nt, Mycobacterium avium subsp. paratuberculosis
gggucauccccgugcgg

SEQ ID NO: 2857152 - RNA, 19 nt, Mycobacterium avium subsp. paratuberculosis
gggucauccccgugcgggg

SEQ ID NO: 2857153 - RNA, 13 nt, Mycobacterium avium subsp. paratuberculosis
ggguccaccggcc

SEQ ID NO: 2857154 - RNA, 14 nt, Mycobacterium avium subsp. paratuberculosis
ggguccaccggccg

SEQ ID NO: 2857155 - RNA, 21 nt, Mycobacterium avium subsp. paratuberculosis
ggguccacgccgagggcggcg

SEQ ID NO: 2857156 - RNA, 14 nt, Mycobacterium avium subsp. paratuberculosis
ggguccagccgccg

SEQ ID NO: 2857157 - RNA, 15 nt, Mycobacterium avium subsp. paratuberculosis
ggguccagccgccgg

SEQ ID NO: 2857158 - RNA, 13 nt, Mycobacterium avium subsp. paratuberculosis
ggguccagccgcg

SEQ ID NO: 2857159 - RNA, 15 nt, Mycobacterium avium subsp. paratuberculosis
ggguccagccgcggu

SEQ ID NO: 2857160 - RNA, 16 nt, Mycobacterium avium subsp. paratuberculosis
ggguccaggccgcgcc

SEQ ID NO: 2857161 - RNA, 24 nt, Mycobacterium avium subsp. paratuberculosis
ggguccaucgccucgaccagcacc

SEQ ID NO: 2857162 - RNA, 19 nt, Mycobacterium avium subsp. paratuberculosis
gggucccaauccucgccga

SEQ ID NO: 2857163 - RNA, 16 nt, Mycobacterium avium subsp. paratuberculosis
gggucccccgccgacc

SEQ ID NO: 2857164 - RNA, 16 nt, Mycobacterium avium subsp. paratuberculosis
ggguccccgccgccgu

SEQ ID NO: 2857165 - RNA, 20 nt, Mycobacterium avium subsp. paratuberculosis
gggucccggcaacaccggcg

SEQ ID NO: 2857166 - RNA, 23 nt, Mycobacterium avium subsp. paratuberculosis
gggucccggcaacaccggcggcg

SEQ ID NO: 2857167 - RNA, 23 nt, Mycobacterium avium subsp. paratuberculosis
gggucccuuugcuguucgucgag

SEQ ID NO: 2857168 - RNA, 14 nt, Mycobacterium avium subsp. paratuberculosis
ggguccgaccagca

SEQ ID NO: 2857169 - RNA, 19 nt, Mycobacterium avium subsp. paratuberculosis
ggguccgaccagcacccgg

SEQ ID NO: 2857170 - RNA, 18 nt, Mycobacterium avium subsp. paratuberculosis
ggguccgcaacgccggcg

SEQ ID NO: 2857171 - RNA, 14 nt, Mycobacterium avium subsp. paratuberculosis
ggguccgcacccgg

SEQ ID NO: 2857172 - RNA, 22 nt, Mycobacterium avium subsp. paratuberculosis
ggguccgccccgagaucccagc

SEQ ID NO: 2857173 - RNA, 14 nt, Mycobacterium avium subsp. paratuberculosis
ggguccgccgggcg

SEQ ID NO: 2857174 - RNA, 15 nt, Mycobacterium avium subsp. paratuberculosis
gggucuucagcccgc

SEQ ID NO: 2857175 - RNA, 18 nt, Mycobacterium avium subsp. paratuberculosis
gggucuucagcccgcgca

SEQ ID NO: 2857176 - RNA, 15 nt, Mycobacterium avium subsp. paratuberculosis
gggucuuccacgccg

SEQ ID NO: 2857177 - RNA, 14 nt, Mycobacterium avium subsp. paratuberculosis
gggucuucucgaag

SEQ ID NO: 2857178 - RNA, 21 nt, Mycobacterium avium subsp. paratuberculosis
gggugaaacacaaacucgccc

SEQ ID NO: 2857179 - RNA, 22 nt, Mycobacterium avium subsp. paratuberculosis
gggugaaacacaaacucgccca

SEQ ID NO: 2857180 - RNA, 15 nt, Mycobacterium avium subsp. paratuberculosis
gggugaacaccccgc

SEQ ID NO: 2857181 - RNA, 15 nt, Mycobacterium avium subsp. paratuberculosis
gggugaacgaggccg

SEQ ID NO: 2857182 - RNA, 18 nt, Mycobacterium avium subsp. paratuberculosis
gggugaacgaggccgcgc

SEQ ID NO: 2857183 - RNA, 15 nt, Mycobacterium avium subsp. paratuberculosis
gggugaaggcggcca

SEQ ID NO: 2857184 - RNA, 16 nt, Mycobacterium avium subsp. paratuberculosis
gggugaaggcggccac

SEQ ID NO: 2857185 - RNA, 17 nt, Mycobacterium avium subsp. paratuberculosis
gggugaaggcggccacc

SEQ ID NO: 2857186 - RNA, 22 nt, Mycobacterium avium subsp. paratuberculosis
gggugaaucaccaagcgcgaca

SEQ ID NO: 2857187 - RNA, 15 nt, Mycobacterium avium subsp. paratuberculosis
gggugaccgacagca

SEQ ID NO: 2857188 - RNA, 17 nt, Mycobacterium avium subsp. paratuberculosis
gggugaccgaggccgcc

SEQ ID NO: 2857189 - RNA, 20 nt, Mycobacterium avium subsp. paratuberculosis
gggugaccgccuuggcgcgc

SEQ ID NO: 2857190 - RNA, 16 nt, Mycobacterium avium subsp. paratuberculosis
gggugaccggcgccgg

SEQ ID NO: 2857191 - RNA, 15 nt, Mycobacterium avium subsp. paratuberculosis
gggugaccggcgcgc

SEQ ID NO: 2857192 - RNA, 19 nt, Mycobacterium avium subsp. paratuberculosis
gggugaccggcgcgcagca

SEQ ID NO: 2857193 - RNA, 15 nt, Mycobacterium avium subsp. paratuberculosis
gggugaccggcggcc

SEQ ID NO: 2857194 - RNA, 16 nt, Mycobacterium avium subsp. paratuberculosis
gggugaccggcggcca

SEQ ID NO: 2857195 - RNA, 17 nt, Mycobacterium avium subsp. paratuberculosis
gggugaccggcggccag

SEQ ID NO: 2857196 - RNA, 22 nt, Mycobacterium avium subsp. paratuberculosis
gggugaccggcggccagcgagg

SEQ ID NO: 2857197 - RNA, 22 nt, Mycobacterium avium subsp. paratuberculosis
gggugaccgucacccccggcgc

SEQ ID NO: 2857198 - RNA, 14 nt, Mycobacterium avium subsp. paratuberculosis
gggugacgaccaug

SEQ ID NO: 2857199 - RNA, 20 nt, Mycobacterium avium subsp. paratuberculosis
gggugacgauccacagcgcg

SEQ ID NO: 2857200 - RNA, 13 nt, Mycobacterium avium subsp. paratuberculosis
gggugacgccuca

SEQ ID NO: 2857201 - RNA, 21 nt, Mycobacterium avium subsp. paratuberculosis
gggugacgcgaaugucgacca

SEQ ID NO: 2857202 - RNA, 21 nt, Mycobacterium avium subsp. paratuberculosis
gggugacgguggcguccucga

SEQ ID NO: 2857203 - RNA, 21 nt, Mycobacterium avium subsp. paratuberculosis
gggugacgucguugaccgagg

SEQ ID NO: 2857204 - RNA, 16 nt, Mycobacterium avium subsp. paratuberculosis
gggugacuucgaugua

SEQ ID NO: 2857205 - RNA, 16 nt, Mycobacterium avium subsp. paratuberculosis
gggugagacggccagc

SEQ ID NO: 2857206 - RNA, 17 nt, Mycobacterium avium subsp. paratuberculosis
gggugagacggccagca

SEQ ID NO: 2857207 - RNA, 18 nt, Mycobacterium avium subsp. paratuberculosis
gggugagacggccagcag

SEQ ID NO: 2857208 - RNA, 19 nt, Mycobacterium avium subsp. paratuberculosis
gggugagacggccagcagc

SEQ ID NO: 2857209 - RNA, 17 nt, Mycobacterium avium subsp. paratuberculosis
gggugagcaccgcgacc

SEQ ID NO: 2857210 - RNA, 20 nt, Mycobacterium avium subsp. paratuberculosis
gggugagcaccgcgaccagc

SEQ ID NO: 2857211 - RNA, 22 nt, Mycobacterium avium subsp. paratuberculosis
gggugagcagggccagcggcaa

SEQ ID NO: 2857212 - RNA, 20 nt, Mycobacterium avium subsp. paratuberculosis
gggugagccggucgaacgcc

SEQ ID NO: 2857213 - RNA, 14 nt, Mycobacterium avium subsp. paratuberculosis
gggugagcgacacc

SEQ ID NO: 2857214 - RNA, 13 nt, Mycobacterium avium subsp. paratuberculosis
gggugagcggcgc

SEQ ID NO: 2857215 - RNA, 14 nt, Mycobacterium avium subsp. paratuberculosis
gggugagcggcgcg

SEQ ID NO: 2857216 - RNA, 22 nt, Mycobacterium avium subsp. paratuberculosis
gggugaggcacccgcugcacca

SEQ ID NO: 2857217 - RNA, 15 nt, Mycobacterium avium subsp. paratuberculosis
gggugaggccaggcg

SEQ ID NO: 2857218 - RNA, 13 nt, Mycobacterium avium subsp. paratuberculosis
gggugaggggcgc

SEQ ID NO: 2857219 - RNA, 15 nt, Mycobacterium avium subsp. paratuberculosis
gggugaggggcgcgc

SEQ ID NO: 2857220 - RNA, 17 nt, Mycobacterium avium subsp. paratuberculosis
gggugauaccggcccag

SEQ ID NO: 2857221 - RNA, 23 nt, Mycobacterium avium subsp. paratuberculosis
gggugauaccggcccagcgcggu

SEQ ID NO: 2857222 - RNA, 11 nt, Mycobacterium avium subsp. paratuberculosis
gggugaucgcg

SEQ ID NO: 2857223 - RNA, 15 nt, Mycobacterium avium subsp. paratuberculosis
gggugaucgcggccc

SEQ ID NO: 2857224 - RNA, 18 nt, Mycobacterium avium subsp. paratuberculosis
gggugaugaggucgcgac

SEQ ID NO: 2857225 - RNA, 22 nt, Mycobacterium avium subsp. paratuberculosis
gggugaugcgucccguuggcgc

SEQ ID NO: 2857226 - RNA, 18 nt, Mycobacterium avium subsp. paratuberculosis
gggugaugucgccgacca

SEQ ID NO: 2857227 - RNA, 16 nt, Mycobacterium avium subsp. paratuberculosis
gggugcagcaccacga

SEQ ID NO: 2857228 - RNA, 20 nt, Mycobacterium avium subsp. paratuberculosis
gggugcaggcccagcugcug

SEQ ID NO: 2857229 - RNA, 21 nt, Mycobacterium avium subsp. paratuberculosis
gggugcaggcccgggcggcga

SEQ ID NO: 2857230 - RNA, 12 nt, Mycobacterium avium subsp. paratuberculosis
gggugccagccg

SEQ ID NO: 2857231 - RNA, 20 nt, Mycobacterium avium subsp. paratuberculosis
gggugccagccgugcggcgg

SEQ ID NO: 2857232 - RNA, 23 nt, Mycobacterium avium subsp. paratuberculosis
gggugccagccgugcggcggcgg

SEQ ID NO: 2857233 - RNA, 14 nt, Mycobacterium avium subsp. paratuberculosis
gggugcccaccagc

SEQ ID NO: 2857234 - RNA, 18 nt, Mycobacterium avium subsp. paratuberculosis
gggugccccgcaccgcca

SEQ ID NO: 2857235 - RNA, 13 nt, Mycobacterium avium subsp. paratuberculosis
gggugccccgcga

SEQ ID NO: 2857236 - RNA, 15 nt, Mycobacterium avium subsp. paratuberculosis
gggugccccgcgacc

SEQ ID NO: 2857237 - RNA, 16 nt, Mycobacterium avium subsp. paratuberculosis
gggugccccgcgaccg

SEQ ID NO: 2857238 - RNA, 18 nt, Mycobacterium avium subsp. paratuberculosis
gggugccccgcgaccgca

SEQ ID NO: 2857239 - RNA, 19 nt, Mycobacterium avium subsp. paratuberculosis
gggugccccgcgaccgcag

SEQ ID NO: 2857240 - RNA, 21 nt, Mycobacterium avium subsp. paratuberculosis
gggugccccgcgaccgcagca

SEQ ID NO: 2857241 - RNA, 12 nt, Mycobacterium avium subsp. paratuberculosis
gggugcccggcg

SEQ ID NO: 2857242 - RNA, 20 nt, Mycobacterium avium subsp. paratuberculosis
gggugcccggcugggcgcgc

SEQ ID NO: 2857243 - RNA, 14 nt, Mycobacterium avium subsp. paratuberculosis
gggugcccgggccg

SEQ ID NO: 2857244 - RNA, 19 nt, Mycobacterium avium subsp. paratuberculosis
gggugcccgggccgcagcu

SEQ ID NO: 2857245 - RNA, 20 nt, Mycobacterium avium subsp. paratuberculosis
gggugcccuuuacccggacg

SEQ ID NO: 2857246 - RNA, 18 nt, Mycobacterium avium subsp. paratuberculosis
gggugccgacgagcucgc

SEQ ID NO: 2857247 - RNA, 13 nt, Mycobacterium avium subsp. paratuberculosis
gggugccgcagcg

SEQ ID NO: 2857248 - RNA, 16 nt, Mycobacterium avium subsp. paratuberculosis
gggugccgcagcggcg

SEQ ID NO: 2857249 - RNA, 17 nt, Mycobacterium avium subsp. paratuberculosis
gggugccgcagcggcgg

SEQ ID NO: 2857250 - RNA, 22 nt, Mycobacterium avium subsp. paratuberculosis
gggugccgcagcggcggcacgg

SEQ ID NO: 2857251 - RNA, 22 nt, Mycobacterium avium subsp. paratuberculosis
gggugccgcccaacgacgucgg

SEQ ID NO: 2857252 - RNA, 12 nt, Mycobacterium avium subsp. paratuberculosis
gggugccgccgc

SEQ ID NO: 2857253 - RNA, 13 nt, Mycobacterium avium subsp. paratuberculosis
gggugccgcgguu

SEQ ID NO: 2857254 - RNA, 19 nt, Mycobacterium avium subsp. paratuberculosis
gggugccgcugcccgccgc

SEQ ID NO: 2857255 - RNA, 18 nt, Mycobacterium avium subsp. paratuberculosis
gggugccggaggcggcgu

SEQ ID NO: 2857256 - RNA, 15 nt, Mycobacterium avium subsp. paratuberculosis
gggugccggccaccg

SEQ ID NO: 2857257 - RNA, 18 nt, Mycobacterium avium subsp. paratuberculosis
gggugccggccaccggcg

SEQ ID NO: 2857258 - RNA, 11 nt, Mycobacterium avium subsp. paratuberculosis
gggugccuucu

SEQ ID NO: 2857259 - RNA, 17 nt, Mycobacterium avium subsp. paratuberculosis
gggugucgcggcugcgc

SEQ ID NO: 2857260 - RNA, 20 nt, Mycobacterium avium subsp. paratuberculosis
gggugucggcggggccggug

SEQ ID NO: 2857261 - RNA, 16 nt, Mycobacterium avium subsp. paratuberculosis
gggugucguagcggcu

SEQ ID NO: 2857262 - RNA, 15 nt, Mycobacterium avium subsp. paratuberculosis
gggugucgucgcgca

SEQ ID NO: 2857263 - RNA, 17 nt, Mycobacterium avium subsp. paratuberculosis
gggugucgucgcgcacc

SEQ ID NO: 2857264 - RNA, 21 nt, Mycobacterium avium subsp. paratuberculosis
gggugucgucgcgcacccagc

SEQ ID NO: 2857265 - RNA, 22 nt, Mycobacterium avium subsp. paratuberculosis
gggugugcaggccgaacaccgu

SEQ ID NO: 2857266 - RNA, 15 nt, Mycobacterium avium subsp. paratuberculosis
gggugugcggcacgg

SEQ ID NO: 2857267 - RNA, 13 nt, Mycobacterium avium subsp. paratuberculosis
ggguguggcgucg

SEQ ID NO: 2857268 - RNA, 14 nt, Mycobacterium avium subsp. paratuberculosis
ggguguggcgucga

SEQ ID NO: 2857269 - RNA, 14 nt, Mycobacterium avium subsp. paratuberculosis
ggguguucaccgcg

SEQ ID NO: 2857270 - RNA, 15 nt, Mycobacterium avium subsp. paratuberculosis
ggguguucaccgcgc

SEQ ID NO: 2857271 - RNA, 21 nt, Mycobacterium avium subsp. paratuberculosis
ggguguucaccgcgccgggca

SEQ ID NO: 2857272 - RNA, 23 nt, Mycobacterium avium subsp. paratuberculosis
ggguguucaccgcgccgggcacc

SEQ ID NO: 2857273 - RNA, 14 nt, Mycobacterium avium subsp. paratuberculosis
ggguguuggacgag

SEQ ID NO: 2857274 - RNA, 16 nt, Mycobacterium avium subsp. paratuberculosis
ggguguuggacgaggu

SEQ ID NO: 2857275 - RNA, 16 nt, Mycobacterium avium subsp. paratuberculosis
ggguguuggcgcacag

SEQ ID NO: 2857276 - RNA, 17 nt, Mycobacterium avium subsp. paratuberculosis
ggguuacguggacgcgc

SEQ ID NO: 2857277 - RNA, 20 nt, Mycobacterium avium subsp. paratuberculosis
ggguuccaccguucgggugc

SEQ ID NO: 2857278 - RNA, 14 nt, Mycobacterium avium subsp. paratuberculosis
ggguucccggccgg

SEQ ID NO: 2857279 - RNA, 12 nt, Mycobacterium avium subsp. paratuberculosis
ggguucgcccuc

SEQ ID NO: 2857280 - RNA, 22 nt, Mycobacterium avium subsp. paratuberculosis
ggguucgcccuccccggccagc

SEQ ID NO: 2857281 - RNA, 16 nt, Mycobacterium avium subsp. paratuberculosis
ggguucggcggcgcgg

SEQ ID NO: 2857282 - RNA, 23 nt, Mycobacterium avium subsp. paratuberculosis
ggguucggcggcgcggcccaggg

SEQ ID NO: 2857283 - RNA, 20 nt, Mycobacterium avium subsp. paratuberculosis
ggguucggucucggcggcgc

SEQ ID NO: 2857284 - RNA, 18 nt, Mycobacterium avium subsp. paratuberculosis
ggguucguugcgccgcca

SEQ ID NO: 2857285 - RNA, 14 nt, Mycobacterium avium subsp. paratuberculosis
ggguucucgcggcg

SEQ ID NO: 2857286 - RNA, 16 nt, Mycobacterium avium subsp. paratuberculosis
ggguucucgcggcggc

SEQ ID NO: 2857287 - RNA, 18 nt, Mycobacterium avium subsp. paratuberculosis
ggguucucgcggcggccg

SEQ ID NO: 2857288 - RNA, 18 nt, Mycobacterium avium subsp. paratuberculosis
ggguucuucagggcggug

SEQ ID NO: 2857289 - RNA, 14 nt, Mycobacterium avium subsp. paratuberculosis
ggguucuucgacca

SEQ ID NO: 2857290 - RNA, 17 nt, Mycobacterium avium subsp. paratuberculosis
ggguucuucgaccacgc

SEQ ID NO: 2857291 - RNA, 18 nt, Mycobacterium avium subsp. paratuberculosis
ggguucuucgaccacgcg

SEQ ID NO: 2857292 - RNA, 20 nt, Mycobacterium avium subsp. paratuberculosis
ggguucuucgaccacgcgcc

SEQ ID NO: 2857293 - RNA, 19 nt, Mycobacterium avium subsp. paratuberculosis
ggguugaagcuggccaccg

SEQ ID NO: 2857294 - RNA, 12 nt, Mycobacterium avium subsp. paratuberculosis
ggguugccggcg

SEQ ID NO: 2857295 - RNA, 15 nt, Mycobacterium avium subsp. paratuberculosis
ggguugccggcggcc

SEQ ID NO: 2857296 - RNA, 17 nt, Mycobacterium avium subsp. paratuberculosis
ggguugcgaaagcccag

SEQ ID NO: 2857297 - RNA, 14 nt, Mycobacterium avium subsp. paratuberculosis
ggguugcucgccgu

SEQ ID NO: 2857298 - RNA, 15 nt, Mycobacterium avium subsp. paratuberculosis
ggguugcuguacugg

SEQ ID NO: 2857299 - RNA, 14 nt, Mycobacterium avium subsp. paratuberculosis
ggguuggccagggc

SEQ ID NO: 2857300 - RNA, 12 nt, Mycobacterium avium subsp. paratuberculosis
ggguugggcgcc

SEQ ID NO: 2857301 - RNA, 20 nt, Mycobacterium avium subsp. paratuberculosis
ggguugggcgccugcgguga

SEQ ID NO: 2857302 - RNA, 14 nt, Mycobacterium avium subsp. paratuberculosis
ggguugggcggcgg

SEQ ID NO: 2857303 - RNA, 13 nt, Mycobacterium avium subsp. paratuberculosis
ggguuggucggcg

SEQ ID NO: 2857304 - RNA, 14 nt, Mycobacterium avium subsp. paratuberculosis
ggguuggucggcgc

SEQ ID NO: 2857305 - RNA, 22 nt, Mycobacterium avium subsp. paratuberculosis
ggguuguucuccagcggccgca

SEQ ID NO: 2857306 - RNA, 23 nt, Mycobacterium avium subsp. paratuberculosis
ggguuguucuccagcggccgcag

SEQ ID NO: 2857307 - RNA, 14 nt, Mycobacterium avium subsp. paratuberculosis
ggguuucggcccgg

SEQ ID NO: 2857308 - RNA, 12 nt, Mycobacterium avium subsp. paratuberculosis
ggguuucgugaa

SEQ ID NO: 2857309 - RNA, 15 nt, Mycobacterium avium subsp. paratuberculosis
ggguuucgugugcuc

SEQ ID NO: 2857310 - RNA, 17 nt, Mycobacterium avium subsp. paratuberculosis
ggguuuguccggccagg

SEQ ID NO: 2857311 - RNA, 15 nt, Mycobacterium avium subsp. paratuberculosis
ggguuuucggcgcgc

SEQ ID NO: 2857312 - RNA, 15 nt, Mycobacterium avium subsp. paratuberculosis
ggguuuucgggccgg

SEQ ID NO: 2857313 - RNA, 19 nt, Mycobacterium avium subsp. paratuberculosis
gguaaaccagcagcgccac

SEQ ID NO: 2857314 - RNA, 18 nt, Mycobacterium avium subsp. paratuberculosis
gguaaaccgccagcagcg

SEQ ID NO: 2857315 - RNA, 19 nt, Mycobacterium avium subsp. paratuberculosis
gguaaagucuucggcgaug

SEQ ID NO: 2857316 - RNA, 20 nt, Mycobacterium avium subsp. paratuberculosis
gguaacagagcgggaucccg

SEQ ID NO: 2857317 - RNA, 18 nt, Mycobacterium avium subsp. paratuberculosis
gguaacccuccggcgccu

SEQ ID NO: 2857318 - RNA, 18 nt, Mycobacterium avium subsp. paratuberculosis
gguaacugcguguggcgc

SEQ ID NO: 2857319 - RNA, 14 nt, Mycobacterium avium subsp. paratuberculosis
gguaaucggcggug

SEQ ID NO: 2857320 - RNA, 20 nt, Mycobacterium avium subsp. paratuberculosis
gguaaucggcgguggugaac

SEQ ID NO: 2857321 - RNA, 20 nt, Mycobacterium avium subsp. paratuberculosis
gguacacguagcgguccagc

SEQ ID NO: 2857322 - RNA, 19 nt, Mycobacterium avium subsp. paratuberculosis
gguacagcaccgccgcggg

SEQ ID NO: 2857323 - RNA, 18 nt, Mycobacterium avium subsp. paratuberculosis
gguacagcgacuccagcg

SEQ ID NO: 2857324 - RNA, 14 nt, Mycobacterium avium subsp. paratuberculosis
gguacagcgccagc

SEQ ID NO: 2857325 - RNA, 18 nt, Mycobacterium avium subsp. paratuberculosis
gguacaucccgccgggca

SEQ ID NO: 2857326 - RNA, 20 nt, Mycobacterium avium subsp. paratuberculosis
gguacaucguucccugcgcg

SEQ ID NO: 2857327 - RNA, 14 nt, Mycobacterium avium subsp. paratuberculosis
gguaccagaucgag

SEQ ID NO: 2857328 - RNA, 19 nt, Mycobacterium avium subsp. paratuberculosis
gguaccagaucgagcuggg

SEQ ID NO: 2857329 - RNA, 17 nt, Mycobacterium avium subsp. paratuberculosis
gguaccagggcagcgcc

SEQ ID NO: 2857330 - RNA, 18 nt, Mycobacterium avium subsp. paratuberculosis
gguaccagggcagcgccu

SEQ ID NO: 2857331 - RNA, 14 nt, Mycobacterium avium subsp. paratuberculosis
gguaccccagcaaa

SEQ ID NO: 2857332 - RNA, 17 nt, Mycobacterium avium subsp. paratuberculosis
gguaccgaugaccaccg

SEQ ID NO: 2857333 - RNA, 18 nt, Mycobacterium avium subsp. paratuberculosis
gguaccgccggccaggcg

SEQ ID NO: 2857334 - RNA, 20 nt, Mycobacterium avium subsp. paratuberculosis
gguaccucugcgcgagcagc

SEQ ID NO: 2857335 - RNA, 21 nt, Mycobacterium avium subsp. paratuberculosis
gguacgaaauucguugauuag

SEQ ID NO: 2857336 - RNA, 14 nt, Mycobacterium avium subsp. paratuberculosis
gguacgcgacgggc

SEQ ID NO: 2857337 - RNA, 23 nt, Mycobacterium avium subsp. paratuberculosis
gguacgcgcaauccugcccgguc

SEQ ID NO: 2857338 - RNA, 13 nt, Mycobacterium avium subsp. paratuberculosis
gguacgcgccguc

SEQ ID NO: 2857339 - RNA, 15 nt, Mycobacterium avium subsp. paratuberculosis
gguacgcggcguugc

SEQ ID NO: 2857340 - RNA, 21 nt, Mycobacterium avium subsp. paratuberculosis
gguacgcggcguugccgccgg

SEQ ID NO: 2857341 - RNA, 23 nt, Mycobacterium avium subsp. paratuberculosis
gguacgcggcguugccgccggcg

SEQ ID NO: 2857342 - RNA, 21 nt, Mycobacterium avium subsp. paratuberculosis
gguacggccgacgcccagcac

SEQ ID NO: 2857343 - RNA, 13 nt, Mycobacterium avium subsp. paratuberculosis
gguacggcggccg

SEQ ID NO: 2857344 - RNA, 15 nt, Mycobacterium avium subsp. paratuberculosis
gguaguagcgcgccg

SEQ ID NO: 2857345 - RNA, 16 nt, Mycobacterium avium subsp. paratuberculosis
gguaguagcgcgccgg

SEQ ID NO: 2857346 - RNA, 21 nt, Mycobacterium avium subsp. paratuberculosis
gguagucccgcgccuggcgca

SEQ ID NO: 2857347 - RNA, 19 nt, Mycobacterium avium subsp. paratuberculosis
gguaguccgacuucgcgug

SEQ ID NO: 2857348 - RNA, 12 nt, Mycobacterium avium subsp. paratuberculosis
gguagucgcgca

SEQ ID NO: 2857349 - RNA, 15 nt, Mycobacterium avium subsp. paratuberculosis
gguagucgcgcagcu

SEQ ID NO: 2857350 - RNA, 16 nt, Mycobacterium avium subsp. paratuberculosis
gguagucggcccaggc

SEQ ID NO: 2857351 - RNA, 14 nt, Mycobacterium avium subsp. paratuberculosis
gguagucggccucc

SEQ ID NO: 2857352 - RNA, 15 nt, Mycobacterium avium subsp. paratuberculosis
gguagucggccuccu

SEQ ID NO: 2857353 - RNA, 12 nt, Mycobacterium avium subsp. paratuberculosis
gguagucgucgu

SEQ ID NO: 2857354 - RNA, 15 nt, Mycobacterium avium subsp. paratuberculosis
gguagucgucguggu

SEQ ID NO: 2857355 - RNA, 17 nt, Mycobacterium avium subsp. paratuberculosis
gguagucugcacugcgg

SEQ ID NO: 2857356 - RNA, 21 nt, Mycobacterium avium subsp. paratuberculosis
gguagugcacggacagcucac

SEQ ID NO: 2857357 - RNA, 20 nt, Mycobacterium avium subsp. paratuberculosis
gguagugcauguagcggucg

SEQ ID NO: 2857358 - RNA, 17 nt, Mycobacterium avium subsp. paratuberculosis
gguaguggcgugcggcc

SEQ ID NO: 2857359 - RNA, 15 nt, Mycobacterium avium subsp. paratuberculosis
gguaguggugggcgu

SEQ ID NO: 2857360 - RNA, 16 nt, Mycobacterium avium subsp. paratuberculosis
gguaguucugcucgau

SEQ ID NO: 2857361 - RNA, 19 nt, Mycobacterium avium subsp. paratuberculosis
gguaucgggucaccgugcg

SEQ ID NO: 2857362 - RNA, 19 nt, Mycobacterium avium subsp. paratuberculosis
gguaugccuuggcccgcgc

SEQ ID NO: 2857363 - RNA, 12 nt, Mycobacterium avium subsp. paratuberculosis
gguauucgcgca

SEQ ID NO: 2857364 - RNA, 23 nt, Mycobacterium avium subsp. paratuberculosis
gguauuggccacgcuggcgucca

SEQ ID NO: 2857365 - RNA, 21 nt, Mycobacterium avium subsp. paratuberculosis
ggucaaacccauugucgccgu

SEQ ID NO: 2857366 - RNA, 23 nt, Mycobacterium avium subsp. paratuberculosis
ggucaacaccgggauccggcgcg

SEQ ID NO: 2857367 - RNA, 23 nt, Mycobacterium avium subsp. paratuberculosis
ggucaacacgaagccggugucgg

SEQ ID NO: 2857368 - RNA, 22 nt, Mycobacterium avium subsp. paratuberculosis
ggucaacacuuuccgcacgcug

SEQ ID NO: 2857369 - RNA, 14 nt, Mycobacterium avium subsp. paratuberculosis
ggucaacggcaccg

SEQ ID NO: 2857370 - RNA, 22 nt, Mycobacterium avium subsp. paratuberculosis
ggucaacggcucggucaagccg

SEQ ID NO: 2857371 - RNA, 17 nt, Mycobacterium avium subsp. paratuberculosis
ggucaacgugucgagca

SEQ ID NO: 2857372 - RNA, 19 nt, Mycobacterium avium subsp. paratuberculosis
ggucaacgugucgagcacg

SEQ ID NO: 2857373 - RNA, 20 nt, Mycobacterium avium subsp. paratuberculosis
ggucaacucgacccgcaccu

SEQ ID NO: 2857374 - RNA, 23 nt, Mycobacterium avium subsp. paratuberculosis
ggucaacucgacccgcaccucga

SEQ ID NO: 2857375 - RNA, 18 nt, Mycobacterium avium subsp. paratuberculosis
ggucaagauaccggccgg

SEQ ID NO: 2857376 - RNA, 16 nt, Mycobacterium avium subsp. paratuberculosis
ggucaagcggcagacc

SEQ ID NO: 2857377 - RNA, 17 nt, Mycobacterium avium subsp. paratuberculosis
ggucaaguccgcgagga

SEQ ID NO: 2857378 - RNA, 13 nt, Mycobacterium avium subsp. paratuberculosis
ggucaaugcccuc

SEQ ID NO: 2857379 - RNA, 16 nt, Mycobacterium avium subsp. paratuberculosis
ggucacaaagcccggg

SEQ ID NO: 2857380 - RNA, 22 nt, Mycobacterium avium subsp. paratuberculosis
ggucacaaagcccgggaugaug

SEQ ID NO: 2857381 - RNA, 17 nt, Mycobacterium avium subsp. paratuberculosis
ggucacacccucggccc

SEQ ID NO: 2857382 - RNA, 19 nt, Mycobacterium avium subsp. paratuberculosis
ggucacacccucggcccgc

SEQ ID NO: 2857383 - RNA, 13 nt, Mycobacterium avium subsp. paratuberculosis
ggucacaccgcug

SEQ ID NO: 2857384 - RNA, 16 nt, Mycobacterium avium subsp. paratuberculosis
ggucacagccgcgaua

SEQ ID NO: 2857385 - RNA, 15 nt, Mycobacterium avium subsp. paratuberculosis
ggucaccaaggcgau

SEQ ID NO: 2857386 - RNA, 11 nt, Mycobacterium avium subsp. paratuberculosis
ggucaccacca

SEQ ID NO: 2857387 - RNA, 13 nt, Mycobacterium avium subsp. paratuberculosis
ggucaccacgguc

SEQ ID NO: 2857388 - RNA, 14 nt, Mycobacterium avium subsp. paratuberculosis
ggucaccagcggcc

SEQ ID NO: 2857389 - RNA, 18 nt, Mycobacterium avium subsp. paratuberculosis
ggucaccagcggcccgcu

SEQ ID NO: 2857390 - RNA, 19 nt, Mycobacterium avium subsp. paratuberculosis
ggucaccagcggcccgcug

SEQ ID NO: 2857391 - RNA, 16 nt, Mycobacterium avium subsp. paratuberculosis
ggucaccagcucgccg

SEQ ID NO: 2857392 - RNA, 17 nt, Mycobacterium avium subsp. paratuberculosis
ggucaccaucagcggcu

SEQ ID NO: 2857393 - RNA, 17 nt, Mycobacterium avium subsp. paratuberculosis
ggucacccacuggcggc

SEQ ID NO: 2857394 - RNA, 19 nt, Mycobacterium avium subsp. paratuberculosis
ggucacccacuggcggccg

SEQ ID NO: 2857395 - RNA, 22 nt, Mycobacterium avium subsp. paratuberculosis
ggucacccacuggcggccggcc

SEQ ID NO: 2857396 - RNA, 13 nt, Mycobacterium avium subsp. paratuberculosis
ggucacccaggcc

SEQ ID NO: 2857397 - RNA, 21 nt, Mycobacterium avium subsp. paratuberculosis
ggucaccccggagauccggcc

SEQ ID NO: 2857398 - RNA, 15 nt, Mycobacterium avium subsp. paratuberculosis
ggucaccccggccau

SEQ ID NO: 2857399 - RNA, 20 nt, Mycobacterium avium subsp. paratuberculosis
ggucaccccggccaucaugc

SEQ ID NO: 2857400 - RNA, 20 nt, Mycobacterium avium subsp. paratuberculosis
ggucacccgguugagcaccg

SEQ ID NO: 2857401 - RNA, 19 nt, Mycobacterium avium subsp. paratuberculosis
ggucacccgugggccgacc

SEQ ID NO: 2857402 - RNA, 21 nt, Mycobacterium avium subsp. paratuberculosis
ggucacccuccucgcggcggu

SEQ ID NO: 2857403 - RNA, 15 nt, Mycobacterium avium subsp. paratuberculosis
ggucaccgagcggcc

SEQ ID NO: 2857404 - RNA, 13 nt, Mycobacterium avium subsp. paratuberculosis
ggucaccgcgacc

SEQ ID NO: 2857405 - RNA, 22 nt, Mycobacterium avium subsp. paratuberculosis
ggucaccgcgggaauggccgcg

SEQ ID NO: 2857406 - RNA, 15 nt, Mycobacterium avium subsp. paratuberculosis
ggucaccggccgagc

SEQ ID NO: 2857407 - RNA, 16 nt, Mycobacterium avium subsp. paratuberculosis
ggucaccggccgagcc

SEQ ID NO: 2857408 - RNA, 13 nt, Mycobacterium avium subsp. paratuberculosis
ggucaccggggug

SEQ ID NO: 2857409 - RNA, 17 nt, Mycobacterium avium subsp. paratuberculosis
ggucaccggggugccgc

SEQ ID NO: 2857410 - RNA, 18 nt, Mycobacterium avium subsp. paratuberculosis
ggucaccggggugccgcc

SEQ ID NO: 2857411 - RNA, 20 nt, Mycobacterium avium subsp. paratuberculosis
ggucaccggggugccgccca

SEQ ID NO: 2857412 - RNA, 21 nt, Mycobacterium avium subsp. paratuberculosis
ggucaccgggugaugucgccg

SEQ ID NO: 2857413 - RNA, 22 nt, Mycobacterium avium subsp. paratuberculosis
ggucaccgggugaugucgccga

SEQ ID NO: 2857414 - RNA, 21 nt, Mycobacterium avium subsp. paratuberculosis
ggucaccgucguacucgaccg

SEQ ID NO: 2857415 - RNA, 19 nt, Mycobacterium avium subsp. paratuberculosis
ggucaccgugucggcgggc

SEQ ID NO: 2857416 - RNA, 13 nt, Mycobacterium avium subsp. paratuberculosis
ggucaccugacgc

SEQ ID NO: 2857417 - RNA, 18 nt, Mycobacterium avium subsp. paratuberculosis
ggucaccugacgcucggu

SEQ ID NO: 2857418 - RNA, 17 nt, Mycobacterium avium subsp. paratuberculosis
ggucaccuuggccggau

SEQ ID NO: 2857419 - RNA, 16 nt, Mycobacterium avium subsp. paratuberculosis
ggucacgcccggggug

SEQ ID NO: 2857420 - RNA, 20 nt, Mycobacterium avium subsp. paratuberculosis
ggucacgcugaucgaccggu

SEQ ID NO: 2857421 - RNA, 12 nt, Mycobacterium avium subsp. paratuberculosis
ggucacgcuggc

SEQ ID NO: 2857422 - RNA, 13 nt, Mycobacterium avium subsp. paratuberculosis
ggucacgcuggcg

SEQ ID NO: 2857423 - RNA, 15 nt, Mycobacterium avium subsp. paratuberculosis
ggucacgcuggcgug

SEQ ID NO: 2857424 - RNA, 18 nt, Mycobacterium avium subsp. paratuberculosis
ggucacgcuggcgugacg

SEQ ID NO: 2857425 - RNA, 16 nt, Mycobacterium avium subsp. paratuberculosis
ggucacggacagccgg

SEQ ID NO: 2857426 - RNA, 20 nt, Mycobacterium avium subsp. paratuberculosis
ggucacggauacccgcggcc

SEQ ID NO: 2857427 - RNA, 21 nt, Mycobacterium avium subsp. paratuberculosis
ggucacggauacccgcggccu

SEQ ID NO: 2857428 - RNA, 14 nt, Mycobacterium avium subsp. paratuberculosis
ggucacggugacgg

SEQ ID NO: 2857429 - RNA, 19 nt, Mycobacterium avium subsp. paratuberculosis
ggucaggcgcagccagcgg

SEQ ID NO: 2857430 - RNA, 15 nt, Mycobacterium avium subsp. paratuberculosis
ggucagggccagcaa

SEQ ID NO: 2857431 - RNA, 16 nt, Mycobacterium avium subsp. paratuberculosis
ggucagggccagcaac

SEQ ID NO: 2857432 - RNA, 14 nt, Mycobacterium avium subsp. paratuberculosis
ggucagggcgcuca

SEQ ID NO: 2857433 - RNA, 14 nt, Mycobacterium avium subsp. paratuberculosis
ggucagggucagcu

SEQ ID NO: 2857434 - RNA, 17 nt, Mycobacterium avium subsp. paratuberculosis
ggucagguagccgaggu

SEQ ID NO: 2857435 - RNA, 20 nt, Mycobacterium avium subsp. paratuberculosis
ggucaggucgcugcgcucgc

SEQ ID NO: 2857436 - RNA, 17 nt, Mycobacterium avium subsp. paratuberculosis
ggucagguuggggccga

SEQ ID NO: 2857437 - RNA, 16 nt, Mycobacterium avium subsp. paratuberculosis
ggucagucgcgccgcc

SEQ ID NO: 2857438 - RNA, 19 nt, Mycobacterium avium subsp. paratuberculosis
ggucagucgcgccgccagc

SEQ ID NO: 2857439 - RNA, 20 nt, Mycobacterium avium subsp. paratuberculosis
ggucagucgcgccgccagca

SEQ ID NO: 2857440 - RNA, 16 nt, Mycobacterium avium subsp. paratuberculosis
ggucaguucgucgguc

SEQ ID NO: 2857441 - RNA, 15 nt, Mycobacterium avium subsp. paratuberculosis
ggucauagggcucgu

SEQ ID NO: 2857442 - RNA, 16 nt, Mycobacterium avium subsp. paratuberculosis
ggucauaucgacggcc

SEQ ID NO: 2857443 - RNA, 20 nt, Mycobacterium avium subsp. paratuberculosis
ggucaucaccuugucgcuga

SEQ ID NO: 2857444 - RNA, 15 nt, Mycobacterium avium subsp. paratuberculosis
ggucaucagcgacgu

SEQ ID NO: 2857445 - RNA, 22 nt, Mycobacterium avium subsp. paratuberculosis
ggucauccagccgugggugucg

SEQ ID NO: 2857446 - RNA, 20 nt, Mycobacterium avium subsp. paratuberculosis
ggucauccccgugcggggcc

SEQ ID NO: 2857447 - RNA, 14 nt, Mycobacterium avium subsp. paratuberculosis
ggucauccgcucca

SEQ ID NO: 2857448 - RNA, 18 nt, Mycobacterium avium subsp. paratuberculosis
ggucauccgcuccaugaa

SEQ ID NO: 2857449 - RNA, 17 nt, Mycobacterium avium subsp. paratuberculosis
ggucauccgggccacca

SEQ ID NO: 2857450 - RNA, 20 nt, Mycobacterium avium subsp. paratuberculosis
ggucauccgggccaccacca

SEQ ID NO: 2857451 - RNA, 15 nt, Mycobacterium avium subsp. paratuberculosis
ggucauccucgccgc

SEQ ID NO: 2857452 - RNA, 17 nt, Mycobacterium avium subsp. paratuberculosis
ggucauccucgccgcgc

SEQ ID NO: 2857453 - RNA, 18 nt, Mycobacterium avium subsp. paratuberculosis
ggucauccucgccgcgcc

SEQ ID NO: 2857454 - RNA, 20 nt, Mycobacterium avium subsp. paratuberculosis
ggucauccucgccgcgccag

SEQ ID NO: 2857455 - RNA, 17 nt, Mycobacterium avium subsp. paratuberculosis
ggucaucgagccgagca

SEQ ID NO: 2857456 - RNA, 12 nt, Mycobacterium avium subsp. paratuberculosis
ggucaucgcgcc

SEQ ID NO: 2857457 - RNA, 17 nt, Mycobacterium avium subsp. paratuberculosis
ggucaugaaggcgacgu

SEQ ID NO: 2857458 - RNA, 14 nt, Mycobacterium avium subsp. paratuberculosis
ggucaugccgagcc

SEQ ID NO: 2857459 - RNA, 16 nt, Mycobacterium avium subsp. paratuberculosis
ggucaugccgucgacg

SEQ ID NO: 2857460 - RNA, 17 nt, Mycobacterium avium subsp. paratuberculosis
ggucaugccgucgacga

SEQ ID NO: 2857461 - RNA, 17 nt, Mycobacterium avium subsp. paratuberculosis
ggucauggcgaccgcga

SEQ ID NO: 2857462 - RNA, 13 nt, Mycobacterium avium subsp. paratuberculosis
ggucaugguggcg

SEQ ID NO: 2857463 - RNA, 18 nt, Mycobacterium avium subsp. paratuberculosis
ggucaugguggcggcgcc

SEQ ID NO: 2857464 - RNA, 18 nt, Mycobacterium avium subsp. paratuberculosis
ggucauguaccaggcgac

SEQ ID NO: 2857465 - RNA, 21 nt, Mycobacterium avium subsp. paratuberculosis
ggucauugaugccccggguga

SEQ ID NO: 2857466 - RNA, 18 nt, Mycobacterium avium subsp. paratuberculosis
gguccaaaacaucccgga

SEQ ID NO: 2857467 - RNA, 23 nt, Mycobacterium avium subsp. paratuberculosis
gguccaaaacaucccggacaggu

SEQ ID NO: 2857468 - RNA, 15 nt, Mycobacterium avium subsp. paratuberculosis
gguccaaagacguug

SEQ ID NO: 2857469 - RNA, 16 nt, Mycobacterium avium subsp. paratuberculosis
gguccaaagacguuga

SEQ ID NO: 2857470 - RNA, 22 nt, Mycobacterium avium subsp. paratuberculosis
gguccaaagacguugaccgcga

SEQ ID NO: 2857471 - RNA, 17 nt, Mycobacterium avium subsp. paratuberculosis
gguccaacgggcucagc

SEQ ID NO: 2857472 - RNA, 21 nt, Mycobacterium avium subsp. paratuberculosis
gguccaacgggcucagcacca

SEQ ID NO: 2857473 - RNA, 14 nt, Mycobacterium avium subsp. paratuberculosis
gguccacacguccu

SEQ ID NO: 2857474 - RNA, 19 nt, Mycobacterium avium subsp. paratuberculosis
gguccaccaauggcggcca

SEQ ID NO: 2857475 - RNA, 20 nt, Mycobacterium avium subsp. paratuberculosis
gguccaccaauggcggccac

SEQ ID NO: 2857476 - RNA, 12 nt, Mycobacterium avium subsp. paratuberculosis
gguccaccacca

SEQ ID NO: 2857477 - RNA, 14 nt, Mycobacterium avium subsp. paratuberculosis
gguccaccaccaca

SEQ ID NO: 2857478 - RNA, 18 nt, Mycobacterium avium subsp. paratuberculosis
gguccacccgccccgccg

SEQ ID NO: 2857479 - RNA, 18 nt, Mycobacterium avium subsp. paratuberculosis
gguccaccgccgcgccga

SEQ ID NO: 2857480 - RNA, 19 nt, Mycobacterium avium subsp. paratuberculosis
gguccaccgccgcgccgag

SEQ ID NO: 2857481 - RNA, 15 nt, Mycobacterium avium subsp. paratuberculosis
gguccaccgcggcgg

SEQ ID NO: 2857482 - RNA, 16 nt, Mycobacterium avium subsp. paratuberculosis
gguccaccgcggcggc

SEQ ID NO: 2857483 - RNA, 19 nt, Mycobacterium avium subsp. paratuberculosis
gguccaccgcggcggccag

SEQ ID NO: 2857484 - RNA, 19 nt, Mycobacterium avium subsp. paratuberculosis
gguccaccgggcaguagaa

SEQ ID NO: 2857485 - RNA, 12 nt, Mycobacterium avium subsp. paratuberculosis
gguccacgcagu

SEQ ID NO: 2857486 - RNA, 22 nt, Mycobacterium avium subsp. paratuberculosis
gguccacgccgagggcggcggc

SEQ ID NO: 2857487 - RNA, 14 nt, Mycobacterium avium subsp. paratuberculosis
gguccacgccggcg

SEQ ID NO: 2857488 - RNA, 22 nt, Mycobacterium avium subsp. paratuberculosis
gguccacggucagcgcgucggc

SEQ ID NO: 2857489 - RNA, 15 nt, Mycobacterium avium subsp. paratuberculosis
gguccagaucggcgc

SEQ ID NO: 2857490 - RNA, 17 nt, Mycobacterium avium subsp. paratuberculosis
gguccagaucggcgcgc

SEQ ID NO: 2857491 - RNA, 20 nt, Mycobacterium avium subsp. paratuberculosis
gguccagaucggcgcgcggg

SEQ ID NO: 2857492 - RNA, 16 nt, Mycobacterium avium subsp. paratuberculosis
gguccagcaccggcgc

SEQ ID NO: 2857493 - RNA, 17 nt, Mycobacterium avium subsp. paratuberculosis
gguccagcaccggcgcc

SEQ ID NO: 2857494 - RNA, 18 nt, Mycobacterium avium subsp. paratuberculosis
gguccagcaccggcgccc

SEQ ID NO: 2857495 - RNA, 20 nt, Mycobacterium avium subsp. paratuberculosis
gguccagcaccggcgccccg

SEQ ID NO: 2857496 - RNA, 18 nt, Mycobacterium avium subsp. paratuberculosis
gguccagcacgugcccag

SEQ ID NO: 2857497 - RNA, 19 nt, Mycobacterium avium subsp. paratuberculosis
gguccagcacgugcccagc

SEQ ID NO: 2857498 - RNA, 20 nt, Mycobacterium avium subsp. paratuberculosis
gguccagcacgugcccagcc

SEQ ID NO: 2857499 - RNA, 21 nt, Mycobacterium avium subsp. paratuberculosis
gguccagcacgugcccagccc

SEQ ID NO: 2857500 - RNA, 13 nt, Mycobacterium avium subsp. paratuberculosis
gguccagcccggu

SEQ ID NO: 2857501 - RNA, 13 nt, Mycobacterium avium subsp. paratuberculosis
gguccagccgccg

SEQ ID NO: 2857502 - RNA, 18 nt, Mycobacterium avium subsp. paratuberculosis
gguccagccgccgcgugg

SEQ ID NO: 2857503 - RNA, 16 nt, Mycobacterium avium subsp. paratuberculosis
gguccagccgccggcg

SEQ ID NO: 2857504 - RNA, 14 nt, Mycobacterium avium subsp. paratuberculosis
gguccagccggucg

SEQ ID NO: 2857505 - RNA, 16 nt, Mycobacterium avium subsp. paratuberculosis
gguccagcgagcccuu

SEQ ID NO: 2857506 - RNA, 13 nt, Mycobacterium avium subsp. paratuberculosis
gguccagcgccga

SEQ ID NO: 2857507 - RNA, 16 nt, Mycobacterium avium subsp. paratuberculosis
gguccagcgugcgcgg

SEQ ID NO: 2857508 - RNA, 19 nt, Mycobacterium avium subsp. paratuberculosis
gguccagcgugcgcggcug

SEQ ID NO: 2857509 - RNA, 14 nt, Mycobacterium avium subsp. paratuberculosis
gguccaggaucacg

SEQ ID NO: 2857510 - RNA, 21 nt, Mycobacterium avium subsp. paratuberculosis
gguccaggaucacgcggcggg

SEQ ID NO: 2857511 - RNA, 19 nt, Mycobacterium avium subsp. paratuberculosis
gguccaggccgcgccgggc

SEQ ID NO: 2857512 - RNA, 18 nt, Mycobacterium avium subsp. paratuberculosis
gguccaggcgccggguug

SEQ ID NO: 2857513 - RNA, 19 nt, Mycobacterium avium subsp. paratuberculosis
gguccagggcgggucgucg

SEQ ID NO: 2857514 - RNA, 18 nt, Mycobacterium avium subsp. paratuberculosis
gguccuccagcggcaggu

SEQ ID NO: 2857515 - RNA, 13 nt, Mycobacterium avium subsp. paratuberculosis
gguccucccgggu

SEQ ID NO: 2857516 - RNA, 12 nt, Mycobacterium avium subsp. paratuberculosis
gguccucgaucc

SEQ ID NO: 2857517 - RNA, 23 nt, Mycobacterium avium subsp. paratuberculosis
gguccucgauccgguccagcccg

SEQ ID NO: 2857518 - RNA, 17 nt, Mycobacterium avium subsp. paratuberculosis
gguccucgaucgacacc

SEQ ID NO: 2857519 - RNA, 15 nt, Mycobacterium avium subsp. paratuberculosis
gguccucgcuggcga

SEQ ID NO: 2857520 - RNA, 21 nt, Mycobacterium avium subsp. paratuberculosis
gguccucggacucgucgcuga

SEQ ID NO: 2857521 - RNA, 14 nt, Mycobacterium avium subsp. paratuberculosis
gguccucggcgaug

SEQ ID NO: 2857522 - RNA, 23 nt, Mycobacterium avium subsp. paratuberculosis
gguccucgucaccgugggcggcg

SEQ ID NO: 2857523 - RNA, 14 nt, Mycobacterium avium subsp. paratuberculosis
gguccugccccggg

SEQ ID NO: 2857524 - RNA, 16 nt, Mycobacterium avium subsp. paratuberculosis
gguccuggcgguggcc

SEQ ID NO: 2857525 - RNA, 18 nt, Mycobacterium avium subsp. paratuberculosis
gguccuggcgguggcccg

SEQ ID NO: 2857526 - RNA, 12 nt, Mycobacterium avium subsp. paratuberculosis
gguccugggccu

SEQ ID NO: 2857527 - RNA, 14 nt, Mycobacterium avium subsp. paratuberculosis
gguccugggccucc

SEQ ID NO: 2857528 - RNA, 22 nt, Mycobacterium avium subsp. paratuberculosis
gguccugggccuccggcggcag

SEQ ID NO: 2857529 - RNA, 22 nt, Mycobacterium avium subsp. paratuberculosis
gguccuucaacuugcgcgacgc

SEQ ID NO: 2857530 - RNA, 23 nt, Mycobacterium avium subsp. paratuberculosis
gguccuugaggaugcgcaccacg

SEQ ID NO: 2857531 - RNA, 23 nt, Mycobacterium avium subsp. paratuberculosis
gguccuugagguagucgcgcagc

SEQ ID NO: 2857532 - RNA, 14 nt, Mycobacterium avium subsp. paratuberculosis
gguccuugcccagc

SEQ ID NO: 2857533 - RNA, 15 nt, Mycobacterium avium subsp. paratuberculosis
gguccuugcccagca

SEQ ID NO: 2857534 - RNA, 18 nt, Mycobacterium avium subsp. paratuberculosis
gguccuugcccagcaguu

SEQ ID NO: 2857535 - RNA, 22 nt, Mycobacterium avium subsp. paratuberculosis
ggucgaaaucgcagacguagca

SEQ ID NO: 2857536 - RNA, 20 nt, Mycobacterium avium subsp. paratuberculosis
ggucgaacaacgcggugacc

SEQ ID NO: 2857537 - RNA, 17 nt, Mycobacterium avium subsp. paratuberculosis
ggucgaacacggcgcug

SEQ ID NO: 2857538 - RNA, 22 nt, Mycobacterium avium subsp. paratuberculosis
ggucgaacagcacgccggccgg

SEQ ID NO: 2857539 - RNA, 23 nt, Mycobacterium avium subsp. paratuberculosis
ggucgaacagcacgccggccggc

SEQ ID NO: 2857540 - RNA, 14 nt, Mycobacterium avium subsp. paratuberculosis
ggucgaacagcgcg

SEQ ID NO: 2857541 - RNA, 15 nt, Mycobacterium avium subsp. paratuberculosis
ggucgaacagcgcgc

SEQ ID NO: 2857542 - RNA, 16 nt, Mycobacterium avium subsp. paratuberculosis
ggucgaacagcgcgcc

SEQ ID NO: 2857543 - RNA, 19 nt, Mycobacterium avium subsp. paratuberculosis
ggucgaacaucacccggcg

SEQ ID NO: 2857544 - RNA, 19 nt, Mycobacterium avium subsp. paratuberculosis
ggucgaaccacgcggcggc

SEQ ID NO: 2857545 - RNA, 21 nt, Mycobacterium avium subsp. paratuberculosis
ggucgaaccgcgagcgcgcgg

SEQ ID NO: 2857546 - RNA, 15 nt, Mycobacterium avium subsp. paratuberculosis
ggucgaacgccaccu

SEQ ID NO: 2857547 - RNA, 17 nt, Mycobacterium avium subsp. paratuberculosis
ggucgaacgccagcgcc

SEQ ID NO: 2857548 - RNA, 16 nt, Mycobacterium avium subsp. paratuberculosis
ggucgaacgcggcgcc

SEQ ID NO: 2857549 - RNA, 14 nt, Mycobacterium avium subsp. paratuberculosis
ggucgaacuggcgc

SEQ ID NO: 2857550 - RNA, 15 nt, Mycobacterium avium subsp. paratuberculosis
ggucgaacuggcgca

SEQ ID NO: 2857551 - RNA, 14 nt, Mycobacterium avium subsp. paratuberculosis
ggucgaagaggugc

SEQ ID NO: 2857552 - RNA, 18 nt, Mycobacterium avium subsp. paratuberculosis
ggucgaagauggccaggu

SEQ ID NO: 2857553 - RNA, 14 nt, Mycobacterium avium subsp. paratuberculosis
ggucgaagcgcagc

SEQ ID NO: 2857554 - RNA, 15 nt, Mycobacterium avium subsp. paratuberculosis
ggucgaagcgcagca

SEQ ID NO: 2857555 - RNA, 15 nt, Mycobacterium avium subsp. paratuberculosis
ggucgaaggccccgg

SEQ ID NO: 2857556 - RNA, 17 nt, Mycobacterium avium subsp. paratuberculosis
ggucgaaggccccgguc

SEQ ID NO: 2857557 - RNA, 20 nt, Mycobacterium avium subsp. paratuberculosis
ggucgaaguccugcgccgcg

SEQ ID NO: 2857558 - RNA, 21 nt, Mycobacterium avium subsp. paratuberculosis
ggucgaaguccugcgccgcgg

SEQ ID NO: 2857559 - RNA, 17 nt, Mycobacterium avium subsp. paratuberculosis
ggucgacagccugaccg

SEQ ID NO: 2857560 - RNA, 22 nt, Mycobacterium avium subsp. paratuberculosis
ggucgacagccugaccgcgggu

SEQ ID NO: 2857561 - RNA, 23 nt, Mycobacterium avium subsp. paratuberculosis
ggucgacagccugaccgcgggug

SEQ ID NO: 2857562 - RNA, 13 nt, Mycobacterium avium subsp. paratuberculosis
ggucgaccagcuc

SEQ ID NO: 2857563 - RNA, 19 nt, Mycobacterium avium subsp. paratuberculosis
ggucgaccaucugccggcg

SEQ ID NO: 2857564 - RNA, 13 nt, Mycobacterium avium subsp. paratuberculosis
ggucgacccgccg

SEQ ID NO: 2857565 - RNA, 15 nt, Mycobacterium avium subsp. paratuberculosis
ggucgacccgccgca

SEQ ID NO: 2857566 - RNA, 17 nt, Mycobacterium avium subsp. paratuberculosis
ggucgacccgccgcagc

SEQ ID NO: 2857567 - RNA, 11 nt, Mycobacterium avium subsp. paratuberculosis
ggucgaccgcc

SEQ ID NO: 2857568 - RNA, 14 nt, Mycobacterium avium subsp. paratuberculosis
ggucgaccgcgcac

SEQ ID NO: 2857569 - RNA, 15 nt, Mycobacterium avium subsp. paratuberculosis
ggucgaccgcgcacc

SEQ ID NO: 2857570 - RNA, 19 nt, Mycobacterium avium subsp. paratuberculosis
ggucgaccgcgcaccggcg

SEQ ID NO: 2857571 - RNA, 13 nt, Mycobacterium avium subsp. paratuberculosis
ggucgaccggcuc

SEQ ID NO: 2857572 - RNA, 22 nt, Mycobacterium avium subsp. paratuberculosis
ggucgacgacgaacggguaggu

SEQ ID NO: 2857573 - RNA, 16 nt, Mycobacterium avium subsp. paratuberculosis
ggucgacgagcccgcg

SEQ ID NO: 2857574 - RNA, 17 nt, Mycobacterium avium subsp. paratuberculosis
ggucgacgagcccgcgc

SEQ ID NO: 2857575 - RNA, 18 nt, Mycobacterium avium subsp. paratuberculosis
ggucgacgauggcccggg

SEQ ID NO: 2857576 - RNA, 21 nt, Mycobacterium avium subsp. paratuberculosis
ggucgacgauggcccgggcca

SEQ ID NO: 2857577 - RNA, 12 nt, Mycobacterium avium subsp. paratuberculosis
ggucgacgcccc

SEQ ID NO: 2857578 - RNA, 14 nt, Mycobacterium avium subsp. paratuberculosis
ggucgacgcgccgc

SEQ ID NO: 2857579 - RNA, 16 nt, Mycobacterium avium subsp. paratuberculosis
ggucgacgcgccgcac

SEQ ID NO: 2857580 - RNA, 23 nt, Mycobacterium avium subsp. paratuberculosis
ggucgacgcgccgcacugcacgg

SEQ ID NO: 2857581 - RNA, 18 nt, Mycobacterium avium subsp. paratuberculosis
ggucgacgcggggcggcg

SEQ ID NO: 2857582 - RNA, 22 nt, Mycobacterium avium subsp. paratuberculosis
ggucgacgcggggcggcggcgc

SEQ ID NO: 2857583 - RNA, 23 nt, Mycobacterium avium subsp. paratuberculosis
ggucgacgcggggcggcggcgcc

SEQ ID NO: 2857584 - RNA, 18 nt, Mycobacterium avium subsp. paratuberculosis
ggucgacggagucgucgg

SEQ ID NO: 2857585 - RNA, 18 nt, Mycobacterium avium subsp. paratuberculosis
ggucgacuggucgucgag

SEQ ID NO: 2857586 - RNA, 16 nt, Mycobacterium avium subsp. paratuberculosis
ggucgacuugggcggg

SEQ ID NO: 2857587 - RNA, 19 nt, Mycobacterium avium subsp. paratuberculosis
ggucgacuugggcggggga

SEQ ID NO: 2857588 - RNA, 19 nt, Mycobacterium avium subsp. paratuberculosis
ggucgagacaccgucgcgc

SEQ ID NO: 2857589 - RNA, 20 nt, Mycobacterium avium subsp. paratuberculosis
ggucgagacaccgucgcgca

SEQ ID NO: 2857590 - RNA, 13 nt, Mycobacterium avium subsp. paratuberculosis
ggucgagaucagc

SEQ ID NO: 2857591 - RNA, 15 nt, Mycobacterium avium subsp. paratuberculosis
ggucgagaucagcac

SEQ ID NO: 2857592 - RNA, 16 nt, Mycobacterium avium subsp. paratuberculosis
ggucgagaucagcacc

SEQ ID NO: 2857593 - RNA, 19 nt, Mycobacterium avium subsp. paratuberculosis
ggucgagcagcagccgccg

SEQ ID NO: 2857594 - RNA, 13 nt, Mycobacterium avium subsp. paratuberculosis
ggucgagcaugcg

SEQ ID NO: 2857595 - RNA, 13 nt, Mycobacterium avium subsp. paratuberculosis
ggucgagcgcgcc

SEQ ID NO: 2857596 - RNA, 16 nt, Mycobacterium avium subsp. paratuberculosis
ggucgagcggcccgca

SEQ ID NO: 2857597 - RNA, 13 nt, Mycobacterium avium subsp. paratuberculosis
ggucgaggccggc

SEQ ID NO: 2857598 - RNA, 15 nt, Mycobacterium avium subsp. paratuberculosis
ggucgaggccggcca

SEQ ID NO: 2857599 - RNA, 22 nt, Mycobacterium avium subsp. paratuberculosis
ggucgcgaagacgcuggccacg

SEQ ID NO: 2857600 - RNA, 16 nt, Mycobacterium avium subsp. paratuberculosis
ggucgcgaagcguaug

SEQ ID NO: 2857601 - RNA, 10 nt, Mycobacterium avium subsp. paratuberculosis
ggucgcgacc

SEQ ID NO: 2857602 - RNA, 13 nt, Mycobacterium avium subsp. paratuberculosis
ggucgcgacccgg

SEQ ID NO: 2857603 - RNA, 17 nt, Mycobacterium avium subsp. paratuberculosis
ggucgcgcagcauggcc

SEQ ID NO: 2857604 - RNA, 16 nt, Mycobacterium avium subsp. paratuberculosis
ggucgcgcagccgccg

SEQ ID NO: 2857605 - RNA, 20 nt, Mycobacterium avium subsp. paratuberculosis
ggucgcgcagccgccgggcu

SEQ ID NO: 2857606 - RNA, 16 nt, Mycobacterium avium subsp. paratuberculosis
ggucgcgcagccgggc

SEQ ID NO: 2857607 - RNA, 17 nt, Mycobacterium avium subsp. paratuberculosis
ggucgcgcagccgggcg

SEQ ID NO: 2857608 - RNA, 22 nt, Mycobacterium avium subsp. paratuberculosis
ggucgcgcagccgggcggcgcu

SEQ ID NO: 2857609 - RNA, 20 nt, Mycobacterium avium subsp. paratuberculosis
ggucgcgcaucgccucggcg

SEQ ID NO: 2857610 - RNA, 13 nt, Mycobacterium avium subsp. paratuberculosis
ggucgcgccgcgg

SEQ ID NO: 2857611 - RNA, 17 nt, Mycobacterium avium subsp. paratuberculosis
ggucgcgccgcggcgcu

SEQ ID NO: 2857612 - RNA, 15 nt, Mycobacterium avium subsp. paratuberculosis
ggucgcgcgccggcg

SEQ ID NO: 2857613 - RNA, 17 nt, Mycobacterium avium subsp. paratuberculosis
ggucgcggaaccggccg

SEQ ID NO: 2857614 - RNA, 18 nt, Mycobacterium avium subsp. paratuberculosis
ggucgcggaucucgucgg

SEQ ID NO: 2857615 - RNA, 23 nt, Mycobacterium avium subsp. paratuberculosis
ggucgcggaucucgucgggccac

SEQ ID NO: 2857616 - RNA, 15 nt, Mycobacterium avium subsp. paratuberculosis
ggucgcggcaucccu

SEQ ID NO: 2857617 - RNA, 15 nt, Mycobacterium avium subsp. paratuberculosis
ggucgcggcccaccg

SEQ ID NO: 2857618 - RNA, 12 nt, Mycobacterium avium subsp. paratuberculosis
ggucgcggcccg

SEQ ID NO: 2857619 - RNA, 19 nt, Mycobacterium avium subsp. paratuberculosis
ggucgcggccuugcgcacc

SEQ ID NO: 2857620 - RNA, 20 nt, Mycobacterium avium subsp. paratuberculosis
ggucgcggccuugcgggccg

SEQ ID NO: 2857621 - RNA, 12 nt, Mycobacterium avium subsp. paratuberculosis
ggucgcggcgcc

SEQ ID NO: 2857622 - RNA, 16 nt, Mycobacterium avium subsp. paratuberculosis
ggucgcggcggccggc

SEQ ID NO: 2857623 - RNA, 20 nt, Mycobacterium avium subsp. paratuberculosis
ggucgcggcguugcccgcug

SEQ ID NO: 2857624 - RNA, 18 nt, Mycobacterium avium subsp. paratuberculosis
ggucgcggcuggugccgc

SEQ ID NO: 2857625 - RNA, 20 nt, Mycobacterium avium subsp. paratuberculosis
ggucgcggcuggugccgccg

SEQ ID NO: 2857626 - RNA, 18 nt, Mycobacterium avium subsp. paratuberculosis
ggucgcgggacaacacga

SEQ ID NO: 2857627 - RNA, 14 nt, Mycobacterium avium subsp. paratuberculosis
ggucgcgggcgccg

SEQ ID NO: 2857628 - RNA, 15 nt, Mycobacterium avium subsp. paratuberculosis
ggucgcgggcgccga

SEQ ID NO: 2857629 - RNA, 13 nt, Mycobacterium avium subsp. paratuberculosis
ggucgcggucggc

SEQ ID NO: 2857630 - RNA, 20 nt, Mycobacterium avium subsp. paratuberculosis
ggucgcggucggcgcccggc

SEQ ID NO: 2857631 - RNA, 13 nt, Mycobacterium avium subsp. paratuberculosis
ggucgcggugauc

SEQ ID NO: 2857632 - RNA, 14 nt, Mycobacterium avium subsp. paratuberculosis
ggucgcggugccca

SEQ ID NO: 2857633 - RNA, 15 nt, Mycobacterium avium subsp. paratuberculosis
ggucgcggugcccag

SEQ ID NO: 2857634 - RNA, 17 nt, Mycobacterium avium subsp. paratuberculosis
ggucgcggugcccagcc

SEQ ID NO: 2857635 - RNA, 20 nt, Mycobacterium avium subsp. paratuberculosis
ggucgcggugcccagccgca

SEQ ID NO: 2857636 - RNA, 21 nt, Mycobacterium avium subsp. paratuberculosis
ggucgcggugggcgcgggccg

SEQ ID NO: 2857637 - RNA, 19 nt, Mycobacterium avium subsp. paratuberculosis
ggucgcggugggcucggcg

SEQ ID NO: 2857638 - RNA, 22 nt, Mycobacterium avium subsp. paratuberculosis
ggucgcguacgggaugaucagc

SEQ ID NO: 2857639 - RNA, 23 nt, Mycobacterium avium subsp. paratuberculosis
ggucgcguacgggaugaucagca

SEQ ID NO: 2857640 - RNA, 19 nt, Mycobacterium avium subsp. paratuberculosis
ggucgcgucgucggcgggc

SEQ ID NO: 2857641 - RNA, 15 nt, Mycobacterium avium subsp. paratuberculosis
ggucgcgucgugcgg

SEQ ID NO: 2857642 - RNA, 18 nt, Mycobacterium avium subsp. paratuberculosis
ggucgcgucgugcggccg

SEQ ID NO: 2857643 - RNA, 20 nt, Mycobacterium avium subsp. paratuberculosis
ggucgcgucgugcggccggc

SEQ ID NO: 2857644 - RNA, 23 nt, Mycobacterium avium subsp. paratuberculosis
ggucgcgucgugcggccggcgcc

SEQ ID NO: 2857645 - RNA, 13 nt, Mycobacterium avium subsp. paratuberculosis
ggucgcgugaccg

SEQ ID NO: 2857646 - RNA, 17 nt, Mycobacterium avium subsp. paratuberculosis
ggucgcgugaccggcgg

SEQ ID NO: 2857647 - RNA, 19 nt, Mycobacterium avium subsp. paratuberculosis
ggucgcguugaaagccgcg

SEQ ID NO: 2857648 - RNA, 15 nt, Mycobacterium avium subsp. paratuberculosis
ggucgcugaccccgc

SEQ ID NO: 2857649 - RNA, 23 nt, Mycobacterium avium subsp. paratuberculosis
ggucgcugaccccgcucggcgug

SEQ ID NO: 2857650 - RNA, 20 nt, Mycobacterium avium subsp. paratuberculosis
ggucgcugcagcggcggcca

SEQ ID NO: 2857651 - RNA, 16 nt, Mycobacterium avium subsp. paratuberculosis
ggucgcugcgcucgcc

SEQ ID NO: 2857652 - RNA, 13 nt, Mycobacterium avium subsp. paratuberculosis
ggucgcuggccgc

SEQ ID NO: 2857653 - RNA, 14 nt, Mycobacterium avium subsp. paratuberculosis
ggucgcugggcucg

SEQ ID NO: 2857654 - RNA, 15 nt, Mycobacterium avium subsp. paratuberculosis
ggucggacgcgggga

SEQ ID NO: 2857655 - RNA, 20 nt, Mycobacterium avium subsp. paratuberculosis
ggucggagcaaauccggcag

SEQ ID NO: 2857656 - RNA, 22 nt, Mycobacterium avium subsp. paratuberculosis
ggucggagcaaauccggcagcg

SEQ ID NO: 2857657 - RNA, 16 nt, Mycobacterium avium subsp. paratuberculosis
ggucggagcgcuccac

SEQ ID NO: 2857658 - RNA, 18 nt, Mycobacterium avium subsp. paratuberculosis
ggucggaggccuugguga

SEQ ID NO: 2857659 - RNA, 19 nt, Mycobacterium avium subsp. paratuberculosis
ggucggcaacccgaccucg

SEQ ID NO: 2857660 - RNA, 15 nt, Mycobacterium avium subsp. paratuberculosis
ggucggcaggauccg

SEQ ID NO: 2857661 - RNA, 21 nt, Mycobacterium avium subsp. paratuberculosis
ggucggcauagcgccgcucgg

SEQ ID NO: 2857662 - RNA, 19 nt, Mycobacterium avium subsp. paratuberculosis
ggucggccacgacgcggcg

SEQ ID NO: 2857663 - RNA, 22 nt, Mycobacterium avium subsp. paratuberculosis
ggucggccacgacgcggcgcgc

SEQ ID NO: 2857664 - RNA, 12 nt, Mycobacterium avium subsp. paratuberculosis
ggucggccagcg

SEQ ID NO: 2857665 - RNA, 16 nt, Mycobacterium avium subsp. paratuberculosis
ggucggccagcgaaug

SEQ ID NO: 2857666 - RNA, 21 nt, Mycobacterium avium subsp. paratuberculosis
ggucggccagcgcgcgcagcg

SEQ ID NO: 2857667 - RNA, 13 nt, Mycobacterium avium subsp. paratuberculosis
ggucggccagcug

SEQ ID NO: 2857668 - RNA, 20 nt, Mycobacterium avium subsp. paratuberculosis
ggucggccccgcgcaucggu

SEQ ID NO: 2857669 - RNA, 13 nt, Mycobacterium avium subsp. paratuberculosis
ggucggcccgcug

SEQ ID NO: 2857670 - RNA, 18 nt, Mycobacterium avium subsp. paratuberculosis
ggucggcccgcugcggcu

SEQ ID NO: 2857671 - RNA, 17 nt, Mycobacterium avium subsp. paratuberculosis
ggucggccgcggccggc

SEQ ID NO: 2857672 - RNA, 17 nt, Mycobacterium avium subsp. paratuberculosis
ggucggccggcaggccg

SEQ ID NO: 2857673 - RNA, 14 nt, Mycobacterium avium subsp. paratuberculosis
ggucggccuggccc

SEQ ID NO: 2857674 - RNA, 15 nt, Mycobacterium avium subsp. paratuberculosis
ggucggccuggccca

SEQ ID NO: 2857675 - RNA, 15 nt, Mycobacterium avium subsp. paratuberculosis
ggucggcgaccaugc

SEQ ID NO: 2857676 - RNA, 14 nt, Mycobacterium avium subsp. paratuberculosis
ggucggcgacgccg

SEQ ID NO: 2857677 - RNA, 15 nt, Mycobacterium avium subsp. paratuberculosis
ggucggcgacgccgu

SEQ ID NO: 2857678 - RNA, 15 nt, Mycobacterium avium subsp. paratuberculosis
ggucggcgacguaca

SEQ ID NO: 2857679 - RNA, 15 nt, Mycobacterium avium subsp. paratuberculosis
ggucggcgagcagcc

SEQ ID NO: 2857680 - RNA, 20 nt, Mycobacterium avium subsp. paratuberculosis
ggucggcgagcuuguccugc

SEQ ID NO: 2857681 - RNA, 12 nt, Mycobacterium avium subsp. paratuberculosis
ggucggcgaugc

SEQ ID NO: 2857682 - RNA, 13 nt, Mycobacterium avium subsp. paratuberculosis
ggucggcgaugcg

SEQ ID NO: 2857683 - RNA, 17 nt, Mycobacterium avium subsp. paratuberculosis
ggucggcgcccggccca

SEQ ID NO: 2857684 - RNA, 14 nt, Mycobacterium avium subsp. paratuberculosis
ggucgucgggcggc

SEQ ID NO: 2857685 - RNA, 15 nt, Mycobacterium avium subsp. paratuberculosis
ggucgucgggcggca

SEQ ID NO: 2857686 - RNA, 13 nt, Mycobacterium avium subsp. paratuberculosis
ggucgucgucgaa

SEQ ID NO: 2857687 - RNA, 16 nt, Mycobacterium avium subsp. paratuberculosis
ggucgucgucgccgcg

SEQ ID NO: 2857688 - RNA, 13 nt, Mycobacterium avium subsp. paratuberculosis
ggucgucguggug

SEQ ID NO: 2857689 - RNA, 14 nt, Mycobacterium avium subsp. paratuberculosis
ggucgucgugguga

SEQ ID NO: 2857690 - RNA, 20 nt, Mycobacterium avium subsp. paratuberculosis
ggucgucuucuuggccgcgg

SEQ ID NO: 2857691 - RNA, 22 nt, Mycobacterium avium subsp. paratuberculosis
ggucgucuucuuggccgcggcc

SEQ ID NO: 2857692 - RNA, 23 nt, Mycobacterium avium subsp. paratuberculosis
ggucgucuucuuggccgcggccu

SEQ ID NO: 2857693 - RNA, 23 nt, Mycobacterium avium subsp. paratuberculosis
ggucgugaaacauggcgcccgcg

SEQ ID NO: 2857694 - RNA, 12 nt, Mycobacterium avium subsp. paratuberculosis
ggucgugcagca

SEQ ID NO: 2857695 - RNA, 17 nt, Mycobacterium avium subsp. paratuberculosis
ggucgugcaucggcgcc

SEQ ID NO: 2857696 - RNA, 14 nt, Mycobacterium avium subsp. paratuberculosis
ggucgugcggcggc

SEQ ID NO: 2857697 - RNA, 19 nt, Mycobacterium avium subsp. paratuberculosis
ggucgugcgggaugccgag

SEQ ID NO: 2857698 - RNA, 21 nt, Mycobacterium avium subsp. paratuberculosis
ggucgugcgggaugccgagca

SEQ ID NO: 2857699 - RNA, 15 nt, Mycobacterium avium subsp. paratuberculosis
ggucgugcucgucgg

SEQ ID NO: 2857700 - RNA, 21 nt, Mycobacterium avium subsp. paratuberculosis
ggucgugcucgucggcgggca

SEQ ID NO: 2857701 - RNA, 15 nt, Mycobacterium avium subsp. paratuberculosis
ggucgugcugggccg

SEQ ID NO: 2857702 - RNA, 22 nt, Mycobacterium avium subsp. paratuberculosis
ggucguucagcugaacggugcc

SEQ ID NO: 2857703 - RNA, 19 nt, Mycobacterium avium subsp. paratuberculosis
ggucguuggagucguccga

SEQ ID NO: 2857704 - RNA, 14 nt, Mycobacterium avium subsp. paratuberculosis
ggucguuggccucc

SEQ ID NO: 2857705 - RNA, 15 nt, Mycobacterium avium subsp. paratuberculosis
ggucguuggccuccu

SEQ ID NO: 2857706 - RNA, 16 nt, Mycobacterium avium subsp. paratuberculosis
ggucguuggcggcggu

SEQ ID NO: 2857707 - RNA, 20 nt, Mycobacterium avium subsp. paratuberculosis
ggucguuucggccggccccg

SEQ ID NO: 2857708 - RNA, 16 nt, Mycobacterium avium subsp. paratuberculosis
ggucucagcgcccgcc

SEQ ID NO: 2857709 - RNA, 17 nt, Mycobacterium avium subsp. paratuberculosis
ggucuccaugucgucgg

SEQ ID NO: 2857710 - RNA, 19 nt, Mycobacterium avium subsp. paratuberculosis
ggucucccagacgucgacc

SEQ ID NO: 2857711 - RNA, 15 nt, Mycobacterium avium subsp. paratuberculosis
ggucuccggccccga

SEQ ID NO: 2857712 - RNA, 18 nt, Mycobacterium avium subsp. paratuberculosis
ggucuccggccccgagcc

SEQ ID NO: 2857713 - RNA, 20 nt, Mycobacterium avium subsp. paratuberculosis
ggucuccgggcugugggcgc

SEQ ID NO: 2857714 - RNA, 19 nt, Mycobacterium avium subsp. paratuberculosis
ggucuccguagcccugcag

SEQ ID NO: 2857715 - RNA, 17 nt, Mycobacterium avium subsp. paratuberculosis
ggucucgaacacgccgu

SEQ ID NO: 2857716 - RNA, 17 nt, Mycobacterium avium subsp. paratuberculosis
ggucucgaaccgggcgg

SEQ ID NO: 2857717 - RNA, 21 nt, Mycobacterium avium subsp. paratuberculosis
ggucucgaaccgggcggugac

SEQ ID NO: 2857718 - RNA, 20 nt, Mycobacterium avium subsp. paratuberculosis
ggucucgaccgcggcgccga

SEQ ID NO: 2857719 - RNA, 20 nt, Mycobacterium avium subsp. paratuberculosis
ggucucgaucugcaccagcg

SEQ ID NO: 2857720 - RNA, 23 nt, Mycobacterium avium subsp. paratuberculosis
ggucucgcaccugccgucgacga

SEQ ID NO: 2857721 - RNA, 22 nt, Mycobacterium avium subsp. paratuberculosis
ggucucgcgcagcacgaugauc

SEQ ID NO: 2857722 - RNA, 12 nt, Mycobacterium avium subsp. paratuberculosis
ggucucggcgag

SEQ ID NO: 2857723 - RNA, 15 nt, Mycobacterium avium subsp. paratuberculosis
ggucucggcgaggcg

SEQ ID NO: 2857724 - RNA, 16 nt, Mycobacterium avium subsp. paratuberculosis
ggucucggcggcgccc

SEQ ID NO: 2857725 - RNA, 17 nt, Mycobacterium avium subsp. paratuberculosis
ggucucggcggcgccca

SEQ ID NO: 2857726 - RNA, 19 nt, Mycobacterium avium subsp. paratuberculosis
ggucucggcggcgcccagg

SEQ ID NO: 2857727 - RNA, 16 nt, Mycobacterium avium subsp. paratuberculosis
ggucucgggcaccacg

SEQ ID NO: 2857728 - RNA, 18 nt, Mycobacterium avium subsp. paratuberculosis
ggucucgggcaccacgcc

SEQ ID NO: 2857729 - RNA, 17 nt, Mycobacterium avium subsp. paratuberculosis
ggucucgggcagcagca

SEQ ID NO: 2857730 - RNA, 20 nt, Mycobacterium avium subsp. paratuberculosis
ggucucgggcagcagcacca

SEQ ID NO: 2857731 - RNA, 16 nt, Mycobacterium avium subsp. paratuberculosis
ggucucggucgcggcg

SEQ ID NO: 2857732 - RNA, 16 nt, Mycobacterium avium subsp. paratuberculosis
ggucucguugugcacc

SEQ ID NO: 2857733 - RNA, 17 nt, Mycobacterium avium subsp. paratuberculosis
ggucucguugugcaccg

SEQ ID NO: 2857734 - RNA, 19 nt, Mycobacterium avium subsp. paratuberculosis
ggucugacccaugccccag

SEQ ID NO: 2857735 - RNA, 18 nt, Mycobacterium avium subsp. paratuberculosis
ggucugaccccccgacgc

SEQ ID NO: 2857736 - RNA, 23 nt, Mycobacterium avium subsp. paratuberculosis
ggucugaccccccgacgccgacg

SEQ ID NO: 2857737 - RNA, 16 nt, Mycobacterium avium subsp. paratuberculosis
ggucugaucgcccagc

SEQ ID NO: 2857738 - RNA, 23 nt, Mycobacterium avium subsp. paratuberculosis
ggucugcagcagccgcugcuggg

SEQ ID NO: 2857739 - RNA, 18 nt, Mycobacterium avium subsp. paratuberculosis
ggucugccacgcccaccg

SEQ ID NO: 2857740 - RNA, 20 nt, Mycobacterium avium subsp. paratuberculosis
ggucugccagaacggcggca

SEQ ID NO: 2857741 - RNA, 17 nt, Mycobacterium avium subsp. paratuberculosis
ggucugccuggcgaacu

SEQ ID NO: 2857742 - RNA, 21 nt, Mycobacterium avium subsp. paratuberculosis
ggucugcgccagcuccagcag

SEQ ID NO: 2857743 - RNA, 14 nt, Mycobacterium avium subsp. paratuberculosis
ggucugcgcccgau

SEQ ID NO: 2857744 - RNA, 13 nt, Mycobacterium avium subsp. paratuberculosis
ggucugcgccggc

SEQ ID NO: 2857745 - RNA, 16 nt, Mycobacterium avium subsp. paratuberculosis
ggucugcgccggcggu

SEQ ID NO: 2857746 - RNA, 21 nt, Mycobacterium avium subsp. paratuberculosis
ggucugcgccggcggugucga

SEQ ID NO: 2857747 - RNA, 14 nt, Mycobacterium avium subsp. paratuberculosis
ggucugcggccgcg

SEQ ID NO: 2857748 - RNA, 17 nt, Mycobacterium avium subsp. paratuberculosis
ggucugcggccgcgacu

SEQ ID NO: 2857749 - RNA, 13 nt, Mycobacterium avium subsp. paratuberculosis
ggucugcggccgg

SEQ ID NO: 2857750 - RNA, 17 nt, Mycobacterium avium subsp. paratuberculosis
ggucugcggccggggca

SEQ ID NO: 2857751 - RNA, 15 nt, Mycobacterium avium subsp. paratuberculosis
ggucugcggugcgcc

SEQ ID NO: 2857752 - RNA, 20 nt, Mycobacterium avium subsp. paratuberculosis
ggucugcggugcgcccaggu

SEQ ID NO: 2857753 - RNA, 15 nt, Mycobacterium avium subsp. paratuberculosis
ggucugggcgaacgg

SEQ ID NO: 2857754 - RNA, 17 nt, Mycobacterium avium subsp. paratuberculosis
ggucugggcgaccaugc

SEQ ID NO: 2857755 - RNA, 13 nt, Mycobacterium avium subsp. paratuberculosis
ggucuuccacgcc

SEQ ID NO: 2857756 - RNA, 15 nt, Mycobacterium avium subsp. paratuberculosis
ggucuucccgccgcc

SEQ ID NO: 2857757 - RNA, 14 nt, Mycobacterium avium subsp. paratuberculosis
ggucuucggucccg

SEQ ID NO: 2857758 - RNA, 19 nt, Mycobacterium avium subsp. paratuberculosis
ggucuucggucccggcggg

SEQ ID NO: 2857759 - RNA, 13 nt, Mycobacterium avium subsp. paratuberculosis
ggucuucucggcc

SEQ ID NO: 2857760 - RNA, 16 nt, Mycobacterium avium subsp. paratuberculosis
ggucuucucggccagg

SEQ ID NO: 2857761 - RNA, 19 nt, Mycobacterium avium subsp. paratuberculosis
ggucuuggcggccagcgcc

SEQ ID NO: 2857762 - RNA, 14 nt, Mycobacterium avium subsp. paratuberculosis
ggucuuggcguugc

SEQ ID NO: 2857763 - RNA, 21 nt, Mycobacterium avium subsp. paratuberculosis
ggucuuucaucgccccggcga

SEQ ID NO: 2857764 - RNA, 18 nt, Mycobacterium avium subsp. paratuberculosis
ggugaaaccguuggccug

SEQ ID NO: 2857765 - RNA, 17 nt, Mycobacterium avium subsp. paratuberculosis
ggugaaauagcgcagca

SEQ ID NO: 2857766 - RNA, 19 nt, Mycobacterium avium subsp. paratuberculosis
ggugaacagcagccacgac

SEQ ID NO: 2857767 - RNA, 16 nt, Mycobacterium avium subsp. paratuberculosis
ggugaacagguaggcg

SEQ ID NO: 2857768 - RNA, 16 nt, Mycobacterium avium subsp. paratuberculosis
ggugaacccgacguug

SEQ ID NO: 2857769 - RNA, 15 nt, Mycobacterium avium subsp. paratuberculosis
ggugagacggccagc

SEQ ID NO: 2857770 - RNA, 16 nt, Mycobacterium avium subsp. paratuberculosis
ggugagacggccagca

SEQ ID NO: 2857771 - RNA, 20 nt, Mycobacterium avium subsp. paratuberculosis
ggugagacggccagcagcac

SEQ ID NO: 2857772 - RNA, 23 nt, Mycobacterium avium subsp. paratuberculosis
ggugagcaacagcgcuucgcgcu

SEQ ID NO: 2857773 - RNA, 11 nt, Mycobacterium avium subsp. paratuberculosis
ggugagcaccg

SEQ ID NO: 2857774 - RNA, 14 nt, Mycobacterium avium subsp. paratuberculosis
ggugagcaccgccg

SEQ ID NO: 2857775 - RNA, 13 nt, Mycobacterium avium subsp. paratuberculosis
ggugagcaccggg

SEQ ID NO: 2857776 - RNA, 13 nt, Mycobacterium avium subsp. paratuberculosis
ggugagcaccguu

SEQ ID NO: 2857777 - RNA, 16 nt, Mycobacterium avium subsp. paratuberculosis
ggugagcacgaccgcc

SEQ ID NO: 2857778 - RNA, 11 nt, Mycobacterium avium subsp. paratuberculosis
ggugagcagaa

SEQ ID NO: 2857779 - RNA, 16 nt, Mycobacterium avium subsp. paratuberculosis
ggugagcagcaugccg

SEQ ID NO: 2857780 - RNA, 17 nt, Mycobacterium avium subsp. paratuberculosis
ggugagcagggccagcg

SEQ ID NO: 2857781 - RNA, 23 nt, Mycobacterium avium subsp. paratuberculosis
ggugagcagggccagcggcaacu

SEQ ID NO: 2857782 - RNA, 21 nt, Mycobacterium avium subsp. paratuberculosis
ggugagccgccacagcgccuc

SEQ ID NO: 2857783 - RNA, 19 nt, Mycobacterium avium subsp. paratuberculosis
ggugagccggucgaacgcc

SEQ ID NO: 2857784 - RNA, 22 nt, Mycobacterium avium subsp. paratuberculosis
ggugagccucagggcgcgcugu

SEQ ID NO: 2857785 - RNA, 16 nt, Mycobacterium avium subsp. paratuberculosis
ggugagcgccaccccg

SEQ ID NO: 2857786 - RNA, 19 nt, Mycobacterium avium subsp. paratuberculosis
ggugagcgcgucgagcacc

SEQ ID NO: 2857787 - RNA, 17 nt, Mycobacterium avium subsp. paratuberculosis
ggugagcggccgcagcg

SEQ ID NO: 2857788 - RNA, 16 nt, Mycobacterium avium subsp. paratuberculosis
ggugagcgugucgcgc

SEQ ID NO: 2857789 - RNA, 17 nt, Mycobacterium avium subsp. paratuberculosis
ggugagcuggccgcgca

SEQ ID NO: 2857790 - RNA, 17 nt, Mycobacterium avium subsp. paratuberculosis
ggugaggacgcccggcg

SEQ ID NO: 2857791 - RNA, 20 nt, Mycobacterium avium subsp. paratuberculosis
ggugaggacgcccggcgagu

SEQ ID NO: 2857792 - RNA, 14 nt, Mycobacterium avium subsp. paratuberculosis
ggugaggcacccgc

SEQ ID NO: 2857793 - RNA, 17 nt, Mycobacterium avium subsp. paratuberculosis
ggugaggcacccgcugc

SEQ ID NO: 2857794 - RNA, 15 nt, Mycobacterium avium subsp. paratuberculosis
ggugaggccaggcgu

SEQ ID NO: 2857795 - RNA, 13 nt, Mycobacterium avium subsp. paratuberculosis
ggugaggggcgcg

SEQ ID NO: 2857796 - RNA, 14 nt, Mycobacterium avium subsp. paratuberculosis
ggugaggggcgcgc

SEQ ID NO: 2857797 - RNA, 16 nt, Mycobacterium avium subsp. paratuberculosis
ggugaggucgcgcagg

SEQ ID NO: 2857798 - RNA, 14 nt, Mycobacterium avium subsp. paratuberculosis
ggugaguagccgau

SEQ ID NO: 2857799 - RNA, 19 nt, Mycobacterium avium subsp. paratuberculosis
ggugaguucaucgacgucg

SEQ ID NO: 2857800 - RNA, 14 nt, Mycobacterium avium subsp. paratuberculosis
ggugaucacccagc

SEQ ID NO: 2857801 - RNA, 13 nt, Mycobacterium avium subsp. paratuberculosis
ggugaucacccgc

SEQ ID NO: 2857802 - RNA, 18 nt, Mycobacterium avium subsp. paratuberculosis
ggugaucacccgccgggu

SEQ ID NO: 2857803 - RNA, 21 nt, Mycobacterium avium subsp. paratuberculosis
ggugaucaggcccucgucggc

SEQ ID NO: 2857804 - RNA, 15 nt, Mycobacterium avium subsp. paratuberculosis
ggugaucaggguccc

SEQ ID NO: 2857805 - RNA, 13 nt, Mycobacterium avium subsp. paratuberculosis
ggugaucccagga

SEQ ID NO: 2857806 - RNA, 15 nt, Mycobacterium avium subsp. paratuberculosis
ggugaucccaggaac

SEQ ID NO: 2857807 - RNA, 21 nt, Mycobacterium avium subsp. paratuberculosis
ggugaucccaggaacgcgccc

SEQ ID NO: 2857808 - RNA, 15 nt, Mycobacterium avium subsp. paratuberculosis
ggugauccggugcca

SEQ ID NO: 2857809 - RNA, 22 nt, Mycobacterium avium subsp. paratuberculosis
ggugauccucgucuccggcggc

SEQ ID NO: 2857810 - RNA, 23 nt, Mycobacterium avium subsp. paratuberculosis
ggugauccucgucuccggcggca

SEQ ID NO: 2857811 - RNA, 23 nt, Mycobacterium avium subsp. paratuberculosis
ggugaucgacauagucgaggggc

SEQ ID NO: 2857812 - RNA, 13 nt, Mycobacterium avium subsp. paratuberculosis
ggugaucgaccgg

SEQ ID NO: 2857813 - RNA, 14 nt, Mycobacterium avium subsp. paratuberculosis
ggugaucgccagcc

SEQ ID NO: 2857814 - RNA, 15 nt, Mycobacterium avium subsp. paratuberculosis
ggugaucgccagccc

SEQ ID NO: 2857815 - RNA, 18 nt, Mycobacterium avium subsp. paratuberculosis
ggugaucgccagcccggc

SEQ ID NO: 2857816 - RNA, 13 nt, Mycobacterium avium subsp. paratuberculosis
ggugaucgccgac

SEQ ID NO: 2857817 - RNA, 16 nt, Mycobacterium avium subsp. paratuberculosis
ggugaucgccgacguc

SEQ ID NO: 2857818 - RNA, 17 nt, Mycobacterium avium subsp. paratuberculosis
ggugaucgccgacgucu

SEQ ID NO: 2857819 - RNA, 13 nt, Mycobacterium avium subsp. paratuberculosis
ggugaucgccgcg

SEQ ID NO: 2857820 - RNA, 15 nt, Mycobacterium avium subsp. paratuberculosis
ggugaucgccgcgga

SEQ ID NO: 2857821 - RNA, 20 nt, Mycobacterium avium subsp. paratuberculosis
ggugaucgccggaucgccga

SEQ ID NO: 2857822 - RNA, 22 nt, Mycobacterium avium subsp. paratuberculosis
ggugaucgccggaucgccgagg

SEQ ID NO: 2857823 - RNA, 17 nt, Mycobacterium avium subsp. paratuberculosis
ggugaucgcgaacgcgc

SEQ ID NO: 2857824 - RNA, 13 nt, Mycobacterium avium subsp. paratuberculosis
ggugaucgcggcc

SEQ ID NO: 2857825 - RNA, 18 nt, Mycobacterium avium subsp. paratuberculosis
ggugaucgcggcccgcgg

SEQ ID NO: 2857826 - RNA, 14 nt, Mycobacterium avium subsp. paratuberculosis
ggugaucgcggcgc

SEQ ID NO: 2857827 - RNA, 22 nt, Mycobacterium avium subsp. paratuberculosis
ggugaucgcggcgcugccgccg

SEQ ID NO: 2857828 - RNA, 19 nt, Mycobacterium avium subsp. paratuberculosis
ggugaucucaccggcggcg

SEQ ID NO: 2857829 - RNA, 17 nt, Mycobacterium avium subsp. paratuberculosis
ggugaucucgccgagca

SEQ ID NO: 2857830 - RNA, 20 nt, Mycobacterium avium subsp. paratuberculosis
ggugaucucgccgagcacac

SEQ ID NO: 2857831 - RNA, 21 nt, Mycobacterium avium subsp. paratuberculosis
ggugaucucgccgcgguggug

SEQ ID NO: 2857832 - RNA, 19 nt, Mycobacterium avium subsp. paratuberculosis
ggugaucugcaccagcgug

SEQ ID NO: 2857833 - RNA, 17 nt, Mycobacterium avium subsp. paratuberculosis
ggugaucugcgccguga

SEQ ID NO: 2857834 - RNA, 22 nt, Mycobacterium avium subsp. paratuberculosis
ggugaucuugcccagccacgcc

SEQ ID NO: 2857835 - RNA, 20 nt, Mycobacterium avium subsp. paratuberculosis
ggugaucuuggccuccaccg

SEQ ID NO: 2857836 - RNA, 19 nt, Mycobacterium avium subsp. paratuberculosis
ggugaucuuguuguuggug

SEQ ID NO: 2857837 - RNA, 20 nt, Mycobacterium avium subsp. paratuberculosis
ggugaugaaaaccgggcccu

SEQ ID NO: 2857838 - RNA, 19 nt, Mycobacterium avium subsp. paratuberculosis
ggugaugaacgcgccgucg

SEQ ID NO: 2857839 - RNA, 17 nt, Mycobacterium avium subsp. paratuberculosis
ggugaugacgucgccca

SEQ ID NO: 2857840 - RNA, 22 nt, Mycobacterium avium subsp. paratuberculosis
ggugaugacguuggugaucgcc

SEQ ID NO: 2857841 - RNA, 16 nt, Mycobacterium avium subsp. paratuberculosis
ggugaugaggucgcga

SEQ ID NO: 2857842 - RNA, 21 nt, Mycobacterium avium subsp. paratuberculosis
ggugaugaggucgcgaccgcc

SEQ ID NO: 2857843 - RNA, 22 nt, Mycobacterium avium subsp. paratuberculosis
ggugaugaggucgcgaccgccg

SEQ ID NO: 2857844 - RNA, 22 nt, Mycobacterium avium subsp. paratuberculosis
ggugaugcagugguugagcagc

SEQ ID NO: 2857845 - RNA, 20 nt, Mycobacterium avium subsp. paratuberculosis
ggugaugccgagcgccgcgu

SEQ ID NO: 2857846 - RNA, 16 nt, Mycobacterium avium subsp. paratuberculosis
ggugaugccggccagc

SEQ ID NO: 2857847 - RNA, 14 nt, Mycobacterium avium subsp. paratuberculosis
ggugaugccggcgg

SEQ ID NO: 2857848 - RNA, 13 nt, Mycobacterium avium subsp. paratuberculosis
ggugaugcggccc

SEQ ID NO: 2857849 - RNA, 18 nt, Mycobacterium avium subsp. paratuberculosis
ggugaugcggcccgaccc

SEQ ID NO: 2857850 - RNA, 21 nt, Mycobacterium avium subsp. paratuberculosis
ggugauggacggggcgaugcc

SEQ ID NO: 2857851 - RNA, 21 nt, Mycobacterium avium subsp. paratuberculosis
ggugauggccaucuggccgcg

SEQ ID NO: 2857852 - RNA, 14 nt, Mycobacterium avium subsp. paratuberculosis
ggugauggucaccg

SEQ ID NO: 2857853 - RNA, 21 nt, Mycobacterium avium subsp. paratuberculosis
ggugauggucucccgggcggu

SEQ ID NO: 2857854 - RNA, 23 nt, Mycobacterium avium subsp. paratuberculosis
ggugcccuucgaguugccguugu

SEQ ID NO: 2857855 - RNA, 15 nt, Mycobacterium avium subsp. paratuberculosis
ggugccgaaccggau

SEQ ID NO: 2857856 - RNA, 22 nt, Mycobacterium avium subsp. paratuberculosis
ggugccgaagcgccacggggcg

SEQ ID NO: 2857857 - RNA, 17 nt, Mycobacterium avium subsp. paratuberculosis
ggugccgaagcgccgca

SEQ ID NO: 2857858 - RNA, 13 nt, Mycobacterium avium subsp. paratuberculosis
ggugccgaccgcg

SEQ ID NO: 2857859 - RNA, 14 nt, Mycobacterium avium subsp. paratuberculosis
ggugccgaccgcgu

SEQ ID NO: 2857860 - RNA, 17 nt, Mycobacterium avium subsp. paratuberculosis
ggugccgaccugggcgg

SEQ ID NO: 2857861 - RNA, 15 nt, Mycobacterium avium subsp. paratuberculosis
ggugccgacgaccuc

SEQ ID NO: 2857862 - RNA, 16 nt, Mycobacterium avium subsp. paratuberculosis
ggugccgacgaccucg

SEQ ID NO: 2857863 - RNA, 23 nt, Mycobacterium avium subsp. paratuberculosis
ggugccgacgaccucgucgucga

SEQ ID NO: 2857864 - RNA, 18 nt, Mycobacterium avium subsp. paratuberculosis
ggugccgacgagcucgcc

SEQ ID NO: 2857865 - RNA, 19 nt, Mycobacterium avium subsp. paratuberculosis
ggugccgacgagcucgccg

SEQ ID NO: 2857866 - RNA, 22 nt, Mycobacterium avium subsp. paratuberculosis
ggugccgacgagcucgccgcug

SEQ ID NO: 2857867 - RNA, 23 nt, Mycobacterium avium subsp. paratuberculosis
ggugccgacgauccgggcgcccu

SEQ ID NO: 2857868 - RNA, 20 nt, Mycobacterium avium subsp. paratuberculosis
ggugccgacgaugagggcca

SEQ ID NO: 2857869 - RNA, 20 nt, Mycobacterium avium subsp. paratuberculosis
ggugccgacggugcgugcca

SEQ ID NO: 2857870 - RNA, 22 nt, Mycobacterium avium subsp. paratuberculosis
ggugccgacggugcgugccagc

SEQ ID NO: 2857871 - RNA, 14 nt, Mycobacterium avium subsp. paratuberculosis
ggugccgagcacgc

SEQ ID NO: 2857872 - RNA, 16 nt, Mycobacterium avium subsp. paratuberculosis
ggugccgagcacgcgg

SEQ ID NO: 2857873 - RNA, 21 nt, Mycobacterium avium subsp. paratuberculosis
ggugccgagcacgcggccgcg

SEQ ID NO: 2857874 - RNA, 14 nt, Mycobacterium avium subsp. paratuberculosis
ggugccgagcgcgc

SEQ ID NO: 2857875 - RNA, 18 nt, Mycobacterium avium subsp. paratuberculosis
ggugccgagcgcgcuugg

SEQ ID NO: 2857876 - RNA, 19 nt, Mycobacterium avium subsp. paratuberculosis
ggugccgaguucgaccucg

SEQ ID NO: 2857877 - RNA, 20 nt, Mycobacterium avium subsp. paratuberculosis
ggugccgaguucgaccucgg

SEQ ID NO: 2857878 - RNA, 16 nt, Mycobacterium avium subsp. paratuberculosis
ggugccgaucaccucg

SEQ ID NO: 2857879 - RNA, 15 nt, Mycobacterium avium subsp. paratuberculosis
ggugccgcagccguc

SEQ ID NO: 2857880 - RNA, 13 nt, Mycobacterium avium subsp. paratuberculosis
ggugccgcagcgg

SEQ ID NO: 2857881 - RNA, 15 nt, Mycobacterium avium subsp. paratuberculosis
ggugccgcagcggcg

SEQ ID NO: 2857882 - RNA, 16 nt, Mycobacterium avium subsp. paratuberculosis
ggugccgcagcggcgg

SEQ ID NO: 2857883 - RNA, 12 nt, Mycobacterium avium subsp. paratuberculosis
ggugccgcagcu

SEQ ID NO: 2857884 - RNA, 11 nt, Mycobacterium avium subsp. paratuberculosis
ggugccgcagu

SEQ ID NO: 2857885 - RNA, 20 nt, Mycobacterium avium subsp. paratuberculosis
ggugccgcagugccggcgca

SEQ ID NO: 2857886 - RNA, 20 nt, Mycobacterium avium subsp. paratuberculosis
ggugccgcccaucgaccgga

SEQ ID NO: 2857887 - RNA, 13 nt, Mycobacterium avium subsp. paratuberculosis
ggugccgccggcg

SEQ ID NO: 2857888 - RNA, 12 nt, Mycobacterium avium subsp. paratuberculosis
ggugccgccggu

SEQ ID NO: 2857889 - RNA, 23 nt, Mycobacterium avium subsp. paratuberculosis
ggugccgccgugcgcggcgacca

SEQ ID NO: 2857890 - RNA, 19 nt, Mycobacterium avium subsp. paratuberculosis
ggugccgcgaugcccgccg

SEQ ID NO: 2857891 - RNA, 13 nt, Mycobacterium avium subsp. paratuberculosis
ggugccgcgcagc

SEQ ID NO: 2857892 - RNA, 16 nt, Mycobacterium avium subsp. paratuberculosis
ggugccgcgcggcagg

SEQ ID NO: 2857893 - RNA, 14 nt, Mycobacterium avium subsp. paratuberculosis
ggugccgcggcgca

SEQ ID NO: 2857894 - RNA, 17 nt, Mycobacterium avium subsp. paratuberculosis
ggugccggccaccggcg

SEQ ID NO: 2857895 - RNA, 22 nt, Mycobacterium avium subsp. paratuberculosis
ggugccggccagaucgacgccg

SEQ ID NO: 2857896 - RNA, 15 nt, Mycobacterium avium subsp. paratuberculosis
ggugccggccgcgau

SEQ ID NO: 2857897 - RNA, 23 nt, Mycobacterium avium subsp. paratuberculosis
ggugccggccucgucggcgagca

SEQ ID NO: 2857898 - RNA, 12 nt, Mycobacterium avium subsp. paratuberculosis
ggugccggcggc

SEQ ID NO: 2857899 - RNA, 13 nt, Mycobacterium avium subsp. paratuberculosis
ggugccggcggcg

SEQ ID NO: 2857900 - RNA, 15 nt, Mycobacterium avium subsp. paratuberculosis
ggugccgggccaggu

SEQ ID NO: 2857901 - RNA, 16 nt, Mycobacterium avium subsp. paratuberculosis
ggugccggugacgguc

SEQ ID NO: 2857902 - RNA, 19 nt, Mycobacterium avium subsp. paratuberculosis
ggugccggugacggucagg

SEQ ID NO: 2857903 - RNA, 13 nt, Mycobacterium avium subsp. paratuberculosis
ggugccggugaug

SEQ ID NO: 2857904 - RNA, 23 nt, Mycobacterium avium subsp. paratuberculosis
ggugccgguguugccgacggcgc

SEQ ID NO: 2857905 - RNA, 20 nt, Mycobacterium avium subsp. paratuberculosis
ggugccgucgaucgcccgcu

SEQ ID NO: 2857906 - RNA, 21 nt, Mycobacterium avium subsp. paratuberculosis
ggugccgucgaucgcccgcuc

SEQ ID NO: 2857907 - RNA, 11 nt, Mycobacterium avium subsp. paratuberculosis
ggugccgucgc

SEQ ID NO: 2857908 - RNA, 13 nt, Mycobacterium avium subsp. paratuberculosis
ggugccgucgcgc

SEQ ID NO: 2857909 - RNA, 19 nt, Mycobacterium avium subsp. paratuberculosis
ggugccgucgcgcucgacg

SEQ ID NO: 2857910 - RNA, 22 nt, Mycobacterium avium subsp. paratuberculosis
ggugccgucgcgcucgacgaug

SEQ ID NO: 2857911 - RNA, 18 nt, Mycobacterium avium subsp. paratuberculosis
ggugccguugaccacgcc

SEQ ID NO: 2857912 - RNA, 21 nt, Mycobacterium avium subsp. paratuberculosis
ggugccguugaucagggcggc

SEQ ID NO: 2857913 - RNA, 22 nt, Mycobacterium avium subsp. paratuberculosis
ggugccguugaucagggcggcg

SEQ ID NO: 2857914 - RNA, 21 nt, Mycobacterium avium subsp. paratuberculosis
ggugcgaaaauggcugcccgg

SEQ ID NO: 2857915 - RNA, 18 nt, Mycobacterium avium subsp. paratuberculosis
ggugcgacgccgcgcagc

SEQ ID NO: 2857916 - RNA, 14 nt, Mycobacterium avium subsp. paratuberculosis
ggugcgacggcaau

SEQ ID NO: 2857917 - RNA, 14 nt, Mycobacterium avium subsp. paratuberculosis
ggugcgagccgcug

SEQ ID NO: 2857918 - RNA, 15 nt, Mycobacterium avium subsp. paratuberculosis
ggugcgagccgcuga

SEQ ID NO: 2857919 - RNA, 21 nt, Mycobacterium avium subsp. paratuberculosis
ggugcgauggcaacgccgguc

SEQ ID NO: 2857920 - RNA, 13 nt, Mycobacterium avium subsp. paratuberculosis
ggugcgcaccagc

SEQ ID NO: 2857921 - RNA, 16 nt, Mycobacterium avium subsp. paratuberculosis
ggugcgcaccagcagg

SEQ ID NO: 2857922 - RNA, 14 nt, Mycobacterium avium subsp. paratuberculosis
ggugcgcaccgaca

SEQ ID NO: 2857923 - RNA, 14 nt, Mycobacterium avium subsp. paratuberculosis
ggugcgcagcacgu

SEQ ID NO: 2857924 - RNA, 17 nt, Mycobacterium avium subsp. paratuberculosis
ggugcgcagcccgccgg

SEQ ID NO: 2857925 - RNA, 19 nt, Mycobacterium avium subsp. paratuberculosis
ggugcgcagcccgccggga

SEQ ID NO: 2857926 - RNA, 15 nt, Mycobacterium avium subsp. paratuberculosis
ggugcgcagccgcug

SEQ ID NO: 2857927 - RNA, 20 nt, Mycobacterium avium subsp. paratuberculosis
ggugcgcagcgcgucgucgg

SEQ ID NO: 2857928 - RNA, 15 nt, Mycobacterium avium subsp. paratuberculosis
ggugcgcagucgcug

SEQ ID NO: 2857929 - RNA, 18 nt, Mycobacterium avium subsp. paratuberculosis
ggugcgcauggcgugcug

SEQ ID NO: 2857930 - RNA, 12 nt, Mycobacterium avium subsp. paratuberculosis
ggugcgccacgc

SEQ ID NO: 2857931 - RNA, 20 nt, Mycobacterium avium subsp. paratuberculosis
ggugcgccacgcccgcagcg

SEQ ID NO: 2857932 - RNA, 15 nt, Mycobacterium avium subsp. paratuberculosis
ggugcgccacugcgg

SEQ ID NO: 2857933 - RNA, 16 nt, Mycobacterium avium subsp. paratuberculosis
ggugcgccagaucgcu

SEQ ID NO: 2857934 - RNA, 17 nt, Mycobacterium avium subsp. paratuberculosis
ggugcgccagaucgcug

SEQ ID NO: 2857935 - RNA, 13 nt, Mycobacterium avium subsp. paratuberculosis
ggugcgccaggca

SEQ ID NO: 2857936 - RNA, 17 nt, Mycobacterium avium subsp. paratuberculosis
ggugcgcccgucggugg

SEQ ID NO: 2857937 - RNA, 21 nt, Mycobacterium avium subsp. paratuberculosis
ggugcgccgccgcgucgccgc

SEQ ID NO: 2857938 - RNA, 16 nt, Mycobacterium avium subsp. paratuberculosis
ggugcgccgcucgucg

SEQ ID NO: 2857939 - RNA, 14 nt, Mycobacterium avium subsp. paratuberculosis
ggugcugggcaccc

SEQ ID NO: 2857940 - RNA, 18 nt, Mycobacterium avium subsp. paratuberculosis
ggugcuguccacaucggu

SEQ ID NO: 2857941 - RNA, 14 nt, Mycobacterium avium subsp. paratuberculosis
ggugcugucgucgc

SEQ ID NO: 2857942 - RNA, 19 nt, Mycobacterium avium subsp. paratuberculosis
ggugcugucgucgcccuga

SEQ ID NO: 2857943 - RNA, 19 nt, Mycobacterium avium subsp. paratuberculosis
ggugcuuaccggccggccg

SEQ ID NO: 2857944 - RNA, 20 nt, Mycobacterium avium subsp. paratuberculosis
ggugcuuaccggccggccgc

SEQ ID NO: 2857945 - RNA, 15 nt, Mycobacterium avium subsp. paratuberculosis
ggugcuuggcguuga

SEQ ID NO: 2857946 - RNA, 17 nt, Mycobacterium avium subsp. paratuberculosis
ggugcuuggucagcgcg

SEQ ID NO: 2857947 - RNA, 20 nt, Mycobacterium avium subsp. paratuberculosis
ggugcuuucgcgucugcucg

SEQ ID NO: 2857948 - RNA, 20 nt, Mycobacterium avium subsp. paratuberculosis
ggugcuuuugugucugcucg

SEQ ID NO: 2857949 - RNA, 19 nt, Mycobacterium avium subsp. paratuberculosis
gguggaaggugacgucgcc

SEQ ID NO: 2857950 - RNA, 17 nt, Mycobacterium avium subsp. paratuberculosis
gguggaauaggccgcgu

SEQ ID NO: 2857951 - RNA, 16 nt, Mycobacterium avium subsp. paratuberculosis
gguggaaugcaucgcg

SEQ ID NO: 2857952 - RNA, 19 nt, Mycobacterium avium subsp. paratuberculosis
gguggaaugcaucgcgauc

SEQ ID NO: 2857953 - RNA, 23 nt, Mycobacterium avium subsp. paratuberculosis
gguggaauucuggccgaccgccg

SEQ ID NO: 2857954 - RNA, 13 nt, Mycobacterium avium subsp. paratuberculosis
gguggacaccgcg

SEQ ID NO: 2857955 - RNA, 13 nt, Mycobacterium avium subsp. paratuberculosis
gguggacagaugc

SEQ ID NO: 2857956 - RNA, 14 nt, Mycobacterium avium subsp. paratuberculosis
gguggacagcgcga

SEQ ID NO: 2857957 - RNA, 19 nt, Mycobacterium avium subsp. paratuberculosis
gguggacgagcagccgcaa

SEQ ID NO: 2857958 - RNA, 13 nt, Mycobacterium avium subsp. paratuberculosis
gguggacgcccgc

SEQ ID NO: 2857959 - RNA, 15 nt, Mycobacterium avium subsp. paratuberculosis
gguggacgcccgcga

SEQ ID NO: 2857960 - RNA, 23 nt, Mycobacterium avium subsp. paratuberculosis
gguggacgcccgcgaggugucga

SEQ ID NO: 2857961 - RNA, 15 nt, Mycobacterium avium subsp. paratuberculosis
gguggacgccgcgca

SEQ ID NO: 2857962 - RNA, 24 nt, Mycobacterium avium subsp. paratuberculosis
gguggacgcgaccaggcccagcgg

SEQ ID NO: 2857963 - RNA, 15 nt, Mycobacterium avium subsp. paratuberculosis
gguggacgcggucgc

SEQ ID NO: 2857964 - RNA, 19 nt, Mycobacterium avium subsp. paratuberculosis
gguggacgcggucgccgcc

SEQ ID NO: 2857965 - RNA, 15 nt, Mycobacterium avium subsp. paratuberculosis
gguggacggucagcg

SEQ ID NO: 2857966 - RNA, 23 nt, Mycobacterium avium subsp. paratuberculosis
gguggacggucagcgcgccgucg

SEQ ID NO: 2857967 - RNA, 18 nt, Mycobacterium avium subsp. paratuberculosis
gguggacgucaggccgua

SEQ ID NO: 2857968 - RNA, 15 nt, Mycobacterium avium subsp. paratuberculosis
gguggacuccagcac

SEQ ID NO: 2857969 - RNA, 19 nt, Mycobacterium avium subsp. paratuberculosis
gguggacuccagcaccagc

SEQ ID NO: 2857970 - RNA, 20 nt, Mycobacterium avium subsp. paratuberculosis
gguggacuccagcaccagca

SEQ ID NO: 2857971 - RNA, 22 nt, Mycobacterium avium subsp. paratuberculosis
gguggacuccagcaccagcacg

SEQ ID NO: 2857972 - RNA, 15 nt, Mycobacterium avium subsp. paratuberculosis
gguggagaaguggcu

SEQ ID NO: 2857973 - RNA, 18 nt, Mycobacterium avium subsp. paratuberculosis
gguggagaaguggcuggu

SEQ ID NO: 2857974 - RNA, 17 nt, Mycobacterium avium subsp. paratuberculosis
gguggagauggccagca

SEQ ID NO: 2857975 - RNA, 13 nt, Mycobacterium avium subsp. paratuberculosis
gguggagcgcggc

SEQ ID NO: 2857976 - RNA, 12 nt, Mycobacterium avium subsp. paratuberculosis
gguggagcggcc

SEQ ID NO: 2857977 - RNA, 16 nt, Mycobacterium avium subsp. paratuberculosis
gguggaugaugccggc

SEQ ID NO: 2857978 - RNA, 19 nt, Mycobacterium avium subsp. paratuberculosis
gguggaugaugccggcggu

SEQ ID NO: 2857979 - RNA, 19 nt, Mycobacterium avium subsp. paratuberculosis
gguggaugcgagccagcug

SEQ ID NO: 2857980 - RNA, 14 nt, Mycobacterium avium subsp. paratuberculosis
gguggaugggcucg

SEQ ID NO: 2857981 - RNA, 20 nt, Mycobacterium avium subsp. paratuberculosis
gguggaugggcucgaccacg

SEQ ID NO: 2857982 - RNA, 21 nt, Mycobacterium avium subsp. paratuberculosis
gguggaugggcucgaccacgc

SEQ ID NO: 2857983 - RNA, 17 nt, Mycobacterium avium subsp. paratuberculosis
gguggauggucaccggg

SEQ ID NO: 2857984 - RNA, 22 nt, Mycobacterium avium subsp. paratuberculosis
gguggauugucggccgcccguc

SEQ ID NO: 2857985 - RNA, 14 nt, Mycobacterium avium subsp. paratuberculosis
gguggcaccccgcg

SEQ ID NO: 2857986 - RNA, 20 nt, Mycobacterium avium subsp. paratuberculosis
gguggcaccccgcgccgggc

SEQ ID NO: 2857987 - RNA, 15 nt, Mycobacterium avium subsp. paratuberculosis
gguggcagcccggcu

SEQ ID NO: 2857988 - RNA, 21 nt, Mycobacterium avium subsp. paratuberculosis
gguggccaaaaagugccggac

SEQ ID NO: 2857989 - RNA, 14 nt, Mycobacterium avium subsp. paratuberculosis
gguggccaccaccg

SEQ ID NO: 2857990 - RNA, 16 nt, Mycobacterium avium subsp. paratuberculosis
gguggccaccaccgag

SEQ ID NO: 2857991 - RNA, 20 nt, Mycobacterium avium subsp. paratuberculosis
gguggccaccaccgaggugg

SEQ ID NO: 2857992 - RNA, 13 nt, Mycobacterium avium subsp. paratuberculosis
gguggccaccgcg

SEQ ID NO: 2857993 - RNA, 22 nt, Mycobacterium avium subsp. paratuberculosis
gguggccaccgcgacgcccagg

SEQ ID NO: 2857994 - RNA, 13 nt, Mycobacterium avium subsp. paratuberculosis
gguggccacggcg

SEQ ID NO: 2857995 - RNA, 12 nt, Mycobacterium avium subsp. paratuberculosis
gguggccagcac

SEQ ID NO: 2857996 - RNA, 17 nt, Mycobacterium avium subsp. paratuberculosis
gguggccagcaccacgu

SEQ ID NO: 2857997 - RNA, 23 nt, Mycobacterium avium subsp. paratuberculosis
gguggccagcaccacguccgcgg

SEQ ID NO: 2857998 - RNA, 13 nt, Mycobacterium avium subsp. paratuberculosis
gguggccagcacg

SEQ ID NO: 2857999 - RNA, 14 nt, Mycobacterium avium subsp. paratuberculosis
gguggccagcacga

SEQ ID NO: 2858000 - RNA, 14 nt, Mycobacterium avium subsp. paratuberculosis
gguggccagcacgc

SEQ ID NO: 2858001 - RNA, 16 nt, Mycobacterium avium subsp. paratuberculosis
gguggccagcacgcug

SEQ ID NO: 2858002 - RNA, 20 nt, Mycobacterium avium subsp. paratuberculosis
gguggccagcacgcugcgga

SEQ ID NO: 2858003 - RNA, 15 nt, Mycobacterium avium subsp. paratuberculosis
gguggccagccaggu

SEQ ID NO: 2858004 - RNA, 23 nt, Mycobacterium avium subsp. paratuberculosis
gguggccaguucgucgcgcgacu

SEQ ID NO: 2858005 - RNA, 20 nt, Mycobacterium avium subsp. paratuberculosis
gguggccaucgcggccccca

SEQ ID NO: 2858006 - RNA, 19 nt, Mycobacterium avium subsp. paratuberculosis
gguggccaugcgcgagucg

SEQ ID NO: 2858007 - RNA, 21 nt, Mycobacterium avium subsp. paratuberculosis
gguggcccagccgcugacgau

SEQ ID NO: 2858008 - RNA, 22 nt, Mycobacterium avium subsp. paratuberculosis
gguggcccagccggccgacgcg

SEQ ID NO: 2858009 - RNA, 23 nt, Mycobacterium avium subsp. paratuberculosis
gguggcccaggcagacccccagc

SEQ ID NO: 2858010 - RNA, 16 nt, Mycobacterium avium subsp. paratuberculosis
gguggccccagcccgg

SEQ ID NO: 2858011 - RNA, 21 nt, Mycobacterium avium subsp. paratuberculosis
gguggccccagcccgggggug

SEQ ID NO: 2858012 - RNA, 18 nt, Mycobacterium avium subsp. paratuberculosis
gguggcccccaccacgaa

SEQ ID NO: 2858013 - RNA, 15 nt, Mycobacterium avium subsp. paratuberculosis
gguggccccgggccg

SEQ ID NO: 2858014 - RNA, 13 nt, Mycobacterium avium subsp. paratuberculosis
gguggcccgaccc

SEQ ID NO: 2858015 - RNA, 18 nt, Mycobacterium avium subsp. paratuberculosis
gguggcccgccacgugcg

SEQ ID NO: 2858016 - RNA, 15 nt, Mycobacterium avium subsp. paratuberculosis
gguggcccgcccggg

SEQ ID NO: 2858017 - RNA, 12 nt, Mycobacterium avium subsp. paratuberculosis
gguggcccgcgc

SEQ ID NO: 2858018 - RNA, 21 nt, Mycobacterium avium subsp. paratuberculosis
gguggcccgguacagcgccgc

SEQ ID NO: 2858019 - RNA, 17 nt, Mycobacterium avium subsp. paratuberculosis
gguggcccggucgucga

SEQ ID NO: 2858020 - RNA, 15 nt, Mycobacterium avium subsp. paratuberculosis
gguggccgaaccgcu

SEQ ID NO: 2858021 - RNA, 15 nt, Mycobacterium avium subsp. paratuberculosis
gguggccgacgugcc

SEQ ID NO: 2858022 - RNA, 20 nt, Mycobacterium avium subsp. paratuberculosis
gguggccgacgugccggugg

SEQ ID NO: 2858023 - RNA, 23 nt, Mycobacterium avium subsp. paratuberculosis
gguggccgaucagcggcgggccc

SEQ ID NO: 2858024 - RNA, 18 nt, Mycobacterium avium subsp. paratuberculosis
ggugggcgaacagcagca

SEQ ID NO: 2858025 - RNA, 21 nt, Mycobacterium avium subsp. paratuberculosis
ggugggcgaacgaggccgacg

SEQ ID NO: 2858026 - RNA, 18 nt, Mycobacterium avium subsp. paratuberculosis
ggugggcgacgucgucgc

SEQ ID NO: 2858027 - RNA, 21 nt, Mycobacterium avium subsp. paratuberculosis
ggugggcgacgucgucgccca

SEQ ID NO: 2858028 - RNA, 14 nt, Mycobacterium avium subsp. paratuberculosis
ggugggcgccggcg

SEQ ID NO: 2858029 - RNA, 16 nt, Mycobacterium avium subsp. paratuberculosis
ggugggcgccggcguc

SEQ ID NO: 2858030 - RNA, 14 nt, Mycobacterium avium subsp. paratuberculosis
ggugggcgccgggu

SEQ ID NO: 2858031 - RNA, 16 nt, Mycobacterium avium subsp. paratuberculosis
ggugggcgccggguca

SEQ ID NO: 2858032 - RNA, 14 nt, Mycobacterium avium subsp. paratuberculosis
ggugggcgcgcagc

SEQ ID NO: 2858033 - RNA, 15 nt, Mycobacterium avium subsp. paratuberculosis
ggugggcgcgggccg

SEQ ID NO: 2858034 - RNA, 13 nt, Mycobacterium avium subsp. paratuberculosis
ggugggcgcggug

SEQ ID NO: 2858035 - RNA, 15 nt, Mycobacterium avium subsp. paratuberculosis
ggugggcgcgguggu

SEQ ID NO: 2858036 - RNA, 12 nt, Mycobacterium avium subsp. paratuberculosis
ggugggcggcca

SEQ ID NO: 2858037 - RNA, 12 nt, Mycobacterium avium subsp. paratuberculosis
ggugggcggcgc

SEQ ID NO: 2858038 - RNA, 16 nt, Mycobacterium avium subsp. paratuberculosis
ggugggcggcgcccga

SEQ ID NO: 2858039 - RNA, 14 nt, Mycobacterium avium subsp. paratuberculosis
ggugggcgggcacc

SEQ ID NO: 2858040 - RNA, 21 nt, Mycobacterium avium subsp. paratuberculosis
ggugggcgugcaggccgcggg

SEQ ID NO: 2858041 - RNA, 14 nt, Mycobacterium avium subsp. paratuberculosis
ggugggcguggcgg

SEQ ID NO: 2858042 - RNA, 15 nt, Mycobacterium avium subsp. paratuberculosis
ggugggcucccaguc

SEQ ID NO: 2858043 - RNA, 15 nt, Mycobacterium avium subsp. paratuberculosis
ggugggcucggcgcc

SEQ ID NO: 2858044 - RNA, 16 nt, Mycobacterium avium subsp. paratuberculosis
ggugggcucggcgccg

SEQ ID NO: 2858045 - RNA, 13 nt, Mycobacterium avium subsp. paratuberculosis
ggugggcugggcg

SEQ ID NO: 2858046 - RNA, 15 nt, Mycobacterium avium subsp. paratuberculosis
gguggggacgacgcc

SEQ ID NO: 2858047 - RNA, 16 nt, Mycobacterium avium subsp. paratuberculosis
gguggggacgacgccg

SEQ ID NO: 2858048 - RNA, 20 nt, Mycobacterium avium subsp. paratuberculosis
gguggggaucacgucggcgu

SEQ ID NO: 2858049 - RNA, 12 nt, Mycobacterium avium subsp. paratuberculosis
gguggggcacca

SEQ ID NO: 2858050 - RNA, 14 nt, Mycobacterium avium subsp. paratuberculosis
gguggggcaccaga

SEQ ID NO: 2858051 - RNA, 18 nt, Mycobacterium avium subsp. paratuberculosis
gguggggcaccagaacac

SEQ ID NO: 2858052 - RNA, 15 nt, Mycobacterium avium subsp. paratuberculosis
gguggggcacgggcg

SEQ ID NO: 2858053 - RNA, 13 nt, Mycobacterium avium subsp. paratuberculosis
ggugggggccagg

SEQ ID NO: 2858054 - RNA, 16 nt, Mycobacterium avium subsp. paratuberculosis
ggugggguccgcaggc

SEQ ID NO: 2858055 - RNA, 20 nt, Mycobacterium avium subsp. paratuberculosis
gguggggucgguuuggcugg

SEQ ID NO: 2858056 - RNA, 18 nt, Mycobacterium avium subsp. paratuberculosis
gguggggugaggcacccg

SEQ ID NO: 2858057 - RNA, 15 nt, Mycobacterium avium subsp. paratuberculosis
gguggggugaugagg

SEQ ID NO: 2858058 - RNA, 18 nt, Mycobacterium avium subsp. paratuberculosis
ggugggguuagggcguca

SEQ ID NO: 2858059 - RNA, 17 nt, Mycobacterium avium subsp. paratuberculosis
gguggguccgccgggcg

SEQ ID NO: 2858060 - RNA, 17 nt, Mycobacterium avium subsp. paratuberculosis
gguggguccggucagca

SEQ ID NO: 2858061 - RNA, 21 nt, Mycobacterium avium subsp. paratuberculosis
ggugggugcucaccccggcca

SEQ ID NO: 2858062 - RNA, 14 nt, Mycobacterium avium subsp. paratuberculosis
gguggucacaccgc

SEQ ID NO: 2858063 - RNA, 18 nt, Mycobacterium avium subsp. paratuberculosis
gguggucaccaccaccag

SEQ ID NO: 2858064 - RNA, 18 nt, Mycobacterium avium subsp. paratuberculosis
gguggucaccagcgcggu

SEQ ID NO: 2858065 - RNA, 14 nt, Mycobacterium avium subsp. paratuberculosis
gguggucaccggca

SEQ ID NO: 2858066 - RNA, 17 nt, Mycobacterium avium subsp. paratuberculosis
gguggucagcggcgcca

SEQ ID NO: 2858067 - RNA, 19 nt, Mycobacterium avium subsp. paratuberculosis
ggugguccaggcgccgggu

SEQ ID NO: 2858068 - RNA, 23 nt, Mycobacterium avium subsp. paratuberculosis
ggugguccagucgauaguggcgu

SEQ ID NO: 2858069 - RNA, 17 nt, Mycobacterium avium subsp. paratuberculosis
gguggucgaacacggcg

SEQ ID NO: 2858070 - RNA, 22 nt, Mycobacterium avium subsp. paratuberculosis
gguggucgacgagcccgcgccc

SEQ ID NO: 2858071 - RNA, 13 nt, Mycobacterium avium subsp. paratuberculosis
gguggucgacgcg

SEQ ID NO: 2858072 - RNA, 17 nt, Mycobacterium avium subsp. paratuberculosis
gguggucgacgcgccgc

SEQ ID NO: 2858073 - RNA, 14 nt, Mycobacterium avium subsp. paratuberculosis
gguggucggcguca

SEQ ID NO: 2858074 - RNA, 22 nt, Mycobacterium avium subsp. paratuberculosis
gguggucugccagaacggcggc

SEQ ID NO: 2858075 - RNA, 13 nt, Mycobacterium avium subsp. paratuberculosis
gguggugaacgcg

SEQ ID NO: 2858076 - RNA, 16 nt, Mycobacterium avium subsp. paratuberculosis
gguggugaucacccag

SEQ ID NO: 2858077 - RNA, 20 nt, Mycobacterium avium subsp. paratuberculosis
gguggugaucacccagccgu

SEQ ID NO: 2858078 - RNA, 23 nt, Mycobacterium avium subsp. paratuberculosis
gguggugaucacccagccguugg

SEQ ID NO: 2858079 - RNA, 13 nt, Mycobacterium avium subsp. paratuberculosis
gguggugcaggcg

SEQ ID NO: 2858080 - RNA, 19 nt, Mycobacterium avium subsp. paratuberculosis
gguggugcccaucgacccg

SEQ ID NO: 2858081 - RNA, 16 nt, Mycobacterium avium subsp. paratuberculosis
gguggugcccccgccc

SEQ ID NO: 2858082 - RNA, 19 nt, Mycobacterium avium subsp. paratuberculosis
gguggugcccccgcccggc

SEQ ID NO: 2858083 - RNA, 16 nt, Mycobacterium avium subsp. paratuberculosis
gguggugccgccgucg

SEQ ID NO: 2858084 - RNA, 14 nt, Mycobacterium avium subsp. paratuberculosis
gguggugcggguga

SEQ ID NO: 2858085 - RNA, 16 nt, Mycobacterium avium subsp. paratuberculosis
gguggugcucgccccg

SEQ ID NO: 2858086 - RNA, 20 nt, Mycobacterium avium subsp. paratuberculosis
gguggugcucgccccgcccg

SEQ ID NO: 2858087 - RNA, 14 nt, Mycobacterium avium subsp. paratuberculosis
ggugguggccuuga

SEQ ID NO: 2858088 - RNA, 13 nt, Mycobacterium avium subsp. paratuberculosis
gguggugggcgcg

SEQ ID NO: 2858089 - RNA, 14 nt, Mycobacterium avium subsp. paratuberculosis
gguggugggcgcga

SEQ ID NO: 2858090 - RNA, 14 nt, Mycobacterium avium subsp. paratuberculosis
gguggugggcgcgg

SEQ ID NO: 2858091 - RNA, 17 nt, Mycobacterium avium subsp. paratuberculosis
gguggugggcgcggugg

SEQ ID NO: 2858092 - RNA, 14 nt, Mycobacterium avium subsp. paratuberculosis
gguggugggcgugc

SEQ ID NO: 2858093 - RNA, 19 nt, Mycobacterium avium subsp. paratuberculosis
ggugguggggccggcgaag

SEQ ID NO: 2858094 - RNA, 15 nt, Mycobacterium avium subsp. paratuberculosis
ggugguggucgucga

SEQ ID NO: 2858095 - RNA, 23 nt, Mycobacterium avium subsp. paratuberculosis
ggugguggucgucgacgagcccg

SEQ ID NO: 2858096 - RNA, 14 nt, Mycobacterium avium subsp. paratuberculosis
ggugguggugccca

SEQ ID NO: 2858097 - RNA, 14 nt, Mycobacterium avium subsp. paratuberculosis
gguggugucgacgg

SEQ ID NO: 2858098 - RNA, 20 nt, Mycobacterium avium subsp. paratuberculosis
ggugguuuugcgucugcucg

SEQ ID NO: 2858099 - RNA, 18 nt, Mycobacterium avium subsp. paratuberculosis
gguguaacgcgucgacgg

SEQ ID NO: 2858100 - RNA, 20 nt, Mycobacterium avium subsp. paratuberculosis
gguguacacgucgcggguga

SEQ ID NO: 2858101 - RNA, 18 nt, Mycobacterium avium subsp. paratuberculosis
gguguacucaaaccgggc

SEQ ID NO: 2858102 - RNA, 13 nt, Mycobacterium avium subsp. paratuberculosis
gguguagcccggu

SEQ ID NO: 2858103 - RNA, 15 nt, Mycobacterium avium subsp. paratuberculosis
gguguagccgugccc

SEQ ID NO: 2858104 - RNA, 13 nt, Mycobacterium avium subsp. paratuberculosis
gguguagcgagug

SEQ ID NO: 2858105 - RNA, 19 nt, Mycobacterium avium subsp. paratuberculosis
gguguagcggauggcgacg

SEQ ID NO: 2858106 - RNA, 22 nt, Mycobacterium avium subsp. paratuberculosis
gguguagcggauggcgacggcg

SEQ ID NO: 2858107 - RNA, 23 nt, Mycobacterium avium subsp. paratuberculosis
gguguagcggauggcgacggcga

SEQ ID NO: 2858108 - RNA, 15 nt, Mycobacterium avium subsp. paratuberculosis
gguguagcggcggcu

SEQ ID NO: 2858109 - RNA, 17 nt, Mycobacterium avium subsp. paratuberculosis
gguguucgagggcgcgg

SEQ ID NO: 2858110 - RNA, 15 nt, Mycobacterium avium subsp. paratuberculosis
gguguucgggucggu

SEQ ID NO: 2858111 - RNA, 14 nt, Mycobacterium avium subsp. paratuberculosis
gguguucgguggag

SEQ ID NO: 2858112 - RNA, 17 nt, Mycobacterium avium subsp. paratuberculosis
gguguucgguggagcgc

SEQ ID NO: 2858113 - RNA, 22 nt, Mycobacterium avium subsp. paratuberculosis
gguguucuugaacggcgcgucg

SEQ ID NO: 2858114 - RNA, 14 nt, Mycobacterium avium subsp. paratuberculosis
gguguugagcgcgu

SEQ ID NO: 2858115 - RNA, 20 nt, Mycobacterium avium subsp. paratuberculosis
gguguugcgcagcgucuccc

SEQ ID NO: 2858116 - RNA, 20 nt, Mycobacterium avium subsp. paratuberculosis
gguguugcggcagggccacc

SEQ ID NO: 2858117 - RNA, 13 nt, Mycobacterium avium subsp. paratuberculosis
gguguuggacgag

SEQ ID NO: 2858118 - RNA, 13 nt, Mycobacterium avium subsp. paratuberculosis
gguguuggcggcg

SEQ ID NO: 2858119 - RNA, 23 nt, Mycobacterium avium subsp. paratuberculosis
gguguuguccgguaggccggccg

SEQ ID NO: 2858120 - RNA, 17 nt, Mycobacterium avium subsp. paratuberculosis
gguguuucggucggcgu

SEQ ID NO: 2858121 - RNA, 14 nt, Mycobacterium avium subsp. paratuberculosis
gguguuuggccgcg

SEQ ID NO: 2858122 - RNA, 18 nt, Mycobacterium avium subsp. paratuberculosis
gguuaccagcucaccggg

SEQ ID NO: 2858123 - RNA, 20 nt, Mycobacterium avium subsp. paratuberculosis
gguuacguggacgcgcgcgg

SEQ ID NO: 2858124 - RNA, 18 nt, Mycobacterium avium subsp. paratuberculosis
gguuagguacgcggcugg

SEQ ID NO: 2858125 - RNA, 13 nt, Mycobacterium avium subsp. paratuberculosis
gguucaccagcac

SEQ ID NO: 2858126 - RNA, 14 nt, Mycobacterium avium subsp. paratuberculosis
gguucaccagcacg

SEQ ID NO: 2858127 - RNA, 22 nt, Mycobacterium avium subsp. paratuberculosis
gguucaccaguuucacgucggc

SEQ ID NO: 2858128 - RNA, 18 nt, Mycobacterium avium subsp. paratuberculosis
gguucacccuggcgaacc

SEQ ID NO: 2858129 - RNA, 18 nt, Mycobacterium avium subsp. paratuberculosis
gguucaccgccaccagca

SEQ ID NO: 2858130 - RNA, 19 nt, Mycobacterium avium subsp. paratuberculosis
gguucaccgccaccagcag

SEQ ID NO: 2858131 - RNA, 21 nt, Mycobacterium avium subsp. paratuberculosis
gguucaggcguccgcaagcac

SEQ ID NO: 2858132 - RNA, 18 nt, Mycobacterium avium subsp. paratuberculosis
gguucaucaccacgaacu

SEQ ID NO: 2858133 - RNA, 20 nt, Mycobacterium avium subsp. paratuberculosis
gguucaugugaccggggucg

SEQ ID NO: 2858134 - RNA, 21 nt, Mycobacterium avium subsp. paratuberculosis
gguucauguggaagccgcgau

SEQ ID NO: 2858135 - RNA, 23 nt, Mycobacterium avium subsp. paratuberculosis
gguucauguggaagccgcgaucg

SEQ ID NO: 2858136 - RNA, 13 nt, Mycobacterium avium subsp. paratuberculosis
gguuccaccgggc

SEQ ID NO: 2858137 - RNA, 15 nt, Mycobacterium avium subsp. paratuberculosis
gguuccaccggucgg

SEQ ID NO: 2858138 - RNA, 18 nt, Mycobacterium avium subsp. paratuberculosis
gguuccagaccggcggcg

SEQ ID NO: 2858139 - RNA, 19 nt, Mycobacterium avium subsp. paratuberculosis
gguuccagaccggcggcga

SEQ ID NO: 2858140 - RNA, 18 nt, Mycobacterium avium subsp. paratuberculosis
gguuccaguacccgcgca

SEQ ID NO: 2858141 - RNA, 18 nt, Mycobacterium avium subsp. paratuberculosis
gguucccggcaccaccac

SEQ ID NO: 2858142 - RNA, 15 nt, Mycobacterium avium subsp. paratuberculosis
gguuccggaucaacc

SEQ ID NO: 2858143 - RNA, 16 nt, Mycobacterium avium subsp. paratuberculosis
gguuccggcgugcagc

SEQ ID NO: 2858144 - RNA, 17 nt, Mycobacterium avium subsp. paratuberculosis
gguuccggcgugcagca

SEQ ID NO: 2858145 - RNA, 18 nt, Mycobacterium avium subsp. paratuberculosis
gguuccggcgugcagcac

SEQ ID NO: 2858146 - RNA, 19 nt, Mycobacterium avium subsp. paratuberculosis
gguuccggcgugcagcacg

SEQ ID NO: 2858147 - RNA, 13 nt, Mycobacterium avium subsp. paratuberculosis
gguuccggucacg

SEQ ID NO: 2858148 - RNA, 21 nt, Mycobacterium avium subsp. paratuberculosis
gguuccgguggacuccagcac

SEQ ID NO: 2858149 - RNA, 15 nt, Mycobacterium avium subsp. paratuberculosis
gguucgacgucacga

SEQ ID NO: 2858150 - RNA, 23 nt, Mycobacterium avium subsp. paratuberculosis
gguucgacgucacgacggucacg

SEQ ID NO: 2858151 - RNA, 20 nt, Mycobacterium avium subsp. paratuberculosis
gguucgauaccguccgcgcc

SEQ ID NO: 2858152 - RNA, 17 nt, Mycobacterium avium subsp. paratuberculosis
gguucgaucuccucggc

SEQ ID NO: 2858153 - RNA, 20 nt, Mycobacterium avium subsp. paratuberculosis
gguucgaucuccucggcgua

SEQ ID NO: 2858154 - RNA, 13 nt, Mycobacterium avium subsp. paratuberculosis
gguucgcccuccc

SEQ ID NO: 2858155 - RNA, 14 nt, Mycobacterium avium subsp. paratuberculosis
gguucgcccucccc

SEQ ID NO: 2858156 - RNA, 20 nt, Mycobacterium avium subsp. paratuberculosis
gguucgcccuccccggccag

SEQ ID NO: 2858157 - RNA, 21 nt, Mycobacterium avium subsp. paratuberculosis
gguucgcccuccccggccagc

SEQ ID NO: 2858158 - RNA, 21 nt, Mycobacterium avium subsp. paratuberculosis
gguucgccgauguccccgcgg

SEQ ID NO: 2858159 - RNA, 20 nt, Mycobacterium avium subsp. paratuberculosis
gguucgccggugaccgcgcc

SEQ ID NO: 2858160 - RNA, 16 nt, Mycobacterium avium subsp. paratuberculosis
gguucgcgccgaugca

SEQ ID NO: 2858161 - RNA, 17 nt, Mycobacterium avium subsp. paratuberculosis
gguucggacacggcgcc

SEQ ID NO: 2858162 - RNA, 22 nt, Mycobacterium avium subsp. paratuberculosis
gguucggccgcucgggugucgc

SEQ ID NO: 2858163 - RNA, 19 nt, Mycobacterium avium subsp. paratuberculosis
gguucgggaaccuggccgu

SEQ ID NO: 2858164 - RNA, 12 nt, Mycobacterium avium subsp. paratuberculosis
gguucgggcccc

SEQ ID NO: 2858165 - RNA, 22 nt, Mycobacterium avium subsp. paratuberculosis
gguucgguggccccgggccgca

SEQ ID NO: 2858166 - RNA, 21 nt, Mycobacterium avium subsp. paratuberculosis
gguucgucccgcgcgggggcc

SEQ ID NO: 2858167 - RNA, 14 nt, Mycobacterium avium subsp. paratuberculosis
gguucgucguggcc

SEQ ID NO: 2858168 - RNA, 16 nt, Mycobacterium avium subsp. paratuberculosis
gguucucccgucgcga

SEQ ID NO: 2858169 - RNA, 15 nt, Mycobacterium avium subsp. paratuberculosis
gguucuccggcccgc

SEQ ID NO: 2858170 - RNA, 19 nt, Mycobacterium avium subsp. paratuberculosis
gguucuccggcccgcucgg

SEQ ID NO: 2858171 - RNA, 13 nt, Mycobacterium avium subsp. paratuberculosis
gguucucgcggcg

SEQ ID NO: 2858172 - RNA, 15 nt, Mycobacterium avium subsp. paratuberculosis
gguucucggugggga

SEQ ID NO: 2858173 - RNA, 17 nt, Mycobacterium avium subsp. paratuberculosis
gguucucgugauccggc

SEQ ID NO: 2858174 - RNA, 15 nt, Mycobacterium avium subsp. paratuberculosis
gguucugauacacca

SEQ ID NO: 2858175 - RNA, 17 nt, Mycobacterium avium subsp. paratuberculosis
gguucuucgaccacgcg

SEQ ID NO: 2858176 - RNA, 17 nt, Mycobacterium avium subsp. paratuberculosis
gguucuugcgccauccc

SEQ ID NO: 2858177 - RNA, 15 nt, Mycobacterium avium subsp. paratuberculosis
gguucuuggcggccu

SEQ ID NO: 2858178 - RNA, 19 nt, Mycobacterium avium subsp. paratuberculosis
gguucuuggcggccugcuc

SEQ ID NO: 2858179 - RNA, 15 nt, Mycobacterium avium subsp. paratuberculosis
gguugaacggcaccc

SEQ ID NO: 2858180 - RNA, 15 nt, Mycobacterium avium subsp. paratuberculosis
gguugaccaccagcg

SEQ ID NO: 2858181 - RNA, 21 nt, Mycobacterium avium subsp. paratuberculosis
gguugaccaggugggcggcca

SEQ ID NO: 2858182 - RNA, 18 nt, Mycobacterium avium subsp. paratuberculosis
gguugacccggccggucg

SEQ ID NO: 2858183 - RNA, 19 nt, Mycobacterium avium subsp. paratuberculosis
gguugacccggccggucgc

SEQ ID NO: 2858184 - RNA, 23 nt, Mycobacterium avium subsp. paratuberculosis
gguugacccucagcagggcggca

SEQ ID NO: 2858185 - RNA, 15 nt, Mycobacterium avium subsp. paratuberculosis
gguugacgccgauga

SEQ ID NO: 2858186 - RNA, 21 nt, Mycobacterium avium subsp. paratuberculosis
gguugacgccgaugcgguuga

SEQ ID NO: 2858187 - RNA, 17 nt, Mycobacterium avium subsp. paratuberculosis
gguugacguccgcggga

SEQ ID NO: 2858188 - RNA, 23 nt, Mycobacterium avium subsp. paratuberculosis
gguugagcaccagcccggccagc

SEQ ID NO: 2858189 - RNA, 15 nt, Mycobacterium avium subsp. paratuberculosis
gguugagcaccgcga

SEQ ID NO: 2858190 - RNA, 16 nt, Mycobacterium avium subsp. paratuberculosis
gguugagcaccgcgau

SEQ ID NO: 2858191 - RNA, 14 nt, Mycobacterium avium subsp. paratuberculosis
gguugagcagcaga

SEQ ID NO: 2858192 - RNA, 13 nt, Mycobacterium avium subsp. paratuberculosis
gguugaggaucug

SEQ ID NO: 2858193 - RNA, 16 nt, Mycobacterium avium subsp. paratuberculosis
gguugaucaguuccuu

SEQ ID NO: 2858194 - RNA, 15 nt, Mycobacterium avium subsp. paratuberculosis
guaacccuccggcgc

SEQ ID NO: 2858195 - RNA, 16 nt, Mycobacterium avium subsp. paratuberculosis
guaacccuccggcgcc

SEQ ID NO: 2858196 - RNA, 15 nt, Mycobacterium avium subsp. paratuberculosis
guaaccgcccgagca

SEQ ID NO: 2858197 - RNA, 17 nt, Mycobacterium avium subsp. paratuberculosis
guaaccguacggcccga

SEQ ID NO: 2858198 - RNA, 21 nt, Mycobacterium avium subsp. paratuberculosis
guaaccguccagucgcauaug

SEQ ID NO: 2858199 - RNA, 21 nt, Mycobacterium avium subsp. paratuberculosis
guaaccguggcaggcgauggu

SEQ ID NO: 2858200 - RNA, 18 nt, Mycobacterium avium subsp. paratuberculosis
guaagccauggcggcccg

SEQ ID NO: 2858201 - RNA, 16 nt, Mycobacterium avium subsp. paratuberculosis
guaaggccgaggcgag

SEQ ID NO: 2858202 - RNA, 22 nt, Mycobacterium avium subsp. paratuberculosis
guaaggccgaggcgagugagga

SEQ ID NO: 2858203 - RNA, 19 nt, Mycobacterium avium subsp. paratuberculosis
guaaguggcgccgcggucg

SEQ ID NO: 2858204 - RNA, 16 nt, Mycobacterium avium subsp. paratuberculosis
guaaucggcgguggug

SEQ ID NO: 2858205 - RNA, 12 nt, Mycobacterium avium subsp. paratuberculosis
guaauugaucgu

SEQ ID NO: 2858206 - RNA, 23 nt, Mycobacterium avium subsp. paratuberculosis
guacaagacaauucgcugccccg

SEQ ID NO: 2858207 - RNA, 18 nt, Mycobacterium avium subsp. paratuberculosis
guacacagggcggcgaca

SEQ ID NO: 2858208 - RNA, 21 nt, Mycobacterium avium subsp. paratuberculosis
guacacagggcggcgacacgc

SEQ ID NO: 2858209 - RNA, 17 nt, Mycobacterium avium subsp. paratuberculosis
guacaccaccgcggcga

SEQ ID NO: 2858210 - RNA, 20 nt, Mycobacterium avium subsp. paratuberculosis
guacaccagggugccgccgg

SEQ ID NO: 2858211 - RNA, 11 nt, Mycobacterium avium subsp. paratuberculosis
guacaccggcu

SEQ ID NO: 2858212 - RNA, 14 nt, Mycobacterium avium subsp. paratuberculosis
guacaccggcucgc

SEQ ID NO: 2858213 - RNA, 18 nt, Mycobacterium avium subsp. paratuberculosis
guacaccggcugaccggc

SEQ ID NO: 2858214 - RNA, 19 nt, Mycobacterium avium subsp. paratuberculosis
guacaccgggaucggggug

SEQ ID NO: 2858215 - RNA, 12 nt, Mycobacterium avium subsp. paratuberculosis
guacaccucgag

SEQ ID NO: 2858216 - RNA, 14 nt, Mycobacterium avium subsp. paratuberculosis
guacaccucggucg

SEQ ID NO: 2858217 - RNA, 14 nt, Mycobacterium avium subsp. paratuberculosis
guacacgaugcccu

SEQ ID NO: 2858218 - RNA, 21 nt, Mycobacterium avium subsp. paratuberculosis
guacacgaugcccuuggccag

SEQ ID NO: 2858219 - RNA, 13 nt, Mycobacterium avium subsp. paratuberculosis
guacacggcccgc

SEQ ID NO: 2858220 - RNA, 15 nt, Mycobacterium avium subsp. paratuberculosis
guacacggcccgcgg

SEQ ID NO: 2858221 - RNA, 17 nt, Mycobacterium avium subsp. paratuberculosis
guacacggcggcgaagu

SEQ ID NO: 2858222 - RNA, 21 nt, Mycobacterium avium subsp. paratuberculosis
guacacguagaaggcgccguc

SEQ ID NO: 2858223 - RNA, 21 nt, Mycobacterium avium subsp. paratuberculosis
guacacguagcgguccagcgu

SEQ ID NO: 2858224 - RNA, 15 nt, Mycobacterium avium subsp. paratuberculosis
guacagcaccgccgc

SEQ ID NO: 2858225 - RNA, 16 nt, Mycobacterium avium subsp. paratuberculosis
guacagcaccgccgcg

SEQ ID NO: 2858226 - RNA, 14 nt, Mycobacterium avium subsp. paratuberculosis
guacagcagccccu

SEQ ID NO: 2858227 - RNA, 14 nt, Mycobacterium avium subsp. paratuberculosis
guacagccagcccg

SEQ ID NO: 2858228 - RNA, 22 nt, Mycobacterium avium subsp. paratuberculosis
guacagccagcccguggccagc

SEQ ID NO: 2858229 - RNA, 13 nt, Mycobacterium avium subsp. paratuberculosis
guacagcccgcgg

SEQ ID NO: 2858230 - RNA, 11 nt, Mycobacterium avium subsp. paratuberculosis
guacagccgca

SEQ ID NO: 2858231 - RNA, 20 nt, Mycobacterium avium subsp. paratuberculosis
guacagcgacagcagcgugg

SEQ ID NO: 2858232 - RNA, 17 nt, Mycobacterium avium subsp. paratuberculosis
guacagcgacuccagcg

SEQ ID NO: 2858233 - RNA, 19 nt, Mycobacterium avium subsp. paratuberculosis
guacagcgacuccagcgcg

SEQ ID NO: 2858234 - RNA, 21 nt, Mycobacterium avium subsp. paratuberculosis
guacagcgacuccagcgcgau

SEQ ID NO: 2858235 - RNA, 13 nt, Mycobacterium avium subsp. paratuberculosis
guacagcgccagc

SEQ ID NO: 2858236 - RNA, 14 nt, Mycobacterium avium subsp. paratuberculosis
guacagcgccagcg

SEQ ID NO: 2858237 - RNA, 19 nt, Mycobacterium avium subsp. paratuberculosis
guacagcgccagcggcuug

SEQ ID NO: 2858238 - RNA, 13 nt, Mycobacterium avium subsp. paratuberculosis
guacagcgccgcg

SEQ ID NO: 2858239 - RNA, 20 nt, Mycobacterium avium subsp. paratuberculosis
guacagcgccgcggccagcc

SEQ ID NO: 2858240 - RNA, 22 nt, Mycobacterium avium subsp. paratuberculosis
guacagcgggucguuggcggcg

SEQ ID NO: 2858241 - RNA, 21 nt, Mycobacterium avium subsp. paratuberculosis
guacagcgucugcuggauggu

SEQ ID NO: 2858242 - RNA, 17 nt, Mycobacterium avium subsp. paratuberculosis
guacagcuaggccagca

SEQ ID NO: 2858243 - RNA, 18 nt, Mycobacterium avium subsp. paratuberculosis
guacagcuaggccagcag

SEQ ID NO: 2858244 - RNA, 19 nt, Mycobacterium avium subsp. paratuberculosis
guacagcuaggccagcagc

SEQ ID NO: 2858245 - RNA, 17 nt, Mycobacterium avium subsp. paratuberculosis
guacagcugguccggcc

SEQ ID NO: 2858246 - RNA, 21 nt, Mycobacterium avium subsp. paratuberculosis
guacagcugguccggccggcc

SEQ ID NO: 2858247 - RNA, 14 nt, Mycobacterium avium subsp. paratuberculosis
guacaggccgucgg

SEQ ID NO: 2858248 - RNA, 15 nt, Mycobacterium avium subsp. paratuberculosis
guacaggccgucggg

SEQ ID NO: 2858249 - RNA, 13 nt, Mycobacterium avium subsp. paratuberculosis
guacagggcgucg

SEQ ID NO: 2858250 - RNA, 22 nt, Mycobacterium avium subsp. paratuberculosis
guacaggucgcugcccggcgug

SEQ ID NO: 2858251 - RNA, 16 nt, Mycobacterium avium subsp. paratuberculosis
guacaggugcagcagc

SEQ ID NO: 2858252 - RNA, 17 nt, Mycobacterium avium subsp. paratuberculosis
guacaggugcagcagca

SEQ ID NO: 2858253 - RNA, 18 nt, Mycobacterium avium subsp. paratuberculosis
guacaggugcagcagcag

SEQ ID NO: 2858254 - RNA, 18 nt, Mycobacterium avium subsp. paratuberculosis
guacaucccgccgggcau

SEQ ID NO: 2858255 - RNA, 20 nt, Mycobacterium avium subsp. paratuberculosis
guacaucgacgcgaccggcc

SEQ ID NO: 2858256 - RNA, 14 nt, Mycobacterium avium subsp. paratuberculosis
guacaucguucccu

SEQ ID NO: 2858257 - RNA, 22 nt, Mycobacterium avium subsp. paratuberculosis
guacaucguucccugcgcggcg

SEQ ID NO: 2858258 - RNA, 18 nt, Mycobacterium avium subsp. paratuberculosis
guacauggugaccagcgu

SEQ ID NO: 2858259 - RNA, 14 nt, Mycobacterium avium subsp. paratuberculosis
guacaugucgucgc

SEQ ID NO: 2858260 - RNA, 21 nt, Mycobacterium avium subsp. paratuberculosis
guaccaccaccagucggcgcg

SEQ ID NO: 2858261 - RNA, 14 nt, Mycobacterium avium subsp. paratuberculosis
guaccacgccgucg

SEQ ID NO: 2858262 - RNA, 18 nt, Mycobacterium avium subsp. paratuberculosis
guaccacuugaaggaggc

SEQ ID NO: 2858263 - RNA, 16 nt, Mycobacterium avium subsp. paratuberculosis
guaccagcgccacggg

SEQ ID NO: 2858264 - RNA, 12 nt, Mycobacterium avium subsp. paratuberculosis
guaccagcggcc

SEQ ID NO: 2858265 - RNA, 18 nt, Mycobacterium avium subsp. paratuberculosis
guaccagcggccgucgcg

SEQ ID NO: 2858266 - RNA, 23 nt, Mycobacterium avium subsp. paratuberculosis
guaccagcggccgucgcgcagcc

SEQ ID NO: 2858267 - RNA, 19 nt, Mycobacterium avium subsp. paratuberculosis
guaccagcugcccaccagc

SEQ ID NO: 2858268 - RNA, 18 nt, Mycobacterium avium subsp. paratuberculosis
guaccagggcagcgccuc

SEQ ID NO: 2858269 - RNA, 20 nt, Mycobacterium avium subsp. paratuberculosis
guaccagggcagcgccucgg

SEQ ID NO: 2858270 - RNA, 22 nt, Mycobacterium avium subsp. paratuberculosis
guaccagggcagcgccucggcg

SEQ ID NO: 2858271 - RNA, 21 nt, Mycobacterium avium subsp. paratuberculosis
guaccagugcaagcucgccag

SEQ ID NO: 2858272 - RNA, 22 nt, Mycobacterium avium subsp. paratuberculosis
guaccagugcaagcucgccagg

SEQ ID NO: 2858273 - RNA, 17 nt, Mycobacterium avium subsp. paratuberculosis
guaccauugcgccgguc

SEQ ID NO: 2858274 - RNA, 17 nt, Mycobacterium avium subsp. paratuberculosis
guacccaggucggcgug

SEQ ID NO: 2858275 - RNA, 20 nt, Mycobacterium avium subsp. paratuberculosis
guaccccagcaaaaccccgc

SEQ ID NO: 2858276 - RNA, 13 nt, Mycobacterium avium subsp. paratuberculosis
guacccccgccgg

SEQ ID NO: 2858277 - RNA, 17 nt, Mycobacterium avium subsp. paratuberculosis
guacccccgccggggcc

SEQ ID NO: 2858278 - RNA, 17 nt, Mycobacterium avium subsp. paratuberculosis
guacccgcaggccauga

SEQ ID NO: 2858279 - RNA, 20 nt, Mycobacterium avium subsp. paratuberculosis
guagaccgccgaguccuuga

SEQ ID NO: 2858280 - RNA, 19 nt, Mycobacterium avium subsp. paratuberculosis
guagaccgggaugacggac

SEQ ID NO: 2858281 - RNA, 14 nt, Mycobacterium avium subsp. paratuberculosis
guagacgacgggca

SEQ ID NO: 2858282 - RNA, 17 nt, Mycobacterium avium subsp. paratuberculosis
guagacgaucaccggcu

SEQ ID NO: 2858283 - RNA, 18 nt, Mycobacterium avium subsp. paratuberculosis
guagacgaugcccagccc

SEQ ID NO: 2858284 - RNA, 18 nt, Mycobacterium avium subsp. paratuberculosis
guagacgcgggccggcac

SEQ ID NO: 2858285 - RNA, 19 nt, Mycobacterium avium subsp. paratuberculosis
guagacgcgggccggcacc

SEQ ID NO: 2858286 - RNA, 16 nt, Mycobacterium avium subsp. paratuberculosis
guagacggcaugccgg

SEQ ID NO: 2858287 - RNA, 14 nt, Mycobacterium avium subsp. paratuberculosis
guagacggucaggu

SEQ ID NO: 2858288 - RNA, 20 nt, Mycobacterium avium subsp. paratuberculosis
guagacggugcuggcgaugu

SEQ ID NO: 2858289 - RNA, 19 nt, Mycobacterium avium subsp. paratuberculosis
guagacguagugcagccgc

SEQ ID NO: 2858290 - RNA, 20 nt, Mycobacterium avium subsp. paratuberculosis
guagacguucuccccgccgg

SEQ ID NO: 2858291 - RNA, 19 nt, Mycobacterium avium subsp. paratuberculosis
guagacucagcgucgaugg

SEQ ID NO: 2858292 - RNA, 22 nt, Mycobacterium avium subsp. paratuberculosis
guagagcgggauccccaccgug

SEQ ID NO: 2858293 - RNA, 19 nt, Mycobacterium avium subsp. paratuberculosis
guagagcgggaucugcgcc

SEQ ID NO: 2858294 - RNA, 20 nt, Mycobacterium avium subsp. paratuberculosis
guagauaagcggauugacca

SEQ ID NO: 2858295 - RNA, 16 nt, Mycobacterium avium subsp. paratuberculosis
guagauauggcccucc

SEQ ID NO: 2858296 - RNA, 19 nt, Mycobacterium avium subsp. paratuberculosis
guagaucacgccggugagc

SEQ ID NO: 2858297 - RNA, 13 nt, Mycobacterium avium subsp. paratuberculosis
guagaucagcgcc

SEQ ID NO: 2858298 - RNA, 23 nt, Mycobacterium avium subsp. paratuberculosis
guagaucuccucggacccgauga

SEQ ID NO: 2858299 - RNA, 18 nt, Mycobacterium avium subsp. paratuberculosis
guagaugguggccgucgg

SEQ ID NO: 2858300 - RNA, 15 nt, Mycobacterium avium subsp. paratuberculosis
guagcacccggccgg

SEQ ID NO: 2858301 - RNA, 20 nt, Mycobacterium avium subsp. paratuberculosis
guagcagacggacacccgcg

SEQ ID NO: 2858302 - RNA, 14 nt, Mycobacterium avium subsp. paratuberculosis
guagcagcgcggcu

SEQ ID NO: 2858303 - RNA, 16 nt, Mycobacterium avium subsp. paratuberculosis
guagcagcgcggcuug

SEQ ID NO: 2858304 - RNA, 16 nt, Mycobacterium avium subsp. paratuberculosis
guagcagcgucugcgc

SEQ ID NO: 2858305 - RNA, 23 nt, Mycobacterium avium subsp. paratuberculosis
guagcagcgucugcgccccggcg

SEQ ID NO: 2858306 - RNA, 12 nt, Mycobacterium avium subsp. paratuberculosis
guagcaggcggu

SEQ ID NO: 2858307 - RNA, 15 nt, Mycobacterium avium subsp. paratuberculosis
guagcaggcgguggu

SEQ ID NO: 2858308 - RNA, 23 nt, Mycobacterium avium subsp. paratuberculosis
guagcagucggccugcagcucgg

SEQ ID NO: 2858309 - RNA, 22 nt, Mycobacterium avium subsp. paratuberculosis
guagcccaccucgagcacgccc

SEQ ID NO: 2858310 - RNA, 14 nt, Mycobacterium avium subsp. paratuberculosis
guagcccagcgcgu

SEQ ID NO: 2858311 - RNA, 11 nt, Mycobacterium avium subsp. paratuberculosis
guagcccagga

SEQ ID NO: 2858312 - RNA, 20 nt, Mycobacterium avium subsp. paratuberculosis
guagcccaggauucccgacc

SEQ ID NO: 2858313 - RNA, 22 nt, Mycobacterium avium subsp. paratuberculosis
guagcccaggauucccgacccc

SEQ ID NO: 2858314 - RNA, 20 nt, Mycobacterium avium subsp. paratuberculosis
guagcccaugucgccggugc

SEQ ID NO: 2858315 - RNA, 22 nt, Mycobacterium avium subsp. paratuberculosis
guagcccaugucgccggugcug

SEQ ID NO: 2858316 - RNA, 12 nt, Mycobacterium avium subsp. paratuberculosis
guagcccgccga

SEQ ID NO: 2858317 - RNA, 14 nt, Mycobacterium avium subsp. paratuberculosis
guagcccugcaggu

SEQ ID NO: 2858318 - RNA, 14 nt, Mycobacterium avium subsp. paratuberculosis
guagccgaagccgc

SEQ ID NO: 2858319 - RNA, 19 nt, Mycobacterium avium subsp. paratuberculosis
guagccgaccaacgggcgg

SEQ ID NO: 2858320 - RNA, 19 nt, Mycobacterium avium subsp. paratuberculosis
guagccgaucuccaccgag

SEQ ID NO: 2858321 - RNA, 15 nt, Mycobacterium avium subsp. paratuberculosis
guagccgccgguggc

SEQ ID NO: 2858322 - RNA, 19 nt, Mycobacterium avium subsp. paratuberculosis
guagccgccgguggcgucg

SEQ ID NO: 2858323 - RNA, 13 nt, Mycobacterium avium subsp. paratuberculosis
guagccgccgguu

SEQ ID NO: 2858324 - RNA, 17 nt, Mycobacterium avium subsp. paratuberculosis
guagccgccguagccgg

SEQ ID NO: 2858325 - RNA, 21 nt, Mycobacterium avium subsp. paratuberculosis
guagccgccguagccggcggu

SEQ ID NO: 2858326 - RNA, 19 nt, Mycobacterium avium subsp. paratuberculosis
guagccgcgcaccacggug

SEQ ID NO: 2858327 - RNA, 14 nt, Mycobacterium avium subsp. paratuberculosis
guagccgcggguga

SEQ ID NO: 2858328 - RNA, 20 nt, Mycobacterium avium subsp. paratuberculosis
guagccgcgguucggcgucg

SEQ ID NO: 2858329 - RNA, 17 nt, Mycobacterium avium subsp. paratuberculosis
guagccgcucgcccagc

SEQ ID NO: 2858330 - RNA, 21 nt, Mycobacterium avium subsp. paratuberculosis
guagccgcucgcccagcgcgg

SEQ ID NO: 2858331 - RNA, 23 nt, Mycobacterium avium subsp. paratuberculosis
guagccgcucgcccagcgcggcg

SEQ ID NO: 2858332 - RNA, 17 nt, Mycobacterium avium subsp. paratuberculosis
guagccggccagcgucg

SEQ ID NO: 2858333 - RNA, 20 nt, Mycobacterium avium subsp. paratuberculosis
guagccggccagcgucgcgc

SEQ ID NO: 2858334 - RNA, 23 nt, Mycobacterium avium subsp. paratuberculosis
guagccggccagcucgagcauca

SEQ ID NO: 2858335 - RNA, 21 nt, Mycobacterium avium subsp. paratuberculosis
guagccggcccgcagccagcg

SEQ ID NO: 2858336 - RNA, 22 nt, Mycobacterium avium subsp. paratuberculosis
guagccggcccgcagccagcgc

SEQ ID NO: 2858337 - RNA, 23 nt, Mycobacterium avium subsp. paratuberculosis
guagccggcccgcagccagcgca

SEQ ID NO: 2858338 - RNA, 14 nt, Mycobacterium avium subsp. paratuberculosis
guagccggcgaucg

SEQ ID NO: 2858339 - RNA, 16 nt, Mycobacterium avium subsp. paratuberculosis
guagccggcgaucguc

SEQ ID NO: 2858340 - RNA, 11 nt, Mycobacterium avium subsp. paratuberculosis
guagccgggcu

SEQ ID NO: 2858341 - RNA, 17 nt, Mycobacterium avium subsp. paratuberculosis
guagccgggcucgagca

SEQ ID NO: 2858342 - RNA, 21 nt, Mycobacterium avium subsp. paratuberculosis
guagccgggcucgagcaccga

SEQ ID NO: 2858343 - RNA, 21 nt, Mycobacterium avium subsp. paratuberculosis
guagccggggacggugcagcc

SEQ ID NO: 2858344 - RNA, 13 nt, Mycobacterium avium subsp. paratuberculosis
guagccggucggc

SEQ ID NO: 2858345 - RNA, 17 nt, Mycobacterium avium subsp. paratuberculosis
guagccguaacgaugcc

SEQ ID NO: 2858346 - RNA, 21 nt, Mycobacterium avium subsp. paratuberculosis
guagccguaacgaugccgcuu

SEQ ID NO: 2858347 - RNA, 16 nt, Mycobacterium avium subsp. paratuberculosis
guagccugcggccugc

SEQ ID NO: 2858348 - RNA, 19 nt, Mycobacterium avium subsp. paratuberculosis
guagcgacgcgacgcgcuc

SEQ ID NO: 2858349 - RNA, 16 nt, Mycobacterium avium subsp. paratuberculosis
guagcgagcgcuggcc

SEQ ID NO: 2858350 - RNA, 16 nt, Mycobacterium avium subsp. paratuberculosis
guagcgagugccggcc

SEQ ID NO: 2858351 - RNA, 11 nt, Mycobacterium avium subsp. paratuberculosis
guagcgcagca

SEQ ID NO: 2858352 - RNA, 17 nt, Mycobacterium avium subsp. paratuberculosis
guagcgcagcaccaggc

SEQ ID NO: 2858353 - RNA, 12 nt, Mycobacterium avium subsp. paratuberculosis
guagcgcagcau

SEQ ID NO: 2858354 - RNA, 23 nt, Mycobacterium avium subsp. paratuberculosis
guagcgcagcaucacgucggcga

SEQ ID NO: 2858355 - RNA, 17 nt, Mycobacterium avium subsp. paratuberculosis
guagcgcauaggccgcg

SEQ ID NO: 2858356 - RNA, 15 nt, Mycobacterium avium subsp. paratuberculosis
guagcgccagucgcg

SEQ ID NO: 2858357 - RNA, 21 nt, Mycobacterium avium subsp. paratuberculosis
guagcgccagucgcggcgaac

SEQ ID NO: 2858358 - RNA, 21 nt, Mycobacterium avium subsp. paratuberculosis
guagcgccggcaacaacgcca

SEQ ID NO: 2858359 - RNA, 13 nt, Mycobacterium avium subsp. paratuberculosis
guagcgcgccggg

SEQ ID NO: 2858360 - RNA, 14 nt, Mycobacterium avium subsp. paratuberculosis
guagcgcgccgggg

SEQ ID NO: 2858361 - RNA, 13 nt, Mycobacterium avium subsp. paratuberculosis
guagcgcggccgc

SEQ ID NO: 2858362 - RNA, 15 nt, Mycobacterium avium subsp. paratuberculosis
guagcgcggccgccc

SEQ ID NO: 2858363 - RNA, 15 nt, Mycobacterium avium subsp. paratuberculosis
guaggugaucguguu

SEQ ID NO: 2858364 - RNA, 18 nt, Mycobacterium avium subsp. paratuberculosis
guaggugcccgagcugau

SEQ ID NO: 2858365 - RNA, 20 nt, Mycobacterium avium subsp. paratuberculosis
guaggugcccgggucgugcg

SEQ ID NO: 2858366 - RNA, 22 nt, Mycobacterium avium subsp. paratuberculosis
guaggugcgcgagauggcgauc

SEQ ID NO: 2858367 - RNA, 13 nt, Mycobacterium avium subsp. paratuberculosis
guagguggccagc

SEQ ID NO: 2858368 - RNA, 17 nt, Mycobacterium avium subsp. paratuberculosis
guagguggcgaccaccg

SEQ ID NO: 2858369 - RNA, 18 nt, Mycobacterium avium subsp. paratuberculosis
guaggugggcagcgcggc

SEQ ID NO: 2858370 - RNA, 18 nt, Mycobacterium avium subsp. paratuberculosis
guaggugugcagccaggu

SEQ ID NO: 2858371 - RNA, 15 nt, Mycobacterium avium subsp. paratuberculosis
guaguaacgcgagau

SEQ ID NO: 2858372 - RNA, 19 nt, Mycobacterium avium subsp. paratuberculosis
guaguaccccgggcugacc

SEQ ID NO: 2858373 - RNA, 13 nt, Mycobacterium avium subsp. paratuberculosis
guaguccagcaca

SEQ ID NO: 2858374 - RNA, 14 nt, Mycobacterium avium subsp. paratuberculosis
guaguccagggugu

SEQ ID NO: 2858375 - RNA, 19 nt, Mycobacterium avium subsp. paratuberculosis
guagucccgcgccuggcgc

SEQ ID NO: 2858376 - RNA, 20 nt, Mycobacterium avium subsp. paratuberculosis
guagucgaccacccgcagcu

SEQ ID NO: 2858377 - RNA, 17 nt, Mycobacterium avium subsp. paratuberculosis
guagucgauggccucgu

SEQ ID NO: 2858378 - RNA, 20 nt, Mycobacterium avium subsp. paratuberculosis
guagucgcgcaccauccgcg

SEQ ID NO: 2858379 - RNA, 12 nt, Mycobacterium avium subsp. paratuberculosis
guagucgcgcag

SEQ ID NO: 2858380 - RNA, 13 nt, Mycobacterium avium subsp. paratuberculosis
guagucgcgcagc

SEQ ID NO: 2858381 - RNA, 17 nt, Mycobacterium avium subsp. paratuberculosis
guagucgcgcagcugcg

SEQ ID NO: 2858382 - RNA, 16 nt, Mycobacterium avium subsp. paratuberculosis
guagucggcccgccgg

SEQ ID NO: 2858383 - RNA, 19 nt, Mycobacterium avium subsp. paratuberculosis
guagucggcccgccgggcc

SEQ ID NO: 2858384 - RNA, 23 nt, Mycobacterium avium subsp. paratuberculosis
guagucggccuccuccucgcugc

SEQ ID NO: 2858385 - RNA, 13 nt, Mycobacterium avium subsp. paratuberculosis
guagucggcgauc

SEQ ID NO: 2858386 - RNA, 16 nt, Mycobacterium avium subsp. paratuberculosis
guagucggcgaucggc

SEQ ID NO: 2858387 - RNA, 14 nt, Mycobacterium avium subsp. paratuberculosis
guagucggcgcagc

SEQ ID NO: 2858388 - RNA, 15 nt, Mycobacterium avium subsp. paratuberculosis
guagucggcgcagcg

SEQ ID NO: 2858389 - RNA, 19 nt, Mycobacterium avium subsp. paratuberculosis
guagucggcgccgacggcc

SEQ ID NO: 2858390 - RNA, 13 nt, Mycobacterium avium subsp. paratuberculosis
guagucggcgucc

SEQ ID NO: 2858391 - RNA, 16 nt, Mycobacterium avium subsp. paratuberculosis
guagucggcgucggcc

SEQ ID NO: 2858392 - RNA, 19 nt, Mycobacterium avium subsp. paratuberculosis
guagucgggauagggcgcg

SEQ ID NO: 2858393 - RNA, 14 nt, Mycobacterium avium subsp. paratuberculosis
guagucggugcagu

SEQ ID NO: 2858394 - RNA, 20 nt, Mycobacterium avium subsp. paratuberculosis
guagucguccucguucuggc

SEQ ID NO: 2858395 - RNA, 13 nt, Mycobacterium avium subsp. paratuberculosis
guagucgucgacc

SEQ ID NO: 2858396 - RNA, 16 nt, Mycobacterium avium subsp. paratuberculosis
guagucgucgaccgcc

SEQ ID NO: 2858397 - RNA, 19 nt, Mycobacterium avium subsp. paratuberculosis
guagucgucgaccgccacc

SEQ ID NO: 2858398 - RNA, 13 nt, Mycobacterium avium subsp. paratuberculosis
guagucgucgagg

SEQ ID NO: 2858399 - RNA, 19 nt, Mycobacterium avium subsp. paratuberculosis
guagugcacggacagcuca

SEQ ID NO: 2858400 - RNA, 14 nt, Mycobacterium avium subsp. paratuberculosis
guagugcagccgcc

SEQ ID NO: 2858401 - RNA, 14 nt, Mycobacterium avium subsp. paratuberculosis
guagugcagcugca

SEQ ID NO: 2858402 - RNA, 17 nt, Mycobacterium avium subsp. paratuberculosis
guagugcagcugcagcg

SEQ ID NO: 2858403 - RNA, 19 nt, Mycobacterium avium subsp. paratuberculosis
guagugcagcugcagcgac

SEQ ID NO: 2858404 - RNA, 13 nt, Mycobacterium avium subsp. paratuberculosis
guagugcaucggc

SEQ ID NO: 2858405 - RNA, 14 nt, Mycobacterium avium subsp. paratuberculosis
guagugcaucggca

SEQ ID NO: 2858406 - RNA, 20 nt, Mycobacterium avium subsp. paratuberculosis
guagugguccaccgccgcgc

SEQ ID NO: 2858407 - RNA, 14 nt, Mycobacterium avium subsp. paratuberculosis
guaguucagcgcgc

SEQ ID NO: 2858408 - RNA, 14 nt, Mycobacterium avium subsp. paratuberculosis
guaguucugcacgu

SEQ ID NO: 2858409 - RNA, 15 nt, Mycobacterium avium subsp. paratuberculosis
guaguugcggccggc

SEQ ID NO: 2858410 - RNA, 17 nt, Mycobacterium avium subsp. paratuberculosis
guaguugcggccggcgg

SEQ ID NO: 2858411 - RNA, 23 nt, Mycobacterium avium subsp. paratuberculosis
guaucccaccacgaagucguugg

SEQ ID NO: 2858412 - RNA, 16 nt, Mycobacterium avium subsp. paratuberculosis
guauccgaucgcggcc

SEQ ID NO: 2858413 - RNA, 16 nt, Mycobacterium avium subsp. paratuberculosis
guauccgccgccagcg

SEQ ID NO: 2858414 - RNA, 16 nt, Mycobacterium avium subsp. paratuberculosis
guauccggucagcgcc

SEQ ID NO: 2858415 - RNA, 17 nt, Mycobacterium avium subsp. paratuberculosis
guauccggucagcgcca

SEQ ID NO: 2858416 - RNA, 16 nt, Mycobacterium avium subsp. paratuberculosis
guaucgagcaccagca

SEQ ID NO: 2858417 - RNA, 17 nt, Mycobacterium avium subsp. paratuberculosis
guaucgagcaccagcaa

SEQ ID NO: 2858418 - RNA, 16 nt, Mycobacterium avium subsp. paratuberculosis
guaucgccacgccgac

SEQ ID NO: 2858419 - RNA, 17 nt, Mycobacterium avium subsp. paratuberculosis
guaucgccacgccgacc

SEQ ID NO: 2858420 - RNA, 18 nt, Mycobacterium avium subsp. paratuberculosis
guaucgccacgccgacca

SEQ ID NO: 2858421 - RNA, 16 nt, Mycobacterium avium subsp. paratuberculosis
guaucgcgccugcacc

SEQ ID NO: 2858422 - RNA, 19 nt, Mycobacterium avium subsp. paratuberculosis
guaucgcgccugcaccggc

SEQ ID NO: 2858423 - RNA, 20 nt, Mycobacterium avium subsp. paratuberculosis
guaucgcgccugcaccggcg

SEQ ID NO: 2858424 - RNA, 19 nt, Mycobacterium avium subsp. paratuberculosis
guaucgggucaccgugcgg

SEQ ID NO: 2858425 - RNA, 21 nt, Mycobacterium avium subsp. paratuberculosis
guaucgggucaccgugcgggu

SEQ ID NO: 2858426 - RNA, 18 nt, Mycobacterium avium subsp. paratuberculosis
guaucuuguucgccgaca

SEQ ID NO: 2858427 - RNA, 20 nt, Mycobacterium avium subsp. paratuberculosis
guaucuuguucgccgacacc

SEQ ID NO: 2858428 - RNA, 15 nt, Mycobacterium avium subsp. paratuberculosis
guaugcccgccgcug

SEQ ID NO: 2858429 - RNA, 17 nt, Mycobacterium avium subsp. paratuberculosis
guaugccuccucgguga

SEQ ID NO: 2858430 - RNA, 16 nt, Mycobacterium avium subsp. paratuberculosis
guaugccuuggcccgc

SEQ ID NO: 2858431 - RNA, 22 nt, Mycobacterium avium subsp. paratuberculosis
guaugcgguccucgagcuggcc

SEQ ID NO: 2858432 - RNA, 17 nt, Mycobacterium avium subsp. paratuberculosis
guaugucggcgacccgc

SEQ ID NO: 2858433 - RNA, 16 nt, Mycobacterium avium subsp. paratuberculosis
guauucaucgcggccg

SEQ ID NO: 2858434 - RNA, 15 nt, Mycobacterium avium subsp. paratuberculosis
guauucgacggcgac

SEQ ID NO: 2858435 - RNA, 13 nt, Mycobacterium avium subsp. paratuberculosis
guauucgcccacc

SEQ ID NO: 2858436 - RNA, 22 nt, Mycobacterium avium subsp. paratuberculosis
guauucgcgggaggacagcgcg

SEQ ID NO: 2858437 - RNA, 18 nt, Mycobacterium avium subsp. paratuberculosis
guauugguagaacucggg

SEQ ID NO: 2858438 - RNA, 19 nt, Mycobacterium avium subsp. paratuberculosis
gucaaaacaacgcgcagcc

SEQ ID NO: 2858439 - RNA, 21 nt, Mycobacterium avium subsp. paratuberculosis
gucaaacccauugucgccgug

SEQ ID NO: 2858440 - RNA, 22 nt, Mycobacterium avium subsp. paratuberculosis
gucaaacccauugucgccgugc

SEQ ID NO: 2858441 - RNA, 22 nt, Mycobacterium avium subsp. paratuberculosis
gucaaagccguucgcgccgaga

SEQ ID NO: 2858442 - RNA, 17 nt, Mycobacterium avium subsp. paratuberculosis
gucaacaccguggugga

SEQ ID NO: 2858443 - RNA, 23 nt, Mycobacterium avium subsp. paratuberculosis
gucaacacgaagccggugucggg

SEQ ID NO: 2858444 - RNA, 12 nt, Mycobacterium avium subsp. paratuberculosis
gucaacgcgcac

SEQ ID NO: 2858445 - RNA, 21 nt, Mycobacterium avium subsp. paratuberculosis
gucaacggcaccgacagggcc

SEQ ID NO: 2858446 - RNA, 13 nt, Mycobacterium avium subsp. paratuberculosis
gucaacggcucgg

SEQ ID NO: 2858447 - RNA, 17 nt, Mycobacterium avium subsp. paratuberculosis
gucaacggcuugcgcag

SEQ ID NO: 2858448 - RNA, 22 nt, Mycobacterium avium subsp. paratuberculosis
gucaccgggugaugucgccgac

SEQ ID NO: 2858449 - RNA, 21 nt, Mycobacterium avium subsp. paratuberculosis
gucaccggucggugcccagca

SEQ ID NO: 2858450 - RNA, 22 nt, Mycobacterium avium subsp. paratuberculosis
gucaccggucggugcccagcac

SEQ ID NO: 2858451 - RNA, 23 nt, Mycobacterium avium subsp. paratuberculosis
gucaccggucggugcccagcacc

SEQ ID NO: 2858452 - RNA, 17 nt, Mycobacterium avium subsp. paratuberculosis
gucaccggugucacgcu

SEQ ID NO: 2858453 - RNA, 20 nt, Mycobacterium avium subsp. paratuberculosis
gucaccggugucacgcuggc

SEQ ID NO: 2858454 - RNA, 21 nt, Mycobacterium avium subsp. paratuberculosis
gucaccggugucacgcuggcg

SEQ ID NO: 2858455 - RNA, 20 nt, Mycobacterium avium subsp. paratuberculosis
gucaccguccuuguagguga

SEQ ID NO: 2858456 - RNA, 21 nt, Mycobacterium avium subsp. paratuberculosis
gucaccgucguacucgaccgc

SEQ ID NO: 2858457 - RNA, 19 nt, Mycobacterium avium subsp. paratuberculosis
gucaccgugcgggucgcgc

SEQ ID NO: 2858458 - RNA, 20 nt, Mycobacterium avium subsp. paratuberculosis
gucaccgugcgggucgcgcu

SEQ ID NO: 2858459 - RNA, 21 nt, Mycobacterium avium subsp. paratuberculosis
gucaccgugcgggucgcgcug

SEQ ID NO: 2858460 - RNA, 18 nt, Mycobacterium avium subsp. paratuberculosis
gucaccguggcgggggag

SEQ ID NO: 2858461 - RNA, 17 nt, Mycobacterium avium subsp. paratuberculosis
gucaccgugggcggcgc

SEQ ID NO: 2858462 - RNA, 19 nt, Mycobacterium avium subsp. paratuberculosis
gucaccgugggcggcgcga

SEQ ID NO: 2858463 - RNA, 20 nt, Mycobacterium avium subsp. paratuberculosis
gucaccgugggcggcgcgau

SEQ ID NO: 2858464 - RNA, 23 nt, Mycobacterium avium subsp. paratuberculosis
gucaccgugggcggcgcgaucgu

SEQ ID NO: 2858465 - RNA, 22 nt, Mycobacterium avium subsp. paratuberculosis
gucaccguggugugcccgcggg

SEQ ID NO: 2858466 - RNA, 18 nt, Mycobacterium avium subsp. paratuberculosis
gucaccgugucggcgggc

SEQ ID NO: 2858467 - RNA, 20 nt, Mycobacterium avium subsp. paratuberculosis
gucaccgugucggcgggcgg

SEQ ID NO: 2858468 - RNA, 15 nt, Mycobacterium avium subsp. paratuberculosis
gucaccucgaccaga

SEQ ID NO: 2858469 - RNA, 16 nt, Mycobacterium avium subsp. paratuberculosis
gucaccucgaccagau

SEQ ID NO: 2858470 - RNA, 22 nt, Mycobacterium avium subsp. paratuberculosis
gucaccugacgcucggucgcca

SEQ ID NO: 2858471 - RNA, 22 nt, Mycobacterium avium subsp. paratuberculosis
gucaccuucacccccacccagg

SEQ ID NO: 2858472 - RNA, 21 nt, Mycobacterium avium subsp. paratuberculosis
gucacgaagaaguauucgccg

SEQ ID NO: 2858473 - RNA, 17 nt, Mycobacterium avium subsp. paratuberculosis
gucacgacggucacggc

SEQ ID NO: 2858474 - RNA, 19 nt, Mycobacterium avium subsp. paratuberculosis
gucacgccagcgugacgcc

SEQ ID NO: 2858475 - RNA, 22 nt, Mycobacterium avium subsp. paratuberculosis
gucacgccagcgugacgccggg

SEQ ID NO: 2858476 - RNA, 22 nt, Mycobacterium avium subsp. paratuberculosis
gucacgccagcgugacgcucgg

SEQ ID NO: 2858477 - RNA, 17 nt, Mycobacterium avium subsp. paratuberculosis
gucacgccaguguggcc

SEQ ID NO: 2858478 - RNA, 15 nt, Mycobacterium avium subsp. paratuberculosis
gucacgcccgucccu

SEQ ID NO: 2858479 - RNA, 18 nt, Mycobacterium avium subsp. paratuberculosis
gucacgcccguugacgcc

SEQ ID NO: 2858480 - RNA, 13 nt, Mycobacterium avium subsp. paratuberculosis
gucacgccgcgcc

SEQ ID NO: 2858481 - RNA, 16 nt, Mycobacterium avium subsp. paratuberculosis
gucacgccgcgcccgu

SEQ ID NO: 2858482 - RNA, 14 nt, Mycobacterium avium subsp. paratuberculosis
gucacgccggggua

SEQ ID NO: 2858483 - RNA, 23 nt, Mycobacterium avium subsp. paratuberculosis
gucacgccgggguagaggccgcg

SEQ ID NO: 2858484 - RNA, 21 nt, Mycobacterium avium subsp. paratuberculosis
gucacgcugaacggugccguc

SEQ ID NO: 2858485 - RNA, 14 nt, Mycobacterium avium subsp. paratuberculosis
gucacgcugcgcgc

SEQ ID NO: 2858486 - RNA, 20 nt, Mycobacterium avium subsp. paratuberculosis
gucacgcuggcgugacacuc

SEQ ID NO: 2858487 - RNA, 20 nt, Mycobacterium avium subsp. paratuberculosis
gucacgcuggcgugacgcuc

SEQ ID NO: 2858488 - RNA, 22 nt, Mycobacterium avium subsp. paratuberculosis
gucacgcuggcgugacgcucgg

SEQ ID NO: 2858489 - RNA, 20 nt, Mycobacterium avium subsp. paratuberculosis
gucacgcuggcgugacguuc

SEQ ID NO: 2858490 - RNA, 15 nt, Mycobacterium avium subsp. paratuberculosis
gucacgcuggcgugg

SEQ ID NO: 2858491 - RNA, 22 nt, Mycobacterium avium subsp. paratuberculosis
gucacgcuggcguggcacccgg

SEQ ID NO: 2858492 - RNA, 18 nt, Mycobacterium avium subsp. paratuberculosis
gucacgcuggcguggcgc

SEQ ID NO: 2858493 - RNA, 23 nt, Mycobacterium avium subsp. paratuberculosis
gucacgcuggcguggcgccggcg

SEQ ID NO: 2858494 - RNA, 14 nt, Mycobacterium avium subsp. paratuberculosis
gucacgcuggugac

SEQ ID NO: 2858495 - RNA, 18 nt, Mycobacterium avium subsp. paratuberculosis
gucacgcuggugacgugc

SEQ ID NO: 2858496 - RNA, 15 nt, Mycobacterium avium subsp. paratuberculosis
gucacggacagccgg

SEQ ID NO: 2858497 - RNA, 14 nt, Mycobacterium avium subsp. paratuberculosis
gucacggacaggug

SEQ ID NO: 2858498 - RNA, 24 nt, Mycobacterium avium subsp. paratuberculosis
gucacggacaggugugggcguacg

SEQ ID NO: 2858499 - RNA, 18 nt, Mycobacterium avium subsp. paratuberculosis
gucacggauacccgcggc

SEQ ID NO: 2858500 - RNA, 16 nt, Mycobacterium avium subsp. paratuberculosis
gucacggaucgcccac

SEQ ID NO: 2858501 - RNA, 17 nt, Mycobacterium avium subsp. paratuberculosis
gucacggaucgcccacc

SEQ ID NO: 2858502 - RNA, 19 nt, Mycobacterium avium subsp. paratuberculosis
gucacggaucgcccacccg

SEQ ID NO: 2858503 - RNA, 13 nt, Mycobacterium avium subsp. paratuberculosis
gucacggccgcca

SEQ ID NO: 2858504 - RNA, 17 nt, Mycobacterium avium subsp. paratuberculosis
gucacggccgccagcag

SEQ ID NO: 2858505 - RNA, 18 nt, Mycobacterium avium subsp. paratuberculosis
gucacggccgccagcagc

SEQ ID NO: 2858506 - RNA, 19 nt, Mycobacterium avium subsp. paratuberculosis
gucacggccgccagcagca

SEQ ID NO: 2858507 - RNA, 22 nt, Mycobacterium avium subsp. paratuberculosis
gucacggccguccaggcgccau

SEQ ID NO: 2858508 - RNA, 23 nt, Mycobacterium avium subsp. paratuberculosis
gucacggcgaggauggcgaucau

SEQ ID NO: 2858509 - RNA, 16 nt, Mycobacterium avium subsp. paratuberculosis
gucacggcgucggcgu

SEQ ID NO: 2858510 - RNA, 17 nt, Mycobacterium avium subsp. paratuberculosis
gucacggcugccgaccu

SEQ ID NO: 2858511 - RNA, 14 nt, Mycobacterium avium subsp. paratuberculosis
gucacgggccaggc

SEQ ID NO: 2858512 - RNA, 16 nt, Mycobacterium avium subsp. paratuberculosis
gucacgggccaggcgc

SEQ ID NO: 2858513 - RNA, 15 nt, Mycobacterium avium subsp. paratuberculosis
gucacgguccagguc

SEQ ID NO: 2858514 - RNA, 21 nt, Mycobacterium avium subsp. paratuberculosis
gucacggucuggcuggugacc

SEQ ID NO: 2858515 - RNA, 16 nt, Mycobacterium avium subsp. paratuberculosis
gucacguagcgcggcc

SEQ ID NO: 2858516 - RNA, 18 nt, Mycobacterium avium subsp. paratuberculosis
gucacguagcgcggccgc

SEQ ID NO: 2858517 - RNA, 20 nt, Mycobacterium avium subsp. paratuberculosis
gucacguagcgcggccgccc

SEQ ID NO: 2858518 - RNA, 17 nt, Mycobacterium avium subsp. paratuberculosis
gucacguagcucagcgg

SEQ ID NO: 2858519 - RNA, 22 nt, Mycobacterium avium subsp. paratuberculosis
gucacguagugcuucuugaaga

SEQ ID NO: 2858520 - RNA, 23 nt, Mycobacterium avium subsp. paratuberculosis
gucacguagugcuucuugaagaa

SEQ ID NO: 2858521 - RNA, 19 nt, Mycobacterium avium subsp. paratuberculosis
gucacgucauuucggucgg

SEQ ID NO: 2858522 - RNA, 15 nt, Mycobacterium avium subsp. paratuberculosis
gucacguccacgccg

SEQ ID NO: 2858523 - RNA, 18 nt, Mycobacterium avium subsp. paratuberculosis
gucacguccacgccgcgg

SEQ ID NO: 2858524 - RNA, 20 nt, Mycobacterium avium subsp. paratuberculosis
gucacguccaucauggcgcu

SEQ ID NO: 2858525 - RNA, 15 nt, Mycobacterium avium subsp. paratuberculosis
gucacgucgacggcc

SEQ ID NO: 2858526 - RNA, 19 nt, Mycobacterium avium subsp. paratuberculosis
gucacgucgacggccgccg

SEQ ID NO: 2858527 - RNA, 15 nt, Mycobacterium avium subsp. paratuberculosis
gucacgucggccugc

SEQ ID NO: 2858528 - RNA, 21 nt, Mycobacterium avium subsp. paratuberculosis
gucacgugcacccacgccagc

SEQ ID NO: 2858529 - RNA, 20 nt, Mycobacterium avium subsp. paratuberculosis
gucacguucaccaccggagc

SEQ ID NO: 2858530 - RNA, 18 nt, Mycobacterium avium subsp. paratuberculosis
gucacguugaugaucgcc

SEQ ID NO: 2858531 - RNA, 16 nt, Mycobacterium avium subsp. paratuberculosis
gucaucccccgcagcu

SEQ ID NO: 2858532 - RNA, 15 nt, Mycobacterium avium subsp. paratuberculosis
gucauccccgugcgg

SEQ ID NO: 2858533 - RNA, 16 nt, Mycobacterium avium subsp. paratuberculosis
gucauccccuggccga

SEQ ID NO: 2858534 - RNA, 15 nt, Mycobacterium avium subsp. paratuberculosis
gucauccggcugccc

SEQ ID NO: 2858535 - RNA, 14 nt, Mycobacterium avium subsp. paratuberculosis
gucauccgggccac

SEQ ID NO: 2858536 - RNA, 22 nt, Mycobacterium avium subsp. paratuberculosis
gucauccgggccaccaccacgg

SEQ ID NO: 2858537 - RNA, 14 nt, Mycobacterium avium subsp. paratuberculosis
gucauccucgccgc

SEQ ID NO: 2858538 - RNA, 15 nt, Mycobacterium avium subsp. paratuberculosis
gucauccucgccgcg

SEQ ID NO: 2858539 - RNA, 16 nt, Mycobacterium avium subsp. paratuberculosis
gucauccucgccgcgc

SEQ ID NO: 2858540 - RNA, 17 nt, Mycobacterium avium subsp. paratuberculosis
gucauccucgccgcgcc

SEQ ID NO: 2858541 - RNA, 21 nt, Mycobacterium avium subsp. paratuberculosis
gucaucgacuugccgccgcac

SEQ ID NO: 2858542 - RNA, 13 nt, Mycobacterium avium subsp. paratuberculosis
gucaucgagccga

SEQ ID NO: 2858543 - RNA, 16 nt, Mycobacterium avium subsp. paratuberculosis
gucaucgagccgagca

SEQ ID NO: 2858544 - RNA, 17 nt, Mycobacterium avium subsp. paratuberculosis
gucaucgccacccgcac

SEQ ID NO: 2858545 - RNA, 18 nt, Mycobacterium avium subsp. paratuberculosis
gucaucgccacccgcacc

SEQ ID NO: 2858546 - RNA, 23 nt, Mycobacterium avium subsp. paratuberculosis
gucaucgccgacggugagcaccg

SEQ ID NO: 2858547 - RNA, 18 nt, Mycobacterium avium subsp. paratuberculosis
gucaucgugaucgcccac

SEQ ID NO: 2858548 - RNA, 16 nt, Mycobacterium avium subsp. paratuberculosis
gucaucgugugggcgc

SEQ ID NO: 2858549 - RNA, 22 nt, Mycobacterium avium subsp. paratuberculosis
gucaucgugugggcgcccgcgg

SEQ ID NO: 2858550 - RNA, 23 nt, Mycobacterium avium subsp. paratuberculosis
gucaucgugugggcgcccgcggc

SEQ ID NO: 2858551 - RNA, 14 nt, Mycobacterium avium subsp. paratuberculosis
gucaugaacgccgg

SEQ ID NO: 2858552 - RNA, 17 nt, Mycobacterium avium subsp. paratuberculosis
gucaugacgaacaugcu

SEQ ID NO: 2858553 - RNA, 15 nt, Mycobacterium avium subsp. paratuberculosis
gucaugccgagccgc

SEQ ID NO: 2858554 - RNA, 16 nt, Mycobacterium avium subsp. paratuberculosis
gucaugccgagccgcu

SEQ ID NO: 2858555 - RNA, 20 nt, Mycobacterium avium subsp. paratuberculosis
gucaugccgcgcucgucgau

SEQ ID NO: 2858556 - RNA, 14 nt, Mycobacterium avium subsp. paratuberculosis
gucaugccgucgac

SEQ ID NO: 2858557 - RNA, 21 nt, Mycobacterium avium subsp. paratuberculosis
gucaugccgucgacgacgguc

SEQ ID NO: 2858558 - RNA, 22 nt, Mycobacterium avium subsp. paratuberculosis
gucaugccguugaugaagaccu

SEQ ID NO: 2858559 - RNA, 14 nt, Mycobacterium avium subsp. paratuberculosis
gucauggccgucgg

SEQ ID NO: 2858560 - RNA, 13 nt, Mycobacterium avium subsp. paratuberculosis
gucauggcgaccg

SEQ ID NO: 2858561 - RNA, 16 nt, Mycobacterium avium subsp. paratuberculosis
gucauggcgaccgcga

SEQ ID NO: 2858562 - RNA, 20 nt, Mycobacterium avium subsp. paratuberculosis
gucauggcgaccgcgacggu

SEQ ID NO: 2858563 - RNA, 16 nt, Mycobacterium avium subsp. paratuberculosis
gucaugguggcggcgc

SEQ ID NO: 2858564 - RNA, 18 nt, Mycobacterium avium subsp. paratuberculosis
gucaugguggcggcgccg

SEQ ID NO: 2858565 - RNA, 20 nt, Mycobacterium avium subsp. paratuberculosis
gucaugguggcggcgccgga

SEQ ID NO: 2858566 - RNA, 21 nt, Mycobacterium avium subsp. paratuberculosis
gucaugugccucgcgcaucag

SEQ ID NO: 2858567 - RNA, 18 nt, Mycobacterium avium subsp. paratuberculosis
gucauuccgccgcgcccg

SEQ ID NO: 2858568 - RNA, 19 nt, Mycobacterium avium subsp. paratuberculosis
gucauuccgccgcgcccgu

SEQ ID NO: 2858569 - RNA, 20 nt, Mycobacterium avium subsp. paratuberculosis
gucauucugaauucggccac

SEQ ID NO: 2858570 - RNA, 22 nt, Mycobacterium avium subsp. paratuberculosis
gucauucugaauucggccaccg

SEQ ID NO: 2858571 - RNA, 19 nt, Mycobacterium avium subsp. paratuberculosis
gucauugaucuccgcggcg

SEQ ID NO: 2858572 - RNA, 19 nt, Mycobacterium avium subsp. paratuberculosis
guccaaaaacugcgcgucg

SEQ ID NO: 2858573 - RNA, 22 nt, Mycobacterium avium subsp. paratuberculosis
guccaaaacaucccggacaggu

SEQ ID NO: 2858574 - RNA, 14 nt, Mycobacterium avium subsp. paratuberculosis
guccaaaaugcguu

SEQ ID NO: 2858575 - RNA, 16 nt, Mycobacterium avium subsp. paratuberculosis
guccaaagacguugac

SEQ ID NO: 2858576 - RNA, 23 nt, Mycobacterium avium subsp. paratuberculosis
guccaaagacguugaccgcgaag

SEQ ID NO: 2858577 - RNA, 21 nt, Mycobacterium avium subsp. paratuberculosis
guccaacacuuuuaaggagca

SEQ ID NO: 2858578 - RNA, 23 nt, Mycobacterium avium subsp. paratuberculosis
guccaacaggugcuuggucagcg

SEQ ID NO: 2858579 - RNA, 15 nt, Mycobacterium avium subsp. paratuberculosis
guccaaccgcggacu

SEQ ID NO: 2858580 - RNA, 19 nt, Mycobacterium avium subsp. paratuberculosis
guccaaugcgccgauggug

SEQ ID NO: 2858581 - RNA, 17 nt, Mycobacterium avium subsp. paratuberculosis
guccacaccgggaaggu

SEQ ID NO: 2858582 - RNA, 20 nt, Mycobacterium avium subsp. paratuberculosis
guccaccaauggcggccacg

SEQ ID NO: 2858583 - RNA, 20 nt, Mycobacterium avium subsp. paratuberculosis
guccaccaccaacccggucu

SEQ ID NO: 2858584 - RNA, 18 nt, Mycobacterium avium subsp. paratuberculosis
guccaccaccacacccgc

SEQ ID NO: 2858585 - RNA, 19 nt, Mycobacterium avium subsp. paratuberculosis
guccaccaccacacccgcg

SEQ ID NO: 2858586 - RNA, 22 nt, Mycobacterium avium subsp. paratuberculosis
guccaccaccacacccgcggcc

SEQ ID NO: 2858587 - RNA, 17 nt, Mycobacterium avium subsp. paratuberculosis
guccaccagaagugguc

SEQ ID NO: 2858588 - RNA, 19 nt, Mycobacterium avium subsp. paratuberculosis
guccaccagaucgccccgc

SEQ ID NO: 2858589 - RNA, 17 nt, Mycobacterium avium subsp. paratuberculosis
guccaccagcaccaggc

SEQ ID NO: 2858590 - RNA, 20 nt, Mycobacterium avium subsp. paratuberculosis
guccaccagcacgccguuga

SEQ ID NO: 2858591 - RNA, 14 nt, Mycobacterium avium subsp. paratuberculosis
guccaccagcucga

SEQ ID NO: 2858592 - RNA, 17 nt, Mycobacterium avium subsp. paratuberculosis
guccaccaggguggccg

SEQ ID NO: 2858593 - RNA, 23 nt, Mycobacterium avium subsp. paratuberculosis
guccaccaggguggccgccacca

SEQ ID NO: 2858594 - RNA, 18 nt, Mycobacterium avium subsp. paratuberculosis
guccaccaggugaccggc

SEQ ID NO: 2858595 - RNA, 15 nt, Mycobacterium avium subsp. paratuberculosis
guccaccaucaacau

SEQ ID NO: 2858596 - RNA, 18 nt, Mycobacterium avium subsp. paratuberculosis
guccaccaucaacauugu

SEQ ID NO: 2858597 - RNA, 21 nt, Mycobacterium avium subsp. paratuberculosis
guccaccauggcuuccgccga

SEQ ID NO: 2858598 - RNA, 23 nt, Mycobacterium avium subsp. paratuberculosis
guccaccauggcuuccgccgaga

SEQ ID NO: 2858599 - RNA, 17 nt, Mycobacterium avium subsp. paratuberculosis
guccacccccgcgguga

SEQ ID NO: 2858600 - RNA, 23 nt, Mycobacterium avium subsp. paratuberculosis
guccaccccgccaaucaccgcgg

SEQ ID NO: 2858601 - RNA, 18 nt, Mycobacterium avium subsp. paratuberculosis
guccacccgccccgccgc

SEQ ID NO: 2858602 - RNA, 21 nt, Mycobacterium avium subsp. paratuberculosis
guccacccgccccgccgcggc

SEQ ID NO: 2858603 - RNA, 22 nt, Mycobacterium avium subsp. paratuberculosis
guccacccgccccgccgcggcc

SEQ ID NO: 2858604 - RNA, 14 nt, Mycobacterium avium subsp. paratuberculosis
guccacccggccca

SEQ ID NO: 2858605 - RNA, 13 nt, Mycobacterium avium subsp. paratuberculosis
guccaccgacgcc

SEQ ID NO: 2858606 - RNA, 12 nt, Mycobacterium avium subsp. paratuberculosis
guccaccgccgc

SEQ ID NO: 2858607 - RNA, 15 nt, Mycobacterium avium subsp. paratuberculosis
guccaccgccgcgcc

SEQ ID NO: 2858608 - RNA, 18 nt, Mycobacterium avium subsp. paratuberculosis
guccaccgccgcgccgag

SEQ ID NO: 2858609 - RNA, 16 nt, Mycobacterium avium subsp. paratuberculosis
guccaccgcggcggcc

SEQ ID NO: 2858610 - RNA, 14 nt, Mycobacterium avium subsp. paratuberculosis
guccaccggauggc

SEQ ID NO: 2858611 - RNA, 19 nt, Mycobacterium avium subsp. paratuberculosis
guccaccggauggcgcccg

SEQ ID NO: 2858612 - RNA, 17 nt, Mycobacterium avium subsp. paratuberculosis
guccaccggcacggcac

SEQ ID NO: 2858613 - RNA, 19 nt, Mycobacterium avium subsp. paratuberculosis
guccaccggcacggcaccg

SEQ ID NO: 2858614 - RNA, 12 nt, Mycobacterium avium subsp. paratuberculosis
guccaccggccg

SEQ ID NO: 2858615 - RNA, 20 nt, Mycobacterium avium subsp. paratuberculosis
guccagcgugcgcggcuggc

SEQ ID NO: 2858616 - RNA, 21 nt, Mycobacterium avium subsp. paratuberculosis
guccagcgugcgcggcuggcc

SEQ ID NO: 2858617 - RNA, 22 nt, Mycobacterium avium subsp. paratuberculosis
guccagcgugcgcggcuggccg

SEQ ID NO: 2858618 - RNA, 23 nt, Mycobacterium avium subsp. paratuberculosis
guccagcgugcgcggcuggccgu

SEQ ID NO: 2858619 - RNA, 18 nt, Mycobacterium avium subsp. paratuberculosis
guccagcgugugcguggu

SEQ ID NO: 2858620 - RNA, 18 nt, Mycobacterium avium subsp. paratuberculosis
guccagcucagcgcgcac

SEQ ID NO: 2858621 - RNA, 17 nt, Mycobacterium avium subsp. paratuberculosis
guccagcuccgccgaca

SEQ ID NO: 2858622 - RNA, 15 nt, Mycobacterium avium subsp. paratuberculosis
guccagcucgcgaag

SEQ ID NO: 2858623 - RNA, 18 nt, Mycobacterium avium subsp. paratuberculosis
guccagcugcgcgccggc

SEQ ID NO: 2858624 - RNA, 21 nt, Mycobacterium avium subsp. paratuberculosis
guccagcugcgcgccggcggc

SEQ ID NO: 2858625 - RNA, 19 nt, Mycobacterium avium subsp. paratuberculosis
guccagcuucucggcgucc

SEQ ID NO: 2858626 - RNA, 20 nt, Mycobacterium avium subsp. paratuberculosis
guccagcuugucguagcggc

SEQ ID NO: 2858627 - RNA, 21 nt, Mycobacterium avium subsp. paratuberculosis
guccagcuugucguagcggcg

SEQ ID NO: 2858628 - RNA, 22 nt, Mycobacterium avium subsp. paratuberculosis
guccagcuugucguagcggcgc

SEQ ID NO: 2858629 - RNA, 16 nt, Mycobacterium avium subsp. paratuberculosis
guccaggaucacgcgg

SEQ ID NO: 2858630 - RNA, 17 nt, Mycobacterium avium subsp. paratuberculosis
guccaggaucacgcggc

SEQ ID NO: 2858631 - RNA, 18 nt, Mycobacterium avium subsp. paratuberculosis
guccaggaucacgcggcg

SEQ ID NO: 2858632 - RNA, 21 nt, Mycobacterium avium subsp. paratuberculosis
guccaggauccccguccagcc

SEQ ID NO: 2858633 - RNA, 16 nt, Mycobacterium avium subsp. paratuberculosis
guccaggauccgcacc

SEQ ID NO: 2858634 - RNA, 19 nt, Mycobacterium avium subsp. paratuberculosis
guccaggauccgcaccggg

SEQ ID NO: 2858635 - RNA, 17 nt, Mycobacterium avium subsp. paratuberculosis
guccaggaucugcagca

SEQ ID NO: 2858636 - RNA, 21 nt, Mycobacterium avium subsp. paratuberculosis
guccaggaucugcagcacgcc

SEQ ID NO: 2858637 - RNA, 17 nt, Mycobacterium avium subsp. paratuberculosis
guccaggccgaggcuga

SEQ ID NO: 2858638 - RNA, 22 nt, Mycobacterium avium subsp. paratuberculosis
guccaggccgaggcugacgauc

SEQ ID NO: 2858639 - RNA, 14 nt, Mycobacterium avium subsp. paratuberculosis
guccaggccgccgu

SEQ ID NO: 2858640 - RNA, 17 nt, Mycobacterium avium subsp. paratuberculosis
guccaggccgcgccggg

SEQ ID NO: 2858641 - RNA, 11 nt, Mycobacterium avium subsp. paratuberculosis
guccaggccgg

SEQ ID NO: 2858642 - RNA, 14 nt, Mycobacterium avium subsp. paratuberculosis
guccaggccggcgc

SEQ ID NO: 2858643 - RNA, 18 nt, Mycobacterium avium subsp. paratuberculosis
guccaggccggcgccgcg

SEQ ID NO: 2858644 - RNA, 14 nt, Mycobacterium avium subsp. paratuberculosis
guccaggccgucga

SEQ ID NO: 2858645 - RNA, 16 nt, Mycobacterium avium subsp. paratuberculosis
guccaggcgcaccgcc

SEQ ID NO: 2858646 - RNA, 22 nt, Mycobacterium avium subsp. paratuberculosis
guccaggcgcaccgccaccgcg

SEQ ID NO: 2858647 - RNA, 18 nt, Mycobacterium avium subsp. paratuberculosis
guccaggcguucgacccc

SEQ ID NO: 2858648 - RNA, 16 nt, Mycobacterium avium subsp. paratuberculosis
guccagggccaccgcg

SEQ ID NO: 2858649 - RNA, 17 nt, Mycobacterium avium subsp. paratuberculosis
guccagggccaccgcgu

SEQ ID NO: 2858650 - RNA, 20 nt, Mycobacterium avium subsp. paratuberculosis
guccagggccaccgcgucgc

SEQ ID NO: 2858651 - RNA, 19 nt, Mycobacterium avium subsp. paratuberculosis
guccagggcgggucgucga

SEQ ID NO: 2858652 - RNA, 14 nt, Mycobacterium avium subsp. paratuberculosis
guccaggguggcca

SEQ ID NO: 2858653 - RNA, 15 nt, Mycobacterium avium subsp. paratuberculosis
guccaggguggccag

SEQ ID NO: 2858654 - RNA, 17 nt, Mycobacterium avium subsp. paratuberculosis
guccaggguggccagca

SEQ ID NO: 2858655 - RNA, 18 nt, Mycobacterium avium subsp. paratuberculosis
guccaggguggccagcac

SEQ ID NO: 2858656 - RNA, 19 nt, Mycobacterium avium subsp. paratuberculosis
guccaggguggccagcacg

SEQ ID NO: 2858657 - RNA, 21 nt, Mycobacterium avium subsp. paratuberculosis
guccaggguggccagcacgcu

SEQ ID NO: 2858658 - RNA, 23 nt, Mycobacterium avium subsp. paratuberculosis
guccaggguggugguggugccca

SEQ ID NO: 2858659 - RNA, 17 nt, Mycobacterium avium subsp. paratuberculosis
guccagggugucgucgu

SEQ ID NO: 2858660 - RNA, 19 nt, Mycobacterium avium subsp. paratuberculosis
guccagggugucgucgucg

SEQ ID NO: 2858661 - RNA, 15 nt, Mycobacterium avium subsp. paratuberculosis
guccaggucgcccuc

SEQ ID NO: 2858662 - RNA, 16 nt, Mycobacterium avium subsp. paratuberculosis
guccaggugcacccgc

SEQ ID NO: 2858663 - RNA, 17 nt, Mycobacterium avium subsp. paratuberculosis
guccaggugcacccgcg

SEQ ID NO: 2858664 - RNA, 21 nt, Mycobacterium avium subsp. paratuberculosis
guccaggugcacccgcggcgc

SEQ ID NO: 2858665 - RNA, 13 nt, Mycobacterium avium subsp. paratuberculosis
guccaggugcgcc

SEQ ID NO: 2858666 - RNA, 16 nt, Mycobacterium avium subsp. paratuberculosis
guccaggugcgccgcc

SEQ ID NO: 2858667 - RNA, 18 nt, Mycobacterium avium subsp. paratuberculosis
guccaggugcgccgccgc

SEQ ID NO: 2858668 - RNA, 22 nt, Mycobacterium avium subsp. paratuberculosis
guccaggugcgccgccgcgucg

SEQ ID NO: 2858669 - RNA, 16 nt, Mycobacterium avium subsp. paratuberculosis
guccagguggccaugg

SEQ ID NO: 2858670 - RNA, 15 nt, Mycobacterium avium subsp. paratuberculosis
guccagguggggugg

SEQ ID NO: 2858671 - RNA, 19 nt, Mycobacterium avium subsp. paratuberculosis
guccaggugggguggugga

SEQ ID NO: 2858672 - RNA, 15 nt, Mycobacterium avium subsp. paratuberculosis
guccaguacaccgcg

SEQ ID NO: 2858673 - RNA, 15 nt, Mycobacterium avium subsp. paratuberculosis
guccaguagccgccg

SEQ ID NO: 2858674 - RNA, 16 nt, Mycobacterium avium subsp. paratuberculosis
guccaguagccgccgg

SEQ ID NO: 2858675 - RNA, 16 nt, Mycobacterium avium subsp. paratuberculosis
guccaguccggccgug

SEQ ID NO: 2858676 - RNA, 15 nt, Mycobacterium avium subsp. paratuberculosis
guccaguccggcgug

SEQ ID NO: 2858677 - RNA, 17 nt, Mycobacterium avium subsp. paratuberculosis
guccaguccggcgugcc

SEQ ID NO: 2858678 - RNA, 21 nt, Mycobacterium avium subsp. paratuberculosis
guccaguccggcgugccaccg

SEQ ID NO: 2858679 - RNA, 13 nt, Mycobacterium avium subsp. paratuberculosis
guccagucgcgcc

SEQ ID NO: 2858680 - RNA, 15 nt, Mycobacterium avium subsp. paratuberculosis
guccagucgcgccga

SEQ ID NO: 2858681 - RNA, 16 nt, Mycobacterium avium subsp. paratuberculosis
guccagucgcgccgag

SEQ ID NO: 2858682 - RNA, 15 nt, Mycobacterium avium subsp. paratuberculosis
guccagucggccgug

SEQ ID NO: 2858683 - RNA, 18 nt, Mycobacterium avium subsp. paratuberculosis
guccagucggccgugaac

SEQ ID NO: 2858684 - RNA, 14 nt, Mycobacterium avium subsp. paratuberculosis
guccagugacgccu

SEQ ID NO: 2858685 - RNA, 13 nt, Mycobacterium avium subsp. paratuberculosis
guccagugccggc

SEQ ID NO: 2858686 - RNA, 18 nt, Mycobacterium avium subsp. paratuberculosis
guccaguucggccagcgc

SEQ ID NO: 2858687 - RNA, 19 nt, Mycobacterium avium subsp. paratuberculosis
guccaguucggccagcgcg

SEQ ID NO: 2858688 - RNA, 20 nt, Mycobacterium avium subsp. paratuberculosis
guccaguucggccagcgcgg

SEQ ID NO: 2858689 - RNA, 22 nt, Mycobacterium avium subsp. paratuberculosis
guccaguugcggcacgccgacc

SEQ ID NO: 2858690 - RNA, 22 nt, Mycobacterium avium subsp. paratuberculosis
guccaguugugccgcaaggcau

SEQ ID NO: 2858691 - RNA, 13 nt, Mycobacterium avium subsp. paratuberculosis
guccaucagcacc

SEQ ID NO: 2858692 - RNA, 14 nt, Mycobacterium avium subsp. paratuberculosis
guccaucagcaccg

SEQ ID NO: 2858693 - RNA, 15 nt, Mycobacterium avium subsp. paratuberculosis
guccauccagcgccg

SEQ ID NO: 2858694 - RNA, 13 nt, Mycobacterium avium subsp. paratuberculosis
guccaucgccgcg

SEQ ID NO: 2858695 - RNA, 17 nt, Mycobacterium avium subsp. paratuberculosis
guccaucgccgcgcacc

SEQ ID NO: 2858696 - RNA, 20 nt, Mycobacterium avium subsp. paratuberculosis
guccaucgccgcgcacccgg

SEQ ID NO: 2858697 - RNA, 16 nt, Mycobacterium avium subsp. paratuberculosis
guccaucgccucgacc

SEQ ID NO: 2858698 - RNA, 20 nt, Mycobacterium avium subsp. paratuberculosis
guccaucgccucgaccagca

SEQ ID NO: 2858699 - RNA, 22 nt, Mycobacterium avium subsp. paratuberculosis
guccaucgccucgaccagcacc

SEQ ID NO: 2858700 - RNA, 13 nt, Mycobacterium avium subsp. paratuberculosis
gucccgcucgauc

SEQ ID NO: 2858701 - RNA, 20 nt, Mycobacterium avium subsp. paratuberculosis
gucccgcucgaucuggcgga

SEQ ID NO: 2858702 - RNA, 22 nt, Mycobacterium avium subsp. paratuberculosis
gucccgcucgaucuggcggacc

SEQ ID NO: 2858703 - RNA, 19 nt, Mycobacterium avium subsp. paratuberculosis
gucccggcaacaccggcgg

SEQ ID NO: 2858704 - RNA, 20 nt, Mycobacterium avium subsp. paratuberculosis
gucccggcaacaccggcggc

SEQ ID NO: 2858705 - RNA, 20 nt, Mycobacterium avium subsp. paratuberculosis
gucccggccgcgacagccgg

SEQ ID NO: 2858706 - RNA, 17 nt, Mycobacterium avium subsp. paratuberculosis
gucccggcgcaccaggc

SEQ ID NO: 2858707 - RNA, 23 nt, Mycobacterium avium subsp. paratuberculosis
gucccggcgcaccaggcgccaca

SEQ ID NO: 2858708 - RNA, 20 nt, Mycobacterium avium subsp. paratuberculosis
gucccggcgcccuucggcgc

SEQ ID NO: 2858709 - RNA, 18 nt, Mycobacterium avium subsp. paratuberculosis
gucccggcgccucggcgc

SEQ ID NO: 2858710 - RNA, 17 nt, Mycobacterium avium subsp. paratuberculosis
gucccggcggacccgga

SEQ ID NO: 2858711 - RNA, 19 nt, Mycobacterium avium subsp. paratuberculosis
gucccggcgggggcggcgg

SEQ ID NO: 2858712 - RNA, 18 nt, Mycobacterium avium subsp. paratuberculosis
gucccggcgucucggcgu

SEQ ID NO: 2858713 - RNA, 19 nt, Mycobacterium avium subsp. paratuberculosis
gucccggcuuuccgacggc

SEQ ID NO: 2858714 - RNA, 17 nt, Mycobacterium avium subsp. paratuberculosis
gucccgguacaggucgc

SEQ ID NO: 2858715 - RNA, 21 nt, Mycobacterium avium subsp. paratuberculosis
gucccggucagcccccaccgc

SEQ ID NO: 2858716 - RNA, 22 nt, Mycobacterium avium subsp. paratuberculosis
gucccggucagcccccaccgcg

SEQ ID NO: 2858717 - RNA, 16 nt, Mycobacterium avium subsp. paratuberculosis
gucccggucagcgucc

SEQ ID NO: 2858718 - RNA, 20 nt, Mycobacterium avium subsp. paratuberculosis
gucccggugaugacggggcg

SEQ ID NO: 2858719 - RNA, 21 nt, Mycobacterium avium subsp. paratuberculosis
gucccggugaugacggggcgu

SEQ ID NO: 2858720 - RNA, 14 nt, Mycobacterium avium subsp. paratuberculosis
gucccggugucgcc

SEQ ID NO: 2858721 - RNA, 20 nt, Mycobacterium avium subsp. paratuberculosis
gucccggugucgccgucgcc

SEQ ID NO: 2858722 - RNA, 20 nt, Mycobacterium avium subsp. paratuberculosis
gucccguccaucgccgcgca

SEQ ID NO: 2858723 - RNA, 15 nt, Mycobacterium avium subsp. paratuberculosis
gucccguccgacggc

SEQ ID NO: 2858724 - RNA, 16 nt, Mycobacterium avium subsp. paratuberculosis
gucccguccgacggcu

SEQ ID NO: 2858725 - RNA, 23 nt, Mycobacterium avium subsp. paratuberculosis
gucccguccugggccuggcgcuc

SEQ ID NO: 2858726 - RNA, 12 nt, Mycobacterium avium subsp. paratuberculosis
gucccgucgacc

SEQ ID NO: 2858727 - RNA, 23 nt, Mycobacterium avium subsp. paratuberculosis
gucccgucggccaguucgccggu

SEQ ID NO: 2858728 - RNA, 14 nt, Mycobacterium avium subsp. paratuberculosis
gucccgucggcgcg

SEQ ID NO: 2858729 - RNA, 17 nt, Mycobacterium avium subsp. paratuberculosis
gucccgugcgccgccca

SEQ ID NO: 2858730 - RNA, 19 nt, Mycobacterium avium subsp. paratuberculosis
gucccguugcgggacuggg

SEQ ID NO: 2858731 - RNA, 17 nt, Mycobacterium avium subsp. paratuberculosis
gucccguuggcgccggu

SEQ ID NO: 2858732 - RNA, 12 nt, Mycobacterium avium subsp. paratuberculosis
gucccugcggcu

SEQ ID NO: 2858733 - RNA, 21 nt, Mycobacterium avium subsp. paratuberculosis
gucccugcggcugcaucaugc

SEQ ID NO: 2858734 - RNA, 22 nt, Mycobacterium avium subsp. paratuberculosis
gucccugcggcugcaucaugcc

SEQ ID NO: 2858735 - RNA, 16 nt, Mycobacterium avium subsp. paratuberculosis
gucccuguucgcgccg

SEQ ID NO: 2858736 - RNA, 18 nt, Mycobacterium avium subsp. paratuberculosis
gucccuguucgcgccggu

SEQ ID NO: 2858737 - RNA, 16 nt, Mycobacterium avium subsp. paratuberculosis
gucccuugggcggauu

SEQ ID NO: 2858738 - RNA, 22 nt, Mycobacterium avium subsp. paratuberculosis
gucccuuugcuguucgucgagu

SEQ ID NO: 2858739 - RNA, 22 nt, Mycobacterium avium subsp. paratuberculosis
guccgaaaaacgcgucgcgugg

SEQ ID NO: 2858740 - RNA, 12 nt, Mycobacterium avium subsp. paratuberculosis
guccgacaccac

SEQ ID NO: 2858741 - RNA, 15 nt, Mycobacterium avium subsp. paratuberculosis
guccgacaccaccug

SEQ ID NO: 2858742 - RNA, 16 nt, Mycobacterium avium subsp. paratuberculosis
guccgacaccaccugc

SEQ ID NO: 2858743 - RNA, 17 nt, Mycobacterium avium subsp. paratuberculosis
guccgacaccaccugca

SEQ ID NO: 2858744 - RNA, 15 nt, Mycobacterium avium subsp. paratuberculosis
guccgacagcccgcc

SEQ ID NO: 2858745 - RNA, 14 nt, Mycobacterium avium subsp. paratuberculosis
guccgacagcgccu

SEQ ID NO: 2858746 - RNA, 19 nt, Mycobacterium avium subsp. paratuberculosis
guccgaccagcggcccacc

SEQ ID NO: 2858747 - RNA, 20 nt, Mycobacterium avium subsp. paratuberculosis
guccgaccagcggcccaccg

SEQ ID NO: 2858748 - RNA, 22 nt, Mycobacterium avium subsp. paratuberculosis
guccgaccagcggcccaccgcg

SEQ ID NO: 2858749 - RNA, 13 nt, Mycobacterium avium subsp. paratuberculosis
guccgaccaggaa

SEQ ID NO: 2858750 - RNA, 18 nt, Mycobacterium avium subsp. paratuberculosis
guccgaccgccaccaccc

SEQ ID NO: 2858751 - RNA, 20 nt, Mycobacterium avium subsp. paratuberculosis
guccgaccgccaccacccgg

SEQ ID NO: 2858752 - RNA, 12 nt, Mycobacterium avium subsp. paratuberculosis
guccgaccgcgu

SEQ ID NO: 2858753 - RNA, 13 nt, Mycobacterium avium subsp. paratuberculosis
guccgaccgcgua

SEQ ID NO: 2858754 - RNA, 23 nt, Mycobacterium avium subsp. paratuberculosis
guccgaccgcguacagggcgucg

SEQ ID NO: 2858755 - RNA, 15 nt, Mycobacterium avium subsp. paratuberculosis
guccgaccgguugcc

SEQ ID NO: 2858756 - RNA, 18 nt, Mycobacterium avium subsp. paratuberculosis
guccgaccgguugcccgg

SEQ ID NO: 2858757 - RNA, 21 nt, Mycobacterium avium subsp. paratuberculosis
guccgacgauccgggccgguc

SEQ ID NO: 2858758 - RNA, 22 nt, Mycobacterium avium subsp. paratuberculosis
guccgacgauccgggccggucg

SEQ ID NO: 2858759 - RNA, 13 nt, Mycobacterium avium subsp. paratuberculosis
guccgacgccguc

SEQ ID NO: 2858760 - RNA, 15 nt, Mycobacterium avium subsp. paratuberculosis
guccgacgcgacggu

SEQ ID NO: 2858761 - RNA, 17 nt, Mycobacterium avium subsp. paratuberculosis
guccgacgcgacggucg

SEQ ID NO: 2858762 - RNA, 21 nt, Mycobacterium avium subsp. paratuberculosis
guccgacgcgacggucgugcu

SEQ ID NO: 2858763 - RNA, 23 nt, Mycobacterium avium subsp. paratuberculosis
guccgacgcgacggucgugcugg

SEQ ID NO: 2858764 - RNA, 11 nt, Mycobacterium avium subsp. paratuberculosis
guccgacggcu

SEQ ID NO: 2858765 - RNA, 16 nt, Mycobacterium avium subsp. paratuberculosis
guccgacggcuaccug

SEQ ID NO: 2858766 - RNA, 14 nt, Mycobacterium avium subsp. paratuberculosis
guccgacggcugcg

SEQ ID NO: 2858767 - RNA, 22 nt, Mycobacterium avium subsp. paratuberculosis
guccgacggcugcgguuggccg

SEQ ID NO: 2858768 - RNA, 19 nt, Mycobacterium avium subsp. paratuberculosis
guccgacggcuggguggcg

SEQ ID NO: 2858769 - RNA, 17 nt, Mycobacterium avium subsp. paratuberculosis
guccgacuucgcgugcc

SEQ ID NO: 2858770 - RNA, 17 nt, Mycobacterium avium subsp. paratuberculosis
guccgagaagggccgcc

SEQ ID NO: 2858771 - RNA, 20 nt, Mycobacterium avium subsp. paratuberculosis
guccgagaagggccgccgcu

SEQ ID NO: 2858772 - RNA, 21 nt, Mycobacterium avium subsp. paratuberculosis
guccgagaagggccgccgcug

SEQ ID NO: 2858773 - RNA, 17 nt, Mycobacterium avium subsp. paratuberculosis
guccgagacgucggcgu

SEQ ID NO: 2858774 - RNA, 18 nt, Mycobacterium avium subsp. paratuberculosis
guccgagcagcagccgca

SEQ ID NO: 2858775 - RNA, 14 nt, Mycobacterium avium subsp. paratuberculosis
guccgagccgccca

SEQ ID NO: 2858776 - RNA, 14 nt, Mycobacterium avium subsp. paratuberculosis
guccgaggcgguuc

SEQ ID NO: 2858777 - RNA, 13 nt, Mycobacterium avium subsp. paratuberculosis
guccgauaccagc

SEQ ID NO: 2858778 - RNA, 17 nt, Mycobacterium avium subsp. paratuberculosis
guccgaucguccggcgc

SEQ ID NO: 2858779 - RNA, 20 nt, Mycobacterium avium subsp. paratuberculosis
guccgaucguccggcgccac

SEQ ID NO: 2858780 - RNA, 22 nt, Mycobacterium avium subsp. paratuberculosis
guccgaugacgagcagcgugcu

SEQ ID NO: 2858781 - RNA, 15 nt, Mycobacterium avium subsp. paratuberculosis
guccgcaaccgccgg

SEQ ID NO: 2858782 - RNA, 18 nt, Mycobacterium avium subsp. paratuberculosis
guccgcaaccgccggcag

SEQ ID NO: 2858783 - RNA, 20 nt, Mycobacterium avium subsp. paratuberculosis
guccgcaaccgccggcagcg

SEQ ID NO: 2858784 - RNA, 19 nt, Mycobacterium avium subsp. paratuberculosis
guccgcucaucgucguugg

SEQ ID NO: 2858785 - RNA, 17 nt, Mycobacterium avium subsp. paratuberculosis
guccgcuccaccagcgc

SEQ ID NO: 2858786 - RNA, 15 nt, Mycobacterium avium subsp. paratuberculosis
guccggaaccgcgcc

SEQ ID NO: 2858787 - RNA, 16 nt, Mycobacterium avium subsp. paratuberculosis
guccggaaccgcgccu

SEQ ID NO: 2858788 - RNA, 18 nt, Mycobacterium avium subsp. paratuberculosis
guccggaagcccuugcag

SEQ ID NO: 2858789 - RNA, 21 nt, Mycobacterium avium subsp. paratuberculosis
guccggaagcccuugcagcac

SEQ ID NO: 2858790 - RNA, 16 nt, Mycobacterium avium subsp. paratuberculosis
guccggaaucaccuug

SEQ ID NO: 2858791 - RNA, 17 nt, Mycobacterium avium subsp. paratuberculosis
guccggacacggccagc

SEQ ID NO: 2858792 - RNA, 22 nt, Mycobacterium avium subsp. paratuberculosis
guccggacacggccagcgccgu

SEQ ID NO: 2858793 - RNA, 22 nt, Mycobacterium avium subsp. paratuberculosis
guccggagcgaaggugccgcga

SEQ ID NO: 2858794 - RNA, 16 nt, Mycobacterium avium subsp. paratuberculosis
guccggcagcagcgag

SEQ ID NO: 2858795 - RNA, 13 nt, Mycobacterium avium subsp. paratuberculosis
guccggcagcgcg

SEQ ID NO: 2858796 - RNA, 14 nt, Mycobacterium avium subsp. paratuberculosis
guccggcagcgcgc

SEQ ID NO: 2858797 - RNA, 15 nt, Mycobacterium avium subsp. paratuberculosis
guccggccacgaccu

SEQ ID NO: 2858798 - RNA, 17 nt, Mycobacterium avium subsp. paratuberculosis
guccggccagguccaca

SEQ ID NO: 2858799 - RNA, 22 nt, Mycobacterium avium subsp. paratuberculosis
guccggccaggucgccgcgcag

SEQ ID NO: 2858800 - RNA, 17 nt, Mycobacterium avium subsp. paratuberculosis
guccggccaguccagcg

SEQ ID NO: 2858801 - RNA, 12 nt, Mycobacterium avium subsp. paratuberculosis
guccggcccgau

SEQ ID NO: 2858802 - RNA, 15 nt, Mycobacterium avium subsp. paratuberculosis
guccggcccgaugcg

SEQ ID NO: 2858803 - RNA, 16 nt, Mycobacterium avium subsp. paratuberculosis
guccggcccggcgucc

SEQ ID NO: 2858804 - RNA, 18 nt, Mycobacterium avium subsp. paratuberculosis
guccggcccggcguccgc

SEQ ID NO: 2858805 - RNA, 15 nt, Mycobacterium avium subsp. paratuberculosis
guccggcccuggucg

SEQ ID NO: 2858806 - RNA, 16 nt, Mycobacterium avium subsp. paratuberculosis
guccggcccuggucgg

SEQ ID NO: 2858807 - RNA, 19 nt, Mycobacterium avium subsp. paratuberculosis
guccggcccuggucggcca

SEQ ID NO: 2858808 - RNA, 13 nt, Mycobacterium avium subsp. paratuberculosis
guccggccggccg

SEQ ID NO: 2858809 - RNA, 17 nt, Mycobacterium avium subsp. paratuberculosis
guccggccggccgaaca

SEQ ID NO: 2858810 - RNA, 13 nt, Mycobacterium avium subsp. paratuberculosis
guccggccgugau

SEQ ID NO: 2858811 - RNA, 22 nt, Mycobacterium avium subsp. paratuberculosis
guccggccgugaugcgccggcg

SEQ ID NO: 2858812 - RNA, 13 nt, Mycobacterium avium subsp. paratuberculosis
guccggccgugcc

SEQ ID NO: 2858813 - RNA, 16 nt, Mycobacterium avium subsp. paratuberculosis
guccggccgugccgug

SEQ ID NO: 2858814 - RNA, 19 nt, Mycobacterium avium subsp. paratuberculosis
guccggcgacaugcgcagc

SEQ ID NO: 2858815 - RNA, 21 nt, Mycobacterium avium subsp. paratuberculosis
guccggcgaguacccgccgca

SEQ ID NO: 2858816 - RNA, 22 nt, Mycobacterium avium subsp. paratuberculosis
guccggcgaguacccgccgcac

SEQ ID NO: 2858817 - RNA, 13 nt, Mycobacterium avium subsp. paratuberculosis
guccggcgccacg

SEQ ID NO: 2858818 - RNA, 22 nt, Mycobacterium avium subsp. paratuberculosis
guccggcgccagcccggugauc

SEQ ID NO: 2858819 - RNA, 17 nt, Mycobacterium avium subsp. paratuberculosis
guccggcgcccgaucgg

SEQ ID NO: 2858820 - RNA, 18 nt, Mycobacterium avium subsp. paratuberculosis
guccggcgcccgaucggc

SEQ ID NO: 2858821 - RNA, 13 nt, Mycobacterium avium subsp. paratuberculosis
guccggcgcccgg

SEQ ID NO: 2858822 - RNA, 14 nt, Mycobacterium avium subsp. paratuberculosis
guccggcgccgacc

SEQ ID NO: 2858823 - RNA, 21 nt, Mycobacterium avium subsp. paratuberculosis
guccggcgccgacccccgccg

SEQ ID NO: 2858824 - RNA, 23 nt, Mycobacterium avium subsp. paratuberculosis
guccggcgccgacccccgccgcg

SEQ ID NO: 2858825 - RNA, 15 nt, Mycobacterium avium subsp. paratuberculosis
guccggcgcgcagca

SEQ ID NO: 2858826 - RNA, 15 nt, Mycobacterium avium subsp. paratuberculosis
guccggcgcgcccgg

SEQ ID NO: 2858827 - RNA, 12 nt, Mycobacterium avium subsp. paratuberculosis
guccggcggcaa

SEQ ID NO: 2858828 - RNA, 18 nt, Mycobacterium avium subsp. paratuberculosis
guccggcggcaccacccg

SEQ ID NO: 2858829 - RNA, 19 nt, Mycobacterium avium subsp. paratuberculosis
guccggcggcaccacccgc

SEQ ID NO: 2858830 - RNA, 15 nt, Mycobacterium avium subsp. paratuberculosis
guccggcggucagca

SEQ ID NO: 2858831 - RNA, 14 nt, Mycobacterium avium subsp. paratuberculosis
guccggcggucgcu

SEQ ID NO: 2858832 - RNA, 20 nt, Mycobacterium avium subsp. paratuberculosis
guccggcggucgcugcagcg

SEQ ID NO: 2858833 - RNA, 22 nt, Mycobacterium avium subsp. paratuberculosis
guccggcggucgcugcagcggc

SEQ ID NO: 2858834 - RNA, 23 nt, Mycobacterium avium subsp. paratuberculosis
guccggcggucgcugcagcggcg

SEQ ID NO: 2858835 - RNA, 24 nt, Mycobacterium avium subsp. paratuberculosis
guccggcggucgcugcagcggcgg

SEQ ID NO: 2858836 - RNA, 13 nt, Mycobacterium avium subsp. paratuberculosis
guccggcguccac

SEQ ID NO: 2858837 - RNA, 19 nt, Mycobacterium avium subsp. paratuberculosis
guccggcgugccaccgcug

SEQ ID NO: 2858838 - RNA, 18 nt, Mycobacterium avium subsp. paratuberculosis
guccggcucggugccgcg

SEQ ID NO: 2858839 - RNA, 17 nt, Mycobacterium avium subsp. paratuberculosis
guccggcucugccugca

SEQ ID NO: 2858840 - RNA, 19 nt, Mycobacterium avium subsp. paratuberculosis
guccggcucugccugcagg

SEQ ID NO: 2858841 - RNA, 22 nt, Mycobacterium avium subsp. paratuberculosis
guccggcugaacgccagcagcc

SEQ ID NO: 2858842 - RNA, 14 nt, Mycobacterium avium subsp. paratuberculosis
guccggcuggucgg

SEQ ID NO: 2858843 - RNA, 18 nt, Mycobacterium avium subsp. paratuberculosis
guccgggaacacguagcg

SEQ ID NO: 2858844 - RNA, 18 nt, Mycobacterium avium subsp. paratuberculosis
guccgggaacagcgacuc

SEQ ID NO: 2858845 - RNA, 20 nt, Mycobacterium avium subsp. paratuberculosis
guccgggauaguucgccgcc

SEQ ID NO: 2858846 - RNA, 18 nt, Mycobacterium avium subsp. paratuberculosis
guccgggaugacaccgcg

SEQ ID NO: 2858847 - RNA, 19 nt, Mycobacterium avium subsp. paratuberculosis
guccgggaugacaccgcgg

SEQ ID NO: 2858848 - RNA, 20 nt, Mycobacterium avium subsp. paratuberculosis
guccgggaugacaccgcgga

SEQ ID NO: 2858849 - RNA, 22 nt, Mycobacterium avium subsp. paratuberculosis
guccgggaugacaccgcggacc

SEQ ID NO: 2858850 - RNA, 21 nt, Mycobacterium avium subsp. paratuberculosis
guccgggauggacgacgugcc

SEQ ID NO: 2858851 - RNA, 14 nt, Mycobacterium avium subsp. paratuberculosis
guccgggcacccga

SEQ ID NO: 2858852 - RNA, 16 nt, Mycobacterium avium subsp. paratuberculosis
guccgggcacucgagc

SEQ ID NO: 2858853 - RNA, 13 nt, Mycobacterium avium subsp. paratuberculosis
guccgggccgccg

SEQ ID NO: 2858854 - RNA, 15 nt, Mycobacterium avium subsp. paratuberculosis
guccgggccgccggc

SEQ ID NO: 2858855 - RNA, 13 nt, Mycobacterium avium subsp. paratuberculosis
guccgggccggcc

SEQ ID NO: 2858856 - RNA, 15 nt, Mycobacterium avium subsp. paratuberculosis
guccgggccggccag

SEQ ID NO: 2858857 - RNA, 17 nt, Mycobacterium avium subsp. paratuberculosis
guccgggccggccagac

SEQ ID NO: 2858858 - RNA, 17 nt, Mycobacterium avium subsp. paratuberculosis
guccgggcgcugcgcgg

SEQ ID NO: 2858859 - RNA, 23 nt, Mycobacterium avium subsp. paratuberculosis
guccgggcgcugcgcgguggcgc

SEQ ID NO: 2858860 - RNA, 14 nt, Mycobacterium avium subsp. paratuberculosis
guccgggcguagug

SEQ ID NO: 2858861 - RNA, 17 nt, Mycobacterium avium subsp. paratuberculosis
guccggggccggugcgu

SEQ ID NO: 2858862 - RNA, 17 nt, Mycobacterium avium subsp. paratuberculosis
guccggggugagcaggg

SEQ ID NO: 2858863 - RNA, 22 nt, Mycobacterium avium subsp. paratuberculosis
guccggggugagcagggccagc

SEQ ID NO: 2858864 - RNA, 14 nt, Mycobacterium avium subsp. paratuberculosis
guccggggugcccu

SEQ ID NO: 2858865 - RNA, 14 nt, Mycobacterium avium subsp. paratuberculosis
guccggggugggca

SEQ ID NO: 2858866 - RNA, 22 nt, Mycobacterium avium subsp. paratuberculosis
guccggggugggcacgucggcc

SEQ ID NO: 2858867 - RNA, 19 nt, Mycobacterium avium subsp. paratuberculosis
guccgggguguaggcgucg

SEQ ID NO: 2858868 - RNA, 22 nt, Mycobacterium avium subsp. paratuberculosis
guccgggguguaggcgucggcg

SEQ ID NO: 2858869 - RNA, 23 nt, Mycobacterium avium subsp. paratuberculosis
guccgggguguaggcgucggcgg

SEQ ID NO: 2858870 - RNA, 23 nt, Mycobacterium avium subsp. paratuberculosis
guccgggucgcacagccgcagca

SEQ ID NO: 2858871 - RNA, 18 nt, Mycobacterium avium subsp. paratuberculosis
guccgggugcgggcugac

SEQ ID NO: 2858872 - RNA, 16 nt, Mycobacterium avium subsp. paratuberculosis
guccgguaggccggcc

SEQ ID NO: 2858873 - RNA, 17 nt, Mycobacterium avium subsp. paratuberculosis
guccgguaggccggccg

SEQ ID NO: 2858874 - RNA, 16 nt, Mycobacterium avium subsp. paratuberculosis
guccgguaggcguugu

SEQ ID NO: 2858875 - RNA, 14 nt, Mycobacterium avium subsp. paratuberculosis
guccggucagcacc

SEQ ID NO: 2858876 - RNA, 17 nt, Mycobacterium avium subsp. paratuberculosis
guccggucagcaccgcg

SEQ ID NO: 2858877 - RNA, 22 nt, Mycobacterium avium subsp. paratuberculosis
guccggucagcaccgcgcggcg

SEQ ID NO: 2858878 - RNA, 17 nt, Mycobacterium avium subsp. paratuberculosis
guccggucucuggccug

SEQ ID NO: 2858879 - RNA, 18 nt, Mycobacterium avium subsp. paratuberculosis
guccggucuucucggcca

SEQ ID NO: 2858880 - RNA, 15 nt, Mycobacterium avium subsp. paratuberculosis
guccgguucgaccgg

SEQ ID NO: 2858881 - RNA, 18 nt, Mycobacterium avium subsp. paratuberculosis
guccgguucgaccggcgu

SEQ ID NO: 2858882 - RNA, 19 nt, Mycobacterium avium subsp. paratuberculosis
guccgguucgaccggcguc

SEQ ID NO: 2858883 - RNA, 17 nt, Mycobacterium avium subsp. paratuberculosis
guccgguucggcggcau

SEQ ID NO: 2858884 - RNA, 18 nt, Mycobacterium avium subsp. paratuberculosis
guccguagugcucggcgu

SEQ ID NO: 2858885 - RNA, 20 nt, Mycobacterium avium subsp. paratuberculosis
guccgucgaauaggugaugu

SEQ ID NO: 2858886 - RNA, 22 nt, Mycobacterium avium subsp. paratuberculosis
guccgugcauagcuggcgccga

SEQ ID NO: 2858887 - RNA, 19 nt, Mycobacterium avium subsp. paratuberculosis
guccgugccacggccgcgg

SEQ ID NO: 2858888 - RNA, 14 nt, Mycobacterium avium subsp. paratuberculosis
guccgugcugccgg

SEQ ID NO: 2858889 - RNA, 16 nt, Mycobacterium avium subsp. paratuberculosis
guccgugcugccggcc

SEQ ID NO: 2858890 - RNA, 17 nt, Mycobacterium avium subsp. paratuberculosis
guccgugcugccggccg

SEQ ID NO: 2858891 - RNA, 20 nt, Mycobacterium avium subsp. paratuberculosis
guccgugcugccggccggca

SEQ ID NO: 2858892 - RNA, 19 nt, Mycobacterium avium subsp. paratuberculosis
guccguggugaucgccgcg

SEQ ID NO: 2858893 - RNA, 21 nt, Mycobacterium avium subsp. paratuberculosis
guccguggugaucgccgcgga

SEQ ID NO: 2858894 - RNA, 14 nt, Mycobacterium avium subsp. paratuberculosis
guccguucggcggu

SEQ ID NO: 2858895 - RNA, 22 nt, Mycobacterium avium subsp. paratuberculosis
guccguugggggcgccgcggcg

SEQ ID NO: 2858896 - RNA, 14 nt, Mycobacterium avium subsp. paratuberculosis
guccucccagcgcc

SEQ ID NO: 2858897 - RNA, 21 nt, Mycobacterium avium subsp. paratuberculosis
guccucccagcgcccgggcgc

SEQ ID NO: 2858898 - RNA, 22 nt, Mycobacterium avium subsp. paratuberculosis
guccuccgucgagucggccacc

SEQ ID NO: 2858899 - RNA, 14 nt, Mycobacterium avium subsp. paratuberculosis
guccuccgucgccu

SEQ ID NO: 2858900 - RNA, 20 nt, Mycobacterium avium subsp. paratuberculosis
guccuccgucgccuucuggc

SEQ ID NO: 2858901 - RNA, 17 nt, Mycobacterium avium subsp. paratuberculosis
guccuccuccucgucgc

SEQ ID NO: 2858902 - RNA, 21 nt, Mycobacterium avium subsp. paratuberculosis
guccuccucguccgcggcggc

SEQ ID NO: 2858903 - RNA, 11 nt, Mycobacterium avium subsp. paratuberculosis
guccuccugcg

SEQ ID NO: 2858904 - RNA, 15 nt, Mycobacterium avium subsp. paratuberculosis
guccucgaccacccg

SEQ ID NO: 2858905 - RNA, 21 nt, Mycobacterium avium subsp. paratuberculosis
guccucgaccacccgcugguc

SEQ ID NO: 2858906 - RNA, 20 nt, Mycobacterium avium subsp. paratuberculosis
guccucgaccucuucggcgc

SEQ ID NO: 2858907 - RNA, 23 nt, Mycobacterium avium subsp. paratuberculosis
guccucgacgaucagcacgucgc

SEQ ID NO: 2858908 - RNA, 15 nt, Mycobacterium avium subsp. paratuberculosis
guccucgacgccgcg

SEQ ID NO: 2858909 - RNA, 21 nt, Mycobacterium avium subsp. paratuberculosis
guccucgagccguuugaugcc

SEQ ID NO: 2858910 - RNA, 23 nt, Mycobacterium avium subsp. paratuberculosis
guccucgagcgcgucgaccagcc

SEQ ID NO: 2858911 - RNA, 20 nt, Mycobacterium avium subsp. paratuberculosis
guccucgauccgguccagcc

SEQ ID NO: 2858912 - RNA, 18 nt, Mycobacterium avium subsp. paratuberculosis
guccucgaucgacaccuc

SEQ ID NO: 2858913 - RNA, 18 nt, Mycobacterium avium subsp. paratuberculosis
guccucgaugacgccgga

SEQ ID NO: 2858914 - RNA, 18 nt, Mycobacterium avium subsp. paratuberculosis
guccucgaugccgaccga

SEQ ID NO: 2858915 - RNA, 23 nt, Mycobacterium avium subsp. paratuberculosis
guccucgaugccgaccgacagcc

SEQ ID NO: 2858916 - RNA, 18 nt, Mycobacterium avium subsp. paratuberculosis
guccucgauggcggcggc

SEQ ID NO: 2858917 - RNA, 20 nt, Mycobacterium avium subsp. paratuberculosis
guccucgauggcggcggcug

SEQ ID NO: 2858918 - RNA, 19 nt, Mycobacterium avium subsp. paratuberculosis
guccucgccguacgcgccg

SEQ ID NO: 2858919 - RNA, 20 nt, Mycobacterium avium subsp. paratuberculosis
guccucgccguacgcgccgg

SEQ ID NO: 2858920 - RNA, 21 nt, Mycobacterium avium subsp. paratuberculosis
guccucgccguacgcgccggc

SEQ ID NO: 2858921 - RNA, 17 nt, Mycobacterium avium subsp. paratuberculosis
guccucgcgccguggcc

SEQ ID NO: 2858922 - RNA, 16 nt, Mycobacterium avium subsp. paratuberculosis
guccucgcgucgcgcg

SEQ ID NO: 2858923 - RNA, 17 nt, Mycobacterium avium subsp. paratuberculosis
guccucgcgucgcgcgg

SEQ ID NO: 2858924 - RNA, 17 nt, Mycobacterium avium subsp. paratuberculosis
guccucgcuggcgauca

SEQ ID NO: 2858925 - RNA, 22 nt, Mycobacterium avium subsp. paratuberculosis
guccucgcuggcgaucaccuug

SEQ ID NO: 2858926 - RNA, 17 nt, Mycobacterium avium subsp. paratuberculosis
guccucggacucgucgc

SEQ ID NO: 2858927 - RNA, 18 nt, Mycobacterium avium subsp. paratuberculosis
guccucggacucgucgcu

SEQ ID NO: 2858928 - RNA, 15 nt, Mycobacterium avium subsp. paratuberculosis
guccucggccgccac

SEQ ID NO: 2858929 - RNA, 16 nt, Mycobacterium avium subsp. paratuberculosis
guccucggccgccacc

SEQ ID NO: 2858930 - RNA, 17 nt, Mycobacterium avium subsp. paratuberculosis
guccucggccgccaccg

SEQ ID NO: 2858931 - RNA, 13 nt, Mycobacterium avium subsp. paratuberculosis
guccucggcgaug

SEQ ID NO: 2858932 - RNA, 14 nt, Mycobacterium avium subsp. paratuberculosis
guccucgggguggu

SEQ ID NO: 2858933 - RNA, 16 nt, Mycobacterium avium subsp. paratuberculosis
guccucggucucgucc

SEQ ID NO: 2858934 - RNA, 17 nt, Mycobacterium avium subsp. paratuberculosis
guccucgguggccaccu

SEQ ID NO: 2858935 - RNA, 17 nt, Mycobacterium avium subsp. paratuberculosis
guccucgucggcgaagg

SEQ ID NO: 2858936 - RNA, 18 nt, Mycobacterium avium subsp. paratuberculosis
guccucgucggcgaaggu

SEQ ID NO: 2858937 - RNA, 13 nt, Mycobacterium avium subsp. paratuberculosis
guccucucggcgc

SEQ ID NO: 2858938 - RNA, 14 nt, Mycobacterium avium subsp. paratuberculosis
guccucucggcgcc

SEQ ID NO: 2858939 - RNA, 17 nt, Mycobacterium avium subsp. paratuberculosis
guccucugcgaccaccc

SEQ ID NO: 2858940 - RNA, 20 nt, Mycobacterium avium subsp. paratuberculosis
guccugcaccgacugcggcg

SEQ ID NO: 2858941 - RNA, 14 nt, Mycobacterium avium subsp. paratuberculosis
guccugcaccgagu

SEQ ID NO: 2858942 - RNA, 19 nt, Mycobacterium avium subsp. paratuberculosis
guccugcaccgaguugaac

SEQ ID NO: 2858943 - RNA, 16 nt, Mycobacterium avium subsp. paratuberculosis
guccugcagcagccgg

SEQ ID NO: 2858944 - RNA, 17 nt, Mycobacterium avium subsp. paratuberculosis
guccugcagcagccgga

SEQ ID NO: 2858945 - RNA, 19 nt, Mycobacterium avium subsp. paratuberculosis
guccugcagcagccggacc

SEQ ID NO: 2858946 - RNA, 23 nt, Mycobacterium avium subsp. paratuberculosis
guccugcagcgccguccgcaccg

SEQ ID NO: 2858947 - RNA, 19 nt, Mycobacterium avium subsp. paratuberculosis
guccugcagcucgccggcg

SEQ ID NO: 2858948 - RNA, 15 nt, Mycobacterium avium subsp. paratuberculosis
guccugcaggcaggc

SEQ ID NO: 2858949 - RNA, 16 nt, Mycobacterium avium subsp. paratuberculosis
guccugcaggcaggcc

SEQ ID NO: 2858950 - RNA, 16 nt, Mycobacterium avium subsp. paratuberculosis
guccugccgggcgucg

SEQ ID NO: 2858951 - RNA, 12 nt, Mycobacterium avium subsp. paratuberculosis
guccugcgccgc

SEQ ID NO: 2858952 - RNA, 18 nt, Mycobacterium avium subsp. paratuberculosis
guccugcggcgacaacgc

SEQ ID NO: 2858953 - RNA, 17 nt, Mycobacterium avium subsp. paratuberculosis
gucgaacugcagccggc

SEQ ID NO: 2858954 - RNA, 18 nt, Mycobacterium avium subsp. paratuberculosis
gucgaacugcagccggcc

SEQ ID NO: 2858955 - RNA, 19 nt, Mycobacterium avium subsp. paratuberculosis
gucgaacugcagccggcca

SEQ ID NO: 2858956 - RNA, 17 nt, Mycobacterium avium subsp. paratuberculosis
gucgaacuggcgcaccg

SEQ ID NO: 2858957 - RNA, 19 nt, Mycobacterium avium subsp. paratuberculosis
gucgaacuggcgcaccggg

SEQ ID NO: 2858958 - RNA, 16 nt, Mycobacterium avium subsp. paratuberculosis
gucgaagaagcggccg

SEQ ID NO: 2858959 - RNA, 18 nt, Mycobacterium avium subsp. paratuberculosis
gucgaagaagcggccgac

SEQ ID NO: 2858960 - RNA, 19 nt, Mycobacterium avium subsp. paratuberculosis
gucgaagaaguaguucugc

SEQ ID NO: 2858961 - RNA, 19 nt, Mycobacterium avium subsp. paratuberculosis
gucgaagaccggugcgcgc

SEQ ID NO: 2858962 - RNA, 17 nt, Mycobacterium avium subsp. paratuberculosis
gucgaagacgguccgcu

SEQ ID NO: 2858963 - RNA, 17 nt, Mycobacterium avium subsp. paratuberculosis
gucgaagagcuggucgc

SEQ ID NO: 2858964 - RNA, 19 nt, Mycobacterium avium subsp. paratuberculosis
gucgaagaggugcucgacg

SEQ ID NO: 2858965 - RNA, 18 nt, Mycobacterium avium subsp. paratuberculosis
gucgaagaugaccugauc

SEQ ID NO: 2858966 - RNA, 17 nt, Mycobacterium avium subsp. paratuberculosis
gucgaagcccgccguca

SEQ ID NO: 2858967 - RNA, 14 nt, Mycobacterium avium subsp. paratuberculosis
gucgaagccgucca

SEQ ID NO: 2858968 - RNA, 17 nt, Mycobacterium avium subsp. paratuberculosis
gucgaagccguccaggc

SEQ ID NO: 2858969 - RNA, 17 nt, Mycobacterium avium subsp. paratuberculosis
gucgaagcugcgcagcc

SEQ ID NO: 2858970 - RNA, 16 nt, Mycobacterium avium subsp. paratuberculosis
gucgaaggaggccagc

SEQ ID NO: 2858971 - RNA, 23 nt, Mycobacterium avium subsp. paratuberculosis
gucgaaggaggccagcugcaccg

SEQ ID NO: 2858972 - RNA, 14 nt, Mycobacterium avium subsp. paratuberculosis
gucgaaggccccgg

SEQ ID NO: 2858973 - RNA, 18 nt, Mycobacterium avium subsp. paratuberculosis
gucgaaggccgggcuggu

SEQ ID NO: 2858974 - RNA, 16 nt, Mycobacterium avium subsp. paratuberculosis
gucgaaggcggccgcg

SEQ ID NO: 2858975 - RNA, 23 nt, Mycobacterium avium subsp. paratuberculosis
gucgaagggcaucgggucguaga

SEQ ID NO: 2858976 - RNA, 22 nt, Mycobacterium avium subsp. paratuberculosis
gucgaaggugaucuuguuguug

SEQ ID NO: 2858977 - RNA, 23 nt, Mycobacterium avium subsp. paratuberculosis
gucgaaggugaucuuguuguugg

SEQ ID NO: 2858978 - RNA, 15 nt, Mycobacterium avium subsp. paratuberculosis
gucgaaguacgccgu

SEQ ID NO: 2858979 - RNA, 17 nt, Mycobacterium avium subsp. paratuberculosis
gucgaaguagggccgca

SEQ ID NO: 2858980 - RNA, 20 nt, Mycobacterium avium subsp. paratuberculosis
gucgaaguccugcgccgcgg

SEQ ID NO: 2858981 - RNA, 22 nt, Mycobacterium avium subsp. paratuberculosis
gucgaaguccugcgccgcggug

SEQ ID NO: 2858982 - RNA, 18 nt, Mycobacterium avium subsp. paratuberculosis
gucgaaguucggcaucuc

SEQ ID NO: 2858983 - RNA, 18 nt, Mycobacterium avium subsp. paratuberculosis
gucgacaccccgcucggc

SEQ ID NO: 2858984 - RNA, 19 nt, Mycobacterium avium subsp. paratuberculosis
gucgacaccccgcucggcc

SEQ ID NO: 2858985 - RNA, 14 nt, Mycobacterium avium subsp. paratuberculosis
gucgacacccgggc

SEQ ID NO: 2858986 - RNA, 16 nt, Mycobacterium avium subsp. paratuberculosis
gucgacacgccggccg

SEQ ID NO: 2858987 - RNA, 17 nt, Mycobacterium avium subsp. paratuberculosis
gucgacacgccggccgu

SEQ ID NO: 2858988 - RNA, 16 nt, Mycobacterium avium subsp. paratuberculosis
gucgacagccggucgc

SEQ ID NO: 2858989 - RNA, 17 nt, Mycobacterium avium subsp. paratuberculosis
gucgacagccggucgcg

SEQ ID NO: 2858990 - RNA, 21 nt, Mycobacterium avium subsp. paratuberculosis
gucgacagccggucgcgcauc

SEQ ID NO: 2858991 - RNA, 13 nt, Mycobacterium avium subsp. paratuberculosis
gucgacagccuga

SEQ ID NO: 2858992 - RNA, 22 nt, Mycobacterium avium subsp. paratuberculosis
gucgacagccugaccgcgggug

SEQ ID NO: 2858993 - RNA, 14 nt, Mycobacterium avium subsp. paratuberculosis
gucgaccaccacga

SEQ ID NO: 2858994 - RNA, 19 nt, Mycobacterium avium subsp. paratuberculosis
gucgaccaccacgaccagu

SEQ ID NO: 2858995 - RNA, 17 nt, Mycobacterium avium subsp. paratuberculosis
gucgaccacccgcagcu

SEQ ID NO: 2858996 - RNA, 18 nt, Mycobacterium avium subsp. paratuberculosis
gucgaccacccgcagcuc

SEQ ID NO: 2858997 - RNA, 16 nt, Mycobacterium avium subsp. paratuberculosis
gucgaccaccgccggc

SEQ ID NO: 2858998 - RNA, 17 nt, Mycobacterium avium subsp. paratuberculosis
gucgaccaccgccggcc

SEQ ID NO: 2858999 - RNA, 21 nt, Mycobacterium avium subsp. paratuberculosis
gucgaccaccgccggcccggc

SEQ ID NO: 2859000 - RNA, 16 nt, Mycobacterium avium subsp. paratuberculosis
gucgaccagccgcauc

SEQ ID NO: 2859001 - RNA, 15 nt, Mycobacterium avium subsp. paratuberculosis
gucgaccagcgggcu

SEQ ID NO: 2859002 - RNA, 22 nt, Mycobacterium avium subsp. paratuberculosis
gucgaccagcgggcugucggcg

SEQ ID NO: 2859003 - RNA, 19 nt, Mycobacterium avium subsp. paratuberculosis
gucgaccaggacgucggcc

SEQ ID NO: 2859004 - RNA, 23 nt, Mycobacterium avium subsp. paratuberculosis
gucgaccaggacgucggccggcu

SEQ ID NO: 2859005 - RNA, 22 nt, Mycobacterium avium subsp. paratuberculosis
gucgaccagggcgaucaccgcg

SEQ ID NO: 2859006 - RNA, 15 nt, Mycobacterium avium subsp. paratuberculosis
gucgaccagguaggc

SEQ ID NO: 2859007 - RNA, 17 nt, Mycobacterium avium subsp. paratuberculosis
gucgaccagguaggcgc

SEQ ID NO: 2859008 - RNA, 15 nt, Mycobacterium avium subsp. paratuberculosis
gucgaccaucugccg

SEQ ID NO: 2859009 - RNA, 14 nt, Mycobacterium avium subsp. paratuberculosis
gucgacccaggucg

SEQ ID NO: 2859010 - RNA, 20 nt, Mycobacterium avium subsp. paratuberculosis
gucgacccaggucgaguuca

SEQ ID NO: 2859011 - RNA, 20 nt, Mycobacterium avium subsp. paratuberculosis
gucgaccccgccggcccggu

SEQ ID NO: 2859012 - RNA, 13 nt, Mycobacterium avium subsp. paratuberculosis
gucgacccgccgc

SEQ ID NO: 2859013 - RNA, 14 nt, Mycobacterium avium subsp. paratuberculosis
gucgacccgccgca

SEQ ID NO: 2859014 - RNA, 15 nt, Mycobacterium avium subsp. paratuberculosis
gucgacccgccgcag

SEQ ID NO: 2859015 - RNA, 17 nt, Mycobacterium avium subsp. paratuberculosis
gucgacccgccgcagcc

SEQ ID NO: 2859016 - RNA, 15 nt, Mycobacterium avium subsp. paratuberculosis
gucgacccgcggcgc

SEQ ID NO: 2859017 - RNA, 17 nt, Mycobacterium avium subsp. paratuberculosis
gucgacccgcggcgccg

SEQ ID NO: 2859018 - RNA, 14 nt, Mycobacterium avium subsp. paratuberculosis
gucgacccggccgc

SEQ ID NO: 2859019 - RNA, 19 nt, Mycobacterium avium subsp. paratuberculosis
gucgacccguuccccggcc

SEQ ID NO: 2859020 - RNA, 13 nt, Mycobacterium avium subsp. paratuberculosis
gucgaccgccacc

SEQ ID NO: 2859021 - RNA, 14 nt, Mycobacterium avium subsp. paratuberculosis
gucgaccgccgcga

SEQ ID NO: 2859022 - RNA, 12 nt, Mycobacterium avium subsp. paratuberculosis
gucgaccgcgac

SEQ ID NO: 2859023 - RNA, 13 nt, Mycobacterium avium subsp. paratuberculosis
gucgaccgcgcac

SEQ ID NO: 2859024 - RNA, 14 nt, Mycobacterium avium subsp. paratuberculosis
gucgaccgcgcacc

SEQ ID NO: 2859025 - RNA, 15 nt, Mycobacterium avium subsp. paratuberculosis
gucgaccgcgcaccg

SEQ ID NO: 2859026 - RNA, 18 nt, Mycobacterium avium subsp. paratuberculosis
gucgaccgcgcaccggcg

SEQ ID NO: 2859027 - RNA, 19 nt, Mycobacterium avium subsp. paratuberculosis
gucgaccgcgcaccggcgc

SEQ ID NO: 2859028 - RNA, 12 nt, Mycobacterium avium subsp. paratuberculosis
gucgaccgcggc

SEQ ID NO: 2859029 - RNA, 15 nt, Mycobacterium avium subsp. paratuberculosis
gucgaccgcggccug

SEQ ID NO: 2859030 - RNA, 20 nt, Mycobacterium avium subsp. paratuberculosis
gucgaccgcggcuccggccg

SEQ ID NO: 2859031 - RNA, 21 nt, Mycobacterium avium subsp. paratuberculosis
gucgaccgcggcuccggccgc

SEQ ID NO: 2859032 - RNA, 22 nt, Mycobacterium avium subsp. paratuberculosis
gucgaccgggaucguguggccg

SEQ ID NO: 2859033 - RNA, 16 nt, Mycobacterium avium subsp. paratuberculosis
gucgaccggggcgccc

SEQ ID NO: 2859034 - RNA, 18 nt, Mycobacterium avium subsp. paratuberculosis
gucgaccggggcgccccg

SEQ ID NO: 2859035 - RNA, 20 nt, Mycobacterium avium subsp. paratuberculosis
gucgaccggggcgccccgcu

SEQ ID NO: 2859036 - RNA, 17 nt, Mycobacterium avium subsp. paratuberculosis
gucgaccgucacgcugg

SEQ ID NO: 2859037 - RNA, 18 nt, Mycobacterium avium subsp. paratuberculosis
gucgaccgucacgcuggc

SEQ ID NO: 2859038 - RNA, 15 nt, Mycobacterium avium subsp. paratuberculosis
gucgacguccucgcc

SEQ ID NO: 2859039 - RNA, 20 nt, Mycobacterium avium subsp. paratuberculosis
gucgacguccucgcccgggu

SEQ ID NO: 2859040 - RNA, 14 nt, Mycobacterium avium subsp. paratuberculosis
gucgacgucgagaa

SEQ ID NO: 2859041 - RNA, 20 nt, Mycobacterium avium subsp. paratuberculosis
gucgacgucgagggcgccgu

SEQ ID NO: 2859042 - RNA, 22 nt, Mycobacterium avium subsp. paratuberculosis
gucgacgucgguggugacgguu

SEQ ID NO: 2859043 - RNA, 14 nt, Mycobacterium avium subsp. paratuberculosis
gucgacgucgucga

SEQ ID NO: 2859044 - RNA, 16 nt, Mycobacterium avium subsp. paratuberculosis
gucgacgucgucgacc

SEQ ID NO: 2859045 - RNA, 16 nt, Mycobacterium avium subsp. paratuberculosis
gucgacgugcgcggcg

SEQ ID NO: 2859046 - RNA, 16 nt, Mycobacterium avium subsp. paratuberculosis
gucgacgugcucggcg

SEQ ID NO: 2859047 - RNA, 20 nt, Mycobacterium avium subsp. paratuberculosis
gucgacgugcucggcggccg

SEQ ID NO: 2859048 - RNA, 19 nt, Mycobacterium avium subsp. paratuberculosis
gucgacgugggcggccacc

SEQ ID NO: 2859049 - RNA, 17 nt, Mycobacterium avium subsp. paratuberculosis
gucgacguggugcaccg

SEQ ID NO: 2859050 - RNA, 21 nt, Mycobacterium avium subsp. paratuberculosis
gucgacguggugcaccgccag

SEQ ID NO: 2859051 - RNA, 19 nt, Mycobacterium avium subsp. paratuberculosis
gucgacguucgccgccagc

SEQ ID NO: 2859052 - RNA, 20 nt, Mycobacterium avium subsp. paratuberculosis
gucgacguucgccgccagca

SEQ ID NO: 2859053 - RNA, 18 nt, Mycobacterium avium subsp. paratuberculosis
gucgacucggcggugccg

SEQ ID NO: 2859054 - RNA, 18 nt, Mycobacterium avium subsp. paratuberculosis
gucgacugaucgacgagc

SEQ ID NO: 2859055 - RNA, 13 nt, Mycobacterium avium subsp. paratuberculosis
gucgacugcaccg

SEQ ID NO: 2859056 - RNA, 14 nt, Mycobacterium avium subsp. paratuberculosis
gucgacugcaccga

SEQ ID NO: 2859057 - RNA, 16 nt, Mycobacterium avium subsp. paratuberculosis
gucgacugggccaggu

SEQ ID NO: 2859058 - RNA, 21 nt, Mycobacterium avium subsp. paratuberculosis
gucgacuucccaguccggcca

SEQ ID NO: 2859059 - RNA, 17 nt, Mycobacterium avium subsp. paratuberculosis
gucgagaaaagcggcga

SEQ ID NO: 2859060 - RNA, 16 nt, Mycobacterium avium subsp. paratuberculosis
gucgagaaacgcgcgc

SEQ ID NO: 2859061 - RNA, 23 nt, Mycobacterium avium subsp. paratuberculosis
gucgagaaaggccagcacgcagg

SEQ ID NO: 2859062 - RNA, 18 nt, Mycobacterium avium subsp. paratuberculosis
gucgagacaccgucgcgc

SEQ ID NO: 2859063 - RNA, 21 nt, Mycobacterium avium subsp. paratuberculosis
gucgagacaccgucgcgcacc

SEQ ID NO: 2859064 - RNA, 16 nt, Mycobacterium avium subsp. paratuberculosis
gucgagaucagcaccg

SEQ ID NO: 2859065 - RNA, 17 nt, Mycobacterium avium subsp. paratuberculosis
gucgagaucagcaccgg

SEQ ID NO: 2859066 - RNA, 21 nt, Mycobacterium avium subsp. paratuberculosis
gucgagaucagcaccggguga

SEQ ID NO: 2859067 - RNA, 20 nt, Mycobacterium avium subsp. paratuberculosis
gucgagaugaccgucguugc

SEQ ID NO: 2859068 - RNA, 15 nt, Mycobacterium avium subsp. paratuberculosis
gucgagcaccacccg

SEQ ID NO: 2859069 - RNA, 23 nt, Mycobacterium avium subsp. paratuberculosis
gucgagcaccacccggguguugg

SEQ ID NO: 2859070 - RNA, 20 nt, Mycobacterium avium subsp. paratuberculosis
gucgagcaccaggucguugc

SEQ ID NO: 2859071 - RNA, 16 nt, Mycobacterium avium subsp. paratuberculosis
gucgagcaccgcgacc

SEQ ID NO: 2859072 - RNA, 23 nt, Mycobacterium avium subsp. paratuberculosis
gucgagcaccgcgaccacgccgc

SEQ ID NO: 2859073 - RNA, 17 nt, Mycobacterium avium subsp. paratuberculosis
gucgagcaccgcgauca

SEQ ID NO: 2859074 - RNA, 18 nt, Mycobacterium avium subsp. paratuberculosis
gucgagcaccgcgaucac

SEQ ID NO: 2859075 - RNA, 15 nt, Mycobacterium avium subsp. paratuberculosis
gucgagcaccgcguc

SEQ ID NO: 2859076 - RNA, 16 nt, Mycobacterium avium subsp. paratuberculosis
gucgagcaccgcgucc

SEQ ID NO: 2859077 - RNA, 22 nt, Mycobacterium avium subsp. paratuberculosis
gucgagcaccgcguccgcgucg

SEQ ID NO: 2859078 - RNA, 13 nt, Mycobacterium avium subsp. paratuberculosis
gucgagcaccggc

SEQ ID NO: 2859079 - RNA, 16 nt, Mycobacterium avium subsp. paratuberculosis
gucgagcaccggcagc

SEQ ID NO: 2859080 - RNA, 17 nt, Mycobacterium avium subsp. paratuberculosis
gucgagcaccggcagcc

SEQ ID NO: 2859081 - RNA, 22 nt, Mycobacterium avium subsp. paratuberculosis
gucgagcaccggcuggugcagc

SEQ ID NO: 2859082 - RNA, 12 nt, Mycobacterium avium subsp. paratuberculosis
gucgagcaccug

SEQ ID NO: 2859083 - RNA, 20 nt, Mycobacterium avium subsp. paratuberculosis
gucgagcacgucgacgccgg

SEQ ID NO: 2859084 - RNA, 17 nt, Mycobacterium avium subsp. paratuberculosis
gucgagcagcaccaccc

SEQ ID NO: 2859085 - RNA, 21 nt, Mycobacterium avium subsp. paratuberculosis
gucgagcagcaccacccgcac

SEQ ID NO: 2859086 - RNA, 13 nt, Mycobacterium avium subsp. paratuberculosis
gucgagcagcagc

SEQ ID NO: 2859087 - RNA, 14 nt, Mycobacterium avium subsp. paratuberculosis
gucgagcagcagcc

SEQ ID NO: 2859088 - RNA, 17 nt, Mycobacterium avium subsp. paratuberculosis
gucgagcagcagccgcc

SEQ ID NO: 2859089 - RNA, 15 nt, Mycobacterium avium subsp. paratuberculosis
gucgagcagcgcccg

SEQ ID NO: 2859090 - RNA, 17 nt, Mycobacterium avium subsp. paratuberculosis
gucgagcagcgcccggc

SEQ ID NO: 2859091 - RNA, 18 nt, Mycobacterium avium subsp. paratuberculosis
gucgagcagcgcccggcg

SEQ ID NO: 2859092 - RNA, 20 nt, Mycobacterium avium subsp. paratuberculosis
gucgagcagcgcccggcgau

SEQ ID NO: 2859093 - RNA, 15 nt, Mycobacterium avium subsp. paratuberculosis
gucgagcaguugcgc

SEQ ID NO: 2859094 - RNA, 16 nt, Mycobacterium avium subsp. paratuberculosis
gucgagcauccggcgc

SEQ ID NO: 2859095 - RNA, 18 nt, Mycobacterium avium subsp. paratuberculosis
gucgagcauccggcgcac

SEQ ID NO: 2859096 - RNA, 22 nt, Mycobacterium avium subsp. paratuberculosis
gucgagcauccggcgcacggcg

SEQ ID NO: 2859097 - RNA, 18 nt, Mycobacterium avium subsp. paratuberculosis
gucgagcaugcguccggu

SEQ ID NO: 2859098 - RNA, 15 nt, Mycobacterium avium subsp. paratuberculosis
gucgagccaccacug

SEQ ID NO: 2859099 - RNA, 17 nt, Mycobacterium avium subsp. paratuberculosis
gucgagccaccacugcg

SEQ ID NO: 2859100 - RNA, 16 nt, Mycobacterium avium subsp. paratuberculosis
gucgagccagcgggcc

SEQ ID NO: 2859101 - RNA, 20 nt, Mycobacterium avium subsp. paratuberculosis
gucgagccgcagucgaucac

SEQ ID NO: 2859102 - RNA, 16 nt, Mycobacterium avium subsp. paratuberculosis
gucgagccgcucgcgc

SEQ ID NO: 2859103 - RNA, 12 nt, Mycobacterium avium subsp. paratuberculosis
gucgagccggcc

SEQ ID NO: 2859104 - RNA, 21 nt, Mycobacterium avium subsp. paratuberculosis
gucgagccggccggacaccga

SEQ ID NO: 2859105 - RNA, 13 nt, Mycobacterium avium subsp. paratuberculosis
gucgagccgggcc

SEQ ID NO: 2859106 - RNA, 22 nt, Mycobacterium avium subsp. paratuberculosis
gucgagccgggcccggguggcg

SEQ ID NO: 2859107 - RNA, 15 nt, Mycobacterium avium subsp. paratuberculosis
gucgagccggugccg

SEQ ID NO: 2859108 - RNA, 18 nt, Mycobacterium avium subsp. paratuberculosis
gucgagccggugccgagg

SEQ ID NO: 2859109 - RNA, 19 nt, Mycobacterium avium subsp. paratuberculosis
gucgagccggugccgaggc

SEQ ID NO: 2859110 - RNA, 14 nt, Mycobacterium avium subsp. paratuberculosis
gucgagccuggcgc

SEQ ID NO: 2859111 - RNA, 13 nt, Mycobacterium avium subsp. paratuberculosis
gucgagcgcgccg

SEQ ID NO: 2859112 - RNA, 14 nt, Mycobacterium avium subsp. paratuberculosis
gucgagcgcgccga

SEQ ID NO: 2859113 - RNA, 13 nt, Mycobacterium avium subsp. paratuberculosis
gucgagcgcggcc

SEQ ID NO: 2859114 - RNA, 14 nt, Mycobacterium avium subsp. paratuberculosis
gucgagcgcucgcg

SEQ ID NO: 2859115 - RNA, 20 nt, Mycobacterium avium subsp. paratuberculosis
gucgagcggcccgcaccgau

SEQ ID NO: 2859116 - RNA, 14 nt, Mycobacterium avium subsp. paratuberculosis
gucgagcggcccgu

SEQ ID NO: 2859117 - RNA, 19 nt, Mycobacterium avium subsp. paratuberculosis
gucgagcggcccgucgccg

SEQ ID NO: 2859118 - RNA, 20 nt, Mycobacterium avium subsp. paratuberculosis
gucgagcggcccgucgccga

SEQ ID NO: 2859119 - RNA, 16 nt, Mycobacterium avium subsp. paratuberculosis
gucgagcggcuugccg

SEQ ID NO: 2859120 - RNA, 17 nt, Mycobacterium avium subsp. paratuberculosis
gucgagcgucacgccgc

SEQ ID NO: 2859121 - RNA, 18 nt, Mycobacterium avium subsp. paratuberculosis
gucgagcgucacgccgcg

SEQ ID NO: 2859122 - RNA, 22 nt, Mycobacterium avium subsp. paratuberculosis
gucgagcgucacgccgcgcccg

SEQ ID NO: 2859123 - RNA, 17 nt, Mycobacterium avium subsp. paratuberculosis
gucgaugcccgcgccga

SEQ ID NO: 2859124 - RNA, 18 nt, Mycobacterium avium subsp. paratuberculosis
gucgaugcccgcgccgac

SEQ ID NO: 2859125 - RNA, 22 nt, Mycobacterium avium subsp. paratuberculosis
gucgaugcccgcgccgaccagc

SEQ ID NO: 2859126 - RNA, 19 nt, Mycobacterium avium subsp. paratuberculosis
gucgaugcccuagcggugg

SEQ ID NO: 2859127 - RNA, 14 nt, Mycobacterium avium subsp. paratuberculosis
gucgaugccgagcc

SEQ ID NO: 2859128 - RNA, 17 nt, Mycobacterium avium subsp. paratuberculosis
gucgaugccgagccggc

SEQ ID NO: 2859129 - RNA, 20 nt, Mycobacterium avium subsp. paratuberculosis
gucgaugccgaucggggcgc

SEQ ID NO: 2859130 - RNA, 19 nt, Mycobacterium avium subsp. paratuberculosis
gucgaugccggccagcggc

SEQ ID NO: 2859131 - RNA, 19 nt, Mycobacterium avium subsp. paratuberculosis
gucgaugcgcagcagcggc

SEQ ID NO: 2859132 - RNA, 15 nt, Mycobacterium avium subsp. paratuberculosis
gucgaugcgcgccac

SEQ ID NO: 2859133 - RNA, 18 nt, Mycobacterium avium subsp. paratuberculosis
gucgaugcgcgccaccag

SEQ ID NO: 2859134 - RNA, 22 nt, Mycobacterium avium subsp. paratuberculosis
gucgaugcggaucucggugccg

SEQ ID NO: 2859135 - RNA, 16 nt, Mycobacterium avium subsp. paratuberculosis
gucgaugcgggcccgc

SEQ ID NO: 2859136 - RNA, 16 nt, Mycobacterium avium subsp. paratuberculosis
gucgauggacagggcg

SEQ ID NO: 2859137 - RNA, 17 nt, Mycobacterium avium subsp. paratuberculosis
gucgauggacagggcga

SEQ ID NO: 2859138 - RNA, 15 nt, Mycobacterium avium subsp. paratuberculosis
gucgauggccaccag

SEQ ID NO: 2859139 - RNA, 18 nt, Mycobacterium avium subsp. paratuberculosis
gucgauggccaccagguc

SEQ ID NO: 2859140 - RNA, 17 nt, Mycobacterium avium subsp. paratuberculosis
gucgauggccucgucgc

SEQ ID NO: 2859141 - RNA, 19 nt, Mycobacterium avium subsp. paratuberculosis
gucgauggcgcggcccagu

SEQ ID NO: 2859142 - RNA, 20 nt, Mycobacterium avium subsp. paratuberculosis
gucgauggucugcccgccgc

SEQ ID NO: 2859143 - RNA, 17 nt, Mycobacterium avium subsp. paratuberculosis
gucgauguaguucugca

SEQ ID NO: 2859144 - RNA, 20 nt, Mycobacterium avium subsp. paratuberculosis
gucgauguaguucugcacgu

SEQ ID NO: 2859145 - RNA, 17 nt, Mycobacterium avium subsp. paratuberculosis
gucgaugucgacgccgu

SEQ ID NO: 2859146 - RNA, 19 nt, Mycobacterium avium subsp. paratuberculosis
gucgaugucgacgccgugc

SEQ ID NO: 2859147 - RNA, 23 nt, Mycobacterium avium subsp. paratuberculosis
gucgaugucggcgaaccagggca

SEQ ID NO: 2859148 - RNA, 16 nt, Mycobacterium avium subsp. paratuberculosis
gucgaugucggcggcc

SEQ ID NO: 2859149 - RNA, 19 nt, Mycobacterium avium subsp. paratuberculosis
gucgaugucggcggcccgg

SEQ ID NO: 2859150 - RNA, 19 nt, Mycobacterium avium subsp. paratuberculosis
gucgaugucgguggcgcgc

SEQ ID NO: 2859151 - RNA, 15 nt, Mycobacterium avium subsp. paratuberculosis
gucgaugucgucguc

SEQ ID NO: 2859152 - RNA, 19 nt, Mycobacterium avium subsp. paratuberculosis
gucgaugucgucgucgacg

SEQ ID NO: 2859153 - RNA, 22 nt, Mycobacterium avium subsp. paratuberculosis
gucgaugucgucgucgacgcug

SEQ ID NO: 2859154 - RNA, 19 nt, Mycobacterium avium subsp. paratuberculosis
gucgauugccgcggccgcg

SEQ ID NO: 2859155 - RNA, 13 nt, Mycobacterium avium subsp. paratuberculosis
gucgcaaagacau

SEQ ID NO: 2859156 - RNA, 16 nt, Mycobacterium avium subsp. paratuberculosis
gucgcacaaccgggcc

SEQ ID NO: 2859157 - RNA, 17 nt, Mycobacterium avium subsp. paratuberculosis
gucgcacaaccgggcca

SEQ ID NO: 2859158 - RNA, 15 nt, Mycobacterium avium subsp. paratuberculosis
gucgcacaccagcac

SEQ ID NO: 2859159 - RNA, 17 nt, Mycobacterium avium subsp. paratuberculosis
gucgcacaccagcacgg

SEQ ID NO: 2859160 - RNA, 22 nt, Mycobacterium avium subsp. paratuberculosis
gucgcacaccagcacggcggcg

SEQ ID NO: 2859161 - RNA, 16 nt, Mycobacterium avium subsp. paratuberculosis
gucgcacagcaugucc

SEQ ID NO: 2859162 - RNA, 20 nt, Mycobacterium avium subsp. paratuberculosis
gucgcacagcauguccucgg

SEQ ID NO: 2859163 - RNA, 13 nt, Mycobacterium avium subsp. paratuberculosis
gucgcaccgcggc

SEQ ID NO: 2859164 - RNA, 16 nt, Mycobacterium avium subsp. paratuberculosis
gucgcaccgcggcgug

SEQ ID NO: 2859165 - RNA, 17 nt, Mycobacterium avium subsp. paratuberculosis
gucgcaccgcggcgugg

SEQ ID NO: 2859166 - RNA, 16 nt, Mycobacterium avium subsp. paratuberculosis
gucgcaccggcaguga

SEQ ID NO: 2859167 - RNA, 13 nt, Mycobacterium avium subsp. paratuberculosis
gucgcacgccggu

SEQ ID NO: 2859168 - RNA, 17 nt, Mycobacterium avium subsp. paratuberculosis
gucgcacgccgguagcc

SEQ ID NO: 2859169 - RNA, 16 nt, Mycobacterium avium subsp. paratuberculosis
gucgcacuagguccgg

SEQ ID NO: 2859170 - RNA, 21 nt, Mycobacterium avium subsp. paratuberculosis
gucgcacugcuucgggucgcc

SEQ ID NO: 2859171 - RNA, 18 nt, Mycobacterium avium subsp. paratuberculosis
gucgcagaucccgccggc

SEQ ID NO: 2859172 - RNA, 21 nt, Mycobacterium avium subsp. paratuberculosis
gucgcagaucccgccggcggc

SEQ ID NO: 2859173 - RNA, 15 nt, Mycobacterium avium subsp. paratuberculosis
gucgcagcagcagcc

SEQ ID NO: 2859174 - RNA, 16 nt, Mycobacterium avium subsp. paratuberculosis
gucgcagcagcagccc

SEQ ID NO: 2859175 - RNA, 12 nt, Mycobacterium avium subsp. paratuberculosis
gucgcagcccgg

SEQ ID NO: 2859176 - RNA, 13 nt, Mycobacterium avium subsp. paratuberculosis
gucgcagcccggg

SEQ ID NO: 2859177 - RNA, 15 nt, Mycobacterium avium subsp. paratuberculosis
gucgcaggcagcagc

SEQ ID NO: 2859178 - RNA, 14 nt, Mycobacterium avium subsp. paratuberculosis
gucgcaggccgccc

SEQ ID NO: 2859179 - RNA, 15 nt, Mycobacterium avium subsp. paratuberculosis
gucgcaggccgcccg

SEQ ID NO: 2859180 - RNA, 18 nt, Mycobacterium avium subsp. paratuberculosis
gucgcaggccgcccggcc

SEQ ID NO: 2859181 - RNA, 15 nt, Mycobacterium avium subsp. paratuberculosis
gucgcagugccggug

SEQ ID NO: 2859182 - RNA, 18 nt, Mycobacterium avium subsp. paratuberculosis
gucgcaucagcucggcag

SEQ ID NO: 2859183 - RNA, 20 nt, Mycobacterium avium subsp. paratuberculosis
gucgccaaggucgucaacga

SEQ ID NO: 2859184 - RNA, 16 nt, Mycobacterium avium subsp. paratuberculosis
gucgccaauccggcgg

SEQ ID NO: 2859185 - RNA, 19 nt, Mycobacterium avium subsp. paratuberculosis
gucgccaauccggcgggcc

SEQ ID NO: 2859186 - RNA, 15 nt, Mycobacterium avium subsp. paratuberculosis
gucgccaccaccacg

SEQ ID NO: 2859187 - RNA, 17 nt, Mycobacterium avium subsp. paratuberculosis
gucgccaccaccacggg

SEQ ID NO: 2859188 - RNA, 16 nt, Mycobacterium avium subsp. paratuberculosis
gucgccaccaccagcg

SEQ ID NO: 2859189 - RNA, 17 nt, Mycobacterium avium subsp. paratuberculosis
gucgccaccaccagcgg

SEQ ID NO: 2859190 - RNA, 18 nt, Mycobacterium avium subsp. paratuberculosis
gucgccaccaccagcggg

SEQ ID NO: 2859191 - RNA, 21 nt, Mycobacterium avium subsp. paratuberculosis
gucgccaccaccagcgggcug

SEQ ID NO: 2859192 - RNA, 17 nt, Mycobacterium avium subsp. paratuberculosis
gucgccaccaccgcgcc

SEQ ID NO: 2859193 - RNA, 19 nt, Mycobacterium avium subsp. paratuberculosis
gucgccaccaccgcgccgu

SEQ ID NO: 2859194 - RNA, 14 nt, Mycobacterium avium subsp. paratuberculosis
gucgccaccacggc

SEQ ID NO: 2859195 - RNA, 15 nt, Mycobacterium avium subsp. paratuberculosis
gucgccaccacggcg

SEQ ID NO: 2859196 - RNA, 16 nt, Mycobacterium avium subsp. paratuberculosis
gucgccaccacggcgc

SEQ ID NO: 2859197 - RNA, 15 nt, Mycobacterium avium subsp. paratuberculosis
gucgccaccagaccg

SEQ ID NO: 2859198 - RNA, 20 nt, Mycobacterium avium subsp. paratuberculosis
gucgccaccagaccggcgaa

SEQ ID NO: 2859199 - RNA, 23 nt, Mycobacterium avium subsp. paratuberculosis
gucgccaccagaccggcgaagcu

SEQ ID NO: 2859200 - RNA, 20 nt, Mycobacterium avium subsp. paratuberculosis
gucgccaccgaugcgggcca

SEQ ID NO: 2859201 - RNA, 15 nt, Mycobacterium avium subsp. paratuberculosis
gucgccacgaucacc

SEQ ID NO: 2859202 - RNA, 15 nt, Mycobacterium avium subsp. paratuberculosis
gucgccacggccggc

SEQ ID NO: 2859203 - RNA, 18 nt, Mycobacterium avium subsp. paratuberculosis
gucgccacggccggcagc

SEQ ID NO: 2859204 - RNA, 15 nt, Mycobacterium avium subsp. paratuberculosis
gucgccacucgggcg

SEQ ID NO: 2859205 - RNA, 16 nt, Mycobacterium avium subsp. paratuberculosis
gucgccagcaccaccu

SEQ ID NO: 2859206 - RNA, 21 nt, Mycobacterium avium subsp. paratuberculosis
gucgccagcaccaccucgcgc

SEQ ID NO: 2859207 - RNA, 13 nt, Mycobacterium avium subsp. paratuberculosis
gucgccagcaccg

SEQ ID NO: 2859208 - RNA, 23 nt, Mycobacterium avium subsp. paratuberculosis
gucgccgauccagccgucguugc

SEQ ID NO: 2859209 - RNA, 23 nt, Mycobacterium avium subsp. paratuberculosis
gucgccgaucgcccgguaggccg

SEQ ID NO: 2859210 - RNA, 16 nt, Mycobacterium avium subsp. paratuberculosis
gucgccgaucucggcc

SEQ ID NO: 2859211 - RNA, 20 nt, Mycobacterium avium subsp. paratuberculosis
gucgccgaucucggccaacc

SEQ ID NO: 2859212 - RNA, 16 nt, Mycobacterium avium subsp. paratuberculosis
gucgccgaugcgccgc

SEQ ID NO: 2859213 - RNA, 17 nt, Mycobacterium avium subsp. paratuberculosis
gucgccgaugcgccgca

SEQ ID NO: 2859214 - RNA, 21 nt, Mycobacterium avium subsp. paratuberculosis
gucgccgauggagaccucuuc

SEQ ID NO: 2859215 - RNA, 21 nt, Mycobacterium avium subsp. paratuberculosis
gucgccgauguaguccagccc

SEQ ID NO: 2859216 - RNA, 22 nt, Mycobacterium avium subsp. paratuberculosis
gucgccgauguaguccagccca

SEQ ID NO: 2859217 - RNA, 14 nt, Mycobacterium avium subsp. paratuberculosis
gucgccgcacgccc

SEQ ID NO: 2859218 - RNA, 13 nt, Mycobacterium avium subsp. paratuberculosis
gucgccgcagauc

SEQ ID NO: 2859219 - RNA, 14 nt, Mycobacterium avium subsp. paratuberculosis
gucgccgcccacgc

SEQ ID NO: 2859220 - RNA, 16 nt, Mycobacterium avium subsp. paratuberculosis
gucgccgcccacgccg

SEQ ID NO: 2859221 - RNA, 15 nt, Mycobacterium avium subsp. paratuberculosis
gucgccgccccgagu

SEQ ID NO: 2859222 - RNA, 15 nt, Mycobacterium avium subsp. paratuberculosis
gucgccgcccgggcc

SEQ ID NO: 2859223 - RNA, 14 nt, Mycobacterium avium subsp. paratuberculosis
gucgccgccgcgca

SEQ ID NO: 2859224 - RNA, 13 nt, Mycobacterium avium subsp. paratuberculosis
gucgccgccggug

SEQ ID NO: 2859225 - RNA, 21 nt, Mycobacterium avium subsp. paratuberculosis
gucgccgccggugccgacgau

SEQ ID NO: 2859226 - RNA, 22 nt, Mycobacterium avium subsp. paratuberculosis
gucgccgccggugccgacgaug

SEQ ID NO: 2859227 - RNA, 12 nt, Mycobacterium avium subsp. paratuberculosis
gucgccgccgug

SEQ ID NO: 2859228 - RNA, 13 nt, Mycobacterium avium subsp. paratuberculosis
gucgccgcgcaga

SEQ ID NO: 2859229 - RNA, 14 nt, Mycobacterium avium subsp. paratuberculosis
gucgccgcgcagca

SEQ ID NO: 2859230 - RNA, 17 nt, Mycobacterium avium subsp. paratuberculosis
gucgccgcgcagcaccg

SEQ ID NO: 2859231 - RNA, 13 nt, Mycobacterium avium subsp. paratuberculosis
gucgccgcgcccg

SEQ ID NO: 2859232 - RNA, 17 nt, Mycobacterium avium subsp. paratuberculosis
gucgccgcgcccgccgg

SEQ ID NO: 2859233 - RNA, 16 nt, Mycobacterium avium subsp. paratuberculosis
gucgccgcgccgccgg

SEQ ID NO: 2859234 - RNA, 14 nt, Mycobacterium avium subsp. paratuberculosis
gucgccgcugguga

SEQ ID NO: 2859235 - RNA, 23 nt, Mycobacterium avium subsp. paratuberculosis
gucgccgcuggugaacucgccga

SEQ ID NO: 2859236 - RNA, 18 nt, Mycobacterium avium subsp. paratuberculosis
gucgccggacucgaucgc

SEQ ID NO: 2859237 - RNA, 14 nt, Mycobacterium avium subsp. paratuberculosis
gucgccggccaggc

SEQ ID NO: 2859238 - RNA, 19 nt, Mycobacterium avium subsp. paratuberculosis
gucgccggccaggccggcc

SEQ ID NO: 2859239 - RNA, 12 nt, Mycobacterium avium subsp. paratuberculosis
gucgccggccgc

SEQ ID NO: 2859240 - RNA, 14 nt, Mycobacterium avium subsp. paratuberculosis
gucgccggccgcca

SEQ ID NO: 2859241 - RNA, 15 nt, Mycobacterium avium subsp. paratuberculosis
gucgccggccgccag

SEQ ID NO: 2859242 - RNA, 20 nt, Mycobacterium avium subsp. paratuberculosis
gucgccggccgccagcgccc

SEQ ID NO: 2859243 - RNA, 14 nt, Mycobacterium avium subsp. paratuberculosis
gucgccggccgcgg

SEQ ID NO: 2859244 - RNA, 13 nt, Mycobacterium avium subsp. paratuberculosis
gucgccggccucc

SEQ ID NO: 2859245 - RNA, 14 nt, Mycobacterium avium subsp. paratuberculosis
gucgccggccucca

SEQ ID NO: 2859246 - RNA, 18 nt, Mycobacterium avium subsp. paratuberculosis
gucgccggcgaccgccac

SEQ ID NO: 2859247 - RNA, 16 nt, Mycobacterium avium subsp. paratuberculosis
gucgccggcgcgcagc

SEQ ID NO: 2859248 - RNA, 18 nt, Mycobacterium avium subsp. paratuberculosis
gucgccggcgcgcagcgu

SEQ ID NO: 2859249 - RNA, 15 nt, Mycobacterium avium subsp. paratuberculosis
gucgccggcggccga

SEQ ID NO: 2859250 - RNA, 16 nt, Mycobacterium avium subsp. paratuberculosis
gucgccggcggccgac

SEQ ID NO: 2859251 - RNA, 13 nt, Mycobacterium avium subsp. paratuberculosis
gucgccggcggcg

SEQ ID NO: 2859252 - RNA, 15 nt, Mycobacterium avium subsp. paratuberculosis
gucgccggcggcgau

SEQ ID NO: 2859253 - RNA, 17 nt, Mycobacterium avium subsp. paratuberculosis
gucgccggcggcgaucg

SEQ ID NO: 2859254 - RNA, 23 nt, Mycobacterium avium subsp. paratuberculosis
gucgccggcggcgaucgccgcga

SEQ ID NO: 2859255 - RNA, 14 nt, Mycobacterium avium subsp. paratuberculosis
gucgccggcggggc

SEQ ID NO: 2859256 - RNA, 20 nt, Mycobacterium avium subsp. paratuberculosis
gucgccggcugacugccggc

SEQ ID NO: 2859257 - RNA, 23 nt, Mycobacterium avium subsp. paratuberculosis
gucgccggcugacugccggcgac

SEQ ID NO: 2859258 - RNA, 22 nt, Mycobacterium avium subsp. paratuberculosis
gucgccggcuuaccgaccucga

SEQ ID NO: 2859259 - RNA, 23 nt, Mycobacterium avium subsp. paratuberculosis
gucgccgggcagguggucggcga

SEQ ID NO: 2859260 - RNA, 14 nt, Mycobacterium avium subsp. paratuberculosis
gucgccgggcuggg

SEQ ID NO: 2859261 - RNA, 21 nt, Mycobacterium avium subsp. paratuberculosis
gucgccgggucuuccacgccg

SEQ ID NO: 2859262 - RNA, 13 nt, Mycobacterium avium subsp. paratuberculosis
gucgccggucugg

SEQ ID NO: 2859263 - RNA, 20 nt, Mycobacterium avium subsp. paratuberculosis
gucgccggugcuggucaugc

SEQ ID NO: 2859264 - RNA, 16 nt, Mycobacterium avium subsp. paratuberculosis
gucgccgguggccgcc

SEQ ID NO: 2859265 - RNA, 19 nt, Mycobacterium avium subsp. paratuberculosis
gucgccgguggugcaccgg

SEQ ID NO: 2859266 - RNA, 20 nt, Mycobacterium avium subsp. paratuberculosis
gucgccgguggugcaccggu

SEQ ID NO: 2859267 - RNA, 20 nt, Mycobacterium avium subsp. paratuberculosis
gucgccggugugaucgagca

SEQ ID NO: 2859268 - RNA, 13 nt, Mycobacterium avium subsp. paratuberculosis
gucgccggugugc

SEQ ID NO: 2859269 - RNA, 21 nt, Mycobacterium avium subsp. paratuberculosis
gucgccggugugcagccaccc

SEQ ID NO: 2859270 - RNA, 23 nt, Mycobacterium avium subsp. paratuberculosis
gucgccguccaacaggugcuugg

SEQ ID NO: 2859271 - RNA, 15 nt, Mycobacterium avium subsp. paratuberculosis
gucgccguccggggc

SEQ ID NO: 2859272 - RNA, 16 nt, Mycobacterium avium subsp. paratuberculosis
gucgccguccggggcc

SEQ ID NO: 2859273 - RNA, 17 nt, Mycobacterium avium subsp. paratuberculosis
gucgccguccggggccg

SEQ ID NO: 2859274 - RNA, 16 nt, Mycobacterium avium subsp. paratuberculosis
gucgccgucgccgcac

SEQ ID NO: 2859275 - RNA, 16 nt, Mycobacterium avium subsp. paratuberculosis
gucgccgucggggucg

SEQ ID NO: 2859276 - RNA, 20 nt, Mycobacterium avium subsp. paratuberculosis
gucgccgucggggucgcgcc

SEQ ID NO: 2859277 - RNA, 23 nt, Mycobacterium avium subsp. paratuberculosis
gucgccgucggggucgcgccggu

SEQ ID NO: 2859278 - RNA, 20 nt, Mycobacterium avium subsp. paratuberculosis
gucgccgugaucuggugggc

SEQ ID NO: 2859279 - RNA, 21 nt, Mycobacterium avium subsp. paratuberculosis
gucgccgugaucuggugggcg

SEQ ID NO: 2859280 - RNA, 14 nt, Mycobacterium avium subsp. paratuberculosis
gucgccgugccgga

SEQ ID NO: 2859281 - RNA, 21 nt, Mycobacterium avium subsp. paratuberculosis
gucgccgugccggaccgcgcg

SEQ ID NO: 2859282 - RNA, 13 nt, Mycobacterium avium subsp. paratuberculosis
gucgccgugcggc

SEQ ID NO: 2859283 - RNA, 21 nt, Mycobacterium avium subsp. paratuberculosis
gucgccguggccgaacggcau

SEQ ID NO: 2859284 - RNA, 16 nt, Mycobacterium avium subsp. paratuberculosis
gucgccguggcggccc

SEQ ID NO: 2859285 - RNA, 17 nt, Mycobacterium avium subsp. paratuberculosis
gucgccguuggcgugga

SEQ ID NO: 2859286 - RNA, 15 nt, Mycobacterium avium subsp. paratuberculosis
gucgccguuggucug

SEQ ID NO: 2859287 - RNA, 18 nt, Mycobacterium avium subsp. paratuberculosis
gucgccguuggucugcgc

SEQ ID NO: 2859288 - RNA, 21 nt, Mycobacterium avium subsp. paratuberculosis
gucgccuccgagauggacagc

SEQ ID NO: 2859289 - RNA, 18 nt, Mycobacterium avium subsp. paratuberculosis
gucgccuccugcuggcgc

SEQ ID NO: 2859290 - RNA, 19 nt, Mycobacterium avium subsp. paratuberculosis
gucgccucgcccucggugu

SEQ ID NO: 2859291 - RNA, 20 nt, Mycobacterium avium subsp. paratuberculosis
gucgccucgcccucgguguu

SEQ ID NO: 2859292 - RNA, 14 nt, Mycobacterium avium subsp. paratuberculosis
gucgccugcacgaa

SEQ ID NO: 2859293 - RNA, 20 nt, Mycobacterium avium subsp. paratuberculosis
gucgcgcgguuccggcgugc

SEQ ID NO: 2859294 - RNA, 23 nt, Mycobacterium avium subsp. paratuberculosis
gucgcgcucauaucccgucaggu

SEQ ID NO: 2859295 - RNA, 19 nt, Mycobacterium avium subsp. paratuberculosis
gucgcgcugccggcccgau

SEQ ID NO: 2859296 - RNA, 13 nt, Mycobacterium avium subsp. paratuberculosis
gucgcgcugcggg

SEQ ID NO: 2859297 - RNA, 16 nt, Mycobacterium avium subsp. paratuberculosis
gucgcggaacagccgg

SEQ ID NO: 2859298 - RNA, 19 nt, Mycobacterium avium subsp. paratuberculosis
gucgcggaacagccggcuc

SEQ ID NO: 2859299 - RNA, 18 nt, Mycobacterium avium subsp. paratuberculosis
gucgcggaaccggccggg

SEQ ID NO: 2859300 - RNA, 20 nt, Mycobacterium avium subsp. paratuberculosis
gucgcggaaccggccggggc

SEQ ID NO: 2859301 - RNA, 22 nt, Mycobacterium avium subsp. paratuberculosis
gucgcggaaccguugcagcaca

SEQ ID NO: 2859302 - RNA, 17 nt, Mycobacterium avium subsp. paratuberculosis
gucgcggaacgggucga

SEQ ID NO: 2859303 - RNA, 19 nt, Mycobacterium avium subsp. paratuberculosis
gucgcggagaugcugguga

SEQ ID NO: 2859304 - RNA, 17 nt, Mycobacterium avium subsp. paratuberculosis
gucgcggaucucgucgg

SEQ ID NO: 2859305 - RNA, 21 nt, Mycobacterium avium subsp. paratuberculosis
gucgcggcaucccuggugacc

SEQ ID NO: 2859306 - RNA, 14 nt, Mycobacterium avium subsp. paratuberculosis
gucgcggcccagca

SEQ ID NO: 2859307 - RNA, 13 nt, Mycobacterium avium subsp. paratuberculosis
gucgcggccggga

SEQ ID NO: 2859308 - RNA, 21 nt, Mycobacterium avium subsp. paratuberculosis
gucgcggccuccgagcggcgc

SEQ ID NO: 2859309 - RNA, 14 nt, Mycobacterium avium subsp. paratuberculosis
gucgcggccuucuu

SEQ ID NO: 2859310 - RNA, 13 nt, Mycobacterium avium subsp. paratuberculosis
gucgcggccuugc

SEQ ID NO: 2859311 - RNA, 18 nt, Mycobacterium avium subsp. paratuberculosis
gucgcggccuugcgcacc

SEQ ID NO: 2859312 - RNA, 15 nt, Mycobacterium avium subsp. paratuberculosis
gucgcggccuugcgg

SEQ ID NO: 2859313 - RNA, 13 nt, Mycobacterium avium subsp. paratuberculosis
gucgcggcgaacc

SEQ ID NO: 2859314 - RNA, 17 nt, Mycobacterium avium subsp. paratuberculosis
gucgcggcgaaccagca

SEQ ID NO: 2859315 - RNA, 18 nt, Mycobacterium avium subsp. paratuberculosis
gucgcggcgaaccagcau

SEQ ID NO: 2859316 - RNA, 14 nt, Mycobacterium avium subsp. paratuberculosis
gucgcggcgcaccc

SEQ ID NO: 2859317 - RNA, 21 nt, Mycobacterium avium subsp. paratuberculosis
gucgcggcgcacccgggcagc

SEQ ID NO: 2859318 - RNA, 13 nt, Mycobacterium avium subsp. paratuberculosis
gucgcggcgcacg

SEQ ID NO: 2859319 - RNA, 20 nt, Mycobacterium avium subsp. paratuberculosis
gucgcggcgcacggugcccg

SEQ ID NO: 2859320 - RNA, 15 nt, Mycobacterium avium subsp. paratuberculosis
gucgcggcgccgguu

SEQ ID NO: 2859321 - RNA, 23 nt, Mycobacterium avium subsp. paratuberculosis
gucgcggcgcuaaagccaccagc

SEQ ID NO: 2859322 - RNA, 15 nt, Mycobacterium avium subsp. paratuberculosis
gucgcggcgcugccg

SEQ ID NO: 2859323 - RNA, 11 nt, Mycobacterium avium subsp. paratuberculosis
gucgcggcggc

SEQ ID NO: 2859324 - RNA, 20 nt, Mycobacterium avium subsp. paratuberculosis
gucgcggcggccggcgccga

SEQ ID NO: 2859325 - RNA, 21 nt, Mycobacterium avium subsp. paratuberculosis
gucgcggcggccggcgccgac

SEQ ID NO: 2859326 - RNA, 13 nt, Mycobacterium avium subsp. paratuberculosis
gucgcggcggcgc

SEQ ID NO: 2859327 - RNA, 14 nt, Mycobacterium avium subsp. paratuberculosis
gucgcggcggcgcu

SEQ ID NO: 2859328 - RNA, 15 nt, Mycobacterium avium subsp. paratuberculosis
gucgcggcggcgcug

SEQ ID NO: 2859329 - RNA, 20 nt, Mycobacterium avium subsp. paratuberculosis
gucgcggcgggggucggagc

SEQ ID NO: 2859330 - RNA, 22 nt, Mycobacterium avium subsp. paratuberculosis
gucgcggcggugcgcagccgcu

SEQ ID NO: 2859331 - RNA, 17 nt, Mycobacterium avium subsp. paratuberculosis
gucgcggcgucgcggua

SEQ ID NO: 2859332 - RNA, 13 nt, Mycobacterium avium subsp. paratuberculosis
gucgcggcugccg

SEQ ID NO: 2859333 - RNA, 12 nt, Mycobacterium avium subsp. paratuberculosis
gucgcggcugcg

SEQ ID NO: 2859334 - RNA, 17 nt, Mycobacterium avium subsp. paratuberculosis
gucgcgggaaucccacc

SEQ ID NO: 2859335 - RNA, 19 nt, Mycobacterium avium subsp. paratuberculosis
gucgcgggaaucccacccg

SEQ ID NO: 2859336 - RNA, 20 nt, Mycobacterium avium subsp. paratuberculosis
gucgcgggaaucccacccgc

SEQ ID NO: 2859337 - RNA, 15 nt, Mycobacterium avium subsp. paratuberculosis
gucgcgggacaacac

SEQ ID NO: 2859338 - RNA, 19 nt, Mycobacterium avium subsp. paratuberculosis
gucgcgggacaacaccacc

SEQ ID NO: 2859339 - RNA, 18 nt, Mycobacterium avium subsp. paratuberculosis
gucgcgggagagcgcggg

SEQ ID NO: 2859340 - RNA, 22 nt, Mycobacterium avium subsp. paratuberculosis
gucgcgggagagcgcgggcacc

SEQ ID NO: 2859341 - RNA, 22 nt, Mycobacterium avium subsp. paratuberculosis
gucgcgggcagccggcgcccgc

SEQ ID NO: 2859342 - RNA, 23 nt, Mycobacterium avium subsp. paratuberculosis
gucgcgggcagccggcgcccgca

SEQ ID NO: 2859343 - RNA, 15 nt, Mycobacterium avium subsp. paratuberculosis
gucgcgggcccgggc

SEQ ID NO: 2859344 - RNA, 16 nt, Mycobacterium avium subsp. paratuberculosis
gucgcgggcccgggcc

SEQ ID NO: 2859345 - RNA, 17 nt, Mycobacterium avium subsp. paratuberculosis
gucgcgggcccgggcca

SEQ ID NO: 2859346 - RNA, 14 nt, Mycobacterium avium subsp. paratuberculosis
gucgcgggcgaaag

SEQ ID NO: 2859347 - RNA, 13 nt, Mycobacterium avium subsp. paratuberculosis
gucgcgggcgccg

SEQ ID NO: 2859348 - RNA, 17 nt, Mycobacterium avium subsp. paratuberculosis
gucgcgggcgccgaaga

SEQ ID NO: 2859349 - RNA, 16 nt, Mycobacterium avium subsp. paratuberculosis
gucgcgggcggggcgc

SEQ ID NO: 2859350 - RNA, 18 nt, Mycobacterium avium subsp. paratuberculosis
gucgcgggcggggcgccg

SEQ ID NO: 2859351 - RNA, 19 nt, Mycobacterium avium subsp. paratuberculosis
gucgcgggcggggcgccga

SEQ ID NO: 2859352 - RNA, 20 nt, Mycobacterium avium subsp. paratuberculosis
gucgcgggcggggcgccgac

SEQ ID NO: 2859353 - RNA, 19 nt, Mycobacterium avium subsp. paratuberculosis
gucgcgggcgucgggcagc

SEQ ID NO: 2859354 - RNA, 14 nt, Mycobacterium avium subsp. paratuberculosis
gucgcgggugaccg

SEQ ID NO: 2859355 - RNA, 17 nt, Mycobacterium avium subsp. paratuberculosis
gucgcgggugaccggcg

SEQ ID NO: 2859356 - RNA, 20 nt, Mycobacterium avium subsp. paratuberculosis
gucgcgguagcgcucgucgu

SEQ ID NO: 2859357 - RNA, 22 nt, Mycobacterium avium subsp. paratuberculosis
gucgcggucagcucgaucgccg

SEQ ID NO: 2859358 - RNA, 16 nt, Mycobacterium avium subsp. paratuberculosis
gucgcgguccacgccg

SEQ ID NO: 2859359 - RNA, 21 nt, Mycobacterium avium subsp. paratuberculosis
gucgcgguccacgccggcgau

SEQ ID NO: 2859360 - RNA, 21 nt, Mycobacterium avium subsp. paratuberculosis
gucgcggucccaggugcuggg

SEQ ID NO: 2859361 - RNA, 13 nt, Mycobacterium avium subsp. paratuberculosis
gucgcggucggcg

SEQ ID NO: 2859362 - RNA, 14 nt, Mycobacterium avium subsp. paratuberculosis
gucgcggucggcgu

SEQ ID NO: 2859363 - RNA, 22 nt, Mycobacterium avium subsp. paratuberculosis
gucgcggugaaguugccgccgc

SEQ ID NO: 2859364 - RNA, 23 nt, Mycobacterium avium subsp. paratuberculosis
gucgcggugaaguugccgccgcc

SEQ ID NO: 2859365 - RNA, 15 nt, Mycobacterium avium subsp. paratuberculosis
gucgcggugcccagc

SEQ ID NO: 2859366 - RNA, 16 nt, Mycobacterium avium subsp. paratuberculosis
gucgcggugcccagcc

SEQ ID NO: 2859367 - RNA, 17 nt, Mycobacterium avium subsp. paratuberculosis
gucgcggugcccagccg

SEQ ID NO: 2859368 - RNA, 19 nt, Mycobacterium avium subsp. paratuberculosis
gucgcggugggcucggcgc

SEQ ID NO: 2859369 - RNA, 21 nt, Mycobacterium avium subsp. paratuberculosis
gucgcggugggcucggcgccg

SEQ ID NO: 2859370 - RNA, 16 nt, Mycobacterium avium subsp. paratuberculosis
gucgcggugucggcgu

SEQ ID NO: 2859371 - RNA, 16 nt, Mycobacterium avium subsp. paratuberculosis
gucgcgguugaucaca

SEQ ID NO: 2859372 - RNA, 18 nt, Mycobacterium avium subsp. paratuberculosis
gucgcgguugaucacacc

SEQ ID NO: 2859373 - RNA, 23 nt, Mycobacterium avium subsp. paratuberculosis
gucgcguacgggaugaucagcag

SEQ ID NO: 2859374 - RNA, 16 nt, Mycobacterium avium subsp. paratuberculosis
gucgcguagggcaggg

SEQ ID NO: 2859375 - RNA, 17 nt, Mycobacterium avium subsp. paratuberculosis
gucgcguagggcagggu

SEQ ID NO: 2859376 - RNA, 16 nt, Mycobacterium avium subsp. paratuberculosis
gucgcguccgcgaucg

SEQ ID NO: 2859377 - RNA, 16 nt, Mycobacterium avium subsp. paratuberculosis
gucgcgucgucggcgg

SEQ ID NO: 2859378 - RNA, 14 nt, Mycobacterium avium subsp. paratuberculosis
gucggacaccagca

SEQ ID NO: 2859379 - RNA, 17 nt, Mycobacterium avium subsp. paratuberculosis
gucggacaccagcaugg

SEQ ID NO: 2859380 - RNA, 23 nt, Mycobacterium avium subsp. paratuberculosis
gucggacaccagcauggcgauca

SEQ ID NO: 2859381 - RNA, 16 nt, Mycobacterium avium subsp. paratuberculosis
gucggacaugccggcg

SEQ ID NO: 2859382 - RNA, 17 nt, Mycobacterium avium subsp. paratuberculosis
gucggacaugccggcgc

SEQ ID NO: 2859383 - RNA, 16 nt, Mycobacterium avium subsp. paratuberculosis
gucggacgccuccccc

SEQ ID NO: 2859384 - RNA, 14 nt, Mycobacterium avium subsp. paratuberculosis
gucggacgcgggga

SEQ ID NO: 2859385 - RNA, 22 nt, Mycobacterium avium subsp. paratuberculosis
gucggacuccuccugcgacggc

SEQ ID NO: 2859386 - RNA, 18 nt, Mycobacterium avium subsp. paratuberculosis
gucggacucgcgccggau

SEQ ID NO: 2859387 - RNA, 16 nt, Mycobacterium avium subsp. paratuberculosis
gucggacuucugguug

SEQ ID NO: 2859388 - RNA, 21 nt, Mycobacterium avium subsp. paratuberculosis
gucggacuucugguugacgcc

SEQ ID NO: 2859389 - RNA, 23 nt, Mycobacterium avium subsp. paratuberculosis
gucggacuucugguugacgccga

SEQ ID NO: 2859390 - RNA, 19 nt, Mycobacterium avium subsp. paratuberculosis
gucggagacccgcccggag

SEQ ID NO: 2859391 - RNA, 16 nt, Mycobacterium avium subsp. paratuberculosis
gucggagaucaccggc

SEQ ID NO: 2859392 - RNA, 20 nt, Mycobacterium avium subsp. paratuberculosis
gucggagaucagggugcuca

SEQ ID NO: 2859393 - RNA, 24 nt, Mycobacterium avium subsp. paratuberculosis
gucggagaucagggugcucagccg

SEQ ID NO: 2859394 - RNA, 14 nt, Mycobacterium avium subsp. paratuberculosis
gucggagaucggcg

SEQ ID NO: 2859395 - RNA, 15 nt, Mycobacterium avium subsp. paratuberculosis
gucggagaugcgggc

SEQ ID NO: 2859396 - RNA, 23 nt, Mycobacterium avium subsp. paratuberculosis
gucggagaugcgggccaccgucc

SEQ ID NO: 2859397 - RNA, 22 nt, Mycobacterium avium subsp. paratuberculosis
gucggagcaaauccggcagcgc

SEQ ID NO: 2859398 - RNA, 14 nt, Mycobacterium avium subsp. paratuberculosis
gucggagcccagcg

SEQ ID NO: 2859399 - RNA, 17 nt, Mycobacterium avium subsp. paratuberculosis
gucggagcccagcguga

SEQ ID NO: 2859400 - RNA, 14 nt, Mycobacterium avium subsp. paratuberculosis
gucggagccgucgg

SEQ ID NO: 2859401 - RNA, 17 nt, Mycobacterium avium subsp. paratuberculosis
gucggagcgcuccacca

SEQ ID NO: 2859402 - RNA, 20 nt, Mycobacterium avium subsp. paratuberculosis
gucggaggacaacgcgucga

SEQ ID NO: 2859403 - RNA, 14 nt, Mycobacterium avium subsp. paratuberculosis
gucggaucgagcuc

SEQ ID NO: 2859404 - RNA, 13 nt, Mycobacterium avium subsp. paratuberculosis
gucggcaacccga

SEQ ID NO: 2859405 - RNA, 14 nt, Mycobacterium avium subsp. paratuberculosis
gucggcaacgccgg

SEQ ID NO: 2859406 - RNA, 15 nt, Mycobacterium avium subsp. paratuberculosis
gucggcaacgccggg

SEQ ID NO: 2859407 - RNA, 16 nt, Mycobacterium avium subsp. paratuberculosis
gucggcaaugaccggc

SEQ ID NO: 2859408 - RNA, 20 nt, Mycobacterium avium subsp. paratuberculosis
gucggcacaccagguaggcg

SEQ ID NO: 2859409 - RNA, 13 nt, Mycobacterium avium subsp. paratuberculosis
gucggcaccagcg

SEQ ID NO: 2859410 - RNA, 14 nt, Mycobacterium avium subsp. paratuberculosis
gucggcaccagcgg

SEQ ID NO: 2859411 - RNA, 23 nt, Mycobacterium avium subsp. paratuberculosis
gucggcaccagcggcaucgccgc

SEQ ID NO: 2859412 - RNA, 18 nt, Mycobacterium avium subsp. paratuberculosis
gucggcaccuccugcacc

SEQ ID NO: 2859413 - RNA, 20 nt, Mycobacterium avium subsp. paratuberculosis
gucggcaccuccugcacccg

SEQ ID NO: 2859414 - RNA, 12 nt, Mycobacterium avium subsp. paratuberculosis
gucggcagcacc

SEQ ID NO: 2859415 - RNA, 16 nt, Mycobacterium avium subsp. paratuberculosis
gucggcagcaccggca

SEQ ID NO: 2859416 - RNA, 20 nt, Mycobacterium avium subsp. paratuberculosis
gucggcagcaccggcagcaa

SEQ ID NO: 2859417 - RNA, 22 nt, Mycobacterium avium subsp. paratuberculosis
gucggcaggauccggacgaccu

SEQ ID NO: 2859418 - RNA, 20 nt, Mycobacterium avium subsp. paratuberculosis
gucggcaguagcacuuucgc

SEQ ID NO: 2859419 - RNA, 18 nt, Mycobacterium avium subsp. paratuberculosis
gucggcauagcgccgcuc

SEQ ID NO: 2859420 - RNA, 15 nt, Mycobacterium avium subsp. paratuberculosis
gucggcauccacccg

SEQ ID NO: 2859421 - RNA, 17 nt, Mycobacterium avium subsp. paratuberculosis
gucggccaacagugcgc

SEQ ID NO: 2859422 - RNA, 19 nt, Mycobacterium avium subsp. paratuberculosis
gucggccaacagugcgcag

SEQ ID NO: 2859423 - RNA, 21 nt, Mycobacterium avium subsp. paratuberculosis
gucggccaccgcggucgacgg

SEQ ID NO: 2859424 - RNA, 16 nt, Mycobacterium avium subsp. paratuberculosis
gucggccacgcucgcc

SEQ ID NO: 2859425 - RNA, 18 nt, Mycobacterium avium subsp. paratuberculosis
gucggccacguugccggg

SEQ ID NO: 2859426 - RNA, 20 nt, Mycobacterium avium subsp. paratuberculosis
gucggccagcaccaccaacg

SEQ ID NO: 2859427 - RNA, 23 nt, Mycobacterium avium subsp. paratuberculosis
gucggccagcaggucgucgacgu

SEQ ID NO: 2859428 - RNA, 22 nt, Mycobacterium avium subsp. paratuberculosis
gucggccagcgaguccagccag

SEQ ID NO: 2859429 - RNA, 24 nt, Mycobacterium avium subsp. paratuberculosis
gucggccagcgaguccagccagcc

SEQ ID NO: 2859430 - RNA, 13 nt, Mycobacterium avium subsp. paratuberculosis
gucggccagcgcc

SEQ ID NO: 2859431 - RNA, 15 nt, Mycobacterium avium subsp. paratuberculosis
gucggccagcgccgc

SEQ ID NO: 2859432 - RNA, 21 nt, Mycobacterium avium subsp. paratuberculosis
gucggccagcgccgcccgggc

SEQ ID NO: 2859433 - RNA, 14 nt, Mycobacterium avium subsp. paratuberculosis
gucggccagcgcgc

SEQ ID NO: 2859434 - RNA, 16 nt, Mycobacterium avium subsp. paratuberculosis
gucggccagcgcgcgc

SEQ ID NO: 2859435 - RNA, 20 nt, Mycobacterium avium subsp. paratuberculosis
gucggccagcgcgcgcagcg

SEQ ID NO: 2859436 - RNA, 19 nt, Mycobacterium avium subsp. paratuberculosis
gucggccagcgcgcgggcg

SEQ ID NO: 2859437 - RNA, 19 nt, Mycobacterium avium subsp. paratuberculosis
gucggccagcgcggcggcc

SEQ ID NO: 2859438 - RNA, 20 nt, Mycobacterium avium subsp. paratuberculosis
gucggccagcgcggcggcca

SEQ ID NO: 2859439 - RNA, 14 nt, Mycobacterium avium subsp. paratuberculosis
gucggccagcgcgu

SEQ ID NO: 2859440 - RNA, 15 nt, Mycobacterium avium subsp. paratuberculosis
gucggccagcgcgug

SEQ ID NO: 2859441 - RNA, 14 nt, Mycobacterium avium subsp. paratuberculosis
gucggccagcggca

SEQ ID NO: 2859442 - RNA, 19 nt, Mycobacterium avium subsp. paratuberculosis
gucggccaggaucucgcgg

SEQ ID NO: 2859443 - RNA, 14 nt, Mycobacterium avium subsp. paratuberculosis
gucggccagggcgu

SEQ ID NO: 2859444 - RNA, 19 nt, Mycobacterium avium subsp. paratuberculosis
gucggccaguucgccggug

SEQ ID NO: 2859445 - RNA, 16 nt, Mycobacterium avium subsp. paratuberculosis
gucggccaucagcacc

SEQ ID NO: 2859446 - RNA, 14 nt, Mycobacterium avium subsp. paratuberculosis
gucggccaucagcc

SEQ ID NO: 2859447 - RNA, 21 nt, Mycobacterium avium subsp. paratuberculosis
gucggccaucagccgccgucg

SEQ ID NO: 2859448 - RNA, 15 nt, Mycobacterium avium subsp. paratuberculosis
gucggcccacgguga

SEQ ID NO: 2859449 - RNA, 24 nt, Mycobacterium avium subsp. paratuberculosis
gucggcccagacgaugucgucgcc

SEQ ID NO: 2859450 - RNA, 12 nt, Mycobacterium avium subsp. paratuberculosis
gucggcccaggc

SEQ ID NO: 2859451 - RNA, 15 nt, Mycobacterium avium subsp. paratuberculosis
gucggcccaggccaa

SEQ ID NO: 2859452 - RNA, 17 nt, Mycobacterium avium subsp. paratuberculosis
gucggcccaggccaaca

SEQ ID NO: 2859453 - RNA, 22 nt, Mycobacterium avium subsp. paratuberculosis
gucggcccaggccaacagcagc

SEQ ID NO: 2859454 - RNA, 23 nt, Mycobacterium avium subsp. paratuberculosis
gucggcccaguccagucgcgccg

SEQ ID NO: 2859455 - RNA, 19 nt, Mycobacterium avium subsp. paratuberculosis
gucggcccccagcgaggug

SEQ ID NO: 2859456 - RNA, 12 nt, Mycobacterium avium subsp. paratuberculosis
gucggccccgcg

SEQ ID NO: 2859457 - RNA, 13 nt, Mycobacterium avium subsp. paratuberculosis
gucggcccgccgg

SEQ ID NO: 2859458 - RNA, 16 nt, Mycobacterium avium subsp. paratuberculosis
gucggcccgccgggcc

SEQ ID NO: 2859459 - RNA, 19 nt, Mycobacterium avium subsp. paratuberculosis
gucggcccgccgggccgga

SEQ ID NO: 2859460 - RNA, 19 nt, Mycobacterium avium subsp. paratuberculosis
gucggcccgcugcggcugg

SEQ ID NO: 2859461 - RNA, 12 nt, Mycobacterium avium subsp. paratuberculosis
gucggccgcacg

SEQ ID NO: 2859462 - RNA, 23 nt, Mycobacterium avium subsp. paratuberculosis
gucggccgcacgucccgcccggc

SEQ ID NO: 2859463 - RNA, 22 nt, Mycobacterium avium subsp. paratuberculosis
gucggcgccgaucacgccggug

SEQ ID NO: 2859464 - RNA, 19 nt, Mycobacterium avium subsp. paratuberculosis
gucggcgccgaugcagcac

SEQ ID NO: 2859465 - RNA, 16 nt, Mycobacterium avium subsp. paratuberculosis
gucggcgccgccgagc

SEQ ID NO: 2859466 - RNA, 17 nt, Mycobacterium avium subsp. paratuberculosis
gucggcgccgccgagcc

SEQ ID NO: 2859467 - RNA, 19 nt, Mycobacterium avium subsp. paratuberculosis
gucggcgccgccgagccgc

SEQ ID NO: 2859468 - RNA, 13 nt, Mycobacterium avium subsp. paratuberculosis
gucggcgccgcgc

SEQ ID NO: 2859469 - RNA, 14 nt, Mycobacterium avium subsp. paratuberculosis
gucggcgccgcgcc

SEQ ID NO: 2859470 - RNA, 15 nt, Mycobacterium avium subsp. paratuberculosis
gucggcgccgcgccg

SEQ ID NO: 2859471 - RNA, 17 nt, Mycobacterium avium subsp. paratuberculosis
gucggcgccgcgccggc

SEQ ID NO: 2859472 - RNA, 21 nt, Mycobacterium avium subsp. paratuberculosis
gucggcgccggaucggccccc

SEQ ID NO: 2859473 - RNA, 13 nt, Mycobacterium avium subsp. paratuberculosis
gucggcgccggcc

SEQ ID NO: 2859474 - RNA, 14 nt, Mycobacterium avium subsp. paratuberculosis
gucggcgccggcca

SEQ ID NO: 2859475 - RNA, 19 nt, Mycobacterium avium subsp. paratuberculosis
gucggcgccggccagcggc

SEQ ID NO: 2859476 - RNA, 16 nt, Mycobacterium avium subsp. paratuberculosis
gucggcgccgucgcgg

SEQ ID NO: 2859477 - RNA, 15 nt, Mycobacterium avium subsp. paratuberculosis
gucggcgcgcaccgc

SEQ ID NO: 2859478 - RNA, 14 nt, Mycobacterium avium subsp. paratuberculosis
gucggcgcgcaggc

SEQ ID NO: 2859479 - RNA, 16 nt, Mycobacterium avium subsp. paratuberculosis
gucggcgcgcaggcug

SEQ ID NO: 2859480 - RNA, 19 nt, Mycobacterium avium subsp. paratuberculosis
gucggcgcgcucggugcug

SEQ ID NO: 2859481 - RNA, 17 nt, Mycobacterium avium subsp. paratuberculosis
gucggcgcggacgugau

SEQ ID NO: 2859482 - RNA, 15 nt, Mycobacterium avium subsp. paratuberculosis
gucggcgcggccgga

SEQ ID NO: 2859483 - RNA, 18 nt, Mycobacterium avium subsp. paratuberculosis
gucggcgcggccggaucg

SEQ ID NO: 2859484 - RNA, 21 nt, Mycobacterium avium subsp. paratuberculosis
gucggcgcggccggaucgaau

SEQ ID NO: 2859485 - RNA, 13 nt, Mycobacterium avium subsp. paratuberculosis
gucggcgcggcga

SEQ ID NO: 2859486 - RNA, 14 nt, Mycobacterium avium subsp. paratuberculosis
gucggcgcggcgac

SEQ ID NO: 2859487 - RNA, 19 nt, Mycobacterium avium subsp. paratuberculosis
gucggcgcggcgacgugau

SEQ ID NO: 2859488 - RNA, 14 nt, Mycobacterium avium subsp. paratuberculosis
gucggcgcgggcca

SEQ ID NO: 2859489 - RNA, 20 nt, Mycobacterium avium subsp. paratuberculosis
gucggcgcgggccagcagca

SEQ ID NO: 2859490 - RNA, 16 nt, Mycobacterium avium subsp. paratuberculosis
gucggcgcgguccacg

SEQ ID NO: 2859491 - RNA, 14 nt, Mycobacterium avium subsp. paratuberculosis
gucggcgcggucgc

SEQ ID NO: 2859492 - RNA, 15 nt, Mycobacterium avium subsp. paratuberculosis
gucggcgcgguuguc

SEQ ID NO: 2859493 - RNA, 13 nt, Mycobacterium avium subsp. paratuberculosis
gucggcgcgucgu

SEQ ID NO: 2859494 - RNA, 16 nt, Mycobacterium avium subsp. paratuberculosis
gucggcgcgugccaac

SEQ ID NO: 2859495 - RNA, 14 nt, Mycobacterium avium subsp. paratuberculosis
gucggcgcuggcca

SEQ ID NO: 2859496 - RNA, 19 nt, Mycobacterium avium subsp. paratuberculosis
gucggcgcuuuccaccucg

SEQ ID NO: 2859497 - RNA, 23 nt, Mycobacterium avium subsp. paratuberculosis
gucggcggacuggcugagcagca

SEQ ID NO: 2859498 - RNA, 20 nt, Mycobacterium avium subsp. paratuberculosis
gucggcggagaugacgugga

SEQ ID NO: 2859499 - RNA, 23 nt, Mycobacterium avium subsp. paratuberculosis
gucggcggaggcgaaugcggcca

SEQ ID NO: 2859500 - RNA, 14 nt, Mycobacterium avium subsp. paratuberculosis
gucggcggccgcga

SEQ ID NO: 2859501 - RNA, 21 nt, Mycobacterium avium subsp. paratuberculosis
gucggcggccgcgaaggcggc

SEQ ID NO: 2859502 - RNA, 12 nt, Mycobacterium avium subsp. paratuberculosis
gucggcggccgg

SEQ ID NO: 2859503 - RNA, 13 nt, Mycobacterium avium subsp. paratuberculosis
gucggcggccggg

SEQ ID NO: 2859504 - RNA, 17 nt, Mycobacterium avium subsp. paratuberculosis
gucggcggccugcucgc

SEQ ID NO: 2859505 - RNA, 17 nt, Mycobacterium avium subsp. paratuberculosis
gucggcggcgacgugcc

SEQ ID NO: 2859506 - RNA, 13 nt, Mycobacterium avium subsp. paratuberculosis
gucggcggcgagg

SEQ ID NO: 2859507 - RNA, 12 nt, Mycobacterium avium subsp. paratuberculosis
gucggcggcggc

SEQ ID NO: 2859508 - RNA, 13 nt, Mycobacterium avium subsp. paratuberculosis
gucggcggcggcc

SEQ ID NO: 2859509 - RNA, 14 nt, Mycobacterium avium subsp. paratuberculosis
gucggcggcggccu

SEQ ID NO: 2859510 - RNA, 16 nt, Mycobacterium avium subsp. paratuberculosis
gucggcggcggccugc

SEQ ID NO: 2859511 - RNA, 17 nt, Mycobacterium avium subsp. paratuberculosis
gucggcggcggccugca

SEQ ID NO: 2859512 - RNA, 15 nt, Mycobacterium avium subsp. paratuberculosis
gucggcggcggcggc

SEQ ID NO: 2859513 - RNA, 16 nt, Mycobacterium avium subsp. paratuberculosis
gucggcggcggcggcc

SEQ ID NO: 2859514 - RNA, 17 nt, Mycobacterium avium subsp. paratuberculosis
gucggcggcggcggccg

SEQ ID NO: 2859515 - RNA, 19 nt, Mycobacterium avium subsp. paratuberculosis
gucggcgggagccggcggc

SEQ ID NO: 2859516 - RNA, 18 nt, Mycobacterium avium subsp. paratuberculosis
gucggcgggauggguggu

SEQ ID NO: 2859517 - RNA, 23 nt, Mycobacterium avium subsp. paratuberculosis
gucggcgggcaccucggccaggu

SEQ ID NO: 2859518 - RNA, 15 nt, Mycobacterium avium subsp. paratuberculosis
gucggcgggccgguc

SEQ ID NO: 2859519 - RNA, 15 nt, Mycobacterium avium subsp. paratuberculosis
gucggcggggaaggu

SEQ ID NO: 2859520 - RNA, 20 nt, Mycobacterium avium subsp. paratuberculosis
gucggcggggaaggugcggg

SEQ ID NO: 2859521 - RNA, 13 nt, Mycobacterium avium subsp. paratuberculosis
gucggcggggccg

SEQ ID NO: 2859522 - RNA, 17 nt, Mycobacterium avium subsp. paratuberculosis
gucggcggggccgguga

SEQ ID NO: 2859523 - RNA, 21 nt, Mycobacterium avium subsp. paratuberculosis
gucggcggguagaaccagccc

SEQ ID NO: 2859524 - RNA, 15 nt, Mycobacterium avium subsp. paratuberculosis
gucggcggucgccag

SEQ ID NO: 2859525 - RNA, 16 nt, Mycobacterium avium subsp. paratuberculosis
gucggcggucgccagc

SEQ ID NO: 2859526 - RNA, 16 nt, Mycobacterium avium subsp. paratuberculosis
gucggcggucgcggug

SEQ ID NO: 2859527 - RNA, 17 nt, Mycobacterium avium subsp. paratuberculosis
gucggcggucuuggcgg

SEQ ID NO: 2859528 - RNA, 20 nt, Mycobacterium avium subsp. paratuberculosis
gucggcggucuuggcggcca

SEQ ID NO: 2859529 - RNA, 22 nt, Mycobacterium avium subsp. paratuberculosis
gucggcggucuuggcggccagc

SEQ ID NO: 2859530 - RNA, 23 nt, Mycobacterium avium subsp. paratuberculosis
gucggcggucuuggcggccagcg

SEQ ID NO: 2859531 - RNA, 13 nt, Mycobacterium avium subsp. paratuberculosis
gucggcggugaug

SEQ ID NO: 2859532 - RNA, 18 nt, Mycobacterium avium subsp. paratuberculosis
gucggcggugaugcgcgc

SEQ ID NO: 2859533 - RNA, 21 nt, Mycobacterium avium subsp. paratuberculosis
gucggcggugaugcgcgccga

SEQ ID NO: 2859534 - RNA, 14 nt, Mycobacterium avium subsp. paratuberculosis
gucggcggugaugg

SEQ ID NO: 2859535 - RNA, 13 nt, Mycobacterium avium subsp. paratuberculosis
gucggcggugccg

SEQ ID NO: 2859536 - RNA, 15 nt, Mycobacterium avium subsp. paratuberculosis
gucggcggugccgag

SEQ ID NO: 2859537 - RNA, 15 nt, Mycobacterium avium subsp. paratuberculosis
gucggcggugggcgc

SEQ ID NO: 2859538 - RNA, 14 nt, Mycobacterium avium subsp. paratuberculosis
gucggcggugucga

SEQ ID NO: 2859539 - RNA, 19 nt, Mycobacterium avium subsp. paratuberculosis
gucggcgguuucggugccg

SEQ ID NO: 2859540 - RNA, 23 nt, Mycobacterium avium subsp. paratuberculosis
gucggcgguuucggugccggccc

SEQ ID NO: 2859541 - RNA, 16 nt, Mycobacterium avium subsp. paratuberculosis
gucggcguagggcagc

SEQ ID NO: 2859542 - RNA, 20 nt, Mycobacterium avium subsp. paratuberculosis
gucggcguagggcagcccga

SEQ ID NO: 2859543 - RNA, 14 nt, Mycobacterium avium subsp. paratuberculosis
gucggcgucaucga

SEQ ID NO: 2859544 - RNA, 16 nt, Mycobacterium avium subsp. paratuberculosis
gucggcguccagcgcg

SEQ ID NO: 2859545 - RNA, 17 nt, Mycobacterium avium subsp. paratuberculosis
gucggcguccagcgcgg

SEQ ID NO: 2859546 - RNA, 18 nt, Mycobacterium avium subsp. paratuberculosis
gucggcguccagcgcggu

SEQ ID NO: 2859547 - RNA, 19 nt, Mycobacterium avium subsp. paratuberculosis
gucggcguccagcgcggug

SEQ ID NO: 2859548 - RNA, 15 nt, Mycobacterium avium subsp. paratuberculosis
gucgggcgcaccacg

SEQ ID NO: 2859549 - RNA, 14 nt, Mycobacterium avium subsp. paratuberculosis
gucgggcgccagcc

SEQ ID NO: 2859550 - RNA, 22 nt, Mycobacterium avium subsp. paratuberculosis
gucgggcgccagcccgcccagc

SEQ ID NO: 2859551 - RNA, 14 nt, Mycobacterium avium subsp. paratuberculosis
gucgggcgccggcg

SEQ ID NO: 2859552 - RNA, 15 nt, Mycobacterium avium subsp. paratuberculosis
gucgggcgccggcgc

SEQ ID NO: 2859553 - RNA, 21 nt, Mycobacterium avium subsp. paratuberculosis
gucgggcgccggcgcguccgg

SEQ ID NO: 2859554 - RNA, 15 nt, Mycobacterium avium subsp. paratuberculosis
gucgggcgcggcggc

SEQ ID NO: 2859555 - RNA, 16 nt, Mycobacterium avium subsp. paratuberculosis
gucgggcgcggcggca

SEQ ID NO: 2859556 - RNA, 17 nt, Mycobacterium avium subsp. paratuberculosis
gucgggcgcggcggcaa

SEQ ID NO: 2859557 - RNA, 18 nt, Mycobacterium avium subsp. paratuberculosis
gucgggcgcggcggcaac

SEQ ID NO: 2859558 - RNA, 13 nt, Mycobacterium avium subsp. paratuberculosis
gucgggcgcggug

SEQ ID NO: 2859559 - RNA, 16 nt, Mycobacterium avium subsp. paratuberculosis
gucgggcucgccucgg

SEQ ID NO: 2859560 - RNA, 15 nt, Mycobacterium avium subsp. paratuberculosis
gucgggcucgcgcac

SEQ ID NO: 2859561 - RNA, 13 nt, Mycobacterium avium subsp. paratuberculosis
gucgggcucgcgg

SEQ ID NO: 2859562 - RNA, 14 nt, Mycobacterium avium subsp. paratuberculosis
gucgggcucggccg

SEQ ID NO: 2859563 - RNA, 20 nt, Mycobacterium avium subsp. paratuberculosis
gucggggaauuccggcgcga

SEQ ID NO: 2859564 - RNA, 17 nt, Mycobacterium avium subsp. paratuberculosis
gucggggaccguccccg

SEQ ID NO: 2859565 - RNA, 19 nt, Mycobacterium avium subsp. paratuberculosis
gucggggacgaagaccggg

SEQ ID NO: 2859566 - RNA, 21 nt, Mycobacterium avium subsp. paratuberculosis
gucggggacgaagaccggguc

SEQ ID NO: 2859567 - RNA, 16 nt, Mycobacterium avium subsp. paratuberculosis
gucggggagccgaaga

SEQ ID NO: 2859568 - RNA, 15 nt, Mycobacterium avium subsp. paratuberculosis
gucggggaucagcgu

SEQ ID NO: 2859569 - RNA, 21 nt, Mycobacterium avium subsp. paratuberculosis
gucggggaugucgucgggcgc

SEQ ID NO: 2859570 - RNA, 23 nt, Mycobacterium avium subsp. paratuberculosis
gucggggcaucgcagcgcgcggc

SEQ ID NO: 2859571 - RNA, 19 nt, Mycobacterium avium subsp. paratuberculosis
gucggggcccguccccacc

SEQ ID NO: 2859572 - RNA, 13 nt, Mycobacterium avium subsp. paratuberculosis
gucggggccgcac

SEQ ID NO: 2859573 - RNA, 14 nt, Mycobacterium avium subsp. paratuberculosis
gucggggccgcacu

SEQ ID NO: 2859574 - RNA, 18 nt, Mycobacterium avium subsp. paratuberculosis
gucggggccgcacucuug

SEQ ID NO: 2859575 - RNA, 22 nt, Mycobacterium avium subsp. paratuberculosis
gucggggcgccuaccggguggc

SEQ ID NO: 2859576 - RNA, 15 nt, Mycobacterium avium subsp. paratuberculosis
gucggggcuggcggc

SEQ ID NO: 2859577 - RNA, 17 nt, Mycobacterium avium subsp. paratuberculosis
gucggggcuggcggcga

SEQ ID NO: 2859578 - RNA, 22 nt, Mycobacterium avium subsp. paratuberculosis
gucggggcuggcggcgaaugcc

SEQ ID NO: 2859579 - RNA, 17 nt, Mycobacterium avium subsp. paratuberculosis
gucgggguccaggccgc

SEQ ID NO: 2859580 - RNA, 19 nt, Mycobacterium avium subsp. paratuberculosis
gucgggguccaggccgcgc

SEQ ID NO: 2859581 - RNA, 23 nt, Mycobacterium avium subsp. paratuberculosis
gucggggucgcgccgguagagcg

SEQ ID NO: 2859582 - RNA, 14 nt, Mycobacterium avium subsp. paratuberculosis
gucggggucggcgc

SEQ ID NO: 2859583 - RNA, 17 nt, Mycobacterium avium subsp. paratuberculosis
gucggggucggcgccgc

SEQ ID NO: 2859584 - RNA, 17 nt, Mycobacterium avium subsp. paratuberculosis
gucggggucgucgacgg

SEQ ID NO: 2859585 - RNA, 22 nt, Mycobacterium avium subsp. paratuberculosis
gucggggucgucgacggccgcg

SEQ ID NO: 2859586 - RNA, 17 nt, Mycobacterium avium subsp. paratuberculosis
gucggggugcgccaggc

SEQ ID NO: 2859587 - RNA, 21 nt, Mycobacterium avium subsp. paratuberculosis
gucggggugcgccaggcaggc

SEQ ID NO: 2859588 - RNA, 22 nt, Mycobacterium avium subsp. paratuberculosis
gucggggugcggucggcgacgu

SEQ ID NO: 2859589 - RNA, 17 nt, Mycobacterium avium subsp. paratuberculosis
gucggggugcucgaucg

SEQ ID NO: 2859590 - RNA, 23 nt, Mycobacterium avium subsp. paratuberculosis
gucggggugcucgaucggcgcgc

SEQ ID NO: 2859591 - RNA, 18 nt, Mycobacterium avium subsp. paratuberculosis
gucgggguggaucgccca

SEQ ID NO: 2859592 - RNA, 13 nt, Mycobacterium avium subsp. paratuberculosis
gucgggguggccg

SEQ ID NO: 2859593 - RNA, 15 nt, Mycobacterium avium subsp. paratuberculosis
gucgggguggccggc

SEQ ID NO: 2859594 - RNA, 19 nt, Mycobacterium avium subsp. paratuberculosis
gucgggguggccggccagc

SEQ ID NO: 2859595 - RNA, 21 nt, Mycobacterium avium subsp. paratuberculosis
gucgggguggggacgacgccg

SEQ ID NO: 2859596 - RNA, 17 nt, Mycobacterium avium subsp. paratuberculosis
gucgggguggugggcgc

SEQ ID NO: 2859597 - RNA, 13 nt, Mycobacterium avium subsp. paratuberculosis
gucgggucccggc

SEQ ID NO: 2859598 - RNA, 19 nt, Mycobacterium avium subsp. paratuberculosis
gucggguccgaccagcacc

SEQ ID NO: 2859599 - RNA, 13 nt, Mycobacterium avium subsp. paratuberculosis
gucgggucggcga

SEQ ID NO: 2859600 - RNA, 19 nt, Mycobacterium avium subsp. paratuberculosis
gucgggucggcgagcagcc

SEQ ID NO: 2859601 - RNA, 20 nt, Mycobacterium avium subsp. paratuberculosis
gucgggucggcgagcagccg

SEQ ID NO: 2859602 - RNA, 18 nt, Mycobacterium avium subsp. paratuberculosis
gucgggugcgcucaccgc

SEQ ID NO: 2859603 - RNA, 22 nt, Mycobacterium avium subsp. paratuberculosis
gucgggugcgcucaccgcaucg

SEQ ID NO: 2859604 - RNA, 15 nt, Mycobacterium avium subsp. paratuberculosis
gucgggugcggcggu

SEQ ID NO: 2859605 - RNA, 18 nt, Mycobacterium avium subsp. paratuberculosis
gucgggugcggcgguguu

SEQ ID NO: 2859606 - RNA, 20 nt, Mycobacterium avium subsp. paratuberculosis
gucgggugguuuugcgucug

SEQ ID NO: 2859607 - RNA, 20 nt, Mycobacterium avium subsp. paratuberculosis
gucgggugucaggucggcga

SEQ ID NO: 2859608 - RNA, 16 nt, Mycobacterium avium subsp. paratuberculosis
gucggguguggcgccg

SEQ ID NO: 2859609 - RNA, 21 nt, Mycobacterium avium subsp. paratuberculosis
gucggguucgcccuccccggc

SEQ ID NO: 2859610 - RNA, 17 nt, Mycobacterium avium subsp. paratuberculosis
gucggguucgccgguga

SEQ ID NO: 2859611 - RNA, 15 nt, Mycobacterium avium subsp. paratuberculosis
gucggguugcgcgga

SEQ ID NO: 2859612 - RNA, 16 nt, Mycobacterium avium subsp. paratuberculosis
gucggguuggccaggg

SEQ ID NO: 2859613 - RNA, 19 nt, Mycobacterium avium subsp. paratuberculosis
gucggguuggccagggcgg

SEQ ID NO: 2859614 - RNA, 15 nt, Mycobacterium avium subsp. paratuberculosis
gucgguaaucggcgg

SEQ ID NO: 2859615 - RNA, 23 nt, Mycobacterium avium subsp. paratuberculosis
gucgguaguugcacucucgcggc

SEQ ID NO: 2859616 - RNA, 15 nt, Mycobacterium avium subsp. paratuberculosis
gucgguaucgagguc

SEQ ID NO: 2859617 - RNA, 17 nt, Mycobacterium avium subsp. paratuberculosis
gucggucaacacuuucc

SEQ ID NO: 2859618 - RNA, 20 nt, Mycobacterium avium subsp. paratuberculosis
gucggucaacgugucgagca

SEQ ID NO: 2859619 - RNA, 18 nt, Mycobacterium avium subsp. paratuberculosis
gucggucacggacagccg

SEQ ID NO: 2859620 - RNA, 15 nt, Mycobacterium avium subsp. paratuberculosis
gucggucagcaggcg

SEQ ID NO: 2859621 - RNA, 15 nt, Mycobacterium avium subsp. paratuberculosis
gucggucagcgccac

SEQ ID NO: 2859622 - RNA, 13 nt, Mycobacterium avium subsp. paratuberculosis
gucggucagcggc

SEQ ID NO: 2859623 - RNA, 16 nt, Mycobacterium avium subsp. paratuberculosis
gucggucagcgucgcc

SEQ ID NO: 2859624 - RNA, 19 nt, Mycobacterium avium subsp. paratuberculosis
gucggucagcgucgccgcc

SEQ ID NO: 2859625 - RNA, 20 nt, Mycobacterium avium subsp. paratuberculosis
gucggucagcgucgccgccc

SEQ ID NO: 2859626 - RNA, 14 nt, Mycobacterium avium subsp. paratuberculosis
gucggucagcucga

SEQ ID NO: 2859627 - RNA, 15 nt, Mycobacterium avium subsp. paratuberculosis
gucggucagcucgaa

SEQ ID NO: 2859628 - RNA, 15 nt, Mycobacterium avium subsp. paratuberculosis
gucggucaggcacuc

SEQ ID NO: 2859629 - RNA, 14 nt, Mycobacterium avium subsp. paratuberculosis
gucggucaggccgg

SEQ ID NO: 2859630 - RNA, 15 nt, Mycobacterium avium subsp. paratuberculosis
gucggucaggccggc

SEQ ID NO: 2859631 - RNA, 18 nt, Mycobacterium avium subsp. paratuberculosis
gucggucagucgcgccgc

SEQ ID NO: 2859632 - RNA, 13 nt, Mycobacterium avium subsp. paratuberculosis
gucggucccgacg

SEQ ID NO: 2859633 - RNA, 21 nt, Mycobacterium avium subsp. paratuberculosis
gucguagucggcccgccgggc

SEQ ID NO: 2859634 - RNA, 21 nt, Mycobacterium avium subsp. paratuberculosis
gucguauuguccugucgacag

SEQ ID NO: 2859635 - RNA, 16 nt, Mycobacterium avium subsp. paratuberculosis
gucgucaacgacccgg

SEQ ID NO: 2859636 - RNA, 13 nt, Mycobacterium avium subsp. paratuberculosis
gucgucaccucga

SEQ ID NO: 2859637 - RNA, 15 nt, Mycobacterium avium subsp. paratuberculosis
gucgucagccgggcc

SEQ ID NO: 2859638 - RNA, 19 nt, Mycobacterium avium subsp. paratuberculosis
gucgucagccgggccagcc

SEQ ID NO: 2859639 - RNA, 13 nt, Mycobacterium avium subsp. paratuberculosis
gucgucagguccg

SEQ ID NO: 2859640 - RNA, 23 nt, Mycobacterium avium subsp. paratuberculosis
gucguccacgcccagcgccccga

SEQ ID NO: 2859641 - RNA, 18 nt, Mycobacterium avium subsp. paratuberculosis
gucguccagcgucgacug

SEQ ID NO: 2859642 - RNA, 20 nt, Mycobacterium avium subsp. paratuberculosis
gucguccagcgucgacugca

SEQ ID NO: 2859643 - RNA, 21 nt, Mycobacterium avium subsp. paratuberculosis
gucguccagcuucucggcguc

SEQ ID NO: 2859644 - RNA, 23 nt, Mycobacterium avium subsp. paratuberculosis
gucguccagcuucucggcguccc

SEQ ID NO: 2859645 - RNA, 19 nt, Mycobacterium avium subsp. paratuberculosis
gucguccagugacgccugc

SEQ ID NO: 2859646 - RNA, 20 nt, Mycobacterium avium subsp. paratuberculosis
gucguccaugcccgcccacg

SEQ ID NO: 2859647 - RNA, 21 nt, Mycobacterium avium subsp. paratuberculosis
gucgucccaggguugccgcac

SEQ ID NO: 2859648 - RNA, 22 nt, Mycobacterium avium subsp. paratuberculosis
gucgucccaggguugccgcacg

SEQ ID NO: 2859649 - RNA, 14 nt, Mycobacterium avium subsp. paratuberculosis
gucguccgaacccg

SEQ ID NO: 2859650 - RNA, 16 nt, Mycobacterium avium subsp. paratuberculosis
gucguccgacaccacc

SEQ ID NO: 2859651 - RNA, 21 nt, Mycobacterium avium subsp. paratuberculosis
gucguccgacaccaccugcac

SEQ ID NO: 2859652 - RNA, 23 nt, Mycobacterium avium subsp. paratuberculosis
gucguccgacaccaccugcacgg

SEQ ID NO: 2859653 - RNA, 18 nt, Mycobacterium avium subsp. paratuberculosis
gucguccgcaaccgccgg

SEQ ID NO: 2859654 - RNA, 19 nt, Mycobacterium avium subsp. paratuberculosis
gucguccgcaaccgccggc

SEQ ID NO: 2859655 - RNA, 15 nt, Mycobacterium avium subsp. paratuberculosis
gucguccggcgcgca

SEQ ID NO: 2859656 - RNA, 15 nt, Mycobacterium avium subsp. paratuberculosis
gucguccucccggcc

SEQ ID NO: 2859657 - RNA, 16 nt, Mycobacterium avium subsp. paratuberculosis
gucguccucccggccg

SEQ ID NO: 2859658 - RNA, 17 nt, Mycobacterium avium subsp. paratuberculosis
gucguccucccggccga

SEQ ID NO: 2859659 - RNA, 20 nt, Mycobacterium avium subsp. paratuberculosis
gucguccucccggccgacga

SEQ ID NO: 2859660 - RNA, 14 nt, Mycobacterium avium subsp. paratuberculosis
gucguccucgauca

SEQ ID NO: 2859661 - RNA, 14 nt, Mycobacterium avium subsp. paratuberculosis
gucguccucgguca

SEQ ID NO: 2859662 - RNA, 22 nt, Mycobacterium avium subsp. paratuberculosis
gucguccucguucuggcccgcc

SEQ ID NO: 2859663 - RNA, 22 nt, Mycobacterium avium subsp. paratuberculosis
gucgucgaagagcuggucgccc

SEQ ID NO: 2859664 - RNA, 15 nt, Mycobacterium avium subsp. paratuberculosis
gucgucgaaggccug

SEQ ID NO: 2859665 - RNA, 15 nt, Mycobacterium avium subsp. paratuberculosis
gucgucgaccaacgc

SEQ ID NO: 2859666 - RNA, 17 nt, Mycobacterium avium subsp. paratuberculosis
gucgucgacgagcccgc

SEQ ID NO: 2859667 - RNA, 21 nt, Mycobacterium avium subsp. paratuberculosis
gucgucgacgagcccgccggc

SEQ ID NO: 2859668 - RNA, 17 nt, Mycobacterium avium subsp. paratuberculosis
gucgucgacgcugccca

SEQ ID NO: 2859669 - RNA, 18 nt, Mycobacterium avium subsp. paratuberculosis
gucgucgacggccgcgcc

SEQ ID NO: 2859670 - RNA, 14 nt, Mycobacterium avium subsp. paratuberculosis
gucgucgacgucca

SEQ ID NO: 2859671 - RNA, 18 nt, Mycobacterium avium subsp. paratuberculosis
gucgucgacgucggacgc

SEQ ID NO: 2859672 - RNA, 21 nt, Mycobacterium avium subsp. paratuberculosis
gucgucgagcaccacccgggu

SEQ ID NO: 2859673 - RNA, 22 nt, Mycobacterium avium subsp. paratuberculosis
gucgucgagcaccggcuggugc

SEQ ID NO: 2859674 - RNA, 23 nt, Mycobacterium avium subsp. paratuberculosis
gucgucgagcacgaaacugccgu

SEQ ID NO: 2859675 - RNA, 19 nt, Mycobacterium avium subsp. paratuberculosis
gucgucgaggccgaaccgc

SEQ ID NO: 2859676 - RNA, 16 nt, Mycobacterium avium subsp. paratuberculosis
gucgucgaggcggauc

SEQ ID NO: 2859677 - RNA, 15 nt, Mycobacterium avium subsp. paratuberculosis
gucgucgagggccac

SEQ ID NO: 2859678 - RNA, 23 nt, Mycobacterium avium subsp. paratuberculosis
gucgucgaucucggugagccgcu

SEQ ID NO: 2859679 - RNA, 16 nt, Mycobacterium avium subsp. paratuberculosis
gucgucgaugaacagc

SEQ ID NO: 2859680 - RNA, 20 nt, Mycobacterium avium subsp. paratuberculosis
gucgucgaugaagucgguga

SEQ ID NO: 2859681 - RNA, 21 nt, Mycobacterium avium subsp. paratuberculosis
gucgucgaugaagucggugag

SEQ ID NO: 2859682 - RNA, 15 nt, Mycobacterium avium subsp. paratuberculosis
gucgucgaugccgau

SEQ ID NO: 2859683 - RNA, 16 nt, Mycobacterium avium subsp. paratuberculosis
gucgucgaugcgcagc

SEQ ID NO: 2859684 - RNA, 17 nt, Mycobacterium avium subsp. paratuberculosis
gucgucgaugcgcagca

SEQ ID NO: 2859685 - RNA, 20 nt, Mycobacterium avium subsp. paratuberculosis
gucgucgaugcgcagcagcg

SEQ ID NO: 2859686 - RNA, 17 nt, Mycobacterium avium subsp. paratuberculosis
gucgucgauggccacca

SEQ ID NO: 2859687 - RNA, 18 nt, Mycobacterium avium subsp. paratuberculosis
gucgucgauggccaccag

SEQ ID NO: 2859688 - RNA, 15 nt, Mycobacterium avium subsp. paratuberculosis
gucgucgcagugccc

SEQ ID NO: 2859689 - RNA, 17 nt, Mycobacterium avium subsp. paratuberculosis
gucgucgcagugcccgc

SEQ ID NO: 2859690 - RNA, 20 nt, Mycobacterium avium subsp. paratuberculosis
gucgucgcccacccgccagc

SEQ ID NO: 2859691 - RNA, 22 nt, Mycobacterium avium subsp. paratuberculosis
gucgucgcccacccgccagccc

SEQ ID NO: 2859692 - RNA, 14 nt, Mycobacterium avium subsp. paratuberculosis
gucgucgcccaccg

SEQ ID NO: 2859693 - RNA, 23 nt, Mycobacterium avium subsp. paratuberculosis
gucgucgcccaccgacgcggcgg

SEQ ID NO: 2859694 - RNA, 24 nt, Mycobacterium avium subsp. paratuberculosis
gucgucgcccgucucggcgugcuc

SEQ ID NO: 2859695 - RNA, 20 nt, Mycobacterium avium subsp. paratuberculosis
gucgucgcccugacacagca

SEQ ID NO: 2859696 - RNA, 21 nt, Mycobacterium avium subsp. paratuberculosis
gucgucgcccugacacagcac

SEQ ID NO: 2859697 - RNA, 22 nt, Mycobacterium avium subsp. paratuberculosis
gucgucgcccugacacagcacc

SEQ ID NO: 2859698 - RNA, 12 nt, Mycobacterium avium subsp. paratuberculosis
gucgucgccgaa

SEQ ID NO: 2859699 - RNA, 19 nt, Mycobacterium avium subsp. paratuberculosis
gucgucgccgaugcgccgc

SEQ ID NO: 2859700 - RNA, 14 nt, Mycobacterium avium subsp. paratuberculosis
gucgucgccgccgg

SEQ ID NO: 2859701 - RNA, 13 nt, Mycobacterium avium subsp. paratuberculosis
gucgucgccggcc

SEQ ID NO: 2859702 - RNA, 15 nt, Mycobacterium avium subsp. paratuberculosis
gucgucgccggccgc

SEQ ID NO: 2859703 - RNA, 18 nt, Mycobacterium avium subsp. paratuberculosis
gucgucgccgguggccgc

SEQ ID NO: 2859704 - RNA, 20 nt, Mycobacterium avium subsp. paratuberculosis
gucgucgccgguggccgccg

SEQ ID NO: 2859705 - RNA, 13 nt, Mycobacterium avium subsp. paratuberculosis
gucgucgcgcacc

SEQ ID NO: 2859706 - RNA, 16 nt, Mycobacterium avium subsp. paratuberculosis
gucgucgcguccagca

SEQ ID NO: 2859707 - RNA, 14 nt, Mycobacterium avium subsp. paratuberculosis
gucgucgcugacgc

SEQ ID NO: 2859708 - RNA, 17 nt, Mycobacterium avium subsp. paratuberculosis
gucgucgcuguccucga

SEQ ID NO: 2859709 - RNA, 17 nt, Mycobacterium avium subsp. paratuberculosis
gucgucggacaccagca

SEQ ID NO: 2859710 - RNA, 21 nt, Mycobacterium avium subsp. paratuberculosis
gucgucggacaccagcauggc

SEQ ID NO: 2859711 - RNA, 22 nt, Mycobacterium avium subsp. paratuberculosis
gucgucggacagcagcaccggc

SEQ ID NO: 2859712 - RNA, 22 nt, Mycobacterium avium subsp. paratuberculosis
gucgucggccaguucaccgcgc

SEQ ID NO: 2859713 - RNA, 15 nt, Mycobacterium avium subsp. paratuberculosis
gucgucggcccaguc

SEQ ID NO: 2859714 - RNA, 19 nt, Mycobacterium avium subsp. paratuberculosis
gucgucggcccaguccagu

SEQ ID NO: 2859715 - RNA, 23 nt, Mycobacterium avium subsp. paratuberculosis
gucgucggcccaguccagucgcg

SEQ ID NO: 2859716 - RNA, 23 nt, Mycobacterium avium subsp. paratuberculosis
gucgucggccgggccggcgguga

SEQ ID NO: 2859717 - RNA, 16 nt, Mycobacterium avium subsp. paratuberculosis
gucguguucgccgagg

SEQ ID NO: 2859718 - RNA, 16 nt, Mycobacterium avium subsp. paratuberculosis
gucguucagcugcagc

SEQ ID NO: 2859719 - RNA, 17 nt, Mycobacterium avium subsp. paratuberculosis
gucguucauucagcacc

SEQ ID NO: 2859720 - RNA, 14 nt, Mycobacterium avium subsp. paratuberculosis
gucguucuccaucc

SEQ ID NO: 2859721 - RNA, 16 nt, Mycobacterium avium subsp. paratuberculosis
gucguucucgggggcg

SEQ ID NO: 2859722 - RNA, 14 nt, Mycobacterium avium subsp. paratuberculosis
gucguugaacgcgc

SEQ ID NO: 2859723 - RNA, 16 nt, Mycobacterium avium subsp. paratuberculosis
gucguugaacgcgcgg

SEQ ID NO: 2859724 - RNA, 17 nt, Mycobacterium avium subsp. paratuberculosis
gucguugaaggccugca

SEQ ID NO: 2859725 - RNA, 20 nt, Mycobacterium avium subsp. paratuberculosis
gucguugaaggccugcagaa

SEQ ID NO: 2859726 - RNA, 20 nt, Mycobacterium avium subsp. paratuberculosis
gucguugacgcugggcggcg

SEQ ID NO: 2859727 - RNA, 20 nt, Mycobacterium avium subsp. paratuberculosis
gucguugagcaucaccauga

SEQ ID NO: 2859728 - RNA, 23 nt, Mycobacterium avium subsp. paratuberculosis
gucguugaucaggugcagcgugg

SEQ ID NO: 2859729 - RNA, 16 nt, Mycobacterium avium subsp. paratuberculosis
gucguugcacacccgg

SEQ ID NO: 2859730 - RNA, 17 nt, Mycobacterium avium subsp. paratuberculosis
gucguugcacacccggu

SEQ ID NO: 2859731 - RNA, 19 nt, Mycobacterium avium subsp. paratuberculosis
gucguugcacacccggugc

SEQ ID NO: 2859732 - RNA, 17 nt, Mycobacterium avium subsp. paratuberculosis
gucguugcccgccagca

SEQ ID NO: 2859733 - RNA, 13 nt, Mycobacterium avium subsp. paratuberculosis
gucguuggcccgc

SEQ ID NO: 2859734 - RNA, 18 nt, Mycobacterium avium subsp. paratuberculosis
gucguuggcccgccgcgg

SEQ ID NO: 2859735 - RNA, 14 nt, Mycobacterium avium subsp. paratuberculosis
gucguuggcggcgg

SEQ ID NO: 2859736 - RNA, 16 nt, Mycobacterium avium subsp. paratuberculosis
gucguuggugcgcacc

SEQ ID NO: 2859737 - RNA, 20 nt, Mycobacterium avium subsp. paratuberculosis
gucguuggugcgcaccagca

SEQ ID NO: 2859738 - RNA, 17 nt, Mycobacterium avium subsp. paratuberculosis
gucguugucgucgccgg

SEQ ID NO: 2859739 - RNA, 23 nt, Mycobacterium avium subsp. paratuberculosis
gucguugucgucgccggccgcgg

SEQ ID NO: 2859740 - RNA, 16 nt, Mycobacterium avium subsp. paratuberculosis
gucguugugggccagc

SEQ ID NO: 2859741 - RNA, 18 nt, Mycobacterium avium subsp. paratuberculosis
gucguugugggccagcgc

SEQ ID NO: 2859742 - RNA, 22 nt, Mycobacterium avium subsp. paratuberculosis
gucguuuuccagccggcgcacc

SEQ ID NO: 2859743 - RNA, 23 nt, Mycobacterium avium subsp. paratuberculosis
gucguuuuccagccggcgcacca

SEQ ID NO: 2859744 - RNA, 13 nt, Mycobacterium avium subsp. paratuberculosis
gucuacuccacca

SEQ ID NO: 2859745 - RNA, 19 nt, Mycobacterium avium subsp. paratuberculosis
gucuacuuggccagcugcg

SEQ ID NO: 2859746 - RNA, 16 nt, Mycobacterium avium subsp. paratuberculosis
gucuagccgccgagcg

SEQ ID NO: 2859747 - RNA, 13 nt, Mycobacterium avium subsp. paratuberculosis
gucuagcggcgug

SEQ ID NO: 2859748 - RNA, 16 nt, Mycobacterium avium subsp. paratuberculosis
gucucaaucuucuccg

SEQ ID NO: 2859749 - RNA, 17 nt, Mycobacterium avium subsp. paratuberculosis
gucucacgccucgucga

SEQ ID NO: 2859750 - RNA, 18 nt, Mycobacterium avium subsp. paratuberculosis
gucucagcgcccgcccgg

SEQ ID NO: 2859751 - RNA, 16 nt, Mycobacterium avium subsp. paratuberculosis
gucucagucggccacc

SEQ ID NO: 2859752 - RNA, 17 nt, Mycobacterium avium subsp. paratuberculosis
gucucagucggccaccg

SEQ ID NO: 2859753 - RNA, 19 nt, Mycobacterium avium subsp. paratuberculosis
gucucagucggccaccgcg

SEQ ID NO: 2859754 - RNA, 16 nt, Mycobacterium avium subsp. paratuberculosis
gucuccaugucgucgg

SEQ ID NO: 2859755 - RNA, 17 nt, Mycobacterium avium subsp. paratuberculosis
gucuccaugucgucggc

SEQ ID NO: 2859756 - RNA, 19 nt, Mycobacterium avium subsp. paratuberculosis
gucuccaugucgucggcgg

SEQ ID NO: 2859757 - RNA, 20 nt, Mycobacterium avium subsp. paratuberculosis
gucucccacgaacggguccu

SEQ ID NO: 2859758 - RNA, 18 nt, Mycobacterium avium subsp. paratuberculosis
gucucccagacgucgacc

SEQ ID NO: 2859759 - RNA, 13 nt, Mycobacterium avium subsp. paratuberculosis
gucucccgggcgg

SEQ ID NO: 2859760 - RNA, 14 nt, Mycobacterium avium subsp. paratuberculosis
gucucccgguccac

SEQ ID NO: 2859761 - RNA, 14 nt, Mycobacterium avium subsp. paratuberculosis
gucuccgcgcagcc

SEQ ID NO: 2859762 - RNA, 15 nt, Mycobacterium avium subsp. paratuberculosis
gucuccgcgcagcca

SEQ ID NO: 2859763 - RNA, 18 nt, Mycobacterium avium subsp. paratuberculosis
gucuccgcgcagccaggu

SEQ ID NO: 2859764 - RNA, 11 nt, Mycobacterium avium subsp. paratuberculosis
gucuccggccc

SEQ ID NO: 2859765 - RNA, 17 nt, Mycobacterium avium subsp. paratuberculosis
gucuccggccccgagcc

SEQ ID NO: 2859766 - RNA, 18 nt, Mycobacterium avium subsp. paratuberculosis
gucuccucgaccagcgcg

SEQ ID NO: 2859767 - RNA, 19 nt, Mycobacterium avium subsp. paratuberculosis
gucuccucgaccagcgcgc

SEQ ID NO: 2859768 - RNA, 23 nt, Mycobacterium avium subsp. paratuberculosis
gucuccucgaccagcgcgccgcc

SEQ ID NO: 2859769 - RNA, 14 nt, Mycobacterium avium subsp. paratuberculosis
gucuccucgaccgc

SEQ ID NO: 2859770 - RNA, 13 nt, Mycobacterium avium subsp. paratuberculosis
gucuccuggccgc

SEQ ID NO: 2859771 - RNA, 17 nt, Mycobacterium avium subsp. paratuberculosis
gucuccuggccgccgug

SEQ ID NO: 2859772 - RNA, 16 nt, Mycobacterium avium subsp. paratuberculosis
gucuccuggggcagau

SEQ ID NO: 2859773 - RNA, 15 nt, Mycobacterium avium subsp. paratuberculosis
gucucgaacacgccg

SEQ ID NO: 2859774 - RNA, 18 nt, Mycobacterium avium subsp. paratuberculosis
gucucgaacacgccgucg

SEQ ID NO: 2859775 - RNA, 19 nt, Mycobacterium avium subsp. paratuberculosis
gucucgacccgggccagca

SEQ ID NO: 2859776 - RNA, 20 nt, Mycobacterium avium subsp. paratuberculosis
gucucgacccgggccagcag

SEQ ID NO: 2859777 - RNA, 16 nt, Mycobacterium avium subsp. paratuberculosis
gucucgaccgcggcgc

SEQ ID NO: 2859778 - RNA, 17 nt, Mycobacterium avium subsp. paratuberculosis
gucucgaccgcggcgcc

SEQ ID NO: 2859779 - RNA, 18 nt, Mycobacterium avium subsp. paratuberculosis
gucucgaccgcggcgccg

SEQ ID NO: 2859780 - RNA, 22 nt, Mycobacterium avium subsp. paratuberculosis
gucucgaccgcggcgccgaugg

SEQ ID NO: 2859781 - RNA, 14 nt, Mycobacterium avium subsp. paratuberculosis
gucucgaccgcggu

SEQ ID NO: 2859782 - RNA, 17 nt, Mycobacterium avium subsp. paratuberculosis
gucucgacggcgccgac

SEQ ID NO: 2859783 - RNA, 16 nt, Mycobacterium avium subsp. paratuberculosis
gucucgagccggcgca

SEQ ID NO: 2859784 - RNA, 17 nt, Mycobacterium avium subsp. paratuberculosis
gucucgagccggcgcac

SEQ ID NO: 2859785 - RNA, 18 nt, Mycobacterium avium subsp. paratuberculosis
gucucgagcuuccgccga

SEQ ID NO: 2859786 - RNA, 16 nt, Mycobacterium avium subsp. paratuberculosis
gucucgaucuccaucc

SEQ ID NO: 2859787 - RNA, 19 nt, Mycobacterium avium subsp. paratuberculosis
gucucgaucugcaccagcg

SEQ ID NO: 2859788 - RNA, 21 nt, Mycobacterium avium subsp. paratuberculosis
gucucgaucugcaccagcgcg

SEQ ID NO: 2859789 - RNA, 16 nt, Mycobacterium avium subsp. paratuberculosis
gucucgaugaccucgc

SEQ ID NO: 2859790 - RNA, 23 nt, Mycobacterium avium subsp. paratuberculosis
gucucgaugcacggucggccccg

SEQ ID NO: 2859791 - RNA, 16 nt, Mycobacterium avium subsp. paratuberculosis
gucucgcaccugccgu

SEQ ID NO: 2859792 - RNA, 19 nt, Mycobacterium avium subsp. paratuberculosis
gucucgcaccugccgucga

SEQ ID NO: 2859793 - RNA, 15 nt, Mycobacterium avium subsp. paratuberculosis
gucucgcccaccuug

SEQ ID NO: 2859794 - RNA, 16 nt, Mycobacterium avium subsp. paratuberculosis
gucucgccccggccgu

SEQ ID NO: 2859795 - RNA, 19 nt, Mycobacterium avium subsp. paratuberculosis
gucucgccccggccguucu

SEQ ID NO: 2859796 - RNA, 13 nt, Mycobacterium avium subsp. paratuberculosis
gucucgccgaucu

SEQ ID NO: 2859797 - RNA, 18 nt, Mycobacterium avium subsp. paratuberculosis
gucucgccggggaacacc

SEQ ID NO: 2859798 - RNA, 13 nt, Mycobacterium avium subsp. paratuberculosis
gucucgcgcaccu

SEQ ID NO: 2859799 - RNA, 12 nt, Mycobacterium avium subsp. paratuberculosis
gucucgcgcagc

SEQ ID NO: 2859800 - RNA, 14 nt, Mycobacterium avium subsp. paratuberculosis
gucucgcgcagcac

SEQ ID NO: 2859801 - RNA, 18 nt, Mycobacterium avium subsp. paratuberculosis
gucucgcgggaguggccg

SEQ ID NO: 2859802 - RNA, 19 nt, Mycobacterium avium subsp. paratuberculosis
gucuucggccaucgacucc

SEQ ID NO: 2859803 - RNA, 23 nt, Mycobacterium avium subsp. paratuberculosis
gucuucggggauguagccgccgg

SEQ ID NO: 2859804 - RNA, 15 nt, Mycobacterium avium subsp. paratuberculosis
gucuucggggccgcc

SEQ ID NO: 2859805 - RNA, 16 nt, Mycobacterium avium subsp. paratuberculosis
gucuucggggccgccg

SEQ ID NO: 2859806 - RNA, 18 nt, Mycobacterium avium subsp. paratuberculosis
gucuucggggccgccguc

SEQ ID NO: 2859807 - RNA, 18 nt, Mycobacterium avium subsp. paratuberculosis
gucuucggucccggcggg

SEQ ID NO: 2859808 - RNA, 20 nt, Mycobacterium avium subsp. paratuberculosis
gucuucggucgcgacccggu

SEQ ID NO: 2859809 - RNA, 23 nt, Mycobacterium avium subsp. paratuberculosis
gucuucggucgcgacccggucca

SEQ ID NO: 2859810 - RNA, 22 nt, Mycobacterium avium subsp. paratuberculosis
gucuucggugaagucaacgcac

SEQ ID NO: 2859811 - RNA, 14 nt, Mycobacterium avium subsp. paratuberculosis
gucuucucggccag

SEQ ID NO: 2859812 - RNA, 21 nt, Mycobacterium avium subsp. paratuberculosis
gucuucucggccaggcucacg

SEQ ID NO: 2859813 - RNA, 20 nt, Mycobacterium avium subsp. paratuberculosis
gucuucucguccgcgcuggc

SEQ ID NO: 2859814 - RNA, 18 nt, Mycobacterium avium subsp. paratuberculosis
gucuucuucagccgcagc

SEQ ID NO: 2859815 - RNA, 13 nt, Mycobacterium avium subsp. paratuberculosis
gucuucuuggccg

SEQ ID NO: 2859816 - RNA, 18 nt, Mycobacterium avium subsp. paratuberculosis
gucuucuuggcgggcgac

SEQ ID NO: 2859817 - RNA, 19 nt, Mycobacterium avium subsp. paratuberculosis
gucuucuuggcgggcgacu

SEQ ID NO: 2859818 - RNA, 16 nt, Mycobacterium avium subsp. paratuberculosis
gucuugaccgcccggg

SEQ ID NO: 2859819 - RNA, 16 nt, Mycobacterium avium subsp. paratuberculosis
gucuugaucucggcgg

SEQ ID NO: 2859820 - RNA, 13 nt, Mycobacterium avium subsp. paratuberculosis
gucuugcagccgg

SEQ ID NO: 2859821 - RNA, 17 nt, Mycobacterium avium subsp. paratuberculosis
gucuugcggcccaaccg

SEQ ID NO: 2859822 - RNA, 21 nt, Mycobacterium avium subsp. paratuberculosis
gucuuggaaagcgcuugucgc

SEQ ID NO: 2859823 - RNA, 16 nt, Mycobacterium avium subsp. paratuberculosis
gucuuggacagcagca

SEQ ID NO: 2859824 - RNA, 15 nt, Mycobacterium avium subsp. paratuberculosis
gucuuggacgcccgc

SEQ ID NO: 2859825 - RNA, 16 nt, Mycobacterium avium subsp. paratuberculosis
gucuuggacgcccggu

SEQ ID NO: 2859826 - RNA, 22 nt, Mycobacterium avium subsp. paratuberculosis
gucuuggacgcccggucgacca

SEQ ID NO: 2859827 - RNA, 13 nt, Mycobacterium avium subsp. paratuberculosis
gucuuggccaggc

SEQ ID NO: 2859828 - RNA, 14 nt, Mycobacterium avium subsp. paratuberculosis
gucuuggccaggcc

SEQ ID NO: 2859829 - RNA, 13 nt, Mycobacterium avium subsp. paratuberculosis
gucuugggcgcga

SEQ ID NO: 2859830 - RNA, 14 nt, Mycobacterium avium subsp. paratuberculosis
gucuugggcucggc

SEQ ID NO: 2859831 - RNA, 16 nt, Mycobacterium avium subsp. paratuberculosis
gucuuggucucgccga

SEQ ID NO: 2859832 - RNA, 21 nt, Mycobacterium avium subsp. paratuberculosis
gucuuggugcgagccaccucg

SEQ ID NO: 2859833 - RNA, 17 nt, Mycobacterium avium subsp. paratuberculosis
gucuuucaucgccccgg

SEQ ID NO: 2859834 - RNA, 18 nt, Mycobacterium avium subsp. paratuberculosis
gucuuucgucgcuuggua

SEQ ID NO: 2859835 - RNA, 19 nt, Mycobacterium avium subsp. paratuberculosis
gucuuugccaucccggugg

SEQ ID NO: 2859836 - RNA, 23 nt, Mycobacterium avium subsp. paratuberculosis
gucuuuuuauuuguuguuuuugg

SEQ ID NO: 2859837 - RNA, 20 nt, Mycobacterium avium subsp. paratuberculosis
gugaaacauggcgcccgcgu

SEQ ID NO: 2859838 - RNA, 15 nt, Mycobacterium avium subsp. paratuberculosis
gugaaacuagcuuca

SEQ ID NO: 2859839 - RNA, 21 nt, Mycobacterium avium subsp. paratuberculosis
gugaaacuagcuucacggucg

SEQ ID NO: 2859840 - RNA, 22 nt, Mycobacterium avium subsp. paratuberculosis
gugaaaucguggcuuucggcgc

SEQ ID NO: 2859841 - RNA, 22 nt, Mycobacterium avium subsp. paratuberculosis
gugaacaccgcguuggccgcca

SEQ ID NO: 2859842 - RNA, 13 nt, Mycobacterium avium subsp. paratuberculosis
gugaacagcagcc

SEQ ID NO: 2859843 - RNA, 16 nt, Mycobacterium avium subsp. paratuberculosis
gugaacagcgcccggc

SEQ ID NO: 2859844 - RNA, 14 nt, Mycobacterium avium subsp. paratuberculosis
gugaacagguaggc

SEQ ID NO: 2859845 - RNA, 17 nt, Mycobacterium avium subsp. paratuberculosis
gugaacccugggcggcg

SEQ ID NO: 2859846 - RNA, 14 nt, Mycobacterium avium subsp. paratuberculosis
gugaacgccgguga

SEQ ID NO: 2859847 - RNA, 16 nt, Mycobacterium avium subsp. paratuberculosis
gugaacgccggugagg

SEQ ID NO: 2859848 - RNA, 22 nt, Mycobacterium avium subsp. paratuberculosis
gugaacgccucgggccggcagc

SEQ ID NO: 2859849 - RNA, 16 nt, Mycobacterium avium subsp. paratuberculosis
gugaacgccugcggga

SEQ ID NO: 2859850 - RNA, 19 nt, Mycobacterium avium subsp. paratuberculosis
gugaacgcgguaccgauga

SEQ ID NO: 2859851 - RNA, 20 nt, Mycobacterium avium subsp. paratuberculosis
gugaacgcgucggucagcgg

SEQ ID NO: 2859852 - RNA, 17 nt, Mycobacterium avium subsp. paratuberculosis
gugaacucguccaugcu

SEQ ID NO: 2859853 - RNA, 13 nt, Mycobacterium avium subsp. paratuberculosis
gugaagaucagcg

SEQ ID NO: 2859854 - RNA, 15 nt, Mycobacterium avium subsp. paratuberculosis
gugaagaucagcgcg

SEQ ID NO: 2859855 - RNA, 20 nt, Mycobacterium avium subsp. paratuberculosis
gugaagaucagcgcgucggu

SEQ ID NO: 2859856 - RNA, 16 nt, Mycobacterium avium subsp. paratuberculosis
gugaagaucgacgcca

SEQ ID NO: 2859857 - RNA, 14 nt, Mycobacterium avium subsp. paratuberculosis
gugaagcagaacgc

SEQ ID NO: 2859858 - RNA, 15 nt, Mycobacterium avium subsp. paratuberculosis
gugaagcccagcgcg

SEQ ID NO: 2859859 - RNA, 16 nt, Mycobacterium avium subsp. paratuberculosis
gugaagcccagcgcgu

SEQ ID NO: 2859860 - RNA, 16 nt, Mycobacterium avium subsp. paratuberculosis
gugaagccgacgccgu

SEQ ID NO: 2859861 - RNA, 22 nt, Mycobacterium avium subsp. paratuberculosis
gugaagccguagacggucaggu

SEQ ID NO: 2859862 - RNA, 13 nt, Mycobacterium avium subsp. paratuberculosis
gugaagcggcgcg

SEQ ID NO: 2859863 - RNA, 14 nt, Mycobacterium avium subsp. paratuberculosis
gugaagcggcgcgg

SEQ ID NO: 2859864 - RNA, 14 nt, Mycobacterium avium subsp. paratuberculosis
gugaagcuagcuuc

SEQ ID NO: 2859865 - RNA, 23 nt, Mycobacterium avium subsp. paratuberculosis
gugaagcuagcuucacgcucggc

SEQ ID NO: 2859866 - RNA, 20 nt, Mycobacterium avium subsp. paratuberculosis
gugaagcuaguuucacguuc

SEQ ID NO: 2859867 - RNA, 21 nt, Mycobacterium avium subsp. paratuberculosis
gugaagcuaguuucacguucg

SEQ ID NO: 2859868 - RNA, 14 nt, Mycobacterium avium subsp. paratuberculosis
gugaagcugccgac

SEQ ID NO: 2859869 - RNA, 19 nt, Mycobacterium avium subsp. paratuberculosis
gugaaggccuggaugccgc

SEQ ID NO: 2859870 - RNA, 16 nt, Mycobacterium avium subsp. paratuberculosis
gugaaggcggccaccg

SEQ ID NO: 2859871 - RNA, 19 nt, Mycobacterium avium subsp. paratuberculosis
gugaaggcggccaccgcgg

SEQ ID NO: 2859872 - RNA, 22 nt, Mycobacterium avium subsp. paratuberculosis
gugaagggcccgccgguggccg

SEQ ID NO: 2859873 - RNA, 23 nt, Mycobacterium avium subsp. paratuberculosis
gugaagggguccggaagcccuug

SEQ ID NO: 2859874 - RNA, 22 nt, Mycobacterium avium subsp. paratuberculosis
gugaagguccgguaggcguugu

SEQ ID NO: 2859875 - RNA, 16 nt, Mycobacterium avium subsp. paratuberculosis
gugaaggugcccuccu

SEQ ID NO: 2859876 - RNA, 22 nt, Mycobacterium avium subsp. paratuberculosis
gugaaguccaugaacggcagcu

SEQ ID NO: 2859877 - RNA, 20 nt, Mycobacterium avium subsp. paratuberculosis
gugaaguccgagacgucggc

SEQ ID NO: 2859878 - RNA, 19 nt, Mycobacterium avium subsp. paratuberculosis
gugaagucggugcccagcg

SEQ ID NO: 2859879 - RNA, 20 nt, Mycobacterium avium subsp. paratuberculosis
gugaagucguccagcgucga

SEQ ID NO: 2859880 - RNA, 13 nt, Mycobacterium avium subsp. paratuberculosis
gugaagugccggc

SEQ ID NO: 2859881 - RNA, 13 nt, Mycobacterium avium subsp. paratuberculosis
gugaagugccggu

SEQ ID NO: 2859882 - RNA, 18 nt, Mycobacterium avium subsp. paratuberculosis
gugaagugccgguccagc

SEQ ID NO: 2859883 - RNA, 21 nt, Mycobacterium avium subsp. paratuberculosis
gugaagugccgguccagccgc

SEQ ID NO: 2859884 - RNA, 16 nt, Mycobacterium avium subsp. paratuberculosis
gugaaguuaguuucac

SEQ ID NO: 2859885 - RNA, 18 nt, Mycobacterium avium subsp. paratuberculosis
gugaaguucuccagcacg

SEQ ID NO: 2859886 - RNA, 19 nt, Mycobacterium avium subsp. paratuberculosis
gugaccucgagcaccggcg

SEQ ID NO: 2859887 - RNA, 20 nt, Mycobacterium avium subsp. paratuberculosis
gugaccucgagcaccggcgg

SEQ ID NO: 2859888 - RNA, 19 nt, Mycobacterium avium subsp. paratuberculosis
gugaccucgagcagcgcgc

SEQ ID NO: 2859889 - RNA, 15 nt, Mycobacterium avium subsp. paratuberculosis
gugaccugcagcgcc

SEQ ID NO: 2859890 - RNA, 19 nt, Mycobacterium avium subsp. paratuberculosis
gugaccugcugggcgggca

SEQ ID NO: 2859891 - RNA, 14 nt, Mycobacterium avium subsp. paratuberculosis
gugaccuugcgggc

SEQ ID NO: 2859892 - RNA, 22 nt, Mycobacterium avium subsp. paratuberculosis
gugacgaaaugcaacgcacggg

SEQ ID NO: 2859893 - RNA, 24 nt, Mycobacterium avium subsp. paratuberculosis
gugacgaaaugcaacgcacgggcg

SEQ ID NO: 2859894 - RNA, 20 nt, Mycobacterium avium subsp. paratuberculosis
gugacgaacccgccgcggcc

SEQ ID NO: 2859895 - RNA, 22 nt, Mycobacterium avium subsp. paratuberculosis
gugacgaacccgccgcggccga

SEQ ID NO: 2859896 - RNA, 14 nt, Mycobacterium avium subsp. paratuberculosis
gugacgaccggcag

SEQ ID NO: 2859897 - RNA, 15 nt, Mycobacterium avium subsp. paratuberculosis
gugacgaccggcagc

SEQ ID NO: 2859898 - RNA, 19 nt, Mycobacterium avium subsp. paratuberculosis
gugacgaccuggucgccgc

SEQ ID NO: 2859899 - RNA, 20 nt, Mycobacterium avium subsp. paratuberculosis
gugacgaccuggucgccgcc

SEQ ID NO: 2859900 - RNA, 22 nt, Mycobacterium avium subsp. paratuberculosis
gugacgaggagggugucggcgg

SEQ ID NO: 2859901 - RNA, 16 nt, Mycobacterium avium subsp. paratuberculosis
gugacgaggcccacga

SEQ ID NO: 2859902 - RNA, 18 nt, Mycobacterium avium subsp. paratuberculosis
gugacgaucaccgcugcc

SEQ ID NO: 2859903 - RNA, 13 nt, Mycobacterium avium subsp. paratuberculosis
gugacgauccaca

SEQ ID NO: 2859904 - RNA, 20 nt, Mycobacterium avium subsp. paratuberculosis
gugacgauccggucgaugaa

SEQ ID NO: 2859905 - RNA, 18 nt, Mycobacterium avium subsp. paratuberculosis
gugacgaugaugucggcc

SEQ ID NO: 2859906 - RNA, 21 nt, Mycobacterium avium subsp. paratuberculosis
gugacgaugcugagcagauca

SEQ ID NO: 2859907 - RNA, 23 nt, Mycobacterium avium subsp. paratuberculosis
gugacgaugucgaugacggcggc

SEQ ID NO: 2859908 - RNA, 12 nt, Mycobacterium avium subsp. paratuberculosis
gugacgcccggc

SEQ ID NO: 2859909 - RNA, 13 nt, Mycobacterium avium subsp. paratuberculosis
gugacgcccggcg

SEQ ID NO: 2859910 - RNA, 14 nt, Mycobacterium avium subsp. paratuberculosis
gugacgcccggcgc

SEQ ID NO: 2859911 - RNA, 19 nt, Mycobacterium avium subsp. paratuberculosis
gugacgcccgucccgccga

SEQ ID NO: 2859912 - RNA, 20 nt, Mycobacterium avium subsp. paratuberculosis
gugacgcccgucccgccgac

SEQ ID NO: 2859913 - RNA, 21 nt, Mycobacterium avium subsp. paratuberculosis
gugacgcccuuguccucgagc

SEQ ID NO: 2859914 - RNA, 21 nt, Mycobacterium avium subsp. paratuberculosis
gugacgccgacguaggacagc

SEQ ID NO: 2859915 - RNA, 20 nt, Mycobacterium avium subsp. paratuberculosis
gugacgccgauccgcugcgg

SEQ ID NO: 2859916 - RNA, 21 nt, Mycobacterium avium subsp. paratuberculosis
gugacgccgauccgcugcgga

SEQ ID NO: 2859917 - RNA, 14 nt, Mycobacterium avium subsp. paratuberculosis
gugacgccgcucgg

SEQ ID NO: 2859918 - RNA, 19 nt, Mycobacterium avium subsp. paratuberculosis
gugacgccgcucggccagc

SEQ ID NO: 2859919 - RNA, 23 nt, Mycobacterium avium subsp. paratuberculosis
gugacgccgcucggccagcgcag

SEQ ID NO: 2859920 - RNA, 18 nt, Mycobacterium avium subsp. paratuberculosis
gugacgccgggccgccgc

SEQ ID NO: 2859921 - RNA, 20 nt, Mycobacterium avium subsp. paratuberculosis
gugacgccgggccgccgcgg

SEQ ID NO: 2859922 - RNA, 14 nt, Mycobacterium avium subsp. paratuberculosis
gugacgccugcggc

SEQ ID NO: 2859923 - RNA, 17 nt, Mycobacterium avium subsp. paratuberculosis
gugacgccugcggccca

SEQ ID NO: 2859924 - RNA, 13 nt, Mycobacterium avium subsp. paratuberculosis
gugacgcgccggc

SEQ ID NO: 2859925 - RNA, 16 nt, Mycobacterium avium subsp. paratuberculosis
gugacgcgccggccca

SEQ ID NO: 2859926 - RNA, 16 nt, Mycobacterium avium subsp. paratuberculosis
gugacgcgcgugacgg

SEQ ID NO: 2859927 - RNA, 11 nt, Mycobacterium avium subsp. paratuberculosis
gugacgcggcg

SEQ ID NO: 2859928 - RNA, 19 nt, Mycobacterium avium subsp. paratuberculosis
gugacgcggcgucgggcgg

SEQ ID NO: 2859929 - RNA, 16 nt, Mycobacterium avium subsp. paratuberculosis
gugacgcucgccggcg

SEQ ID NO: 2859930 - RNA, 17 nt, Mycobacterium avium subsp. paratuberculosis
gugacgcucgccggcgg

SEQ ID NO: 2859931 - RNA, 18 nt, Mycobacterium avium subsp. paratuberculosis
gugacgcucgccggcggc

SEQ ID NO: 2859932 - RNA, 21 nt, Mycobacterium avium subsp. paratuberculosis
gugacgcucgccggcggccgc

SEQ ID NO: 2859933 - RNA, 15 nt, Mycobacterium avium subsp. paratuberculosis
gugacgcucgcgguu

SEQ ID NO: 2859934 - RNA, 14 nt, Mycobacterium avium subsp. paratuberculosis
gugacgcucggcgc

SEQ ID NO: 2859935 - RNA, 16 nt, Mycobacterium avium subsp. paratuberculosis
gugacgcucggcgccg

SEQ ID NO: 2859936 - RNA, 18 nt, Mycobacterium avium subsp. paratuberculosis
gugacgcucggcgccgcg

SEQ ID NO: 2859937 - RNA, 19 nt, Mycobacterium avium subsp. paratuberculosis
gugacgcucggcgccggcc

SEQ ID NO: 2859938 - RNA, 20 nt, Mycobacterium avium subsp. paratuberculosis
gugacgcucggcgccggccg

SEQ ID NO: 2859939 - RNA, 15 nt, Mycobacterium avium subsp. paratuberculosis
gugacgcucggcgcg

SEQ ID NO: 2859940 - RNA, 23 nt, Mycobacterium avium subsp. paratuberculosis
gugacgcucggcgcgucguccga

SEQ ID NO: 2859941 - RNA, 16 nt, Mycobacterium avium subsp. paratuberculosis
gugacgcucggcggcc

SEQ ID NO: 2859942 - RNA, 18 nt, Mycobacterium avium subsp. paratuberculosis
gugacgcucggcggccga

SEQ ID NO: 2859943 - RNA, 17 nt, Mycobacterium avium subsp. paratuberculosis
gugacgcugaagaucga

SEQ ID NO: 2859944 - RNA, 23 nt, Mycobacterium avium subsp. paratuberculosis
gugacgcuugggguuuggcgacg

SEQ ID NO: 2859945 - RNA, 21 nt, Mycobacterium avium subsp. paratuberculosis
gugacggaguuggaucgccgc

SEQ ID NO: 2859946 - RNA, 22 nt, Mycobacterium avium subsp. paratuberculosis
gugacggaguuggaucgccgca

SEQ ID NO: 2859947 - RNA, 15 nt, Mycobacterium avium subsp. paratuberculosis
gugacggauccgggc

SEQ ID NO: 2859948 - RNA, 16 nt, Mycobacterium avium subsp. paratuberculosis
gugacggauccgggcg

SEQ ID NO: 2859949 - RNA, 21 nt, Mycobacterium avium subsp. paratuberculosis
gugacggauccgggcgccggu

SEQ ID NO: 2859950 - RNA, 17 nt, Mycobacterium avium subsp. paratuberculosis
gugacggauguggucgg

SEQ ID NO: 2859951 - RNA, 19 nt, Mycobacterium avium subsp. paratuberculosis
gugacggauguggucggcc

SEQ ID NO: 2859952 - RNA, 20 nt, Mycobacterium avium subsp. paratuberculosis
gugacggauguggucggcca

SEQ ID NO: 2859953 - RNA, 22 nt, Mycobacterium avium subsp. paratuberculosis
gugacggauguggucggccacg

SEQ ID NO: 2859954 - RNA, 23 nt, Mycobacterium avium subsp. paratuberculosis
gugacggauguggucggccacga

SEQ ID NO: 2859955 - RNA, 13 nt, Mycobacterium avium subsp. paratuberculosis
gugacggccguga

SEQ ID NO: 2859956 - RNA, 15 nt, Mycobacterium avium subsp. paratuberculosis
gugacggccgugaug

SEQ ID NO: 2859957 - RNA, 18 nt, Mycobacterium avium subsp. paratuberculosis
gugacggccgugaugccg

SEQ ID NO: 2859958 - RNA, 22 nt, Mycobacterium avium subsp. paratuberculosis
gugacggccucccacucgucga

SEQ ID NO: 2859959 - RNA, 14 nt, Mycobacterium avium subsp. paratuberculosis
gugacggcggggcg

SEQ ID NO: 2859960 - RNA, 16 nt, Mycobacterium avium subsp. paratuberculosis
gugacggcggggcgga

SEQ ID NO: 2859961 - RNA, 13 nt, Mycobacterium avium subsp. paratuberculosis
gugacggcgucgg

SEQ ID NO: 2859962 - RNA, 14 nt, Mycobacterium avium subsp. paratuberculosis
gugacggcgucggc

SEQ ID NO: 2859963 - RNA, 14 nt, Mycobacterium avium subsp. paratuberculosis
gugacgggcgucgg

SEQ ID NO: 2859964 - RNA, 17 nt, Mycobacterium avium subsp. paratuberculosis
gugacgggcgucggcgg

SEQ ID NO: 2859965 - RNA, 20 nt, Mycobacterium avium subsp. paratuberculosis
gugacggguuggucggcgcg

SEQ ID NO: 2859966 - RNA, 22 nt, Mycobacterium avium subsp. paratuberculosis
gugacggucaugccgagccgcu

SEQ ID NO: 2859967 - RNA, 14 nt, Mycobacterium avium subsp. paratuberculosis
gugacggucgaccu

SEQ ID NO: 2859968 - RNA, 16 nt, Mycobacterium avium subsp. paratuberculosis
gugacggugccgccgu

SEQ ID NO: 2859969 - RNA, 17 nt, Mycobacterium avium subsp. paratuberculosis
gugacggugccgccgug

SEQ ID NO: 2859970 - RNA, 15 nt, Mycobacterium avium subsp. paratuberculosis
gugaucgccgcccac

SEQ ID NO: 2859971 - RNA, 16 nt, Mycobacterium avium subsp. paratuberculosis
gugaucgccgcggacc

SEQ ID NO: 2859972 - RNA, 20 nt, Mycobacterium avium subsp. paratuberculosis
gugaucgccggaucgccgag

SEQ ID NO: 2859973 - RNA, 14 nt, Mycobacterium avium subsp. paratuberculosis
gugaucgcggccca

SEQ ID NO: 2859974 - RNA, 15 nt, Mycobacterium avium subsp. paratuberculosis
gugaucgcggcccac

SEQ ID NO: 2859975 - RNA, 16 nt, Mycobacterium avium subsp. paratuberculosis
gugaucgcggcccacc

SEQ ID NO: 2859976 - RNA, 15 nt, Mycobacterium avium subsp. paratuberculosis
gugaucgcggcccgc

SEQ ID NO: 2859977 - RNA, 16 nt, Mycobacterium avium subsp. paratuberculosis
gugaucgcggcccgcg

SEQ ID NO: 2859978 - RNA, 22 nt, Mycobacterium avium subsp. paratuberculosis
gugaucgcggcgcugccgccgg

SEQ ID NO: 2859979 - RNA, 17 nt, Mycobacterium avium subsp. paratuberculosis
gugaucgcggcggcgua

SEQ ID NO: 2859980 - RNA, 15 nt, Mycobacterium avium subsp. paratuberculosis
gugaucgcugacgcc

SEQ ID NO: 2859981 - RNA, 15 nt, Mycobacterium avium subsp. paratuberculosis
gugaucggccaggcg

SEQ ID NO: 2859982 - RNA, 16 nt, Mycobacterium avium subsp. paratuberculosis
gugaucggccaggcgc

SEQ ID NO: 2859983 - RNA, 21 nt, Mycobacterium avium subsp. paratuberculosis
gugaucggccaggcgcccagc

SEQ ID NO: 2859984 - RNA, 14 nt, Mycobacterium avium subsp. paratuberculosis
gugaucggccuuca

SEQ ID NO: 2859985 - RNA, 13 nt, Mycobacterium avium subsp. paratuberculosis
gugaucggcggaa

SEQ ID NO: 2859986 - RNA, 14 nt, Mycobacterium avium subsp. paratuberculosis
gugaucggcggcca

SEQ ID NO: 2859987 - RNA, 15 nt, Mycobacterium avium subsp. paratuberculosis
gugaucggcggccac

SEQ ID NO: 2859988 - RNA, 22 nt, Mycobacterium avium subsp. paratuberculosis
gugaucggcggccaccagccgg

SEQ ID NO: 2859989 - RNA, 19 nt, Mycobacterium avium subsp. paratuberculosis
gugaucggucugccuggcg

SEQ ID NO: 2859990 - RNA, 15 nt, Mycobacterium avium subsp. paratuberculosis
gugaucggugcccgc

SEQ ID NO: 2859991 - RNA, 17 nt, Mycobacterium avium subsp. paratuberculosis
gugaucggugcccgcgg

SEQ ID NO: 2859992 - RNA, 15 nt, Mycobacterium avium subsp. paratuberculosis
gugaucucaccggcg

SEQ ID NO: 2859993 - RNA, 21 nt, Mycobacterium avium subsp. paratuberculosis
gugaucucaccggcggcggcc

SEQ ID NO: 2859994 - RNA, 17 nt, Mycobacterium avium subsp. paratuberculosis
gugaucucgccgcggug

SEQ ID NO: 2859995 - RNA, 16 nt, Mycobacterium avium subsp. paratuberculosis
gugaucucgucggcgg

SEQ ID NO: 2859996 - RNA, 13 nt, Mycobacterium avium subsp. paratuberculosis
gugaucugcacca

SEQ ID NO: 2859997 - RNA, 21 nt, Mycobacterium avium subsp. paratuberculosis
gugaucugcaccagcguggug

SEQ ID NO: 2859998 - RNA, 22 nt, Mycobacterium avium subsp. paratuberculosis
gugaucugcaccagcguggugc

SEQ ID NO: 2859999 - RNA, 15 nt, Mycobacterium avium subsp. paratuberculosis
gugaucuggucggcc

SEQ ID NO: 2860000 - RNA, 18 nt, Mycobacterium avium subsp. paratuberculosis
gugaucuguucggcggcg

SEQ ID NO: 2860001 - RNA, 15 nt, Mycobacterium avium subsp. paratuberculosis
gugaucuugcccagc

SEQ ID NO: 2860002 - RNA, 22 nt, Mycobacterium avium subsp. paratuberculosis
gugaucuuguuguuggugccgc

SEQ ID NO: 2860003 - RNA, 14 nt, Mycobacterium avium subsp. paratuberculosis
gugaugaacgcgcc

SEQ ID NO: 2860004 - RNA, 22 nt, Mycobacterium avium subsp. paratuberculosis
gugaugaacgcgccgucgucgg

SEQ ID NO: 2860005 - RNA, 23 nt, Mycobacterium avium subsp. paratuberculosis
gugaugaaucgucccgucgacca

SEQ ID NO: 2860006 - RNA, 15 nt, Mycobacterium avium subsp. paratuberculosis
gugaugaccagggcc

SEQ ID NO: 2860007 - RNA, 14 nt, Mycobacterium avium subsp. paratuberculosis
gugaugacggcggc

SEQ ID NO: 2860008 - RNA, 14 nt, Mycobacterium avium subsp. paratuberculosis
gugaugacguuggu

SEQ ID NO: 2860009 - RNA, 15 nt, Mycobacterium avium subsp. paratuberculosis
gugaugaggucgcga

SEQ ID NO: 2860010 - RNA, 22 nt, Mycobacterium avium subsp. paratuberculosis
gugaugaggucgcgaccgccgg

SEQ ID NO: 2860011 - RNA, 14 nt, Mycobacterium avium subsp. paratuberculosis
gugaugcagcugaa

SEQ ID NO: 2860012 - RNA, 17 nt, Mycobacterium avium subsp. paratuberculosis
gugaugccgagcgccgc

SEQ ID NO: 2860013 - RNA, 20 nt, Mycobacterium avium subsp. paratuberculosis
gugaugccgaguuccugcga

SEQ ID NO: 2860014 - RNA, 22 nt, Mycobacterium avium subsp. paratuberculosis
gugaugccggacuugaugcugc

SEQ ID NO: 2860015 - RNA, 15 nt, Mycobacterium avium subsp. paratuberculosis
gugaugccggcaucc

SEQ ID NO: 2860016 - RNA, 14 nt, Mycobacterium avium subsp. paratuberculosis
gugaugccggccag

SEQ ID NO: 2860017 - RNA, 19 nt, Mycobacterium avium subsp. paratuberculosis
gugaugccguggucggcga

SEQ ID NO: 2860018 - RNA, 13 nt, Mycobacterium avium subsp. paratuberculosis
gugaugcgcgccg

SEQ ID NO: 2860019 - RNA, 14 nt, Mycobacterium avium subsp. paratuberculosis
gugaugcgcggcga

SEQ ID NO: 2860020 - RNA, 20 nt, Mycobacterium avium subsp. paratuberculosis
gugaugcggaugcccgccgg

SEQ ID NO: 2860021 - RNA, 14 nt, Mycobacterium avium subsp. paratuberculosis
gugaugcggucggc

SEQ ID NO: 2860022 - RNA, 15 nt, Mycobacterium avium subsp. paratuberculosis
gugaugcggucggcg

SEQ ID NO: 2860023 - RNA, 16 nt, Mycobacterium avium subsp. paratuberculosis
gugaugcggucggcgc

SEQ ID NO: 2860024 - RNA, 16 nt, Mycobacterium avium subsp. paratuberculosis
gugauggacggggcga

SEQ ID NO: 2860025 - RNA, 16 nt, Mycobacterium avium subsp. paratuberculosis
gugauggccgccgcag

SEQ ID NO: 2860026 - RNA, 23 nt, Mycobacterium avium subsp. paratuberculosis
gugauggccgccgcaggcgaagg

SEQ ID NO: 2860027 - RNA, 21 nt, Mycobacterium avium subsp. paratuberculosis
gugauggcgaaccagcgcccg

SEQ ID NO: 2860028 - RNA, 18 nt, Mycobacterium avium subsp. paratuberculosis
gugaugggcagcgccccg

SEQ ID NO: 2860029 - RNA, 23 nt, Mycobacterium avium subsp. paratuberculosis
gugauggucucccgggcggucgc

SEQ ID NO: 2860030 - RNA, 16 nt, Mycobacterium avium subsp. paratuberculosis
gugaugucgccggcgg

SEQ ID NO: 2860031 - RNA, 19 nt, Mycobacterium avium subsp. paratuberculosis
gugaugucgccggcggcga

SEQ ID NO: 2860032 - RNA, 13 nt, Mycobacterium avium subsp. paratuberculosis
gugaugucgcugc

SEQ ID NO: 2860033 - RNA, 19 nt, Mycobacterium avium subsp. paratuberculosis
gugaugucgcugccgccgc

SEQ ID NO: 2860034 - RNA, 14 nt, Mycobacterium avium subsp. paratuberculosis
gugaugugcaggac

SEQ ID NO: 2860035 - RNA, 14 nt, Mycobacterium avium subsp. paratuberculosis
gugaugugcggcgc

SEQ ID NO: 2860036 - RNA, 16 nt, Mycobacterium avium subsp. paratuberculosis
gugaugugcggcgcgg

SEQ ID NO: 2860037 - RNA, 19 nt, Mycobacterium avium subsp. paratuberculosis
gugaugugcggcgcggcgg

SEQ ID NO: 2860038 - RNA, 20 nt, Mycobacterium avium subsp. paratuberculosis
gugauguuggccgcgacgcc

SEQ ID NO: 2860039 - RNA, 21 nt, Mycobacterium avium subsp. paratuberculosis
gugauuccggcacccgccagc

SEQ ID NO: 2860040 - RNA, 13 nt, Mycobacterium avium subsp. paratuberculosis
gugauucgaagaa

SEQ ID NO: 2860041 - RNA, 18 nt, Mycobacterium avium subsp. paratuberculosis
gugauucgaagaacacgc

SEQ ID NO: 2860042 - RNA, 13 nt, Mycobacterium avium subsp. paratuberculosis
gugauucgcgcgg

SEQ ID NO: 2860043 - RNA, 24 nt, Mycobacterium avium subsp. paratuberculosis
gugauucgggucagaccgcggcgg

SEQ ID NO: 2860044 - RNA, 22 nt, Mycobacterium avium subsp. paratuberculosis
gugauucgugcagugcgaucgc

SEQ ID NO: 2860045 - RNA, 14 nt, Mycobacterium avium subsp. paratuberculosis
gugcaacacauggu

SEQ ID NO: 2860046 - RNA, 17 nt, Mycobacterium avium subsp. paratuberculosis
gugcaacaccgaaagcc

SEQ ID NO: 2860047 - RNA, 16 nt, Mycobacterium avium subsp. paratuberculosis
gugcaacacucgagcg

SEQ ID NO: 2860048 - RNA, 20 nt, Mycobacterium avium subsp. paratuberculosis
gugcaacacucgagcgcgcu

SEQ ID NO: 2860049 - RNA, 21 nt, Mycobacterium avium subsp. paratuberculosis
gugcaacacucgagcgcgcuc

SEQ ID NO: 2860050 - RNA, 17 nt, Mycobacterium avium subsp. paratuberculosis
gugcaacgugaugccgu

SEQ ID NO: 2860051 - RNA, 23 nt, Mycobacterium avium subsp. paratuberculosis
gugcaacgugaugccguggucgg

SEQ ID NO: 2860052 - RNA, 15 nt, Mycobacterium avium subsp. paratuberculosis
gugcaacuaccgacg

SEQ ID NO: 2860053 - RNA, 16 nt, Mycobacterium avium subsp. paratuberculosis
gugcaacuggcaacgc

SEQ ID NO: 2860054 - RNA, 14 nt, Mycobacterium avium subsp. paratuberculosis
gugcaagcucgcca

SEQ ID NO: 2860055 - RNA, 16 nt, Mycobacterium avium subsp. paratuberculosis
gugcagcagcucggcg

SEQ ID NO: 2860056 - RNA, 13 nt, Mycobacterium avium subsp. paratuberculosis
gugcagcagcugg

SEQ ID NO: 2860057 - RNA, 14 nt, Mycobacterium avium subsp. paratuberculosis
gugcagcagggcgc

SEQ ID NO: 2860058 - RNA, 20 nt, Mycobacterium avium subsp. paratuberculosis
gugcagccacccgucgguga

SEQ ID NO: 2860059 - RNA, 22 nt, Mycobacterium avium subsp. paratuberculosis
gugcagccgcaaggugauucgc

SEQ ID NO: 2860060 - RNA, 16 nt, Mycobacterium avium subsp. paratuberculosis
gugcagccggcggcgc

SEQ ID NO: 2860061 - RNA, 13 nt, Mycobacterium avium subsp. paratuberculosis
gugcagccgggcc

SEQ ID NO: 2860062 - RNA, 19 nt, Mycobacterium avium subsp. paratuberculosis
gugcagccgggcggcgccg

SEQ ID NO: 2860063 - RNA, 17 nt, Mycobacterium avium subsp. paratuberculosis
gugcagccgggggcggu

SEQ ID NO: 2860064 - RNA, 21 nt, Mycobacterium avium subsp. paratuberculosis
gugcagccgggggcggugcag

SEQ ID NO: 2860065 - RNA, 20 nt, Mycobacterium avium subsp. paratuberculosis
gugcagcgacucguuggccg

SEQ ID NO: 2860066 - RNA, 13 nt, Mycobacterium avium subsp. paratuberculosis
gugcagcgccagc

SEQ ID NO: 2860067 - RNA, 15 nt, Mycobacterium avium subsp. paratuberculosis
gugcagcgccagcac

SEQ ID NO: 2860068 - RNA, 23 nt, Mycobacterium avium subsp. paratuberculosis
gugcagcgccagcaccgggccca

SEQ ID NO: 2860069 - RNA, 14 nt, Mycobacterium avium subsp. paratuberculosis
gugcagcgcccagc

SEQ ID NO: 2860070 - RNA, 23 nt, Mycobacterium avium subsp. paratuberculosis
gugcagcgcccagccgagccggg

SEQ ID NO: 2860071 - RNA, 17 nt, Mycobacterium avium subsp. paratuberculosis
gugcagcgcggcgauga

SEQ ID NO: 2860072 - RNA, 19 nt, Mycobacterium avium subsp. paratuberculosis
gugcagcgugguccagcac

SEQ ID NO: 2860073 - RNA, 20 nt, Mycobacterium avium subsp. paratuberculosis
gugcagcgugguccagcacg

SEQ ID NO: 2860074 - RNA, 19 nt, Mycobacterium avium subsp. paratuberculosis
gugcaggaccuugucgggc

SEQ ID NO: 2860075 - RNA, 15 nt, Mycobacterium avium subsp. paratuberculosis
gugcaggauccgcuc

SEQ ID NO: 2860076 - RNA, 19 nt, Mycobacterium avium subsp. paratuberculosis
gugcaggauccgcucgacg

SEQ ID NO: 2860077 - RNA, 14 nt, Mycobacterium avium subsp. paratuberculosis
gugcaggaucggcu

SEQ ID NO: 2860078 - RNA, 21 nt, Mycobacterium avium subsp. paratuberculosis
gugcaggaugaccgcgucggc

SEQ ID NO: 2860079 - RNA, 23 nt, Mycobacterium avium subsp. paratuberculosis
gugcaggaugaccgcgucggcgc

SEQ ID NO: 2860080 - RNA, 14 nt, Mycobacterium avium subsp. paratuberculosis
gugcaggcagccgu

SEQ ID NO: 2860081 - RNA, 17 nt, Mycobacterium avium subsp. paratuberculosis
gugcaggcccgggcggc

SEQ ID NO: 2860082 - RNA, 19 nt, Mycobacterium avium subsp. paratuberculosis
gugcaggcccgggcggcga

SEQ ID NO: 2860083 - RNA, 20 nt, Mycobacterium avium subsp. paratuberculosis
gugcaggccgaacaccguca

SEQ ID NO: 2860084 - RNA, 14 nt, Mycobacterium avium subsp. paratuberculosis
gugcaggccgcgac

SEQ ID NO: 2860085 - RNA, 15 nt, Mycobacterium avium subsp. paratuberculosis
gugcaggccgcgacg

SEQ ID NO: 2860086 - RNA, 22 nt, Mycobacterium avium subsp. paratuberculosis
gugcaggccgcggguggcgcca

SEQ ID NO: 2860087 - RNA, 21 nt, Mycobacterium avium subsp. paratuberculosis
gugcaggcugacgcgaccgcg

SEQ ID NO: 2860088 - RNA, 18 nt, Mycobacterium avium subsp. paratuberculosis
gugcaggguguuggacga

SEQ ID NO: 2860089 - RNA, 20 nt, Mycobacterium avium subsp. paratuberculosis
gugcaggugcccgucggccu

SEQ ID NO: 2860090 - RNA, 18 nt, Mycobacterium avium subsp. paratuberculosis
gugcagguuccggaucaa

SEQ ID NO: 2860091 - RNA, 17 nt, Mycobacterium avium subsp. paratuberculosis
gugcaguacgcaucggc

SEQ ID NO: 2860092 - RNA, 19 nt, Mycobacterium avium subsp. paratuberculosis
gugcaguacgcaucggcgc

SEQ ID NO: 2860093 - RNA, 20 nt, Mycobacterium avium subsp. paratuberculosis
gugcaguacgcaucggcgcc

SEQ ID NO: 2860094 - RNA, 21 nt, Mycobacterium avium subsp. paratuberculosis
gugcaguacgcaucggcgccg

SEQ ID NO: 2860095 - RNA, 19 nt, Mycobacterium avium subsp. paratuberculosis
gugcagucggucggucagc

SEQ ID NO: 2860096 - RNA, 17 nt, Mycobacterium avium subsp. paratuberculosis
gugcagugcgaucgccg

SEQ ID NO: 2860097 - RNA, 20 nt, Mycobacterium avium subsp. paratuberculosis
gugcaguucgaugccgauga

SEQ ID NO: 2860098 - RNA, 18 nt, Mycobacterium avium subsp. paratuberculosis
gugcauagcuggcgccga

SEQ ID NO: 2860099 - RNA, 20 nt, Mycobacterium avium subsp. paratuberculosis
gugcauccagccguccagcc

SEQ ID NO: 2860100 - RNA, 17 nt, Mycobacterium avium subsp. paratuberculosis
gugcauccagucggcgc

SEQ ID NO: 2860101 - RNA, 20 nt, Mycobacterium avium subsp. paratuberculosis
gugcaucgccaccgucgucg

SEQ ID NO: 2860102 - RNA, 21 nt, Mycobacterium avium subsp. paratuberculosis
gugcaucgccaccgucgucga

SEQ ID NO: 2860103 - RNA, 16 nt, Mycobacterium avium subsp. paratuberculosis
gugcaucggcgccugc

SEQ ID NO: 2860104 - RNA, 15 nt, Mycobacterium avium subsp. paratuberculosis
gugcaugcgcuggcg

SEQ ID NO: 2860105 - RNA, 20 nt, Mycobacterium avium subsp. paratuberculosis
gugcauguagcggucguaga

SEQ ID NO: 2860106 - RNA, 18 nt, Mycobacterium avium subsp. paratuberculosis
gugcaugugcucggcgag

SEQ ID NO: 2860107 - RNA, 19 nt, Mycobacterium avium subsp. paratuberculosis
gugcauguggccgucgccg

SEQ ID NO: 2860108 - RNA, 21 nt, Mycobacterium avium subsp. paratuberculosis
gugcauguggccgucgccgaa

SEQ ID NO: 2860109 - RNA, 21 nt, Mycobacterium avium subsp. paratuberculosis
gugccaagcgguuccagaccg

SEQ ID NO: 2860110 - RNA, 17 nt, Mycobacterium avium subsp. paratuberculosis
gugccaaggucgccggu

SEQ ID NO: 2860111 - RNA, 18 nt, Mycobacterium avium subsp. paratuberculosis
gugccaaggucgccggug

SEQ ID NO: 2860112 - RNA, 19 nt, Mycobacterium avium subsp. paratuberculosis
gugccaaugaaauucaggc

SEQ ID NO: 2860113 - RNA, 14 nt, Mycobacterium avium subsp. paratuberculosis
gugccacaggccga

SEQ ID NO: 2860114 - RNA, 15 nt, Mycobacterium avium subsp. paratuberculosis
gugccacaggccgaa

SEQ ID NO: 2860115 - RNA, 16 nt, Mycobacterium avium subsp. paratuberculosis
gugccaccgccgaugg

SEQ ID NO: 2860116 - RNA, 15 nt, Mycobacterium avium subsp. paratuberculosis
gugccaccgcugggc

SEQ ID NO: 2860117 - RNA, 16 nt, Mycobacterium avium subsp. paratuberculosis
gugccaccgcugggcg

SEQ ID NO: 2860118 - RNA, 17 nt, Mycobacterium avium subsp. paratuberculosis
gugccacgaugaugccc

SEQ ID NO: 2860119 - RNA, 20 nt, Mycobacterium avium subsp. paratuberculosis
gugccacggccgcggcccgg

SEQ ID NO: 2860120 - RNA, 21 nt, Mycobacterium avium subsp. paratuberculosis
gugccacggccgcggcccggc

SEQ ID NO: 2860121 - RNA, 22 nt, Mycobacterium avium subsp. paratuberculosis
gugccacggccgcggcccggcc

SEQ ID NO: 2860122 - RNA, 16 nt, Mycobacterium avium subsp. paratuberculosis
gugccacggucaggcg

SEQ ID NO: 2860123 - RNA, 20 nt, Mycobacterium avium subsp. paratuberculosis
gugccacggucaggcgcagc

SEQ ID NO: 2860124 - RNA, 13 nt, Mycobacterium avium subsp. paratuberculosis
gugccacuggcgc

SEQ ID NO: 2860125 - RNA, 19 nt, Mycobacterium avium subsp. paratuberculosis
gugccacuucgacggcagc

SEQ ID NO: 2860126 - RNA, 22 nt, Mycobacterium avium subsp. paratuberculosis
gugccagcccguuguggcggcc

SEQ ID NO: 2860127 - RNA, 16 nt, Mycobacterium avium subsp. paratuberculosis
gugccagccgugcggc

SEQ ID NO: 2860128 - RNA, 16 nt, Mycobacterium avium subsp. paratuberculosis
gugccaguaccagcgg

SEQ ID NO: 2860129 - RNA, 22 nt, Mycobacterium avium subsp. paratuberculosis
gugccaucgugggcgccgucgc

SEQ ID NO: 2860130 - RNA, 18 nt, Mycobacterium avium subsp. paratuberculosis
gugcccaauagcacccgc

SEQ ID NO: 2860131 - RNA, 13 nt, Mycobacterium avium subsp. paratuberculosis
gugcccaccagca

SEQ ID NO: 2860132 - RNA, 14 nt, Mycobacterium avium subsp. paratuberculosis
gugcccaccagccg

SEQ ID NO: 2860133 - RNA, 15 nt, Mycobacterium avium subsp. paratuberculosis
gugcccaccagccgg

SEQ ID NO: 2860134 - RNA, 13 nt, Mycobacterium avium subsp. paratuberculosis
gugcccaccgggc

SEQ ID NO: 2860135 - RNA, 20 nt, Mycobacterium avium subsp. paratuberculosis
gugcccaccgggcagccgca

SEQ ID NO: 2860136 - RNA, 13 nt, Mycobacterium avium subsp. paratuberculosis
gugcccagcacga

SEQ ID NO: 2860137 - RNA, 19 nt, Mycobacterium avium subsp. paratuberculosis
gugcccagcacgacgccgc

SEQ ID NO: 2860138 - RNA, 22 nt, Mycobacterium avium subsp. paratuberculosis
gugcccagccaggccgccgggc

SEQ ID NO: 2860139 - RNA, 22 nt, Mycobacterium avium subsp. paratuberculosis
gugccgauccgcaccggacgca

SEQ ID NO: 2860140 - RNA, 15 nt, Mycobacterium avium subsp. paratuberculosis
gugccgaugccggcc

SEQ ID NO: 2860141 - RNA, 17 nt, Mycobacterium avium subsp. paratuberculosis
gugccgaugccggccug

SEQ ID NO: 2860142 - RNA, 13 nt, Mycobacterium avium subsp. paratuberculosis
gugccgauggcca

SEQ ID NO: 2860143 - RNA, 18 nt, Mycobacterium avium subsp. paratuberculosis
gugccgauguaggacagg

SEQ ID NO: 2860144 - RNA, 17 nt, Mycobacterium avium subsp. paratuberculosis
gugccgauuccagcaac

SEQ ID NO: 2860145 - RNA, 15 nt, Mycobacterium avium subsp. paratuberculosis
gugccgcaccagcac

SEQ ID NO: 2860146 - RNA, 17 nt, Mycobacterium avium subsp. paratuberculosis
gugccgcaccagcaccc

SEQ ID NO: 2860147 - RNA, 23 nt, Mycobacterium avium subsp. paratuberculosis
gugccgcaccagcaccccgccgc

SEQ ID NO: 2860148 - RNA, 16 nt, Mycobacterium avium subsp. paratuberculosis
gugccgcacccgaucc

SEQ ID NO: 2860149 - RNA, 14 nt, Mycobacterium avium subsp. paratuberculosis
gugccgcaccuggu

SEQ ID NO: 2860150 - RNA, 14 nt, Mycobacterium avium subsp. paratuberculosis
gugccgcagcggcg

SEQ ID NO: 2860151 - RNA, 16 nt, Mycobacterium avium subsp. paratuberculosis
gugccgcagcggcggc

SEQ ID NO: 2860152 - RNA, 12 nt, Mycobacterium avium subsp. paratuberculosis
gugccgcaggcg

SEQ ID NO: 2860153 - RNA, 16 nt, Mycobacterium avium subsp. paratuberculosis
gugccgcaggcgaaca

SEQ ID NO: 2860154 - RNA, 14 nt, Mycobacterium avium subsp. paratuberculosis
gugccgcagguggu

SEQ ID NO: 2860155 - RNA, 15 nt, Mycobacterium avium subsp. paratuberculosis
gugccgcagugccgg

SEQ ID NO: 2860156 - RNA, 19 nt, Mycobacterium avium subsp. paratuberculosis
gugccgccauacccacaau

SEQ ID NO: 2860157 - RNA, 20 nt, Mycobacterium avium subsp. paratuberculosis
gugccgcccaacgacgucgg

SEQ ID NO: 2860158 - RNA, 18 nt, Mycobacterium avium subsp. paratuberculosis
gugccgcccggaccgcgg

SEQ ID NO: 2860159 - RNA, 13 nt, Mycobacterium avium subsp. paratuberculosis
gugccgcccgucg

SEQ ID NO: 2860160 - RNA, 15 nt, Mycobacterium avium subsp. paratuberculosis
gugccgcccgucgcc

SEQ ID NO: 2860161 - RNA, 20 nt, Mycobacterium avium subsp. paratuberculosis
gugccgccgaugacggcgcg

SEQ ID NO: 2860162 - RNA, 15 nt, Mycobacterium avium subsp. paratuberculosis
gugccgccggcgauc

SEQ ID NO: 2860163 - RNA, 15 nt, Mycobacterium avium subsp. paratuberculosis
gugccgccgggcacc

SEQ ID NO: 2860164 - RNA, 22 nt, Mycobacterium avium subsp. paratuberculosis
gugccgccgggcaccucggcgu

SEQ ID NO: 2860165 - RNA, 19 nt, Mycobacterium avium subsp. paratuberculosis
gugccgccggggacccgca

SEQ ID NO: 2860166 - RNA, 13 nt, Mycobacterium avium subsp. paratuberculosis
gugccgccgguga

SEQ ID NO: 2860167 - RNA, 18 nt, Mycobacterium avium subsp. paratuberculosis
gugccgcgaugcccgccg

SEQ ID NO: 2860168 - RNA, 15 nt, Mycobacterium avium subsp. paratuberculosis
gugccgcgcaccacc

SEQ ID NO: 2860169 - RNA, 13 nt, Mycobacterium avium subsp. paratuberculosis
gugccgcgcagca

SEQ ID NO: 2860170 - RNA, 15 nt, Mycobacterium avium subsp. paratuberculosis
gugccgcgcagcacc

SEQ ID NO: 2860171 - RNA, 21 nt, Mycobacterium avium subsp. paratuberculosis
gugccgcgccaacgaggcacg

SEQ ID NO: 2860172 - RNA, 13 nt, Mycobacterium avium subsp. paratuberculosis
gugccgcgcggca

SEQ ID NO: 2860173 - RNA, 13 nt, Mycobacterium avium subsp. paratuberculosis
gugccgcggcggc

SEQ ID NO: 2860174 - RNA, 14 nt, Mycobacterium avium subsp. paratuberculosis
gugccgcggcggcg

SEQ ID NO: 2860175 - RNA, 18 nt, Mycobacterium avium subsp. paratuberculosis
gugccgcggcggcgccga

SEQ ID NO: 2860176 - RNA, 13 nt, Mycobacterium avium subsp. paratuberculosis
gugccgcgggucg

SEQ ID NO: 2860177 - RNA, 15 nt, Mycobacterium avium subsp. paratuberculosis
gugccgcgguugaac

SEQ ID NO: 2860178 - RNA, 23 nt, Mycobacterium avium subsp. paratuberculosis
gugccgcgguugaacaggcugcc

SEQ ID NO: 2860179 - RNA, 19 nt, Mycobacterium avium subsp. paratuberculosis
gugccgcguuccccggcgu

SEQ ID NO: 2860180 - RNA, 20 nt, Mycobacterium avium subsp. paratuberculosis
gugccgcuccggucgcgucg

SEQ ID NO: 2860181 - RNA, 20 nt, Mycobacterium avium subsp. paratuberculosis
gugccgcugacggucgccga

SEQ ID NO: 2860182 - RNA, 18 nt, Mycobacterium avium subsp. paratuberculosis
gugccgcugcauccgcag

SEQ ID NO: 2860183 - RNA, 19 nt, Mycobacterium avium subsp. paratuberculosis
gugccgcugcauccgcagc

SEQ ID NO: 2860184 - RNA, 17 nt, Mycobacterium avium subsp. paratuberculosis
gugccgcugcccgccgc

SEQ ID NO: 2860185 - RNA, 19 nt, Mycobacterium avium subsp. paratuberculosis
gugccgcugguaggcggcg

SEQ ID NO: 2860186 - RNA, 15 nt, Mycobacterium avium subsp. paratuberculosis
gugccggaagcggcg

SEQ ID NO: 2860187 - RNA, 16 nt, Mycobacterium avium subsp. paratuberculosis
gugccggaagcggcgg

SEQ ID NO: 2860188 - RNA, 20 nt, Mycobacterium avium subsp. paratuberculosis
gugccggaaguucucgccgu

SEQ ID NO: 2860189 - RNA, 21 nt, Mycobacterium avium subsp. paratuberculosis
gugccggaaguucucgccgug

SEQ ID NO: 2860190 - RNA, 22 nt, Mycobacterium avium subsp. paratuberculosis
gugccggaaguucucgccgugc

SEQ ID NO: 2860191 - RNA, 17 nt, Mycobacterium avium subsp. paratuberculosis
gugccggaauugaagaa

SEQ ID NO: 2860192 - RNA, 15 nt, Mycobacterium avium subsp. paratuberculosis
gugccggacaccggc

SEQ ID NO: 2860193 - RNA, 19 nt, Mycobacterium avium subsp. paratuberculosis
gugccggaugcggucgaug

SEQ ID NO: 2860194 - RNA, 13 nt, Mycobacterium avium subsp. paratuberculosis
gugccggccaccg

SEQ ID NO: 2860195 - RNA, 15 nt, Mycobacterium avium subsp. paratuberculosis
gugccggccaccggc

SEQ ID NO: 2860196 - RNA, 17 nt, Mycobacterium avium subsp. paratuberculosis
gugccggccaccggcgc

SEQ ID NO: 2860197 - RNA, 18 nt, Mycobacterium avium subsp. paratuberculosis
gugccggccaccggcgcg

SEQ ID NO: 2860198 - RNA, 22 nt, Mycobacterium avium subsp. paratuberculosis
gugccggccagaucgacgccgc

SEQ ID NO: 2860199 - RNA, 13 nt, Mycobacterium avium subsp. paratuberculosis
gugccggccagcu

SEQ ID NO: 2860200 - RNA, 16 nt, Mycobacterium avium subsp. paratuberculosis
gugccggccagcucgc

SEQ ID NO: 2860201 - RNA, 18 nt, Mycobacterium avium subsp. paratuberculosis
gugccggccagcucgccg

SEQ ID NO: 2860202 - RNA, 19 nt, Mycobacterium avium subsp. paratuberculosis
gugccggccagcucgccgc

SEQ ID NO: 2860203 - RNA, 22 nt, Mycobacterium avium subsp. paratuberculosis
gugccggccagcucgccgccga

SEQ ID NO: 2860204 - RNA, 13 nt, Mycobacterium avium subsp. paratuberculosis
gugccggcccagu

SEQ ID NO: 2860205 - RNA, 12 nt, Mycobacterium avium subsp. paratuberculosis
gugccggccggu

SEQ ID NO: 2860206 - RNA, 15 nt, Mycobacterium avium subsp. paratuberculosis
gugccggccucgucg

SEQ ID NO: 2860207 - RNA, 19 nt, Mycobacterium avium subsp. paratuberculosis
gugccggccucgucggcga

SEQ ID NO: 2860208 - RNA, 20 nt, Mycobacterium avium subsp. paratuberculosis
gugccggccucgucggcgag

SEQ ID NO: 2860209 - RNA, 22 nt, Mycobacterium avium subsp. paratuberculosis
gugccggccucgucggcgagca

SEQ ID NO: 2860210 - RNA, 13 nt, Mycobacterium avium subsp. paratuberculosis
gugccggcgaacc

SEQ ID NO: 2860211 - RNA, 19 nt, Mycobacterium avium subsp. paratuberculosis
gugccggcgaugguggcgc

SEQ ID NO: 2860212 - RNA, 15 nt, Mycobacterium avium subsp. paratuberculosis
gugccggcgcaccgc

SEQ ID NO: 2860213 - RNA, 16 nt, Mycobacterium avium subsp. paratuberculosis
gugccggcgcaccgcg

SEQ ID NO: 2860214 - RNA, 19 nt, Mycobacterium avium subsp. paratuberculosis
gugccggcgcucgucgucg

SEQ ID NO: 2860215 - RNA, 20 nt, Mycobacterium avium subsp. paratuberculosis
gugccggcgcucgucgucgc

SEQ ID NO: 2860216 - RNA, 13 nt, Mycobacterium avium subsp. paratuberculosis
gugccggcggcgc

SEQ ID NO: 2860217 - RNA, 15 nt, Mycobacterium avium subsp. paratuberculosis
gugccggcggcgcgg

SEQ ID NO: 2860218 - RNA, 14 nt, Mycobacterium avium subsp. paratuberculosis
gugccggcggguca

SEQ ID NO: 2860219 - RNA, 19 nt, Mycobacterium avium subsp. paratuberculosis
gugccggcgggucagcagc

SEQ ID NO: 2860220 - RNA, 20 nt, Mycobacterium avium subsp. paratuberculosis
gugccggcgggucagcagcg

SEQ ID NO: 2860221 - RNA, 16 nt, Mycobacterium avium subsp. paratuberculosis
gugccggcucggcggc

SEQ ID NO: 2860222 - RNA, 20 nt, Mycobacterium avium subsp. paratuberculosis
gugccggcugaaccugcugg

SEQ ID NO: 2860223 - RNA, 14 nt, Mycobacterium avium subsp. paratuberculosis
gugccgggccagcu

SEQ ID NO: 2860224 - RNA, 18 nt, Mycobacterium avium subsp. paratuberculosis
gugcgccaggcaggcggc

SEQ ID NO: 2860225 - RNA, 22 nt, Mycobacterium avium subsp. paratuberculosis
gugcgccaguugcucgggugac

SEQ ID NO: 2860226 - RNA, 21 nt, Mycobacterium avium subsp. paratuberculosis
gugcgcccagguacuccucgg

SEQ ID NO: 2860227 - RNA, 16 nt, Mycobacterium avium subsp. paratuberculosis
gugcgcccauccggcg

SEQ ID NO: 2860228 - RNA, 18 nt, Mycobacterium avium subsp. paratuberculosis
gugcgcccauccggcgcc

SEQ ID NO: 2860229 - RNA, 21 nt, Mycobacterium avium subsp. paratuberculosis
gugcgcccauccggcgccgcg

SEQ ID NO: 2860230 - RNA, 22 nt, Mycobacterium avium subsp. paratuberculosis
gugcgcccauccggcgccgcgc

SEQ ID NO: 2860231 - RNA, 17 nt, Mycobacterium avium subsp. paratuberculosis
gugcgccccacggcgcg

SEQ ID NO: 2860232 - RNA, 13 nt, Mycobacterium avium subsp. paratuberculosis
gugcgccccgccc

SEQ ID NO: 2860233 - RNA, 16 nt, Mycobacterium avium subsp. paratuberculosis
gugcgcccggccagcc

SEQ ID NO: 2860234 - RNA, 16 nt, Mycobacterium avium subsp. paratuberculosis
gugcgccgacagcuga

SEQ ID NO: 2860235 - RNA, 20 nt, Mycobacterium avium subsp. paratuberculosis
gugcgccgcauuggugccgg

SEQ ID NO: 2860236 - RNA, 13 nt, Mycobacterium avium subsp. paratuberculosis
gugcgccgcccac

SEQ ID NO: 2860237 - RNA, 15 nt, Mycobacterium avium subsp. paratuberculosis
gugcgccgcccacac

SEQ ID NO: 2860238 - RNA, 17 nt, Mycobacterium avium subsp. paratuberculosis
gugcgccgcccacaccg

SEQ ID NO: 2860239 - RNA, 20 nt, Mycobacterium avium subsp. paratuberculosis
gugcgccgcccacaccgaca

SEQ ID NO: 2860240 - RNA, 12 nt, Mycobacterium avium subsp. paratuberculosis
gugcgccgcggc

SEQ ID NO: 2860241 - RNA, 13 nt, Mycobacterium avium subsp. paratuberculosis
gugcgccgcggcg

SEQ ID NO: 2860242 - RNA, 21 nt, Mycobacterium avium subsp. paratuberculosis
gugcgccgcggcggcucggcg

SEQ ID NO: 2860243 - RNA, 22 nt, Mycobacterium avium subsp. paratuberculosis
gugcgccgcggcggcucggcgg

SEQ ID NO: 2860244 - RNA, 16 nt, Mycobacterium avium subsp. paratuberculosis
gugcgccgcucgucgg

SEQ ID NO: 2860245 - RNA, 18 nt, Mycobacterium avium subsp. paratuberculosis
gugcgccggcagcggccg

SEQ ID NO: 2860246 - RNA, 19 nt, Mycobacterium avium subsp. paratuberculosis
gugcgccggcagcggccgc

SEQ ID NO: 2860247 - RNA, 10 nt, Mycobacterium avium subsp. paratuberculosis
gugcgccggg

SEQ ID NO: 2860248 - RNA, 13 nt, Mycobacterium avium subsp. paratuberculosis
gugcgccgggucg

SEQ ID NO: 2860249 - RNA, 17 nt, Mycobacterium avium subsp. paratuberculosis
gugcgccgggucgcggu

SEQ ID NO: 2860250 - RNA, 17 nt, Mycobacterium avium subsp. paratuberculosis
gugcgccgugcagcacg

SEQ ID NO: 2860251 - RNA, 21 nt, Mycobacterium avium subsp. paratuberculosis
gugcgccgugcagcacgccgc

SEQ ID NO: 2860252 - RNA, 20 nt, Mycobacterium avium subsp. paratuberculosis
gugcgccuugucgauggucg

SEQ ID NO: 2860253 - RNA, 17 nt, Mycobacterium avium subsp. paratuberculosis
gugcgcgaagcuggggu

SEQ ID NO: 2860254 - RNA, 23 nt, Mycobacterium avium subsp. paratuberculosis
gugcgcgacgaauugcagaucca

SEQ ID NO: 2860255 - RNA, 20 nt, Mycobacterium avium subsp. paratuberculosis
gugcgcgagauggcgaucag

SEQ ID NO: 2860256 - RNA, 13 nt, Mycobacterium avium subsp. paratuberculosis
gugcgcgauggcg

SEQ ID NO: 2860257 - RNA, 16 nt, Mycobacterium avium subsp. paratuberculosis
gugcgcgauggcgugc

SEQ ID NO: 2860258 - RNA, 20 nt, Mycobacterium avium subsp. paratuberculosis
gugcgcgauggcgugccggc

SEQ ID NO: 2860259 - RNA, 13 nt, Mycobacterium avium subsp. paratuberculosis
gugcgcgcaccag

SEQ ID NO: 2860260 - RNA, 15 nt, Mycobacterium avium subsp. paratuberculosis
gugcgcgcaccaggc

SEQ ID NO: 2860261 - RNA, 17 nt, Mycobacterium avium subsp. paratuberculosis
gugcgcgcaccaggccg

SEQ ID NO: 2860262 - RNA, 13 nt, Mycobacterium avium subsp. paratuberculosis
gugcgcgccgacc

SEQ ID NO: 2860263 - RNA, 15 nt, Mycobacterium avium subsp. paratuberculosis
gugcgcgccggcguc

SEQ ID NO: 2860264 - RNA, 16 nt, Mycobacterium avium subsp. paratuberculosis
gugcgcgccggcgucg

SEQ ID NO: 2860265 - RNA, 21 nt, Mycobacterium avium subsp. paratuberculosis
gugcgcgccggcgucgguguc

SEQ ID NO: 2860266 - RNA, 14 nt, Mycobacterium avium subsp. paratuberculosis
gugcgcgcgcaccu

SEQ ID NO: 2860267 - RNA, 14 nt, Mycobacterium avium subsp. paratuberculosis
gugcgcgcgcgcuc

SEQ ID NO: 2860268 - RNA, 13 nt, Mycobacterium avium subsp. paratuberculosis
gugcgcgcuggcc

SEQ ID NO: 2860269 - RNA, 20 nt, Mycobacterium avium subsp. paratuberculosis
gugcgcggcgaaggcauccc

SEQ ID NO: 2860270 - RNA, 23 nt, Mycobacterium avium subsp. paratuberculosis
gugcgcggcgaccaccucggcga

SEQ ID NO: 2860271 - RNA, 12 nt, Mycobacterium avium subsp. paratuberculosis
gugcgcggcgcg

SEQ ID NO: 2860272 - RNA, 13 nt, Mycobacterium avium subsp. paratuberculosis
gugcgcggcgucc

SEQ ID NO: 2860273 - RNA, 17 nt, Mycobacterium avium subsp. paratuberculosis
gugcgcggcguccucga

SEQ ID NO: 2860274 - RNA, 20 nt, Mycobacterium avium subsp. paratuberculosis
gugcgcggcguccucgauga

SEQ ID NO: 2860275 - RNA, 15 nt, Mycobacterium avium subsp. paratuberculosis
gugcgcggcuggccg

SEQ ID NO: 2860276 - RNA, 21 nt, Mycobacterium avium subsp. paratuberculosis
gugcgcggcuggccgucgucg

SEQ ID NO: 2860277 - RNA, 22 nt, Mycobacterium avium subsp. paratuberculosis
gugcgcggcuggccgucgucga

SEQ ID NO: 2860278 - RNA, 15 nt, Mycobacterium avium subsp. paratuberculosis
gugcgcgggguggcg

SEQ ID NO: 2860279 - RNA, 17 nt, Mycobacterium avium subsp. paratuberculosis
gugcgcgucagccgucg

SEQ ID NO: 2860280 - RNA, 13 nt, Mycobacterium avium subsp. paratuberculosis
gugcgcgucgaca

SEQ ID NO: 2860281 - RNA, 17 nt, Mycobacterium avium subsp. paratuberculosis
gugcgcguggggcgucg

SEQ ID NO: 2860282 - RNA, 23 nt, Mycobacterium avium subsp. paratuberculosis
gugcgcguggggcgucgccgccc

SEQ ID NO: 2860283 - RNA, 13 nt, Mycobacterium avium subsp. paratuberculosis
gugcgcucaccgc

SEQ ID NO: 2860284 - RNA, 14 nt, Mycobacterium avium subsp. paratuberculosis
gugcgcucaccgca

SEQ ID NO: 2860285 - RNA, 12 nt, Mycobacterium avium subsp. paratuberculosis
gugcgcucgacc

SEQ ID NO: 2860286 - RNA, 20 nt, Mycobacterium avium subsp. paratuberculosis
gugcgcucgaccucggcggc

SEQ ID NO: 2860287 - RNA, 22 nt, Mycobacterium avium subsp. paratuberculosis
gugcgcucgaccucggcggcca

SEQ ID NO: 2860288 - RNA, 18 nt, Mycobacterium avium subsp. paratuberculosis
gugcgcucgacggccugc

SEQ ID NO: 2860289 - RNA, 19 nt, Mycobacterium avium subsp. paratuberculosis
gugcgcuguggugacggcc

SEQ ID NO: 2860290 - RNA, 15 nt, Mycobacterium avium subsp. paratuberculosis
gugcgcuugucggcg

SEQ ID NO: 2860291 - RNA, 17 nt, Mycobacterium avium subsp. paratuberculosis
gugcgcuugucggcgug

SEQ ID NO: 2860292 - RNA, 21 nt, Mycobacterium avium subsp. paratuberculosis
gugcgcuugucggcguggccg

SEQ ID NO: 2860293 - RNA, 15 nt, Mycobacterium avium subsp. paratuberculosis
gugcggaaaagucgg

SEQ ID NO: 2860294 - RNA, 16 nt, Mycobacterium avium subsp. paratuberculosis
gugcggaacaccgccu

SEQ ID NO: 2860295 - RNA, 20 nt, Mycobacterium avium subsp. paratuberculosis
gugcggaacaccgccuugcc

SEQ ID NO: 2860296 - RNA, 20 nt, Mycobacterium avium subsp. paratuberculosis
gugcggacccguugggccag

SEQ ID NO: 2860297 - RNA, 21 nt, Mycobacterium avium subsp. paratuberculosis
gugcggacccguugggccaga

SEQ ID NO: 2860298 - RNA, 20 nt, Mycobacterium avium subsp. paratuberculosis
gugcggaugaagugcgccag

SEQ ID NO: 2860299 - RNA, 19 nt, Mycobacterium avium subsp. paratuberculosis
gugcggaugaugguggcca

SEQ ID NO: 2860300 - RNA, 22 nt, Mycobacterium avium subsp. paratuberculosis
gugcggaugaugguggccaguu

SEQ ID NO: 2860301 - RNA, 18 nt, Mycobacterium avium subsp. paratuberculosis
gugcggauggccccggcg

SEQ ID NO: 2860302 - RNA, 21 nt, Mycobacterium avium subsp. paratuberculosis
gugcggauggccccggcgagu

SEQ ID NO: 2860303 - RNA, 13 nt, Mycobacterium avium subsp. paratuberculosis
gugcggcaacccg

SEQ ID NO: 2860304 - RNA, 14 nt, Mycobacterium avium subsp. paratuberculosis
gugcggcaacccga

SEQ ID NO: 2860305 - RNA, 13 nt, Mycobacterium avium subsp. paratuberculosis
gugcggcacggca

SEQ ID NO: 2860306 - RNA, 13 nt, Mycobacterium avium subsp. paratuberculosis
gugcggcagcucg

SEQ ID NO: 2860307 - RNA, 15 nt, Mycobacterium avium subsp. paratuberculosis
gugcggcccgcggca

SEQ ID NO: 2860308 - RNA, 16 nt, Mycobacterium avium subsp. paratuberculosis
gugcggcccggcacug

SEQ ID NO: 2860309 - RNA, 23 nt, Mycobacterium avium subsp. paratuberculosis
gugcucccgccgagauccaccgc

SEQ ID NO: 2860310 - RNA, 17 nt, Mycobacterium avium subsp. paratuberculosis
gugcucgacggcacccg

SEQ ID NO: 2860311 - RNA, 13 nt, Mycobacterium avium subsp. paratuberculosis
gugcucgagcaca

SEQ ID NO: 2860312 - RNA, 20 nt, Mycobacterium avium subsp. paratuberculosis
gugcucgagcaucucggugc

SEQ ID NO: 2860313 - RNA, 14 nt, Mycobacterium avium subsp. paratuberculosis
gugcucgaucagcg

SEQ ID NO: 2860314 - RNA, 14 nt, Mycobacterium avium subsp. paratuberculosis
gugcucgaucggcg

SEQ ID NO: 2860315 - RNA, 20 nt, Mycobacterium avium subsp. paratuberculosis
gugcucgaugcgacgcaccu

SEQ ID NO: 2860316 - RNA, 22 nt, Mycobacterium avium subsp. paratuberculosis
gugcucgaugcgacgcaccucg

SEQ ID NO: 2860317 - RNA, 18 nt, Mycobacterium avium subsp. paratuberculosis
gugcucgauggccagcgc

SEQ ID NO: 2860318 - RNA, 19 nt, Mycobacterium avium subsp. paratuberculosis
gugcucgauggccagcgcg

SEQ ID NO: 2860319 - RNA, 19 nt, Mycobacterium avium subsp. paratuberculosis
gugcucgauguaccaggcc

SEQ ID NO: 2860320 - RNA, 13 nt, Mycobacterium avium subsp. paratuberculosis
gugcucgccccgc

SEQ ID NO: 2860321 - RNA, 14 nt, Mycobacterium avium subsp. paratuberculosis
gugcucgccggcgc

SEQ ID NO: 2860322 - RNA, 15 nt, Mycobacterium avium subsp. paratuberculosis
gugcucgcgcucguc

SEQ ID NO: 2860323 - RNA, 23 nt, Mycobacterium avium subsp. paratuberculosis
gugcucggaguaguccagcaccg

SEQ ID NO: 2860324 - RNA, 14 nt, Mycobacterium avium subsp. paratuberculosis
gugcucggccacga

SEQ ID NO: 2860325 - RNA, 24 nt, Mycobacterium avium subsp. paratuberculosis
gugcucggccacgacgcgccacgc

SEQ ID NO: 2860326 - RNA, 17 nt, Mycobacterium avium subsp. paratuberculosis
gugcucggcgagcaccg

SEQ ID NO: 2860327 - RNA, 16 nt, Mycobacterium avium subsp. paratuberculosis
gugcucggcggccgcc

SEQ ID NO: 2860328 - RNA, 15 nt, Mycobacterium avium subsp. paratuberculosis
gugcucggcggcgca

SEQ ID NO: 2860329 - RNA, 21 nt, Mycobacterium avium subsp. paratuberculosis
gugcucggcggcgcaggcgcg

SEQ ID NO: 2860330 - RNA, 23 nt, Mycobacterium avium subsp. paratuberculosis
gugcucggcggcggggucguugc

SEQ ID NO: 2860331 - RNA, 16 nt, Mycobacterium avium subsp. paratuberculosis
gugcucggcgucccgc

SEQ ID NO: 2860332 - RNA, 22 nt, Mycobacterium avium subsp. paratuberculosis
gugcucggcguugagccggcgc

SEQ ID NO: 2860333 - RNA, 20 nt, Mycobacterium avium subsp. paratuberculosis
gugcucggggcaguaguggu

SEQ ID NO: 2860334 - RNA, 22 nt, Mycobacterium avium subsp. paratuberculosis
gugcucggugauccacgcggug

SEQ ID NO: 2860335 - RNA, 13 nt, Mycobacterium avium subsp. paratuberculosis
gugcucgucggcg

SEQ ID NO: 2860336 - RNA, 14 nt, Mycobacterium avium subsp. paratuberculosis
gugcucuccgcugu

SEQ ID NO: 2860337 - RNA, 13 nt, Mycobacterium avium subsp. paratuberculosis
gugcucuccugcu

SEQ ID NO: 2860338 - RNA, 15 nt, Mycobacterium avium subsp. paratuberculosis
gugcucucgucgucg

SEQ ID NO: 2860339 - RNA, 16 nt, Mycobacterium avium subsp. paratuberculosis
gugcucucgucgucgg

SEQ ID NO: 2860340 - RNA, 15 nt, Mycobacterium avium subsp. paratuberculosis
gugcucuugacggcc

SEQ ID NO: 2860341 - RNA, 19 nt, Mycobacterium avium subsp. paratuberculosis
gugcucuugacggccgcgg

SEQ ID NO: 2860342 - RNA, 23 nt, Mycobacterium avium subsp. paratuberculosis
gugcucuugacggccgcggcggu

SEQ ID NO: 2860343 - RNA, 17 nt, Mycobacterium avium subsp. paratuberculosis
gugcugaacgccugccg

SEQ ID NO: 2860344 - RNA, 18 nt, Mycobacterium avium subsp. paratuberculosis
gugcugaacgccugccgg

SEQ ID NO: 2860345 - RNA, 21 nt, Mycobacterium avium subsp. paratuberculosis
gugcugaacgccugccggcgc

SEQ ID NO: 2860346 - RNA, 18 nt, Mycobacterium avium subsp. paratuberculosis
gugcugacccagcgcggg

SEQ ID NO: 2860347 - RNA, 18 nt, Mycobacterium avium subsp. paratuberculosis
gugcugacccggucgcgg

SEQ ID NO: 2860348 - RNA, 19 nt, Mycobacterium avium subsp. paratuberculosis
gugcugacccggucgcggc

SEQ ID NO: 2860349 - RNA, 21 nt, Mycobacterium avium subsp. paratuberculosis
gugcugacccggucgcggccg

SEQ ID NO: 2860350 - RNA, 14 nt, Mycobacterium avium subsp. paratuberculosis
gugcugagcguggu

SEQ ID NO: 2860351 - RNA, 18 nt, Mycobacterium avium subsp. paratuberculosis
gugcugauccacgcccgg

SEQ ID NO: 2860352 - RNA, 20 nt, Mycobacterium avium subsp. paratuberculosis
gugcugauccacgcccggac

SEQ ID NO: 2860353 - RNA, 22 nt, Mycobacterium avium subsp. paratuberculosis
gugcugauccacgcccggaccc

SEQ ID NO: 2860354 - RNA, 23 nt, Mycobacterium avium subsp. paratuberculosis
gugcugcagaccgaacgucacgg

SEQ ID NO: 2860355 - RNA, 19 nt, Mycobacterium avium subsp. paratuberculosis
gugcugcagauccgcucgc

SEQ ID NO: 2860356 - RNA, 13 nt, Mycobacterium avium subsp. paratuberculosis
gugcugcccggcg

SEQ ID NO: 2860357 - RNA, 20 nt, Mycobacterium avium subsp. paratuberculosis
gugcugcccggcgcggacag

SEQ ID NO: 2860358 - RNA, 19 nt, Mycobacterium avium subsp. paratuberculosis
gugcugcccuugugguugc

SEQ ID NO: 2860359 - RNA, 19 nt, Mycobacterium avium subsp. paratuberculosis
gugcugccgaacaucagcc

SEQ ID NO: 2860360 - RNA, 20 nt, Mycobacterium avium subsp. paratuberculosis
gugcugccggacaccccggc

SEQ ID NO: 2860361 - RNA, 15 nt, Mycobacterium avium subsp. paratuberculosis
gugcugccggccggc

SEQ ID NO: 2860362 - RNA, 16 nt, Mycobacterium avium subsp. paratuberculosis
gugcugccggccggca

SEQ ID NO: 2860363 - RNA, 17 nt, Mycobacterium avium subsp. paratuberculosis
gugcugccugccguugg

SEQ ID NO: 2860364 - RNA, 13 nt, Mycobacterium avium subsp. paratuberculosis
gugcugcgcagca

SEQ ID NO: 2860365 - RNA, 16 nt, Mycobacterium avium subsp. paratuberculosis
gugcugcgcagcagcg

SEQ ID NO: 2860366 - RNA, 19 nt, Mycobacterium avium subsp. paratuberculosis
gugcugcgcagcagcgcca

SEQ ID NO: 2860367 - RNA, 21 nt, Mycobacterium avium subsp. paratuberculosis
gugcugcgcagcagcgccagc

SEQ ID NO: 2860368 - RNA, 14 nt, Mycobacterium avium subsp. paratuberculosis
gugcugcucgaggg

SEQ ID NO: 2860369 - RNA, 19 nt, Mycobacterium avium subsp. paratuberculosis
gugcugcucgagggccucc

SEQ ID NO: 2860370 - RNA, 20 nt, Mycobacterium avium subsp. paratuberculosis
gugcuggacggcccgacgac

SEQ ID NO: 2860371 - RNA, 16 nt, Mycobacterium avium subsp. paratuberculosis
gugcuggccaccacgg

SEQ ID NO: 2860372 - RNA, 15 nt, Mycobacterium avium subsp. paratuberculosis
gugcuggccagcacc

SEQ ID NO: 2860373 - RNA, 16 nt, Mycobacterium avium subsp. paratuberculosis
gugcuggccaucgcgg

SEQ ID NO: 2860374 - RNA, 16 nt, Mycobacterium avium subsp. paratuberculosis
gugcuggccggguugg

SEQ ID NO: 2860375 - RNA, 13 nt, Mycobacterium avium subsp. paratuberculosis
gugcuggcgaugu

SEQ ID NO: 2860376 - RNA, 21 nt, Mycobacterium avium subsp. paratuberculosis
gugcuggcgaugugaucgcgg

SEQ ID NO: 2860377 - RNA, 23 nt, Mycobacterium avium subsp. paratuberculosis
gugcugggccacgauccgcgcgg

SEQ ID NO: 2860378 - RNA, 15 nt, Mycobacterium avium subsp. paratuberculosis
gugcugggcggacgg

SEQ ID NO: 2860379 - RNA, 21 nt, Mycobacterium avium subsp. paratuberculosis
gugcuggggguggcgucgacg

SEQ ID NO: 2860380 - RNA, 14 nt, Mycobacterium avium subsp. paratuberculosis
gugcugucgucgcc

SEQ ID NO: 2860381 - RNA, 17 nt, Mycobacterium avium subsp. paratuberculosis
gugcugugcgggcggug

SEQ ID NO: 2860382 - RNA, 22 nt, Mycobacterium avium subsp. paratuberculosis
gugcuuaccggccggccgccug

SEQ ID NO: 2860383 - RNA, 16 nt, Mycobacterium avium subsp. paratuberculosis
gugcuugaucagcggg

SEQ ID NO: 2860384 - RNA, 14 nt, Mycobacterium avium subsp. paratuberculosis
gugcuugccgaugu

SEQ ID NO: 2860385 - RNA, 13 nt, Mycobacterium avium subsp. paratuberculosis
gugcuuggcggcg

SEQ ID NO: 2860386 - RNA, 16 nt, Mycobacterium avium subsp. paratuberculosis
gugcuuggucagcgcg

SEQ ID NO: 2860387 - RNA, 22 nt, Mycobacterium avium subsp. paratuberculosis
gugcuuggucagcgcggcccgc

SEQ ID NO: 2860388 - RNA, 18 nt, Mycobacterium avium subsp. paratuberculosis
gugcuuucgcgucugcuc

SEQ ID NO: 2860389 - RNA, 20 nt, Mycobacterium avium subsp. paratuberculosis
gugcuuucgcgucugcucgc

SEQ ID NO: 2860390 - RNA, 20 nt, Mycobacterium avium subsp. paratuberculosis
gugcuuuugcgucugcucgc

SEQ ID NO: 2860391 - RNA, 20 nt, Mycobacterium avium subsp. paratuberculosis
gugcuuuugugucugcucgc

SEQ ID NO: 2860392 - RNA, 19 nt, Mycobacterium avium subsp. paratuberculosis
guggaaaucgagcgcgcug

SEQ ID NO: 2860393 - RNA, 12 nt, Mycobacterium avium subsp. paratuberculosis
guggccaccgcg

SEQ ID NO: 2860394 - RNA, 20 nt, Mycobacterium avium subsp. paratuberculosis
guggccaccgcgacgcccag

SEQ ID NO: 2860395 - RNA, 11 nt, Mycobacterium avium subsp. paratuberculosis
guggccagcac

SEQ ID NO: 2860396 - RNA, 22 nt, Mycobacterium avium subsp. paratuberculosis
guggccagcaccacguccgcgg

SEQ ID NO: 2860397 - RNA, 16 nt, Mycobacterium avium subsp. paratuberculosis
guggccagcaccagcc

SEQ ID NO: 2860398 - RNA, 18 nt, Mycobacterium avium subsp. paratuberculosis
guggccagcaccagcccg

SEQ ID NO: 2860399 - RNA, 19 nt, Mycobacterium avium subsp. paratuberculosis
guggccagcaccagcccga

SEQ ID NO: 2860400 - RNA, 14 nt, Mycobacterium avium subsp. paratuberculosis
guggccagcaccgc

SEQ ID NO: 2860401 - RNA, 15 nt, Mycobacterium avium subsp. paratuberculosis
guggccagcaccgcg

SEQ ID NO: 2860402 - RNA, 21 nt, Mycobacterium avium subsp. paratuberculosis
guggccagcaccgcgucgaug

SEQ ID NO: 2860403 - RNA, 16 nt, Mycobacterium avium subsp. paratuberculosis
guggccagcaccguca

SEQ ID NO: 2860404 - RNA, 22 nt, Mycobacterium avium subsp. paratuberculosis
guggccagcaccgucagccagg

SEQ ID NO: 2860405 - RNA, 14 nt, Mycobacterium avium subsp. paratuberculosis
guggccagcacgau

SEQ ID NO: 2860406 - RNA, 14 nt, Mycobacterium avium subsp. paratuberculosis
guggccagcagggu

SEQ ID NO: 2860407 - RNA, 18 nt, Mycobacterium avium subsp. paratuberculosis
guggccagcgccagcgcc

SEQ ID NO: 2860408 - RNA, 20 nt, Mycobacterium avium subsp. paratuberculosis
guggccagcgccagcgccag

SEQ ID NO: 2860409 - RNA, 17 nt, Mycobacterium avium subsp. paratuberculosis
guggccagcuucaccgg

SEQ ID NO: 2860410 - RNA, 18 nt, Mycobacterium avium subsp. paratuberculosis
guggccagcuucaccggu

SEQ ID NO: 2860411 - RNA, 17 nt, Mycobacterium avium subsp. paratuberculosis
guggccaguucgucgcg

SEQ ID NO: 2860412 - RNA, 15 nt, Mycobacterium avium subsp. paratuberculosis
guggccaucgcggcc

SEQ ID NO: 2860413 - RNA, 23 nt, Mycobacterium avium subsp. paratuberculosis
guggcccaaccgcauucggccgc

SEQ ID NO: 2860414 - RNA, 13 nt, Mycobacterium avium subsp. paratuberculosis
guggcccagccgc

SEQ ID NO: 2860415 - RNA, 22 nt, Mycobacterium avium subsp. paratuberculosis
guggcccagccgcugacgaugg

SEQ ID NO: 2860416 - RNA, 17 nt, Mycobacterium avium subsp. paratuberculosis
guggcccagccggccga

SEQ ID NO: 2860417 - RNA, 16 nt, Mycobacterium avium subsp. paratuberculosis
guggcccagccggugc

SEQ ID NO: 2860418 - RNA, 17 nt, Mycobacterium avium subsp. paratuberculosis
guggcccagccggugcg

SEQ ID NO: 2860419 - RNA, 18 nt, Mycobacterium avium subsp. paratuberculosis
guggcccagccggugcga

SEQ ID NO: 2860420 - RNA, 22 nt, Mycobacterium avium subsp. paratuberculosis
guggcccagccggugcgagccg

SEQ ID NO: 2860421 - RNA, 22 nt, Mycobacterium avium subsp. paratuberculosis
guggcccaggccggcgguggug

SEQ ID NO: 2860422 - RNA, 14 nt, Mycobacterium avium subsp. paratuberculosis
guggccccagcccg

SEQ ID NO: 2860423 - RNA, 19 nt, Mycobacterium avium subsp. paratuberculosis
guggcccccaccacgaagc

SEQ ID NO: 2860424 - RNA, 14 nt, Mycobacterium avium subsp. paratuberculosis
guggcccgacccgu

SEQ ID NO: 2860425 - RNA, 22 nt, Mycobacterium avium subsp. paratuberculosis
guggcccgccacgugcggcugc

SEQ ID NO: 2860426 - RNA, 14 nt, Mycobacterium avium subsp. paratuberculosis
guggcccgcccggg

SEQ ID NO: 2860427 - RNA, 13 nt, Mycobacterium avium subsp. paratuberculosis
guggcccgcgcgc

SEQ ID NO: 2860428 - RNA, 19 nt, Mycobacterium avium subsp. paratuberculosis
guggcccggauggccgggc

SEQ ID NO: 2860429 - RNA, 21 nt, Mycobacterium avium subsp. paratuberculosis
guggcccgguacagcgccgcg

SEQ ID NO: 2860430 - RNA, 12 nt, Mycobacterium avium subsp. paratuberculosis
guggcccggucg

SEQ ID NO: 2860431 - RNA, 16 nt, Mycobacterium avium subsp. paratuberculosis
guggcccggucgucga

SEQ ID NO: 2860432 - RNA, 20 nt, Mycobacterium avium subsp. paratuberculosis
guggcccugcucgucguuga

SEQ ID NO: 2860433 - RNA, 20 nt, Mycobacterium avium subsp. paratuberculosis
guggccgaaccgcucgucgg

SEQ ID NO: 2860434 - RNA, 23 nt, Mycobacterium avium subsp. paratuberculosis
guggccgaacgggucggcgacca

SEQ ID NO: 2860435 - RNA, 19 nt, Mycobacterium avium subsp. paratuberculosis
guggccgaucagcggcggg

SEQ ID NO: 2860436 - RNA, 15 nt, Mycobacterium avium subsp. paratuberculosis
guggccgaucagcug

SEQ ID NO: 2860437 - RNA, 22 nt, Mycobacterium avium subsp. paratuberculosis
guggccgaucagcugcucggcc

SEQ ID NO: 2860438 - RNA, 17 nt, Mycobacterium avium subsp. paratuberculosis
guggccgccaccaacau

SEQ ID NO: 2860439 - RNA, 22 nt, Mycobacterium avium subsp. paratuberculosis
guggccgccaccaacaucgacg

SEQ ID NO: 2860440 - RNA, 22 nt, Mycobacterium avium subsp. paratuberculosis
guggccgcgaaaauaccgccgg

SEQ ID NO: 2860441 - RNA, 14 nt, Mycobacterium avium subsp. paratuberculosis
guggccgcgcuggu

SEQ ID NO: 2860442 - RNA, 15 nt, Mycobacterium avium subsp. paratuberculosis
guggccgcgcugguc

SEQ ID NO: 2860443 - RNA, 14 nt, Mycobacterium avium subsp. paratuberculosis
guggccgcggcggc

SEQ ID NO: 2860444 - RNA, 15 nt, Mycobacterium avium subsp. paratuberculosis
guggccgcggcggcc

SEQ ID NO: 2860445 - RNA, 18 nt, Mycobacterium avium subsp. paratuberculosis
guggccgcggcggcccgg

SEQ ID NO: 2860446 - RNA, 13 nt, Mycobacterium avium subsp. paratuberculosis
guggccgcggugg

SEQ ID NO: 2860447 - RNA, 14 nt, Mycobacterium avium subsp. paratuberculosis
guggccgcgguggu

SEQ ID NO: 2860448 - RNA, 20 nt, Mycobacterium avium subsp. paratuberculosis
guggccgcgucgaccagccg

SEQ ID NO: 2860449 - RNA, 14 nt, Mycobacterium avium subsp. paratuberculosis
guggccggcgucca

SEQ ID NO: 2860450 - RNA, 17 nt, Mycobacterium avium subsp. paratuberculosis
guggccggcguccaggc

SEQ ID NO: 2860451 - RNA, 14 nt, Mycobacterium avium subsp. paratuberculosis
guggccgggaugcc

SEQ ID NO: 2860452 - RNA, 18 nt, Mycobacterium avium subsp. paratuberculosis
guggccgguaucggguca

SEQ ID NO: 2860453 - RNA, 18 nt, Mycobacterium avium subsp. paratuberculosis
guggccggugggcggcgc

SEQ ID NO: 2860454 - RNA, 21 nt, Mycobacterium avium subsp. paratuberculosis
guggccggugggcggcgcccg

SEQ ID NO: 2860455 - RNA, 22 nt, Mycobacterium avium subsp. paratuberculosis
guggccggugggcggcgcccga

SEQ ID NO: 2860456 - RNA, 16 nt, Mycobacterium avium subsp. paratuberculosis
guggccgucacgcugg

SEQ ID NO: 2860457 - RNA, 20 nt, Mycobacterium avium subsp. paratuberculosis
guggccguccgaaucguuga

SEQ ID NO: 2860458 - RNA, 13 nt, Mycobacterium avium subsp. paratuberculosis
guggccgucgccg

SEQ ID NO: 2860459 - RNA, 13 nt, Mycobacterium avium subsp. paratuberculosis
guggccgucggcc

SEQ ID NO: 2860460 - RNA, 18 nt, Mycobacterium avium subsp. paratuberculosis
guggccgucucgucggcc

SEQ ID NO: 2860461 - RNA, 21 nt, Mycobacterium avium subsp. paratuberculosis
guggccgucucgucggccgcg

SEQ ID NO: 2860462 - RNA, 22 nt, Mycobacterium avium subsp. paratuberculosis
guggccgucucgucggccgcga

SEQ ID NO: 2860463 - RNA, 16 nt, Mycobacterium avium subsp. paratuberculosis
guggccgugaaggggu

SEQ ID NO: 2860464 - RNA, 21 nt, Mycobacterium avium subsp. paratuberculosis
guggccgugugcgcaucggcg

SEQ ID NO: 2860465 - RNA, 22 nt, Mycobacterium avium subsp. paratuberculosis
guggccucccgguagaucgccg

SEQ ID NO: 2860466 - RNA, 22 nt, Mycobacterium avium subsp. paratuberculosis
guggccucgcgcaaugccgccg

SEQ ID NO: 2860467 - RNA, 20 nt, Mycobacterium avium subsp. paratuberculosis
guggccucggcgcugcccgc

SEQ ID NO: 2860468 - RNA, 15 nt, Mycobacterium avium subsp. paratuberculosis
guggccucgucggcg

SEQ ID NO: 2860469 - RNA, 16 nt, Mycobacterium avium subsp. paratuberculosis
guggccucgucggcgc

SEQ ID NO: 2860470 - RNA, 17 nt, Mycobacterium avium subsp. paratuberculosis
guggccucgucggcgcc

SEQ ID NO: 2860471 - RNA, 18 nt, Mycobacterium avium subsp. paratuberculosis
guggccucgucggcgccg

SEQ ID NO: 2860472 - RNA, 21 nt, Mycobacterium avium subsp. paratuberculosis
guggccugcaacuggucgugc

SEQ ID NO: 2860473 - RNA, 17 nt, Mycobacterium avium subsp. paratuberculosis
guggccugcccggcggu

SEQ ID NO: 2860474 - RNA, 19 nt, Mycobacterium avium subsp. paratuberculosis
guggccuggaagaugaccc

SEQ ID NO: 2860475 - RNA, 17 nt, Mycobacterium avium subsp. paratuberculosis
guggccugggcgaccag

SEQ ID NO: 2860476 - RNA, 21 nt, Mycobacterium avium subsp. paratuberculosis
guggccugggcgaccagauag

SEQ ID NO: 2860477 - RNA, 22 nt, Mycobacterium avium subsp. paratuberculosis
guggcguagucgucgaucucgg

SEQ ID NO: 2860478 - RNA, 17 nt, Mycobacterium avium subsp. paratuberculosis
guggcguccagaugccg

SEQ ID NO: 2860479 - RNA, 19 nt, Mycobacterium avium subsp. paratuberculosis
guggcguccuugccgauca

SEQ ID NO: 2860480 - RNA, 22 nt, Mycobacterium avium subsp. paratuberculosis
guggcguccuugccgaucagcg

SEQ ID NO: 2860481 - RNA, 15 nt, Mycobacterium avium subsp. paratuberculosis
guggcgucgaugccg

SEQ ID NO: 2860482 - RNA, 16 nt, Mycobacterium avium subsp. paratuberculosis
guggcgucgccgccgg

SEQ ID NO: 2860483 - RNA, 15 nt, Mycobacterium avium subsp. paratuberculosis
guggcgucggccggg

SEQ ID NO: 2860484 - RNA, 18 nt, Mycobacterium avium subsp. paratuberculosis
guggcgucggccgggggc

SEQ ID NO: 2860485 - RNA, 12 nt, Mycobacterium avium subsp. paratuberculosis
guggcgucggcg

SEQ ID NO: 2860486 - RNA, 17 nt, Mycobacterium avium subsp. paratuberculosis
guggcgucggcgcgcac

SEQ ID NO: 2860487 - RNA, 13 nt, Mycobacterium avium subsp. paratuberculosis
guggcgucggcgu

SEQ ID NO: 2860488 - RNA, 15 nt, Mycobacterium avium subsp. paratuberculosis
guggcgugcagcgcg

SEQ ID NO: 2860489 - RNA, 16 nt, Mycobacterium avium subsp. paratuberculosis
guggcgugcagcgcgg

SEQ ID NO: 2860490 - RNA, 19 nt, Mycobacterium avium subsp. paratuberculosis
guggcgugcagcgcggcga

SEQ ID NO: 2860491 - RNA, 15 nt, Mycobacterium avium subsp. paratuberculosis
guggcgugccgggcg

SEQ ID NO: 2860492 - RNA, 16 nt, Mycobacterium avium subsp. paratuberculosis
guggcgugcggccucg

SEQ ID NO: 2860493 - RNA, 20 nt, Mycobacterium avium subsp. paratuberculosis
guggcgugugggcucgcccg

SEQ ID NO: 2860494 - RNA, 18 nt, Mycobacterium avium subsp. paratuberculosis
guggcguuacacccgcgg

SEQ ID NO: 2860495 - RNA, 20 nt, Mycobacterium avium subsp. paratuberculosis
guggcguucacaguaggcgg

SEQ ID NO: 2860496 - RNA, 14 nt, Mycobacterium avium subsp. paratuberculosis
guggcguugcgggc

SEQ ID NO: 2860497 - RNA, 15 nt, Mycobacterium avium subsp. paratuberculosis
guggcguugcgggcg

SEQ ID NO: 2860498 - RNA, 21 nt, Mycobacterium avium subsp. paratuberculosis
guggcguuuuccuucggugcg

SEQ ID NO: 2860499 - RNA, 22 nt, Mycobacterium avium subsp. paratuberculosis
guggcguuuuccuucggugcgu

SEQ ID NO: 2860500 - RNA, 23 nt, Mycobacterium avium subsp. paratuberculosis
guggcuaccgccgggcgggccgc

SEQ ID NO: 2860501 - RNA, 15 nt, Mycobacterium avium subsp. paratuberculosis
guggcucggcccgcc

SEQ ID NO: 2860502 - RNA, 17 nt, Mycobacterium avium subsp. paratuberculosis
guggcucggcccgccgg

SEQ ID NO: 2860503 - RNA, 14 nt, Mycobacterium avium subsp. paratuberculosis
guggcugaacagcg

SEQ ID NO: 2860504 - RNA, 13 nt, Mycobacterium avium subsp. paratuberculosis
guggcugaggccg

SEQ ID NO: 2860505 - RNA, 21 nt, Mycobacterium avium subsp. paratuberculosis
guggcugcacgucacgggcca

SEQ ID NO: 2860506 - RNA, 14 nt, Mycobacterium avium subsp. paratuberculosis
guggcugucgggug

SEQ ID NO: 2860507 - RNA, 14 nt, Mycobacterium avium subsp. paratuberculosis
guggcuuccagccc

SEQ ID NO: 2860508 - RNA, 14 nt, Mycobacterium avium subsp. paratuberculosis
guggcuugaucgca

SEQ ID NO: 2860509 - RNA, 17 nt, Mycobacterium avium subsp. paratuberculosis
guggcuugaucgcaccc

SEQ ID NO: 2860510 - RNA, 16 nt, Mycobacterium avium subsp. paratuberculosis
gugggaaugcggcugg

SEQ ID NO: 2860511 - RNA, 17 nt, Mycobacterium avium subsp. paratuberculosis
gugggaaugcggcuggg

SEQ ID NO: 2860512 - RNA, 14 nt, Mycobacterium avium subsp. paratuberculosis
gugggaccgucggc

SEQ ID NO: 2860513 - RNA, 16 nt, Mycobacterium avium subsp. paratuberculosis
gugggacggcgggugg

SEQ ID NO: 2860514 - RNA, 18 nt, Mycobacterium avium subsp. paratuberculosis
gugggacggcgggugggg

SEQ ID NO: 2860515 - RNA, 20 nt, Mycobacterium avium subsp. paratuberculosis
gugggacugggcgccgccgg

SEQ ID NO: 2860516 - RNA, 15 nt, Mycobacterium avium subsp. paratuberculosis
gugggagguacucga

SEQ ID NO: 2860517 - RNA, 20 nt, Mycobacterium avium subsp. paratuberculosis
gugggcaacacgucguccgg

SEQ ID NO: 2860518 - RNA, 18 nt, Mycobacterium avium subsp. paratuberculosis
gugggcaccagcugcgga

SEQ ID NO: 2860519 - RNA, 12 nt, Mycobacterium avium subsp. paratuberculosis
gugggcaccgcg

SEQ ID NO: 2860520 - RNA, 13 nt, Mycobacterium avium subsp. paratuberculosis
gugggcaccggca

SEQ ID NO: 2860521 - RNA, 18 nt, Mycobacterium avium subsp. paratuberculosis
gugggcaccggcaccgcc

SEQ ID NO: 2860522 - RNA, 21 nt, Mycobacterium avium subsp. paratuberculosis
gugggcagccaaccgccgggg

SEQ ID NO: 2860523 - RNA, 13 nt, Mycobacterium avium subsp. paratuberculosis
gugggcagcccca

SEQ ID NO: 2860524 - RNA, 23 nt, Mycobacterium avium subsp. paratuberculosis
gugggcagccccagcgagcaggu

SEQ ID NO: 2860525 - RNA, 15 nt, Mycobacterium avium subsp. paratuberculosis
gugggcagccggcaa

SEQ ID NO: 2860526 - RNA, 13 nt, Mycobacterium avium subsp. paratuberculosis
gugggcagcgcga

SEQ ID NO: 2860527 - RNA, 15 nt, Mycobacterium avium subsp. paratuberculosis
gugggcagcgcgauc

SEQ ID NO: 2860528 - RNA, 18 nt, Mycobacterium avium subsp. paratuberculosis
gugggcagcgcggccagc

SEQ ID NO: 2860529 - RNA, 13 nt, Mycobacterium avium subsp. paratuberculosis
gugggcagcucgu

SEQ ID NO: 2860530 - RNA, 19 nt, Mycobacterium avium subsp. paratuberculosis
gugggcagcucgucggcgc

SEQ ID NO: 2860531 - RNA, 13 nt, Mycobacterium avium subsp. paratuberculosis
gugggccaccacg

SEQ ID NO: 2860532 - RNA, 14 nt, Mycobacterium avium subsp. paratuberculosis
gugggccagcagcg

SEQ ID NO: 2860533 - RNA, 20 nt, Mycobacterium avium subsp. paratuberculosis
gugggccaucaucggugcca

SEQ ID NO: 2860534 - RNA, 14 nt, Mycobacterium avium subsp. paratuberculosis
gugggccaucgcca

SEQ ID NO: 2860535 - RNA, 15 nt, Mycobacterium avium subsp. paratuberculosis
gugggccaucgccag

SEQ ID NO: 2860536 - RNA, 13 nt, Mycobacterium avium subsp. paratuberculosis
gugggcccgccgu

SEQ ID NO: 2860537 - RNA, 23 nt, Mycobacterium avium subsp. paratuberculosis
gugggcccgccgucgaccacgaa

SEQ ID NO: 2860538 - RNA, 19 nt, Mycobacterium avium subsp. paratuberculosis
gugggccgcagcgcggcga

SEQ ID NO: 2860539 - RNA, 14 nt, Mycobacterium avium subsp. paratuberculosis
gugggcgacgaggu

SEQ ID NO: 2860540 - RNA, 17 nt, Mycobacterium avium subsp. paratuberculosis
gugggcgacgucgucgc

SEQ ID NO: 2860541 - RNA, 21 nt, Mycobacterium avium subsp. paratuberculosis
gugggcgacgucgucgcccac

SEQ ID NO: 2860542 - RNA, 15 nt, Mycobacterium avium subsp. paratuberculosis
gugggcgcagggccg

SEQ ID NO: 2860543 - RNA, 18 nt, Mycobacterium avium subsp. paratuberculosis
gugggcgccccuggcguc

SEQ ID NO: 2860544 - RNA, 20 nt, Mycobacterium avium subsp. paratuberculosis
gugggcgcccgcggcgcgca

SEQ ID NO: 2860545 - RNA, 14 nt, Mycobacterium avium subsp. paratuberculosis
gugggcgccggguc

SEQ ID NO: 2860546 - RNA, 13 nt, Mycobacterium avium subsp. paratuberculosis
gugggcgccguca

SEQ ID NO: 2860547 - RNA, 17 nt, Mycobacterium avium subsp. paratuberculosis
gugggcgccgucaaugg

SEQ ID NO: 2860548 - RNA, 18 nt, Mycobacterium avium subsp. paratuberculosis
gugggcgccgucgccgcc

SEQ ID NO: 2860549 - RNA, 20 nt, Mycobacterium avium subsp. paratuberculosis
gugggcgccgucgccgccgu

SEQ ID NO: 2860550 - RNA, 15 nt, Mycobacterium avium subsp. paratuberculosis
gugggcgcgcagcac

SEQ ID NO: 2860551 - RNA, 14 nt, Mycobacterium avium subsp. paratuberculosis
gugggcgcgguggu

SEQ ID NO: 2860552 - RNA, 15 nt, Mycobacterium avium subsp. paratuberculosis
gugggcgcugguccu

SEQ ID NO: 2860553 - RNA, 13 nt, Mycobacterium avium subsp. paratuberculosis
gugggcggccacc

SEQ ID NO: 2860554 - RNA, 20 nt, Mycobacterium avium subsp. paratuberculosis
gugggcggccaccaacggca

SEQ ID NO: 2860555 - RNA, 13 nt, Mycobacterium avium subsp. paratuberculosis
gugggcggcgcga

SEQ ID NO: 2860556 - RNA, 20 nt, Mycobacterium avium subsp. paratuberculosis
gugggcggcgcgaucgucga

SEQ ID NO: 2860557 - RNA, 23 nt, Mycobacterium avium subsp. paratuberculosis
gugggcgggacguggcucagcgg

SEQ ID NO: 2860558 - RNA, 13 nt, Mycobacterium avium subsp. paratuberculosis
gugggcgggcacc

SEQ ID NO: 2860559 - RNA, 14 nt, Mycobacterium avium subsp. paratuberculosis
gugggcgggcaccc

SEQ ID NO: 2860560 - RNA, 14 nt, Mycobacterium avium subsp. paratuberculosis
gugggcggugcgca

SEQ ID NO: 2860561 - RNA, 18 nt, Mycobacterium avium subsp. paratuberculosis
gugggcguacgggcgggc

SEQ ID NO: 2860562 - RNA, 13 nt, Mycobacterium avium subsp. paratuberculosis
guggugcccccgc

SEQ ID NO: 2860563 - RNA, 21 nt, Mycobacterium avium subsp. paratuberculosis
guggugcccccgcccggccgg

SEQ ID NO: 2860564 - RNA, 13 nt, Mycobacterium avium subsp. paratuberculosis
guggugcgcccgu

SEQ ID NO: 2860565 - RNA, 18 nt, Mycobacterium avium subsp. paratuberculosis
guggugcggugcaccgcg

SEQ ID NO: 2860566 - RNA, 20 nt, Mycobacterium avium subsp. paratuberculosis
gugguggccgaacgggucgg

SEQ ID NO: 2860567 - RNA, 13 nt, Mycobacterium avium subsp. paratuberculosis
gugguggcggcga

SEQ ID NO: 2860568 - RNA, 14 nt, Mycobacterium avium subsp. paratuberculosis
gugguggcggcgaa

SEQ ID NO: 2860569 - RNA, 12 nt, Mycobacterium avium subsp. paratuberculosis
guggugggcaga

SEQ ID NO: 2860570 - RNA, 17 nt, Mycobacterium avium subsp. paratuberculosis
guggugggcgaacagca

SEQ ID NO: 2860571 - RNA, 18 nt, Mycobacterium avium subsp. paratuberculosis
guggugggcgaacagcag

SEQ ID NO: 2860572 - RNA, 20 nt, Mycobacterium avium subsp. paratuberculosis
guggugggcgugcaggccgc

SEQ ID NO: 2860573 - RNA, 13 nt, Mycobacterium avium subsp. paratuberculosis
gugguggggccgg

SEQ ID NO: 2860574 - RNA, 19 nt, Mycobacterium avium subsp. paratuberculosis
gugguggggccggcgaagg

SEQ ID NO: 2860575 - RNA, 19 nt, Mycobacterium avium subsp. paratuberculosis
gugguggugcccaucgacc

SEQ ID NO: 2860576 - RNA, 15 nt, Mycobacterium avium subsp. paratuberculosis
gugguggugcgggug

SEQ ID NO: 2860577 - RNA, 16 nt, Mycobacterium avium subsp. paratuberculosis
guggugugcaccagcg

SEQ ID NO: 2860578 - RNA, 15 nt, Mycobacterium avium subsp. paratuberculosis
guggugugcccgcgg

SEQ ID NO: 2860579 - RNA, 19 nt, Mycobacterium avium subsp. paratuberculosis
gugguguggcgucggccgg

SEQ ID NO: 2860580 - RNA, 22 nt, Mycobacterium avium subsp. paratuberculosis
gugguguugaucauccggcggg

SEQ ID NO: 2860581 - RNA, 20 nt, Mycobacterium avium subsp. paratuberculosis
gugguuaccagcucaccggg

SEQ ID NO: 2860582 - RNA, 13 nt, Mycobacterium avium subsp. paratuberculosis
gugguucguccgg

SEQ ID NO: 2860583 - RNA, 16 nt, Mycobacterium avium subsp. paratuberculosis
gugguucuccgcgaca

SEQ ID NO: 2860584 - RNA, 20 nt, Mycobacterium avium subsp. paratuberculosis
gugguugcaaucucgucggg

SEQ ID NO: 2860585 - RNA, 19 nt, Mycobacterium avium subsp. paratuberculosis
gugguugcguucgccggcg

SEQ ID NO: 2860586 - RNA, 21 nt, Mycobacterium avium subsp. paratuberculosis
gugguuggcgaucagggcggc

SEQ ID NO: 2860587 - RNA, 23 nt, Mycobacterium avium subsp. paratuberculosis
gugguuggcgaucagggcggcgc

SEQ ID NO: 2860588 - RNA, 14 nt, Mycobacterium avium subsp. paratuberculosis
guguaacgcgucga

SEQ ID NO: 2860589 - RNA, 16 nt, Mycobacterium avium subsp. paratuberculosis
guguaacgcgucgacg

SEQ ID NO: 2860590 - RNA, 18 nt, Mycobacterium avium subsp. paratuberculosis
guguacacagggcggcga

SEQ ID NO: 2860591 - RNA, 16 nt, Mycobacterium avium subsp. paratuberculosis
guguacacgucgcggg

SEQ ID NO: 2860592 - RNA, 17 nt, Mycobacterium avium subsp. paratuberculosis
guguacacgucgcgggu

SEQ ID NO: 2860593 - RNA, 15 nt, Mycobacterium avium subsp. paratuberculosis
guguacucggcgucg

SEQ ID NO: 2860594 - RNA, 20 nt, Mycobacterium avium subsp. paratuberculosis
guguagaucggcucaccgaa

SEQ ID NO: 2860595 - RNA, 15 nt, Mycobacterium avium subsp. paratuberculosis
guguagcccggugcc

SEQ ID NO: 2860596 - RNA, 13 nt, Mycobacterium avium subsp. paratuberculosis
guguagccgaccg

SEQ ID NO: 2860597 - RNA, 21 nt, Mycobacterium avium subsp. paratuberculosis
guguagccguaacgaugccgc

SEQ ID NO: 2860598 - RNA, 14 nt, Mycobacterium avium subsp. paratuberculosis
guguagcugcgggu

SEQ ID NO: 2860599 - RNA, 22 nt, Mycobacterium avium subsp. paratuberculosis
guguagcugggccccuccagcc

SEQ ID NO: 2860600 - RNA, 13 nt, Mycobacterium avium subsp. paratuberculosis
guguaggccgcgu

SEQ ID NO: 2860601 - RNA, 14 nt, Mycobacterium avium subsp. paratuberculosis
guguaggcgucggc

SEQ ID NO: 2860602 - RNA, 16 nt, Mycobacterium avium subsp. paratuberculosis
guguaggcgucggcgg

SEQ ID NO: 2860603 - RNA, 15 nt, Mycobacterium avium subsp. paratuberculosis
guguagggcaacacg

SEQ ID NO: 2860604 - RNA, 21 nt, Mycobacterium avium subsp. paratuberculosis
guguaguacugcucgacguag

SEQ ID NO: 2860605 - RNA, 14 nt, Mycobacterium avium subsp. paratuberculosis
guguagucggcgau

SEQ ID NO: 2860606 - RNA, 15 nt, Mycobacterium avium subsp. paratuberculosis
guguagucggcgauc

SEQ ID NO: 2860607 - RNA, 14 nt, Mycobacterium avium subsp. paratuberculosis
gugucacgcuggcg

SEQ ID NO: 2860608 - RNA, 17 nt, Mycobacterium avium subsp. paratuberculosis
gugucacgcuggcguga

SEQ ID NO: 2860609 - RNA, 19 nt, Mycobacterium avium subsp. paratuberculosis
gugucacgcuggcgugacg

SEQ ID NO: 2860610 - RNA, 20 nt, Mycobacterium avium subsp. paratuberculosis
gugucacgcuggcgugacgu

SEQ ID NO: 2860611 - RNA, 23 nt, Mycobacterium avium subsp. paratuberculosis
gugucagcgcgaccucgguggug

SEQ ID NO: 2860612 - RNA, 13 nt, Mycobacterium avium subsp. paratuberculosis
gugucagggcagc

SEQ ID NO: 2860613 - RNA, 16 nt, Mycobacterium avium subsp. paratuberculosis
gugucagggcagcggu

SEQ ID NO: 2860614 - RNA, 16 nt, Mycobacterium avium subsp. paratuberculosis
gugucaggucggcgau

SEQ ID NO: 2860615 - RNA, 15 nt, Mycobacterium avium subsp. paratuberculosis
gugucaugugccucg

SEQ ID NO: 2860616 - RNA, 17 nt, Mycobacterium avium subsp. paratuberculosis
guguccacgaugcggug

SEQ ID NO: 2860617 - RNA, 18 nt, Mycobacterium avium subsp. paratuberculosis
guguccacgucgcccagc

SEQ ID NO: 2860618 - RNA, 23 nt, Mycobacterium avium subsp. paratuberculosis
guguccagcggguugucgucguc

SEQ ID NO: 2860619 - RNA, 17 nt, Mycobacterium avium subsp. paratuberculosis
guguccaggucguugga

SEQ ID NO: 2860620 - RNA, 20 nt, Mycobacterium avium subsp. paratuberculosis
guguccaggucguuggaguc

SEQ ID NO: 2860621 - RNA, 23 nt, Mycobacterium avium subsp. paratuberculosis
guguccaggucguuggagucguc

SEQ ID NO: 2860622 - RNA, 16 nt, Mycobacterium avium subsp. paratuberculosis
gugucccagcgccacu

SEQ ID NO: 2860623 - RNA, 19 nt, Mycobacterium avium subsp. paratuberculosis
gugucccaguucccggcgg

SEQ ID NO: 2860624 - RNA, 20 nt, Mycobacterium avium subsp. paratuberculosis
gugucccaguucccggcggg

SEQ ID NO: 2860625 - RNA, 13 nt, Mycobacterium avium subsp. paratuberculosis
gugucccgcgugg

SEQ ID NO: 2860626 - RNA, 17 nt, Mycobacterium avium subsp. paratuberculosis
gugucccggauggagcg

SEQ ID NO: 2860627 - RNA, 15 nt, Mycobacterium avium subsp. paratuberculosis
guguccgcgccggcg

SEQ ID NO: 2860628 - RNA, 16 nt, Mycobacterium avium subsp. paratuberculosis
guguccgcgccggcgc

SEQ ID NO: 2860629 - RNA, 18 nt, Mycobacterium avium subsp. paratuberculosis
guguccggcccgaugcgg

SEQ ID NO: 2860630 - RNA, 18 nt, Mycobacterium avium subsp. paratuberculosis
guguccuugcgcaccacg

SEQ ID NO: 2860631 - RNA, 15 nt, Mycobacterium avium subsp. paratuberculosis
gugucgaagaccggu

SEQ ID NO: 2860632 - RNA, 18 nt, Mycobacterium avium subsp. paratuberculosis
gugucgaagaccggugcg

SEQ ID NO: 2860633 - RNA, 20 nt, Mycobacterium avium subsp. paratuberculosis
gugucgaagaccggugcgcg

SEQ ID NO: 2860634 - RNA, 22 nt, Mycobacterium avium subsp. paratuberculosis
gugucgaagaccggugcgcgca

SEQ ID NO: 2860635 - RNA, 20 nt, Mycobacterium avium subsp. paratuberculosis
gugucgaagcugcgcagccg

SEQ ID NO: 2860636 - RNA, 17 nt, Mycobacterium avium subsp. paratuberculosis
gugucgaaggccggggu

SEQ ID NO: 2860637 - RNA, 18 nt, Mycobacterium avium subsp. paratuberculosis
gugucgaaguacgccguc

SEQ ID NO: 2860638 - RNA, 13 nt, Mycobacterium avium subsp. paratuberculosis
gugucgaagucga

SEQ ID NO: 2860639 - RNA, 16 nt, Mycobacterium avium subsp. paratuberculosis
gugucgacccaggucg

SEQ ID NO: 2860640 - RNA, 12 nt, Mycobacterium avium subsp. paratuberculosis
gugucgacgccg

SEQ ID NO: 2860641 - RNA, 21 nt, Mycobacterium avium subsp. paratuberculosis
gugucgacgcugagcacccgc

SEQ ID NO: 2860642 - RNA, 20 nt, Mycobacterium avium subsp. paratuberculosis
gugucgacgguugccucggc

SEQ ID NO: 2860643 - RNA, 21 nt, Mycobacterium avium subsp. paratuberculosis
gugucgagcacgucgacgccg

SEQ ID NO: 2860644 - RNA, 16 nt, Mycobacterium avium subsp. paratuberculosis
gugucgagccggugcc

SEQ ID NO: 2860645 - RNA, 16 nt, Mycobacterium avium subsp. paratuberculosis
gugucgaggucgucgg

SEQ ID NO: 2860646 - RNA, 15 nt, Mycobacterium avium subsp. paratuberculosis
gugucgaugaacgca

SEQ ID NO: 2860647 - RNA, 23 nt, Mycobacterium avium subsp. paratuberculosis
guuaguuaaccgaagcggcccga

SEQ ID NO: 2860648 - RNA, 23 nt, Mycobacterium avium subsp. paratuberculosis
guuauccaccagguugcggauca

SEQ ID NO: 2860649 - RNA, 16 nt, Mycobacterium avium subsp. paratuberculosis
guuaugccgucaccca

SEQ ID NO: 2860650 - RNA, 20 nt, Mycobacterium avium subsp. paratuberculosis
guucacaguaggcggcuguc

SEQ ID NO: 2860651 - RNA, 21 nt, Mycobacterium avium subsp. paratuberculosis
guucacaguaggcggcugucg

SEQ ID NO: 2860652 - RNA, 21 nt, Mycobacterium avium subsp. paratuberculosis
guucaccaccggagcggcggu

SEQ ID NO: 2860653 - RNA, 14 nt, Mycobacterium avium subsp. paratuberculosis
guucaccagcgggg

SEQ ID NO: 2860654 - RNA, 23 nt, Mycobacterium avium subsp. paratuberculosis
guucaccaguuucacgucggcga

SEQ ID NO: 2860655 - RNA, 16 nt, Mycobacterium avium subsp. paratuberculosis
guucaccccgaucaac

SEQ ID NO: 2860656 - RNA, 22 nt, Mycobacterium avium subsp. paratuberculosis
guucaccccgaucaacaccgcc

SEQ ID NO: 2860657 - RNA, 14 nt, Mycobacterium avium subsp. paratuberculosis
guucaccccggcgc

SEQ ID NO: 2860658 - RNA, 16 nt, Mycobacterium avium subsp. paratuberculosis
guucaccccggcgcgg

SEQ ID NO: 2860659 - RNA, 20 nt, Mycobacterium avium subsp. paratuberculosis
guucaccccguugagcagcg

SEQ ID NO: 2860660 - RNA, 16 nt, Mycobacterium avium subsp. paratuberculosis
guucacccgcgcccgc

SEQ ID NO: 2860661 - RNA, 15 nt, Mycobacterium avium subsp. paratuberculosis
guucacccguggcug

SEQ ID NO: 2860662 - RNA, 18 nt, Mycobacterium avium subsp. paratuberculosis
guucacccguggcugacc

SEQ ID NO: 2860663 - RNA, 21 nt, Mycobacterium avium subsp. paratuberculosis
guucacccguggcugaccacg

SEQ ID NO: 2860664 - RNA, 14 nt, Mycobacterium avium subsp. paratuberculosis
guucacccuggcga

SEQ ID NO: 2860665 - RNA, 17 nt, Mycobacterium avium subsp. paratuberculosis
guucaccgccaccagca

SEQ ID NO: 2860666 - RNA, 22 nt, Mycobacterium avium subsp. paratuberculosis
guucaccugacgcaucaccacg

SEQ ID NO: 2860667 - RNA, 14 nt, Mycobacterium avium subsp. paratuberculosis
guucacgcggcugg

SEQ ID NO: 2860668 - RNA, 23 nt, Mycobacterium avium subsp. paratuberculosis
guucacgucgaucacgccgccgg

SEQ ID NO: 2860669 - RNA, 19 nt, Mycobacterium avium subsp. paratuberculosis
guucagaagucgcccgcgu

SEQ ID NO: 2860670 - RNA, 14 nt, Mycobacterium avium subsp. paratuberculosis
guucagcagccggc

SEQ ID NO: 2860671 - RNA, 15 nt, Mycobacterium avium subsp. paratuberculosis
guucagcagcgcggu

SEQ ID NO: 2860672 - RNA, 23 nt, Mycobacterium avium subsp. paratuberculosis
guucagcccggcgcugcgcccgg

SEQ ID NO: 2860673 - RNA, 24 nt, Mycobacterium avium subsp. paratuberculosis
guucagcccggcgcugcgcccggu

SEQ ID NO: 2860674 - RNA, 21 nt, Mycobacterium avium subsp. paratuberculosis
guucagccggagccggccucg

SEQ ID NO: 2860675 - RNA, 21 nt, Mycobacterium avium subsp. paratuberculosis
guucagcgacuugccgccggc

SEQ ID NO: 2860676 - RNA, 13 nt, Mycobacterium avium subsp. paratuberculosis
guucagcgcggcc

SEQ ID NO: 2860677 - RNA, 17 nt, Mycobacterium avium subsp. paratuberculosis
guucagcggcaccguca

SEQ ID NO: 2860678 - RNA, 18 nt, Mycobacterium avium subsp. paratuberculosis
guucagcggcaccgucac

SEQ ID NO: 2860679 - RNA, 21 nt, Mycobacterium avium subsp. paratuberculosis
guucagcggcaccgucaccga

SEQ ID NO: 2860680 - RNA, 20 nt, Mycobacterium avium subsp. paratuberculosis
guucagcugaacggugcccg

SEQ ID NO: 2860681 - RNA, 21 nt, Mycobacterium avium subsp. paratuberculosis
guucagcugcagccggccggc

SEQ ID NO: 2860682 - RNA, 14 nt, Mycobacterium avium subsp. paratuberculosis
guucaggcccgcgc

SEQ ID NO: 2860683 - RNA, 23 nt, Mycobacterium avium subsp. paratuberculosis
guucaggcccgcgccgacggccg

SEQ ID NO: 2860684 - RNA, 17 nt, Mycobacterium avium subsp. paratuberculosis
guucagguaaucgauga

SEQ ID NO: 2860685 - RNA, 20 nt, Mycobacterium avium subsp. paratuberculosis
guucagguaggucaacccgc

SEQ ID NO: 2860686 - RNA, 16 nt, Mycobacterium avium subsp. paratuberculosis
guucaggucgaugguc

SEQ ID NO: 2860687 - RNA, 21 nt, Mycobacterium avium subsp. paratuberculosis
guucaguucgggaaaccggau

SEQ ID NO: 2860688 - RNA, 19 nt, Mycobacterium avium subsp. paratuberculosis
guucaucaccacgaacucc

SEQ ID NO: 2860689 - RNA, 16 nt, Mycobacterium avium subsp. paratuberculosis
guucaucaccuggucg

SEQ ID NO: 2860690 - RNA, 18 nt, Mycobacterium avium subsp. paratuberculosis
guucauccacucggccac

SEQ ID NO: 2860691 - RNA, 23 nt, Mycobacterium avium subsp. paratuberculosis
guucauccccagcacggugaugc

SEQ ID NO: 2860692 - RNA, 16 nt, Mycobacterium avium subsp. paratuberculosis
guucauccccgcggcc

SEQ ID NO: 2860693 - RNA, 20 nt, Mycobacterium avium subsp. paratuberculosis
guucauccccgcggccaccc

SEQ ID NO: 2860694 - RNA, 22 nt, Mycobacterium avium subsp. paratuberculosis
guucaugaucucguugcggcgc

SEQ ID NO: 2860695 - RNA, 15 nt, Mycobacterium avium subsp. paratuberculosis
guucauguagcagcg

SEQ ID NO: 2860696 - RNA, 24 nt, Mycobacterium avium subsp. paratuberculosis
guucauguagcagcgcggcuuggc

SEQ ID NO: 2860697 - RNA, 22 nt, Mycobacterium avium subsp. paratuberculosis
guucaugugaccggggucggcg

SEQ ID NO: 2860698 - RNA, 20 nt, Mycobacterium avium subsp. paratuberculosis
guucauguggaagccgcgau

SEQ ID NO: 2860699 - RNA, 12 nt, Mycobacterium avium subsp. paratuberculosis
guucauuauccc

SEQ ID NO: 2860700 - RNA, 16 nt, Mycobacterium avium subsp. paratuberculosis
guuccaaccaccgugg

SEQ ID NO: 2860701 - RNA, 14 nt, Mycobacterium avium subsp. paratuberculosis
guuccacaccgaca

SEQ ID NO: 2860702 - RNA, 15 nt, Mycobacterium avium subsp. paratuberculosis
guuccaccagcggcc

SEQ ID NO: 2860703 - RNA, 19 nt, Mycobacterium avium subsp. paratuberculosis
guuccaccagcggccgucg

SEQ ID NO: 2860704 - RNA, 22 nt, Mycobacterium avium subsp. paratuberculosis
guuccaccagcggccgucgccg

SEQ ID NO: 2860705 - RNA, 23 nt, Mycobacterium avium subsp. paratuberculosis
guuccaccagcggccgucgccgg

SEQ ID NO: 2860706 - RNA, 17 nt, Mycobacterium avium subsp. paratuberculosis
guuccaccggucggaaa

SEQ ID NO: 2860707 - RNA, 17 nt, Mycobacterium avium subsp. paratuberculosis
guuccaccucgggccgg

SEQ ID NO: 2860708 - RNA, 17 nt, Mycobacterium avium subsp. paratuberculosis
guuccagaagaucuuca

SEQ ID NO: 2860709 - RNA, 16 nt, Mycobacterium avium subsp. paratuberculosis
guuccagaccggcggc

SEQ ID NO: 2860710 - RNA, 17 nt, Mycobacterium avium subsp. paratuberculosis
guuccagaccggcggcg

SEQ ID NO: 2860711 - RNA, 15 nt, Mycobacterium avium subsp. paratuberculosis
guuccagcacccggc

SEQ ID NO: 2860712 - RNA, 14 nt, Mycobacterium avium subsp. paratuberculosis
guuccagcacgccc

SEQ ID NO: 2860713 - RNA, 17 nt, Mycobacterium avium subsp. paratuberculosis
guuccagcacgcccaga

SEQ ID NO: 2860714 - RNA, 19 nt, Mycobacterium avium subsp. paratuberculosis
guuccagccgaucgcggug

SEQ ID NO: 2860715 - RNA, 16 nt, Mycobacterium avium subsp. paratuberculosis
guuccagccggcccgc

SEQ ID NO: 2860716 - RNA, 14 nt, Mycobacterium avium subsp. paratuberculosis
guuccagcggcacc

SEQ ID NO: 2860717 - RNA, 15 nt, Mycobacterium avium subsp. paratuberculosis
guuccaggugugccg

SEQ ID NO: 2860718 - RNA, 17 nt, Mycobacterium avium subsp. paratuberculosis
guuccaguacccgcgca

SEQ ID NO: 2860719 - RNA, 17 nt, Mycobacterium avium subsp. paratuberculosis
guuccaguggcugucgg

SEQ ID NO: 2860720 - RNA, 15 nt, Mycobacterium avium subsp. paratuberculosis
guuccaucagcgccc

SEQ ID NO: 2860721 - RNA, 15 nt, Mycobacterium avium subsp. paratuberculosis
guuccaugucgacga

SEQ ID NO: 2860722 - RNA, 18 nt, Mycobacterium avium subsp. paratuberculosis
guucccagcccggccagu

SEQ ID NO: 2860723 - RNA, 18 nt, Mycobacterium avium subsp. paratuberculosis
guuccccccauacacggg

SEQ ID NO: 2860724 - RNA, 14 nt, Mycobacterium avium subsp. paratuberculosis
guuccccggccgac

SEQ ID NO: 2860725 - RNA, 18 nt, Mycobacterium avium subsp. paratuberculosis
guucccgacagcucgcgc

SEQ ID NO: 2860726 - RNA, 12 nt, Mycobacterium avium subsp. paratuberculosis
guucccggccgg

SEQ ID NO: 2860727 - RNA, 16 nt, Mycobacterium avium subsp. paratuberculosis
guucccggccgguggc

SEQ ID NO: 2860728 - RNA, 18 nt, Mycobacterium avium subsp. paratuberculosis
guucccggccgguggccg

SEQ ID NO: 2860729 - RNA, 17 nt, Mycobacterium avium subsp. paratuberculosis
guucccgugcuggccau

SEQ ID NO: 2860730 - RNA, 21 nt, Mycobacterium avium subsp. paratuberculosis
guucccuucauuagccggacu

SEQ ID NO: 2860731 - RNA, 21 nt, Mycobacterium avium subsp. paratuberculosis
guucgccggugaccugcagcg

SEQ ID NO: 2860732 - RNA, 12 nt, Mycobacterium avium subsp. paratuberculosis
guucgccgucgc

SEQ ID NO: 2860733 - RNA, 17 nt, Mycobacterium avium subsp. paratuberculosis
guucgcgcacgcuggcc

SEQ ID NO: 2860734 - RNA, 20 nt, Mycobacterium avium subsp. paratuberculosis
guucgcgcacgcuggccggc

SEQ ID NO: 2860735 - RNA, 18 nt, Mycobacterium avium subsp. paratuberculosis
guucgcgcacggcgcgca

SEQ ID NO: 2860736 - RNA, 17 nt, Mycobacterium avium subsp. paratuberculosis
guucgcgccgguaggcg

SEQ ID NO: 2860737 - RNA, 21 nt, Mycobacterium avium subsp. paratuberculosis
guucgcgccgguaggcggcca

SEQ ID NO: 2860738 - RNA, 23 nt, Mycobacterium avium subsp. paratuberculosis
guucgcgccgguaggcggccagc

SEQ ID NO: 2860739 - RNA, 15 nt, Mycobacterium avium subsp. paratuberculosis
guucgcggcgcagca

SEQ ID NO: 2860740 - RNA, 13 nt, Mycobacterium avium subsp. paratuberculosis
guucgcggcuggc

SEQ ID NO: 2860741 - RNA, 20 nt, Mycobacterium avium subsp. paratuberculosis
guucgcggcuggccgcggcg

SEQ ID NO: 2860742 - RNA, 18 nt, Mycobacterium avium subsp. paratuberculosis
guucgcguacccgcgcgg

SEQ ID NO: 2860743 - RNA, 19 nt, Mycobacterium avium subsp. paratuberculosis
guucgcucuucucguucug

SEQ ID NO: 2860744 - RNA, 13 nt, Mycobacterium avium subsp. paratuberculosis
guucgcugaccgc

SEQ ID NO: 2860745 - RNA, 12 nt, Mycobacterium avium subsp. paratuberculosis
guucgcuggcgg

SEQ ID NO: 2860746 - RNA, 13 nt, Mycobacterium avium subsp. paratuberculosis
guucgcuggcggc

SEQ ID NO: 2860747 - RNA, 14 nt, Mycobacterium avium subsp. paratuberculosis
guucgcuggcggcc

SEQ ID NO: 2860748 - RNA, 17 nt, Mycobacterium avium subsp. paratuberculosis
guucgcuggcggccagc

SEQ ID NO: 2860749 - RNA, 16 nt, Mycobacterium avium subsp. paratuberculosis
guucgcuuucgccggg

SEQ ID NO: 2860750 - RNA, 16 nt, Mycobacterium avium subsp. paratuberculosis
guucgcuuucgcguuc

SEQ ID NO: 2860751 - RNA, 13 nt, Mycobacterium avium subsp. paratuberculosis
guucggacacggc

SEQ ID NO: 2860752 - RNA, 18 nt, Mycobacterium avium subsp. paratuberculosis
guucggaguccaccggcg

SEQ ID NO: 2860753 - RNA, 19 nt, Mycobacterium avium subsp. paratuberculosis
guucggaguccaccggcgg

SEQ ID NO: 2860754 - RNA, 22 nt, Mycobacterium avium subsp. paratuberculosis
guucggaugaccaagccccgca

SEQ ID NO: 2860755 - RNA, 21 nt, Mycobacterium avium subsp. paratuberculosis
guucggcaucucggccggaag

SEQ ID NO: 2860756 - RNA, 15 nt, Mycobacterium avium subsp. paratuberculosis
guucggccaccgcgc

SEQ ID NO: 2860757 - RNA, 17 nt, Mycobacterium avium subsp. paratuberculosis
guucggccaccgcgcgg

SEQ ID NO: 2860758 - RNA, 17 nt, Mycobacterium avium subsp. paratuberculosis
guucggccaccgcgucc

SEQ ID NO: 2860759 - RNA, 16 nt, Mycobacterium avium subsp. paratuberculosis
guucggccagcgccgc

SEQ ID NO: 2860760 - RNA, 19 nt, Mycobacterium avium subsp. paratuberculosis
guucggccaguucgggucc

SEQ ID NO: 2860761 - RNA, 14 nt, Mycobacterium avium subsp. paratuberculosis
guucggccgccgug

SEQ ID NO: 2860762 - RNA, 13 nt, Mycobacterium avium subsp. paratuberculosis
guucggcgacgcu

SEQ ID NO: 2860763 - RNA, 17 nt, Mycobacterium avium subsp. paratuberculosis
guucggcgacgcuggug

SEQ ID NO: 2860764 - RNA, 12 nt, Mycobacterium avium subsp. paratuberculosis
guucggcgagug

SEQ ID NO: 2860765 - RNA, 13 nt, Mycobacterium avium subsp. paratuberculosis
guucggcgaguga

SEQ ID NO: 2860766 - RNA, 16 nt, Mycobacterium avium subsp. paratuberculosis
guucggcgccagccgc

SEQ ID NO: 2860767 - RNA, 12 nt, Mycobacterium avium subsp. paratuberculosis
guucggcggccc

SEQ ID NO: 2860768 - RNA, 20 nt, Mycobacterium avium subsp. paratuberculosis
guucggcggcgauccggccg

SEQ ID NO: 2860769 - RNA, 16 nt, Mycobacterium avium subsp. paratuberculosis
guucggcggcgcggcc

SEQ ID NO: 2860770 - RNA, 16 nt, Mycobacterium avium subsp. paratuberculosis
guucggcgggcaggcc

SEQ ID NO: 2860771 - RNA, 18 nt, Mycobacterium avium subsp. paratuberculosis
guucggcgggggcaggga

SEQ ID NO: 2860772 - RNA, 16 nt, Mycobacterium avium subsp. paratuberculosis
guucggcgucgaaauc

SEQ ID NO: 2860773 - RNA, 23 nt, Mycobacterium avium subsp. paratuberculosis
guucggcguucgauugccggacg

SEQ ID NO: 2860774 - RNA, 13 nt, Mycobacterium avium subsp. paratuberculosis
guucggcucugca

SEQ ID NO: 2860775 - RNA, 19 nt, Mycobacterium avium subsp. paratuberculosis
guucgggauccucgccgcg

SEQ ID NO: 2860776 - RNA, 19 nt, Mycobacterium avium subsp. paratuberculosis
guucgggaucgucgccggg

SEQ ID NO: 2860777 - RNA, 20 nt, Mycobacterium avium subsp. paratuberculosis
guucgggcagauggucgccg

SEQ ID NO: 2860778 - RNA, 21 nt, Mycobacterium avium subsp. paratuberculosis
guucgggcagcgccucgagca

SEQ ID NO: 2860779 - RNA, 21 nt, Mycobacterium avium subsp. paratuberculosis
guucgggcccacacuguucgg

SEQ ID NO: 2860780 - RNA, 14 nt, Mycobacterium avium subsp. paratuberculosis
guucgggucggugg

SEQ ID NO: 2860781 - RNA, 23 nt, Mycobacterium avium subsp. paratuberculosis
guucggucucggcggcgcccagg

SEQ ID NO: 2860782 - RNA, 18 nt, Mycobacterium avium subsp. paratuberculosis
guucggugaacugcagcc

SEQ ID NO: 2860783 - RNA, 12 nt, Mycobacterium avium subsp. paratuberculosis
guucgguggcca

SEQ ID NO: 2860784 - RNA, 15 nt, Mycobacterium avium subsp. paratuberculosis
guucgguggccaccg

SEQ ID NO: 2860785 - RNA, 19 nt, Mycobacterium avium subsp. paratuberculosis
guucgguggccaccgcgac

SEQ ID NO: 2860786 - RNA, 16 nt, Mycobacterium avium subsp. paratuberculosis
guucgguggggccgcc

SEQ ID NO: 2860787 - RNA, 20 nt, Mycobacterium avium subsp. paratuberculosis
guucguagggacugcgccgg

SEQ ID NO: 2860788 - RNA, 21 nt, Mycobacterium avium subsp. paratuberculosis
guucguagggacugcgccggg

SEQ ID NO: 2860789 - RNA, 14 nt, Mycobacterium avium subsp. paratuberculosis
guucguccaccucc

SEQ ID NO: 2860790 - RNA, 18 nt, Mycobacterium avium subsp. paratuberculosis
guucguccacgcuggcgg

SEQ ID NO: 2860791 - RNA, 15 nt, Mycobacterium avium subsp. paratuberculosis
guucgucccgcgcgg

SEQ ID NO: 2860792 - RNA, 21 nt, Mycobacterium avium subsp. paratuberculosis
guucgucccgcgcgggggccg

SEQ ID NO: 2860793 - RNA, 23 nt, Mycobacterium avium subsp. paratuberculosis
guucgucccgcgcgggggccgcc

SEQ ID NO: 2860794 - RNA, 22 nt, Mycobacterium avium subsp. paratuberculosis
guucgucggccgucggcgccgc

SEQ ID NO: 2860795 - RNA, 20 nt, Mycobacterium avium subsp. paratuberculosis
guucgucggcgaucgccagc

SEQ ID NO: 2860796 - RNA, 16 nt, Mycobacterium avium subsp. paratuberculosis
guucgucggucacgga

SEQ ID NO: 2860797 - RNA, 14 nt, Mycobacterium avium subsp. paratuberculosis
guucgucgucgcgc

SEQ ID NO: 2860798 - RNA, 17 nt, Mycobacterium avium subsp. paratuberculosis
guucgucgucgcgcagg

SEQ ID NO: 2860799 - RNA, 15 nt, Mycobacterium avium subsp. paratuberculosis
guucguugcgccgcc

SEQ ID NO: 2860800 - RNA, 16 nt, Mycobacterium avium subsp. paratuberculosis
guucuccagcggccgc

SEQ ID NO: 2860801 - RNA, 22 nt, Mycobacterium avium subsp. paratuberculosis
guucuccagcggccgcagcgcg

SEQ ID NO: 2860802 - RNA, 20 nt, Mycobacterium avium subsp. paratuberculosis
guucuccauccgggcggcca

SEQ ID NO: 2860803 - RNA, 14 nt, Mycobacterium avium subsp. paratuberculosis
guucuccccgccgg

SEQ ID NO: 2860804 - RNA, 15 nt, Mycobacterium avium subsp. paratuberculosis
guucuccgcgacauc

SEQ ID NO: 2860805 - RNA, 12 nt, Mycobacterium avium subsp. paratuberculosis
guucuccggccc

SEQ ID NO: 2860806 - RNA, 14 nt, Mycobacterium avium subsp. paratuberculosis
guucuccggcccgc

SEQ ID NO: 2860807 - RNA, 22 nt, Mycobacterium avium subsp. paratuberculosis
guucuccucccagcccucgucg

SEQ ID NO: 2860808 - RNA, 13 nt, Mycobacterium avium subsp. paratuberculosis
guucuccucgaac

SEQ ID NO: 2860809 - RNA, 19 nt, Mycobacterium avium subsp. paratuberculosis
guucucggcgaacagcggg

SEQ ID NO: 2860810 - RNA, 18 nt, Mycobacterium avium subsp. paratuberculosis
guucucgggggcgggcac

SEQ ID NO: 2860811 - RNA, 15 nt, Mycobacterium avium subsp. paratuberculosis
guucugcaccagcuc

SEQ ID NO: 2860812 - RNA, 11 nt, Mycobacterium avium subsp. paratuberculosis
guucugcaccg

SEQ ID NO: 2860813 - RNA, 14 nt, Mycobacterium avium subsp. paratuberculosis
guucugcaccgacu

SEQ ID NO: 2860814 - RNA, 14 nt, Mycobacterium avium subsp. paratuberculosis
guucugcacguccu

SEQ ID NO: 2860815 - RNA, 13 nt, Mycobacterium avium subsp. paratuberculosis
guucugcgugcgg

SEQ ID NO: 2860816 - RNA, 22 nt, Mycobacterium avium subsp. paratuberculosis
guugaucacguguccgucgccg

SEQ ID NO: 2860817 - RNA, 17 nt, Mycobacterium avium subsp. paratuberculosis
guugaucagcccgaccc

SEQ ID NO: 2860818 - RNA, 21 nt, Mycobacterium avium subsp. paratuberculosis
guugaucagguucaccagcac

SEQ ID NO: 2860819 - RNA, 16 nt, Mycobacterium avium subsp. paratuberculosis
guugaucauccggcgg

SEQ ID NO: 2860820 - RNA, 17 nt, Mycobacterium avium subsp. paratuberculosis
guugaucauccggcggg

SEQ ID NO: 2860821 - RNA, 15 nt, Mycobacterium avium subsp. paratuberculosis
guugauccagcggcg

SEQ ID NO: 2860822 - RNA, 23 nt, Mycobacterium avium subsp. paratuberculosis
guugauccagcggcgcaccgugu

SEQ ID NO: 2860823 - RNA, 23 nt, Mycobacterium avium subsp. paratuberculosis
guugauccgaugcagggccgaaa

SEQ ID NO: 2860824 - RNA, 14 nt, Mycobacterium avium subsp. paratuberculosis
guugauccggaucg

SEQ ID NO: 2860825 - RNA, 17 nt, Mycobacterium avium subsp. paratuberculosis
guugaucgagcaccggg

SEQ ID NO: 2860826 - RNA, 20 nt, Mycobacterium avium subsp. paratuberculosis
guugaucucgucgaugacga

SEQ ID NO: 2860827 - RNA, 20 nt, Mycobacterium avium subsp. paratuberculosis
guugaucuugaccgucgcgg

SEQ ID NO: 2860828 - RNA, 22 nt, Mycobacterium avium subsp. paratuberculosis
guugaucuugaccgucgcggag

SEQ ID NO: 2860829 - RNA, 14 nt, Mycobacterium avium subsp. paratuberculosis
guugaugaaaacca

SEQ ID NO: 2860830 - RNA, 21 nt, Mycobacterium avium subsp. paratuberculosis
guugaugaaacuuccgcccgg

SEQ ID NO: 2860831 - RNA, 16 nt, Mycobacterium avium subsp. paratuberculosis
guugaugccgcccagc

SEQ ID NO: 2860832 - RNA, 23 nt, Mycobacterium avium subsp. paratuberculosis
guugaugccgucgaucaccugcg

SEQ ID NO: 2860833 - RNA, 22 nt, Mycobacterium avium subsp. paratuberculosis
guugaugccgugcgcgcuggug

SEQ ID NO: 2860834 - RNA, 14 nt, Mycobacterium avium subsp. paratuberculosis
guugaugucgcgcg

SEQ ID NO: 2860835 - RNA, 16 nt, Mycobacterium avium subsp. paratuberculosis
guugaugucgcgcggc

SEQ ID NO: 2860836 - RNA, 16 nt, Mycobacterium avium subsp. paratuberculosis
guugaugucgguggug

SEQ ID NO: 2860837 - RNA, 15 nt, Mycobacterium avium subsp. paratuberculosis
guugauugcgcccgc

SEQ ID NO: 2860838 - RNA, 20 nt, Mycobacterium avium subsp. paratuberculosis
guugcacaccaccagcgagg

SEQ ID NO: 2860839 - RNA, 17 nt, Mycobacterium avium subsp. paratuberculosis
guugcacacccggugcg

SEQ ID NO: 2860840 - RNA, 13 nt, Mycobacterium avium subsp. paratuberculosis
guugcacaggcac

SEQ ID NO: 2860841 - RNA, 17 nt, Mycobacterium avium subsp. paratuberculosis
guugcacaggucgaugg

SEQ ID NO: 2860842 - RNA, 12 nt, Mycobacterium avium subsp. paratuberculosis
guugcaccggca

SEQ ID NO: 2860843 - RNA, 18 nt, Mycobacterium avium subsp. paratuberculosis
guugcacguaggcggcga

SEQ ID NO: 2860844 - RNA, 20 nt, Mycobacterium avium subsp. paratuberculosis
guugcacguaggcggcgagc

SEQ ID NO: 2860845 - RNA, 20 nt, Mycobacterium avium subsp. paratuberculosis
guugcacucucgcggcaagg

SEQ ID NO: 2860846 - RNA, 17 nt, Mycobacterium avium subsp. paratuberculosis
guugcacuuucgcgguc

SEQ ID NO: 2860847 - RNA, 20 nt, Mycobacterium avium subsp. paratuberculosis
guugcacuuucggcagcuga

SEQ ID NO: 2860848 - RNA, 16 nt, Mycobacterium avium subsp. paratuberculosis
guugcagcgccgcggc

SEQ ID NO: 2860849 - RNA, 14 nt, Mycobacterium avium subsp. paratuberculosis
guugcaggccacgc

SEQ ID NO: 2860850 - RNA, 18 nt, Mycobacterium avium subsp. paratuberculosis
guugcaggccacgcccac

SEQ ID NO: 2860851 - RNA, 17 nt, Mycobacterium avium subsp. paratuberculosis
guugccaggccgcgagc

SEQ ID NO: 2860852 - RNA, 19 nt, Mycobacterium avium subsp. paratuberculosis
guugccccaaaacgggcga

SEQ ID NO: 2860853 - RNA, 14 nt, Mycobacterium avium subsp. paratuberculosis
guugccccaccccg

SEQ ID NO: 2860854 - RNA, 16 nt, Mycobacterium avium subsp. paratuberculosis
guugcccgaucagccg

SEQ ID NO: 2860855 - RNA, 15 nt, Mycobacterium avium subsp. paratuberculosis
guugcccgccagcau

SEQ ID NO: 2860856 - RNA, 12 nt, Mycobacterium avium subsp. paratuberculosis
guugcccgccgc

SEQ ID NO: 2860857 - RNA, 15 nt, Mycobacterium avium subsp. paratuberculosis
guugcccgccgcggc

SEQ ID NO: 2860858 - RNA, 23 nt, Mycobacterium avium subsp. paratuberculosis
guugcccggaagccgcauggugc

SEQ ID NO: 2860859 - RNA, 19 nt, Mycobacterium avium subsp. paratuberculosis
guugcccgguuccgcgaca

SEQ ID NO: 2860860 - RNA, 17 nt, Mycobacterium avium subsp. paratuberculosis
guugcccgucgccuccg

SEQ ID NO: 2860861 - RNA, 14 nt, Mycobacterium avium subsp. paratuberculosis
guugcccugccugc

SEQ ID NO: 2860862 - RNA, 13 nt, Mycobacterium avium subsp. paratuberculosis
guugccgacggcg

SEQ ID NO: 2860863 - RNA, 17 nt, Mycobacterium avium subsp. paratuberculosis
guugccgacggcgccgg

SEQ ID NO: 2860864 - RNA, 15 nt, Mycobacterium avium subsp. paratuberculosis
guugccgaguaccga

SEQ ID NO: 2860865 - RNA, 18 nt, Mycobacterium avium subsp. paratuberculosis
guugccgauggcggucca

SEQ ID NO: 2860866 - RNA, 23 nt, Mycobacterium avium subsp. paratuberculosis
guugccgauggcgguccaccacc

SEQ ID NO: 2860867 - RNA, 16 nt, Mycobacterium avium subsp. paratuberculosis
guugccgcacaccgcg

SEQ ID NO: 2860868 - RNA, 21 nt, Mycobacterium avium subsp. paratuberculosis
guugccgcccucggccguacc

SEQ ID NO: 2860869 - RNA, 15 nt, Mycobacterium avium subsp. paratuberculosis
guugccgccgcgcgc

SEQ ID NO: 2860870 - RNA, 20 nt, Mycobacterium avium subsp. paratuberculosis
guugccgccgcgcgcggcca

SEQ ID NO: 2860871 - RNA, 13 nt, Mycobacterium avium subsp. paratuberculosis
guugccgccggcg

SEQ ID NO: 2860872 - RNA, 14 nt, Mycobacterium avium subsp. paratuberculosis
guugccgccggcgc

SEQ ID NO: 2860873 - RNA, 18 nt, Mycobacterium avium subsp. paratuberculosis
guugccgcgcgcccgcgg

SEQ ID NO: 2860874 - RNA, 14 nt, Mycobacterium avium subsp. paratuberculosis
guugccggcggcca

SEQ ID NO: 2860875 - RNA, 15 nt, Mycobacterium avium subsp. paratuberculosis
guugccggcggccag

SEQ ID NO: 2860876 - RNA, 16 nt, Mycobacterium avium subsp. paratuberculosis
guugccggcggccagc

SEQ ID NO: 2860877 - RNA, 18 nt, Mycobacterium avium subsp. paratuberculosis
guugccggcggccagcau

SEQ ID NO: 2860878 - RNA, 20 nt, Mycobacterium avium subsp. paratuberculosis
guugccggcggccagcaucg

SEQ ID NO: 2860879 - RNA, 19 nt, Mycobacterium avium subsp. paratuberculosis
guugccggucgggauggcg

SEQ ID NO: 2860880 - RNA, 13 nt, Mycobacterium avium subsp. paratuberculosis
guugccgucgacg

SEQ ID NO: 2860881 - RNA, 13 nt, Mycobacterium avium subsp. paratuberculosis
guugccgugcugg

SEQ ID NO: 2860882 - RNA, 17 nt, Mycobacterium avium subsp. paratuberculosis
guugccguuguccuuga

SEQ ID NO: 2860883 - RNA, 22 nt, Mycobacterium avium subsp. paratuberculosis
guugccguuguccuugagccgg

SEQ ID NO: 2860884 - RNA, 17 nt, Mycobacterium avium subsp. paratuberculosis
guugccucggccagcac

SEQ ID NO: 2860885 - RNA, 18 nt, Mycobacterium avium subsp. paratuberculosis
guugccucggccagcacc

SEQ ID NO: 2860886 - RNA, 19 nt, Mycobacterium avium subsp. paratuberculosis
guugccugguucgacguga

SEQ ID NO: 2860887 - RNA, 19 nt, Mycobacterium avium subsp. paratuberculosis
guugcgaaagcccaggccc

SEQ ID NO: 2860888 - RNA, 20 nt, Mycobacterium avium subsp. paratuberculosis
guugcgaaagcccaggcccg

SEQ ID NO: 2860889 - RNA, 23 nt, Mycobacterium avium subsp. paratuberculosis
guugcgaaagcccaggcccggca

SEQ ID NO: 2860890 - RNA, 12 nt, Mycobacterium avium subsp. paratuberculosis
guugcgaccccg

SEQ ID NO: 2860891 - RNA, 23 nt, Mycobacterium avium subsp. paratuberculosis
guugcgagucaucgccacccgca

SEQ ID NO: 2860892 - RNA, 15 nt, Mycobacterium avium subsp. paratuberculosis
guugcgcacccgcgg

SEQ ID NO: 2860893 - RNA, 17 nt, Mycobacterium avium subsp. paratuberculosis
guugcgcacccgcgggu

SEQ ID NO: 2860894 - RNA, 23 nt, Mycobacterium avium subsp. paratuberculosis
guugcgcaucagcgccaccagca

SEQ ID NO: 2860895 - RNA, 14 nt, Mycobacterium avium subsp. paratuberculosis
guugcgcaugacgg

SEQ ID NO: 2860896 - RNA, 11 nt, Mycobacterium avium subsp. paratuberculosis
guugcgcccgg

SEQ ID NO: 2860897 - RNA, 16 nt, Mycobacterium avium subsp. paratuberculosis
guugcgccgccagggc

SEQ ID NO: 2860898 - RNA, 23 nt, Mycobacterium avium subsp. paratuberculosis
guugcgccgccagggcgcggcgc

SEQ ID NO: 2860899 - RNA, 18 nt, Mycobacterium avium subsp. paratuberculosis
guugcgccguccggccac

SEQ ID NO: 2860900 - RNA, 19 nt, Mycobacterium avium subsp. paratuberculosis
guugcgccguccggccacg

SEQ ID NO: 2860901 - RNA, 12 nt, Mycobacterium avium subsp. paratuberculosis
guuggcgguggu

SEQ ID NO: 2860902 - RNA, 20 nt, Mycobacterium avium subsp. paratuberculosis
guuggcguagugggucggcg

SEQ ID NO: 2860903 - RNA, 21 nt, Mycobacterium avium subsp. paratuberculosis
guuggcguagugggucggcgg

SEQ ID NO: 2860904 - RNA, 16 nt, Mycobacterium avium subsp. paratuberculosis
guuggcgucgucggcg

SEQ ID NO: 2860905 - RNA, 17 nt, Mycobacterium avium subsp. paratuberculosis
guuggcgucgucggcgg

SEQ ID NO: 2860906 - RNA, 20 nt, Mycobacterium avium subsp. paratuberculosis
guuggcgucgucggcggcga

SEQ ID NO: 2860907 - RNA, 17 nt, Mycobacterium avium subsp. paratuberculosis
guuggcguggauggccg

SEQ ID NO: 2860908 - RNA, 20 nt, Mycobacterium avium subsp. paratuberculosis
guuggcguggauggccggcc

SEQ ID NO: 2860909 - RNA, 22 nt, Mycobacterium avium subsp. paratuberculosis
guuggcgugucggugauggccg

SEQ ID NO: 2860910 - RNA, 21 nt, Mycobacterium avium subsp. paratuberculosis
guuggcuuuucgggccggccc

SEQ ID NO: 2860911 - RNA, 14 nt, Mycobacterium avium subsp. paratuberculosis
guugggcagcucgg

SEQ ID NO: 2860912 - RNA, 16 nt, Mycobacterium avium subsp. paratuberculosis
guugggcagcucggcg

SEQ ID NO: 2860913 - RNA, 19 nt, Mycobacterium avium subsp. paratuberculosis
guugggccggcgcccguca

SEQ ID NO: 2860914 - RNA, 21 nt, Mycobacterium avium subsp. paratuberculosis
guugggccggcgcccgucacg

SEQ ID NO: 2860915 - RNA, 18 nt, Mycobacterium avium subsp. paratuberculosis
guugggcgccugcgguga

SEQ ID NO: 2860916 - RNA, 13 nt, Mycobacterium avium subsp. paratuberculosis
guugggcggcggc

SEQ ID NO: 2860917 - RNA, 23 nt, Mycobacterium avium subsp. paratuberculosis
guugggcggcggccaccucgccg

SEQ ID NO: 2860918 - RNA, 14 nt, Mycobacterium avium subsp. paratuberculosis
guuggggaugucga

SEQ ID NO: 2860919 - RNA, 23 nt, Mycobacterium avium subsp. paratuberculosis
guuggggccgauguucaccccga

SEQ ID NO: 2860920 - RNA, 20 nt, Mycobacterium avium subsp. paratuberculosis
guuggggccggccgcccgca

SEQ ID NO: 2860921 - RNA, 18 nt, Mycobacterium avium subsp. paratuberculosis
guugggggccagcgccga

SEQ ID NO: 2860922 - RNA, 22 nt, Mycobacterium avium subsp. paratuberculosis
guugggggucgacugggccagg

SEQ ID NO: 2860923 - RNA, 21 nt, Mycobacterium avium subsp. paratuberculosis
guugggucgcguccgcgaucg

SEQ ID NO: 2860924 - RNA, 20 nt, Mycobacterium avium subsp. paratuberculosis
guugggucucaucccgccga

SEQ ID NO: 2860925 - RNA, 16 nt, Mycobacterium avium subsp. paratuberculosis
guuggucaccaccaac

SEQ ID NO: 2860926 - RNA, 14 nt, Mycobacterium avium subsp. paratuberculosis
guuggucagccuga

SEQ ID NO: 2860927 - RNA, 15 nt, Mycobacterium avium subsp. paratuberculosis
guuggucggcgcggc

SEQ ID NO: 2860928 - RNA, 16 nt, Mycobacterium avium subsp. paratuberculosis
guuggucggcgcggcg

SEQ ID NO: 2860929 - RNA, 21 nt, Mycobacterium avium subsp. paratuberculosis
guuggucggcgcggcgacgug

SEQ ID NO: 2860930 - RNA, 21 nt, Mycobacterium avium subsp. paratuberculosis
guuggugaacagguaggcggc

SEQ ID NO: 2860931 - RNA, 20 nt, Mycobacterium avium subsp. paratuberculosis
guuggugacgcucacccggc

SEQ ID NO: 2860932 - RNA, 19 nt, Mycobacterium avium subsp. paratuberculosis
guuggugaucagccccgcc

SEQ ID NO: 2860933 - RNA, 21 nt, Mycobacterium avium subsp. paratuberculosis
guuggugaucagccccgccuc

SEQ ID NO: 2860934 - RNA, 22 nt, Mycobacterium avium subsp. paratuberculosis
guuggugaucgccgacgucugg

SEQ ID NO: 2860935 - RNA, 20 nt, Mycobacterium avium subsp. paratuberculosis
guugguggucgacgcgccgc

SEQ ID NO: 2860936 - RNA, 21 nt, Mycobacterium avium subsp. paratuberculosis
guugguugcggccccgccagc

SEQ ID NO: 2860937 - RNA, 23 nt, Mycobacterium avium subsp. paratuberculosis
guugguugcggccccgccagcag

SEQ ID NO: 2860938 - RNA, 18 nt, Mycobacterium avium subsp. paratuberculosis
guuguagcaggcgguggu

SEQ ID NO: 2860939 - RNA, 19 nt, Mycobacterium avium subsp. paratuberculosis
guuguagcaggcgguggug

SEQ ID NO: 2860940 - RNA, 17 nt, Mycobacterium avium subsp. paratuberculosis
guuguaguagaccuuga

SEQ ID NO: 2860941 - RNA, 16 nt, Mycobacterium avium subsp. paratuberculosis
guuguccagcagcgcc

SEQ ID NO: 2860942 - RNA, 12 nt, Mycobacterium avium subsp. paratuberculosis
guuguccaggua

SEQ ID NO: 2860943 - RNA, 21 nt, Mycobacterium avium subsp. paratuberculosis
guugucccggaagugccggcg

SEQ ID NO: 2860944 - RNA, 19 nt, Mycobacterium avium subsp. paratuberculosis
guugucccgggcgaacguc

SEQ ID NO: 2860945 - RNA, 16 nt, Mycobacterium avium subsp. paratuberculosis
guuguccgagccgccc

SEQ ID NO: 2860946 - RNA, 17 nt, Mycobacterium avium subsp. paratuberculosis
guugucgaacagccggu

SEQ ID NO: 2860947 - RNA, 20 nt, Mycobacterium avium subsp. paratuberculosis
guugucgaccaccaggugcg

SEQ ID NO: 2860948 - RNA, 23 nt, Mycobacterium avium subsp. paratuberculosis
guugucgaggucggugaggcugg

SEQ ID NO: 2860949 - RNA, 17 nt, Mycobacterium avium subsp. paratuberculosis
guugucgaucuccucgc

SEQ ID NO: 2860950 - RNA, 20 nt, Mycobacterium avium subsp. paratuberculosis
guugucgaugaugucguugg

SEQ ID NO: 2860951 - RNA, 14 nt, Mycobacterium avium subsp. paratuberculosis
guugucgccgcgcc

SEQ ID NO: 2860952 - RNA, 15 nt, Mycobacterium avium subsp. paratuberculosis
guugucgccgcgcca

SEQ ID NO: 2860953 - RNA, 17 nt, Mycobacterium avium subsp. paratuberculosis
guugucgccgcgccagc

SEQ ID NO: 2860954 - RNA, 19 nt, Mycobacterium avium subsp. paratuberculosis
guugucgccgcgccagccg

SEQ ID NO: 2860955 - RNA, 21 nt, Mycobacterium avium subsp. paratuberculosis
guugucgccgcgccagccgcc

SEQ ID NO: 2860956 - RNA, 18 nt, Mycobacterium avium subsp. paratuberculosis
guugucgcggcccagcac

SEQ ID NO: 2860957 - RNA, 19 nt, Mycobacterium avium subsp. paratuberculosis
guugucgcucagaggcggg

SEQ ID NO: 2860958 - RNA, 21 nt, Mycobacterium avium subsp. paratuberculosis
guugucgucgggcaccacggc

SEQ ID NO: 2860959 - RNA, 23 nt, Mycobacterium avium subsp. paratuberculosis
guugucguggguggugaccaggc

SEQ ID NO: 2860960 - RNA, 15 nt, Mycobacterium avium subsp. paratuberculosis
guugucucggcgccg

SEQ ID NO: 2860961 - RNA, 21 nt, Mycobacterium avium subsp. paratuberculosis
guugucucggcgccgucgccg

SEQ ID NO: 2860962 - RNA, 17 nt, Mycobacterium avium subsp. paratuberculosis
guugugaauccagccgu

SEQ ID NO: 2860963 - RNA, 16 nt, Mycobacterium avium subsp. paratuberculosis
guugugacccgcucgg

SEQ ID NO: 2860964 - RNA, 13 nt, Mycobacterium avium subsp. paratuberculosis
guugugcaccggc

SEQ ID NO: 2860965 - RNA, 16 nt, Mycobacterium avium subsp. paratuberculosis
guugugcauguggccg

SEQ ID NO: 2860966 - RNA, 15 nt, Mycobacterium avium subsp. paratuberculosis
guugugccaccgccg

SEQ ID NO: 2860967 - RNA, 19 nt, Mycobacterium avium subsp. paratuberculosis
guugugccaccgccgaugg

SEQ ID NO: 2860968 - RNA, 17 nt, Mycobacterium avium subsp. paratuberculosis
guugugcccgacggcgc

SEQ ID NO: 2860969 - RNA, 21 nt, Mycobacterium avium subsp. paratuberculosis
guugugccgcaaggcauucca

SEQ ID NO: 2860970 - RNA, 13 nt, Mycobacterium avium subsp. paratuberculosis
guuguggcggcca

SEQ ID NO: 2860971 - RNA, 17 nt, Mycobacterium avium subsp. paratuberculosis
guuguucuccagcggcc

SEQ ID NO: 2860972 - RNA, 23 nt, Mycobacterium avium subsp. paratuberculosis
guuguucuccagcggccgcagcg

SEQ ID NO: 2860973 - RNA, 20 nt, Mycobacterium avium subsp. paratuberculosis
guuguugaccgcggacacgc

SEQ ID NO: 2860974 - RNA, 18 nt, Mycobacterium avium subsp. paratuberculosis
guuguuuccccagcccgg

SEQ ID NO: 2860975 - RNA, 13 nt, Mycobacterium avium subsp. paratuberculosis
guuguuuuuggcc

SEQ ID NO: 2860976 - RNA, 14 nt, Mycobacterium avium subsp. paratuberculosis
guuucaccgugcgc

SEQ ID NO: 2860977 - RNA, 18 nt, Mycobacterium avium subsp. paratuberculosis
guuucaccgugcgcgcgc

SEQ ID NO: 2860978 - RNA, 14 nt, Mycobacterium avium subsp. paratuberculosis
guuucacgcucggc

SEQ ID NO: 2860979 - RNA, 16 nt, Mycobacterium avium subsp. paratuberculosis
guuucacgcucggcgg

SEQ ID NO: 2860980 - RNA, 12 nt, Mycobacterium avium subsp. paratuberculosis
guuucagcaacc

SEQ ID NO: 2860981 - RNA, 21 nt, Mycobacterium avium subsp. paratuberculosis
guuuccacgugcacggcgccg

SEQ ID NO: 2860982 - RNA, 15 nt, Mycobacterium avium subsp. paratuberculosis
guuuccagcgccggc

SEQ ID NO: 2860983 - RNA, 17 nt, Mycobacterium avium subsp. paratuberculosis
guuuccagcgccggcac

SEQ ID NO: 2860984 - RNA, 13 nt, Mycobacterium avium subsp. paratuberculosis
guuuccccaccag

SEQ ID NO: 2860985 - RNA, 13 nt, Mycobacterium avium subsp. paratuberculosis
uacaugugccgau

SEQ ID NO: 2860986 - RNA, 13 nt, Mycobacterium avium subsp. paratuberculosis
uaccacugcgcgc

SEQ ID NO: 2860987 - RNA, 16 nt, Mycobacterium avium subsp. paratuberculosis
uaccacugcgcgcccg

SEQ ID NO: 2860988 - RNA, 15 nt, Mycobacterium avium subsp. paratuberculosis
uaccacuugaaggag

SEQ ID NO: 2860989 - RNA, 21 nt, Mycobacterium avium subsp. paratuberculosis
uaccacuugaaggaggcgguc

SEQ ID NO: 2860990 - RNA, 11 nt, Mycobacterium avium subsp. paratuberculosis
uaccagcgcca

SEQ ID NO: 2860991 - RNA, 22 nt, Mycobacterium avium subsp. paratuberculosis
uaccagcgccacggguugagcc

SEQ ID NO: 2860992 - RNA, 21 nt, Mycobacterium avium subsp. paratuberculosis
uaccagcgcugguaccgguug

SEQ ID NO: 2860993 - RNA, 11 nt, Mycobacterium avium subsp. paratuberculosis
uaccagcucac

SEQ ID NO: 2860994 - RNA, 22 nt, Mycobacterium avium subsp. paratuberculosis
uaccagggcagcgccucggcgg

SEQ ID NO: 2860995 - RNA, 14 nt, Mycobacterium avium subsp. paratuberculosis
uaccagggcgagga

SEQ ID NO: 2860996 - RNA, 14 nt, Mycobacterium avium subsp. paratuberculosis
uaccagugcccgag

SEQ ID NO: 2860997 - RNA, 20 nt, Mycobacterium avium subsp. paratuberculosis
uaccaucaacccgagcaccg

SEQ ID NO: 2860998 - RNA, 19 nt, Mycobacterium avium subsp. paratuberculosis
uaccccccacgcucggcga

SEQ ID NO: 2860999 - RNA, 17 nt, Mycobacterium avium subsp. paratuberculosis
uacccccgccggggccg

SEQ ID NO: 2861000 - RNA, 20 nt, Mycobacterium avium subsp. paratuberculosis
uaccccgucgaaaccgucuc

SEQ ID NO: 2861001 - RNA, 17 nt, Mycobacterium avium subsp. paratuberculosis
uacccgaacccagcgcc

SEQ ID NO: 2861002 - RNA, 18 nt, Mycobacterium avium subsp. paratuberculosis
uacccgaacccagcgccu

SEQ ID NO: 2861003 - RNA, 12 nt, Mycobacterium avium subsp. paratuberculosis
uacccgcccagc

SEQ ID NO: 2861004 - RNA, 16 nt, Mycobacterium avium subsp. paratuberculosis
uacccgcgauggcaca

SEQ ID NO: 2861005 - RNA, 19 nt, Mycobacterium avium subsp. paratuberculosis
uacccgcgauggcacacag

SEQ ID NO: 2861006 - RNA, 20 nt, Mycobacterium avium subsp. paratuberculosis
uacccgcgcauguuggugau

SEQ ID NO: 2861007 - RNA, 14 nt, Mycobacterium avium subsp. paratuberculosis
uacccgcgcggcgc

SEQ ID NO: 2861008 - RNA, 16 nt, Mycobacterium avium subsp. paratuberculosis
uacccgcgcggcgucg

SEQ ID NO: 2861009 - RNA, 13 nt, Mycobacterium avium subsp. paratuberculosis
uacccuccgggcg

SEQ ID NO: 2861010 - RNA, 15 nt, Mycobacterium avium subsp. paratuberculosis
uacccuucggccggc

SEQ ID NO: 2861011 - RNA, 16 nt, Mycobacterium avium subsp. paratuberculosis
uaccgaccuguccgau

SEQ ID NO: 2861012 - RNA, 14 nt, Mycobacterium avium subsp. paratuberculosis
uaccgcaacaccga

SEQ ID NO: 2861013 - RNA, 21 nt, Mycobacterium avium subsp. paratuberculosis
uaccgcaacaccgaaagccga

SEQ ID NO: 2861014 - RNA, 16 nt, Mycobacterium avium subsp. paratuberculosis
uaccgcccgcgcuggu

SEQ ID NO: 2861015 - RNA, 18 nt, Mycobacterium avium subsp. paratuberculosis
uaccgccgagcgugaagu

SEQ ID NO: 2861016 - RNA, 16 nt, Mycobacterium avium subsp. paratuberculosis
uaccgccggccaggcg

SEQ ID NO: 2861017 - RNA, 13 nt, Mycobacterium avium subsp. paratuberculosis
uaccgccggccgc

SEQ ID NO: 2861018 - RNA, 16 nt, Mycobacterium avium subsp. paratuberculosis
uaccgccgggcgggcc

SEQ ID NO: 2861019 - RNA, 17 nt, Mycobacterium avium subsp. paratuberculosis
uaccgccgggcgggccg

SEQ ID NO: 2861020 - RNA, 18 nt, Mycobacterium avium subsp. paratuberculosis
uaccgccgggcgggccgc

SEQ ID NO: 2861021 - RNA, 19 nt, Mycobacterium avium subsp. paratuberculosis
uaccgccgggcgggccgca

SEQ ID NO: 2861022 - RNA, 17 nt, Mycobacterium avium subsp. paratuberculosis
uaccgcgcggagauggu

SEQ ID NO: 2861023 - RNA, 16 nt, Mycobacterium avium subsp. paratuberculosis
uaccgcgcucaccguc

SEQ ID NO: 2861024 - RNA, 17 nt, Mycobacterium avium subsp. paratuberculosis
uaccgcgcucaccgucg

SEQ ID NO: 2861025 - RNA, 13 nt, Mycobacterium avium subsp. paratuberculosis
uaccgcuuggccc

SEQ ID NO: 2861026 - RNA, 14 nt, Mycobacterium avium subsp. paratuberculosis
uaccgcuuggccca

SEQ ID NO: 2861027 - RNA, 13 nt, Mycobacterium avium subsp. paratuberculosis
uaccggcccagcg

SEQ ID NO: 2861028 - RNA, 14 nt, Mycobacterium avium subsp. paratuberculosis
uaccggcgccaggc

SEQ ID NO: 2861029 - RNA, 23 nt, Mycobacterium avium subsp. paratuberculosis
uaccggcgccaggccggcgacgc

SEQ ID NO: 2861030 - RNA, 16 nt, Mycobacterium avium subsp. paratuberculosis
uaccggcgcuggaaca

SEQ ID NO: 2861031 - RNA, 20 nt, Mycobacterium avium subsp. paratuberculosis
uaccggcguagaacaccgaa

SEQ ID NO: 2861032 - RNA, 19 nt, Mycobacterium avium subsp. paratuberculosis
uaccggguggccagcacca

SEQ ID NO: 2861033 - RNA, 15 nt, Mycobacterium avium subsp. paratuberculosis
uaccgguuccgggcg

SEQ ID NO: 2861034 - RNA, 15 nt, Mycobacterium avium subsp. paratuberculosis
uaccgugccucgcca

SEQ ID NO: 2861035 - RNA, 22 nt, Mycobacterium avium subsp. paratuberculosis
uaccucgcuguaggccagccgg

SEQ ID NO: 2861036 - RNA, 16 nt, Mycobacterium avium subsp. paratuberculosis
uaccucugcgcgagca

SEQ ID NO: 2861037 - RNA, 16 nt, Mycobacterium avium subsp. paratuberculosis
uacgacaucucgacgg

SEQ ID NO: 2861038 - RNA, 13 nt, Mycobacterium avium subsp. paratuberculosis
uacgaccgcgacg

SEQ ID NO: 2861039 - RNA, 16 nt, Mycobacterium avium subsp. paratuberculosis
uacgacguccgggccg

SEQ ID NO: 2861040 - RNA, 17 nt, Mycobacterium avium subsp. paratuberculosis
uacgacucggccuccgc

SEQ ID NO: 2861041 - RNA, 12 nt, Mycobacterium avium subsp. paratuberculosis
uacgagcagcaa

SEQ ID NO: 2861042 - RNA, 13 nt, Mycobacterium avium subsp. paratuberculosis
uacgcaucgccga

SEQ ID NO: 2861043 - RNA, 16 nt, Mycobacterium avium subsp. paratuberculosis
uacgcaucgccgagag

SEQ ID NO: 2861044 - RNA, 17 nt, Mycobacterium avium subsp. paratuberculosis
uacgcaucggcgccgga

SEQ ID NO: 2861045 - RNA, 17 nt, Mycobacterium avium subsp. paratuberculosis
uacgccaucagcaccac

SEQ ID NO: 2861046 - RNA, 21 nt, Mycobacterium avium subsp. paratuberculosis
uacgccgacgcauguccgccg

SEQ ID NO: 2861047 - RNA, 13 nt, Mycobacterium avium subsp. paratuberculosis
uacgccgacguca

SEQ ID NO: 2861048 - RNA, 23 nt, Mycobacterium avium subsp. paratuberculosis
uacgccgcgacgaugucgacccg

SEQ ID NO: 2861049 - RNA, 17 nt, Mycobacterium avium subsp. paratuberculosis
uacgccggggucgacag

SEQ ID NO: 2861050 - RNA, 17 nt, Mycobacterium avium subsp. paratuberculosis
uacgccgucugguccac

SEQ ID NO: 2861051 - RNA, 15 nt, Mycobacterium avium subsp. paratuberculosis
uacgccucaccccag

SEQ ID NO: 2861052 - RNA, 22 nt, Mycobacterium avium subsp. paratuberculosis
uacgccucaccccagcgcgacc

SEQ ID NO: 2861053 - RNA, 21 nt, Mycobacterium avium subsp. paratuberculosis
uacgcgacgaaccgccacacg

SEQ ID NO: 2861054 - RNA, 16 nt, Mycobacterium avium subsp. paratuberculosis
uacgcgagcugcuucg

SEQ ID NO: 2861055 - RNA, 23 nt, Mycobacterium avium subsp. paratuberculosis
uacgcgagcugcuucgucgccgg

SEQ ID NO: 2861056 - RNA, 18 nt, Mycobacterium avium subsp. paratuberculosis
uacgcgauggcggcgcgc

SEQ ID NO: 2861057 - RNA, 19 nt, Mycobacterium avium subsp. paratuberculosis
uacgcgauggcggcgcgcu

SEQ ID NO: 2861058 - RNA, 14 nt, Mycobacterium avium subsp. paratuberculosis
uacgcgccggccag

SEQ ID NO: 2861059 - RNA, 19 nt, Mycobacterium avium subsp. paratuberculosis
uacgcgccggccagccggc

SEQ ID NO: 2861060 - RNA, 16 nt, Mycobacterium avium subsp. paratuberculosis
uacgcgcugccgacga

SEQ ID NO: 2861061 - RNA, 18 nt, Mycobacterium avium subsp. paratuberculosis
uacgcggcguugccgccg

SEQ ID NO: 2861062 - RNA, 19 nt, Mycobacterium avium subsp. paratuberculosis
uacgcggcguugccgccgg

SEQ ID NO: 2861063 - RNA, 20 nt, Mycobacterium avium subsp. paratuberculosis
uacgcgguucgugcgcaacg

SEQ ID NO: 2861064 - RNA, 17 nt, Mycobacterium avium subsp. paratuberculosis
uacgcugcggcgccggg

SEQ ID NO: 2861065 - RNA, 20 nt, Mycobacterium avium subsp. paratuberculosis
uacgcugcggcgccgggcau

SEQ ID NO: 2861066 - RNA, 14 nt, Mycobacterium avium subsp. paratuberculosis
uacggacgcaucca

SEQ ID NO: 2861067 - RNA, 20 nt, Mycobacterium avium subsp. paratuberculosis
uacggaucgccggacagcgg

SEQ ID NO: 2861068 - RNA, 18 nt, Mycobacterium avium subsp. paratuberculosis
uacggaugccccuugacg

SEQ ID NO: 2861069 - RNA, 15 nt, Mycobacterium avium subsp. paratuberculosis
uacggccgacgccca

SEQ ID NO: 2861070 - RNA, 17 nt, Mycobacterium avium subsp. paratuberculosis
uagccguagaucgucga

SEQ ID NO: 2861071 - RNA, 14 nt, Mycobacterium avium subsp. paratuberculosis
uagccgucggcggc

SEQ ID NO: 2861072 - RNA, 16 nt, Mycobacterium avium subsp. paratuberculosis
uagccgucggcggccu

SEQ ID NO: 2861073 - RNA, 16 nt, Mycobacterium avium subsp. paratuberculosis
uagcgaggugugagga

SEQ ID NO: 2861074 - RNA, 17 nt, Mycobacterium avium subsp. paratuberculosis
uagcgaggugugaggag

SEQ ID NO: 2861075 - RNA, 17 nt, Mycobacterium avium subsp. paratuberculosis
uagcgcaacaccgaaag

SEQ ID NO: 2861076 - RNA, 17 nt, Mycobacterium avium subsp. paratuberculosis
uagcgcauaggccgcga

SEQ ID NO: 2861077 - RNA, 14 nt, Mycobacterium avium subsp. paratuberculosis
uagcgcaucagcuc

SEQ ID NO: 2861078 - RNA, 17 nt, Mycobacterium avium subsp. paratuberculosis
uagcgcaugaugcccag

SEQ ID NO: 2861079 - RNA, 16 nt, Mycobacterium avium subsp. paratuberculosis
uagcgccacaucagcu

SEQ ID NO: 2861080 - RNA, 17 nt, Mycobacterium avium subsp. paratuberculosis
uagcgccacaucagcuc

SEQ ID NO: 2861081 - RNA, 14 nt, Mycobacterium avium subsp. paratuberculosis
uagcgccgcccguc

SEQ ID NO: 2861082 - RNA, 16 nt, Mycobacterium avium subsp. paratuberculosis
uagcgccgcccgucca

SEQ ID NO: 2861083 - RNA, 16 nt, Mycobacterium avium subsp. paratuberculosis
uagcgccgccggggcg

SEQ ID NO: 2861084 - RNA, 19 nt, Mycobacterium avium subsp. paratuberculosis
uagcgccgccggggcgggc

SEQ ID NO: 2861085 - RNA, 16 nt, Mycobacterium avium subsp. paratuberculosis
uagcgccgcucggccg

SEQ ID NO: 2861086 - RNA, 14 nt, Mycobacterium avium subsp. paratuberculosis
uagcgccggcaaca

SEQ ID NO: 2861087 - RNA, 23 nt, Mycobacterium avium subsp. paratuberculosis
uagcgccgguaggccgcgccgau

SEQ ID NO: 2861088 - RNA, 23 nt, Mycobacterium avium subsp. paratuberculosis
uagcgcgcgaaggcucgccacgc

SEQ ID NO: 2861089 - RNA, 17 nt, Mycobacterium avium subsp. paratuberculosis
uagcgcggccgcccguc

SEQ ID NO: 2861090 - RNA, 20 nt, Mycobacterium avium subsp. paratuberculosis
uagcgcggcggccucggugg

SEQ ID NO: 2861091 - RNA, 22 nt, Mycobacterium avium subsp. paratuberculosis
uagcgcugggugaacaccccgc

SEQ ID NO: 2861092 - RNA, 17 nt, Mycobacterium avium subsp. paratuberculosis
uagcggaagcugccguu

SEQ ID NO: 2861093 - RNA, 20 nt, Mycobacterium avium subsp. paratuberculosis
uagcggacgacggccagcug

SEQ ID NO: 2861094 - RNA, 17 nt, Mycobacterium avium subsp. paratuberculosis
uagcggaucaggucggu

SEQ ID NO: 2861095 - RNA, 20 nt, Mycobacterium avium subsp. paratuberculosis
uagcggauggcgacggcgac

SEQ ID NO: 2861096 - RNA, 12 nt, Mycobacterium avium subsp. paratuberculosis
uagcggcccagg

SEQ ID NO: 2861097 - RNA, 15 nt, Mycobacterium avium subsp. paratuberculosis
uagcggccgcggaau

SEQ ID NO: 2861098 - RNA, 18 nt, Mycobacterium avium subsp. paratuberculosis
uagcggcgccaccggcug

SEQ ID NO: 2861099 - RNA, 21 nt, Mycobacterium avium subsp. paratuberculosis
uagcggcggcugaagcgcugg

SEQ ID NO: 2861100 - RNA, 20 nt, Mycobacterium avium subsp. paratuberculosis
uagcggcggucggcgccgau

SEQ ID NO: 2861101 - RNA, 18 nt, Mycobacterium avium subsp. paratuberculosis
uagcggcucgccaccucg

SEQ ID NO: 2861102 - RNA, 19 nt, Mycobacterium avium subsp. paratuberculosis
uagcgggagccggccaggu

SEQ ID NO: 2861103 - RNA, 18 nt, Mycobacterium avium subsp. paratuberculosis
uagcgggcuaggcucggc

SEQ ID NO: 2861104 - RNA, 12 nt, Mycobacterium avium subsp. paratuberculosis
uagcggucgggg

SEQ ID NO: 2861105 - RNA, 20 nt, Mycobacterium avium subsp. paratuberculosis
uagcgugacagucgaccucg

SEQ ID NO: 2861106 - RNA, 22 nt, Mycobacterium avium subsp. paratuberculosis
uagcguugccggccgaagugcu

SEQ ID NO: 2861107 - RNA, 15 nt, Mycobacterium avium subsp. paratuberculosis
uagcucgccgcggcc

SEQ ID NO: 2861108 - RNA, 18 nt, Mycobacterium avium subsp. paratuberculosis
uagcucgccgcggccacg

SEQ ID NO: 2861109 - RNA, 22 nt, Mycobacterium avium subsp. paratuberculosis
uagcucgccgcggccacgcucg

SEQ ID NO: 2861110 - RNA, 13 nt, Mycobacterium avium subsp. paratuberculosis
uagcugcaggcga

SEQ ID NO: 2861111 - RNA, 15 nt, Mycobacterium avium subsp. paratuberculosis
uagcugcgggucucg

SEQ ID NO: 2861112 - RNA, 13 nt, Mycobacterium avium subsp. paratuberculosis
uagcuggcgccga

SEQ ID NO: 2861113 - RNA, 19 nt, Mycobacterium avium subsp. paratuberculosis
uagcugggccccuccagcc

SEQ ID NO: 2861114 - RNA, 21 nt, Mycobacterium avium subsp. paratuberculosis
uagcugggccccuccagccgc

SEQ ID NO: 2861115 - RNA, 20 nt, Mycobacterium avium subsp. paratuberculosis
uagcuggugcgcagcccgcc

SEQ ID NO: 2861116 - RNA, 19 nt, Mycobacterium avium subsp. paratuberculosis
uagcuucacgcucggcagg

SEQ ID NO: 2861117 - RNA, 23 nt, Mycobacterium avium subsp. paratuberculosis
uagcuugggugagcuaucagcuc

SEQ ID NO: 2861118 - RNA, 18 nt, Mycobacterium avium subsp. paratuberculosis
uaggacaccacgguggcg

SEQ ID NO: 2861119 - RNA, 19 nt, Mycobacterium avium subsp. paratuberculosis
uaggacaccgucaugccgu

SEQ ID NO: 2861120 - RNA, 15 nt, Mycobacterium avium subsp. paratuberculosis
uaggacagcaccaca

SEQ ID NO: 2861121 - RNA, 12 nt, Mycobacterium avium subsp. paratuberculosis
uaggacagcagc

SEQ ID NO: 2861122 - RNA, 19 nt, Mycobacterium avium subsp. paratuberculosis
uaggacagcagccgcucac

SEQ ID NO: 2861123 - RNA, 20 nt, Mycobacterium avium subsp. paratuberculosis
uaggacaggaacgggccggc

SEQ ID NO: 2861124 - RNA, 16 nt, Mycobacterium avium subsp. paratuberculosis
uaggacccggcgagcg

SEQ ID NO: 2861125 - RNA, 17 nt, Mycobacterium avium subsp. paratuberculosis
uaggacccggcgagcgg

SEQ ID NO: 2861126 - RNA, 22 nt, Mycobacterium avium subsp. paratuberculosis
uaggacgccgcaccgcaaagca

SEQ ID NO: 2861127 - RNA, 17 nt, Mycobacterium avium subsp. paratuberculosis
uaggagcugccggcgac

SEQ ID NO: 2861128 - RNA, 22 nt, Mycobacterium avium subsp. paratuberculosis
uaggcauccugcuggccgggcu

SEQ ID NO: 2861129 - RNA, 18 nt, Mycobacterium avium subsp. paratuberculosis
uaggccagcagcgcggcg

SEQ ID NO: 2861130 - RNA, 11 nt, Mycobacterium avium subsp. paratuberculosis
uaggccagccc

SEQ ID NO: 2861131 - RNA, 21 nt, Mycobacterium avium subsp. paratuberculosis
uaggccagccgggaauaucca

SEQ ID NO: 2861132 - RNA, 14 nt, Mycobacterium avium subsp. paratuberculosis
uaggccaggaccgg

SEQ ID NO: 2861133 - RNA, 21 nt, Mycobacterium avium subsp. paratuberculosis
uaggccagguucaggcugauc

SEQ ID NO: 2861134 - RNA, 13 nt, Mycobacterium avium subsp. paratuberculosis
uaggcccaguccu

SEQ ID NO: 2861135 - RNA, 21 nt, Mycobacterium avium subsp. paratuberculosis
uaggccgccgcgaccgucagc

SEQ ID NO: 2861136 - RNA, 18 nt, Mycobacterium avium subsp. paratuberculosis
uaggccgcgaggauuucg

SEQ ID NO: 2861137 - RNA, 14 nt, Mycobacterium avium subsp. paratuberculosis
uaggccgcgcagau

SEQ ID NO: 2861138 - RNA, 15 nt, Mycobacterium avium subsp. paratuberculosis
uaggccgcgcugaac

SEQ ID NO: 2861139 - RNA, 18 nt, Mycobacterium avium subsp. paratuberculosis
uaggccgcgcuggccagc

SEQ ID NO: 2861140 - RNA, 13 nt, Mycobacterium avium subsp. paratuberculosis
uaggccggauccc

SEQ ID NO: 2861141 - RNA, 15 nt, Mycobacterium avium subsp. paratuberculosis
uaggccucguggaac

SEQ ID NO: 2861142 - RNA, 18 nt, Mycobacterium avium subsp. paratuberculosis
uaggccucguggaacacc

SEQ ID NO: 2861143 - RNA, 19 nt, Mycobacterium avium subsp. paratuberculosis
uaggccucguggaacaccg

SEQ ID NO: 2861144 - RNA, 17 nt, Mycobacterium avium subsp. paratuberculosis
uaggccuggaaccgggu

SEQ ID NO: 2861145 - RNA, 20 nt, Mycobacterium avium subsp. paratuberculosis
uaggcgaaauaacccacccc

SEQ ID NO: 2861146 - RNA, 21 nt, Mycobacterium avium subsp. paratuberculosis
uaggcgaaauaacccaccccg

SEQ ID NO: 2861147 - RNA, 19 nt, Mycobacterium avium subsp. paratuberculosis
uaggcgaagagcggcacga

SEQ ID NO: 2861148 - RNA, 19 nt, Mycobacterium avium subsp. paratuberculosis
uaggcgaccaugcccagca

SEQ ID NO: 2861149 - RNA, 20 nt, Mycobacterium avium subsp. paratuberculosis
uaggcgaucgggaacagccc

SEQ ID NO: 2861150 - RNA, 18 nt, Mycobacterium avium subsp. paratuberculosis
uaggcgcaccgccgggca

SEQ ID NO: 2861151 - RNA, 15 nt, Mycobacterium avium subsp. paratuberculosis
uaggcggccagcucc

SEQ ID NO: 2861152 - RNA, 13 nt, Mycobacterium avium subsp. paratuberculosis
uaggcggcgagcu

SEQ ID NO: 2861153 - RNA, 14 nt, Mycobacterium avium subsp. paratuberculosis
uaggcgucgaacgg

SEQ ID NO: 2861154 - RNA, 21 nt, Mycobacterium avium subsp. paratuberculosis
uaggcgucgaacgggccgggc

SEQ ID NO: 2861155 - RNA, 18 nt, Mycobacterium avium subsp. paratuberculosis
ucaagaugauugcgugcc

SEQ ID NO: 2861156 - RNA, 23 nt, Mycobacterium avium subsp. paratuberculosis
ucaagaugauugcgugcccggcc

SEQ ID NO: 2861157 - RNA, 20 nt, Mycobacterium avium subsp. paratuberculosis
ucaagauggugugcaaaagc

SEQ ID NO: 2861158 - RNA, 19 nt, Mycobacterium avium subsp. paratuberculosis
ucaagccggcaugguuccc

SEQ ID NO: 2861159 - RNA, 21 nt, Mycobacterium avium subsp. paratuberculosis
ucaagccggcaugguuccccc

SEQ ID NO: 2861160 - RNA, 18 nt, Mycobacterium avium subsp. paratuberculosis
ucaagccggccagcagcg

SEQ ID NO: 2861161 - RNA, 21 nt, Mycobacterium avium subsp. paratuberculosis
ucaagccggccagcagcggcu

SEQ ID NO: 2861162 - RNA, 15 nt, Mycobacterium avium subsp. paratuberculosis
ucaaggggccgggcu

SEQ ID NO: 2861163 - RNA, 11 nt, Mycobacterium avium subsp. paratuberculosis
ucaaggugcug

SEQ ID NO: 2861164 - RNA, 12 nt, Mycobacterium avium subsp. paratuberculosis
ucaaggugcuga

SEQ ID NO: 2861165 - RNA, 19 nt, Mycobacterium avium subsp. paratuberculosis
ucaagguggacgagcagcc

SEQ ID NO: 2861166 - RNA, 19 nt, Mycobacterium avium subsp. paratuberculosis
ucaaguccucgguggccac

SEQ ID NO: 2861167 - RNA, 20 nt, Mycobacterium avium subsp. paratuberculosis
ucaauacguuccuggugggc

SEQ ID NO: 2861168 - RNA, 17 nt, Mycobacterium avium subsp. paratuberculosis
ucaaucggucagggugu

SEQ ID NO: 2861169 - RNA, 15 nt, Mycobacterium avium subsp. paratuberculosis
ucaaugauggucagc

SEQ ID NO: 2861170 - RNA, 22 nt, Mycobacterium avium subsp. paratuberculosis
ucaauucgaagcccgugccgau

SEQ ID NO: 2861171 - RNA, 14 nt, Mycobacterium avium subsp. paratuberculosis
ucaauucugcugcc

SEQ ID NO: 2861172 - RNA, 17 nt, Mycobacterium avium subsp. paratuberculosis
ucacaaauccagcagcg

SEQ ID NO: 2861173 - RNA, 16 nt, Mycobacterium avium subsp. paratuberculosis
ucacacagccgcuugg

SEQ ID NO: 2861174 - RNA, 22 nt, Mycobacterium avium subsp. paratuberculosis
ucacacagccgcuuggcgcgcc

SEQ ID NO: 2861175 - RNA, 20 nt, Mycobacterium avium subsp. paratuberculosis
ucacaccaccacgcgaucag

SEQ ID NO: 2861176 - RNA, 17 nt, Mycobacterium avium subsp. paratuberculosis
ucacaccgcggccagcg

SEQ ID NO: 2861177 - RNA, 17 nt, Mycobacterium avium subsp. paratuberculosis
ucacaccgcugagguag

SEQ ID NO: 2861178 - RNA, 17 nt, Mycobacterium avium subsp. paratuberculosis
ucacaccgucggcgauc

SEQ ID NO: 2861179 - RNA, 18 nt, Mycobacterium avium subsp. paratuberculosis
ucacaccgucggcgaucg

SEQ ID NO: 2861180 - RNA, 21 nt, Mycobacterium avium subsp. paratuberculosis
ucacaccgucggcgaucgccg

SEQ ID NO: 2861181 - RNA, 22 nt, Mycobacterium avium subsp. paratuberculosis
ucacaccucgcuacgcgagcug

SEQ ID NO: 2861182 - RNA, 13 nt, Mycobacterium avium subsp. paratuberculosis
ucacacgcgcgcc

SEQ ID NO: 2861183 - RNA, 19 nt, Mycobacterium avium subsp. paratuberculosis
ucacacgcgcgccccgguc

SEQ ID NO: 2861184 - RNA, 17 nt, Mycobacterium avium subsp. paratuberculosis
ucacacggggcagaccg

SEQ ID NO: 2861185 - RNA, 14 nt, Mycobacterium avium subsp. paratuberculosis
ucacagccgcgaua

SEQ ID NO: 2861186 - RNA, 13 nt, Mycobacterium avium subsp. paratuberculosis
ucacagcgacaac

SEQ ID NO: 2861187 - RNA, 19 nt, Mycobacterium avium subsp. paratuberculosis
ucacagcgacaacgggccg

SEQ ID NO: 2861188 - RNA, 11 nt, Mycobacterium avium subsp. paratuberculosis
ucacagcgccc

SEQ ID NO: 2861189 - RNA, 17 nt, Mycobacterium avium subsp. paratuberculosis
ucacagcgcggcgguga

SEQ ID NO: 2861190 - RNA, 16 nt, Mycobacterium avium subsp. paratuberculosis
ucacagcucaccugcg

SEQ ID NO: 2861191 - RNA, 22 nt, Mycobacterium avium subsp. paratuberculosis
ucacauacgccucaccccagcg

SEQ ID NO: 2861192 - RNA, 21 nt, Mycobacterium avium subsp. paratuberculosis
ucaccaaauagccgucggcgg

SEQ ID NO: 2861193 - RNA, 22 nt, Mycobacterium avium subsp. paratuberculosis
ucaccaaauagccgucggcggc

SEQ ID NO: 2861194 - RNA, 15 nt, Mycobacterium avium subsp. paratuberculosis
ucaccaagcgcgaca

SEQ ID NO: 2861195 - RNA, 23 nt, Mycobacterium avium subsp. paratuberculosis
ucaccaaggcgauuucgggaucc

SEQ ID NO: 2861196 - RNA, 16 nt, Mycobacterium avium subsp. paratuberculosis
ucaccaaugcgccggc

SEQ ID NO: 2861197 - RNA, 22 nt, Mycobacterium avium subsp. paratuberculosis
ucaccaaugcgccggcggccgc

SEQ ID NO: 2861198 - RNA, 15 nt, Mycobacterium avium subsp. paratuberculosis
ucaccaccaccgccg

SEQ ID NO: 2861199 - RNA, 13 nt, Mycobacterium avium subsp. paratuberculosis
ucaccaccgccgc

SEQ ID NO: 2861200 - RNA, 15 nt, Mycobacterium avium subsp. paratuberculosis
ucaccaccgccgccg

SEQ ID NO: 2861201 - RNA, 16 nt, Mycobacterium avium subsp. paratuberculosis
ucaccaccgccgccga

SEQ ID NO: 2861202 - RNA, 16 nt, Mycobacterium avium subsp. paratuberculosis
ucaccaccgccggggu

SEQ ID NO: 2861203 - RNA, 17 nt, Mycobacterium avium subsp. paratuberculosis
ucaccaccgccggggug

SEQ ID NO: 2861204 - RNA, 19 nt, Mycobacterium avium subsp. paratuberculosis
ucaccaccggagcggcggu

SEQ ID NO: 2861205 - RNA, 20 nt, Mycobacterium avium subsp. paratuberculosis
ucaccaccggagcggcggua

SEQ ID NO: 2861206 - RNA, 23 nt, Mycobacterium avium subsp. paratuberculosis
ucaccacgcuguagggccaccac

SEQ ID NO: 2861207 - RNA, 13 nt, Mycobacterium avium subsp. paratuberculosis
ucaccacggucac

SEQ ID NO: 2861208 - RNA, 22 nt, Mycobacterium avium subsp. paratuberculosis
ucaccacggucagggccagcaa

SEQ ID NO: 2861209 - RNA, 16 nt, Mycobacterium avium subsp. paratuberculosis
ucaccacgugccacug

SEQ ID NO: 2861210 - RNA, 18 nt, Mycobacterium avium subsp. paratuberculosis
ucaccagcagacccgacg

SEQ ID NO: 2861211 - RNA, 17 nt, Mycobacterium avium subsp. paratuberculosis
ucaccagcgccucggcc

SEQ ID NO: 2861212 - RNA, 18 nt, Mycobacterium avium subsp. paratuberculosis
ucaccagcgccucggccu

SEQ ID NO: 2861213 - RNA, 14 nt, Mycobacterium avium subsp. paratuberculosis
ucaccagcgcgguc

SEQ ID NO: 2861214 - RNA, 21 nt, Mycobacterium avium subsp. paratuberculosis
ucaccagcgcggucaaaccca

SEQ ID NO: 2861215 - RNA, 12 nt, Mycobacterium avium subsp. paratuberculosis
ucaccagcgcgu

SEQ ID NO: 2861216 - RNA, 12 nt, Mycobacterium avium subsp. paratuberculosis
ucaccagcggcu

SEQ ID NO: 2861217 - RNA, 18 nt, Mycobacterium avium subsp. paratuberculosis
ucaccagcggcugcagca

SEQ ID NO: 2861218 - RNA, 17 nt, Mycobacterium avium subsp. paratuberculosis
ucaccagcucccacgac

SEQ ID NO: 2861219 - RNA, 12 nt, Mycobacterium avium subsp. paratuberculosis
ucaccagcucgc

SEQ ID NO: 2861220 - RNA, 16 nt, Mycobacterium avium subsp. paratuberculosis
ucaccagcucgccgau

SEQ ID NO: 2861221 - RNA, 16 nt, Mycobacterium avium subsp. paratuberculosis
ucaccagcugucccag

SEQ ID NO: 2861222 - RNA, 14 nt, Mycobacterium avium subsp. paratuberculosis
ucaccaggcccagg

SEQ ID NO: 2861223 - RNA, 15 nt, Mycobacterium avium subsp. paratuberculosis
ucaccaggcccaggc

SEQ ID NO: 2861224 - RNA, 16 nt, Mycobacterium avium subsp. paratuberculosis
ucaccaggcccaggcc

SEQ ID NO: 2861225 - RNA, 21 nt, Mycobacterium avium subsp. paratuberculosis
ucaccaggcugcucggcgggc

SEQ ID NO: 2861226 - RNA, 22 nt, Mycobacterium avium subsp. paratuberculosis
ucaccaggcugcucggcgggcu

SEQ ID NO: 2861227 - RNA, 21 nt, Mycobacterium avium subsp. paratuberculosis
ucaccaguuucacgucggcga

SEQ ID NO: 2861228 - RNA, 15 nt, Mycobacterium avium subsp. paratuberculosis
ucaccaucagcaccg

SEQ ID NO: 2861229 - RNA, 15 nt, Mycobacterium avium subsp. paratuberculosis
ucaccaucagcggcu

SEQ ID NO: 2861230 - RNA, 18 nt, Mycobacterium avium subsp. paratuberculosis
ucaccaucagcggcucgc

SEQ ID NO: 2861231 - RNA, 13 nt, Mycobacterium avium subsp. paratuberculosis
ucaccaugaucag

SEQ ID NO: 2861232 - RNA, 20 nt, Mycobacterium avium subsp. paratuberculosis
ucacccaaaaaggcgcgggu

SEQ ID NO: 2861233 - RNA, 16 nt, Mycobacterium avium subsp. paratuberculosis
ucacccacuggcggcc

SEQ ID NO: 2861234 - RNA, 19 nt, Mycobacterium avium subsp. paratuberculosis
ucacccacuggcggccggc

SEQ ID NO: 2861235 - RNA, 22 nt, Mycobacterium avium subsp. paratuberculosis
ucacccacuggcggccggccgc

SEQ ID NO: 2861236 - RNA, 21 nt, Mycobacterium avium subsp. paratuberculosis
ucacccagaucgcccgggcgg

SEQ ID NO: 2861237 - RNA, 19 nt, Mycobacterium avium subsp. paratuberculosis
ucacccagcgagcucaggc

SEQ ID NO: 2861238 - RNA, 23 nt, Mycobacterium avium subsp. paratuberculosis
ucacccagcgagcucaggccggc

SEQ ID NO: 2861239 - RNA, 19 nt, Mycobacterium avium subsp. paratuberculosis
ucaccgcguugucggcgac

SEQ ID NO: 2861240 - RNA, 23 nt, Mycobacterium avium subsp. paratuberculosis
ucaccgcguugucggcgacggcg

SEQ ID NO: 2861241 - RNA, 24 nt, Mycobacterium avium subsp. paratuberculosis
ucaccgcguugucggcgacggcgg

SEQ ID NO: 2861242 - RNA, 16 nt, Mycobacterium avium subsp. paratuberculosis
ucaccgcugaugccgc

SEQ ID NO: 2861243 - RNA, 18 nt, Mycobacterium avium subsp. paratuberculosis
ucaccgcugaugccgccg

SEQ ID NO: 2861244 - RNA, 18 nt, Mycobacterium avium subsp. paratuberculosis
ucaccggaccggccagca

SEQ ID NO: 2861245 - RNA, 19 nt, Mycobacterium avium subsp. paratuberculosis
ucaccggaccggccagcag

SEQ ID NO: 2861246 - RNA, 16 nt, Mycobacterium avium subsp. paratuberculosis
ucaccggaugcacgug

SEQ ID NO: 2861247 - RNA, 12 nt, Mycobacterium avium subsp. paratuberculosis
ucaccggcacgu

SEQ ID NO: 2861248 - RNA, 15 nt, Mycobacterium avium subsp. paratuberculosis
ucaccggcacgugcg

SEQ ID NO: 2861249 - RNA, 14 nt, Mycobacterium avium subsp. paratuberculosis
ucaccggccagggc

SEQ ID NO: 2861250 - RNA, 15 nt, Mycobacterium avium subsp. paratuberculosis
ucaccggccagggcc

SEQ ID NO: 2861251 - RNA, 16 nt, Mycobacterium avium subsp. paratuberculosis
ucaccggccagggccg

SEQ ID NO: 2861252 - RNA, 20 nt, Mycobacterium avium subsp. paratuberculosis
ucaccggccagggccgccgc

SEQ ID NO: 2861253 - RNA, 21 nt, Mycobacterium avium subsp. paratuberculosis
ucaccggccagggccgccgca

SEQ ID NO: 2861254 - RNA, 23 nt, Mycobacterium avium subsp. paratuberculosis
ucaccggccagggccgccgcaua

SEQ ID NO: 2861255 - RNA, 16 nt, Mycobacterium avium subsp. paratuberculosis
ucaccggccauccgcu

SEQ ID NO: 2861256 - RNA, 11 nt, Mycobacterium avium subsp. paratuberculosis
ucaccggccga

SEQ ID NO: 2861257 - RNA, 15 nt, Mycobacterium avium subsp. paratuberculosis
ucaccggccgagccg

SEQ ID NO: 2861258 - RNA, 17 nt, Mycobacterium avium subsp. paratuberculosis
ucaccggccgagccgau

SEQ ID NO: 2861259 - RNA, 19 nt, Mycobacterium avium subsp. paratuberculosis
ucaccggcgcguuggcccg

SEQ ID NO: 2861260 - RNA, 13 nt, Mycobacterium avium subsp. paratuberculosis
ucaccggcguggu

SEQ ID NO: 2861261 - RNA, 17 nt, Mycobacterium avium subsp. paratuberculosis
ucaccggcugcccgacc

SEQ ID NO: 2861262 - RNA, 22 nt, Mycobacterium avium subsp. paratuberculosis
ucaccggcugcccgacccgcac

SEQ ID NO: 2861263 - RNA, 20 nt, Mycobacterium avium subsp. paratuberculosis
ucaccggcuuggcggugaug

SEQ ID NO: 2861264 - RNA, 17 nt, Mycobacterium avium subsp. paratuberculosis
ucaccgggacaccgcug

SEQ ID NO: 2861265 - RNA, 21 nt, Mycobacterium avium subsp. paratuberculosis
ucaccgggacaccgcuggccg

SEQ ID NO: 2861266 - RNA, 13 nt, Mycobacterium avium subsp. paratuberculosis
ucaccgggcggcc

SEQ ID NO: 2861267 - RNA, 21 nt, Mycobacterium avium subsp. paratuberculosis
ucaccgggcggccguggucga

SEQ ID NO: 2861268 - RNA, 22 nt, Mycobacterium avium subsp. paratuberculosis
ucaccgggcggccguggucgau

SEQ ID NO: 2861269 - RNA, 14 nt, Mycobacterium avium subsp. paratuberculosis
ucaccgggcucggu

SEQ ID NO: 2861270 - RNA, 15 nt, Mycobacterium avium subsp. paratuberculosis
ucaccggggaucacc

SEQ ID NO: 2861271 - RNA, 17 nt, Mycobacterium avium subsp. paratuberculosis
ucaccggggaucaccuc

SEQ ID NO: 2861272 - RNA, 17 nt, Mycobacterium avium subsp. paratuberculosis
ucaccggggugccgccc

SEQ ID NO: 2861273 - RNA, 18 nt, Mycobacterium avium subsp. paratuberculosis
ucaccggggugccgccca

SEQ ID NO: 2861274 - RNA, 21 nt, Mycobacterium avium subsp. paratuberculosis
ucaccgggugaugucgccgac

SEQ ID NO: 2861275 - RNA, 23 nt, Mycobacterium avium subsp. paratuberculosis
ucaccgggugaugucgccgacca

SEQ ID NO: 2861276 - RNA, 16 nt, Mycobacterium avium subsp. paratuberculosis
ucaccgguccggucac

SEQ ID NO: 2861277 - RNA, 18 nt, Mycobacterium avium subsp. paratuberculosis
ucaccgguccggucacgc

SEQ ID NO: 2861278 - RNA, 13 nt, Mycobacterium avium subsp. paratuberculosis
ucaccggucgggc

SEQ ID NO: 2861279 - RNA, 15 nt, Mycobacterium avium subsp. paratuberculosis
ucaccgguggccgcg

SEQ ID NO: 2861280 - RNA, 17 nt, Mycobacterium avium subsp. paratuberculosis
ucaccgguggccgcguc

SEQ ID NO: 2861281 - RNA, 23 nt, Mycobacterium avium subsp. paratuberculosis
ucaccgguggccgcgucgaccag

SEQ ID NO: 2861282 - RNA, 22 nt, Mycobacterium avium subsp. paratuberculosis
ucaccggugucacgcuggcgug

SEQ ID NO: 2861283 - RNA, 14 nt, Mycobacterium avium subsp. paratuberculosis
ucaccgucacgucg

SEQ ID NO: 2861284 - RNA, 15 nt, Mycobacterium avium subsp. paratuberculosis
ucaccgucaggguga

SEQ ID NO: 2861285 - RNA, 17 nt, Mycobacterium avium subsp. paratuberculosis
ucaccgugcgcgcgcac

SEQ ID NO: 2861286 - RNA, 23 nt, Mycobacterium avium subsp. paratuberculosis
ucaccgugcgggucgcgcugcgg

SEQ ID NO: 2861287 - RNA, 15 nt, Mycobacterium avium subsp. paratuberculosis
ucaccgugggcggcg

SEQ ID NO: 2861288 - RNA, 18 nt, Mycobacterium avium subsp. paratuberculosis
ucaccgugggcggcgcga

SEQ ID NO: 2861289 - RNA, 19 nt, Mycobacterium avium subsp. paratuberculosis
ucaccgugggcggcgcgau

SEQ ID NO: 2861290 - RNA, 24 nt, Mycobacterium avium subsp. paratuberculosis
ucaccgugggcggcgcgaucgucg

SEQ ID NO: 2861291 - RNA, 19 nt, Mycobacterium avium subsp. paratuberculosis
ucaccguggugugcccgcg

SEQ ID NO: 2861292 - RNA, 20 nt, Mycobacterium avium subsp. paratuberculosis
ucaccguggugugcccgcgg

SEQ ID NO: 2861293 - RNA, 17 nt, Mycobacterium avium subsp. paratuberculosis
ucaccgugucggcgggc

SEQ ID NO: 2861294 - RNA, 19 nt, Mycobacterium avium subsp. paratuberculosis
ucaccgugucggcgggcgg

SEQ ID NO: 2861295 - RNA, 18 nt, Mycobacterium avium subsp. paratuberculosis
ucaccguucggggggcac

SEQ ID NO: 2861296 - RNA, 17 nt, Mycobacterium avium subsp. paratuberculosis
ucaccucaucgcccagc

SEQ ID NO: 2861297 - RNA, 21 nt, Mycobacterium avium subsp. paratuberculosis
ucaccucgagcacucgcggga

SEQ ID NO: 2861298 - RNA, 16 nt, Mycobacterium avium subsp. paratuberculosis
ucaccucgauggccgg

SEQ ID NO: 2861299 - RNA, 12 nt, Mycobacterium avium subsp. paratuberculosis
ucaccucgccgg

SEQ ID NO: 2861300 - RNA, 18 nt, Mycobacterium avium subsp. paratuberculosis
ucaccucgccggccgggc

SEQ ID NO: 2861301 - RNA, 16 nt, Mycobacterium avium subsp. paratuberculosis
ucaccucgcugacguc

SEQ ID NO: 2861302 - RNA, 21 nt, Mycobacterium avium subsp. paratuberculosis
ucaccucgggauagccgagcg

SEQ ID NO: 2861303 - RNA, 16 nt, Mycobacterium avium subsp. paratuberculosis
ucaccucuucgggcag

SEQ ID NO: 2861304 - RNA, 13 nt, Mycobacterium avium subsp. paratuberculosis
ucaccugcgggcg

SEQ ID NO: 2861305 - RNA, 14 nt, Mycobacterium avium subsp. paratuberculosis
ucaccuggucgggu

SEQ ID NO: 2861306 - RNA, 16 nt, Mycobacterium avium subsp. paratuberculosis
ucaccuugcccugcgu

SEQ ID NO: 2861307 - RNA, 21 nt, Mycobacterium avium subsp. paratuberculosis
ucaccuugcggccggcggcgu

SEQ ID NO: 2861308 - RNA, 16 nt, Mycobacterium avium subsp. paratuberculosis
ucaccuuggccggauc

SEQ ID NO: 2861309 - RNA, 17 nt, Mycobacterium avium subsp. paratuberculosis
ucaccuugucgcugacc

SEQ ID NO: 2861310 - RNA, 17 nt, Mycobacterium avium subsp. paratuberculosis
ucaccuuguugcgggcg

SEQ ID NO: 2861311 - RNA, 14 nt, Mycobacterium avium subsp. paratuberculosis
ucacgaacuccuug

SEQ ID NO: 2861312 - RNA, 17 nt, Mycobacterium avium subsp. paratuberculosis
ucacgaacuccuugacc

SEQ ID NO: 2861313 - RNA, 20 nt, Mycobacterium avium subsp. paratuberculosis
ucacgaacuccuugacccgg

SEQ ID NO: 2861314 - RNA, 21 nt, Mycobacterium avium subsp. paratuberculosis
ucacgaacuccuugacccggc

SEQ ID NO: 2861315 - RNA, 13 nt, Mycobacterium avium subsp. paratuberculosis
ucacgaccggcag

SEQ ID NO: 2861316 - RNA, 18 nt, Mycobacterium avium subsp. paratuberculosis
ucacgaccggcagcaccg

SEQ ID NO: 2861317 - RNA, 19 nt, Mycobacterium avium subsp. paratuberculosis
ucacgaccggcagcaccgg

SEQ ID NO: 2861318 - RNA, 20 nt, Mycobacterium avium subsp. paratuberculosis
ucacgaccggcagcaccggc

SEQ ID NO: 2861319 - RNA, 21 nt, Mycobacterium avium subsp. paratuberculosis
ucacgacgcggucugcggugc

SEQ ID NO: 2861320 - RNA, 21 nt, Mycobacterium avium subsp. paratuberculosis
ucacgacggucacggccgcca

SEQ ID NO: 2861321 - RNA, 21 nt, Mycobacterium avium subsp. paratuberculosis
ucacgaggccgggcuggcgcu

SEQ ID NO: 2861322 - RNA, 20 nt, Mycobacterium avium subsp. paratuberculosis
ucacgauauggaucagaccc

SEQ ID NO: 2861323 - RNA, 14 nt, Mycobacterium avium subsp. paratuberculosis
ucacguucggcggg

SEQ ID NO: 2861324 - RNA, 18 nt, Mycobacterium avium subsp. paratuberculosis
ucacguugauccgaugca

SEQ ID NO: 2861325 - RNA, 20 nt, Mycobacterium avium subsp. paratuberculosis
ucacguugaugaucgccgau

SEQ ID NO: 2861326 - RNA, 17 nt, Mycobacterium avium subsp. paratuberculosis
ucacguugucgcggccc

SEQ ID NO: 2861327 - RNA, 15 nt, Mycobacterium avium subsp. paratuberculosis
ucacuacccgcgaug

SEQ ID NO: 2861328 - RNA, 23 nt, Mycobacterium avium subsp. paratuberculosis
ucacucaggccacaugggccacg

SEQ ID NO: 2861329 - RNA, 16 nt, Mycobacterium avium subsp. paratuberculosis
ucacuccagcggcggc

SEQ ID NO: 2861330 - RNA, 17 nt, Mycobacterium avium subsp. paratuberculosis
ucacuccagcggcggcc

SEQ ID NO: 2861331 - RNA, 15 nt, Mycobacterium avium subsp. paratuberculosis
ucacucuggcgugac

SEQ ID NO: 2861332 - RNA, 17 nt, Mycobacterium avium subsp. paratuberculosis
ucacucuggcgugacgc

SEQ ID NO: 2861333 - RNA, 20 nt, Mycobacterium avium subsp. paratuberculosis
ucacucuggcgugacgcucg

SEQ ID NO: 2861334 - RNA, 17 nt, Mycobacterium avium subsp. paratuberculosis
ucacucuggcgugacgu

SEQ ID NO: 2861335 - RNA, 20 nt, Mycobacterium avium subsp. paratuberculosis
ucacucuggcgugacguucg

SEQ ID NO: 2861336 - RNA, 15 nt, Mycobacterium avium subsp. paratuberculosis
ucacugcacgcacgg

SEQ ID NO: 2861337 - RNA, 14 nt, Mycobacterium avium subsp. paratuberculosis
ucacugcccagcca

SEQ ID NO: 2861338 - RNA, 20 nt, Mycobacterium avium subsp. paratuberculosis
ucacugcgguagaggcgggc

SEQ ID NO: 2861339 - RNA, 16 nt, Mycobacterium avium subsp. paratuberculosis
ucacugucggcgcgga

SEQ ID NO: 2861340 - RNA, 16 nt, Mycobacterium avium subsp. paratuberculosis
ucagaagucgcccgcg

SEQ ID NO: 2861341 - RNA, 15 nt, Mycobacterium avium subsp. paratuberculosis
ucagaccgcggcggu

SEQ ID NO: 2861342 - RNA, 18 nt, Mycobacterium avium subsp. paratuberculosis
ucagaccgcggcggucgc

SEQ ID NO: 2861343 - RNA, 21 nt, Mycobacterium avium subsp. paratuberculosis
ucagacgaugggccgcccgcu

SEQ ID NO: 2861344 - RNA, 13 nt, Mycobacterium avium subsp. paratuberculosis
ucagacugccgag

SEQ ID NO: 2861345 - RNA, 17 nt, Mycobacterium avium subsp. paratuberculosis
ucagagcccgaacacgg

SEQ ID NO: 2861346 - RNA, 13 nt, Mycobacterium avium subsp. paratuberculosis
ucagaucgacgag

SEQ ID NO: 2861347 - RNA, 12 nt, Mycobacterium avium subsp. paratuberculosis
ucagaucgccga

SEQ ID NO: 2861348 - RNA, 14 nt, Mycobacterium avium subsp. paratuberculosis
ucagaucgccgacg

SEQ ID NO: 2861349 - RNA, 23 nt, Mycobacterium avium subsp. paratuberculosis
ucagaucguugaugucgguggug

SEQ ID NO: 2861350 - RNA, 15 nt, Mycobacterium avium subsp. paratuberculosis
ucagcaccaccaaca

SEQ ID NO: 2861351 - RNA, 16 nt, Mycobacterium avium subsp. paratuberculosis
ucagcaccaccaacag

SEQ ID NO: 2861352 - RNA, 21 nt, Mycobacterium avium subsp. paratuberculosis
ucagcaccaccaacagcagcg

SEQ ID NO: 2861353 - RNA, 20 nt, Mycobacterium avium subsp. paratuberculosis
ucagcaccacguugcgcccg

SEQ ID NO: 2861354 - RNA, 23 nt, Mycobacterium avium subsp. paratuberculosis
ucagcaccacguugcgcccggcc

SEQ ID NO: 2861355 - RNA, 12 nt, Mycobacterium avium subsp. paratuberculosis
ucagcaccaggu

SEQ ID NO: 2861356 - RNA, 21 nt, Mycobacterium avium subsp. paratuberculosis
ucagcaccagguggcccgacc

SEQ ID NO: 2861357 - RNA, 20 nt, Mycobacterium avium subsp. paratuberculosis
ucagcaccagguugucgccg

SEQ ID NO: 2861358 - RNA, 22 nt, Mycobacterium avium subsp. paratuberculosis
ucagcaccagguugucgccgcg

SEQ ID NO: 2861359 - RNA, 23 nt, Mycobacterium avium subsp. paratuberculosis
ucagcaccagguugucgccgcgc

SEQ ID NO: 2861360 - RNA, 12 nt, Mycobacterium avium subsp. paratuberculosis
ucagcacccgca

SEQ ID NO: 2861361 - RNA, 18 nt, Mycobacterium avium subsp. paratuberculosis
ucagcacccgcagccgcg

SEQ ID NO: 2861362 - RNA, 22 nt, Mycobacterium avium subsp. paratuberculosis
ucagcacccgcagccgcgaguc

SEQ ID NO: 2861363 - RNA, 17 nt, Mycobacterium avium subsp. paratuberculosis
ucagcaccgaaucgccg

SEQ ID NO: 2861364 - RNA, 21 nt, Mycobacterium avium subsp. paratuberculosis
ucagcaccgaaucgccgagcu

SEQ ID NO: 2861365 - RNA, 14 nt, Mycobacterium avium subsp. paratuberculosis
ucagcaccgacgcg

SEQ ID NO: 2861366 - RNA, 19 nt, Mycobacterium avium subsp. paratuberculosis
ucagcaccgacgcggcgac

SEQ ID NO: 2861367 - RNA, 15 nt, Mycobacterium avium subsp. paratuberculosis
ucagcaccgagaaca

SEQ ID NO: 2861368 - RNA, 14 nt, Mycobacterium avium subsp. paratuberculosis
ucagcaccgcgaac

SEQ ID NO: 2861369 - RNA, 19 nt, Mycobacterium avium subsp. paratuberculosis
ucagcaccgcgaacaucgc

SEQ ID NO: 2861370 - RNA, 23 nt, Mycobacterium avium subsp. paratuberculosis
ucagcaccgcgaacaucgccagc

SEQ ID NO: 2861371 - RNA, 15 nt, Mycobacterium avium subsp. paratuberculosis
ucagcaccgcgacgg

SEQ ID NO: 2861372 - RNA, 13 nt, Mycobacterium avium subsp. paratuberculosis
ucagcaccgcgcg

SEQ ID NO: 2861373 - RNA, 17 nt, Mycobacterium avium subsp. paratuberculosis
ucagcaccgcgcggcgg

SEQ ID NO: 2861374 - RNA, 20 nt, Mycobacterium avium subsp. paratuberculosis
ucagcaccgcgcggcggugc

SEQ ID NO: 2861375 - RNA, 14 nt, Mycobacterium avium subsp. paratuberculosis
ucagcaccgcggag

SEQ ID NO: 2861376 - RNA, 14 nt, Mycobacterium avium subsp. paratuberculosis
ucagcaccggguga

SEQ ID NO: 2861377 - RNA, 23 nt, Mycobacterium avium subsp. paratuberculosis
ucagcaccgggugauaccggccc

SEQ ID NO: 2861378 - RNA, 18 nt, Mycobacterium avium subsp. paratuberculosis
ucagcaccgucaccgccu

SEQ ID NO: 2861379 - RNA, 17 nt, Mycobacterium avium subsp. paratuberculosis
ucagcaccguccacagc

SEQ ID NO: 2861380 - RNA, 18 nt, Mycobacterium avium subsp. paratuberculosis
ucagcaccguccacagcc

SEQ ID NO: 2861381 - RNA, 21 nt, Mycobacterium avium subsp. paratuberculosis
ucagcaccguccacagccggc

SEQ ID NO: 2861382 - RNA, 17 nt, Mycobacterium avium subsp. paratuberculosis
ucagcaccuccggcagc

SEQ ID NO: 2861383 - RNA, 22 nt, Mycobacterium avium subsp. paratuberculosis
ucagcaccuuccaucgacgcug

SEQ ID NO: 2861384 - RNA, 14 nt, Mycobacterium avium subsp. paratuberculosis
ucagcacgcggauc

SEQ ID NO: 2861385 - RNA, 17 nt, Mycobacterium avium subsp. paratuberculosis
ucagcacgcggaucgcg

SEQ ID NO: 2861386 - RNA, 18 nt, Mycobacterium avium subsp. paratuberculosis
ucagcacgcggaucgcgc

SEQ ID NO: 2861387 - RNA, 22 nt, Mycobacterium avium subsp. paratuberculosis
ucagcacgcggaucgcgcugac

SEQ ID NO: 2861388 - RNA, 14 nt, Mycobacterium avium subsp. paratuberculosis
ucagcacgcugauc

SEQ ID NO: 2861389 - RNA, 14 nt, Mycobacterium avium subsp. paratuberculosis
ucagcacggccgcg

SEQ ID NO: 2861390 - RNA, 20 nt, Mycobacterium avium subsp. paratuberculosis
ucagcacguugugggcgggc

SEQ ID NO: 2861391 - RNA, 22 nt, Mycobacterium avium subsp. paratuberculosis
ucagcagcaccgcauggggcag

SEQ ID NO: 2861392 - RNA, 14 nt, Mycobacterium avium subsp. paratuberculosis
ucagcagcaccggc

SEQ ID NO: 2861393 - RNA, 15 nt, Mycobacterium avium subsp. paratuberculosis
ucagcagcaccggcg

SEQ ID NO: 2861394 - RNA, 13 nt, Mycobacterium avium subsp. paratuberculosis
ucagcagcaccug

SEQ ID NO: 2861395 - RNA, 15 nt, Mycobacterium avium subsp. paratuberculosis
ucagcagcagguccu

SEQ ID NO: 2861396 - RNA, 14 nt, Mycobacterium avium subsp. paratuberculosis
ucagcagccgggcc

SEQ ID NO: 2861397 - RNA, 15 nt, Mycobacterium avium subsp. paratuberculosis
ucagcagccgggccu

SEQ ID NO: 2861398 - RNA, 13 nt, Mycobacterium avium subsp. paratuberculosis
ucagcagcgacau

SEQ ID NO: 2861399 - RNA, 12 nt, Mycobacterium avium subsp. paratuberculosis
ucagcagcgccu

SEQ ID NO: 2861400 - RNA, 13 nt, Mycobacterium avium subsp. paratuberculosis
ucagcagcgccuc

SEQ ID NO: 2861401 - RNA, 21 nt, Mycobacterium avium subsp. paratuberculosis
ucagcagcgccucgccgggcc

SEQ ID NO: 2861402 - RNA, 12 nt, Mycobacterium avium subsp. paratuberculosis
ucagcagcgcgg

SEQ ID NO: 2861403 - RNA, 13 nt, Mycobacterium avium subsp. paratuberculosis
ucagcagcgcggu

SEQ ID NO: 2861404 - RNA, 12 nt, Mycobacterium avium subsp. paratuberculosis
ucagcagcgcgu

SEQ ID NO: 2861405 - RNA, 19 nt, Mycobacterium avium subsp. paratuberculosis
ucagcagcgcguaggugcg

SEQ ID NO: 2861406 - RNA, 13 nt, Mycobacterium avium subsp. paratuberculosis
ucagcagcgggcc

SEQ ID NO: 2861407 - RNA, 23 nt, Mycobacterium avium subsp. paratuberculosis
ucagcagcuagcccagaacugcu

SEQ ID NO: 2861408 - RNA, 22 nt, Mycobacterium avium subsp. paratuberculosis
ucagcgccgucuccucgaccag

SEQ ID NO: 2861409 - RNA, 19 nt, Mycobacterium avium subsp. paratuberculosis
ucagcgccugguccucccg

SEQ ID NO: 2861410 - RNA, 23 nt, Mycobacterium avium subsp. paratuberculosis
ucagcgccugguccucccgggug

SEQ ID NO: 2861411 - RNA, 13 nt, Mycobacterium avium subsp. paratuberculosis
ucagcgcgacagc

SEQ ID NO: 2861412 - RNA, 15 nt, Mycobacterium avium subsp. paratuberculosis
ucagcgcgacaucgc

SEQ ID NO: 2861413 - RNA, 19 nt, Mycobacterium avium subsp. paratuberculosis
ucagcgcgacaucgccggc

SEQ ID NO: 2861414 - RNA, 22 nt, Mycobacterium avium subsp. paratuberculosis
ucagcgcgacaucgccggcgac

SEQ ID NO: 2861415 - RNA, 16 nt, Mycobacterium avium subsp. paratuberculosis
ucagcgcgacgugccg

SEQ ID NO: 2861416 - RNA, 21 nt, Mycobacterium avium subsp. paratuberculosis
ucagcgcgacgugccggcgau

SEQ ID NO: 2861417 - RNA, 22 nt, Mycobacterium avium subsp. paratuberculosis
ucagcgcgcaacgacgaagucg

SEQ ID NO: 2861418 - RNA, 17 nt, Mycobacterium avium subsp. paratuberculosis
ucagcgcgcacagcgcc

SEQ ID NO: 2861419 - RNA, 22 nt, Mycobacterium avium subsp. paratuberculosis
ucagcgcgcacagcgccacacc

SEQ ID NO: 2861420 - RNA, 15 nt, Mycobacterium avium subsp. paratuberculosis
ucagcgcgcccaggc

SEQ ID NO: 2861421 - RNA, 19 nt, Mycobacterium avium subsp. paratuberculosis
ucagcgcgcccaggcccga

SEQ ID NO: 2861422 - RNA, 14 nt, Mycobacterium avium subsp. paratuberculosis
ucagcgcgccgccc

SEQ ID NO: 2861423 - RNA, 21 nt, Mycobacterium avium subsp. paratuberculosis
ucagcgcgccgcccagcggug

SEQ ID NO: 2861424 - RNA, 12 nt, Mycobacterium avium subsp. paratuberculosis
ucagcgcgccgu

SEQ ID NO: 2861425 - RNA, 14 nt, Mycobacterium avium subsp. paratuberculosis
ucagcgcggcccgc

SEQ ID NO: 2861426 - RNA, 15 nt, Mycobacterium avium subsp. paratuberculosis
ucagcgcggcccgcg

SEQ ID NO: 2861427 - RNA, 14 nt, Mycobacterium avium subsp. paratuberculosis
ucagcgcggcgggc

SEQ ID NO: 2861428 - RNA, 10 nt, Mycobacterium avium subsp. paratuberculosis
ucagcgcggu

SEQ ID NO: 2861429 - RNA, 13 nt, Mycobacterium avium subsp. paratuberculosis
ucagcgcggucag

SEQ ID NO: 2861430 - RNA, 20 nt, Mycobacterium avium subsp. paratuberculosis
ucagcgcgucgaggucgcgc

SEQ ID NO: 2861431 - RNA, 22 nt, Mycobacterium avium subsp. paratuberculosis
ucagcgcgucgaggucgcgcag

SEQ ID NO: 2861432 - RNA, 21 nt, Mycobacterium avium subsp. paratuberculosis
ucagcgcgucggcgaccgcgc

SEQ ID NO: 2861433 - RNA, 18 nt, Mycobacterium avium subsp. paratuberculosis
ucagcgcgugaccccggc

SEQ ID NO: 2861434 - RNA, 23 nt, Mycobacterium avium subsp. paratuberculosis
ucagcgcgugaccccggcgacca

SEQ ID NO: 2861435 - RNA, 16 nt, Mycobacterium avium subsp. paratuberculosis
ucagcgcuccuggccg

SEQ ID NO: 2861436 - RNA, 18 nt, Mycobacterium avium subsp. paratuberculosis
ucagcgcugucgcgggcc

SEQ ID NO: 2861437 - RNA, 21 nt, Mycobacterium avium subsp. paratuberculosis
ucagcggagugaccgccagca

SEQ ID NO: 2861438 - RNA, 22 nt, Mycobacterium avium subsp. paratuberculosis
ucagcggauagaggcggcgcau

SEQ ID NO: 2861439 - RNA, 24 nt, Mycobacterium avium subsp. paratuberculosis
ucagcggauagaggcggcgcauga

SEQ ID NO: 2861440 - RNA, 18 nt, Mycobacterium avium subsp. paratuberculosis
ucagcggcaacacgccgg

SEQ ID NO: 2861441 - RNA, 19 nt, Mycobacterium avium subsp. paratuberculosis
ucagcggcaacacgccggc

SEQ ID NO: 2861442 - RNA, 22 nt, Mycobacterium avium subsp. paratuberculosis
ucagcggcaacacgccggcggc

SEQ ID NO: 2861443 - RNA, 23 nt, Mycobacterium avium subsp. paratuberculosis
ucagcggcaggucccaggccagg

SEQ ID NO: 2861444 - RNA, 16 nt, Mycobacterium avium subsp. paratuberculosis
ucagcggcaggugcgc

SEQ ID NO: 2861445 - RNA, 13 nt, Mycobacterium avium subsp. paratuberculosis
ucagcggcaucga

SEQ ID NO: 2861446 - RNA, 14 nt, Mycobacterium avium subsp. paratuberculosis
ucagcggccagccc

SEQ ID NO: 2861447 - RNA, 17 nt, Mycobacterium avium subsp. paratuberculosis
ucagcggccagcccauc

SEQ ID NO: 2861448 - RNA, 18 nt, Mycobacterium avium subsp. paratuberculosis
ucagcggccaucgccgcc

SEQ ID NO: 2861449 - RNA, 20 nt, Mycobacterium avium subsp. paratuberculosis
ucagcggccaucgccgccau

SEQ ID NO: 2861450 - RNA, 13 nt, Mycobacterium avium subsp. paratuberculosis
ucagcggcccgau

SEQ ID NO: 2861451 - RNA, 11 nt, Mycobacterium avium subsp. paratuberculosis
ucagcggccuc

SEQ ID NO: 2861452 - RNA, 18 nt, Mycobacterium avium subsp. paratuberculosis
ucagcggcgccaccggga

SEQ ID NO: 2861453 - RNA, 15 nt, Mycobacterium avium subsp. paratuberculosis
ucagcggcgggccca

SEQ ID NO: 2861454 - RNA, 18 nt, Mycobacterium avium subsp. paratuberculosis
ucagcggcgggcccagca

SEQ ID NO: 2861455 - RNA, 22 nt, Mycobacterium avium subsp. paratuberculosis
ucagcggcgucaggauggugaa

SEQ ID NO: 2861456 - RNA, 19 nt, Mycobacterium avium subsp. paratuberculosis
ucagcggcgugcugcgcag

SEQ ID NO: 2861457 - RNA, 21 nt, Mycobacterium avium subsp. paratuberculosis
ucagcgggcgcagcucgucgu

SEQ ID NO: 2861458 - RNA, 17 nt, Mycobacterium avium subsp. paratuberculosis
ucagcgggcggccagcc

SEQ ID NO: 2861459 - RNA, 22 nt, Mycobacterium avium subsp. paratuberculosis
ucagcgggcggccagccgcucc

SEQ ID NO: 2861460 - RNA, 20 nt, Mycobacterium avium subsp. paratuberculosis
ucagcggggcguccagcgag

SEQ ID NO: 2861461 - RNA, 16 nt, Mycobacterium avium subsp. paratuberculosis
ucagcggguuugacgu

SEQ ID NO: 2861462 - RNA, 18 nt, Mycobacterium avium subsp. paratuberculosis
ucagcggguuugacgucg

SEQ ID NO: 2861463 - RNA, 12 nt, Mycobacterium avium subsp. paratuberculosis
ucagcgucagca

SEQ ID NO: 2861464 - RNA, 15 nt, Mycobacterium avium subsp. paratuberculosis
ucagcgucagcacgu

SEQ ID NO: 2861465 - RNA, 13 nt, Mycobacterium avium subsp. paratuberculosis
ucagcgucgaugu

SEQ ID NO: 2861466 - RNA, 23 nt, Mycobacterium avium subsp. paratuberculosis
ucagcgucgaugugggccgcagc

SEQ ID NO: 2861467 - RNA, 17 nt, Mycobacterium avium subsp. paratuberculosis
ucagcgucgccaugccg

SEQ ID NO: 2861468 - RNA, 13 nt, Mycobacterium avium subsp. paratuberculosis
ucagcgucgccgc

SEQ ID NO: 2861469 - RNA, 19 nt, Mycobacterium avium subsp. paratuberculosis
ucagcgucuuggaaagcgc

SEQ ID NO: 2861470 - RNA, 15 nt, Mycobacterium avium subsp. paratuberculosis
ucagcguggucagcg

SEQ ID NO: 2861471 - RNA, 19 nt, Mycobacterium avium subsp. paratuberculosis
ucagcguguuggacgcccg

SEQ ID NO: 2861472 - RNA, 20 nt, Mycobacterium avium subsp. paratuberculosis
ucagcguguuggacgcccgc

SEQ ID NO: 2861473 - RNA, 16 nt, Mycobacterium avium subsp. paratuberculosis
ucagcguuccggcggc

SEQ ID NO: 2861474 - RNA, 20 nt, Mycobacterium avium subsp. paratuberculosis
ucagcucaggaacggccgga

SEQ ID NO: 2861475 - RNA, 19 nt, Mycobacterium avium subsp. paratuberculosis
ucagcuccaccugcggcac

SEQ ID NO: 2861476 - RNA, 19 nt, Mycobacterium avium subsp. paratuberculosis
ucagcucccccgucgggcc

SEQ ID NO: 2861477 - RNA, 21 nt, Mycobacterium avium subsp. paratuberculosis
ucagcuccuccugcggugggc

SEQ ID NO: 2861478 - RNA, 17 nt, Mycobacterium avium subsp. paratuberculosis
ucagcuccucgcggaac

SEQ ID NO: 2861479 - RNA, 15 nt, Mycobacterium avium subsp. paratuberculosis
ucagcucgaucgccg

SEQ ID NO: 2861480 - RNA, 19 nt, Mycobacterium avium subsp. paratuberculosis
ucagcucgaucgccgcgcc

SEQ ID NO: 2861481 - RNA, 13 nt, Mycobacterium avium subsp. paratuberculosis
ucagcucgcgcau

SEQ ID NO: 2861482 - RNA, 19 nt, Mycobacterium avium subsp. paratuberculosis
ucagcucgcgcaucagcgg

SEQ ID NO: 2861483 - RNA, 16 nt, Mycobacterium avium subsp. paratuberculosis
ucagcucgcgcccggc

SEQ ID NO: 2861484 - RNA, 17 nt, Mycobacterium avium subsp. paratuberculosis
ucagcucgcgcccggcc

SEQ ID NO: 2861485 - RNA, 20 nt, Mycobacterium avium subsp. paratuberculosis
ucagcucgcgcccggccagg

SEQ ID NO: 2861486 - RNA, 14 nt, Mycobacterium avium subsp. paratuberculosis
ucagcucggcggcc

SEQ ID NO: 2861487 - RNA, 17 nt, Mycobacterium avium subsp. paratuberculosis
ucagcucgucagcgcgg

SEQ ID NO: 2861488 - RNA, 22 nt, Mycobacterium avium subsp. paratuberculosis
ucagcucgucagcgcgggccag

SEQ ID NO: 2861489 - RNA, 16 nt, Mycobacterium avium subsp. paratuberculosis
ucagcucguggcgggc

SEQ ID NO: 2861490 - RNA, 22 nt, Mycobacterium avium subsp. paratuberculosis
ucagcucguggcgggcccgggc

SEQ ID NO: 2861491 - RNA, 20 nt, Mycobacterium avium subsp. paratuberculosis
ucagcugaacggugcccgcc

SEQ ID NO: 2861492 - RNA, 14 nt, Mycobacterium avium subsp. paratuberculosis
ucagguucgccacg

SEQ ID NO: 2861493 - RNA, 19 nt, Mycobacterium avium subsp. paratuberculosis
ucagguucuucugcgcgau

SEQ ID NO: 2861494 - RNA, 19 nt, Mycobacterium avium subsp. paratuberculosis
ucagguugaccaggugggc

SEQ ID NO: 2861495 - RNA, 18 nt, Mycobacterium avium subsp. paratuberculosis
ucagguugcgcagcagcc

SEQ ID NO: 2861496 - RNA, 16 nt, Mycobacterium avium subsp. paratuberculosis
ucagguuggggccgau

SEQ ID NO: 2861497 - RNA, 12 nt, Mycobacterium avium subsp. paratuberculosis
ucaguaccggcg

SEQ ID NO: 2861498 - RNA, 20 nt, Mycobacterium avium subsp. paratuberculosis
ucaguaccggcgaugccagc

SEQ ID NO: 2861499 - RNA, 15 nt, Mycobacterium avium subsp. paratuberculosis
ucaguccucgccgag

SEQ ID NO: 2861500 - RNA, 14 nt, Mycobacterium avium subsp. paratuberculosis
ucagucggccaccg

SEQ ID NO: 2861501 - RNA, 15 nt, Mycobacterium avium subsp. paratuberculosis
ucagucggccaccgc

SEQ ID NO: 2861502 - RNA, 17 nt, Mycobacterium avium subsp. paratuberculosis
ucagugaccagugcaga

SEQ ID NO: 2861503 - RNA, 15 nt, Mycobacterium avium subsp. paratuberculosis
ucagugaggccagca

SEQ ID NO: 2861504 - RNA, 17 nt, Mycobacterium avium subsp. paratuberculosis
ucagugaggccagcacc

SEQ ID NO: 2861505 - RNA, 13 nt, Mycobacterium avium subsp. paratuberculosis
ucagugccgcgcc

SEQ ID NO: 2861506 - RNA, 17 nt, Mycobacterium avium subsp. paratuberculosis
ucagugccgcgccaacg

SEQ ID NO: 2861507 - RNA, 19 nt, Mycobacterium avium subsp. paratuberculosis
ucagugcgcauucggcgac

SEQ ID NO: 2861508 - RNA, 20 nt, Mycobacterium avium subsp. paratuberculosis
ucagugcgcauucggcgacg

SEQ ID NO: 2861509 - RNA, 21 nt, Mycobacterium avium subsp. paratuberculosis
ucaguuaguuaaccgaagcgg

SEQ ID NO: 2861510 - RNA, 19 nt, Mycobacterium avium subsp. paratuberculosis
ucaguucguucauccgggu

SEQ ID NO: 2861511 - RNA, 20 nt, Mycobacterium avium subsp. paratuberculosis
ucaguucguucauccggguu

SEQ ID NO: 2861512 - RNA, 13 nt, Mycobacterium avium subsp. paratuberculosis
ucauacagcggcg

SEQ ID NO: 2861513 - RNA, 14 nt, Mycobacterium avium subsp. paratuberculosis
ucauacagcggcgc

SEQ ID NO: 2861514 - RNA, 15 nt, Mycobacterium avium subsp. paratuberculosis
ucauacagcggcgcg

SEQ ID NO: 2861515 - RNA, 16 nt, Mycobacterium avium subsp. paratuberculosis
ucauacagcggcgcgc

SEQ ID NO: 2861516 - RNA, 13 nt, Mycobacterium avium subsp. paratuberculosis
ucauacggcggcu

SEQ ID NO: 2861517 - RNA, 13 nt, Mycobacterium avium subsp. paratuberculosis
ucauagccggccg

SEQ ID NO: 2861518 - RNA, 14 nt, Mycobacterium avium subsp. paratuberculosis
ucauagccggccgc

SEQ ID NO: 2861519 - RNA, 15 nt, Mycobacterium avium subsp. paratuberculosis
ucauagccggccgcg

SEQ ID NO: 2861520 - RNA, 18 nt, Mycobacterium avium subsp. paratuberculosis
ucauagcugaucacaugg

SEQ ID NO: 2861521 - RNA, 15 nt, Mycobacterium avium subsp. paratuberculosis
ucauaugacgccggc

SEQ ID NO: 2861522 - RNA, 18 nt, Mycobacterium avium subsp. paratuberculosis
ucaucaccacgaacuccc

SEQ ID NO: 2861523 - RNA, 12 nt, Mycobacterium avium subsp. paratuberculosis
ucaucaccgccg

SEQ ID NO: 2861524 - RNA, 11 nt, Mycobacterium avium subsp. paratuberculosis
ucaucaccggc

SEQ ID NO: 2861525 - RNA, 13 nt, Mycobacterium avium subsp. paratuberculosis
ucaucagcgacac

SEQ ID NO: 2861526 - RNA, 13 nt, Mycobacterium avium subsp. paratuberculosis
ucaucagcgacgu

SEQ ID NO: 2861527 - RNA, 15 nt, Mycobacterium avium subsp. paratuberculosis
ucaucagcgacguca

SEQ ID NO: 2861528 - RNA, 21 nt, Mycobacterium avium subsp. paratuberculosis
ucaucagcgacgucaggucga

SEQ ID NO: 2861529 - RNA, 16 nt, Mycobacterium avium subsp. paratuberculosis
ucaucaggcggccggc

SEQ ID NO: 2861530 - RNA, 13 nt, Mycobacterium avium subsp. paratuberculosis
ucauccagccgug

SEQ ID NO: 2861531 - RNA, 21 nt, Mycobacterium avium subsp. paratuberculosis
ucauccaggugaacagcagcc

SEQ ID NO: 2861532 - RNA, 18 nt, Mycobacterium avium subsp. paratuberculosis
ucaucccccgcagcuucu

SEQ ID NO: 2861533 - RNA, 14 nt, Mycobacterium avium subsp. paratuberculosis
ucauccccuggccg

SEQ ID NO: 2861534 - RNA, 21 nt, Mycobacterium avium subsp. paratuberculosis
ucauccccuggccgaaggugg

SEQ ID NO: 2861535 - RNA, 12 nt, Mycobacterium avium subsp. paratuberculosis
ucaucccgccga

SEQ ID NO: 2861536 - RNA, 23 nt, Mycobacterium avium subsp. paratuberculosis
ucauccgggccaccaccacggcc

SEQ ID NO: 2861537 - RNA, 14 nt, Mycobacterium avium subsp. paratuberculosis
ucauccucgccgcg

SEQ ID NO: 2861538 - RNA, 16 nt, Mycobacterium avium subsp. paratuberculosis
ucauccucgccgcgcc

SEQ ID NO: 2861539 - RNA, 20 nt, Mycobacterium avium subsp. paratuberculosis
ucauccucgccgcgccagca

SEQ ID NO: 2861540 - RNA, 19 nt, Mycobacterium avium subsp. paratuberculosis
ucaucgacaccgaacccac

SEQ ID NO: 2861541 - RNA, 15 nt, Mycobacterium avium subsp. paratuberculosis
ucaucgacuugccgc

SEQ ID NO: 2861542 - RNA, 16 nt, Mycobacterium avium subsp. paratuberculosis
ucaucgacuugccgcc

SEQ ID NO: 2861543 - RNA, 17 nt, Mycobacterium avium subsp. paratuberculosis
ucaucgacuugccgccg

SEQ ID NO: 2861544 - RNA, 18 nt, Mycobacterium avium subsp. paratuberculosis
ucaucgacuugccgccgc

SEQ ID NO: 2861545 - RNA, 22 nt, Mycobacterium avium subsp. paratuberculosis
ucaucgagccgagcaccggcag

SEQ ID NO: 2861546 - RNA, 15 nt, Mycobacterium avium subsp. paratuberculosis
ucaucgagggcgucc

SEQ ID NO: 2861547 - RNA, 23 nt, Mycobacterium avium subsp. paratuberculosis
ucaucgaggucgaaccacgcggc

SEQ ID NO: 2861548 - RNA, 17 nt, Mycobacterium avium subsp. paratuberculosis
ucaucgcccagccggcg

SEQ ID NO: 2861549 - RNA, 20 nt, Mycobacterium avium subsp. paratuberculosis
ucaucgcccagccggcggau

SEQ ID NO: 2861550 - RNA, 13 nt, Mycobacterium avium subsp. paratuberculosis
ucaucgccccggc

SEQ ID NO: 2861551 - RNA, 15 nt, Mycobacterium avium subsp. paratuberculosis
ucaucgccucggucg

SEQ ID NO: 2861552 - RNA, 12 nt, Mycobacterium avium subsp. paratuberculosis
ucaucgcgcacc

SEQ ID NO: 2861553 - RNA, 21 nt, Mycobacterium avium subsp. paratuberculosis
ucaucgcgcuggggugcucga

SEQ ID NO: 2861554 - RNA, 15 nt, Mycobacterium avium subsp. paratuberculosis
ucaucgcggccgccg

SEQ ID NO: 2861555 - RNA, 16 nt, Mycobacterium avium subsp. paratuberculosis
ucaucguccacaccgg

SEQ ID NO: 2861556 - RNA, 16 nt, Mycobacterium avium subsp. paratuberculosis
ucaucgucgacccggc

SEQ ID NO: 2861557 - RNA, 13 nt, Mycobacterium avium subsp. paratuberculosis
ucaucgucgucac

SEQ ID NO: 2861558 - RNA, 19 nt, Mycobacterium avium subsp. paratuberculosis
ucaucgugacgcgaagucg

SEQ ID NO: 2861559 - RNA, 15 nt, Mycobacterium avium subsp. paratuberculosis
ucaucguguccagca

SEQ ID NO: 2861560 - RNA, 20 nt, Mycobacterium avium subsp. paratuberculosis
ucaucgugugggcgcccgcg

SEQ ID NO: 2861561 - RNA, 17 nt, Mycobacterium avium subsp. paratuberculosis
ucaucucaccgacgacc

SEQ ID NO: 2861562 - RNA, 20 nt, Mycobacterium avium subsp. paratuberculosis
ucaucucaccgacgaccucg

SEQ ID NO: 2861563 - RNA, 14 nt, Mycobacterium avium subsp. paratuberculosis
ucaucuccguguug

SEQ ID NO: 2861564 - RNA, 21 nt, Mycobacterium avium subsp. paratuberculosis
ucaucucggugguggccaucg

SEQ ID NO: 2861565 - RNA, 16 nt, Mycobacterium avium subsp. paratuberculosis
ucaucuugguguugau

SEQ ID NO: 2861566 - RNA, 14 nt, Mycobacterium avium subsp. paratuberculosis
ucaugaaggcgacg

SEQ ID NO: 2861567 - RNA, 15 nt, Mycobacterium avium subsp. paratuberculosis
ucaugagcccuccag

SEQ ID NO: 2861568 - RNA, 14 nt, Mycobacterium avium subsp. paratuberculosis
ucaugaucggcagg

SEQ ID NO: 2861569 - RNA, 15 nt, Mycobacterium avium subsp. paratuberculosis
ucaugcacggcgcug

SEQ ID NO: 2861570 - RNA, 23 nt, Mycobacterium avium subsp. paratuberculosis
ucaugccagacgcgcaccgccac

SEQ ID NO: 2861571 - RNA, 20 nt, Mycobacterium avium subsp. paratuberculosis
ucaugccauagauguuggcg

SEQ ID NO: 2861572 - RNA, 16 nt, Mycobacterium avium subsp. paratuberculosis
ucaugcccgccacggc

SEQ ID NO: 2861573 - RNA, 17 nt, Mycobacterium avium subsp. paratuberculosis
ucaugcccgccacggcc

SEQ ID NO: 2861574 - RNA, 20 nt, Mycobacterium avium subsp. paratuberculosis
ucaugccguugaugaagacc

SEQ ID NO: 2861575 - RNA, 21 nt, Mycobacterium avium subsp. paratuberculosis
ucaugcgcgucauggccgucg

SEQ ID NO: 2861576 - RNA, 22 nt, Mycobacterium avium subsp. paratuberculosis
ucauggcaguuguuccaguccc

SEQ ID NO: 2861577 - RNA, 20 nt, Mycobacterium avium subsp. paratuberculosis
uccagcccagcgcccguagc

SEQ ID NO: 2861578 - RNA, 20 nt, Mycobacterium avium subsp. paratuberculosis
uccagcccugcucggccagc

SEQ ID NO: 2861579 - RNA, 22 nt, Mycobacterium avium subsp. paratuberculosis
uccagcccugcucggccagcgg

SEQ ID NO: 2861580 - RNA, 20 nt, Mycobacterium avium subsp. paratuberculosis
uccagcccugcuugaccgcg

SEQ ID NO: 2861581 - RNA, 15 nt, Mycobacterium avium subsp. paratuberculosis
uccagccgaucgcgg

SEQ ID NO: 2861582 - RNA, 22 nt, Mycobacterium avium subsp. paratuberculosis
uccagccgaucgcggugcugca

SEQ ID NO: 2861583 - RNA, 18 nt, Mycobacterium avium subsp. paratuberculosis
uccagccgccgcguggcc

SEQ ID NO: 2861584 - RNA, 12 nt, Mycobacterium avium subsp. paratuberculosis
uccagccgccgg

SEQ ID NO: 2861585 - RNA, 14 nt, Mycobacterium avium subsp. paratuberculosis
uccagccgccgguc

SEQ ID NO: 2861586 - RNA, 14 nt, Mycobacterium avium subsp. paratuberculosis
uccagccgcgcggc

SEQ ID NO: 2861587 - RNA, 17 nt, Mycobacterium avium subsp. paratuberculosis
uccagccgcgcggccgc

SEQ ID NO: 2861588 - RNA, 22 nt, Mycobacterium avium subsp. paratuberculosis
uccagccgcgcggccgccuccg

SEQ ID NO: 2861589 - RNA, 15 nt, Mycobacterium avium subsp. paratuberculosis
uccagccguccagcc

SEQ ID NO: 2861590 - RNA, 22 nt, Mycobacterium avium subsp. paratuberculosis
uccagccgugcggcacgccgca

SEQ ID NO: 2861591 - RNA, 20 nt, Mycobacterium avium subsp. paratuberculosis
uccagccguucgcgcacggc

SEQ ID NO: 2861592 - RNA, 15 nt, Mycobacterium avium subsp. paratuberculosis
uccagccuugcagcc

SEQ ID NO: 2861593 - RNA, 21 nt, Mycobacterium avium subsp. paratuberculosis
uccagccuugcagccgcugcc

SEQ ID NO: 2861594 - RNA, 21 nt, Mycobacterium avium subsp. paratuberculosis
uccagcgagcccuucgcggug

SEQ ID NO: 2861595 - RNA, 15 nt, Mycobacterium avium subsp. paratuberculosis
uccagcgcacacacc

SEQ ID NO: 2861596 - RNA, 16 nt, Mycobacterium avium subsp. paratuberculosis
uccagcgcacacaccg

SEQ ID NO: 2861597 - RNA, 22 nt, Mycobacterium avium subsp. paratuberculosis
uccagcgccagcgaguggguga

SEQ ID NO: 2861598 - RNA, 13 nt, Mycobacterium avium subsp. paratuberculosis
uccagcgcccgcc

SEQ ID NO: 2861599 - RNA, 22 nt, Mycobacterium avium subsp. paratuberculosis
uccagcgcccgccgcaacgcgu

SEQ ID NO: 2861600 - RNA, 12 nt, Mycobacterium avium subsp. paratuberculosis
uccagcgccgag

SEQ ID NO: 2861601 - RNA, 13 nt, Mycobacterium avium subsp. paratuberculosis
uccagcgccgcca

SEQ ID NO: 2861602 - RNA, 15 nt, Mycobacterium avium subsp. paratuberculosis
uccagcgccggcacc

SEQ ID NO: 2861603 - RNA, 21 nt, Mycobacterium avium subsp. paratuberculosis
uccagcgcgaucaacgggucg

SEQ ID NO: 2861604 - RNA, 16 nt, Mycobacterium avium subsp. paratuberculosis
uccagcgcgccgcuga

SEQ ID NO: 2861605 - RNA, 14 nt, Mycobacterium avium subsp. paratuberculosis
uccagcgcggcgau

SEQ ID NO: 2861606 - RNA, 15 nt, Mycobacterium avium subsp. paratuberculosis
uccagcgcggcgauc

SEQ ID NO: 2861607 - RNA, 16 nt, Mycobacterium avium subsp. paratuberculosis
uccagcgcggucucga

SEQ ID NO: 2861608 - RNA, 23 nt, Mycobacterium avium subsp. paratuberculosis
uccagcgcggugagcagcaugcc

SEQ ID NO: 2861609 - RNA, 15 nt, Mycobacterium avium subsp. paratuberculosis
uccagcgcuggccgg

SEQ ID NO: 2861610 - RNA, 17 nt, Mycobacterium avium subsp. paratuberculosis
uccagcggccacaccgg

SEQ ID NO: 2861611 - RNA, 18 nt, Mycobacterium avium subsp. paratuberculosis
uccagcggccgcagcgcg

SEQ ID NO: 2861612 - RNA, 15 nt, Mycobacterium avium subsp. paratuberculosis
uccagcggcggccuu

SEQ ID NO: 2861613 - RNA, 18 nt, Mycobacterium avium subsp. paratuberculosis
uccagcgggcggcggugg

SEQ ID NO: 2861614 - RNA, 16 nt, Mycobacterium avium subsp. paratuberculosis
uccagcggguccagcc

SEQ ID NO: 2861615 - RNA, 18 nt, Mycobacterium avium subsp. paratuberculosis
uccagcggguccagccgc

SEQ ID NO: 2861616 - RNA, 17 nt, Mycobacterium avium subsp. paratuberculosis
uccagcggguugccgcu

SEQ ID NO: 2861617 - RNA, 13 nt, Mycobacterium avium subsp. paratuberculosis
uccagcguccggg

SEQ ID NO: 2861618 - RNA, 13 nt, Mycobacterium avium subsp. paratuberculosis
uccagcgucgcgg

SEQ ID NO: 2861619 - RNA, 23 nt, Mycobacterium avium subsp. paratuberculosis
uccagcgucuggcagccggccgg

SEQ ID NO: 2861620 - RNA, 22 nt, Mycobacterium avium subsp. paratuberculosis
uccagcgugaacguguggguga

SEQ ID NO: 2861621 - RNA, 20 nt, Mycobacterium avium subsp. paratuberculosis
uccagcuaggagccugcuga

SEQ ID NO: 2861622 - RNA, 15 nt, Mycobacterium avium subsp. paratuberculosis
uccagcucagcgcgc

SEQ ID NO: 2861623 - RNA, 14 nt, Mycobacterium avium subsp. paratuberculosis
uccagcuccgccga

SEQ ID NO: 2861624 - RNA, 15 nt, Mycobacterium avium subsp. paratuberculosis
uccagcuccgccgac

SEQ ID NO: 2861625 - RNA, 13 nt, Mycobacterium avium subsp. paratuberculosis
uccagcuccucgg

SEQ ID NO: 2861626 - RNA, 24 nt, Mycobacterium avium subsp. paratuberculosis
uccagcucgcgaagcgcgaugcgg

SEQ ID NO: 2861627 - RNA, 17 nt, Mycobacterium avium subsp. paratuberculosis
uccagcugcgcgccggc

SEQ ID NO: 2861628 - RNA, 21 nt, Mycobacterium avium subsp. paratuberculosis
uccagcuguugacgggccgcg

SEQ ID NO: 2861629 - RNA, 14 nt, Mycobacterium avium subsp. paratuberculosis
uccaggaaacggcc

SEQ ID NO: 2861630 - RNA, 22 nt, Mycobacterium avium subsp. paratuberculosis
uccaggaacggcacccgcagcu

SEQ ID NO: 2861631 - RNA, 20 nt, Mycobacterium avium subsp. paratuberculosis
uccaggaagaacccggcgug

SEQ ID NO: 2861632 - RNA, 21 nt, Mycobacterium avium subsp. paratuberculosis
uccaggaagaacccggcgugc

SEQ ID NO: 2861633 - RNA, 16 nt, Mycobacterium avium subsp. paratuberculosis
uccaggaccgcgcgcc

SEQ ID NO: 2861634 - RNA, 14 nt, Mycobacterium avium subsp. paratuberculosis
uccaggacucgggg

SEQ ID NO: 2861635 - RNA, 17 nt, Mycobacterium avium subsp. paratuberculosis
uccaggaucacgcggcg

SEQ ID NO: 2861636 - RNA, 20 nt, Mycobacterium avium subsp. paratuberculosis
uccaggaucugcagcacgcc

SEQ ID NO: 2861637 - RNA, 18 nt, Mycobacterium avium subsp. paratuberculosis
uccaggauggggaagucc

SEQ ID NO: 2861638 - RNA, 17 nt, Mycobacterium avium subsp. paratuberculosis
uccaggccgcgccgggc

SEQ ID NO: 2861639 - RNA, 19 nt, Mycobacterium avium subsp. paratuberculosis
uccaggccggcgccgcggg

SEQ ID NO: 2861640 - RNA, 20 nt, Mycobacterium avium subsp. paratuberculosis
uccaggccgucgaggcgcug

SEQ ID NO: 2861641 - RNA, 16 nt, Mycobacterium avium subsp. paratuberculosis
uccaggcgaccggccc

SEQ ID NO: 2861642 - RNA, 13 nt, Mycobacterium avium subsp. paratuberculosis
uccaggcgcaccg

SEQ ID NO: 2861643 - RNA, 17 nt, Mycobacterium avium subsp. paratuberculosis
uccaggcgcaccgccac

SEQ ID NO: 2861644 - RNA, 18 nt, Mycobacterium avium subsp. paratuberculosis
uccaggcguucgacccca

SEQ ID NO: 2861645 - RNA, 20 nt, Mycobacterium avium subsp. paratuberculosis
uccaggcguucgaccccaac

SEQ ID NO: 2861646 - RNA, 22 nt, Mycobacterium avium subsp. paratuberculosis
uccaggcguucgaccccaaccc

SEQ ID NO: 2861647 - RNA, 18 nt, Mycobacterium avium subsp. paratuberculosis
uccagggcgggucgucga

SEQ ID NO: 2861648 - RNA, 15 nt, Mycobacterium avium subsp. paratuberculosis
uccaggguggccagc

SEQ ID NO: 2861649 - RNA, 15 nt, Mycobacterium avium subsp. paratuberculosis
uccagggugguggug

SEQ ID NO: 2861650 - RNA, 19 nt, Mycobacterium avium subsp. paratuberculosis
uccaggguggugguggugc

SEQ ID NO: 2861651 - RNA, 15 nt, Mycobacterium avium subsp. paratuberculosis
uccagggugucgucg

SEQ ID NO: 2861652 - RNA, 16 nt, Mycobacterium avium subsp. paratuberculosis
uccagguacacguagc

SEQ ID NO: 2861653 - RNA, 15 nt, Mycobacterium avium subsp. paratuberculosis
uccagguacugggcg

SEQ ID NO: 2861654 - RNA, 21 nt, Mycobacterium avium subsp. paratuberculosis
uccagguagcccaugucgccg

SEQ ID NO: 2861655 - RNA, 22 nt, Mycobacterium avium subsp. paratuberculosis
uccagguagcccaugucgccgg

SEQ ID NO: 2861656 - RNA, 15 nt, Mycobacterium avium subsp. paratuberculosis
uccagguccuugaac

SEQ ID NO: 2861657 - RNA, 22 nt, Mycobacterium avium subsp. paratuberculosis
uccaggucguuggagucguccg

SEQ ID NO: 2861658 - RNA, 15 nt, Mycobacterium avium subsp. paratuberculosis
uccaggugaaugcuc

SEQ ID NO: 2861659 - RNA, 20 nt, Mycobacterium avium subsp. paratuberculosis
uccaggugaaugcucagcgg

SEQ ID NO: 2861660 - RNA, 21 nt, Mycobacterium avium subsp. paratuberculosis
uccaggugaaugcucagcggg

SEQ ID NO: 2861661 - RNA, 17 nt, Mycobacterium avium subsp. paratuberculosis
uccccaaccuggacggu

SEQ ID NO: 2861662 - RNA, 18 nt, Mycobacterium avium subsp. paratuberculosis
uccccaccaggcgcgggc

SEQ ID NO: 2861663 - RNA, 12 nt, Mycobacterium avium subsp. paratuberculosis
uccccaccguga

SEQ ID NO: 2861664 - RNA, 13 nt, Mycobacterium avium subsp. paratuberculosis
uccccagcacggu

SEQ ID NO: 2861665 - RNA, 12 nt, Mycobacterium avium subsp. paratuberculosis
uccccagcggca

SEQ ID NO: 2861666 - RNA, 18 nt, Mycobacterium avium subsp. paratuberculosis
uccccaggauggccgcuu

SEQ ID NO: 2861667 - RNA, 14 nt, Mycobacterium avium subsp. paratuberculosis
uccccauccgcggc

SEQ ID NO: 2861668 - RNA, 19 nt, Mycobacterium avium subsp. paratuberculosis
ucccccaaaacccggcauu

SEQ ID NO: 2861669 - RNA, 19 nt, Mycobacterium avium subsp. paratuberculosis
ucccccaccacguaggcga

SEQ ID NO: 2861670 - RNA, 13 nt, Mycobacterium avium subsp. paratuberculosis
uccccccgcgccg

SEQ ID NO: 2861671 - RNA, 17 nt, Mycobacterium avium subsp. paratuberculosis
ucccccgacccgccgug

SEQ ID NO: 2861672 - RNA, 13 nt, Mycobacterium avium subsp. paratuberculosis
ucccccgacgccg

SEQ ID NO: 2861673 - RNA, 17 nt, Mycobacterium avium subsp. paratuberculosis
ucccccgacgccgacac

SEQ ID NO: 2861674 - RNA, 18 nt, Mycobacterium avium subsp. paratuberculosis
ucccccgacgccgacacc

SEQ ID NO: 2861675 - RNA, 19 nt, Mycobacterium avium subsp. paratuberculosis
ucccccgacgccgacacca

SEQ ID NO: 2861676 - RNA, 22 nt, Mycobacterium avium subsp. paratuberculosis
ucccccgacgccgacaccagcg

SEQ ID NO: 2861677 - RNA, 12 nt, Mycobacterium avium subsp. paratuberculosis
ucccccgagucg

SEQ ID NO: 2861678 - RNA, 14 nt, Mycobacterium avium subsp. paratuberculosis
ucccccgccgaccg

SEQ ID NO: 2861679 - RNA, 16 nt, Mycobacterium avium subsp. paratuberculosis
ucccccggaccugccg

SEQ ID NO: 2861680 - RNA, 15 nt, Mycobacterium avium subsp. paratuberculosis
ucccccgucgggccg

SEQ ID NO: 2861681 - RNA, 20 nt, Mycobacterium avium subsp. paratuberculosis
ucccccgucgggccguccgc

SEQ ID NO: 2861682 - RNA, 23 nt, Mycobacterium avium subsp. paratuberculosis
ucccccgucgggccguccgccgg

SEQ ID NO: 2861683 - RNA, 15 nt, Mycobacterium avium subsp. paratuberculosis
ucccccucggcggga

SEQ ID NO: 2861684 - RNA, 18 nt, Mycobacterium avium subsp. paratuberculosis
uccccgaagcgcuaacaa

SEQ ID NO: 2861685 - RNA, 14 nt, Mycobacterium avium subsp. paratuberculosis
uccccgaccacacc

SEQ ID NO: 2861686 - RNA, 14 nt, Mycobacterium avium subsp. paratuberculosis
uccccgagcacguc

SEQ ID NO: 2861687 - RNA, 15 nt, Mycobacterium avium subsp. paratuberculosis
uccccgagcacgucg

SEQ ID NO: 2861688 - RNA, 23 nt, Mycobacterium avium subsp. paratuberculosis
uccccgauccggcugagcagcuc

SEQ ID NO: 2861689 - RNA, 17 nt, Mycobacterium avium subsp. paratuberculosis
uccccgauuucgcggcc

SEQ ID NO: 2861690 - RNA, 18 nt, Mycobacterium avium subsp. paratuberculosis
uccccgauuucgcggccg

SEQ ID NO: 2861691 - RNA, 23 nt, Mycobacterium avium subsp. paratuberculosis
uccccgcaaacacgagcagaccc

SEQ ID NO: 2861692 - RNA, 20 nt, Mycobacterium avium subsp. paratuberculosis
uccccgcagcucccccggcg

SEQ ID NO: 2861693 - RNA, 17 nt, Mycobacterium avium subsp. paratuberculosis
uccccgccucgguugau

SEQ ID NO: 2861694 - RNA, 15 nt, Mycobacterium avium subsp. paratuberculosis
uccccgcgcccgccg

SEQ ID NO: 2861695 - RNA, 16 nt, Mycobacterium avium subsp. paratuberculosis
uccccgcgcccgccgc

SEQ ID NO: 2861696 - RNA, 15 nt, Mycobacterium avium subsp. paratuberculosis
uccccgcgccgggca

SEQ ID NO: 2861697 - RNA, 16 nt, Mycobacterium avium subsp. paratuberculosis
uccccgcgcggcucgc

SEQ ID NO: 2861698 - RNA, 16 nt, Mycobacterium avium subsp. paratuberculosis
uccccgcgcugggcug

SEQ ID NO: 2861699 - RNA, 23 nt, Mycobacterium avium subsp. paratuberculosis
uccccgcgcugggcuggccgucc

SEQ ID NO: 2861700 - RNA, 12 nt, Mycobacterium avium subsp. paratuberculosis
uccccgcggcca

SEQ ID NO: 2861701 - RNA, 19 nt, Mycobacterium avium subsp. paratuberculosis
uccccgcggccaccccgga

SEQ ID NO: 2861702 - RNA, 21 nt, Mycobacterium avium subsp. paratuberculosis
uccccgcgggugacgcugacc

SEQ ID NO: 2861703 - RNA, 18 nt, Mycobacterium avium subsp. paratuberculosis
uccccgcguuggccagcg

SEQ ID NO: 2861704 - RNA, 21 nt, Mycobacterium avium subsp. paratuberculosis
uccccgcguuggccagcgccu

SEQ ID NO: 2861705 - RNA, 22 nt, Mycobacterium avium subsp. paratuberculosis
uccccgcguuggccagcgccuc

SEQ ID NO: 2861706 - RNA, 20 nt, Mycobacterium avium subsp. paratuberculosis
uccccgcuagccucaacgac

SEQ ID NO: 2861707 - RNA, 14 nt, Mycobacterium avium subsp. paratuberculosis
uccccgcuggcgcc

SEQ ID NO: 2861708 - RNA, 16 nt, Mycobacterium avium subsp. paratuberculosis
uccccggagagccggu

SEQ ID NO: 2861709 - RNA, 15 nt, Mycobacterium avium subsp. paratuberculosis
uccccggagucgucg

SEQ ID NO: 2861710 - RNA, 13 nt, Mycobacterium avium subsp. paratuberculosis
uccccggccagca

SEQ ID NO: 2861711 - RNA, 16 nt, Mycobacterium avium subsp. paratuberculosis
uccccggccagcacgc

SEQ ID NO: 2861712 - RNA, 17 nt, Mycobacterium avium subsp. paratuberculosis
uccccggcggccggccc

SEQ ID NO: 2861713 - RNA, 12 nt, Mycobacterium avium subsp. paratuberculosis
uccccggcgggc

SEQ ID NO: 2861714 - RNA, 16 nt, Mycobacterium avium subsp. paratuberculosis
uccccgggcaccccgg

SEQ ID NO: 2861715 - RNA, 12 nt, Mycobacterium avium subsp. paratuberculosis
uccccgggccca

SEQ ID NO: 2861716 - RNA, 15 nt, Mycobacterium avium subsp. paratuberculosis
uccccgggcccagca

SEQ ID NO: 2861717 - RNA, 18 nt, Mycobacterium avium subsp. paratuberculosis
uccccgggcccagcacca

SEQ ID NO: 2861718 - RNA, 19 nt, Mycobacterium avium subsp. paratuberculosis
uccccgggcccagcaccac

SEQ ID NO: 2861719 - RNA, 21 nt, Mycobacterium avium subsp. paratuberculosis
uccccgggcccagcaccacca

SEQ ID NO: 2861720 - RNA, 18 nt, Mycobacterium avium subsp. paratuberculosis
uccccgggcgagcgucgc

SEQ ID NO: 2861721 - RNA, 18 nt, Mycobacterium avium subsp. paratuberculosis
uccccguagucacccggc

SEQ ID NO: 2861722 - RNA, 13 nt, Mycobacterium avium subsp. paratuberculosis
uccccgugcagcc

SEQ ID NO: 2861723 - RNA, 19 nt, Mycobacterium avium subsp. paratuberculosis
uccccgugcagccgggccu

SEQ ID NO: 2861724 - RNA, 22 nt, Mycobacterium avium subsp. paratuberculosis
uccccguugaucuugaccgucg

SEQ ID NO: 2861725 - RNA, 22 nt, Mycobacterium avium subsp. paratuberculosis
uccccugguccuuaaucgggac

SEQ ID NO: 2861726 - RNA, 14 nt, Mycobacterium avium subsp. paratuberculosis
ucccgaaaccgucg

SEQ ID NO: 2861727 - RNA, 15 nt, Mycobacterium avium subsp. paratuberculosis
ucccgaacagggcga

SEQ ID NO: 2861728 - RNA, 16 nt, Mycobacterium avium subsp. paratuberculosis
ucccgaacagggcgac

SEQ ID NO: 2861729 - RNA, 22 nt, Mycobacterium avium subsp. paratuberculosis
ucccgaacagggcgacggcggc

SEQ ID NO: 2861730 - RNA, 15 nt, Mycobacterium avium subsp. paratuberculosis
ucccgaacugccgcg

SEQ ID NO: 2861731 - RNA, 21 nt, Mycobacterium avium subsp. paratuberculosis
ucccgaccccgccagcaccga

SEQ ID NO: 2861732 - RNA, 13 nt, Mycobacterium avium subsp. paratuberculosis
ucccgacuccuca

SEQ ID NO: 2861733 - RNA, 14 nt, Mycobacterium avium subsp. paratuberculosis
ucccgacuccucac

SEQ ID NO: 2861734 - RNA, 15 nt, Mycobacterium avium subsp. paratuberculosis
ucccgacuccucaca

SEQ ID NO: 2861735 - RNA, 19 nt, Mycobacterium avium subsp. paratuberculosis
ucccgacuccucacaccuc

SEQ ID NO: 2861736 - RNA, 16 nt, Mycobacterium avium subsp. paratuberculosis
ucccgagcaucgccga

SEQ ID NO: 2861737 - RNA, 19 nt, Mycobacterium avium subsp. paratuberculosis
ucccgagcaucgccgagcg

SEQ ID NO: 2861738 - RNA, 22 nt, Mycobacterium avium subsp. paratuberculosis
ucccgaggagguuuugcguggu

SEQ ID NO: 2861739 - RNA, 17 nt, Mycobacterium avium subsp. paratuberculosis
ucccgaggaugccgccc

SEQ ID NO: 2861740 - RNA, 22 nt, Mycobacterium avium subsp. paratuberculosis
ucccgaggaugccgcccaccac

SEQ ID NO: 2861741 - RNA, 13 nt, Mycobacterium avium subsp. paratuberculosis
ucccgaguggcgc

SEQ ID NO: 2861742 - RNA, 16 nt, Mycobacterium avium subsp. paratuberculosis
ucccgaguggcgccgu

SEQ ID NO: 2861743 - RNA, 15 nt, Mycobacterium avium subsp. paratuberculosis
ucccgauccgcgccg

SEQ ID NO: 2861744 - RNA, 16 nt, Mycobacterium avium subsp. paratuberculosis
ucccgauccgcgccgc

SEQ ID NO: 2861745 - RNA, 17 nt, Mycobacterium avium subsp. paratuberculosis
ucccgauccgcgccgcc

SEQ ID NO: 2861746 - RNA, 15 nt, Mycobacterium avium subsp. paratuberculosis
ucccggggcgcgcug

SEQ ID NO: 2861747 - RNA, 19 nt, Mycobacterium avium subsp. paratuberculosis
ucccgggggaagcccagca

SEQ ID NO: 2861748 - RNA, 21 nt, Mycobacterium avium subsp. paratuberculosis
ucccgggggaagcccagcacc

SEQ ID NO: 2861749 - RNA, 16 nt, Mycobacterium avium subsp. paratuberculosis
ucccgggugcgauggc

SEQ ID NO: 2861750 - RNA, 17 nt, Mycobacterium avium subsp. paratuberculosis
ucccgggugcgcgucgc

SEQ ID NO: 2861751 - RNA, 19 nt, Mycobacterium avium subsp. paratuberculosis
ucccgggugcgcgucgcgg

SEQ ID NO: 2861752 - RNA, 15 nt, Mycobacterium avium subsp. paratuberculosis
ucccgggugggcagc

SEQ ID NO: 2861753 - RNA, 17 nt, Mycobacterium avium subsp. paratuberculosis
ucccgggugggcagcgc

SEQ ID NO: 2861754 - RNA, 21 nt, Mycobacterium avium subsp. paratuberculosis
ucccgggugggcagcgcgauc

SEQ ID NO: 2861755 - RNA, 18 nt, Mycobacterium avium subsp. paratuberculosis
ucccgguagagcggcacc

SEQ ID NO: 2861756 - RNA, 19 nt, Mycobacterium avium subsp. paratuberculosis
ucccgguagagcggcacca

SEQ ID NO: 2861757 - RNA, 15 nt, Mycobacterium avium subsp. paratuberculosis
ucccgguaggcggcg

SEQ ID NO: 2861758 - RNA, 18 nt, Mycobacterium avium subsp. paratuberculosis
ucccgguaggcggcgaga

SEQ ID NO: 2861759 - RNA, 23 nt, Mycobacterium avium subsp. paratuberculosis
ucccggucagguugacgccgaug

SEQ ID NO: 2861760 - RNA, 16 nt, Mycobacterium avium subsp. paratuberculosis
ucccggucguagucgg

SEQ ID NO: 2861761 - RNA, 18 nt, Mycobacterium avium subsp. paratuberculosis
ucccggucguagucggcc

SEQ ID NO: 2861762 - RNA, 22 nt, Mycobacterium avium subsp. paratuberculosis
ucccggucguagucggcccgcc

SEQ ID NO: 2861763 - RNA, 20 nt, Mycobacterium avium subsp. paratuberculosis
ucccggugagcgugucgcgc

SEQ ID NO: 2861764 - RNA, 14 nt, Mycobacterium avium subsp. paratuberculosis
ucccggugucgccg

SEQ ID NO: 2861765 - RNA, 16 nt, Mycobacterium avium subsp. paratuberculosis
ucccggugucgccguc

SEQ ID NO: 2861766 - RNA, 21 nt, Mycobacterium avium subsp. paratuberculosis
ucccggugucgccgucgccgc

SEQ ID NO: 2861767 - RNA, 23 nt, Mycobacterium avium subsp. paratuberculosis
ucccgguugaccccggccccggc

SEQ ID NO: 2861768 - RNA, 13 nt, Mycobacterium avium subsp. paratuberculosis
ucccguagccgua

SEQ ID NO: 2861769 - RNA, 21 nt, Mycobacterium avium subsp. paratuberculosis
ucccguagccguagaucgucg

SEQ ID NO: 2861770 - RNA, 21 nt, Mycobacterium avium subsp. paratuberculosis
ucccguaggucgccuccaggu

SEQ ID NO: 2861771 - RNA, 14 nt, Mycobacterium avium subsp. paratuberculosis
ucccgucacggcug

SEQ ID NO: 2861772 - RNA, 18 nt, Mycobacterium avium subsp. paratuberculosis
ucccgucaggucgcggua

SEQ ID NO: 2861773 - RNA, 21 nt, Mycobacterium avium subsp. paratuberculosis
ucccgucccgguugaccccgg

SEQ ID NO: 2861774 - RNA, 12 nt, Mycobacterium avium subsp. paratuberculosis
ucccgucgcgac

SEQ ID NO: 2861775 - RNA, 22 nt, Mycobacterium avium subsp. paratuberculosis
ucccgucgcgacgagcgggccg

SEQ ID NO: 2861776 - RNA, 12 nt, Mycobacterium avium subsp. paratuberculosis
ucccgucggcca

SEQ ID NO: 2861777 - RNA, 23 nt, Mycobacterium avium subsp. paratuberculosis
ucccgucggccaucagccgccgu

SEQ ID NO: 2861778 - RNA, 12 nt, Mycobacterium avium subsp. paratuberculosis
ucccgucgucgg

SEQ ID NO: 2861779 - RNA, 15 nt, Mycobacterium avium subsp. paratuberculosis
ucccgucgucggcgc

SEQ ID NO: 2861780 - RNA, 21 nt, Mycobacterium avium subsp. paratuberculosis
ucccgucguugaaggccugca

SEQ ID NO: 2861781 - RNA, 15 nt, Mycobacterium avium subsp. paratuberculosis
ucccgugcgccgccc

SEQ ID NO: 2861782 - RNA, 18 nt, Mycobacterium avium subsp. paratuberculosis
ucccgugcgccgcccaca

SEQ ID NO: 2861783 - RNA, 14 nt, Mycobacterium avium subsp. paratuberculosis
ucccgugcuggcca

SEQ ID NO: 2861784 - RNA, 15 nt, Mycobacterium avium subsp. paratuberculosis
ucccgugcuggccau

SEQ ID NO: 2861785 - RNA, 14 nt, Mycobacterium avium subsp. paratuberculosis
ucccguugaucucg

SEQ ID NO: 2861786 - RNA, 16 nt, Mycobacterium avium subsp. paratuberculosis
ucccguuggcgccggu

SEQ ID NO: 2861787 - RNA, 15 nt, Mycobacterium avium subsp. paratuberculosis
ucccuccggcaggcc

SEQ ID NO: 2861788 - RNA, 16 nt, Mycobacterium avium subsp. paratuberculosis
ucccuccggcaggccg

SEQ ID NO: 2861789 - RNA, 21 nt, Mycobacterium avium subsp. paratuberculosis
ucccucgucgcuaccucacca

SEQ ID NO: 2861790 - RNA, 18 nt, Mycobacterium avium subsp. paratuberculosis
ucccugacacgaccgccu

SEQ ID NO: 2861791 - RNA, 18 nt, Mycobacterium avium subsp. paratuberculosis
ucccugagcuuuucgucg

SEQ ID NO: 2861792 - RNA, 19 nt, Mycobacterium avium subsp. paratuberculosis
ucccugagcuuuucgucgg

SEQ ID NO: 2861793 - RNA, 13 nt, Mycobacterium avium subsp. paratuberculosis
ucccugcgcggcg

SEQ ID NO: 2861794 - RNA, 20 nt, Mycobacterium avium subsp. paratuberculosis
ucccugcggcugcaucaugc

SEQ ID NO: 2861795 - RNA, 19 nt, Mycobacterium avium subsp. paratuberculosis
ucccuggugaccgacgacg

SEQ ID NO: 2861796 - RNA, 13 nt, Mycobacterium avium subsp. paratuberculosis
ucccuugccgccg

SEQ ID NO: 2861797 - RNA, 14 nt, Mycobacterium avium subsp. paratuberculosis
ucccuugccgccga

SEQ ID NO: 2861798 - RNA, 10 nt, Mycobacterium avium subsp. paratuberculosis
ucccuuguug

SEQ ID NO: 2861799 - RNA, 14 nt, Mycobacterium avium subsp. paratuberculosis
uccgaacgugcagc

SEQ ID NO: 2861800 - RNA, 16 nt, Mycobacterium avium subsp. paratuberculosis
uccgaauccagcgcgc

SEQ ID NO: 2861801 - RNA, 19 nt, Mycobacterium avium subsp. paratuberculosis
uccgaauccagcgcgccgc

SEQ ID NO: 2861802 - RNA, 24 nt, Mycobacterium avium subsp. paratuberculosis
uccgacaccgccuucgacggccgg

SEQ ID NO: 2861803 - RNA, 16 nt, Mycobacterium avium subsp. paratuberculosis
uccgacagcccccgca

SEQ ID NO: 2861804 - RNA, 15 nt, Mycobacterium avium subsp. paratuberculosis
uccgacagccgcacc

SEQ ID NO: 2861805 - RNA, 23 nt, Mycobacterium avium subsp. paratuberculosis
uccgacaggaugcuggggucggc

SEQ ID NO: 2861806 - RNA, 23 nt, Mycobacterium avium subsp. paratuberculosis
uccgacaucagugcgggcaucgg

SEQ ID NO: 2861807 - RNA, 14 nt, Mycobacterium avium subsp. paratuberculosis
uccgaccagcaccc

SEQ ID NO: 2861808 - RNA, 14 nt, Mycobacterium avium subsp. paratuberculosis
uccgaccagcggcc

SEQ ID NO: 2861809 - RNA, 22 nt, Mycobacterium avium subsp. paratuberculosis
uccgaccagcggcccaccgcga

SEQ ID NO: 2861810 - RNA, 21 nt, Mycobacterium avium subsp. paratuberculosis
uccgacccguccagcgugugc

SEQ ID NO: 2861811 - RNA, 16 nt, Mycobacterium avium subsp. paratuberculosis
uccgaccgccaccacc

SEQ ID NO: 2861812 - RNA, 23 nt, Mycobacterium avium subsp. paratuberculosis
uccgaccgccaccacccggcgau

SEQ ID NO: 2861813 - RNA, 22 nt, Mycobacterium avium subsp. paratuberculosis
uccgaccggcucagcccggcgc

SEQ ID NO: 2861814 - RNA, 16 nt, Mycobacterium avium subsp. paratuberculosis
uccgaccgguugcccg

SEQ ID NO: 2861815 - RNA, 14 nt, Mycobacterium avium subsp. paratuberculosis
uccgacgaaccgug

SEQ ID NO: 2861816 - RNA, 17 nt, Mycobacterium avium subsp. paratuberculosis
uccgacgauccgggccg

SEQ ID NO: 2861817 - RNA, 16 nt, Mycobacterium avium subsp. paratuberculosis
uccgacgccgucgagc

SEQ ID NO: 2861818 - RNA, 14 nt, Mycobacterium avium subsp. paratuberculosis
uccgacgcgacggu

SEQ ID NO: 2861819 - RNA, 16 nt, Mycobacterium avium subsp. paratuberculosis
uccgacgcgacggucg

SEQ ID NO: 2861820 - RNA, 19 nt, Mycobacterium avium subsp. paratuberculosis
uccgacggcugcgguuggc

SEQ ID NO: 2861821 - RNA, 21 nt, Mycobacterium avium subsp. paratuberculosis
uccgacggcugcgguuggccg

SEQ ID NO: 2861822 - RNA, 19 nt, Mycobacterium avium subsp. paratuberculosis
uccgacggcuggguggcga

SEQ ID NO: 2861823 - RNA, 14 nt, Mycobacterium avium subsp. paratuberculosis
uccgacggcuucca

SEQ ID NO: 2861824 - RNA, 14 nt, Mycobacterium avium subsp. paratuberculosis
uccgacgugccgug

SEQ ID NO: 2861825 - RNA, 16 nt, Mycobacterium avium subsp. paratuberculosis
uccgacuccagcagcg

SEQ ID NO: 2861826 - RNA, 23 nt, Mycobacterium avium subsp. paratuberculosis
uccgacuccagcagcgccuugcc

SEQ ID NO: 2861827 - RNA, 17 nt, Mycobacterium avium subsp. paratuberculosis
uccgacuucgcgugccg

SEQ ID NO: 2861828 - RNA, 18 nt, Mycobacterium avium subsp. paratuberculosis
uccgagacguggucgggc

SEQ ID NO: 2861829 - RNA, 21 nt, Mycobacterium avium subsp. paratuberculosis
uccgagcagcagccgcagcgg

SEQ ID NO: 2861830 - RNA, 15 nt, Mycobacterium avium subsp. paratuberculosis
uccgagccgguggag

SEQ ID NO: 2861831 - RNA, 16 nt, Mycobacterium avium subsp. paratuberculosis
uccgcgaacucgucga

SEQ ID NO: 2861832 - RNA, 17 nt, Mycobacterium avium subsp. paratuberculosis
uccgcgacaaggucgac

SEQ ID NO: 2861833 - RNA, 23 nt, Mycobacterium avium subsp. paratuberculosis
uccgcgacaaggucgaccgcgca

SEQ ID NO: 2861834 - RNA, 20 nt, Mycobacterium avium subsp. paratuberculosis
uccgcgacaucggcgccgac

SEQ ID NO: 2861835 - RNA, 22 nt, Mycobacterium avium subsp. paratuberculosis
uccgcgacaucggugaccgucg

SEQ ID NO: 2861836 - RNA, 16 nt, Mycobacterium avium subsp. paratuberculosis
uccgcgacgacaccac

SEQ ID NO: 2861837 - RNA, 19 nt, Mycobacterium avium subsp. paratuberculosis
uccgcgacgccaacaacua

SEQ ID NO: 2861838 - RNA, 16 nt, Mycobacterium avium subsp. paratuberculosis
uccgcgacgccagcac

SEQ ID NO: 2861839 - RNA, 17 nt, Mycobacterium avium subsp. paratuberculosis
uccgcgacgccagcacc

SEQ ID NO: 2861840 - RNA, 20 nt, Mycobacterium avium subsp. paratuberculosis
uccgcgacgccagcaccuuc

SEQ ID NO: 2861841 - RNA, 14 nt, Mycobacterium avium subsp. paratuberculosis
uccgcgaucagcuc

SEQ ID NO: 2861842 - RNA, 21 nt, Mycobacterium avium subsp. paratuberculosis
uccgcgaucagcucguggcgg

SEQ ID NO: 2861843 - RNA, 18 nt, Mycobacterium avium subsp. paratuberculosis
uccgcgaucgucucgucg

SEQ ID NO: 2861844 - RNA, 13 nt, Mycobacterium avium subsp. paratuberculosis
uccgcgcagcagc

SEQ ID NO: 2861845 - RNA, 14 nt, Mycobacterium avium subsp. paratuberculosis
uccgcgcagcagcg

SEQ ID NO: 2861846 - RNA, 15 nt, Mycobacterium avium subsp. paratuberculosis
uccgcgcagcagcgu

SEQ ID NO: 2861847 - RNA, 12 nt, Mycobacterium avium subsp. paratuberculosis
uccgcgccgccg

SEQ ID NO: 2861848 - RNA, 16 nt, Mycobacterium avium subsp. paratuberculosis
uccgcgccgccgccag

SEQ ID NO: 2861849 - RNA, 17 nt, Mycobacterium avium subsp. paratuberculosis
uccgcgcgaccaucagc

SEQ ID NO: 2861850 - RNA, 22 nt, Mycobacterium avium subsp. paratuberculosis
uccgcgcgagaguaucgccacg

SEQ ID NO: 2861851 - RNA, 17 nt, Mycobacterium avium subsp. paratuberculosis
uccgcgcgagcgcgcug

SEQ ID NO: 2861852 - RNA, 18 nt, Mycobacterium avium subsp. paratuberculosis
uccgcgcgagcgcgcugu

SEQ ID NO: 2861853 - RNA, 13 nt, Mycobacterium avium subsp. paratuberculosis
uccgcgcgcggca

SEQ ID NO: 2861854 - RNA, 15 nt, Mycobacterium avium subsp. paratuberculosis
uccgcgcgcggcacg

SEQ ID NO: 2861855 - RNA, 18 nt, Mycobacterium avium subsp. paratuberculosis
uccgcgcgcggcacggug

SEQ ID NO: 2861856 - RNA, 13 nt, Mycobacterium avium subsp. paratuberculosis
uccgcgcgcggcc

SEQ ID NO: 2861857 - RNA, 15 nt, Mycobacterium avium subsp. paratuberculosis
uccgcgcggccacca

SEQ ID NO: 2861858 - RNA, 22 nt, Mycobacterium avium subsp. paratuberculosis
uccgcgcggccaccagcgcggc

SEQ ID NO: 2861859 - RNA, 15 nt, Mycobacterium avium subsp. paratuberculosis
uccgcgcggcgacga

SEQ ID NO: 2861860 - RNA, 16 nt, Mycobacterium avium subsp. paratuberculosis
uccgcgcggcgacgau

SEQ ID NO: 2861861 - RNA, 17 nt, Mycobacterium avium subsp. paratuberculosis
uccgcgcggcgacgauc

SEQ ID NO: 2861862 - RNA, 22 nt, Mycobacterium avium subsp. paratuberculosis
uccgcgcggcgggcccgcagcu

SEQ ID NO: 2861863 - RNA, 14 nt, Mycobacterium avium subsp. paratuberculosis
uccgcgcgucgggc

SEQ ID NO: 2861864 - RNA, 23 nt, Mycobacterium avium subsp. paratuberculosis
uccgcgcgucgggcucgcggucg

SEQ ID NO: 2861865 - RNA, 17 nt, Mycobacterium avium subsp. paratuberculosis
uccgcgcgucucccccg

SEQ ID NO: 2861866 - RNA, 20 nt, Mycobacterium avium subsp. paratuberculosis
uccgcgcgucucccccgauc

SEQ ID NO: 2861867 - RNA, 22 nt, Mycobacterium avium subsp. paratuberculosis
uccgcgcgucucccccgaucag

SEQ ID NO: 2861868 - RNA, 13 nt, Mycobacterium avium subsp. paratuberculosis
uccgcgcugacca

SEQ ID NO: 2861869 - RNA, 20 nt, Mycobacterium avium subsp. paratuberculosis
uccgcggaggcgagcagccg

SEQ ID NO: 2861870 - RNA, 14 nt, Mycobacterium avium subsp. paratuberculosis
uccgcggccaccgg

SEQ ID NO: 2861871 - RNA, 13 nt, Mycobacterium avium subsp. paratuberculosis
uccgcggccagcu

SEQ ID NO: 2861872 - RNA, 20 nt, Mycobacterium avium subsp. paratuberculosis
uccgcggccagcucggucgc

SEQ ID NO: 2861873 - RNA, 22 nt, Mycobacterium avium subsp. paratuberculosis
uccgcggccagcucggucgcgg

SEQ ID NO: 2861874 - RNA, 18 nt, Mycobacterium avium subsp. paratuberculosis
uccgcggccgcggcgcgc

SEQ ID NO: 2861875 - RNA, 13 nt, Mycobacterium avium subsp. paratuberculosis
uccgcggcgauga

SEQ ID NO: 2861876 - RNA, 11 nt, Mycobacterium avium subsp. paratuberculosis
uccgcggcgcc

SEQ ID NO: 2861877 - RNA, 14 nt, Mycobacterium avium subsp. paratuberculosis
uccgcggcgccggg

SEQ ID NO: 2861878 - RNA, 17 nt, Mycobacterium avium subsp. paratuberculosis
uccgcggcgccgggcgg

SEQ ID NO: 2861879 - RNA, 15 nt, Mycobacterium avium subsp. paratuberculosis
uccgcggcgccguag

SEQ ID NO: 2861880 - RNA, 15 nt, Mycobacterium avium subsp. paratuberculosis
uccgcggcggccggc

SEQ ID NO: 2861881 - RNA, 13 nt, Mycobacterium avium subsp. paratuberculosis
uccgcgggcagcg

SEQ ID NO: 2861882 - RNA, 19 nt, Mycobacterium avium subsp. paratuberculosis
uccgcgggcagcgagcaca

SEQ ID NO: 2861883 - RNA, 22 nt, Mycobacterium avium subsp. paratuberculosis
uccgcgggcagcgagcacagcg

SEQ ID NO: 2861884 - RNA, 14 nt, Mycobacterium avium subsp. paratuberculosis
uccgcgggccggca

SEQ ID NO: 2861885 - RNA, 14 nt, Mycobacterium avium subsp. paratuberculosis
uccgcgggcggggc

SEQ ID NO: 2861886 - RNA, 20 nt, Mycobacterium avium subsp. paratuberculosis
uccgcgggcguggcggucgg

SEQ ID NO: 2861887 - RNA, 19 nt, Mycobacterium avium subsp. paratuberculosis
uccgcggguacggucggcc

SEQ ID NO: 2861888 - RNA, 14 nt, Mycobacterium avium subsp. paratuberculosis
uccgcggucgacca

SEQ ID NO: 2861889 - RNA, 19 nt, Mycobacterium avium subsp. paratuberculosis
uccgcggucgaccaagacg

SEQ ID NO: 2861890 - RNA, 18 nt, Mycobacterium avium subsp. paratuberculosis
uccgcgguuuggucagcg

SEQ ID NO: 2861891 - RNA, 20 nt, Mycobacterium avium subsp. paratuberculosis
uccgcgguuuggucagcgcc

SEQ ID NO: 2861892 - RNA, 21 nt, Mycobacterium avium subsp. paratuberculosis
uccgcgguuuggucagcgccc

SEQ ID NO: 2861893 - RNA, 16 nt, Mycobacterium avium subsp. paratuberculosis
uccgcgucggcgccgg

SEQ ID NO: 2861894 - RNA, 16 nt, Mycobacterium avium subsp. paratuberculosis
uccgcgucgucgaggc

SEQ ID NO: 2861895 - RNA, 19 nt, Mycobacterium avium subsp. paratuberculosis
uccgcguggcucucguccu

SEQ ID NO: 2861896 - RNA, 21 nt, Mycobacterium avium subsp. paratuberculosis
uccgcguucgaccuccacgag

SEQ ID NO: 2861897 - RNA, 21 nt, Mycobacterium avium subsp. paratuberculosis
uccgcucaacuugaucagcuc

SEQ ID NO: 2861898 - RNA, 14 nt, Mycobacterium avium subsp. paratuberculosis
uccgcucgccgcgg

SEQ ID NO: 2861899 - RNA, 16 nt, Mycobacterium avium subsp. paratuberculosis
uccgcugaacgggcag

SEQ ID NO: 2861900 - RNA, 14 nt, Mycobacterium avium subsp. paratuberculosis
uccgcuggggccca

SEQ ID NO: 2861901 - RNA, 17 nt, Mycobacterium avium subsp. paratuberculosis
uccgcuggggcccagcu

SEQ ID NO: 2861902 - RNA, 21 nt, Mycobacterium avium subsp. paratuberculosis
uccgcuguucggguagacgau

SEQ ID NO: 2861903 - RNA, 13 nt, Mycobacterium avium subsp. paratuberculosis
uccggaaccgggc

SEQ ID NO: 2861904 - RNA, 16 nt, Mycobacterium avium subsp. paratuberculosis
uccggaagccgucggu

SEQ ID NO: 2861905 - RNA, 17 nt, Mycobacterium avium subsp. paratuberculosis
uccggacacggccagcg

SEQ ID NO: 2861906 - RNA, 20 nt, Mycobacterium avium subsp. paratuberculosis
uccggacacggccagcgccg

SEQ ID NO: 2861907 - RNA, 21 nt, Mycobacterium avium subsp. paratuberculosis
uccggacgaccugggcgccgu

SEQ ID NO: 2861908 - RNA, 13 nt, Mycobacterium avium subsp. paratuberculosis
uccggagaaccgc

SEQ ID NO: 2861909 - RNA, 16 nt, Mycobacterium avium subsp. paratuberculosis
uccggagaaccgcucg

SEQ ID NO: 2861910 - RNA, 22 nt, Mycobacterium avium subsp. paratuberculosis
uccggagcgcgguccacggugg

SEQ ID NO: 2861911 - RNA, 17 nt, Mycobacterium avium subsp. paratuberculosis
uccggaggugccggccg

SEQ ID NO: 2861912 - RNA, 20 nt, Mycobacterium avium subsp. paratuberculosis
uccggaucaaccacaccagc

SEQ ID NO: 2861913 - RNA, 14 nt, Mycobacterium avium subsp. paratuberculosis
uccggaugccggcu

SEQ ID NO: 2861914 - RNA, 18 nt, Mycobacterium avium subsp. paratuberculosis
uccggaugccggcuuggg

SEQ ID NO: 2861915 - RNA, 13 nt, Mycobacterium avium subsp. paratuberculosis
uccggaugcggcg

SEQ ID NO: 2861916 - RNA, 20 nt, Mycobacterium avium subsp. paratuberculosis
uccggcuucaccgucagggu

SEQ ID NO: 2861917 - RNA, 12 nt, Mycobacterium avium subsp. paratuberculosis
uccgggaaggcg

SEQ ID NO: 2861918 - RNA, 15 nt, Mycobacterium avium subsp. paratuberculosis
uccgggaccggcguc

SEQ ID NO: 2861919 - RNA, 15 nt, Mycobacterium avium subsp. paratuberculosis
uccgggaggccagca

SEQ ID NO: 2861920 - RNA, 16 nt, Mycobacterium avium subsp. paratuberculosis
uccgggaugacaccgc

SEQ ID NO: 2861921 - RNA, 18 nt, Mycobacterium avium subsp. paratuberculosis
uccgggcacccgacgucg

SEQ ID NO: 2861922 - RNA, 17 nt, Mycobacterium avium subsp. paratuberculosis
uccgggcaugcucagga

SEQ ID NO: 2861923 - RNA, 20 nt, Mycobacterium avium subsp. paratuberculosis
uccgggcaugcucaggauga

SEQ ID NO: 2861924 - RNA, 13 nt, Mycobacterium avium subsp. paratuberculosis
uccgggccgccgc

SEQ ID NO: 2861925 - RNA, 18 nt, Mycobacterium avium subsp. paratuberculosis
uccgggccgccucgaagu

SEQ ID NO: 2861926 - RNA, 14 nt, Mycobacterium avium subsp. paratuberculosis
uccgggccggcguc

SEQ ID NO: 2861927 - RNA, 15 nt, Mycobacterium avium subsp. paratuberculosis
uccgggccggcgucg

SEQ ID NO: 2861928 - RNA, 18 nt, Mycobacterium avium subsp. paratuberculosis
uccgggccggcgucgcgg

SEQ ID NO: 2861929 - RNA, 19 nt, Mycobacterium avium subsp. paratuberculosis
uccgggccggcgucgcggu

SEQ ID NO: 2861930 - RNA, 14 nt, Mycobacterium avium subsp. paratuberculosis
uccgggcgaccccg

SEQ ID NO: 2861931 - RNA, 18 nt, Mycobacterium avium subsp. paratuberculosis
uccgggcgaccccggcca

SEQ ID NO: 2861932 - RNA, 19 nt, Mycobacterium avium subsp. paratuberculosis
uccgggcgaccccggccag

SEQ ID NO: 2861933 - RNA, 21 nt, Mycobacterium avium subsp. paratuberculosis
uccgggcgaccccggccagga

SEQ ID NO: 2861934 - RNA, 22 nt, Mycobacterium avium subsp. paratuberculosis
uccgggcgaccccggccaggau

SEQ ID NO: 2861935 - RNA, 12 nt, Mycobacterium avium subsp. paratuberculosis
uccgggcgccau

SEQ ID NO: 2861936 - RNA, 13 nt, Mycobacterium avium subsp. paratuberculosis
uccgggcgccauc

SEQ ID NO: 2861937 - RNA, 18 nt, Mycobacterium avium subsp. paratuberculosis
uccgggcgcccagaagcc

SEQ ID NO: 2861938 - RNA, 16 nt, Mycobacterium avium subsp. paratuberculosis
uccgggcgccggccgg

SEQ ID NO: 2861939 - RNA, 19 nt, Mycobacterium avium subsp. paratuberculosis
uccgggcgccggccggcgc

SEQ ID NO: 2861940 - RNA, 17 nt, Mycobacterium avium subsp. paratuberculosis
uccgggcgcugcgcggu

SEQ ID NO: 2861941 - RNA, 23 nt, Mycobacterium avium subsp. paratuberculosis
uccgggcggcaucgcgcgcggcg

SEQ ID NO: 2861942 - RNA, 18 nt, Mycobacterium avium subsp. paratuberculosis
uccgggcggccagccgcg

SEQ ID NO: 2861943 - RNA, 15 nt, Mycobacterium avium subsp. paratuberculosis
uccgggcguagugca

SEQ ID NO: 2861944 - RNA, 21 nt, Mycobacterium avium subsp. paratuberculosis
uccgggcugccguagaaccgc

SEQ ID NO: 2861945 - RNA, 16 nt, Mycobacterium avium subsp. paratuberculosis
uccgggcugugggcgc

SEQ ID NO: 2861946 - RNA, 22 nt, Mycobacterium avium subsp. paratuberculosis
uccgggcugugggcgcagggcc

SEQ ID NO: 2861947 - RNA, 12 nt, Mycobacterium avium subsp. paratuberculosis
uccggggcagca

SEQ ID NO: 2861948 - RNA, 23 nt, Mycobacterium avium subsp. paratuberculosis
uccgggguggccuuguggucgau

SEQ ID NO: 2861949 - RNA, 20 nt, Mycobacterium avium subsp. paratuberculosis
uccgggguguaggcgucggc

SEQ ID NO: 2861950 - RNA, 15 nt, Mycobacterium avium subsp. paratuberculosis
uccggguccgcggug

SEQ ID NO: 2861951 - RNA, 18 nt, Mycobacterium avium subsp. paratuberculosis
uccggguccuaucaggac

SEQ ID NO: 2861952 - RNA, 12 nt, Mycobacterium avium subsp. paratuberculosis
uccgggucgcgg

SEQ ID NO: 2861953 - RNA, 18 nt, Mycobacterium avium subsp. paratuberculosis
uccgggucgcggaucucg

SEQ ID NO: 2861954 - RNA, 21 nt, Mycobacterium avium subsp. paratuberculosis
uccggguucgacgccucggug

SEQ ID NO: 2861955 - RNA, 20 nt, Mycobacterium avium subsp. paratuberculosis
uccggguugggcgccugcgg

SEQ ID NO: 2861956 - RNA, 21 nt, Mycobacterium avium subsp. paratuberculosis
uccgguaggccggccgcagcu

SEQ ID NO: 2861957 - RNA, 14 nt, Mycobacterium avium subsp. paratuberculosis
uccggucacgcccg

SEQ ID NO: 2861958 - RNA, 16 nt, Mycobacterium avium subsp. paratuberculosis
uccggucacgcccggg

SEQ ID NO: 2861959 - RNA, 15 nt, Mycobacterium avium subsp. paratuberculosis
uccggucagaccuuc

SEQ ID NO: 2861960 - RNA, 12 nt, Mycobacterium avium subsp. paratuberculosis
uccggucagcac

SEQ ID NO: 2861961 - RNA, 14 nt, Mycobacterium avium subsp. paratuberculosis
uccggucagcaccg

SEQ ID NO: 2861962 - RNA, 16 nt, Mycobacterium avium subsp. paratuberculosis
uccggucagcaccgcg

SEQ ID NO: 2861963 - RNA, 15 nt, Mycobacterium avium subsp. paratuberculosis
uccggucagggcucg

SEQ ID NO: 2861964 - RNA, 12 nt, Mycobacterium avium subsp. paratuberculosis
uccgguccagau

SEQ ID NO: 2861965 - RNA, 14 nt, Mycobacterium avium subsp. paratuberculosis
uccgguccagcccg

SEQ ID NO: 2861966 - RNA, 16 nt, Mycobacterium avium subsp. paratuberculosis
uccgguccagcccggu

SEQ ID NO: 2861967 - RNA, 14 nt, Mycobacterium avium subsp. paratuberculosis
uccggucgaccuug

SEQ ID NO: 2861968 - RNA, 16 nt, Mycobacterium avium subsp. paratuberculosis
uccggucgaucaccuc

SEQ ID NO: 2861969 - RNA, 17 nt, Mycobacterium avium subsp. paratuberculosis
uccggucgaucaccucg

SEQ ID NO: 2861970 - RNA, 19 nt, Mycobacterium avium subsp. paratuberculosis
uccggucgaugaauuccgg

SEQ ID NO: 2861971 - RNA, 17 nt, Mycobacterium avium subsp. paratuberculosis
uccggucuucucggcca

SEQ ID NO: 2861972 - RNA, 23 nt, Mycobacterium avium subsp. paratuberculosis
uccggugaccgccucgucgaagg

SEQ ID NO: 2861973 - RNA, 21 nt, Mycobacterium avium subsp. paratuberculosis
uccggugaccgcgacgcugcc

SEQ ID NO: 2861974 - RNA, 18 nt, Mycobacterium avium subsp. paratuberculosis
uccggugauugaauggaa

SEQ ID NO: 2861975 - RNA, 14 nt, Mycobacterium avium subsp. paratuberculosis
uccggugccacgcg

SEQ ID NO: 2861976 - RNA, 15 nt, Mycobacterium avium subsp. paratuberculosis
uccggugccacgcgg

SEQ ID NO: 2861977 - RNA, 17 nt, Mycobacterium avium subsp. paratuberculosis
uccggugccgagcgcgc

SEQ ID NO: 2861978 - RNA, 18 nt, Mycobacterium avium subsp. paratuberculosis
uccggugccgagcgcgcu

SEQ ID NO: 2861979 - RNA, 21 nt, Mycobacterium avium subsp. paratuberculosis
uccgguggcgcgaaucccggc

SEQ ID NO: 2861980 - RNA, 14 nt, Mycobacterium avium subsp. paratuberculosis
uccgguuccucggc

SEQ ID NO: 2861981 - RNA, 12 nt, Mycobacterium avium subsp. paratuberculosis
uccgguugcggc

SEQ ID NO: 2861982 - RNA, 16 nt, Mycobacterium avium subsp. paratuberculosis
uccgguugcggcagca

SEQ ID NO: 2861983 - RNA, 15 nt, Mycobacterium avium subsp. paratuberculosis
uccgguuggccaggu

SEQ ID NO: 2861984 - RNA, 15 nt, Mycobacterium avium subsp. paratuberculosis
uccgucagcgccgcc

SEQ ID NO: 2861985 - RNA, 16 nt, Mycobacterium avium subsp. paratuberculosis
uccgucagcgccgccc

SEQ ID NO: 2861986 - RNA, 18 nt, Mycobacterium avium subsp. paratuberculosis
uccgucaucucgucaacc

SEQ ID NO: 2861987 - RNA, 19 nt, Mycobacterium avium subsp. paratuberculosis
uccguccaccggcacggca

SEQ ID NO: 2861988 - RNA, 13 nt, Mycobacterium avium subsp. paratuberculosis
uccguccggcgac

SEQ ID NO: 2861989 - RNA, 23 nt, Mycobacterium avium subsp. paratuberculosis
uccgucgagucggccaccgcggu

SEQ ID NO: 2861990 - RNA, 14 nt, Mycobacterium avium subsp. paratuberculosis
uccgucgccccgca

SEQ ID NO: 2861991 - RNA, 19 nt, Mycobacterium avium subsp. paratuberculosis
uccgucgcccgcgugggca

SEQ ID NO: 2861992 - RNA, 20 nt, Mycobacterium avium subsp. paratuberculosis
uccgucggccuugcgccacu

SEQ ID NO: 2861993 - RNA, 15 nt, Mycobacterium avium subsp. paratuberculosis
uccgucuuggccagg

SEQ ID NO: 2861994 - RNA, 16 nt, Mycobacterium avium subsp. paratuberculosis
uccgucuuggccaggc

SEQ ID NO: 2861995 - RNA, 21 nt, Mycobacterium avium subsp. paratuberculosis
uccgugagggaccuccagcgg

SEQ ID NO: 2861996 - RNA, 22 nt, Mycobacterium avium subsp. paratuberculosis
uccgugcacggccaacugcauc

SEQ ID NO: 2861997 - RNA, 18 nt, Mycobacterium avium subsp. paratuberculosis
uccgugccacggccgcgg

SEQ ID NO: 2861998 - RNA, 17 nt, Mycobacterium avium subsp. paratuberculosis
uccgugcuugcccgacg

SEQ ID NO: 2861999 - RNA, 17 nt, Mycobacterium avium subsp. paratuberculosis
uccguggacggcgagcg

SEQ ID NO: 2862000 - RNA, 20 nt, Mycobacterium avium subsp. paratuberculosis
uccgugucgcccguggccca

SEQ ID NO: 2862001 - RNA, 12 nt, Mycobacterium avium subsp. paratuberculosis
uccugcaggcag

SEQ ID NO: 2862002 - RNA, 15 nt, Mycobacterium avium subsp. paratuberculosis
uccugcaggcaggcc

SEQ ID NO: 2862003 - RNA, 14 nt, Mycobacterium avium subsp. paratuberculosis
uccugcaugccggg

SEQ ID NO: 2862004 - RNA, 16 nt, Mycobacterium avium subsp. paratuberculosis
uccugcaugccgggca

SEQ ID NO: 2862005 - RNA, 23 nt, Mycobacterium avium subsp. paratuberculosis
uccugccguucggccagcgccgc

SEQ ID NO: 2862006 - RNA, 14 nt, Mycobacterium avium subsp. paratuberculosis
uccugcgcaucgag

SEQ ID NO: 2862007 - RNA, 15 nt, Mycobacterium avium subsp. paratuberculosis
uccugcgccgcggug

SEQ ID NO: 2862008 - RNA, 16 nt, Mycobacterium avium subsp. paratuberculosis
uccugcgccgcggugc

SEQ ID NO: 2862009 - RNA, 17 nt, Mycobacterium avium subsp. paratuberculosis
uccugcggugggcgcug

SEQ ID NO: 2862010 - RNA, 14 nt, Mycobacterium avium subsp. paratuberculosis
uccugcucgcgggc

SEQ ID NO: 2862011 - RNA, 22 nt, Mycobacterium avium subsp. paratuberculosis
uccugcucgcgggccaccgcgg

SEQ ID NO: 2862012 - RNA, 15 nt, Mycobacterium avium subsp. paratuberculosis
uccugcucggcgacg

SEQ ID NO: 2862013 - RNA, 15 nt, Mycobacterium avium subsp. paratuberculosis
uccugcuggccgggc

SEQ ID NO: 2862014 - RNA, 14 nt, Mycobacterium avium subsp. paratuberculosis
uccugcuggcgcug

SEQ ID NO: 2862015 - RNA, 13 nt, Mycobacterium avium subsp. paratuberculosis
uccuggaucgcgc

SEQ ID NO: 2862016 - RNA, 19 nt, Mycobacterium avium subsp. paratuberculosis
uccuggccaacucgaccug

SEQ ID NO: 2862017 - RNA, 21 nt, Mycobacterium avium subsp. paratuberculosis
uccuggccaacucgaccugcc

SEQ ID NO: 2862018 - RNA, 22 nt, Mycobacterium avium subsp. paratuberculosis
uccuggccggacgggucgaccg

SEQ ID NO: 2862019 - RNA, 18 nt, Mycobacterium avium subsp. paratuberculosis
uccuggcgcuggugcagc

SEQ ID NO: 2862020 - RNA, 16 nt, Mycobacterium avium subsp. paratuberculosis
uccuggcggguggcga

SEQ ID NO: 2862021 - RNA, 15 nt, Mycobacterium avium subsp. paratuberculosis
uccugggccgggaug

SEQ ID NO: 2862022 - RNA, 15 nt, Mycobacterium avium subsp. paratuberculosis
uccugggccggggcu

SEQ ID NO: 2862023 - RNA, 14 nt, Mycobacterium avium subsp. paratuberculosis
uccugggccuggcg

SEQ ID NO: 2862024 - RNA, 19 nt, Mycobacterium avium subsp. paratuberculosis
uccugguccggcgcccgau

SEQ ID NO: 2862025 - RNA, 16 nt, Mycobacterium avium subsp. paratuberculosis
uccuggugcaccaggu

SEQ ID NO: 2862026 - RNA, 17 nt, Mycobacterium avium subsp. paratuberculosis
uccuggugcaccaggua

SEQ ID NO: 2862027 - RNA, 19 nt, Mycobacterium avium subsp. paratuberculosis
uccuggugcaccagguaga

SEQ ID NO: 2862028 - RNA, 19 nt, Mycobacterium avium subsp. paratuberculosis
uccuguuccccggcgggcu

SEQ ID NO: 2862029 - RNA, 23 nt, Mycobacterium avium subsp. paratuberculosis
uccuguuggcccugcucuucgcg

SEQ ID NO: 2862030 - RNA, 15 nt, Mycobacterium avium subsp. paratuberculosis
uccuucaucgaucgg

SEQ ID NO: 2862031 - RNA, 13 nt, Mycobacterium avium subsp. paratuberculosis
uccuucccggugg

SEQ ID NO: 2862032 - RNA, 18 nt, Mycobacterium avium subsp. paratuberculosis
uccuugaacuucagcugc

SEQ ID NO: 2862033 - RNA, 12 nt, Mycobacterium avium subsp. paratuberculosis
uccuugagcccc

SEQ ID NO: 2862034 - RNA, 20 nt, Mycobacterium avium subsp. paratuberculosis
uccuugagccgccgcggcac

SEQ ID NO: 2862035 - RNA, 22 nt, Mycobacterium avium subsp. paratuberculosis
uccuugaggaugcgcaccacgc

SEQ ID NO: 2862036 - RNA, 20 nt, Mycobacterium avium subsp. paratuberculosis
uccuugagguagucgcgcag

SEQ ID NO: 2862037 - RNA, 15 nt, Mycobacterium avium subsp. paratuberculosis
uccuugauccggccg

SEQ ID NO: 2862038 - RNA, 12 nt, Mycobacterium avium subsp. paratuberculosis
uccuugcgccgc

SEQ ID NO: 2862039 - RNA, 21 nt, Mycobacterium avium subsp. paratuberculosis
uccuugcgcgccgcgacgucg

SEQ ID NO: 2862040 - RNA, 13 nt, Mycobacterium avium subsp. paratuberculosis
uccuuggccaggc

SEQ ID NO: 2862041 - RNA, 14 nt, Mycobacterium avium subsp. paratuberculosis
uccuuggccaggcg

SEQ ID NO: 2862042 - RNA, 18 nt, Mycobacterium avium subsp. paratuberculosis
uccuuggccgccagcacc

SEQ ID NO: 2862043 - RNA, 22 nt, Mycobacterium avium subsp. paratuberculosis
ucgaaacccagcuugaccaccc

SEQ ID NO: 2862044 - RNA, 16 nt, Mycobacterium avium subsp. paratuberculosis
ucgaaauagcggcgca

SEQ ID NO: 2862045 - RNA, 17 nt, Mycobacterium avium subsp. paratuberculosis
ucgaacaacccggccgc

SEQ ID NO: 2862046 - RNA, 18 nt, Mycobacterium avium subsp. paratuberculosis
ucgaacaacccggccgcg

SEQ ID NO: 2862047 - RNA, 21 nt, Mycobacterium avium subsp. paratuberculosis
ucgaacaacccggccgcgauc

SEQ ID NO: 2862048 - RNA, 22 nt, Mycobacterium avium subsp. paratuberculosis
ucgaacacaucguggcgcauca

SEQ ID NO: 2862049 - RNA, 20 nt, Mycobacterium avium subsp. paratuberculosis
ucgaacacgccgucgugggu

SEQ ID NO: 2862050 - RNA, 16 nt, Mycobacterium avium subsp. paratuberculosis
ucgaacagcacgccgg

SEQ ID NO: 2862051 - RNA, 20 nt, Mycobacterium avium subsp. paratuberculosis
ucgaacagcaggcccaggcc

SEQ ID NO: 2862052 - RNA, 15 nt, Mycobacterium avium subsp. paratuberculosis
ucgaacagccgggcc

SEQ ID NO: 2862053 - RNA, 17 nt, Mycobacterium avium subsp. paratuberculosis
ucgaacagccgggccgc

SEQ ID NO: 2862054 - RNA, 18 nt, Mycobacterium avium subsp. paratuberculosis
ucgaacagccgggccgcc

SEQ ID NO: 2862055 - RNA, 21 nt, Mycobacterium avium subsp. paratuberculosis
ucgaacagccgggccgcccgc

SEQ ID NO: 2862056 - RNA, 14 nt, Mycobacterium avium subsp. paratuberculosis
ucgaacagcgcgcc

SEQ ID NO: 2862057 - RNA, 19 nt, Mycobacterium avium subsp. paratuberculosis
ucgaacagcgcgcccgacg

SEQ ID NO: 2862058 - RNA, 13 nt, Mycobacterium avium subsp. paratuberculosis
ucgaacaggaugc

SEQ ID NO: 2862059 - RNA, 15 nt, Mycobacterium avium subsp. paratuberculosis
ucgaacagggcggcg

SEQ ID NO: 2862060 - RNA, 23 nt, Mycobacterium avium subsp. paratuberculosis
ucgaacagggcggcgggcccggc

SEQ ID NO: 2862061 - RNA, 19 nt, Mycobacterium avium subsp. paratuberculosis
ucgaacaucacccggcggc

SEQ ID NO: 2862062 - RNA, 16 nt, Mycobacterium avium subsp. paratuberculosis
ucgaaccacgcggcgg

SEQ ID NO: 2862063 - RNA, 17 nt, Mycobacterium avium subsp. paratuberculosis
ucgaaccacgcggcggc

SEQ ID NO: 2862064 - RNA, 18 nt, Mycobacterium avium subsp. paratuberculosis
ucgaacccgaaaagcacc

SEQ ID NO: 2862065 - RNA, 20 nt, Mycobacterium avium subsp. paratuberculosis
ucgaacccgaccccggcgag

SEQ ID NO: 2862066 - RNA, 14 nt, Mycobacterium avium subsp. paratuberculosis
ucgaaccgccgcgc

SEQ ID NO: 2862067 - RNA, 22 nt, Mycobacterium avium subsp. paratuberculosis
ucgaaccgccgcgcucgcacca

SEQ ID NO: 2862068 - RNA, 19 nt, Mycobacterium avium subsp. paratuberculosis
ucgaaccgcgagcgcgcgg

SEQ ID NO: 2862069 - RNA, 14 nt, Mycobacterium avium subsp. paratuberculosis
ucgaaccgggcggu

SEQ ID NO: 2862070 - RNA, 15 nt, Mycobacterium avium subsp. paratuberculosis
ucgaaccucgcggcg

SEQ ID NO: 2862071 - RNA, 18 nt, Mycobacterium avium subsp. paratuberculosis
ucgaacgagaaggcggcg

SEQ ID NO: 2862072 - RNA, 15 nt, Mycobacterium avium subsp. paratuberculosis
ucgaacgccagcgcc

SEQ ID NO: 2862073 - RNA, 20 nt, Mycobacterium avium subsp. paratuberculosis
ucgaacgcgacgaagcgguc

SEQ ID NO: 2862074 - RNA, 21 nt, Mycobacterium avium subsp. paratuberculosis
ucgaacgcgacgaagcggucg

SEQ ID NO: 2862075 - RNA, 16 nt, Mycobacterium avium subsp. paratuberculosis
ucgaacgcgccgaucg

SEQ ID NO: 2862076 - RNA, 15 nt, Mycobacterium avium subsp. paratuberculosis
ucgaacgcggcgccg

SEQ ID NO: 2862077 - RNA, 17 nt, Mycobacterium avium subsp. paratuberculosis
ucgaacgcggcgccgac

SEQ ID NO: 2862078 - RNA, 18 nt, Mycobacterium avium subsp. paratuberculosis
ucgaacgcggcgccgacg

SEQ ID NO: 2862079 - RNA, 21 nt, Mycobacterium avium subsp. paratuberculosis
ucgaacgcggcgccgacgucc

SEQ ID NO: 2862080 - RNA, 21 nt, Mycobacterium avium subsp. paratuberculosis
ucgaacgcguacacggcccgc

SEQ ID NO: 2862081 - RNA, 22 nt, Mycobacterium avium subsp. paratuberculosis
ucgaacgcguacacggcccgcg

SEQ ID NO: 2862082 - RNA, 20 nt, Mycobacterium avium subsp. paratuberculosis
ucgaacggcaaccugggcgg

SEQ ID NO: 2862083 - RNA, 22 nt, Mycobacterium avium subsp. paratuberculosis
ucgaacggcaaccugggcggcg

SEQ ID NO: 2862084 - RNA, 18 nt, Mycobacterium avium subsp. paratuberculosis
ucgaacggcaccucgauc

SEQ ID NO: 2862085 - RNA, 21 nt, Mycobacterium avium subsp. paratuberculosis
ucgaacggcggaaccgggccg

SEQ ID NO: 2862086 - RNA, 14 nt, Mycobacterium avium subsp. paratuberculosis
ucgaccgccgcguc

SEQ ID NO: 2862087 - RNA, 13 nt, Mycobacterium avium subsp. paratuberculosis
ucgaccgccucgg

SEQ ID NO: 2862088 - RNA, 18 nt, Mycobacterium avium subsp. paratuberculosis
ucgaccgcgacgaccucg

SEQ ID NO: 2862089 - RNA, 22 nt, Mycobacterium avium subsp. paratuberculosis
ucgaccgcgacgaccucgcccg

SEQ ID NO: 2862090 - RNA, 12 nt, Mycobacterium avium subsp. paratuberculosis
ucgaccgcgaug

SEQ ID NO: 2862091 - RNA, 13 nt, Mycobacterium avium subsp. paratuberculosis
ucgaccgcgaugg

SEQ ID NO: 2862092 - RNA, 18 nt, Mycobacterium avium subsp. paratuberculosis
ucgaccgcgcaccggcgc

SEQ ID NO: 2862093 - RNA, 13 nt, Mycobacterium avium subsp. paratuberculosis
ucgaccgcgccgg

SEQ ID NO: 2862094 - RNA, 18 nt, Mycobacterium avium subsp. paratuberculosis
ucgaccgcggcgccgaug

SEQ ID NO: 2862095 - RNA, 21 nt, Mycobacterium avium subsp. paratuberculosis
ucgaccgcggcuccggccgcg

SEQ ID NO: 2862096 - RNA, 15 nt, Mycobacterium avium subsp. paratuberculosis
ucgaccgcgguggcg

SEQ ID NO: 2862097 - RNA, 19 nt, Mycobacterium avium subsp. paratuberculosis
ucgaccggcggaaguagcc

SEQ ID NO: 2862098 - RNA, 12 nt, Mycobacterium avium subsp. paratuberculosis
ucgaccggggcg

SEQ ID NO: 2862099 - RNA, 21 nt, Mycobacterium avium subsp. paratuberculosis
ucgaccggggcgccccgcugg

SEQ ID NO: 2862100 - RNA, 16 nt, Mycobacterium avium subsp. paratuberculosis
ucgaccggguuggcgc

SEQ ID NO: 2862101 - RNA, 17 nt, Mycobacterium avium subsp. paratuberculosis
ucgaccggguuggcgcg

SEQ ID NO: 2862102 - RNA, 19 nt, Mycobacterium avium subsp. paratuberculosis
ucgaccggguuggcgcgca

SEQ ID NO: 2862103 - RNA, 22 nt, Mycobacterium avium subsp. paratuberculosis
ucgaccggguuggcgcgcacca

SEQ ID NO: 2862104 - RNA, 23 nt, Mycobacterium avium subsp. paratuberculosis
ucgaccgguucgucaacgccccg

SEQ ID NO: 2862105 - RNA, 13 nt, Mycobacterium avium subsp. paratuberculosis
ucgaccgucaggu

SEQ ID NO: 2862106 - RNA, 18 nt, Mycobacterium avium subsp. paratuberculosis
ucgaccgugaggcccggc

SEQ ID NO: 2862107 - RNA, 19 nt, Mycobacterium avium subsp. paratuberculosis
ucgaccucgagcgucacgc

SEQ ID NO: 2862108 - RNA, 12 nt, Mycobacterium avium subsp. paratuberculosis
ucgaccucggcg

SEQ ID NO: 2862109 - RNA, 15 nt, Mycobacterium avium subsp. paratuberculosis
ucgaccucggcgacc

SEQ ID NO: 2862110 - RNA, 13 nt, Mycobacterium avium subsp. paratuberculosis
ucgaccucgucgg

SEQ ID NO: 2862111 - RNA, 17 nt, Mycobacterium avium subsp. paratuberculosis
ucgaccucgucggcggc

SEQ ID NO: 2862112 - RNA, 18 nt, Mycobacterium avium subsp. paratuberculosis
ucgaccucgucggcggcg

SEQ ID NO: 2862113 - RNA, 19 nt, Mycobacterium avium subsp. paratuberculosis
ucgaccucgucggcggcga

SEQ ID NO: 2862114 - RNA, 15 nt, Mycobacterium avium subsp. paratuberculosis
ucgaccugcccgggc

SEQ ID NO: 2862115 - RNA, 17 nt, Mycobacterium avium subsp. paratuberculosis
ucgaccugcccgggccc

SEQ ID NO: 2862116 - RNA, 14 nt, Mycobacterium avium subsp. paratuberculosis
ucgaccugcgggug

SEQ ID NO: 2862117 - RNA, 20 nt, Mycobacterium avium subsp. paratuberculosis
ucgaccugggucaucaccuu

SEQ ID NO: 2862118 - RNA, 16 nt, Mycobacterium avium subsp. paratuberculosis
ucgaccuucgagccgc

SEQ ID NO: 2862119 - RNA, 23 nt, Mycobacterium avium subsp. paratuberculosis
ucgaccuucgagccgccgccggc

SEQ ID NO: 2862120 - RNA, 21 nt, Mycobacterium avium subsp. paratuberculosis
ucgaccuuggggucaccgucc

SEQ ID NO: 2862121 - RNA, 15 nt, Mycobacterium avium subsp. paratuberculosis
ucgacgaacgcggcg

SEQ ID NO: 2862122 - RNA, 20 nt, Mycobacterium avium subsp. paratuberculosis
ucgacgaacuccgcgcgcgg

SEQ ID NO: 2862123 - RNA, 21 nt, Mycobacterium avium subsp. paratuberculosis
ucgacgaacuccgcgcgcggc

SEQ ID NO: 2862124 - RNA, 20 nt, Mycobacterium avium subsp. paratuberculosis
ucgacgaagaaggacgccuc

SEQ ID NO: 2862125 - RNA, 13 nt, Mycobacterium avium subsp. paratuberculosis
ucgacgacccgau

SEQ ID NO: 2862126 - RNA, 19 nt, Mycobacterium avium subsp. paratuberculosis
ucgacgacccguaggagcu

SEQ ID NO: 2862127 - RNA, 18 nt, Mycobacterium avium subsp. paratuberculosis
ucgacgaccucgccgacg

SEQ ID NO: 2862128 - RNA, 22 nt, Mycobacterium avium subsp. paratuberculosis
ucgacgacggcgccgcgucgga

SEQ ID NO: 2862129 - RNA, 15 nt, Mycobacterium avium subsp. paratuberculosis
ucgacgacggguggg

SEQ ID NO: 2862130 - RNA, 19 nt, Mycobacterium avium subsp. paratuberculosis
ucgacgacgggugggugga

SEQ ID NO: 2862131 - RNA, 21 nt, Mycobacterium avium subsp. paratuberculosis
ucgacgacguugcgggccagg

SEQ ID NO: 2862132 - RNA, 20 nt, Mycobacterium avium subsp. paratuberculosis
ucgacgacuucggccucggu

SEQ ID NO: 2862133 - RNA, 16 nt, Mycobacterium avium subsp. paratuberculosis
ucgacgagcaggcuga

SEQ ID NO: 2862134 - RNA, 15 nt, Mycobacterium avium subsp. paratuberculosis
ucgacgagcccgccg

SEQ ID NO: 2862135 - RNA, 14 nt, Mycobacterium avium subsp. paratuberculosis
ucgacgagcccgcg

SEQ ID NO: 2862136 - RNA, 15 nt, Mycobacterium avium subsp. paratuberculosis
ucgacgaggcgggcg

SEQ ID NO: 2862137 - RNA, 21 nt, Mycobacterium avium subsp. paratuberculosis
ucgacgaucucgugggucagc

SEQ ID NO: 2862138 - RNA, 24 nt, Mycobacterium avium subsp. paratuberculosis
ucgacgaucuugccgaacaggcgc

SEQ ID NO: 2862139 - RNA, 19 nt, Mycobacterium avium subsp. paratuberculosis
ucgacgaugaaauccggga

SEQ ID NO: 2862140 - RNA, 15 nt, Mycobacterium avium subsp. paratuberculosis
ucgacgaugcgcugc

SEQ ID NO: 2862141 - RNA, 19 nt, Mycobacterium avium subsp. paratuberculosis
ucgacgaugcgcugcuguu

SEQ ID NO: 2862142 - RNA, 16 nt, Mycobacterium avium subsp. paratuberculosis
ucgacgaugcguucgg

SEQ ID NO: 2862143 - RNA, 16 nt, Mycobacterium avium subsp. paratuberculosis
ucgacgauggcccgga

SEQ ID NO: 2862144 - RNA, 19 nt, Mycobacterium avium subsp. paratuberculosis
ucgacgauggcccggaccg

SEQ ID NO: 2862145 - RNA, 15 nt, Mycobacterium avium subsp. paratuberculosis
ucgacgauggcgucc

SEQ ID NO: 2862146 - RNA, 19 nt, Mycobacterium avium subsp. paratuberculosis
ucgacgauggucuggauga

SEQ ID NO: 2862147 - RNA, 16 nt, Mycobacterium avium subsp. paratuberculosis
ucgacgaugucgacgc

SEQ ID NO: 2862148 - RNA, 18 nt, Mycobacterium avium subsp. paratuberculosis
ucgacgauguuggcgacg

SEQ ID NO: 2862149 - RNA, 19 nt, Mycobacterium avium subsp. paratuberculosis
ucgacgauguuggcgacga

SEQ ID NO: 2862150 - RNA, 20 nt, Mycobacterium avium subsp. paratuberculosis
ucgacgauguuggcgacgac

SEQ ID NO: 2862151 - RNA, 17 nt, Mycobacterium avium subsp. paratuberculosis
ucgacgauugucggggc

SEQ ID NO: 2862152 - RNA, 14 nt, Mycobacterium avium subsp. paratuberculosis
ucgacgccaugggc

SEQ ID NO: 2862153 - RNA, 17 nt, Mycobacterium avium subsp. paratuberculosis
ucgacgccaugggccca

SEQ ID NO: 2862154 - RNA, 15 nt, Mycobacterium avium subsp. paratuberculosis
ucgacgccccgcgcc

SEQ ID NO: 2862155 - RNA, 19 nt, Mycobacterium avium subsp. paratuberculosis
ucgacgcccugccacagcg

SEQ ID NO: 2862156 - RNA, 21 nt, Mycobacterium avium subsp. paratuberculosis
ucgacgcccuuggcgcccagc

SEQ ID NO: 2862157 - RNA, 20 nt, Mycobacterium avium subsp. paratuberculosis
ucgacgccgacaucgcggcg

SEQ ID NO: 2862158 - RNA, 16 nt, Mycobacterium avium subsp. paratuberculosis
ucgacgccgaccgcgg

SEQ ID NO: 2862159 - RNA, 12 nt, Mycobacterium avium subsp. paratuberculosis
ucgacgccgaug

SEQ ID NO: 2862160 - RNA, 15 nt, Mycobacterium avium subsp. paratuberculosis
ucgacgccgcugccg

SEQ ID NO: 2862161 - RNA, 14 nt, Mycobacterium avium subsp. paratuberculosis
ucgacgccgggcag

SEQ ID NO: 2862162 - RNA, 17 nt, Mycobacterium avium subsp. paratuberculosis
ucgacgccgggcagcgc

SEQ ID NO: 2862163 - RNA, 15 nt, Mycobacterium avium subsp. paratuberculosis
ucgacgccgggcucg

SEQ ID NO: 2862164 - RNA, 16 nt, Mycobacterium avium subsp. paratuberculosis
ucgacgccgggcucgc

SEQ ID NO: 2862165 - RNA, 19 nt, Mycobacterium avium subsp. paratuberculosis
ucgacgccggugaaaccgg

SEQ ID NO: 2862166 - RNA, 14 nt, Mycobacterium avium subsp. paratuberculosis
ucgacgccgugcug

SEQ ID NO: 2862167 - RNA, 17 nt, Mycobacterium avium subsp. paratuberculosis
ucgacgccgugcugccg

SEQ ID NO: 2862168 - RNA, 20 nt, Mycobacterium avium subsp. paratuberculosis
ucgacgccucggugcggaac

SEQ ID NO: 2862169 - RNA, 14 nt, Mycobacterium avium subsp. paratuberculosis
ucgacgcgaccggc

SEQ ID NO: 2862170 - RNA, 17 nt, Mycobacterium avium subsp. paratuberculosis
ucgacgcgaccggcccg

SEQ ID NO: 2862171 - RNA, 23 nt, Mycobacterium avium subsp. paratuberculosis
ucgacgcgaccuguuugaacacc

SEQ ID NO: 2862172 - RNA, 16 nt, Mycobacterium avium subsp. paratuberculosis
ucgacgcgcacccggg

SEQ ID NO: 2862173 - RNA, 18 nt, Mycobacterium avium subsp. paratuberculosis
ucgacgcgcacccgggac

SEQ ID NO: 2862174 - RNA, 20 nt, Mycobacterium avium subsp. paratuberculosis
ucgacgcgcacccgggaccg

SEQ ID NO: 2862175 - RNA, 14 nt, Mycobacterium avium subsp. paratuberculosis
ucgacgcgccgcac

SEQ ID NO: 2862176 - RNA, 22 nt, Mycobacterium avium subsp. paratuberculosis
ucgacgcgcugcuugacccgcu

SEQ ID NO: 2862177 - RNA, 19 nt, Mycobacterium avium subsp. paratuberculosis
ucgacgcggggcggcggcg

SEQ ID NO: 2862178 - RNA, 21 nt, Mycobacterium avium subsp. paratuberculosis
ucgacgcggggcggcggcgcc

SEQ ID NO: 2862179 - RNA, 19 nt, Mycobacterium avium subsp. paratuberculosis
ucgacgcgugcgucaucgc

SEQ ID NO: 2862180 - RNA, 22 nt, Mycobacterium avium subsp. paratuberculosis
ucgacgcguuguugcucggcgg

SEQ ID NO: 2862181 - RNA, 13 nt, Mycobacterium avium subsp. paratuberculosis
ucgacgcucggcg

SEQ ID NO: 2862182 - RNA, 17 nt, Mycobacterium avium subsp. paratuberculosis
ucgacgcucggcgaugg

SEQ ID NO: 2862183 - RNA, 16 nt, Mycobacterium avium subsp. paratuberculosis
ucgacgcugaccagcu

SEQ ID NO: 2862184 - RNA, 15 nt, Mycobacterium avium subsp. paratuberculosis
ucgacgcugagcacc

SEQ ID NO: 2862185 - RNA, 19 nt, Mycobacterium avium subsp. paratuberculosis
ucgacgcugagcacccgcc

SEQ ID NO: 2862186 - RNA, 17 nt, Mycobacterium avium subsp. paratuberculosis
ucgacgcugagccgcuc

SEQ ID NO: 2862187 - RNA, 14 nt, Mycobacterium avium subsp. paratuberculosis
ucgacggacggguc

SEQ ID NO: 2862188 - RNA, 15 nt, Mycobacterium avium subsp. paratuberculosis
ucgacggagucgucg

SEQ ID NO: 2862189 - RNA, 22 nt, Mycobacterium avium subsp. paratuberculosis
ucgacggagucgucggcgcggu

SEQ ID NO: 2862190 - RNA, 14 nt, Mycobacterium avium subsp. paratuberculosis
ucgacggcacccgg

SEQ ID NO: 2862191 - RNA, 15 nt, Mycobacterium avium subsp. paratuberculosis
ucgacggcacccggc

SEQ ID NO: 2862192 - RNA, 13 nt, Mycobacterium avium subsp. paratuberculosis
ucgacggcagcgc

SEQ ID NO: 2862193 - RNA, 17 nt, Mycobacterium avium subsp. paratuberculosis
ucgacggccccccgggc

SEQ ID NO: 2862194 - RNA, 17 nt, Mycobacterium avium subsp. paratuberculosis
ucgacggccgccgcgac

SEQ ID NO: 2862195 - RNA, 18 nt, Mycobacterium avium subsp. paratuberculosis
ucgacggccgccgcgacg

SEQ ID NO: 2862196 - RNA, 19 nt, Mycobacterium avium subsp. paratuberculosis
ucgacggccgccgcgacgc

SEQ ID NO: 2862197 - RNA, 13 nt, Mycobacterium avium subsp. paratuberculosis
ucgacggccgcgc

SEQ ID NO: 2862198 - RNA, 15 nt, Mycobacterium avium subsp. paratuberculosis
ucgacggccgcgccg

SEQ ID NO: 2862199 - RNA, 20 nt, Mycobacterium avium subsp. paratuberculosis
ucgacggccggcgucacucu

SEQ ID NO: 2862200 - RNA, 11 nt, Mycobacterium avium subsp. paratuberculosis
ucgacggcgaa

SEQ ID NO: 2862201 - RNA, 18 nt, Mycobacterium avium subsp. paratuberculosis
ucgacggcgaagccggcg

SEQ ID NO: 2862202 - RNA, 22 nt, Mycobacterium avium subsp. paratuberculosis
ucgacggggucggacagagucg

SEQ ID NO: 2862203 - RNA, 16 nt, Mycobacterium avium subsp. paratuberculosis
ucgacggugaccggcu

SEQ ID NO: 2862204 - RNA, 22 nt, Mycobacterium avium subsp. paratuberculosis
ucgacggugaccggcucgagca

SEQ ID NO: 2862205 - RNA, 22 nt, Mycobacterium avium subsp. paratuberculosis
ucgacgguggagcggcccagcu

SEQ ID NO: 2862206 - RNA, 17 nt, Mycobacterium avium subsp. paratuberculosis
ucgacgguggccucggc

SEQ ID NO: 2862207 - RNA, 18 nt, Mycobacterium avium subsp. paratuberculosis
ucgacgguggccucggcg

SEQ ID NO: 2862208 - RNA, 19 nt, Mycobacterium avium subsp. paratuberculosis
ucgacgguggccucggcgc

SEQ ID NO: 2862209 - RNA, 20 nt, Mycobacterium avium subsp. paratuberculosis
ucgacgguggccucggcgcu

SEQ ID NO: 2862210 - RNA, 18 nt, Mycobacterium avium subsp. paratuberculosis
ucgacgguugccucggcc

SEQ ID NO: 2862211 - RNA, 21 nt, Mycobacterium avium subsp. paratuberculosis
ucgacgguugccucggccagc

SEQ ID NO: 2862212 - RNA, 22 nt, Mycobacterium avium subsp. paratuberculosis
ucgacgguugccucggccagca

SEQ ID NO: 2862213 - RNA, 24 nt, Mycobacterium avium subsp. paratuberculosis
ucgacgguugccucggccagcacc

SEQ ID NO: 2862214 - RNA, 18 nt, Mycobacterium avium subsp. paratuberculosis
ucgacgguuugcccggcg

SEQ ID NO: 2862215 - RNA, 22 nt, Mycobacterium avium subsp. paratuberculosis
ucgacgguuugcccggcgaugu

SEQ ID NO: 2862216 - RNA, 17 nt, Mycobacterium avium subsp. paratuberculosis
ucgacguacaucagcuc

SEQ ID NO: 2862217 - RNA, 15 nt, Mycobacterium avium subsp. paratuberculosis
ucgacguaggccaga

SEQ ID NO: 2862218 - RNA, 17 nt, Mycobacterium avium subsp. paratuberculosis
ucgacguaguccggcca

SEQ ID NO: 2862219 - RNA, 12 nt, Mycobacterium avium subsp. paratuberculosis
ucgacgucacca

SEQ ID NO: 2862220 - RNA, 16 nt, Mycobacterium avium subsp. paratuberculosis
ucgacgucacgacggu

SEQ ID NO: 2862221 - RNA, 16 nt, Mycobacterium avium subsp. paratuberculosis
ucgacgucauccggcu

SEQ ID NO: 2862222 - RNA, 19 nt, Mycobacterium avium subsp. paratuberculosis
ucgacgucauccggcugcc

SEQ ID NO: 2862223 - RNA, 22 nt, Mycobacterium avium subsp. paratuberculosis
ucgacguccaccggauggcgcc

SEQ ID NO: 2862224 - RNA, 15 nt, Mycobacterium avium subsp. paratuberculosis
ucgacguccaggccg

SEQ ID NO: 2862225 - RNA, 17 nt, Mycobacterium avium subsp. paratuberculosis
ucgacguccucgcccgg

SEQ ID NO: 2862226 - RNA, 23 nt, Mycobacterium avium subsp. paratuberculosis
ucgacgucgaagggucggucgag

SEQ ID NO: 2862227 - RNA, 15 nt, Mycobacterium avium subsp. paratuberculosis
ucgacgucgacgucg

SEQ ID NO: 2862228 - RNA, 22 nt, Mycobacterium avium subsp. paratuberculosis
ucgacgucgacugaucgacgag

SEQ ID NO: 2862229 - RNA, 19 nt, Mycobacterium avium subsp. paratuberculosis
ucgacgugaucuggucggc

SEQ ID NO: 2862230 - RNA, 16 nt, Mycobacterium avium subsp. paratuberculosis
ucgacgugcgcggcgu

SEQ ID NO: 2862231 - RNA, 21 nt, Mycobacterium avium subsp. paratuberculosis
ucgacgugcucggcggccgcc

SEQ ID NO: 2862232 - RNA, 18 nt, Mycobacterium avium subsp. paratuberculosis
ucgacguggugcaccgcc

SEQ ID NO: 2862233 - RNA, 15 nt, Mycobacterium avium subsp. paratuberculosis
ucgacguucgccgcc

SEQ ID NO: 2862234 - RNA, 15 nt, Mycobacterium avium subsp. paratuberculosis
ucgacguucggcggg

SEQ ID NO: 2862235 - RNA, 17 nt, Mycobacterium avium subsp. paratuberculosis
ucgacguucggcgggca

SEQ ID NO: 2862236 - RNA, 20 nt, Mycobacterium avium subsp. paratuberculosis
ucgacguucggcgggcaggc

SEQ ID NO: 2862237 - RNA, 16 nt, Mycobacterium avium subsp. paratuberculosis
ucgacuccagcaccgg

SEQ ID NO: 2862238 - RNA, 14 nt, Mycobacterium avium subsp. paratuberculosis
ucgacuccggcgac

SEQ ID NO: 2862239 - RNA, 16 nt, Mycobacterium avium subsp. paratuberculosis
ucgacuccggcgacac

SEQ ID NO: 2862240 - RNA, 12 nt, Mycobacterium avium subsp. paratuberculosis
ucgacucggcgg

SEQ ID NO: 2862241 - RNA, 15 nt, Mycobacterium avium subsp. paratuberculosis
ucgacugcaccgacu

SEQ ID NO: 2862242 - RNA, 21 nt, Mycobacterium avium subsp. paratuberculosis
ucgacugcgaugcuucccauu

SEQ ID NO: 2862243 - RNA, 14 nt, Mycobacterium avium subsp. paratuberculosis
ucgacuugccgccg

SEQ ID NO: 2862244 - RNA, 15 nt, Mycobacterium avium subsp. paratuberculosis
ucgagaaaagcggcg

SEQ ID NO: 2862245 - RNA, 13 nt, Mycobacterium avium subsp. paratuberculosis
ucgagaaacgcgc

SEQ ID NO: 2862246 - RNA, 21 nt, Mycobacterium avium subsp. paratuberculosis
ucgagacaccgucgcgcaccc

SEQ ID NO: 2862247 - RNA, 20 nt, Mycobacterium avium subsp. paratuberculosis
ucgagaccaugucggccagg

SEQ ID NO: 2862248 - RNA, 21 nt, Mycobacterium avium subsp. paratuberculosis
ucgagaccaugucggccaggu

SEQ ID NO: 2862249 - RNA, 18 nt, Mycobacterium avium subsp. paratuberculosis
ucgagacugcacagugcg

SEQ ID NO: 2862250 - RNA, 16 nt, Mycobacterium avium subsp. paratuberculosis
ucgagagccgcaucgc

SEQ ID NO: 2862251 - RNA, 16 nt, Mycobacterium avium subsp. paratuberculosis
ucgagaucagcaccgg

SEQ ID NO: 2862252 - RNA, 18 nt, Mycobacterium avium subsp. paratuberculosis
ucgagaucagcaccgggu

SEQ ID NO: 2862253 - RNA, 21 nt, Mycobacterium avium subsp. paratuberculosis
ucgagaucagggcgcgcaccg

SEQ ID NO: 2862254 - RNA, 13 nt, Mycobacterium avium subsp. paratuberculosis
ucgagaugaccgu

SEQ ID NO: 2862255 - RNA, 16 nt, Mycobacterium avium subsp. paratuberculosis
ucgagcgucacgccgc

SEQ ID NO: 2862256 - RNA, 22 nt, Mycobacterium avium subsp. paratuberculosis
ucgagcgucacgccgcgcccgu

SEQ ID NO: 2862257 - RNA, 23 nt, Mycobacterium avium subsp. paratuberculosis
ucgagcgucacgccgcgcccguc

SEQ ID NO: 2862258 - RNA, 14 nt, Mycobacterium avium subsp. paratuberculosis
ucgagcgucacgcu

SEQ ID NO: 2862259 - RNA, 21 nt, Mycobacterium avium subsp. paratuberculosis
ucgagcgucacgcuggcguga

SEQ ID NO: 2862260 - RNA, 16 nt, Mycobacterium avium subsp. paratuberculosis
ucgagcgugggcccua

SEQ ID NO: 2862261 - RNA, 13 nt, Mycobacterium avium subsp. paratuberculosis
ucgagcuccuccg

SEQ ID NO: 2862262 - RNA, 15 nt, Mycobacterium avium subsp. paratuberculosis
ucgagcuccucggcc

SEQ ID NO: 2862263 - RNA, 20 nt, Mycobacterium avium subsp. paratuberculosis
ucgagcucgcagucgaucag

SEQ ID NO: 2862264 - RNA, 21 nt, Mycobacterium avium subsp. paratuberculosis
ucgagcugcaacgcgucggcg

SEQ ID NO: 2862265 - RNA, 22 nt, Mycobacterium avium subsp. paratuberculosis
ucgagcugcaacgcgucggcgc

SEQ ID NO: 2862266 - RNA, 14 nt, Mycobacterium avium subsp. paratuberculosis
ucgagcugggcccg

SEQ ID NO: 2862267 - RNA, 15 nt, Mycobacterium avium subsp. paratuberculosis
ucgagcugggcccgc

SEQ ID NO: 2862268 - RNA, 22 nt, Mycobacterium avium subsp. paratuberculosis
ucgagcuuccgccgagucgcgc

SEQ ID NO: 2862269 - RNA, 16 nt, Mycobacterium avium subsp. paratuberculosis
ucgaggaccggcgccg

SEQ ID NO: 2862270 - RNA, 17 nt, Mycobacterium avium subsp. paratuberculosis
ucgaggaccggcgccgg

SEQ ID NO: 2862271 - RNA, 18 nt, Mycobacterium avium subsp. paratuberculosis
ucgaggaccggcgccggc

SEQ ID NO: 2862272 - RNA, 16 nt, Mycobacterium avium subsp. paratuberculosis
ucgaggaucgccaacu

SEQ ID NO: 2862273 - RNA, 15 nt, Mycobacterium avium subsp. paratuberculosis
ucgaggaucgcggcc

SEQ ID NO: 2862274 - RNA, 19 nt, Mycobacterium avium subsp. paratuberculosis
ucgaggaucgcggccacgc

SEQ ID NO: 2862275 - RNA, 22 nt, Mycobacterium avium subsp. paratuberculosis
ucgaggccagcgcgaucgccgg

SEQ ID NO: 2862276 - RNA, 22 nt, Mycobacterium avium subsp. paratuberculosis
ucgaggccccgcgugacggccg

SEQ ID NO: 2862277 - RNA, 14 nt, Mycobacterium avium subsp. paratuberculosis
ucgaggcccucgac

SEQ ID NO: 2862278 - RNA, 15 nt, Mycobacterium avium subsp. paratuberculosis
ucgaggccgcgggcg

SEQ ID NO: 2862279 - RNA, 15 nt, Mycobacterium avium subsp. paratuberculosis
ucgaggccggccagc

SEQ ID NO: 2862280 - RNA, 14 nt, Mycobacterium avium subsp. paratuberculosis
ucgaggcgcugcag

SEQ ID NO: 2862281 - RNA, 16 nt, Mycobacterium avium subsp. paratuberculosis
ucgagggccaccggcu

SEQ ID NO: 2862282 - RNA, 20 nt, Mycobacterium avium subsp. paratuberculosis
ucgagggccaccggcuccuu

SEQ ID NO: 2862283 - RNA, 13 nt, Mycobacterium avium subsp. paratuberculosis
ucgagggccucca

SEQ ID NO: 2862284 - RNA, 16 nt, Mycobacterium avium subsp. paratuberculosis
ucgagggcggcgaccu

SEQ ID NO: 2862285 - RNA, 18 nt, Mycobacterium avium subsp. paratuberculosis
ucgagggcguccuuccaa

SEQ ID NO: 2862286 - RNA, 15 nt, Mycobacterium avium subsp. paratuberculosis
ucgagggggucauca

SEQ ID NO: 2862287 - RNA, 23 nt, Mycobacterium avium subsp. paratuberculosis
ucgagggugaugucgcugccgcc

SEQ ID NO: 2862288 - RNA, 17 nt, Mycobacterium avium subsp. paratuberculosis
ucgagguaggccaccgg

SEQ ID NO: 2862289 - RNA, 20 nt, Mycobacterium avium subsp. paratuberculosis
ucgaggucgaaccacgcggc

SEQ ID NO: 2862290 - RNA, 22 nt, Mycobacterium avium subsp. paratuberculosis
ucgaggucgaaccacgcggcgg

SEQ ID NO: 2862291 - RNA, 14 nt, Mycobacterium avium subsp. paratuberculosis
ucgaggucggccag

SEQ ID NO: 2862292 - RNA, 15 nt, Mycobacterium avium subsp. paratuberculosis
ucgaggucggccagc

SEQ ID NO: 2862293 - RNA, 16 nt, Mycobacterium avium subsp. paratuberculosis
ucgaggucggccagca

SEQ ID NO: 2862294 - RNA, 13 nt, Mycobacterium avium subsp. paratuberculosis
ucgaggucgucgg

SEQ ID NO: 2862295 - RNA, 15 nt, Mycobacterium avium subsp. paratuberculosis
ucgaggucgucgggc

SEQ ID NO: 2862296 - RNA, 21 nt, Mycobacterium avium subsp. paratuberculosis
ucgaggucgucgggcgccggu

SEQ ID NO: 2862297 - RNA, 22 nt, Mycobacterium avium subsp. paratuberculosis
ucgaggugauguuggccgcgac

SEQ ID NO: 2862298 - RNA, 19 nt, Mycobacterium avium subsp. paratuberculosis
ucgagguguugucgugccg

SEQ ID NO: 2862299 - RNA, 16 nt, Mycobacterium avium subsp. paratuberculosis
ucgagguugaugccga

SEQ ID NO: 2862300 - RNA, 23 nt, Mycobacterium avium subsp. paratuberculosis
ucgagguugaugccgacgucggu

SEQ ID NO: 2862301 - RNA, 22 nt, Mycobacterium avium subsp. paratuberculosis
ucgaguaccucgcuguaggcca

SEQ ID NO: 2862302 - RNA, 15 nt, Mycobacterium avium subsp. paratuberculosis
ucgaguaggcgacca

SEQ ID NO: 2862303 - RNA, 21 nt, Mycobacterium avium subsp. paratuberculosis
ucgaguaggcgaccacaccgc

SEQ ID NO: 2862304 - RNA, 16 nt, Mycobacterium avium subsp. paratuberculosis
ucgaguaguccgggau

SEQ ID NO: 2862305 - RNA, 16 nt, Mycobacterium avium subsp. paratuberculosis
ucgagucccgcgcggc

SEQ ID NO: 2862306 - RNA, 17 nt, Mycobacterium avium subsp. paratuberculosis
ucgagucccgcgcggcg

SEQ ID NO: 2862307 - RNA, 19 nt, Mycobacterium avium subsp. paratuberculosis
ucgagucccgcgcggcgca

SEQ ID NO: 2862308 - RNA, 23 nt, Mycobacterium avium subsp. paratuberculosis
ucgagucccgcgcggcgcagggc

SEQ ID NO: 2862309 - RNA, 18 nt, Mycobacterium avium subsp. paratuberculosis
ucgagugcucgauggcca

SEQ ID NO: 2862310 - RNA, 20 nt, Mycobacterium avium subsp. paratuberculosis
ucgaguguguacacagggcg

SEQ ID NO: 2862311 - RNA, 19 nt, Mycobacterium avium subsp. paratuberculosis
ucgaguuccuccacgacuu

SEQ ID NO: 2862312 - RNA, 16 nt, Mycobacterium avium subsp. paratuberculosis
ucgaguucgcggcgca

SEQ ID NO: 2862313 - RNA, 18 nt, Mycobacterium avium subsp. paratuberculosis
ucgaguuuggccagcucg

SEQ ID NO: 2862314 - RNA, 18 nt, Mycobacterium avium subsp. paratuberculosis
ucgauaacgcgcgcgccg

SEQ ID NO: 2862315 - RNA, 22 nt, Mycobacterium avium subsp. paratuberculosis
ucgauagugaacgccucgggcc

SEQ ID NO: 2862316 - RNA, 16 nt, Mycobacterium avium subsp. paratuberculosis
ucgauaguggcgucca

SEQ ID NO: 2862317 - RNA, 19 nt, Mycobacterium avium subsp. paratuberculosis
ucgaucaaaucccgcagcu

SEQ ID NO: 2862318 - RNA, 15 nt, Mycobacterium avium subsp. paratuberculosis
ucgaucaacgccggg

SEQ ID NO: 2862319 - RNA, 16 nt, Mycobacterium avium subsp. paratuberculosis
ucgaucaacgccgggu

SEQ ID NO: 2862320 - RNA, 15 nt, Mycobacterium avium subsp. paratuberculosis
ucgaucacgccgccg

SEQ ID NO: 2862321 - RNA, 15 nt, Mycobacterium avium subsp. paratuberculosis
ucgaucagagcgggc

SEQ ID NO: 2862322 - RNA, 16 nt, Mycobacterium avium subsp. paratuberculosis
ucgaucagagcgggcc

SEQ ID NO: 2862323 - RNA, 18 nt, Mycobacterium avium subsp. paratuberculosis
ucgaucagagcgggccga

SEQ ID NO: 2862324 - RNA, 14 nt, Mycobacterium avium subsp. paratuberculosis
ucgaucagcaccgc

SEQ ID NO: 2862325 - RNA, 16 nt, Mycobacterium avium subsp. paratuberculosis
ucgaucagcaccgcca

SEQ ID NO: 2862326 - RNA, 19 nt, Mycobacterium avium subsp. paratuberculosis
ucgaucagcaccgccacgc

SEQ ID NO: 2862327 - RNA, 17 nt, Mycobacterium avium subsp. paratuberculosis
ucgaucagccacaccgc

SEQ ID NO: 2862328 - RNA, 21 nt, Mycobacterium avium subsp. paratuberculosis
ucgaucagccacaccgccggc

SEQ ID NO: 2862329 - RNA, 19 nt, Mycobacterium avium subsp. paratuberculosis
ucgaucagcgacggcccgc

SEQ ID NO: 2862330 - RNA, 18 nt, Mycobacterium avium subsp. paratuberculosis
ucgaucagucgucccggc

SEQ ID NO: 2862331 - RNA, 19 nt, Mycobacterium avium subsp. paratuberculosis
ucgaucagucgucccggcu

SEQ ID NO: 2862332 - RNA, 23 nt, Mycobacterium avium subsp. paratuberculosis
ucgaucagucgucccggcuuucc

SEQ ID NO: 2862333 - RNA, 16 nt, Mycobacterium avium subsp. paratuberculosis
ucgaucaucgccucgg

SEQ ID NO: 2862334 - RNA, 17 nt, Mycobacterium avium subsp. paratuberculosis
ucgaucaucgcgucggu

SEQ ID NO: 2862335 - RNA, 18 nt, Mycobacterium avium subsp. paratuberculosis
ucgauccacccaccggca

SEQ ID NO: 2862336 - RNA, 23 nt, Mycobacterium avium subsp. paratuberculosis
ucgauccccgcagcucccccggc

SEQ ID NO: 2862337 - RNA, 20 nt, Mycobacterium avium subsp. paratuberculosis
ucgaucccuuggcggcggcc

SEQ ID NO: 2862338 - RNA, 23 nt, Mycobacterium avium subsp. paratuberculosis
ucgaucgaauacaccugccgcac

SEQ ID NO: 2862339 - RNA, 24 nt, Mycobacterium avium subsp. paratuberculosis
ucgauggcggcggcugccucgacg

SEQ ID NO: 2862340 - RNA, 18 nt, Mycobacterium avium subsp. paratuberculosis
ucgauggcgggcgcgccg

SEQ ID NO: 2862341 - RNA, 21 nt, Mycobacterium avium subsp. paratuberculosis
ucgaugggaaccgcucggcuc

SEQ ID NO: 2862342 - RNA, 17 nt, Mycobacterium avium subsp. paratuberculosis
ucgauggggauggugcg

SEQ ID NO: 2862343 - RNA, 21 nt, Mycobacterium avium subsp. paratuberculosis
ucgauggggauggugcgccgg

SEQ ID NO: 2862344 - RNA, 14 nt, Mycobacterium avium subsp. paratuberculosis
ucgauggucgccuu

SEQ ID NO: 2862345 - RNA, 18 nt, Mycobacterium avium subsp. paratuberculosis
ucgauggucgccuuguug

SEQ ID NO: 2862346 - RNA, 23 nt, Mycobacterium avium subsp. paratuberculosis
ucgauggucugcccgccgccgau

SEQ ID NO: 2862347 - RNA, 15 nt, Mycobacterium avium subsp. paratuberculosis
ucgaugucgacgccg

SEQ ID NO: 2862348 - RNA, 21 nt, Mycobacterium avium subsp. paratuberculosis
ucgaugucgcccggcgcggca

SEQ ID NO: 2862349 - RNA, 13 nt, Mycobacterium avium subsp. paratuberculosis
ucgaugucgccgg

SEQ ID NO: 2862350 - RNA, 15 nt, Mycobacterium avium subsp. paratuberculosis
ucgaugucgccggcg

SEQ ID NO: 2862351 - RNA, 20 nt, Mycobacterium avium subsp. paratuberculosis
ucgaugucggccagcgcggc

SEQ ID NO: 2862352 - RNA, 17 nt, Mycobacterium avium subsp. paratuberculosis
ucgaugucgguggcgcg

SEQ ID NO: 2862353 - RNA, 19 nt, Mycobacterium avium subsp. paratuberculosis
ucgaugucggugguggggc

SEQ ID NO: 2862354 - RNA, 13 nt, Mycobacterium avium subsp. paratuberculosis
ucgaugucgucgu

SEQ ID NO: 2862355 - RNA, 16 nt, Mycobacterium avium subsp. paratuberculosis
ucgaugucgucgucga

SEQ ID NO: 2862356 - RNA, 15 nt, Mycobacterium avium subsp. paratuberculosis
ucgaugugcucgggg

SEQ ID NO: 2862357 - RNA, 14 nt, Mycobacterium avium subsp. paratuberculosis
ucgauugccggacg

SEQ ID NO: 2862358 - RNA, 23 nt, Mycobacterium avium subsp. paratuberculosis
ucgcaaacgaaucgagccgccug

SEQ ID NO: 2862359 - RNA, 13 nt, Mycobacterium avium subsp. paratuberculosis
ucgcaaccgucuu

SEQ ID NO: 2862360 - RNA, 18 nt, Mycobacterium avium subsp. paratuberculosis
ucgcacaacccgcccggg

SEQ ID NO: 2862361 - RNA, 15 nt, Mycobacterium avium subsp. paratuberculosis
ucgcacaaccgggcc

SEQ ID NO: 2862362 - RNA, 16 nt, Mycobacterium avium subsp. paratuberculosis
ucgcacaaccgggcca

SEQ ID NO: 2862363 - RNA, 19 nt, Mycobacterium avium subsp. paratuberculosis
ucgcacaaccgggccaacg

SEQ ID NO: 2862364 - RNA, 13 nt, Mycobacterium avium subsp. paratuberculosis
ucgcacaccagca

SEQ ID NO: 2862365 - RNA, 18 nt, Mycobacterium avium subsp. paratuberculosis
ucgcacaccagcacggcg

SEQ ID NO: 2862366 - RNA, 21 nt, Mycobacterium avium subsp. paratuberculosis
ucgcacaccagcacggcggcg

SEQ ID NO: 2862367 - RNA, 14 nt, Mycobacterium avium subsp. paratuberculosis
ucgcacagccggcg

SEQ ID NO: 2862368 - RNA, 14 nt, Mycobacterium avium subsp. paratuberculosis
ucgcacagcgccgc

SEQ ID NO: 2862369 - RNA, 16 nt, Mycobacterium avium subsp. paratuberculosis
ucgcacagcgccgcgu

SEQ ID NO: 2862370 - RNA, 22 nt, Mycobacterium avium subsp. paratuberculosis
ucgcacaggaugcccaacagcu

SEQ ID NO: 2862371 - RNA, 11 nt, Mycobacterium avium subsp. paratuberculosis
ucgcaccagcg

SEQ ID NO: 2862372 - RNA, 19 nt, Mycobacterium avium subsp. paratuberculosis
ucgcaccagcgcuuucgcg

SEQ ID NO: 2862373 - RNA, 17 nt, Mycobacterium avium subsp. paratuberculosis
ucgcaccccaccgacag

SEQ ID NO: 2862374 - RNA, 18 nt, Mycobacterium avium subsp. paratuberculosis
ucgcaccccaccgacagc

SEQ ID NO: 2862375 - RNA, 23 nt, Mycobacterium avium subsp. paratuberculosis
ucgcaccccaccgacagccggac

SEQ ID NO: 2862376 - RNA, 16 nt, Mycobacterium avium subsp. paratuberculosis
ucgcacccggucaggu

SEQ ID NO: 2862377 - RNA, 13 nt, Mycobacterium avium subsp. paratuberculosis
ucgcaccgcggcg

SEQ ID NO: 2862378 - RNA, 22 nt, Mycobacterium avium subsp. paratuberculosis
ucgcaccggcgccucgaugcgg

SEQ ID NO: 2862379 - RNA, 17 nt, Mycobacterium avium subsp. paratuberculosis
ucgcaccugccgucgac

SEQ ID NO: 2862380 - RNA, 16 nt, Mycobacterium avium subsp. paratuberculosis
ucgcacuagguccggc

SEQ ID NO: 2862381 - RNA, 22 nt, Mycobacterium avium subsp. paratuberculosis
ucgcacuagguccggcgcgacc

SEQ ID NO: 2862382 - RNA, 16 nt, Mycobacterium avium subsp. paratuberculosis
ucgcacuugaagcuga

SEQ ID NO: 2862383 - RNA, 21 nt, Mycobacterium avium subsp. paratuberculosis
ucgcagcagcagcccgaacag

SEQ ID NO: 2862384 - RNA, 22 nt, Mycobacterium avium subsp. paratuberculosis
ucgcagcagcagcccgaacagc

SEQ ID NO: 2862385 - RNA, 19 nt, Mycobacterium avium subsp. paratuberculosis
ucgcagcgacaaucggcuc

SEQ ID NO: 2862386 - RNA, 11 nt, Mycobacterium avium subsp. paratuberculosis
ucgcagcgcgc

SEQ ID NO: 2862387 - RNA, 16 nt, Mycobacterium avium subsp. paratuberculosis
ucgcagcgcgcggcgc

SEQ ID NO: 2862388 - RNA, 17 nt, Mycobacterium avium subsp. paratuberculosis
ucgcagcgcgcggcgca

SEQ ID NO: 2862389 - RNA, 19 nt, Mycobacterium avium subsp. paratuberculosis
ucgcagcgcgcggcgcaga

SEQ ID NO: 2862390 - RNA, 14 nt, Mycobacterium avium subsp. paratuberculosis
ucgcagcggugaca

SEQ ID NO: 2862391 - RNA, 19 nt, Mycobacterium avium subsp. paratuberculosis
ucgcaggcagcagcacccc

SEQ ID NO: 2862392 - RNA, 16 nt, Mycobacterium avium subsp. paratuberculosis
ucgcaggccgcccggc

SEQ ID NO: 2862393 - RNA, 23 nt, Mycobacterium avium subsp. paratuberculosis
ucgcaggugccggugacggucag

SEQ ID NO: 2862394 - RNA, 18 nt, Mycobacterium avium subsp. paratuberculosis
ucgcagguucgacacgcc

SEQ ID NO: 2862395 - RNA, 21 nt, Mycobacterium avium subsp. paratuberculosis
ucgcauagcgguccauccagc

SEQ ID NO: 2862396 - RNA, 13 nt, Mycobacterium avium subsp. paratuberculosis
ucgcaucagcucg

SEQ ID NO: 2862397 - RNA, 14 nt, Mycobacterium avium subsp. paratuberculosis
ucgcaucagcucgg

SEQ ID NO: 2862398 - RNA, 13 nt, Mycobacterium avium subsp. paratuberculosis
ucgccaaggcgcu

SEQ ID NO: 2862399 - RNA, 14 nt, Mycobacterium avium subsp. paratuberculosis
ucgccaaggcgcug

SEQ ID NO: 2862400 - RNA, 22 nt, Mycobacterium avium subsp. paratuberculosis
ucgccaauaaagcgggcccgcc

SEQ ID NO: 2862401 - RNA, 18 nt, Mycobacterium avium subsp. paratuberculosis
ucgccaauccggcgggcc

SEQ ID NO: 2862402 - RNA, 13 nt, Mycobacterium avium subsp. paratuberculosis
ucgccaccaccag

SEQ ID NO: 2862403 - RNA, 17 nt, Mycobacterium avium subsp. paratuberculosis
ucgccaccaccagcggu

SEQ ID NO: 2862404 - RNA, 17 nt, Mycobacterium avium subsp. paratuberculosis
ucgccaccaccgcgccg

SEQ ID NO: 2862405 - RNA, 20 nt, Mycobacterium avium subsp. paratuberculosis
ucgccaccaccgcgccgucg

SEQ ID NO: 2862406 - RNA, 22 nt, Mycobacterium avium subsp. paratuberculosis
ucgccaccaccuucaucgccgu

SEQ ID NO: 2862407 - RNA, 15 nt, Mycobacterium avium subsp. paratuberculosis
ucgccaccacggcgc

SEQ ID NO: 2862408 - RNA, 16 nt, Mycobacterium avium subsp. paratuberculosis
ucgccaccacggcgcc

SEQ ID NO: 2862409 - RNA, 19 nt, Mycobacterium avium subsp. paratuberculosis
ucgccaccacggcgcccuc

SEQ ID NO: 2862410 - RNA, 13 nt, Mycobacterium avium subsp. paratuberculosis
ucgccaccacggu

SEQ ID NO: 2862411 - RNA, 14 nt, Mycobacterium avium subsp. paratuberculosis
ucgccaccagaccg

SEQ ID NO: 2862412 - RNA, 16 nt, Mycobacterium avium subsp. paratuberculosis
ucgccaccagaccggc

SEQ ID NO: 2862413 - RNA, 12 nt, Mycobacterium avium subsp. paratuberculosis
ucgccaccgaga

SEQ ID NO: 2862414 - RNA, 22 nt, Mycobacterium avium subsp. paratuberculosis
ucgccaccgagucgcgcgacca

SEQ ID NO: 2862415 - RNA, 23 nt, Mycobacterium avium subsp. paratuberculosis
ucgccaccgagucgcgcgaccag

SEQ ID NO: 2862416 - RNA, 19 nt, Mycobacterium avium subsp. paratuberculosis
ucgccaccgaugcgggcca

SEQ ID NO: 2862417 - RNA, 20 nt, Mycobacterium avium subsp. paratuberculosis
ucgccaccgaugcgggccag

SEQ ID NO: 2862418 - RNA, 21 nt, Mycobacterium avium subsp. paratuberculosis
ucgccaccgaugcgggccagg

SEQ ID NO: 2862419 - RNA, 13 nt, Mycobacterium avium subsp. paratuberculosis
ucgccaccgucgu

SEQ ID NO: 2862420 - RNA, 13 nt, Mycobacterium avium subsp. paratuberculosis
ucgccacgaucac

SEQ ID NO: 2862421 - RNA, 18 nt, Mycobacterium avium subsp. paratuberculosis
ucgccacgaucaccacca

SEQ ID NO: 2862422 - RNA, 21 nt, Mycobacterium avium subsp. paratuberculosis
ucgccacgaucaccaccaccg

SEQ ID NO: 2862423 - RNA, 12 nt, Mycobacterium avium subsp. paratuberculosis
ucgccacgccgu

SEQ ID NO: 2862424 - RNA, 13 nt, Mycobacterium avium subsp. paratuberculosis
ucgccccggcgac

SEQ ID NO: 2862425 - RNA, 17 nt, Mycobacterium avium subsp. paratuberculosis
ucgccccggcgacgucg

SEQ ID NO: 2862426 - RNA, 22 nt, Mycobacterium avium subsp. paratuberculosis
ucgccccggcgacgucgccggc

SEQ ID NO: 2862427 - RNA, 15 nt, Mycobacterium avium subsp. paratuberculosis
ucgcccgcagcacgc

SEQ ID NO: 2862428 - RNA, 14 nt, Mycobacterium avium subsp. paratuberculosis
ucgcccgccgacgg

SEQ ID NO: 2862429 - RNA, 15 nt, Mycobacterium avium subsp. paratuberculosis
ucgcccgccgacggc

SEQ ID NO: 2862430 - RNA, 18 nt, Mycobacterium avium subsp. paratuberculosis
ucgcccgccgacggcugc

SEQ ID NO: 2862431 - RNA, 12 nt, Mycobacterium avium subsp. paratuberculosis
ucgcccgccgcg

SEQ ID NO: 2862432 - RNA, 14 nt, Mycobacterium avium subsp. paratuberculosis
ucgcccgccgcgag

SEQ ID NO: 2862433 - RNA, 19 nt, Mycobacterium avium subsp. paratuberculosis
ucgcccgcguugcggcgca

SEQ ID NO: 2862434 - RNA, 15 nt, Mycobacterium avium subsp. paratuberculosis
ucgcccgcuccgcgg

SEQ ID NO: 2862435 - RNA, 19 nt, Mycobacterium avium subsp. paratuberculosis
ucgcccgcuccgcgggcag

SEQ ID NO: 2862436 - RNA, 18 nt, Mycobacterium avium subsp. paratuberculosis
ucgcccgcuccgcggugc

SEQ ID NO: 2862437 - RNA, 20 nt, Mycobacterium avium subsp. paratuberculosis
ucgcccggaaaaagcguugc

SEQ ID NO: 2862438 - RNA, 16 nt, Mycobacterium avium subsp. paratuberculosis
ucgcccggcgcccggc

SEQ ID NO: 2862439 - RNA, 20 nt, Mycobacterium avium subsp. paratuberculosis
ucgcccggcgcccggccggc

SEQ ID NO: 2862440 - RNA, 13 nt, Mycobacterium avium subsp. paratuberculosis
ucgcccggcgcgg

SEQ ID NO: 2862441 - RNA, 14 nt, Mycobacterium avium subsp. paratuberculosis
ucgcccggcgcggc

SEQ ID NO: 2862442 - RNA, 12 nt, Mycobacterium avium subsp. paratuberculosis
ucgcccggcggc

SEQ ID NO: 2862443 - RNA, 13 nt, Mycobacterium avium subsp. paratuberculosis
ucgcccggcggca

SEQ ID NO: 2862444 - RNA, 22 nt, Mycobacterium avium subsp. paratuberculosis
ucgcccggcguccagugcaugc

SEQ ID NO: 2862445 - RNA, 17 nt, Mycobacterium avium subsp. paratuberculosis
ucgcccggcucgccggg

SEQ ID NO: 2862446 - RNA, 20 nt, Mycobacterium avium subsp. paratuberculosis
ucgcccggcugcgccgcgcu

SEQ ID NO: 2862447 - RNA, 12 nt, Mycobacterium avium subsp. paratuberculosis
ucgcccgggcca

SEQ ID NO: 2862448 - RNA, 15 nt, Mycobacterium avium subsp. paratuberculosis
ucgcccgggccaggu

SEQ ID NO: 2862449 - RNA, 19 nt, Mycobacterium avium subsp. paratuberculosis
ucgcccgggccaggucggu

SEQ ID NO: 2862450 - RNA, 21 nt, Mycobacterium avium subsp. paratuberculosis
ucgcccgggcuaucgcccggc

SEQ ID NO: 2862451 - RNA, 23 nt, Mycobacterium avium subsp. paratuberculosis
ucgcccgggcuaucgcccggcgc

SEQ ID NO: 2862452 - RNA, 12 nt, Mycobacterium avium subsp. paratuberculosis
ucgcccgggugc

SEQ ID NO: 2862453 - RNA, 17 nt, Mycobacterium avium subsp. paratuberculosis
ucgcccgucucggcgug

SEQ ID NO: 2862454 - RNA, 12 nt, Mycobacterium avium subsp. paratuberculosis
ucgcccuccccg

SEQ ID NO: 2862455 - RNA, 15 nt, Mycobacterium avium subsp. paratuberculosis
ucgcccuccccggcc

SEQ ID NO: 2862456 - RNA, 17 nt, Mycobacterium avium subsp. paratuberculosis
ucgcccuccccggccag

SEQ ID NO: 2862457 - RNA, 17 nt, Mycobacterium avium subsp. paratuberculosis
ucgcccucgaucgcgac

SEQ ID NO: 2862458 - RNA, 17 nt, Mycobacterium avium subsp. paratuberculosis
ucgcccuggauauccag

SEQ ID NO: 2862459 - RNA, 14 nt, Mycobacterium avium subsp. paratuberculosis
ucgcccuggcaucc

SEQ ID NO: 2862460 - RNA, 15 nt, Mycobacterium avium subsp. paratuberculosis
ucgcccuggcauccg

SEQ ID NO: 2862461 - RNA, 21 nt, Mycobacterium avium subsp. paratuberculosis
ucgcccuggcauccgucggcc

SEQ ID NO: 2862462 - RNA, 12 nt, Mycobacterium avium subsp. paratuberculosis
ucgcccuggccg

SEQ ID NO: 2862463 - RNA, 14 nt, Mycobacterium avium subsp. paratuberculosis
ucgcccuggccgcg

SEQ ID NO: 2862464 - RNA, 19 nt, Mycobacterium avium subsp. paratuberculosis
ucgccgaaccgggcgcgca

SEQ ID NO: 2862465 - RNA, 15 nt, Mycobacterium avium subsp. paratuberculosis
ucgccgaaccggggc

SEQ ID NO: 2862466 - RNA, 20 nt, Mycobacterium avium subsp. paratuberculosis
ucgccgaaccggggccgcac

SEQ ID NO: 2862467 - RNA, 16 nt, Mycobacterium avium subsp. paratuberculosis
ucgccgaacgccacca

SEQ ID NO: 2862468 - RNA, 18 nt, Mycobacterium avium subsp. paratuberculosis
ucgccgaacgccucgauc

SEQ ID NO: 2862469 - RNA, 14 nt, Mycobacterium avium subsp. paratuberculosis
ucgccgaacgugcg

SEQ ID NO: 2862470 - RNA, 19 nt, Mycobacterium avium subsp. paratuberculosis
ucgccgaacgugcgcggcg

SEQ ID NO: 2862471 - RNA, 20 nt, Mycobacterium avium subsp. paratuberculosis
ucgccgaaguuccagccgau

SEQ ID NO: 2862472 - RNA, 21 nt, Mycobacterium avium subsp. paratuberculosis
ucgccgaaguuccagccgauc

SEQ ID NO: 2862473 - RNA, 18 nt, Mycobacterium avium subsp. paratuberculosis
ucgccgaauccggcgggg

SEQ ID NO: 2862474 - RNA, 22 nt, Mycobacterium avium subsp. paratuberculosis
ucgccgaauuguucggccaccg

SEQ ID NO: 2862475 - RNA, 16 nt, Mycobacterium avium subsp. paratuberculosis
ucgccgacagcgucgu

SEQ ID NO: 2862476 - RNA, 19 nt, Mycobacterium avium subsp. paratuberculosis
ucgccgacagcgucgucca

SEQ ID NO: 2862477 - RNA, 13 nt, Mycobacterium avium subsp. paratuberculosis
ucgccgaccagca

SEQ ID NO: 2862478 - RNA, 18 nt, Mycobacterium avium subsp. paratuberculosis
ucgccgaccagcaggacg

SEQ ID NO: 2862479 - RNA, 19 nt, Mycobacterium avium subsp. paratuberculosis
ucgccgaccagcaggacgc

SEQ ID NO: 2862480 - RNA, 22 nt, Mycobacterium avium subsp. paratuberculosis
ucgccgaccaguucggccaccg

SEQ ID NO: 2862481 - RNA, 23 nt, Mycobacterium avium subsp. paratuberculosis
ucgccgaccaguucggccaccgc

SEQ ID NO: 2862482 - RNA, 13 nt, Mycobacterium avium subsp. paratuberculosis
ucgccgacgccag

SEQ ID NO: 2862483 - RNA, 15 nt, Mycobacterium avium subsp. paratuberculosis
ucgccgacgccagca

SEQ ID NO: 2862484 - RNA, 18 nt, Mycobacterium avium subsp. paratuberculosis
ucgccgacgccagcacgu

SEQ ID NO: 2862485 - RNA, 13 nt, Mycobacterium avium subsp. paratuberculosis
ucgccgacgccga

SEQ ID NO: 2862486 - RNA, 22 nt, Mycobacterium avium subsp. paratuberculosis
ucgccgacgccgaagaucagcg

SEQ ID NO: 2862487 - RNA, 13 nt, Mycobacterium avium subsp. paratuberculosis
ucgccgacgccgu

SEQ ID NO: 2862488 - RNA, 21 nt, Mycobacterium avium subsp. paratuberculosis
ucgccgacgccgucgaugacg

SEQ ID NO: 2862489 - RNA, 15 nt, Mycobacterium avium subsp. paratuberculosis
ucgccgacgggccca

SEQ ID NO: 2862490 - RNA, 23 nt, Mycobacterium avium subsp. paratuberculosis
ucgccgacgggcccagcgcgacg

SEQ ID NO: 2862491 - RNA, 14 nt, Mycobacterium avium subsp. paratuberculosis
ucgccgacggugag

SEQ ID NO: 2862492 - RNA, 20 nt, Mycobacterium avium subsp. paratuberculosis
ucgccgacggugagcaccgc

SEQ ID NO: 2862493 - RNA, 22 nt, Mycobacterium avium subsp. paratuberculosis
ucgccgacggugagcaccgccg

SEQ ID NO: 2862494 - RNA, 23 nt, Mycobacterium avium subsp. paratuberculosis
ucgccgacggugagcaccgccgu

SEQ ID NO: 2862495 - RNA, 15 nt, Mycobacterium avium subsp. paratuberculosis
ucgccgacgguggcg

SEQ ID NO: 2862496 - RNA, 16 nt, Mycobacterium avium subsp. paratuberculosis
ucgccgacgguggcga

SEQ ID NO: 2862497 - RNA, 14 nt, Mycobacterium avium subsp. paratuberculosis
ucgccgacgguguc

SEQ ID NO: 2862498 - RNA, 21 nt, Mycobacterium avium subsp. paratuberculosis
ucgccgacguagacgagccgg

SEQ ID NO: 2862499 - RNA, 15 nt, Mycobacterium avium subsp. paratuberculosis
ucgccgacgucuggu

SEQ ID NO: 2862500 - RNA, 24 nt, Mycobacterium avium subsp. paratuberculosis
ucgccgacgucugguuggccggcg

SEQ ID NO: 2862501 - RNA, 23 nt, Mycobacterium avium subsp. paratuberculosis
ucgccgacguuguugucgaugau

SEQ ID NO: 2862502 - RNA, 17 nt, Mycobacterium avium subsp. paratuberculosis
ucgccgagacgaucccg

SEQ ID NO: 2862503 - RNA, 23 nt, Mycobacterium avium subsp. paratuberculosis
ucgccgagacgaucccguagccg

SEQ ID NO: 2862504 - RNA, 13 nt, Mycobacterium avium subsp. paratuberculosis
ucgccgagcagau

SEQ ID NO: 2862505 - RNA, 15 nt, Mycobacterium avium subsp. paratuberculosis
ucgccgagcagaucg

SEQ ID NO: 2862506 - RNA, 18 nt, Mycobacterium avium subsp. paratuberculosis
ucgccgagccgcaccgcc

SEQ ID NO: 2862507 - RNA, 19 nt, Mycobacterium avium subsp. paratuberculosis
ucgccgagccgcaccgccu

SEQ ID NO: 2862508 - RNA, 13 nt, Mycobacterium avium subsp. paratuberculosis
ucgccgagccgcg

SEQ ID NO: 2862509 - RNA, 22 nt, Mycobacterium avium subsp. paratuberculosis
ucgccgcgcuugcgaccgccgc

SEQ ID NO: 2862510 - RNA, 23 nt, Mycobacterium avium subsp. paratuberculosis
ucgccgcgcuugcgaccgccgcu

SEQ ID NO: 2862511 - RNA, 16 nt, Mycobacterium avium subsp. paratuberculosis
ucgccgcggaccccag

SEQ ID NO: 2862512 - RNA, 23 nt, Mycobacterium avium subsp. paratuberculosis
ucgccgcggaccccagcgugacg

SEQ ID NO: 2862513 - RNA, 15 nt, Mycobacterium avium subsp. paratuberculosis
ucgccgcggccacgc

SEQ ID NO: 2862514 - RNA, 23 nt, Mycobacterium avium subsp. paratuberculosis
ucgccgcggccacgcucgggccg

SEQ ID NO: 2862515 - RNA, 12 nt, Mycobacterium avium subsp. paratuberculosis
ucgccgcggccg

SEQ ID NO: 2862516 - RNA, 18 nt, Mycobacterium avium subsp. paratuberculosis
ucgccgcgguagacaccg

SEQ ID NO: 2862517 - RNA, 13 nt, Mycobacterium avium subsp. paratuberculosis
ucgccgcggucau

SEQ ID NO: 2862518 - RNA, 21 nt, Mycobacterium avium subsp. paratuberculosis
ucgccgcggucaucgagccgg

SEQ ID NO: 2862519 - RNA, 15 nt, Mycobacterium avium subsp. paratuberculosis
ucgccgcgguggcgc

SEQ ID NO: 2862520 - RNA, 14 nt, Mycobacterium avium subsp. paratuberculosis
ucgccgcgguggug

SEQ ID NO: 2862521 - RNA, 20 nt, Mycobacterium avium subsp. paratuberculosis
ucgccgcucuucgacgaccc

SEQ ID NO: 2862522 - RNA, 21 nt, Mycobacterium avium subsp. paratuberculosis
ucgccgcuggugaacucgccg

SEQ ID NO: 2862523 - RNA, 23 nt, Mycobacterium avium subsp. paratuberculosis
ucgccgcuggugaacucgccgau

SEQ ID NO: 2862524 - RNA, 21 nt, Mycobacterium avium subsp. paratuberculosis
ucgccgcuugcagcuuggcgg

SEQ ID NO: 2862525 - RNA, 18 nt, Mycobacterium avium subsp. paratuberculosis
ucgccggaauggcaaggc

SEQ ID NO: 2862526 - RNA, 23 nt, Mycobacterium avium subsp. paratuberculosis
ucgccggaauggcaaggccagca

SEQ ID NO: 2862527 - RNA, 14 nt, Mycobacterium avium subsp. paratuberculosis
ucgccggacagccg

SEQ ID NO: 2862528 - RNA, 18 nt, Mycobacterium avium subsp. paratuberculosis
ucgccggacagccggggc

SEQ ID NO: 2862529 - RNA, 18 nt, Mycobacterium avium subsp. paratuberculosis
ucgccggacagcgggccg

SEQ ID NO: 2862530 - RNA, 21 nt, Mycobacterium avium subsp. paratuberculosis
ucgccggacagcgggccgacc

SEQ ID NO: 2862531 - RNA, 22 nt, Mycobacterium avium subsp. paratuberculosis
ucgccggacagcgggccgaccc

SEQ ID NO: 2862532 - RNA, 23 nt, Mycobacterium avium subsp. paratuberculosis
ucgccggacagcgggccgacccg

SEQ ID NO: 2862533 - RNA, 18 nt, Mycobacterium avium subsp. paratuberculosis
ucgccggagagcccgucg

SEQ ID NO: 2862534 - RNA, 20 nt, Mycobacterium avium subsp. paratuberculosis
ucgccggagcgccccagggc

SEQ ID NO: 2862535 - RNA, 16 nt, Mycobacterium avium subsp. paratuberculosis
ucgccggaggcgauca

SEQ ID NO: 2862536 - RNA, 16 nt, Mycobacterium avium subsp. paratuberculosis
ucgccggaucgagcac

SEQ ID NO: 2862537 - RNA, 18 nt, Mycobacterium avium subsp. paratuberculosis
ucgccggaucgagcaccc

SEQ ID NO: 2862538 - RNA, 13 nt, Mycobacterium avium subsp. paratuberculosis
ucgccggaucgcc

SEQ ID NO: 2862539 - RNA, 18 nt, Mycobacterium avium subsp. paratuberculosis
ucgccggaucgccgaggu

SEQ ID NO: 2862540 - RNA, 21 nt, Mycobacterium avium subsp. paratuberculosis
ucgccggaucggucucggugg

SEQ ID NO: 2862541 - RNA, 22 nt, Mycobacterium avium subsp. paratuberculosis
ucgccggauguguugcgcacca

SEQ ID NO: 2862542 - RNA, 16 nt, Mycobacterium avium subsp. paratuberculosis
ucgccggccagcacgc

SEQ ID NO: 2862543 - RNA, 17 nt, Mycobacterium avium subsp. paratuberculosis
ucgccggccagcacgcc

SEQ ID NO: 2862544 - RNA, 19 nt, Mycobacterium avium subsp. paratuberculosis
ucgccggccagcacgccgu

SEQ ID NO: 2862545 - RNA, 20 nt, Mycobacterium avium subsp. paratuberculosis
ucgccggccagcacgccguc

SEQ ID NO: 2862546 - RNA, 14 nt, Mycobacterium avium subsp. paratuberculosis
ucgccggcccgacc

SEQ ID NO: 2862547 - RNA, 18 nt, Mycobacterium avium subsp. paratuberculosis
ucgccggccgccagcgcc

SEQ ID NO: 2862548 - RNA, 15 nt, Mycobacterium avium subsp. paratuberculosis
ucgccggccgccgug

SEQ ID NO: 2862549 - RNA, 16 nt, Mycobacterium avium subsp. paratuberculosis
ucgccggccgcgggcg

SEQ ID NO: 2862550 - RNA, 14 nt, Mycobacterium avium subsp. paratuberculosis
ucgccggccgggcg

SEQ ID NO: 2862551 - RNA, 15 nt, Mycobacterium avium subsp. paratuberculosis
ucgccggccugcccg

SEQ ID NO: 2862552 - RNA, 21 nt, Mycobacterium avium subsp. paratuberculosis
ucgccggccugcccgccgcgg

SEQ ID NO: 2862553 - RNA, 13 nt, Mycobacterium avium subsp. paratuberculosis
ucgccggcgaccg

SEQ ID NO: 2862554 - RNA, 17 nt, Mycobacterium avium subsp. paratuberculosis
ucgccggcgaccgccac

SEQ ID NO: 2862555 - RNA, 23 nt, Mycobacterium avium subsp. paratuberculosis
ucgccggcgaccgugcccaccag

SEQ ID NO: 2862556 - RNA, 14 nt, Mycobacterium avium subsp. paratuberculosis
ucgccggcgacggc

SEQ ID NO: 2862557 - RNA, 23 nt, Mycobacterium avium subsp. paratuberculosis
ucgccggcgacggccagcgcggc

SEQ ID NO: 2862558 - RNA, 19 nt, Mycobacterium avium subsp. paratuberculosis
ucgccggcgaugcgcgccu

SEQ ID NO: 2862559 - RNA, 13 nt, Mycobacterium avium subsp. paratuberculosis
ucgccggcgccgg

SEQ ID NO: 2862560 - RNA, 15 nt, Mycobacterium avium subsp. paratuberculosis
ucgccggcgccggag

SEQ ID NO: 2862561 - RNA, 14 nt, Mycobacterium avium subsp. paratuberculosis
ucgccggcgccggg

SEQ ID NO: 2862562 - RNA, 15 nt, Mycobacterium avium subsp. paratuberculosis
ucgccggcgcgcagc

SEQ ID NO: 2862563 - RNA, 15 nt, Mycobacterium avium subsp. paratuberculosis
ucgccggcgcgcuga

SEQ ID NO: 2862564 - RNA, 17 nt, Mycobacterium avium subsp. paratuberculosis
ucgccggcgcgcugaag

SEQ ID NO: 2862565 - RNA, 15 nt, Mycobacterium avium subsp. paratuberculosis
ucgccggcgcggaac

SEQ ID NO: 2862566 - RNA, 18 nt, Mycobacterium avium subsp. paratuberculosis
ucgccggcgcgggccgca

SEQ ID NO: 2862567 - RNA, 20 nt, Mycobacterium avium subsp. paratuberculosis
ucgccggcgcgggccgcagc

SEQ ID NO: 2862568 - RNA, 12 nt, Mycobacterium avium subsp. paratuberculosis
ucgccggcggcc

SEQ ID NO: 2862569 - RNA, 17 nt, Mycobacterium avium subsp. paratuberculosis
ucgccggcggccgacag

SEQ ID NO: 2862570 - RNA, 14 nt, Mycobacterium avium subsp. paratuberculosis
ucgccggcggccgc

SEQ ID NO: 2862571 - RNA, 17 nt, Mycobacterium avium subsp. paratuberculosis
ucgccggcggccgccac

SEQ ID NO: 2862572 - RNA, 14 nt, Mycobacterium avium subsp. paratuberculosis
ucgccggcggcgau

SEQ ID NO: 2862573 - RNA, 19 nt, Mycobacterium avium subsp. paratuberculosis
ucgccggcggcgaucgccg

SEQ ID NO: 2862574 - RNA, 13 nt, Mycobacterium avium subsp. paratuberculosis
ucgccggcggcgc

SEQ ID NO: 2862575 - RNA, 14 nt, Mycobacterium avium subsp. paratuberculosis
ucgccggcggcgcc

SEQ ID NO: 2862576 - RNA, 12 nt, Mycobacterium avium subsp. paratuberculosis
ucgccggcgggg

SEQ ID NO: 2862577 - RNA, 22 nt, Mycobacterium avium subsp. paratuberculosis
ucgccggcggggcgucgcccgc

SEQ ID NO: 2862578 - RNA, 17 nt, Mycobacterium avium subsp. paratuberculosis
ucgccggcuaccggcgc

SEQ ID NO: 2862579 - RNA, 20 nt, Mycobacterium avium subsp. paratuberculosis
ucgccggcuuaccgaccucg

SEQ ID NO: 2862580 - RNA, 20 nt, Mycobacterium avium subsp. paratuberculosis
ucgccgggcgucacucuggc

SEQ ID NO: 2862581 - RNA, 14 nt, Mycobacterium avium subsp. paratuberculosis
ucgccgggcuggcc

SEQ ID NO: 2862582 - RNA, 18 nt, Mycobacterium avium subsp. paratuberculosis
ucgccgggcuggccgucg

SEQ ID NO: 2862583 - RNA, 22 nt, Mycobacterium avium subsp. paratuberculosis
ucgccgggcuggccgucggcga

SEQ ID NO: 2862584 - RNA, 23 nt, Mycobacterium avium subsp. paratuberculosis
ucgccgggcuggccgucggcgau

SEQ ID NO: 2862585 - RNA, 15 nt, Mycobacterium avium subsp. paratuberculosis
ucgccggggaacacc

SEQ ID NO: 2862586 - RNA, 18 nt, Mycobacterium avium subsp. paratuberculosis
ucgccggggaacaccggc

SEQ ID NO: 2862587 - RNA, 19 nt, Mycobacterium avium subsp. paratuberculosis
ucgccggggaacaccggcg

SEQ ID NO: 2862588 - RNA, 17 nt, Mycobacterium avium subsp. paratuberculosis
ucgccggggacgacggc

SEQ ID NO: 2862589 - RNA, 23 nt, Mycobacterium avium subsp. paratuberculosis
ucgccggggccuucuuggcggcg

SEQ ID NO: 2862590 - RNA, 19 nt, Mycobacterium avium subsp. paratuberculosis
ucgccgggucuuccacgcc

SEQ ID NO: 2862591 - RNA, 17 nt, Mycobacterium avium subsp. paratuberculosis
ucgccgguaccgccggc

SEQ ID NO: 2862592 - RNA, 20 nt, Mycobacterium avium subsp. paratuberculosis
ucgccgguaccgccggccag

SEQ ID NO: 2862593 - RNA, 18 nt, Mycobacterium avium subsp. paratuberculosis
ucgccuguccgaccagcg

SEQ ID NO: 2862594 - RNA, 14 nt, Mycobacterium avium subsp. paratuberculosis
ucgccuuguuggcc

SEQ ID NO: 2862595 - RNA, 16 nt, Mycobacterium avium subsp. paratuberculosis
ucgccuuugaugacga

SEQ ID NO: 2862596 - RNA, 17 nt, Mycobacterium avium subsp. paratuberculosis
ucgccuuugaugacgac

SEQ ID NO: 2862597 - RNA, 15 nt, Mycobacterium avium subsp. paratuberculosis
ucgcgaacuucaggc

SEQ ID NO: 2862598 - RNA, 18 nt, Mycobacterium avium subsp. paratuberculosis
ucgcgaagcgcgaugcgg

SEQ ID NO: 2862599 - RNA, 23 nt, Mycobacterium avium subsp. paratuberculosis
ucgcgaagcguaugccgguggcg

SEQ ID NO: 2862600 - RNA, 14 nt, Mycobacterium avium subsp. paratuberculosis
ucgcgaccaccggc

SEQ ID NO: 2862601 - RNA, 17 nt, Mycobacterium avium subsp. paratuberculosis
ucgcgaccaccggccga

SEQ ID NO: 2862602 - RNA, 12 nt, Mycobacterium avium subsp. paratuberculosis
ucgcgaccgccg

SEQ ID NO: 2862603 - RNA, 20 nt, Mycobacterium avium subsp. paratuberculosis
ucgcgaccgccggacaccac

SEQ ID NO: 2862604 - RNA, 21 nt, Mycobacterium avium subsp. paratuberculosis
ucgcgacgagcgggccgauca

SEQ ID NO: 2862605 - RNA, 22 nt, Mycobacterium avium subsp. paratuberculosis
ucgcgacgagcgggccgaucag

SEQ ID NO: 2862606 - RNA, 12 nt, Mycobacterium avium subsp. paratuberculosis
ucgcgacgcggc

SEQ ID NO: 2862607 - RNA, 16 nt, Mycobacterium avium subsp. paratuberculosis
ucgcgacgcggcucgc

SEQ ID NO: 2862608 - RNA, 14 nt, Mycobacterium avium subsp. paratuberculosis
ucgcgacggccggg

SEQ ID NO: 2862609 - RNA, 13 nt, Mycobacterium avium subsp. paratuberculosis
ucgcgagcgcgcu

SEQ ID NO: 2862610 - RNA, 14 nt, Mycobacterium avium subsp. paratuberculosis
ucgcgagggcgggc

SEQ ID NO: 2862611 - RNA, 19 nt, Mycobacterium avium subsp. paratuberculosis
ucgcgagggcgggccagcu

SEQ ID NO: 2862612 - RNA, 15 nt, Mycobacterium avium subsp. paratuberculosis
ucgcgaucacaccac

SEQ ID NO: 2862613 - RNA, 17 nt, Mycobacterium avium subsp. paratuberculosis
ucgcgaucacaccacca

SEQ ID NO: 2862614 - RNA, 24 nt, Mycobacterium avium subsp. paratuberculosis
ucgcgaucacaccaccacgcgauc

SEQ ID NO: 2862615 - RNA, 18 nt, Mycobacterium avium subsp. paratuberculosis
ucgcgaucaccgcggcca

SEQ ID NO: 2862616 - RNA, 14 nt, Mycobacterium avium subsp. paratuberculosis
ucgcgauccgggcg

SEQ ID NO: 2862617 - RNA, 15 nt, Mycobacterium avium subsp. paratuberculosis
ucgcgauccgggcgc

SEQ ID NO: 2862618 - RNA, 16 nt, Mycobacterium avium subsp. paratuberculosis
ucgcgauccgggcgcc

SEQ ID NO: 2862619 - RNA, 14 nt, Mycobacterium avium subsp. paratuberculosis
ucgcgaucgaggau

SEQ ID NO: 2862620 - RNA, 23 nt, Mycobacterium avium subsp. paratuberculosis
ucgcgaucgccgauccggcgccg

SEQ ID NO: 2862621 - RNA, 14 nt, Mycobacterium avium subsp. paratuberculosis
ucgcgaucgcgguc

SEQ ID NO: 2862622 - RNA, 20 nt, Mycobacterium avium subsp. paratuberculosis
ucgcgaugcccaagccggcc

SEQ ID NO: 2862623 - RNA, 21 nt, Mycobacterium avium subsp. paratuberculosis
ucgcgaugcccaagccggcca

SEQ ID NO: 2862624 - RNA, 22 nt, Mycobacterium avium subsp. paratuberculosis
ucgcgaugcccaagccggccag

SEQ ID NO: 2862625 - RNA, 13 nt, Mycobacterium avium subsp. paratuberculosis
ucgcgauggcggg

SEQ ID NO: 2862626 - RNA, 16 nt, Mycobacterium avium subsp. paratuberculosis
ucgcgcaacugggugg

SEQ ID NO: 2862627 - RNA, 20 nt, Mycobacterium avium subsp. paratuberculosis
ucgcgcaaugccgccgcgac

SEQ ID NO: 2862628 - RNA, 21 nt, Mycobacterium avium subsp. paratuberculosis
ucgcgcaaugccgccgcgacg

SEQ ID NO: 2862629 - RNA, 12 nt, Mycobacterium avium subsp. paratuberculosis
ucgcgcaccacc

SEQ ID NO: 2862630 - RNA, 14 nt, Mycobacterium avium subsp. paratuberculosis
ucgcgcaccaccuc

SEQ ID NO: 2862631 - RNA, 15 nt, Mycobacterium avium subsp. paratuberculosis
ucgcgcaccaccucg

SEQ ID NO: 2862632 - RNA, 17 nt, Mycobacterium avium subsp. paratuberculosis
ucgcgcaccaccucggc

SEQ ID NO: 2862633 - RNA, 23 nt, Mycobacterium avium subsp. paratuberculosis
ucgcgcaccaccucggcgaucug

SEQ ID NO: 2862634 - RNA, 15 nt, Mycobacterium avium subsp. paratuberculosis
ucgcgcaccagcucg

SEQ ID NO: 2862635 - RNA, 21 nt, Mycobacterium avium subsp. paratuberculosis
ucgcgcaccagcucgaggccg

SEQ ID NO: 2862636 - RNA, 19 nt, Mycobacterium avium subsp. paratuberculosis
ucgcgcaccagggccugca

SEQ ID NO: 2862637 - RNA, 23 nt, Mycobacterium avium subsp. paratuberculosis
ucgcgcaccagggccugcagcac

SEQ ID NO: 2862638 - RNA, 14 nt, Mycobacterium avium subsp. paratuberculosis
ucgcgcaccauccg

SEQ ID NO: 2862639 - RNA, 23 nt, Mycobacterium avium subsp. paratuberculosis
ucgcgcaccauccgcgacgccag

SEQ ID NO: 2862640 - RNA, 24 nt, Mycobacterium avium subsp. paratuberculosis
ucgcgcaccauccgcgacgccagc

SEQ ID NO: 2862641 - RNA, 16 nt, Mycobacterium avium subsp. paratuberculosis
ucgcgcacccagccgc

SEQ ID NO: 2862642 - RNA, 17 nt, Mycobacterium avium subsp. paratuberculosis
ucgcgcacccagccgca

SEQ ID NO: 2862643 - RNA, 17 nt, Mycobacterium avium subsp. paratuberculosis
ucgcgcacccgcacgug

SEQ ID NO: 2862644 - RNA, 15 nt, Mycobacterium avium subsp. paratuberculosis
ucgcgcaccgcggcg

SEQ ID NO: 2862645 - RNA, 16 nt, Mycobacterium avium subsp. paratuberculosis
ucgcgcaccgcggcgg

SEQ ID NO: 2862646 - RNA, 12 nt, Mycobacterium avium subsp. paratuberculosis
ucgcgcaccggc

SEQ ID NO: 2862647 - RNA, 14 nt, Mycobacterium avium subsp. paratuberculosis
ucgcgcaccgggac

SEQ ID NO: 2862648 - RNA, 16 nt, Mycobacterium avium subsp. paratuberculosis
ucgcgcaccgggacca

SEQ ID NO: 2862649 - RNA, 17 nt, Mycobacterium avium subsp. paratuberculosis
ucgcgcaccuggucggu

SEQ ID NO: 2862650 - RNA, 21 nt, Mycobacterium avium subsp. paratuberculosis
ucgcgcaccuggucggucagc

SEQ ID NO: 2862651 - RNA, 18 nt, Mycobacterium avium subsp. paratuberculosis
ucgcgcaccuucccggcc

SEQ ID NO: 2862652 - RNA, 19 nt, Mycobacterium avium subsp. paratuberculosis
ucgcgcaccuucccggccg

SEQ ID NO: 2862653 - RNA, 21 nt, Mycobacterium avium subsp. paratuberculosis
ucgcgcaccuucccggccgcc

SEQ ID NO: 2862654 - RNA, 19 nt, Mycobacterium avium subsp. paratuberculosis
ucgcgcacgccaucgccuc

SEQ ID NO: 2862655 - RNA, 16 nt, Mycobacterium avium subsp. paratuberculosis
ucgcgcacgcuggccg

SEQ ID NO: 2862656 - RNA, 18 nt, Mycobacterium avium subsp. paratuberculosis
ucgcgcacgcuggccggc

SEQ ID NO: 2862657 - RNA, 20 nt, Mycobacterium avium subsp. paratuberculosis
ucgcgcacgcuggccggcag

SEQ ID NO: 2862658 - RNA, 22 nt, Mycobacterium avium subsp. paratuberculosis
ucgcgcacgcuggccggcagcg

SEQ ID NO: 2862659 - RNA, 15 nt, Mycobacterium avium subsp. paratuberculosis
ucgcgcacggcgcgc

SEQ ID NO: 2862660 - RNA, 16 nt, Mycobacterium avium subsp. paratuberculosis
ucgcgcacggcgcgca

SEQ ID NO: 2862661 - RNA, 18 nt, Mycobacterium avium subsp. paratuberculosis
ucgcgcacuucgcgggcg

SEQ ID NO: 2862662 - RNA, 14 nt, Mycobacterium avium subsp. paratuberculosis
ucgcgcagcaccga

SEQ ID NO: 2862663 - RNA, 15 nt, Mycobacterium avium subsp. paratuberculosis
ucgcgcagcaccgau

SEQ ID NO: 2862664 - RNA, 22 nt, Mycobacterium avium subsp. paratuberculosis
ucgcgcagcaccgaugccagac

SEQ ID NO: 2862665 - RNA, 21 nt, Mycobacterium avium subsp. paratuberculosis
ucgcgcagcacgaugaucccg

SEQ ID NO: 2862666 - RNA, 13 nt, Mycobacterium avium subsp. paratuberculosis
ucgcgcagcagcg

SEQ ID NO: 2862667 - RNA, 21 nt, Mycobacterium avium subsp. paratuberculosis
ucgcgcagcagcugcacccgc

SEQ ID NO: 2862668 - RNA, 23 nt, Mycobacterium avium subsp. paratuberculosis
ucgcgcagcauggcccacaggac

SEQ ID NO: 2862669 - RNA, 15 nt, Mycobacterium avium subsp. paratuberculosis
ucgcgcagccaccgc

SEQ ID NO: 2862670 - RNA, 19 nt, Mycobacterium avium subsp. paratuberculosis
ucgcgcagcccccggacca

SEQ ID NO: 2862671 - RNA, 12 nt, Mycobacterium avium subsp. paratuberculosis
ucgcgcagccgc

SEQ ID NO: 2862672 - RNA, 14 nt, Mycobacterium avium subsp. paratuberculosis
ucgcgcagccgccg

SEQ ID NO: 2862673 - RNA, 17 nt, Mycobacterium avium subsp. paratuberculosis
ucgcgcagccgccgggc

SEQ ID NO: 2862674 - RNA, 13 nt, Mycobacterium avium subsp. paratuberculosis
ucgcgcagccgcg

SEQ ID NO: 2862675 - RNA, 19 nt, Mycobacterium avium subsp. paratuberculosis
ucgcgcagccgcgguggcg

SEQ ID NO: 2862676 - RNA, 17 nt, Mycobacterium avium subsp. paratuberculosis
ucgcgcagccggccgac

SEQ ID NO: 2862677 - RNA, 19 nt, Mycobacterium avium subsp. paratuberculosis
ucgcgcagccggccgaccg

SEQ ID NO: 2862678 - RNA, 19 nt, Mycobacterium avium subsp. paratuberculosis
ucgcgcucccggcgccgcc

SEQ ID NO: 2862679 - RNA, 18 nt, Mycobacterium avium subsp. paratuberculosis
ucgcgcucgacgaugucg

SEQ ID NO: 2862680 - RNA, 21 nt, Mycobacterium avium subsp. paratuberculosis
ucgcgcucuugggcggccggc

SEQ ID NO: 2862681 - RNA, 15 nt, Mycobacterium avium subsp. paratuberculosis
ucgcgcugaccaggc

SEQ ID NO: 2862682 - RNA, 16 nt, Mycobacterium avium subsp. paratuberculosis
ucgcgcugaccaggcc

SEQ ID NO: 2862683 - RNA, 17 nt, Mycobacterium avium subsp. paratuberculosis
ucgcgcugcaugccggu

SEQ ID NO: 2862684 - RNA, 19 nt, Mycobacterium avium subsp. paratuberculosis
ucgcgcugccgcgcgccga

SEQ ID NO: 2862685 - RNA, 20 nt, Mycobacterium avium subsp. paratuberculosis
ucgcgcugcgggaagccgag

SEQ ID NO: 2862686 - RNA, 21 nt, Mycobacterium avium subsp. paratuberculosis
ucgcgcuggcggccaucgccg

SEQ ID NO: 2862687 - RNA, 16 nt, Mycobacterium avium subsp. paratuberculosis
ucgcggaacagccggc

SEQ ID NO: 2862688 - RNA, 16 nt, Mycobacterium avium subsp. paratuberculosis
ucgcggaaccgcuuga

SEQ ID NO: 2862689 - RNA, 13 nt, Mycobacterium avium subsp. paratuberculosis
ucgcggaaccggc

SEQ ID NO: 2862690 - RNA, 16 nt, Mycobacterium avium subsp. paratuberculosis
ucgcggaaccggccgg

SEQ ID NO: 2862691 - RNA, 17 nt, Mycobacterium avium subsp. paratuberculosis
ucgcggaaccggccggg

SEQ ID NO: 2862692 - RNA, 20 nt, Mycobacterium avium subsp. paratuberculosis
ucgcggaaccguugcagcac

SEQ ID NO: 2862693 - RNA, 21 nt, Mycobacterium avium subsp. paratuberculosis
ucgcggacccuggccagcacc

SEQ ID NO: 2862694 - RNA, 21 nt, Mycobacterium avium subsp. paratuberculosis
ucgcggacuggugggcgucgu

SEQ ID NO: 2862695 - RNA, 15 nt, Mycobacterium avium subsp. paratuberculosis
ucgcggagcggguca

SEQ ID NO: 2862696 - RNA, 16 nt, Mycobacterium avium subsp. paratuberculosis
ucgcggaggaugccgg

SEQ ID NO: 2862697 - RNA, 20 nt, Mycobacterium avium subsp. paratuberculosis
ucgcggaggaugccggccag

SEQ ID NO: 2862698 - RNA, 21 nt, Mycobacterium avium subsp. paratuberculosis
ucgcggaggaugccggccagc

SEQ ID NO: 2862699 - RNA, 22 nt, Mycobacterium avium subsp. paratuberculosis
ucgcggaggaugccggccagcu

SEQ ID NO: 2862700 - RNA, 22 nt, Mycobacterium avium subsp. paratuberculosis
ucgcggauacgcccggccaccu

SEQ ID NO: 2862701 - RNA, 12 nt, Mycobacterium avium subsp. paratuberculosis
ucgcggauccgc

SEQ ID NO: 2862702 - RNA, 14 nt, Mycobacterium avium subsp. paratuberculosis
ucgcggauccgggc

SEQ ID NO: 2862703 - RNA, 18 nt, Mycobacterium avium subsp. paratuberculosis
ucgcggauccgggccggc

SEQ ID NO: 2862704 - RNA, 19 nt, Mycobacterium avium subsp. paratuberculosis
ucgcggaucgaacagggcg

SEQ ID NO: 2862705 - RNA, 15 nt, Mycobacterium avium subsp. paratuberculosis
ucgcggaucucgucg

SEQ ID NO: 2862706 - RNA, 16 nt, Mycobacterium avium subsp. paratuberculosis
ucgcggaucucgucgg

SEQ ID NO: 2862707 - RNA, 20 nt, Mycobacterium avium subsp. paratuberculosis
ucgcggaugcgggcgcugcc

SEQ ID NO: 2862708 - RNA, 17 nt, Mycobacterium avium subsp. paratuberculosis
ucgcggauguccgaccg

SEQ ID NO: 2862709 - RNA, 20 nt, Mycobacterium avium subsp. paratuberculosis
ucgcggauguccgaccgguu

SEQ ID NO: 2862710 - RNA, 21 nt, Mycobacterium avium subsp. paratuberculosis
ucgcggauguccgaccgguug

SEQ ID NO: 2862711 - RNA, 22 nt, Mycobacterium avium subsp. paratuberculosis
ucgcggcaaagggcuaggugac

SEQ ID NO: 2862712 - RNA, 13 nt, Mycobacterium avium subsp. paratuberculosis
ucgcggcaggcga

SEQ ID NO: 2862713 - RNA, 14 nt, Mycobacterium avium subsp. paratuberculosis
ucgcggcaggcgac

SEQ ID NO: 2862714 - RNA, 17 nt, Mycobacterium avium subsp. paratuberculosis
ucgcggcaucccuggug

SEQ ID NO: 2862715 - RNA, 19 nt, Mycobacterium avium subsp. paratuberculosis
ucgcggcaucccuggugac

SEQ ID NO: 2862716 - RNA, 15 nt, Mycobacterium avium subsp. paratuberculosis
ucgcggccaccacga

SEQ ID NO: 2862717 - RNA, 20 nt, Mycobacterium avium subsp. paratuberculosis
ucgcggccaccacgacgccg

SEQ ID NO: 2862718 - RNA, 15 nt, Mycobacterium avium subsp. paratuberculosis
ucgcggccacgcccu

SEQ ID NO: 2862719 - RNA, 16 nt, Mycobacterium avium subsp. paratuberculosis
ucgcggccacgcccug

SEQ ID NO: 2862720 - RNA, 18 nt, Mycobacterium avium subsp. paratuberculosis
ucgcggccacgcccuggc

SEQ ID NO: 2862721 - RNA, 22 nt, Mycobacterium avium subsp. paratuberculosis
ucgcggccacgcccuggccgcc

SEQ ID NO: 2862722 - RNA, 12 nt, Mycobacterium avium subsp. paratuberculosis
ucgcggccagcg

SEQ ID NO: 2862723 - RNA, 20 nt, Mycobacterium avium subsp. paratuberculosis
ucgcggccagcgugaacacc

SEQ ID NO: 2862724 - RNA, 21 nt, Mycobacterium avium subsp. paratuberculosis
ucgcggcccacccgcagggcg

SEQ ID NO: 2862725 - RNA, 15 nt, Mycobacterium avium subsp. paratuberculosis
ucgcggcccaccgcg

SEQ ID NO: 2862726 - RNA, 17 nt, Mycobacterium avium subsp. paratuberculosis
ucgcggcccaccgcguc

SEQ ID NO: 2862727 - RNA, 15 nt, Mycobacterium avium subsp. paratuberculosis
ucgcggcccagcacc

SEQ ID NO: 2862728 - RNA, 12 nt, Mycobacterium avium subsp. paratuberculosis
ucgcggcccgcc

SEQ ID NO: 2862729 - RNA, 20 nt, Mycobacterium avium subsp. paratuberculosis
ucgcggcccuggaugucacg

SEQ ID NO: 2862730 - RNA, 18 nt, Mycobacterium avium subsp. paratuberculosis
ucgcggccggcgagucgc

SEQ ID NO: 2862731 - RNA, 20 nt, Mycobacterium avium subsp. paratuberculosis
ucgcggccggcgagucgcgg

SEQ ID NO: 2862732 - RNA, 23 nt, Mycobacterium avium subsp. paratuberculosis
ucgcggccggcgagucgcggauc

SEQ ID NO: 2862733 - RNA, 15 nt, Mycobacterium avium subsp. paratuberculosis
ucgcggccguagccg

SEQ ID NO: 2862734 - RNA, 17 nt, Mycobacterium avium subsp. paratuberculosis
ucgcggccuccgagcgg

SEQ ID NO: 2862735 - RNA, 24 nt, Mycobacterium avium subsp. paratuberculosis
ucgcggccuccgagcggcgcaggc

SEQ ID NO: 2862736 - RNA, 17 nt, Mycobacterium avium subsp. paratuberculosis
ucgcggccugcgggcgc

SEQ ID NO: 2862737 - RNA, 20 nt, Mycobacterium avium subsp. paratuberculosis
ucgcggccugcgggcgccgg

SEQ ID NO: 2862738 - RNA, 21 nt, Mycobacterium avium subsp. paratuberculosis
ucgcggccugcgggcgccggc

SEQ ID NO: 2862739 - RNA, 15 nt, Mycobacterium avium subsp. paratuberculosis
ucgcggcgaaccagc

SEQ ID NO: 2862740 - RNA, 14 nt, Mycobacterium avium subsp. paratuberculosis
ucgcggcgacccgc

SEQ ID NO: 2862741 - RNA, 15 nt, Mycobacterium avium subsp. paratuberculosis
ucgcggcgacccgcu

SEQ ID NO: 2862742 - RNA, 14 nt, Mycobacterium avium subsp. paratuberculosis
ucgcggcgagcagc

SEQ ID NO: 2862743 - RNA, 15 nt, Mycobacterium avium subsp. paratuberculosis
ucgcggcgagcagcg

SEQ ID NO: 2862744 - RNA, 19 nt, Mycobacterium avium subsp. paratuberculosis
ucgcggcgagcucaacagc

SEQ ID NO: 2862745 - RNA, 18 nt, Mycobacterium avium subsp. paratuberculosis
ucgcggcgaucagcccgg

SEQ ID NO: 2862746 - RNA, 18 nt, Mycobacterium avium subsp. paratuberculosis
ucgcggcgaucgcgagca

SEQ ID NO: 2862747 - RNA, 13 nt, Mycobacterium avium subsp. paratuberculosis
ucgcggcgaucgg

SEQ ID NO: 2862748 - RNA, 23 nt, Mycobacterium avium subsp. paratuberculosis
ucgcggcgauggacguccagcgg

SEQ ID NO: 2862749 - RNA, 19 nt, Mycobacterium avium subsp. paratuberculosis
ucgcggcgcacccgggcag

SEQ ID NO: 2862750 - RNA, 13 nt, Mycobacterium avium subsp. paratuberculosis
ucgcggcgcacgg

SEQ ID NO: 2862751 - RNA, 13 nt, Mycobacterium avium subsp. paratuberculosis
ucgcggcgcacgu

SEQ ID NO: 2862752 - RNA, 14 nt, Mycobacterium avium subsp. paratuberculosis
ucgcggcgcagcac

SEQ ID NO: 2862753 - RNA, 14 nt, Mycobacterium avium subsp. paratuberculosis
ucgcggcgcagcuc

SEQ ID NO: 2862754 - RNA, 14 nt, Mycobacterium avium subsp. paratuberculosis
ucgcggcgccgguu

SEQ ID NO: 2862755 - RNA, 19 nt, Mycobacterium avium subsp. paratuberculosis
ucgcggcgcggaccccagu

SEQ ID NO: 2862756 - RNA, 22 nt, Mycobacterium avium subsp. paratuberculosis
ucgcggcgcuaaagccaccagc

SEQ ID NO: 2862757 - RNA, 13 nt, Mycobacterium avium subsp. paratuberculosis
ucgcggcgcugcc

SEQ ID NO: 2862758 - RNA, 20 nt, Mycobacterium avium subsp. paratuberculosis
ucgcggcggccgacgcgccg

SEQ ID NO: 2862759 - RNA, 14 nt, Mycobacterium avium subsp. paratuberculosis
ucgcggcggccggc

SEQ ID NO: 2862760 - RNA, 13 nt, Mycobacterium avium subsp. paratuberculosis
ucgcggcggcgcc

SEQ ID NO: 2862761 - RNA, 13 nt, Mycobacterium avium subsp. paratuberculosis
ucgcggcggcgcu

SEQ ID NO: 2862762 - RNA, 17 nt, Mycobacterium avium subsp. paratuberculosis
ucgcggcggcgcugguc

SEQ ID NO: 2862763 - RNA, 19 nt, Mycobacterium avium subsp. paratuberculosis
ucgcggugggcgcgggccg

SEQ ID NO: 2862764 - RNA, 22 nt, Mycobacterium avium subsp. paratuberculosis
ucgcggugggcucggcgccgac

SEQ ID NO: 2862765 - RNA, 14 nt, Mycobacterium avium subsp. paratuberculosis
ucgcggugucggcg

SEQ ID NO: 2862766 - RNA, 15 nt, Mycobacterium avium subsp. paratuberculosis
ucgcgguugcgggug

SEQ ID NO: 2862767 - RNA, 21 nt, Mycobacterium avium subsp. paratuberculosis
ucgcgguugcggguggcggcc

SEQ ID NO: 2862768 - RNA, 18 nt, Mycobacterium avium subsp. paratuberculosis
ucgcgguugggccgccgg

SEQ ID NO: 2862769 - RNA, 18 nt, Mycobacterium avium subsp. paratuberculosis
ucgcgguugggccggcgc

SEQ ID NO: 2862770 - RNA, 14 nt, Mycobacterium avium subsp. paratuberculosis
ucgcguagcgaggu

SEQ ID NO: 2862771 - RNA, 15 nt, Mycobacterium avium subsp. paratuberculosis
ucgcguagcgaggug

SEQ ID NO: 2862772 - RNA, 19 nt, Mycobacterium avium subsp. paratuberculosis
ucgcguagcgaggugugag

SEQ ID NO: 2862773 - RNA, 21 nt, Mycobacterium avium subsp. paratuberculosis
ucgcguaguccagcacggcga

SEQ ID NO: 2862774 - RNA, 15 nt, Mycobacterium avium subsp. paratuberculosis
ucgcgucaaccaccg

SEQ ID NO: 2862775 - RNA, 17 nt, Mycobacterium avium subsp. paratuberculosis
ucgcgucaaccaccggc

SEQ ID NO: 2862776 - RNA, 16 nt, Mycobacterium avium subsp. paratuberculosis
ucgcguccccgcgccg

SEQ ID NO: 2862777 - RNA, 20 nt, Mycobacterium avium subsp. paratuberculosis
ucgcguccccgcgccgggca

SEQ ID NO: 2862778 - RNA, 22 nt, Mycobacterium avium subsp. paratuberculosis
ucgcguccccgcgccgggcaau

SEQ ID NO: 2862779 - RNA, 14 nt, Mycobacterium avium subsp. paratuberculosis
ucgcguccgcgauc

SEQ ID NO: 2862780 - RNA, 13 nt, Mycobacterium avium subsp. paratuberculosis
ucgcgucgacgau

SEQ ID NO: 2862781 - RNA, 15 nt, Mycobacterium avium subsp. paratuberculosis
ucgcgucgacggcgc

SEQ ID NO: 2862782 - RNA, 18 nt, Mycobacterium avium subsp. paratuberculosis
ucgcgucgacggcgccgg

SEQ ID NO: 2862783 - RNA, 14 nt, Mycobacterium avium subsp. paratuberculosis
ucgcgucgacgucg

SEQ ID NO: 2862784 - RNA, 15 nt, Mycobacterium avium subsp. paratuberculosis
ucgcgucgacgucgg

SEQ ID NO: 2862785 - RNA, 13 nt, Mycobacterium avium subsp. paratuberculosis
ucgcgucgguguc

SEQ ID NO: 2862786 - RNA, 16 nt, Mycobacterium avium subsp. paratuberculosis
ucgcgucgucggcggg

SEQ ID NO: 2862787 - RNA, 18 nt, Mycobacterium avium subsp. paratuberculosis
ucgcgucgugcggccggc

SEQ ID NO: 2862788 - RNA, 23 nt, Mycobacterium avium subsp. paratuberculosis
ucgcgucgugcggccggcgccgg

SEQ ID NO: 2862789 - RNA, 15 nt, Mycobacterium avium subsp. paratuberculosis
ucgcgugaccggcgg

SEQ ID NO: 2862790 - RNA, 16 nt, Mycobacterium avium subsp. paratuberculosis
ucgcgugcgucacgcu

SEQ ID NO: 2862791 - RNA, 15 nt, Mycobacterium avium subsp. paratuberculosis
ucgcgugcuuuugcg

SEQ ID NO: 2862792 - RNA, 16 nt, Mycobacterium avium subsp. paratuberculosis
ucgcgugugcccagca

SEQ ID NO: 2862793 - RNA, 22 nt, Mycobacterium avium subsp. paratuberculosis
ucgcguucccgggcccgcugca

SEQ ID NO: 2862794 - RNA, 17 nt, Mycobacterium avium subsp. paratuberculosis
ucgcguuccgccacggc

SEQ ID NO: 2862795 - RNA, 17 nt, Mycobacterium avium subsp. paratuberculosis
ucgcguucgcucucgcg

SEQ ID NO: 2862796 - RNA, 15 nt, Mycobacterium avium subsp. paratuberculosis
ucgcguucgggcagc

SEQ ID NO: 2862797 - RNA, 17 nt, Mycobacterium avium subsp. paratuberculosis
ucgcguucgggcagcgc

SEQ ID NO: 2862798 - RNA, 18 nt, Mycobacterium avium subsp. paratuberculosis
ucgcguucgggcagcgcc

SEQ ID NO: 2862799 - RNA, 15 nt, Mycobacterium avium subsp. paratuberculosis
ucgcguucugcacca

SEQ ID NO: 2862800 - RNA, 18 nt, Mycobacterium avium subsp. paratuberculosis
ucgcguucugcaccagcu

SEQ ID NO: 2862801 - RNA, 17 nt, Mycobacterium avium subsp. paratuberculosis
ucgcguugaaagccgcg

SEQ ID NO: 2862802 - RNA, 18 nt, Mycobacterium avium subsp. paratuberculosis
ucgcguugagcgucgcca

SEQ ID NO: 2862803 - RNA, 22 nt, Mycobacterium avium subsp. paratuberculosis
ucgcguugagcgucgccaccac

SEQ ID NO: 2862804 - RNA, 16 nt, Mycobacterium avium subsp. paratuberculosis
ucgcuaaucgccgcgc

SEQ ID NO: 2862805 - RNA, 16 nt, Mycobacterium avium subsp. paratuberculosis
ucgcuauaucgcaccg

SEQ ID NO: 2862806 - RNA, 21 nt, Mycobacterium avium subsp. paratuberculosis
ucgcucaacggcuccagguag

SEQ ID NO: 2862807 - RNA, 16 nt, Mycobacterium avium subsp. paratuberculosis
ucgcucaucgugaucg

SEQ ID NO: 2862808 - RNA, 21 nt, Mycobacterium avium subsp. paratuberculosis
ucgcucauguugugcaggcag

SEQ ID NO: 2862809 - RNA, 19 nt, Mycobacterium avium subsp. paratuberculosis
ucgcuccacaucugccggc

SEQ ID NO: 2862810 - RNA, 12 nt, Mycobacterium avium subsp. paratuberculosis
ucgcucggcggc

SEQ ID NO: 2862811 - RNA, 13 nt, Mycobacterium avium subsp. paratuberculosis
ucgcucggcggcg

SEQ ID NO: 2862812 - RNA, 23 nt, Mycobacterium avium subsp. paratuberculosis
ucgcucgucggcgcgggccagca

SEQ ID NO: 2862813 - RNA, 23 nt, Mycobacterium avium subsp. paratuberculosis
ucgcucuucucguucugcgugcg

SEQ ID NO: 2862814 - RNA, 16 nt, Mycobacterium avium subsp. paratuberculosis
ucgcugaacgcgucgu

SEQ ID NO: 2862815 - RNA, 18 nt, Mycobacterium avium subsp. paratuberculosis
ucgcugaccccgcucggc

SEQ ID NO: 2862816 - RNA, 19 nt, Mycobacterium avium subsp. paratuberculosis
ucgcugaccccgcucggcg

SEQ ID NO: 2862817 - RNA, 12 nt, Mycobacterium avium subsp. paratuberculosis
ucgcugacccgg

SEQ ID NO: 2862818 - RNA, 15 nt, Mycobacterium avium subsp. paratuberculosis
ucgcugacccgggcg

SEQ ID NO: 2862819 - RNA, 16 nt, Mycobacterium avium subsp. paratuberculosis
ucgcugacccgggcgg

SEQ ID NO: 2862820 - RNA, 14 nt, Mycobacterium avium subsp. paratuberculosis
ucgcugaccgccau

SEQ ID NO: 2862821 - RNA, 12 nt, Mycobacterium avium subsp. paratuberculosis
ucgcugaccuuc

SEQ ID NO: 2862822 - RNA, 22 nt, Mycobacterium avium subsp. paratuberculosis
ucgcugaccuucuuggucagcg

SEQ ID NO: 2862823 - RNA, 20 nt, Mycobacterium avium subsp. paratuberculosis
ucgcugacgccgagcagcuc

SEQ ID NO: 2862824 - RNA, 13 nt, Mycobacterium avium subsp. paratuberculosis
ucgcugacuccau

SEQ ID NO: 2862825 - RNA, 20 nt, Mycobacterium avium subsp. paratuberculosis
ucgcugagcgggacgcgcag

SEQ ID NO: 2862826 - RNA, 20 nt, Mycobacterium avium subsp. paratuberculosis
ucgcugaucgcgauccgggc

SEQ ID NO: 2862827 - RNA, 16 nt, Mycobacterium avium subsp. paratuberculosis
ucgcugaucucgacgg

SEQ ID NO: 2862828 - RNA, 19 nt, Mycobacterium avium subsp. paratuberculosis
ucgcugaucugcggcacca

SEQ ID NO: 2862829 - RNA, 23 nt, Mycobacterium avium subsp. paratuberculosis
ucgcugcagcauuuccgagcgac

SEQ ID NO: 2862830 - RNA, 15 nt, Mycobacterium avium subsp. paratuberculosis
ucgcugcagcggcgg

SEQ ID NO: 2862831 - RNA, 21 nt, Mycobacterium avium subsp. paratuberculosis
ucgcugcaguagccggccagc

SEQ ID NO: 2862832 - RNA, 21 nt, Mycobacterium avium subsp. paratuberculosis
ucgcugccacguacaccggga

SEQ ID NO: 2862833 - RNA, 17 nt, Mycobacterium avium subsp. paratuberculosis
ucgcugccccggcgagg

SEQ ID NO: 2862834 - RNA, 23 nt, Mycobacterium avium subsp. paratuberculosis
ucgcugccccggcgaggccaggc

SEQ ID NO: 2862835 - RNA, 20 nt, Mycobacterium avium subsp. paratuberculosis
ucgcugcccucggucgccga

SEQ ID NO: 2862836 - RNA, 23 nt, Mycobacterium avium subsp. paratuberculosis
ucgcugcccucggucgccgaauc

SEQ ID NO: 2862837 - RNA, 19 nt, Mycobacterium avium subsp. paratuberculosis
ucgcugccgcccccgcugg

SEQ ID NO: 2862838 - RNA, 12 nt, Mycobacterium avium subsp. paratuberculosis
ucgcugccgccg

SEQ ID NO: 2862839 - RNA, 13 nt, Mycobacterium avium subsp. paratuberculosis
ucgcugccgccgc

SEQ ID NO: 2862840 - RNA, 14 nt, Mycobacterium avium subsp. paratuberculosis
ucgcugccggccgg

SEQ ID NO: 2862841 - RNA, 13 nt, Mycobacterium avium subsp. paratuberculosis
ucgcugccgucca

SEQ ID NO: 2862842 - RNA, 19 nt, Mycobacterium avium subsp. paratuberculosis
ucgcugccguccacccggc

SEQ ID NO: 2862843 - RNA, 17 nt, Mycobacterium avium subsp. paratuberculosis
ucgcugcgagcccggcc

SEQ ID NO: 2862844 - RNA, 19 nt, Mycobacterium avium subsp. paratuberculosis
ucgcugcgagcccggccag

SEQ ID NO: 2862845 - RNA, 22 nt, Mycobacterium avium subsp. paratuberculosis
ucgcugcgagcccggccagucc

SEQ ID NO: 2862846 - RNA, 16 nt, Mycobacterium avium subsp. paratuberculosis
ucgcugcgaggcgggc

SEQ ID NO: 2862847 - RNA, 20 nt, Mycobacterium avium subsp. paratuberculosis
ucgcugcgauugguggcccg

SEQ ID NO: 2862848 - RNA, 17 nt, Mycobacterium avium subsp. paratuberculosis
ucggcacaccagguagg

SEQ ID NO: 2862849 - RNA, 17 nt, Mycobacterium avium subsp. paratuberculosis
ucggcacacgcggacag

SEQ ID NO: 2862850 - RNA, 15 nt, Mycobacterium avium subsp. paratuberculosis
ucggcaccagcggca

SEQ ID NO: 2862851 - RNA, 15 nt, Mycobacterium avium subsp. paratuberculosis
ucggcacccgcaaca

SEQ ID NO: 2862852 - RNA, 22 nt, Mycobacterium avium subsp. paratuberculosis
ucggcacccgcaacaccacguc

SEQ ID NO: 2862853 - RNA, 16 nt, Mycobacterium avium subsp. paratuberculosis
ucggcaccgugccgcg

SEQ ID NO: 2862854 - RNA, 23 nt, Mycobacterium avium subsp. paratuberculosis
ucggcaccgugccgcgcggcggu

SEQ ID NO: 2862855 - RNA, 15 nt, Mycobacterium avium subsp. paratuberculosis
ucggcacgaagccga

SEQ ID NO: 2862856 - RNA, 20 nt, Mycobacterium avium subsp. paratuberculosis
ucggcacgccggggcccucg

SEQ ID NO: 2862857 - RNA, 22 nt, Mycobacterium avium subsp. paratuberculosis
ucggcacguguccgacgccguc

SEQ ID NO: 2862858 - RNA, 17 nt, Mycobacterium avium subsp. paratuberculosis
ucggcacugcccgcauc

SEQ ID NO: 2862859 - RNA, 20 nt, Mycobacterium avium subsp. paratuberculosis
ucggcagcagggugccgccg

SEQ ID NO: 2862860 - RNA, 17 nt, Mycobacterium avium subsp. paratuberculosis
ucggcagccccgucggu

SEQ ID NO: 2862861 - RNA, 21 nt, Mycobacterium avium subsp. paratuberculosis
ucggcagcccggaggcgaugc

SEQ ID NO: 2862862 - RNA, 23 nt, Mycobacterium avium subsp. paratuberculosis
ucggcagcccggaggcgaugcgg

SEQ ID NO: 2862863 - RNA, 16 nt, Mycobacterium avium subsp. paratuberculosis
ucggcagccggcugag

SEQ ID NO: 2862864 - RNA, 15 nt, Mycobacterium avium subsp. paratuberculosis
ucggcagcgacgcgg

SEQ ID NO: 2862865 - RNA, 22 nt, Mycobacterium avium subsp. paratuberculosis
ucggcaggaaagcgcuuucgcu

SEQ ID NO: 2862866 - RNA, 20 nt, Mycobacterium avium subsp. paratuberculosis
ucggcaggaaguucuucgcg

SEQ ID NO: 2862867 - RNA, 15 nt, Mycobacterium avium subsp. paratuberculosis
ucggcaggucgucga

SEQ ID NO: 2862868 - RNA, 17 nt, Mycobacterium avium subsp. paratuberculosis
ucggcaggucgucgacg

SEQ ID NO: 2862869 - RNA, 20 nt, Mycobacterium avium subsp. paratuberculosis
ucggcauaacgcaaccgguc

SEQ ID NO: 2862870 - RNA, 16 nt, Mycobacterium avium subsp. paratuberculosis
ucggcauagcgccgcu

SEQ ID NO: 2862871 - RNA, 20 nt, Mycobacterium avium subsp. paratuberculosis
ucggcauagcgccgcucggc

SEQ ID NO: 2862872 - RNA, 17 nt, Mycobacterium avium subsp. paratuberculosis
ucggcaucgcgcgcggc

SEQ ID NO: 2862873 - RNA, 18 nt, Mycobacterium avium subsp. paratuberculosis
ucggcaucgcgcgcggcg

SEQ ID NO: 2862874 - RNA, 20 nt, Mycobacterium avium subsp. paratuberculosis
ucggcaucgcgcgcggcgac

SEQ ID NO: 2862875 - RNA, 17 nt, Mycobacterium avium subsp. paratuberculosis
ucggcaucucggccgga

SEQ ID NO: 2862876 - RNA, 23 nt, Mycobacterium avium subsp. paratuberculosis
ucggccaacagugcgcaggcggc

SEQ ID NO: 2862877 - RNA, 16 nt, Mycobacterium avium subsp. paratuberculosis
ucggccaaccgggcag

SEQ ID NO: 2862878 - RNA, 14 nt, Mycobacterium avium subsp. paratuberculosis
ucggccaaggggag

SEQ ID NO: 2862879 - RNA, 22 nt, Mycobacterium avium subsp. paratuberculosis
ucggccaauuccucagcccggc

SEQ ID NO: 2862880 - RNA, 14 nt, Mycobacterium avium subsp. paratuberculosis
ucggccaccaccuc

SEQ ID NO: 2862881 - RNA, 19 nt, Mycobacterium avium subsp. paratuberculosis
ucggccaccaccucgcggg

SEQ ID NO: 2862882 - RNA, 23 nt, Mycobacterium avium subsp. paratuberculosis
ucggccaccaccucgcgggcgac

SEQ ID NO: 2862883 - RNA, 15 nt, Mycobacterium avium subsp. paratuberculosis
ucggccaccagcgcc

SEQ ID NO: 2862884 - RNA, 16 nt, Mycobacterium avium subsp. paratuberculosis
ucggccaccagcgccc

SEQ ID NO: 2862885 - RNA, 22 nt, Mycobacterium avium subsp. paratuberculosis
ucggccaccagcgcccgcccgg

SEQ ID NO: 2862886 - RNA, 15 nt, Mycobacterium avium subsp. paratuberculosis
ucggccaccgcgcgg

SEQ ID NO: 2862887 - RNA, 16 nt, Mycobacterium avium subsp. paratuberculosis
ucggccaccgcgcggc

SEQ ID NO: 2862888 - RNA, 22 nt, Mycobacterium avium subsp. paratuberculosis
ucggccaccgcgcggugcacca

SEQ ID NO: 2862889 - RNA, 14 nt, Mycobacterium avium subsp. paratuberculosis
ucggccaccgcggu

SEQ ID NO: 2862890 - RNA, 22 nt, Mycobacterium avium subsp. paratuberculosis
ucggccaccgcggucgacggga

SEQ ID NO: 2862891 - RNA, 14 nt, Mycobacterium avium subsp. paratuberculosis
ucggccaccgcguc

SEQ ID NO: 2862892 - RNA, 16 nt, Mycobacterium avium subsp. paratuberculosis
ucggccacgacgcgcc

SEQ ID NO: 2862893 - RNA, 17 nt, Mycobacterium avium subsp. paratuberculosis
ucggccacgacgcggcg

SEQ ID NO: 2862894 - RNA, 19 nt, Mycobacterium avium subsp. paratuberculosis
ucggccacgacgcggcgcg

SEQ ID NO: 2862895 - RNA, 20 nt, Mycobacterium avium subsp. paratuberculosis
ucggccacgacgcggcgcgc

SEQ ID NO: 2862896 - RNA, 21 nt, Mycobacterium avium subsp. paratuberculosis
ucggccacgacgcggcgcgcg

SEQ ID NO: 2862897 - RNA, 14 nt, Mycobacterium avium subsp. paratuberculosis
ucggccacgccggg

SEQ ID NO: 2862898 - RNA, 12 nt, Mycobacterium avium subsp. paratuberculosis
ucggccacgcuc

SEQ ID NO: 2862899 - RNA, 19 nt, Mycobacterium avium subsp. paratuberculosis
ucggccagaucggccaggu

SEQ ID NO: 2862900 - RNA, 19 nt, Mycobacterium avium subsp. paratuberculosis
ucggccagcaccagcagcc

SEQ ID NO: 2862901 - RNA, 13 nt, Mycobacterium avium subsp. paratuberculosis
ucggccagcagcg

SEQ ID NO: 2862902 - RNA, 17 nt, Mycobacterium avium subsp. paratuberculosis
ucggccagcagcgcguc

SEQ ID NO: 2862903 - RNA, 21 nt, Mycobacterium avium subsp. paratuberculosis
ucggccagcagcgcgucgcgg

SEQ ID NO: 2862904 - RNA, 19 nt, Mycobacterium avium subsp. paratuberculosis
ucggccagcaggucgucga

SEQ ID NO: 2862905 - RNA, 23 nt, Mycobacterium avium subsp. paratuberculosis
ucggccagcaggucgucgacguc

SEQ ID NO: 2862906 - RNA, 20 nt, Mycobacterium avium subsp. paratuberculosis
ucggccagccacgccgacac

SEQ ID NO: 2862907 - RNA, 22 nt, Mycobacterium avium subsp. paratuberculosis
ucggccagccacgccgacaccg

SEQ ID NO: 2862908 - RNA, 15 nt, Mycobacterium avium subsp. paratuberculosis
ucggccagccacucc

SEQ ID NO: 2862909 - RNA, 22 nt, Mycobacterium avium subsp. paratuberculosis
ucggccagccaggccgucggcg

SEQ ID NO: 2862910 - RNA, 14 nt, Mycobacterium avium subsp. paratuberculosis
ucggccagccccac

SEQ ID NO: 2862911 - RNA, 16 nt, Mycobacterium avium subsp. paratuberculosis
ucggccagccggggga

SEQ ID NO: 2862912 - RNA, 21 nt, Mycobacterium avium subsp. paratuberculosis
ucggccagccgggggaucacc

SEQ ID NO: 2862913 - RNA, 15 nt, Mycobacterium avium subsp. paratuberculosis
ucggccagcgagucc

SEQ ID NO: 2862914 - RNA, 15 nt, Mycobacterium avium subsp. paratuberculosis
ucggccagcgccgcc

SEQ ID NO: 2862915 - RNA, 18 nt, Mycobacterium avium subsp. paratuberculosis
ucggccagcgccgcccgg

SEQ ID NO: 2862916 - RNA, 23 nt, Mycobacterium avium subsp. paratuberculosis
ucggccagcgccgcgcgcgcggc

SEQ ID NO: 2862917 - RNA, 15 nt, Mycobacterium avium subsp. paratuberculosis
ucggccagcgcgcgg

SEQ ID NO: 2862918 - RNA, 16 nt, Mycobacterium avium subsp. paratuberculosis
ucggccagcgcggccg

SEQ ID NO: 2862919 - RNA, 18 nt, Mycobacterium avium subsp. paratuberculosis
ucggccagcgcggccggg

SEQ ID NO: 2862920 - RNA, 22 nt, Mycobacterium avium subsp. paratuberculosis
ucggccagcgcggccgggcgcc

SEQ ID NO: 2862921 - RNA, 15 nt, Mycobacterium avium subsp. paratuberculosis
ucggccagcgcggcg

SEQ ID NO: 2862922 - RNA, 22 nt, Mycobacterium avium subsp. paratuberculosis
ucggccagcgcggugugcggcg

SEQ ID NO: 2862923 - RNA, 20 nt, Mycobacterium avium subsp. paratuberculosis
ucggccagcgcgucggccag

SEQ ID NO: 2862924 - RNA, 21 nt, Mycobacterium avium subsp. paratuberculosis
ucggccagcgcgucggccagc

SEQ ID NO: 2862925 - RNA, 22 nt, Mycobacterium avium subsp. paratuberculosis
ucggccagcgcgucggccagca

SEQ ID NO: 2862926 - RNA, 11 nt, Mycobacterium avium subsp. paratuberculosis
ucggccagcgg

SEQ ID NO: 2862927 - RNA, 15 nt, Mycobacterium avium subsp. paratuberculosis
ucggccagcggcagc

SEQ ID NO: 2862928 - RNA, 16 nt, Mycobacterium avium subsp. paratuberculosis
ucggccagcggcagcg

SEQ ID NO: 2862929 - RNA, 15 nt, Mycobacterium avium subsp. paratuberculosis
ucggccagcgggcgg

SEQ ID NO: 2862930 - RNA, 14 nt, Mycobacterium avium subsp. paratuberculosis
ucggccagcguguu

SEQ ID NO: 2862931 - RNA, 17 nt, Mycobacterium avium subsp. paratuberculosis
ucggccaggaaccaccg

SEQ ID NO: 2862932 - RNA, 22 nt, Mycobacterium avium subsp. paratuberculosis
ucggccgugaucucgugccgca

SEQ ID NO: 2862933 - RNA, 16 nt, Mycobacterium avium subsp. paratuberculosis
ucggccguggccguca

SEQ ID NO: 2862934 - RNA, 17 nt, Mycobacterium avium subsp. paratuberculosis
ucggccguggccgucac

SEQ ID NO: 2862935 - RNA, 20 nt, Mycobacterium avium subsp. paratuberculosis
ucggccguggccgucacgcu

SEQ ID NO: 2862936 - RNA, 16 nt, Mycobacterium avium subsp. paratuberculosis
ucggccucaggcgucg

SEQ ID NO: 2862937 - RNA, 23 nt, Mycobacterium avium subsp. paratuberculosis
ucggccucaggcgucggucagca

SEQ ID NO: 2862938 - RNA, 17 nt, Mycobacterium avium subsp. paratuberculosis
ucggccuccagccggcg

SEQ ID NO: 2862939 - RNA, 23 nt, Mycobacterium avium subsp. paratuberculosis
ucggccuccuccucgcugccggc

SEQ ID NO: 2862940 - RNA, 14 nt, Mycobacterium avium subsp. paratuberculosis
ucggccucggcggc

SEQ ID NO: 2862941 - RNA, 15 nt, Mycobacterium avium subsp. paratuberculosis
ucggccucggcggcc

SEQ ID NO: 2862942 - RNA, 15 nt, Mycobacterium avium subsp. paratuberculosis
ucggccugcacgucg

SEQ ID NO: 2862943 - RNA, 18 nt, Mycobacterium avium subsp. paratuberculosis
ucggccugcacgucggcg

SEQ ID NO: 2862944 - RNA, 20 nt, Mycobacterium avium subsp. paratuberculosis
ucggccugcacgucggcgcg

SEQ ID NO: 2862945 - RNA, 20 nt, Mycobacterium avium subsp. paratuberculosis
ucggccugcagcucggugcg

SEQ ID NO: 2862946 - RNA, 15 nt, Mycobacterium avium subsp. paratuberculosis
ucggccugcgcccgg

SEQ ID NO: 2862947 - RNA, 16 nt, Mycobacterium avium subsp. paratuberculosis
ucggccugcgcugcgg

SEQ ID NO: 2862948 - RNA, 23 nt, Mycobacterium avium subsp. paratuberculosis
ucggccugcgucacuccucgauc

SEQ ID NO: 2862949 - RNA, 14 nt, Mycobacterium avium subsp. paratuberculosis
ucggccuucagcgu

SEQ ID NO: 2862950 - RNA, 15 nt, Mycobacterium avium subsp. paratuberculosis
ucggccuugaccacg

SEQ ID NO: 2862951 - RNA, 20 nt, Mycobacterium avium subsp. paratuberculosis
ucggccuugaccacggugcg

SEQ ID NO: 2862952 - RNA, 16 nt, Mycobacterium avium subsp. paratuberculosis
ucggccuugaccagga

SEQ ID NO: 2862953 - RNA, 22 nt, Mycobacterium avium subsp. paratuberculosis
ucggccuugagccggucgugcg

SEQ ID NO: 2862954 - RNA, 15 nt, Mycobacterium avium subsp. paratuberculosis
ucggccuugcgccac

SEQ ID NO: 2862955 - RNA, 22 nt, Mycobacterium avium subsp. paratuberculosis
ucggccuugcgccacuugucca

SEQ ID NO: 2862956 - RNA, 16 nt, Mycobacterium avium subsp. paratuberculosis
ucggccuuggccaccg

SEQ ID NO: 2862957 - RNA, 19 nt, Mycobacterium avium subsp. paratuberculosis
ucggccuuggccaccgccu

SEQ ID NO: 2862958 - RNA, 22 nt, Mycobacterium avium subsp. paratuberculosis
ucggcgaacaucuccagauugc

SEQ ID NO: 2862959 - RNA, 12 nt, Mycobacterium avium subsp. paratuberculosis
ucggcgaaccag

SEQ ID NO: 2862960 - RNA, 20 nt, Mycobacterium avium subsp. paratuberculosis
ucggcgaaccagggcagcca

SEQ ID NO: 2862961 - RNA, 22 nt, Mycobacterium avium subsp. paratuberculosis
ucggcgaaccagggcagccagc

SEQ ID NO: 2862962 - RNA, 22 nt, Mycobacterium avium subsp. paratuberculosis
ucggcgaacgcccggucgauga

SEQ ID NO: 2862963 - RNA, 22 nt, Mycobacterium avium subsp. paratuberculosis
ucggcgaacggccaguccaggc

SEQ ID NO: 2862964 - RNA, 19 nt, Mycobacterium avium subsp. paratuberculosis
ucggcgaaggugccccgcu

SEQ ID NO: 2862965 - RNA, 21 nt, Mycobacterium avium subsp. paratuberculosis
ucggcgacaacagcgccgaga

SEQ ID NO: 2862966 - RNA, 20 nt, Mycobacterium avium subsp. paratuberculosis
ucggcgaccaauugcgagca

SEQ ID NO: 2862967 - RNA, 16 nt, Mycobacterium avium subsp. paratuberculosis
ucggcgaccagcgacg

SEQ ID NO: 2862968 - RNA, 14 nt, Mycobacterium avium subsp. paratuberculosis
ucggcgaccaugcc

SEQ ID NO: 2862969 - RNA, 13 nt, Mycobacterium avium subsp. paratuberculosis
ucggcgaccgccg

SEQ ID NO: 2862970 - RNA, 14 nt, Mycobacterium avium subsp. paratuberculosis
ucggcgaccgccgg

SEQ ID NO: 2862971 - RNA, 13 nt, Mycobacterium avium subsp. paratuberculosis
ucggcgaccgcgc

SEQ ID NO: 2862972 - RNA, 18 nt, Mycobacterium avium subsp. paratuberculosis
ucggcgaccgcgcgcggc

SEQ ID NO: 2862973 - RNA, 19 nt, Mycobacterium avium subsp. paratuberculosis
ucggcgaccgcgcgcggcg

SEQ ID NO: 2862974 - RNA, 16 nt, Mycobacterium avium subsp. paratuberculosis
ucggcgacgauggcca

SEQ ID NO: 2862975 - RNA, 17 nt, Mycobacterium avium subsp. paratuberculosis
ucggcgacgauggccag

SEQ ID NO: 2862976 - RNA, 19 nt, Mycobacterium avium subsp. paratuberculosis
ucggcgacgauggccaggc

SEQ ID NO: 2862977 - RNA, 20 nt, Mycobacterium avium subsp. paratuberculosis
ucggcgacgauggccaggcc

SEQ ID NO: 2862978 - RNA, 14 nt, Mycobacterium avium subsp. paratuberculosis
ucggcgacgccgcc

SEQ ID NO: 2862979 - RNA, 13 nt, Mycobacterium avium subsp. paratuberculosis
ucggcgacgcuca

SEQ ID NO: 2862980 - RNA, 20 nt, Mycobacterium avium subsp. paratuberculosis
ucggcgacgcucaggcgucc

SEQ ID NO: 2862981 - RNA, 13 nt, Mycobacterium avium subsp. paratuberculosis
ucggcgacgcugg

SEQ ID NO: 2862982 - RNA, 16 nt, Mycobacterium avium subsp. paratuberculosis
ucggcgacgcuggugg

SEQ ID NO: 2862983 - RNA, 17 nt, Mycobacterium avium subsp. paratuberculosis
ucggcgacggcgacggc

SEQ ID NO: 2862984 - RNA, 16 nt, Mycobacterium avium subsp. paratuberculosis
ucggcgacggcgcuca

SEQ ID NO: 2862985 - RNA, 13 nt, Mycobacterium avium subsp. paratuberculosis
ucggcgacggcgu

SEQ ID NO: 2862986 - RNA, 23 nt, Mycobacterium avium subsp. paratuberculosis
ucggcgacguccuugaucagcau

SEQ ID NO: 2862987 - RNA, 15 nt, Mycobacterium avium subsp. paratuberculosis
ucggcgagcaaggcg

SEQ ID NO: 2862988 - RNA, 13 nt, Mycobacterium avium subsp. paratuberculosis
ucggcgagcaccg

SEQ ID NO: 2862989 - RNA, 14 nt, Mycobacterium avium subsp. paratuberculosis
ucggcgagcaccgu

SEQ ID NO: 2862990 - RNA, 18 nt, Mycobacterium avium subsp. paratuberculosis
ucggcgagcaccgugccg

SEQ ID NO: 2862991 - RNA, 19 nt, Mycobacterium avium subsp. paratuberculosis
ucggcgagcagccgcgccg

SEQ ID NO: 2862992 - RNA, 22 nt, Mycobacterium avium subsp. paratuberculosis
ucggcgagcagcugcagcgucg

SEQ ID NO: 2862993 - RNA, 16 nt, Mycobacterium avium subsp. paratuberculosis
ucggcgagcuuggcgg

SEQ ID NO: 2862994 - RNA, 17 nt, Mycobacterium avium subsp. paratuberculosis
ucggcgagcuuggcggg

SEQ ID NO: 2862995 - RNA, 12 nt, Mycobacterium avium subsp. paratuberculosis
ucggcgaggcgc

SEQ ID NO: 2862996 - RNA, 15 nt, Mycobacterium avium subsp. paratuberculosis
ucggcgaggcgcucc

SEQ ID NO: 2862997 - RNA, 14 nt, Mycobacterium avium subsp. paratuberculosis
ucggcgagguagac

SEQ ID NO: 2862998 - RNA, 19 nt, Mycobacterium avium subsp. paratuberculosis
ucggcgagguagaccgccg

SEQ ID NO: 2862999 - RNA, 18 nt, Mycobacterium avium subsp. paratuberculosis
ucggcgaggucgucgagg

SEQ ID NO: 2863000 - RNA, 22 nt, Mycobacterium avium subsp. paratuberculosis
ucggcgaggucgucgagggcca

SEQ ID NO: 2863001 - RNA, 17 nt, Mycobacterium avium subsp. paratuberculosis
ucggcgagugaggccga

SEQ ID NO: 2863002 - RNA, 21 nt, Mycobacterium avium subsp. paratuberculosis
ucggcgagugaggccgaggcg

SEQ ID NO: 2863003 - RNA, 15 nt, Mycobacterium avium subsp. paratuberculosis
ucggcgagugcaccu

SEQ ID NO: 2863004 - RNA, 14 nt, Mycobacterium avium subsp. paratuberculosis
ucggcgaucaccgc

SEQ ID NO: 2863005 - RNA, 14 nt, Mycobacterium avium subsp. paratuberculosis
ucggcgaucagcug

SEQ ID NO: 2863006 - RNA, 16 nt, Mycobacterium avium subsp. paratuberculosis
ucggcgauccacgccu

SEQ ID NO: 2863007 - RNA, 14 nt, Mycobacterium avium subsp. paratuberculosis
ucggcgaucgccgg

SEQ ID NO: 2863008 - RNA, 17 nt, Mycobacterium avium subsp. paratuberculosis
ucggcgaucgccgggga

SEQ ID NO: 2863009 - RNA, 21 nt, Mycobacterium avium subsp. paratuberculosis
ucggcgaucggccgcugcggg

SEQ ID NO: 2863010 - RNA, 15 nt, Mycobacterium avium subsp. paratuberculosis
ucggcgaucggcgug

SEQ ID NO: 2863011 - RNA, 17 nt, Mycobacterium avium subsp. paratuberculosis
ucggcgaucggcgugcc

SEQ ID NO: 2863012 - RNA, 18 nt, Mycobacterium avium subsp. paratuberculosis
ucggcgaucggcgugccg

SEQ ID NO: 2863013 - RNA, 12 nt, Mycobacterium avium subsp. paratuberculosis
ucggcgaucucg

SEQ ID NO: 2863014 - RNA, 18 nt, Mycobacterium avium subsp. paratuberculosis
ucggcgaucucggucacc

SEQ ID NO: 2863015 - RNA, 16 nt, Mycobacterium avium subsp. paratuberculosis
ucggcgaucucgucgc

SEQ ID NO: 2863016 - RNA, 20 nt, Mycobacterium avium subsp. paratuberculosis
ucggcgaugcgcaccaucac

SEQ ID NO: 2863017 - RNA, 22 nt, Mycobacterium avium subsp. paratuberculosis
ucggcgcgggccagcagcagca

SEQ ID NO: 2863018 - RNA, 13 nt, Mycobacterium avium subsp. paratuberculosis
ucggcgcggggcc

SEQ ID NO: 2863019 - RNA, 18 nt, Mycobacterium avium subsp. paratuberculosis
ucggcgcggggccaccag

SEQ ID NO: 2863020 - RNA, 20 nt, Mycobacterium avium subsp. paratuberculosis
ucggcgcggggccaccaggc

SEQ ID NO: 2863021 - RNA, 18 nt, Mycobacterium avium subsp. paratuberculosis
ucggcgcgguccacgguc

SEQ ID NO: 2863022 - RNA, 22 nt, Mycobacterium avium subsp. paratuberculosis
ucggcgcggucgcaggcgagcc

SEQ ID NO: 2863023 - RNA, 19 nt, Mycobacterium avium subsp. paratuberculosis
ucggcgcgucguacaccuc

SEQ ID NO: 2863024 - RNA, 23 nt, Mycobacterium avium subsp. paratuberculosis
ucggcgcgucguacaccucgguc

SEQ ID NO: 2863025 - RNA, 19 nt, Mycobacterium avium subsp. paratuberculosis
ucggcgcgucguccgacac

SEQ ID NO: 2863026 - RNA, 20 nt, Mycobacterium avium subsp. paratuberculosis
ucggcgcgucguccgacacc

SEQ ID NO: 2863027 - RNA, 19 nt, Mycobacterium avium subsp. paratuberculosis
ucggcgcuccagcgggcgg

SEQ ID NO: 2863028 - RNA, 21 nt, Mycobacterium avium subsp. paratuberculosis
ucggcgcuccagcgggcggcg

SEQ ID NO: 2863029 - RNA, 16 nt, Mycobacterium avium subsp. paratuberculosis
ucggcgcucgccgcgc

SEQ ID NO: 2863030 - RNA, 21 nt, Mycobacterium avium subsp. paratuberculosis
ucggcgcucgccgcgcggccc

SEQ ID NO: 2863031 - RNA, 15 nt, Mycobacterium avium subsp. paratuberculosis
ucggcgcugaacugc

SEQ ID NO: 2863032 - RNA, 16 nt, Mycobacterium avium subsp. paratuberculosis
ucggcgcuggccagcg

SEQ ID NO: 2863033 - RNA, 21 nt, Mycobacterium avium subsp. paratuberculosis
ucggcgcuggccagcgcgacg

SEQ ID NO: 2863034 - RNA, 18 nt, Mycobacterium avium subsp. paratuberculosis
ucggcggaacggucgggg

SEQ ID NO: 2863035 - RNA, 20 nt, Mycobacterium avium subsp. paratuberculosis
ucggcggaacggucggggcg

SEQ ID NO: 2863036 - RNA, 17 nt, Mycobacterium avium subsp. paratuberculosis
ucggcggaagcucaucg

SEQ ID NO: 2863037 - RNA, 22 nt, Mycobacterium avium subsp. paratuberculosis
ucggcggacuggcugagcagca

SEQ ID NO: 2863038 - RNA, 21 nt, Mycobacterium avium subsp. paratuberculosis
ucggcggaggucauggcgacc

SEQ ID NO: 2863039 - RNA, 23 nt, Mycobacterium avium subsp. paratuberculosis
ucggcggcaaagcguugccgcgc

SEQ ID NO: 2863040 - RNA, 15 nt, Mycobacterium avium subsp. paratuberculosis
ucggcggcaccgccc

SEQ ID NO: 2863041 - RNA, 18 nt, Mycobacterium avium subsp. paratuberculosis
ucggcggcaccgcccggg

SEQ ID NO: 2863042 - RNA, 15 nt, Mycobacterium avium subsp. paratuberculosis
ucggcggccaccagc

SEQ ID NO: 2863043 - RNA, 16 nt, Mycobacterium avium subsp. paratuberculosis
ucggcggccaccagcc

SEQ ID NO: 2863044 - RNA, 18 nt, Mycobacterium avium subsp. paratuberculosis
ucggcggccagcgcgacg

SEQ ID NO: 2863045 - RNA, 19 nt, Mycobacterium avium subsp. paratuberculosis
ucggcggccagcgcgacgc

SEQ ID NO: 2863046 - RNA, 19 nt, Mycobacterium avium subsp. paratuberculosis
ucggcggccaugucggagc

SEQ ID NO: 2863047 - RNA, 21 nt, Mycobacterium avium subsp. paratuberculosis
ucggcggcccgcaggaucgag

SEQ ID NO: 2863048 - RNA, 13 nt, Mycobacterium avium subsp. paratuberculosis
ucggcggcccgcc

SEQ ID NO: 2863049 - RNA, 13 nt, Mycobacterium avium subsp. paratuberculosis
ucggcggcccgcu

SEQ ID NO: 2863050 - RNA, 21 nt, Mycobacterium avium subsp. paratuberculosis
ucggcggcccgcuugccgacg

SEQ ID NO: 2863051 - RNA, 13 nt, Mycobacterium avium subsp. paratuberculosis
ucggcggccgacc

SEQ ID NO: 2863052 - RNA, 14 nt, Mycobacterium avium subsp. paratuberculosis
ucggcggccgagcg

SEQ ID NO: 2863053 - RNA, 20 nt, Mycobacterium avium subsp. paratuberculosis
ucggcggccgagcgcaccgc

SEQ ID NO: 2863054 - RNA, 14 nt, Mycobacterium avium subsp. paratuberculosis
ucggcggccgagga

SEQ ID NO: 2863055 - RNA, 22 nt, Mycobacterium avium subsp. paratuberculosis
ucggcggccgaggaaagcucgc

SEQ ID NO: 2863056 - RNA, 13 nt, Mycobacterium avium subsp. paratuberculosis
ucggcggccgcga

SEQ ID NO: 2863057 - RNA, 21 nt, Mycobacterium avium subsp. paratuberculosis
ucggcggccgcgaaggcggcg

SEQ ID NO: 2863058 - RNA, 22 nt, Mycobacterium avium subsp. paratuberculosis
ucggcggccgcgaaggcggcgu

SEQ ID NO: 2863059 - RNA, 23 nt, Mycobacterium avium subsp. paratuberculosis
ucggcggccgcgaaggcggcguc

SEQ ID NO: 2863060 - RNA, 18 nt, Mycobacterium avium subsp. paratuberculosis
ucggcggccucgccgucg

SEQ ID NO: 2863061 - RNA, 14 nt, Mycobacterium avium subsp. paratuberculosis
ucggcggccucggu

SEQ ID NO: 2863062 - RNA, 13 nt, Mycobacterium avium subsp. paratuberculosis
ucggcggccugcg

SEQ ID NO: 2863063 - RNA, 19 nt, Mycobacterium avium subsp. paratuberculosis
ucggcggccugcggcggca

SEQ ID NO: 2863064 - RNA, 13 nt, Mycobacterium avium subsp. paratuberculosis
ucggcggccugcu

SEQ ID NO: 2863065 - RNA, 20 nt, Mycobacterium avium subsp. paratuberculosis
ucggcggccuugaacgcguc

SEQ ID NO: 2863066 - RNA, 22 nt, Mycobacterium avium subsp. paratuberculosis
ucggcggccuuuuccggcgaca

SEQ ID NO: 2863067 - RNA, 13 nt, Mycobacterium avium subsp. paratuberculosis
ucggcggcgaaca

SEQ ID NO: 2863068 - RNA, 15 nt, Mycobacterium avium subsp. paratuberculosis
ucggcggcgacggcg

SEQ ID NO: 2863069 - RNA, 19 nt, Mycobacterium avium subsp. paratuberculosis
ucggcggcgacggcgacca

SEQ ID NO: 2863070 - RNA, 24 nt, Mycobacterium avium subsp. paratuberculosis
ucggcggcgaggacgucgucgacg

SEQ ID NO: 2863071 - RNA, 18 nt, Mycobacterium avium subsp. paratuberculosis
ucggcggcgauccggccg

SEQ ID NO: 2863072 - RNA, 20 nt, Mycobacterium avium subsp. paratuberculosis
ucggcggcgauccggccggc

SEQ ID NO: 2863073 - RNA, 22 nt, Mycobacterium avium subsp. paratuberculosis
ucggcggcgauccggccggcgg

SEQ ID NO: 2863074 - RNA, 23 nt, Mycobacterium avium subsp. paratuberculosis
ucggcggcgauccggccggcggc

SEQ ID NO: 2863075 - RNA, 14 nt, Mycobacterium avium subsp. paratuberculosis
ucggcggcgcaggc

SEQ ID NO: 2863076 - RNA, 22 nt, Mycobacterium avium subsp. paratuberculosis
ucggcggcgcaggcgcgcacca

SEQ ID NO: 2863077 - RNA, 18 nt, Mycobacterium avium subsp. paratuberculosis
ucggcggcgccgucgucg

SEQ ID NO: 2863078 - RNA, 11 nt, Mycobacterium avium subsp. paratuberculosis
ucggcggcgcg

SEQ ID NO: 2863079 - RNA, 14 nt, Mycobacterium avium subsp. paratuberculosis
ucggcggcgcgcag

SEQ ID NO: 2863080 - RNA, 19 nt, Mycobacterium avium subsp. paratuberculosis
ucggcggcgcgcaggcgcg

SEQ ID NO: 2863081 - RNA, 23 nt, Mycobacterium avium subsp. paratuberculosis
ucggcggcgcgcaggcgcgcggc

SEQ ID NO: 2863082 - RNA, 17 nt, Mycobacterium avium subsp. paratuberculosis
ucggcggcgcgcugcag

SEQ ID NO: 2863083 - RNA, 19 nt, Mycobacterium avium subsp. paratuberculosis
ucggcggcgcgcugcaggc

SEQ ID NO: 2863084 - RNA, 13 nt, Mycobacterium avium subsp. paratuberculosis
ucggcggcggccu

SEQ ID NO: 2863085 - RNA, 12 nt, Mycobacterium avium subsp. paratuberculosis
ucggcggcggcg

SEQ ID NO: 2863086 - RNA, 14 nt, Mycobacterium avium subsp. paratuberculosis
ucggcggcggcgcg

SEQ ID NO: 2863087 - RNA, 16 nt, Mycobacterium avium subsp. paratuberculosis
ucggcggcggcgcgcc

SEQ ID NO: 2863088 - RNA, 18 nt, Mycobacterium avium subsp. paratuberculosis
ucggcggcggcgcgccgg

SEQ ID NO: 2863089 - RNA, 21 nt, Mycobacterium avium subsp. paratuberculosis
ucggcggcggcgcgccggccg

SEQ ID NO: 2863090 - RNA, 22 nt, Mycobacterium avium subsp. paratuberculosis
ucggcggcggcgcgccggccgg

SEQ ID NO: 2863091 - RNA, 14 nt, Mycobacterium avium subsp. paratuberculosis
ucggcggcggcggc

SEQ ID NO: 2863092 - RNA, 17 nt, Mycobacterium avium subsp. paratuberculosis
ucggcggcggcggccgc

SEQ ID NO: 2863093 - RNA, 20 nt, Mycobacterium avium subsp. paratuberculosis
ucggcggcggcggccgcguc

SEQ ID NO: 2863094 - RNA, 14 nt, Mycobacterium avium subsp. paratuberculosis
ucggcggcgggcag

SEQ ID NO: 2863095 - RNA, 23 nt, Mycobacterium avium subsp. paratuberculosis
ucggcggcggggugggcugcauc

SEQ ID NO: 2863096 - RNA, 22 nt, Mycobacterium avium subsp. paratuberculosis
ucggcggcguauucccggggga

SEQ ID NO: 2863097 - RNA, 22 nt, Mycobacterium avium subsp. paratuberculosis
ucggcggcucaggggaucucgg

SEQ ID NO: 2863098 - RNA, 14 nt, Mycobacterium avium subsp. paratuberculosis
ucggcgggagccgg

SEQ ID NO: 2863099 - RNA, 16 nt, Mycobacterium avium subsp. paratuberculosis
ucggcgggagccggcg

SEQ ID NO: 2863100 - RNA, 18 nt, Mycobacterium avium subsp. paratuberculosis
ucggcgggagccggcggc

SEQ ID NO: 2863101 - RNA, 15 nt, Mycobacterium avium subsp. paratuberculosis
ucggcguucagcggc

SEQ ID NO: 2863102 - RNA, 18 nt, Mycobacterium avium subsp. paratuberculosis
ucggcguucaucgugccg

SEQ ID NO: 2863103 - RNA, 23 nt, Mycobacterium avium subsp. paratuberculosis
ucggcguucaucgugccgaacgu

SEQ ID NO: 2863104 - RNA, 21 nt, Mycobacterium avium subsp. paratuberculosis
ucggcguucgauugccggacg

SEQ ID NO: 2863105 - RNA, 13 nt, Mycobacterium avium subsp. paratuberculosis
ucggcguugagcc

SEQ ID NO: 2863106 - RNA, 18 nt, Mycobacterium avium subsp. paratuberculosis
ucggcguugagccggcgc

SEQ ID NO: 2863107 - RNA, 15 nt, Mycobacterium avium subsp. paratuberculosis
ucggcguuggcggcg

SEQ ID NO: 2863108 - RNA, 22 nt, Mycobacterium avium subsp. paratuberculosis
ucggcuagcagcuccggucggc

SEQ ID NO: 2863109 - RNA, 14 nt, Mycobacterium avium subsp. paratuberculosis
ucggcuagcggcug

SEQ ID NO: 2863110 - RNA, 19 nt, Mycobacterium avium subsp. paratuberculosis
ucggcuagcggcugacccg

SEQ ID NO: 2863111 - RNA, 17 nt, Mycobacterium avium subsp. paratuberculosis
ucggcucgagcucgucg

SEQ ID NO: 2863112 - RNA, 13 nt, Mycobacterium avium subsp. paratuberculosis
ucggcucgcccgc

SEQ ID NO: 2863113 - RNA, 13 nt, Mycobacterium avium subsp. paratuberculosis
ucggcucgccgau

SEQ ID NO: 2863114 - RNA, 14 nt, Mycobacterium avium subsp. paratuberculosis
ucggcucggccggc

SEQ ID NO: 2863115 - RNA, 22 nt, Mycobacterium avium subsp. paratuberculosis
ucggcucggcgacaacagcgcc

SEQ ID NO: 2863116 - RNA, 17 nt, Mycobacterium avium subsp. paratuberculosis
ucggcucguagcgggcg

SEQ ID NO: 2863117 - RNA, 22 nt, Mycobacterium avium subsp. paratuberculosis
ucggcucguguccgaugacgag

SEQ ID NO: 2863118 - RNA, 13 nt, Mycobacterium avium subsp. paratuberculosis
ucggcugcgggcc

SEQ ID NO: 2863119 - RNA, 15 nt, Mycobacterium avium subsp. paratuberculosis
ucggcugcgggccag

SEQ ID NO: 2863120 - RNA, 18 nt, Mycobacterium avium subsp. paratuberculosis
ucggcugcgggccagcgc

SEQ ID NO: 2863121 - RNA, 18 nt, Mycobacterium avium subsp. paratuberculosis
ucggcuggcgugcggcgc

SEQ ID NO: 2863122 - RNA, 13 nt, Mycobacterium avium subsp. paratuberculosis
ucggcuggucggc

SEQ ID NO: 2863123 - RNA, 17 nt, Mycobacterium avium subsp. paratuberculosis
ucggcuuccuccucggc

SEQ ID NO: 2863124 - RNA, 19 nt, Mycobacterium avium subsp. paratuberculosis
ucggcuuccuccucggcgc

SEQ ID NO: 2863125 - RNA, 17 nt, Mycobacterium avium subsp. paratuberculosis
ucggcuucguacggccc

SEQ ID NO: 2863126 - RNA, 18 nt, Mycobacterium avium subsp. paratuberculosis
ucggcuugcgucgcuguc

SEQ ID NO: 2863127 - RNA, 23 nt, Mycobacterium avium subsp. paratuberculosis
ucggcuugcgucgcugucggcga

SEQ ID NO: 2863128 - RNA, 18 nt, Mycobacterium avium subsp. paratuberculosis
ucggcuuggggaagccgg

SEQ ID NO: 2863129 - RNA, 22 nt, Mycobacterium avium subsp. paratuberculosis
ucggcuuggggaagccggccag

SEQ ID NO: 2863130 - RNA, 15 nt, Mycobacterium avium subsp. paratuberculosis
ucggcuuucucgcca

SEQ ID NO: 2863131 - RNA, 18 nt, Mycobacterium avium subsp. paratuberculosis
ucggcuuucucgccaaua

SEQ ID NO: 2863132 - RNA, 17 nt, Mycobacterium avium subsp. paratuberculosis
ucgggaaacgcgucgcu

SEQ ID NO: 2863133 - RNA, 17 nt, Mycobacterium avium subsp. paratuberculosis
ucgggaaaucggaccca

SEQ ID NO: 2863134 - RNA, 20 nt, Mycobacterium avium subsp. paratuberculosis
ucgggaaaucggacccagcc

SEQ ID NO: 2863135 - RNA, 21 nt, Mycobacterium avium subsp. paratuberculosis
ucgggaaaucggacccagccc

SEQ ID NO: 2863136 - RNA, 17 nt, Mycobacterium avium subsp. paratuberculosis
ucgggaaaugcgucgcc

SEQ ID NO: 2863137 - RNA, 18 nt, Mycobacterium avium subsp. paratuberculosis
ucgggaaaugcgucgcca

SEQ ID NO: 2863138 - RNA, 15 nt, Mycobacterium avium subsp. paratuberculosis
ucgggaacagcccgc

SEQ ID NO: 2863139 - RNA, 16 nt, Mycobacterium avium subsp. paratuberculosis
ucgggaacagcccgcc

SEQ ID NO: 2863140 - RNA, 17 nt, Mycobacterium avium subsp. paratuberculosis
ucgggaacagcccgccc

SEQ ID NO: 2863141 - RNA, 15 nt, Mycobacterium avium subsp. paratuberculosis
ucgggaacgccgauc

SEQ ID NO: 2863142 - RNA, 17 nt, Mycobacterium avium subsp. paratuberculosis
ucgggaacgccgaucac

SEQ ID NO: 2863143 - RNA, 19 nt, Mycobacterium avium subsp. paratuberculosis
ucgggaacggguagugcac

SEQ ID NO: 2863144 - RNA, 16 nt, Mycobacterium avium subsp. paratuberculosis
ucgggaacggucagcc

SEQ ID NO: 2863145 - RNA, 20 nt, Mycobacterium avium subsp. paratuberculosis
ucgggaacggucagccgcgg

SEQ ID NO: 2863146 - RNA, 15 nt, Mycobacterium avium subsp. paratuberculosis
ucgggaaugucggcg

SEQ ID NO: 2863147 - RNA, 17 nt, Mycobacterium avium subsp. paratuberculosis
ucgggacccuuguccag

SEQ ID NO: 2863148 - RNA, 18 nt, Mycobacterium avium subsp. paratuberculosis
ucgggaccgaugccgcug

SEQ ID NO: 2863149 - RNA, 21 nt, Mycobacterium avium subsp. paratuberculosis
ucgggaccgaugccgcugauc

SEQ ID NO: 2863150 - RNA, 15 nt, Mycobacterium avium subsp. paratuberculosis
ucgggaccgcgggcg

SEQ ID NO: 2863151 - RNA, 15 nt, Mycobacterium avium subsp. paratuberculosis
ucgggaccgggaagc

SEQ ID NO: 2863152 - RNA, 20 nt, Mycobacterium avium subsp. paratuberculosis
ucgggaccgucaccguggcg

SEQ ID NO: 2863153 - RNA, 17 nt, Mycobacterium avium subsp. paratuberculosis
ucgggaccgucgcgcag

SEQ ID NO: 2863154 - RNA, 19 nt, Mycobacterium avium subsp. paratuberculosis
ucgggaccgucgcgcagcc

SEQ ID NO: 2863155 - RNA, 14 nt, Mycobacterium avium subsp. paratuberculosis
ucgggacgccugcc

SEQ ID NO: 2863156 - RNA, 14 nt, Mycobacterium avium subsp. paratuberculosis
ucgggacgcggcag

SEQ ID NO: 2863157 - RNA, 16 nt, Mycobacterium avium subsp. paratuberculosis
ucgggacggccagcag

SEQ ID NO: 2863158 - RNA, 15 nt, Mycobacterium avium subsp. paratuberculosis
ucgggacgucggcgc

SEQ ID NO: 2863159 - RNA, 16 nt, Mycobacterium avium subsp. paratuberculosis
ucgggacgucggcgcg

SEQ ID NO: 2863160 - RNA, 20 nt, Mycobacterium avium subsp. paratuberculosis
ucgggacgucggcgcgcucg

SEQ ID NO: 2863161 - RNA, 22 nt, Mycobacterium avium subsp. paratuberculosis
ucgggacgucggcgcgcucggu

SEQ ID NO: 2863162 - RNA, 24 nt, Mycobacterium avium subsp. paratuberculosis
ucgggacgucggcgcgcucggugc

SEQ ID NO: 2863163 - RNA, 16 nt, Mycobacterium avium subsp. paratuberculosis
ucgggagcaaggucgu

SEQ ID NO: 2863164 - RNA, 23 nt, Mycobacterium avium subsp. paratuberculosis
ucgggagcaaggucgucgcggcc

SEQ ID NO: 2863165 - RNA, 15 nt, Mycobacterium avium subsp. paratuberculosis
ucgggagugcggccc

SEQ ID NO: 2863166 - RNA, 22 nt, Mycobacterium avium subsp. paratuberculosis
ucgggagugcggcccacccgga

SEQ ID NO: 2863167 - RNA, 16 nt, Mycobacterium avium subsp. paratuberculosis
ucgggauacucguccu

SEQ ID NO: 2863168 - RNA, 16 nt, Mycobacterium avium subsp. paratuberculosis
ucgggauagccgagcg

SEQ ID NO: 2863169 - RNA, 20 nt, Mycobacterium avium subsp. paratuberculosis
ucgggauagccgagcggcgc

SEQ ID NO: 2863170 - RNA, 13 nt, Mycobacterium avium subsp. paratuberculosis
ucgggauagggcg

SEQ ID NO: 2863171 - RNA, 22 nt, Mycobacterium avium subsp. paratuberculosis
ucgggauagggcgcgucgaucg

SEQ ID NO: 2863172 - RNA, 21 nt, Mycobacterium avium subsp. paratuberculosis
ucgggauccucgccgcgggcc

SEQ ID NO: 2863173 - RNA, 18 nt, Mycobacterium avium subsp. paratuberculosis
ucgggaucgccgaagcgg

SEQ ID NO: 2863174 - RNA, 13 nt, Mycobacterium avium subsp. paratuberculosis
ucgggaucggcgc

SEQ ID NO: 2863175 - RNA, 20 nt, Mycobacterium avium subsp. paratuberculosis
ucgggaucggugaagcggcg

SEQ ID NO: 2863176 - RNA, 21 nt, Mycobacterium avium subsp. paratuberculosis
ucgggaucggugaagcggcgc

SEQ ID NO: 2863177 - RNA, 16 nt, Mycobacterium avium subsp. paratuberculosis
ucgggaucgucgccgg

SEQ ID NO: 2863178 - RNA, 13 nt, Mycobacterium avium subsp. paratuberculosis
ucgggauggucga

SEQ ID NO: 2863179 - RNA, 16 nt, Mycobacterium avium subsp. paratuberculosis
ucgggauggucgaucc

SEQ ID NO: 2863180 - RNA, 18 nt, Mycobacterium avium subsp. paratuberculosis
ucgggaugucgugggcgu

SEQ ID NO: 2863181 - RNA, 21 nt, Mycobacterium avium subsp. paratuberculosis
ucgggaugucgugggcgugcc

SEQ ID NO: 2863182 - RNA, 19 nt, Mycobacterium avium subsp. paratuberculosis
ucgggaugugcgugguugc

SEQ ID NO: 2863183 - RNA, 20 nt, Mycobacterium avium subsp. paratuberculosis
ucgggauuggacagcggcgc

SEQ ID NO: 2863184 - RNA, 15 nt, Mycobacterium avium subsp. paratuberculosis
ucgggauuggcggcc

SEQ ID NO: 2863185 - RNA, 18 nt, Mycobacterium avium subsp. paratuberculosis
ucggggccaccaggccga

SEQ ID NO: 2863186 - RNA, 12 nt, Mycobacterium avium subsp. paratuberculosis
ucggggccagga

SEQ ID NO: 2863187 - RNA, 21 nt, Mycobacterium avium subsp. paratuberculosis
ucggggcccaccccggacaac

SEQ ID NO: 2863188 - RNA, 20 nt, Mycobacterium avium subsp. paratuberculosis
ucggggcccggcccggcgau

SEQ ID NO: 2863189 - RNA, 23 nt, Mycobacterium avium subsp. paratuberculosis
ucggggcccguccccaccaccga

SEQ ID NO: 2863190 - RNA, 18 nt, Mycobacterium avium subsp. paratuberculosis
ucggggcccuccgcggcg

SEQ ID NO: 2863191 - RNA, 16 nt, Mycobacterium avium subsp. paratuberculosis
ucggggcgaccuggac

SEQ ID NO: 2863192 - RNA, 20 nt, Mycobacterium avium subsp. paratuberculosis
ucggggcgaccuggacgccg

SEQ ID NO: 2863193 - RNA, 21 nt, Mycobacterium avium subsp. paratuberculosis
ucggggcgccuaccggguggc

SEQ ID NO: 2863194 - RNA, 16 nt, Mycobacterium avium subsp. paratuberculosis
ucggggcggaugugcc

SEQ ID NO: 2863195 - RNA, 16 nt, Mycobacterium avium subsp. paratuberculosis
ucggggcggcgggcga

SEQ ID NO: 2863196 - RNA, 19 nt, Mycobacterium avium subsp. paratuberculosis
ucggggcgucggcggccuu

SEQ ID NO: 2863197 - RNA, 16 nt, Mycobacterium avium subsp. paratuberculosis
ucggggcguggcggaa

SEQ ID NO: 2863198 - RNA, 13 nt, Mycobacterium avium subsp. paratuberculosis
ucggggcucacca

SEQ ID NO: 2863199 - RNA, 16 nt, Mycobacterium avium subsp. paratuberculosis
ucggggcugcgcggcu

SEQ ID NO: 2863200 - RNA, 15 nt, Mycobacterium avium subsp. paratuberculosis
ucggggcuggcggcg

SEQ ID NO: 2863201 - RNA, 18 nt, Mycobacterium avium subsp. paratuberculosis
ucgggggcgggcaccucg

SEQ ID NO: 2863202 - RNA, 23 nt, Mycobacterium avium subsp. paratuberculosis
ucgggggcgggcaccucgaugcc

SEQ ID NO: 2863203 - RNA, 14 nt, Mycobacterium avium subsp. paratuberculosis
ucggggggcacguc

SEQ ID NO: 2863204 - RNA, 23 nt, Mycobacterium avium subsp. paratuberculosis
ucggggguaaaccgccagcagcg

SEQ ID NO: 2863205 - RNA, 14 nt, Mycobacterium avium subsp. paratuberculosis
ucgggggugaaggc

SEQ ID NO: 2863206 - RNA, 17 nt, Mycobacterium avium subsp. paratuberculosis
ucgggggugaaggcggc

SEQ ID NO: 2863207 - RNA, 15 nt, Mycobacterium avium subsp. paratuberculosis
ucggggguggccagc

SEQ ID NO: 2863208 - RNA, 22 nt, Mycobacterium avium subsp. paratuberculosis
ucgggguacucggcggcgggca

SEQ ID NO: 2863209 - RNA, 15 nt, Mycobacterium avium subsp. paratuberculosis
ucgggguagccggcc

SEQ ID NO: 2863210 - RNA, 22 nt, Mycobacterium avium subsp. paratuberculosis
ucgggguagccggcccgcagcc

SEQ ID NO: 2863211 - RNA, 13 nt, Mycobacterium avium subsp. paratuberculosis
ucgggguccaggc

SEQ ID NO: 2863212 - RNA, 13 nt, Mycobacterium avium subsp. paratuberculosis
ucggggucgccgu

SEQ ID NO: 2863213 - RNA, 13 nt, Mycobacterium avium subsp. paratuberculosis
ucggggucgcgcc

SEQ ID NO: 2863214 - RNA, 15 nt, Mycobacterium avium subsp. paratuberculosis
ucggggucggcgucg

SEQ ID NO: 2863215 - RNA, 17 nt, Mycobacterium avium subsp. paratuberculosis
ucggggucggcgucggg

SEQ ID NO: 2863216 - RNA, 15 nt, Mycobacterium avium subsp. paratuberculosis
ucggggucgucgacg

SEQ ID NO: 2863217 - RNA, 17 nt, Mycobacterium avium subsp. paratuberculosis
ucggggucgucgacggc

SEQ ID NO: 2863218 - RNA, 19 nt, Mycobacterium avium subsp. paratuberculosis
ucggggugccgccggggac

SEQ ID NO: 2863219 - RNA, 19 nt, Mycobacterium avium subsp. paratuberculosis
ucggggugcggucggcgac

SEQ ID NO: 2863220 - RNA, 17 nt, Mycobacterium avium subsp. paratuberculosis
ucgggguggucaccggc

SEQ ID NO: 2863221 - RNA, 21 nt, Mycobacterium avium subsp. paratuberculosis
ucggggugguugaucacgggc

SEQ ID NO: 2863222 - RNA, 21 nt, Mycobacterium avium subsp. paratuberculosis
ucgggguuuugaucagcccgg

SEQ ID NO: 2863223 - RNA, 19 nt, Mycobacterium avium subsp. paratuberculosis
ucggguaacccuccggcgc

SEQ ID NO: 2863224 - RNA, 18 nt, Mycobacterium avium subsp. paratuberculosis
ucggguacaccgagccgg

SEQ ID NO: 2863225 - RNA, 15 nt, Mycobacterium avium subsp. paratuberculosis
ucggguagacgauca

SEQ ID NO: 2863226 - RNA, 14 nt, Mycobacterium avium subsp. paratuberculosis
ucgggucaccggcc

SEQ ID NO: 2863227 - RNA, 15 nt, Mycobacterium avium subsp. paratuberculosis
ucgggucaccgugcg

SEQ ID NO: 2863228 - RNA, 14 nt, Mycobacterium avium subsp. paratuberculosis
ucgggucagaccgc

SEQ ID NO: 2863229 - RNA, 22 nt, Mycobacterium avium subsp. paratuberculosis
ucgggucagaccgcggcggucg

SEQ ID NO: 2863230 - RNA, 13 nt, Mycobacterium avium subsp. paratuberculosis
ucggguccagcgc

SEQ ID NO: 2863231 - RNA, 15 nt, Mycobacterium avium subsp. paratuberculosis
ucgggucccggcaac

SEQ ID NO: 2863232 - RNA, 14 nt, Mycobacterium avium subsp. paratuberculosis
ucggguccgaccag

SEQ ID NO: 2863233 - RNA, 13 nt, Mycobacterium avium subsp. paratuberculosis
ucggguccgcggu

SEQ ID NO: 2863234 - RNA, 20 nt, Mycobacterium avium subsp. paratuberculosis
ucgggucgaagugcucgagc

SEQ ID NO: 2863235 - RNA, 15 nt, Mycobacterium avium subsp. paratuberculosis
ucgggucgacgagca

SEQ ID NO: 2863236 - RNA, 18 nt, Mycobacterium avium subsp. paratuberculosis
ucgggucgacgagcaggc

SEQ ID NO: 2863237 - RNA, 20 nt, Mycobacterium avium subsp. paratuberculosis
ucgggucgagacugcacagu

SEQ ID NO: 2863238 - RNA, 12 nt, Mycobacterium avium subsp. paratuberculosis
ucgggucgcccg

SEQ ID NO: 2863239 - RNA, 15 nt, Mycobacterium avium subsp. paratuberculosis
ucgggucggcgagca

SEQ ID NO: 2863240 - RNA, 23 nt, Mycobacterium avium subsp. paratuberculosis
ucgggugacgccucaggcgagca

SEQ ID NO: 2863241 - RNA, 21 nt, Mycobacterium avium subsp. paratuberculosis
ucgggugaguaguccagcacc

SEQ ID NO: 2863242 - RNA, 16 nt, Mycobacterium avium subsp. paratuberculosis
ucgggugcggcgugcg

SEQ ID NO: 2863243 - RNA, 14 nt, Mycobacterium avium subsp. paratuberculosis
ucggguggcgucgc

SEQ ID NO: 2863244 - RNA, 18 nt, Mycobacterium avium subsp. paratuberculosis
ucggguggcgucgccgcc

SEQ ID NO: 2863245 - RNA, 22 nt, Mycobacterium avium subsp. paratuberculosis
ucggguguaggcccgaucaggg

SEQ ID NO: 2863246 - RNA, 14 nt, Mycobacterium avium subsp. paratuberculosis
ucgggugucgccga

SEQ ID NO: 2863247 - RNA, 18 nt, Mycobacterium avium subsp. paratuberculosis
ucgggugucgccgagccg

SEQ ID NO: 2863248 - RNA, 20 nt, Mycobacterium avium subsp. paratuberculosis
ucggguucgcccuccccggc

SEQ ID NO: 2863249 - RNA, 15 nt, Mycobacterium avium subsp. paratuberculosis
ucggguucgccggug

SEQ ID NO: 2863250 - RNA, 14 nt, Mycobacterium avium subsp. paratuberculosis
ucggguugccggcg

SEQ ID NO: 2863251 - RNA, 18 nt, Mycobacterium avium subsp. paratuberculosis
ucggguugccggcggcca

SEQ ID NO: 2863252 - RNA, 14 nt, Mycobacterium avium subsp. paratuberculosis
ucggguuggccagg

SEQ ID NO: 2863253 - RNA, 20 nt, Mycobacterium avium subsp. paratuberculosis
ucggguuguuguccgaccag

SEQ ID NO: 2863254 - RNA, 21 nt, Mycobacterium avium subsp. paratuberculosis
ucgguacgcgcaauccugccc

SEQ ID NO: 2863255 - RNA, 17 nt, Mycobacterium avium subsp. paratuberculosis
ucgguaguugcacucuc

SEQ ID NO: 2863256 - RNA, 20 nt, Mycobacterium avium subsp. paratuberculosis
ucgguaguugcacucucgcg

SEQ ID NO: 2863257 - RNA, 17 nt, Mycobacterium avium subsp. paratuberculosis
ucggucaagccggccag

SEQ ID NO: 2863258 - RNA, 19 nt, Mycobacterium avium subsp. paratuberculosis
ucggucaagccggccagca

SEQ ID NO: 2863259 - RNA, 15 nt, Mycobacterium avium subsp. paratuberculosis
ucggucaccagcggc

SEQ ID NO: 2863260 - RNA, 24 nt, Mycobacterium avium subsp. paratuberculosis
ucggucacccgguugagcaccgca

SEQ ID NO: 2863261 - RNA, 15 nt, Mycobacterium avium subsp. paratuberculosis
ucggucaccgagcgg

SEQ ID NO: 2863262 - RNA, 13 nt, Mycobacterium avium subsp. paratuberculosis
ucggucaccggug

SEQ ID NO: 2863263 - RNA, 20 nt, Mycobacterium avium subsp. paratuberculosis
ucggucaccggugucacgcu

SEQ ID NO: 2863264 - RNA, 18 nt, Mycobacterium avium subsp. paratuberculosis
ucggucacggacagccgg

SEQ ID NO: 2863265 - RNA, 12 nt, Mycobacterium avium subsp. paratuberculosis
ucggucagcacc

SEQ ID NO: 2863266 - RNA, 14 nt, Mycobacterium avium subsp. paratuberculosis
ucggucagcacgac

SEQ ID NO: 2863267 - RNA, 16 nt, Mycobacterium avium subsp. paratuberculosis
ucggucagcaggcgcc

SEQ ID NO: 2863268 - RNA, 17 nt, Mycobacterium avium subsp. paratuberculosis
ucggucagccgggcggc

SEQ ID NO: 2863269 - RNA, 22 nt, Mycobacterium avium subsp. paratuberculosis
ucggucagcgagcgguuggcga

SEQ ID NO: 2863270 - RNA, 15 nt, Mycobacterium avium subsp. paratuberculosis
ucggugcgggucaca

SEQ ID NO: 2863271 - RNA, 18 nt, Mycobacterium avium subsp. paratuberculosis
ucggugcgggucacaccc

SEQ ID NO: 2863272 - RNA, 20 nt, Mycobacterium avium subsp. paratuberculosis
ucggugcgguaggugccggc

SEQ ID NO: 2863273 - RNA, 16 nt, Mycobacterium avium subsp. paratuberculosis
ucgguggacagcgcga

SEQ ID NO: 2863274 - RNA, 18 nt, Mycobacterium avium subsp. paratuberculosis
ucgguggacagcgcgacg

SEQ ID NO: 2863275 - RNA, 13 nt, Mycobacterium avium subsp. paratuberculosis
ucgguggacgccg

SEQ ID NO: 2863276 - RNA, 14 nt, Mycobacterium avium subsp. paratuberculosis
ucgguggacgccgc

SEQ ID NO: 2863277 - RNA, 13 nt, Mycobacterium avium subsp. paratuberculosis
ucgguggacgcgg

SEQ ID NO: 2863278 - RNA, 22 nt, Mycobacterium avium subsp. paratuberculosis
ucgguggacgcggucgccgccc

SEQ ID NO: 2863279 - RNA, 17 nt, Mycobacterium avium subsp. paratuberculosis
ucgguggagcgcggcau

SEQ ID NO: 2863280 - RNA, 13 nt, Mycobacterium avium subsp. paratuberculosis
ucgguggauccgg

SEQ ID NO: 2863281 - RNA, 22 nt, Mycobacterium avium subsp. paratuberculosis
ucgguggcaccccgcgccgggc

SEQ ID NO: 2863282 - RNA, 15 nt, Mycobacterium avium subsp. paratuberculosis
ucgguggccaccgcg

SEQ ID NO: 2863283 - RNA, 17 nt, Mycobacterium avium subsp. paratuberculosis
ucgguggccccgggccg

SEQ ID NO: 2863284 - RNA, 14 nt, Mycobacterium avium subsp. paratuberculosis
ucgguggccucgcg

SEQ ID NO: 2863285 - RNA, 16 nt, Mycobacterium avium subsp. paratuberculosis
ucgguggcgauggugc

SEQ ID NO: 2863286 - RNA, 20 nt, Mycobacterium avium subsp. paratuberculosis
ucgguggcgauggugcugcc

SEQ ID NO: 2863287 - RNA, 20 nt, Mycobacterium avium subsp. paratuberculosis
ucgguggcggcggcgacgau

SEQ ID NO: 2863288 - RNA, 19 nt, Mycobacterium avium subsp. paratuberculosis
ucgguggcggugccgcggc

SEQ ID NO: 2863289 - RNA, 23 nt, Mycobacterium avium subsp. paratuberculosis
ucgguggcggugccgcggcggcg

SEQ ID NO: 2863290 - RNA, 20 nt, Mycobacterium avium subsp. paratuberculosis
ucgguggcgguggccacggc

SEQ ID NO: 2863291 - RNA, 21 nt, Mycobacterium avium subsp. paratuberculosis
ucgguggcgguggccacggcg

SEQ ID NO: 2863292 - RNA, 12 nt, Mycobacterium avium subsp. paratuberculosis
ucgguggcgucg

SEQ ID NO: 2863293 - RNA, 14 nt, Mycobacterium avium subsp. paratuberculosis
ucgguggcgucggc

SEQ ID NO: 2863294 - RNA, 17 nt, Mycobacterium avium subsp. paratuberculosis
ucgguggcgucggcggc

SEQ ID NO: 2863295 - RNA, 18 nt, Mycobacterium avium subsp. paratuberculosis
ucgguggcgucggcggcc

SEQ ID NO: 2863296 - RNA, 18 nt, Mycobacterium avium subsp. paratuberculosis
ucggugggccgccgcggc

SEQ ID NO: 2863297 - RNA, 22 nt, Mycobacterium avium subsp. paratuberculosis
ucggugggccgccgcggcggca

SEQ ID NO: 2863298 - RNA, 23 nt, Mycobacterium avium subsp. paratuberculosis
ucgguggggacgugcacgcguuc

SEQ ID NO: 2863299 - RNA, 14 nt, Mycobacterium avium subsp. paratuberculosis
ucgguggggccgcc

SEQ ID NO: 2863300 - RNA, 16 nt, Mycobacterium avium subsp. paratuberculosis
ucggugggggccaggc

SEQ ID NO: 2863301 - RNA, 21 nt, Mycobacterium avium subsp. paratuberculosis
ucgguggggugaggcacccgc

SEQ ID NO: 2863302 - RNA, 15 nt, Mycobacterium avium subsp. paratuberculosis
ucgguggucgacgag

SEQ ID NO: 2863303 - RNA, 13 nt, Mycobacterium avium subsp. paratuberculosis
ucggugguggggc

SEQ ID NO: 2863304 - RNA, 20 nt, Mycobacterium avium subsp. paratuberculosis
ucggugguguggcagguggc

SEQ ID NO: 2863305 - RNA, 22 nt, Mycobacterium avium subsp. paratuberculosis
ucgguguacagcgccauguccu

SEQ ID NO: 2863306 - RNA, 16 nt, Mycobacterium avium subsp. paratuberculosis
ucgguguagcccggug

SEQ ID NO: 2863307 - RNA, 15 nt, Mycobacterium avium subsp. paratuberculosis
ucgguguccagccgc

SEQ ID NO: 2863308 - RNA, 18 nt, Mycobacterium avium subsp. paratuberculosis
ucggugucccgcgcccgc

SEQ ID NO: 2863309 - RNA, 23 nt, Mycobacterium avium subsp. paratuberculosis
ucggugucccgcgcccgcgaaca

SEQ ID NO: 2863310 - RNA, 15 nt, Mycobacterium avium subsp. paratuberculosis
ucggugucgccgauu

SEQ ID NO: 2863311 - RNA, 13 nt, Mycobacterium avium subsp. paratuberculosis
ucggugucgcuca

SEQ ID NO: 2863312 - RNA, 20 nt, Mycobacterium avium subsp. paratuberculosis
ucggugucuuugcccuugau

SEQ ID NO: 2863313 - RNA, 16 nt, Mycobacterium avium subsp. paratuberculosis
ucggugugcagcagcu

SEQ ID NO: 2863314 - RNA, 18 nt, Mycobacterium avium subsp. paratuberculosis
ucggugugcagcagcucg

SEQ ID NO: 2863315 - RNA, 20 nt, Mycobacterium avium subsp. paratuberculosis
ucggugugggucagcgaggc

SEQ ID NO: 2863316 - RNA, 21 nt, Mycobacterium avium subsp. paratuberculosis
ucgguucugcagcgagauccc

SEQ ID NO: 2863317 - RNA, 20 nt, Mycobacterium avium subsp. paratuberculosis
ucgguuucgaacugggucug

SEQ ID NO: 2863318 - RNA, 15 nt, Mycobacterium avium subsp. paratuberculosis
ucgguuugaccacgg

SEQ ID NO: 2863319 - RNA, 22 nt, Mycobacterium avium subsp. paratuberculosis
ucguaacacccucggucgggcg

SEQ ID NO: 2863320 - RNA, 17 nt, Mycobacterium avium subsp. paratuberculosis
ucguacaaggugauggc

SEQ ID NO: 2863321 - RNA, 18 nt, Mycobacterium avium subsp. paratuberculosis
ucguacgggcgcagcgcc

SEQ ID NO: 2863322 - RNA, 19 nt, Mycobacterium avium subsp. paratuberculosis
ucguacgucuugcgcaccu

SEQ ID NO: 2863323 - RNA, 15 nt, Mycobacterium avium subsp. paratuberculosis
ucguacucccaggau

SEQ ID NO: 2863324 - RNA, 17 nt, Mycobacterium avium subsp. paratuberculosis
ucguacucgaccgcgac

SEQ ID NO: 2863325 - RNA, 12 nt, Mycobacterium avium subsp. paratuberculosis
ucguagaccgcu

SEQ ID NO: 2863326 - RNA, 21 nt, Mycobacterium avium subsp. paratuberculosis
ucguagacgaagcggccgggg

SEQ ID NO: 2863327 - RNA, 21 nt, Mycobacterium avium subsp. paratuberculosis
ucguagacgacgucgaccgcg

SEQ ID NO: 2863328 - RNA, 18 nt, Mycobacterium avium subsp. paratuberculosis
ucguagacgcugccgcug

SEQ ID NO: 2863329 - RNA, 22 nt, Mycobacterium avium subsp. paratuberculosis
ucguagagcugacgggaccgca

SEQ ID NO: 2863330 - RNA, 22 nt, Mycobacterium avium subsp. paratuberculosis
ucguagaggggccggacgguga

SEQ ID NO: 2863331 - RNA, 22 nt, Mycobacterium avium subsp. paratuberculosis
ucguagcccaccucgagcacgc

SEQ ID NO: 2863332 - RNA, 15 nt, Mycobacterium avium subsp. paratuberculosis
ucguagccggcacgc

SEQ ID NO: 2863333 - RNA, 20 nt, Mycobacterium avium subsp. paratuberculosis
ucguagccgugcaucgggcg

SEQ ID NO: 2863334 - RNA, 22 nt, Mycobacterium avium subsp. paratuberculosis
ucguagcggccgcacgcgaaca

SEQ ID NO: 2863335 - RNA, 13 nt, Mycobacterium avium subsp. paratuberculosis
ucguagcggcgcc

SEQ ID NO: 2863336 - RNA, 17 nt, Mycobacterium avium subsp. paratuberculosis
ucguagcggcgccaccg

SEQ ID NO: 2863337 - RNA, 17 nt, Mycobacterium avium subsp. paratuberculosis
ucguagcgucgggggcg

SEQ ID NO: 2863338 - RNA, 22 nt, Mycobacterium avium subsp. paratuberculosis
ucguagcuggugcgcagcccgc

SEQ ID NO: 2863339 - RNA, 14 nt, Mycobacterium avium subsp. paratuberculosis
ucguaggcgcgguc

SEQ ID NO: 2863340 - RNA, 14 nt, Mycobacterium avium subsp. paratuberculosis
ucguagggcucggc

SEQ ID NO: 2863341 - RNA, 22 nt, Mycobacterium avium subsp. paratuberculosis
ucguagguggccagcacgaucg

SEQ ID NO: 2863342 - RNA, 15 nt, Mycobacterium avium subsp. paratuberculosis
ucguaguaggugcgc

SEQ ID NO: 2863343 - RNA, 12 nt, Mycobacterium avium subsp. paratuberculosis
ucguagucgaug

SEQ ID NO: 2863344 - RNA, 15 nt, Mycobacterium avium subsp. paratuberculosis
ucguagucgcucggc

SEQ ID NO: 2863345 - RNA, 11 nt, Mycobacterium avium subsp. paratuberculosis
ucguaguugcg

SEQ ID NO: 2863346 - RNA, 18 nt, Mycobacterium avium subsp. paratuberculosis
ucguaguugcgcgccgau

SEQ ID NO: 2863347 - RNA, 18 nt, Mycobacterium avium subsp. paratuberculosis
ucguaguuggggccggcc

SEQ ID NO: 2863348 - RNA, 19 nt, Mycobacterium avium subsp. paratuberculosis
ucguaguuggggccggccg

SEQ ID NO: 2863349 - RNA, 15 nt, Mycobacterium avium subsp. paratuberculosis
ucguauucgacggcg

SEQ ID NO: 2863350 - RNA, 21 nt, Mycobacterium avium subsp. paratuberculosis
ucgucaaaccguuuucggcgc

SEQ ID NO: 2863351 - RNA, 15 nt, Mycobacterium avium subsp. paratuberculosis
ucgucaacgacccgg

SEQ ID NO: 2863352 - RNA, 13 nt, Mycobacterium avium subsp. paratuberculosis
ucgucaacgcccc

SEQ ID NO: 2863353 - RNA, 14 nt, Mycobacterium avium subsp. paratuberculosis
ucgucaacgccccg

SEQ ID NO: 2863354 - RNA, 18 nt, Mycobacterium avium subsp. paratuberculosis
ucgucaccgugggcggcg

SEQ ID NO: 2863355 - RNA, 15 nt, Mycobacterium avium subsp. paratuberculosis
ucgucgaucuucgcg

SEQ ID NO: 2863356 - RNA, 18 nt, Mycobacterium avium subsp. paratuberculosis
ucgucgaucuucgcggcg

SEQ ID NO: 2863357 - RNA, 14 nt, Mycobacterium avium subsp. paratuberculosis
ucgucgaugacgau

SEQ ID NO: 2863358 - RNA, 23 nt, Mycobacterium avium subsp. paratuberculosis
ucgucgaugcccuagcgguggcg

SEQ ID NO: 2863359 - RNA, 16 nt, Mycobacterium avium subsp. paratuberculosis
ucgucgaugccgaucg

SEQ ID NO: 2863360 - RNA, 17 nt, Mycobacterium avium subsp. paratuberculosis
ucgucgaugccgaucgg

SEQ ID NO: 2863361 - RNA, 20 nt, Mycobacterium avium subsp. paratuberculosis
ucgucgaugcgcagcagcgg

SEQ ID NO: 2863362 - RNA, 22 nt, Mycobacterium avium subsp. paratuberculosis
ucgucgaugcgcagcagcggcu

SEQ ID NO: 2863363 - RNA, 21 nt, Mycobacterium avium subsp. paratuberculosis
ucgucgauggccaccaggucc

SEQ ID NO: 2863364 - RNA, 15 nt, Mycobacterium avium subsp. paratuberculosis
ucgucgaugucggcg

SEQ ID NO: 2863365 - RNA, 17 nt, Mycobacterium avium subsp. paratuberculosis
ucgucgaugucggcggc

SEQ ID NO: 2863366 - RNA, 18 nt, Mycobacterium avium subsp. paratuberculosis
ucgucgaugucggcggcc

SEQ ID NO: 2863367 - RNA, 20 nt, Mycobacterium avium subsp. paratuberculosis
ucgucgcagugcccgcccag

SEQ ID NO: 2863368 - RNA, 20 nt, Mycobacterium avium subsp. paratuberculosis
ucgucgcccacccgccagcc

SEQ ID NO: 2863369 - RNA, 22 nt, Mycobacterium avium subsp. paratuberculosis
ucgucgcccaccgacgcggcgg

SEQ ID NO: 2863370 - RNA, 15 nt, Mycobacterium avium subsp. paratuberculosis
ucgucgcccaccgug

SEQ ID NO: 2863371 - RNA, 17 nt, Mycobacterium avium subsp. paratuberculosis
ucgucgcccaccguguu

SEQ ID NO: 2863372 - RNA, 12 nt, Mycobacterium avium subsp. paratuberculosis
ucgucgcccggc

SEQ ID NO: 2863373 - RNA, 15 nt, Mycobacterium avium subsp. paratuberculosis
ucgucgcccggcguc

SEQ ID NO: 2863374 - RNA, 22 nt, Mycobacterium avium subsp. paratuberculosis
ucgucgcccgucucggcgugcu

SEQ ID NO: 2863375 - RNA, 23 nt, Mycobacterium avium subsp. paratuberculosis
ucgucgcccugacacagcaccgg

SEQ ID NO: 2863376 - RNA, 14 nt, Mycobacterium avium subsp. paratuberculosis
ucgucgccgaccag

SEQ ID NO: 2863377 - RNA, 18 nt, Mycobacterium avium subsp. paratuberculosis
ucgucgccgaugcgccgc

SEQ ID NO: 2863378 - RNA, 15 nt, Mycobacterium avium subsp. paratuberculosis
ucgucgccgcgguag

SEQ ID NO: 2863379 - RNA, 13 nt, Mycobacterium avium subsp. paratuberculosis
ucgucgccggccg

SEQ ID NO: 2863380 - RNA, 15 nt, Mycobacterium avium subsp. paratuberculosis
ucgucgccggccgcc

SEQ ID NO: 2863381 - RNA, 14 nt, Mycobacterium avium subsp. paratuberculosis
ucgucgccgggcug

SEQ ID NO: 2863382 - RNA, 14 nt, Mycobacterium avium subsp. paratuberculosis
ucgucgccggugag

SEQ ID NO: 2863383 - RNA, 18 nt, Mycobacterium avium subsp. paratuberculosis
ucgucgccgguggccgcc

SEQ ID NO: 2863384 - RNA, 13 nt, Mycobacterium avium subsp. paratuberculosis
ucgucgcgcacca

SEQ ID NO: 2863385 - RNA, 19 nt, Mycobacterium avium subsp. paratuberculosis
ucgucgcgcaccagcucga

SEQ ID NO: 2863386 - RNA, 21 nt, Mycobacterium avium subsp. paratuberculosis
ucgucgcgcacccagccgcau

SEQ ID NO: 2863387 - RNA, 16 nt, Mycobacterium avium subsp. paratuberculosis
ucgucgcggcgcugcc

SEQ ID NO: 2863388 - RNA, 13 nt, Mycobacterium avium subsp. paratuberculosis
ucgucgcggcggc

SEQ ID NO: 2863389 - RNA, 12 nt, Mycobacterium avium subsp. paratuberculosis
ucgucgcgggcg

SEQ ID NO: 2863390 - RNA, 17 nt, Mycobacterium avium subsp. paratuberculosis
ucgucgcgggcgccgag

SEQ ID NO: 2863391 - RNA, 18 nt, Mycobacterium avium subsp. paratuberculosis
ucgucgcgguccacgccg

SEQ ID NO: 2863392 - RNA, 21 nt, Mycobacterium avium subsp. paratuberculosis
ucgucgcgguccacgccggcg

SEQ ID NO: 2863393 - RNA, 17 nt, Mycobacterium avium subsp. paratuberculosis
ucgucgcuaccucacca

SEQ ID NO: 2863394 - RNA, 23 nt, Mycobacterium avium subsp. paratuberculosis
ucgucgcuaccucaccacgugcc

SEQ ID NO: 2863395 - RNA, 14 nt, Mycobacterium avium subsp. paratuberculosis
ucgucgcuggccag

SEQ ID NO: 2863396 - RNA, 16 nt, Mycobacterium avium subsp. paratuberculosis
ucgucgcuggccaggu

SEQ ID NO: 2863397 - RNA, 15 nt, Mycobacterium avium subsp. paratuberculosis
ucgucggacagcagc

SEQ ID NO: 2863398 - RNA, 20 nt, Mycobacterium avium subsp. paratuberculosis
ucgucggacagcagcaccgg

SEQ ID NO: 2863399 - RNA, 21 nt, Mycobacterium avium subsp. paratuberculosis
ucgucggacagcagcaccggc

SEQ ID NO: 2863400 - RNA, 21 nt, Mycobacterium avium subsp. paratuberculosis
ucgucggagacguugccgcac

SEQ ID NO: 2863401 - RNA, 15 nt, Mycobacterium avium subsp. paratuberculosis
ucgucggcagcgacg

SEQ ID NO: 2863402 - RNA, 20 nt, Mycobacterium avium subsp. paratuberculosis
ucgucggcagcgacgcggug

SEQ ID NO: 2863403 - RNA, 13 nt, Mycobacterium avium subsp. paratuberculosis
ucgucggccacgc

SEQ ID NO: 2863404 - RNA, 14 nt, Mycobacterium avium subsp. paratuberculosis
ucgucggccagcga

SEQ ID NO: 2863405 - RNA, 20 nt, Mycobacterium avium subsp. paratuberculosis
ucgucggccgacucgaugcg

SEQ ID NO: 2863406 - RNA, 15 nt, Mycobacterium avium subsp. paratuberculosis
ucgucggccgcgacg

SEQ ID NO: 2863407 - RNA, 14 nt, Mycobacterium avium subsp. paratuberculosis
ucgucggccugcac

SEQ ID NO: 2863408 - RNA, 18 nt, Mycobacterium avium subsp. paratuberculosis
ucgucggccugcacgucg

SEQ ID NO: 2863409 - RNA, 23 nt, Mycobacterium avium subsp. paratuberculosis
ucgucggccugcacgucggcgcg

SEQ ID NO: 2863410 - RNA, 19 nt, Mycobacterium avium subsp. paratuberculosis
ucgucggcgaacagugcac

SEQ ID NO: 2863411 - RNA, 20 nt, Mycobacterium avium subsp. paratuberculosis
ucgucggcgaacggccaguc

SEQ ID NO: 2863412 - RNA, 21 nt, Mycobacterium avium subsp. paratuberculosis
ucgucggcgaagguguccucg

SEQ ID NO: 2863413 - RNA, 20 nt, Mycobacterium avium subsp. paratuberculosis
ucgucggcgagcagcagcgc

SEQ ID NO: 2863414 - RNA, 13 nt, Mycobacterium avium subsp. paratuberculosis
ucgucggcgaucg

SEQ ID NO: 2863415 - RNA, 12 nt, Mycobacterium avium subsp. paratuberculosis
ucgucggcgccg

SEQ ID NO: 2863416 - RNA, 15 nt, Mycobacterium avium subsp. paratuberculosis
ucgucggcgccgcgc

SEQ ID NO: 2863417 - RNA, 13 nt, Mycobacterium avium subsp. paratuberculosis
ucgucggcgccgg

SEQ ID NO: 2863418 - RNA, 15 nt, Mycobacterium avium subsp. paratuberculosis
ucgucggcgccggcg

SEQ ID NO: 2863419 - RNA, 15 nt, Mycobacterium avium subsp. paratuberculosis
ucgucggcgccgucg

SEQ ID NO: 2863420 - RNA, 21 nt, Mycobacterium avium subsp. paratuberculosis
ucgucggcgccgucgcgggag

SEQ ID NO: 2863421 - RNA, 15 nt, Mycobacterium avium subsp. paratuberculosis
ucgucggcgcgggcc

SEQ ID NO: 2863422 - RNA, 20 nt, Mycobacterium avium subsp. paratuberculosis
ucgucggcgcgggccagcag

SEQ ID NO: 2863423 - RNA, 13 nt, Mycobacterium avium subsp. paratuberculosis
ucgucggcgcggu

SEQ ID NO: 2863424 - RNA, 14 nt, Mycobacterium avium subsp. paratuberculosis
ucgucggcgcgucg

SEQ ID NO: 2863425 - RNA, 14 nt, Mycobacterium avium subsp. paratuberculosis
ucgucggcggacug

SEQ ID NO: 2863426 - RNA, 13 nt, Mycobacterium avium subsp. paratuberculosis
ucgucggcgggcu

SEQ ID NO: 2863427 - RNA, 13 nt, Mycobacterium avium subsp. paratuberculosis
ucgucggcggugc

SEQ ID NO: 2863428 - RNA, 14 nt, Mycobacterium avium subsp. paratuberculosis
ucgucggcggugcc

SEQ ID NO: 2863429 - RNA, 15 nt, Mycobacterium avium subsp. paratuberculosis
ucgucggcggugccg

SEQ ID NO: 2863430 - RNA, 22 nt, Mycobacterium avium subsp. paratuberculosis
ucgucggcggugccgagcccgc

SEQ ID NO: 2863431 - RNA, 14 nt, Mycobacterium avium subsp. paratuberculosis
ucgucggcgguuuc

SEQ ID NO: 2863432 - RNA, 23 nt, Mycobacterium avium subsp. paratuberculosis
ucgucggcucguguccgaugacg

SEQ ID NO: 2863433 - RNA, 19 nt, Mycobacterium avium subsp. paratuberculosis
ucgucgggaacgccgauca

SEQ ID NO: 2863434 - RNA, 18 nt, Mycobacterium avium subsp. paratuberculosis
ucgucgggaaugucggcg

SEQ ID NO: 2863435 - RNA, 19 nt, Mycobacterium avium subsp. paratuberculosis
ucgucgggcaccacggcgg

SEQ ID NO: 2863436 - RNA, 17 nt, Mycobacterium avium subsp. paratuberculosis
ucgucgggcaccagcac

SEQ ID NO: 2863437 - RNA, 20 nt, Mycobacterium avium subsp. paratuberculosis
ucgucgggcaccagcaccga

SEQ ID NO: 2863438 - RNA, 16 nt, Mycobacterium avium subsp. paratuberculosis
ucgucgggccgcagca

SEQ ID NO: 2863439 - RNA, 18 nt, Mycobacterium avium subsp. paratuberculosis
ucgucgggccgcagcacg

SEQ ID NO: 2863440 - RNA, 15 nt, Mycobacterium avium subsp. paratuberculosis
ucgugcggcgccgcc

SEQ ID NO: 2863441 - RNA, 19 nt, Mycobacterium avium subsp. paratuberculosis
ucgugcggcgccgcccggc

SEQ ID NO: 2863442 - RNA, 22 nt, Mycobacterium avium subsp. paratuberculosis
ucgugcggcgccgcccggcgau

SEQ ID NO: 2863443 - RNA, 13 nt, Mycobacterium avium subsp. paratuberculosis
ucgugcggcugcc

SEQ ID NO: 2863444 - RNA, 23 nt, Mycobacterium avium subsp. paratuberculosis
ucgugcucgagcaucucggugcc

SEQ ID NO: 2863445 - RNA, 17 nt, Mycobacterium avium subsp. paratuberculosis
ucgugcucggcgagcac

SEQ ID NO: 2863446 - RNA, 15 nt, Mycobacterium avium subsp. paratuberculosis
ucgugcucgucggcg

SEQ ID NO: 2863447 - RNA, 20 nt, Mycobacterium avium subsp. paratuberculosis
ucgugcucgucggcgggcac

SEQ ID NO: 2863448 - RNA, 19 nt, Mycobacterium avium subsp. paratuberculosis
ucguggaaaucgagcgcgc

SEQ ID NO: 2863449 - RNA, 22 nt, Mycobacterium avium subsp. paratuberculosis
ucguggaaaucgagcgcgcugu

SEQ ID NO: 2863450 - RNA, 14 nt, Mycobacterium avium subsp. paratuberculosis
ucguggaacgacgc

SEQ ID NO: 2863451 - RNA, 18 nt, Mycobacterium avium subsp. paratuberculosis
ucguggacaggaggacaa

SEQ ID NO: 2863452 - RNA, 18 nt, Mycobacterium avium subsp. paratuberculosis
ucguggacgaacgcggcg

SEQ ID NO: 2863453 - RNA, 15 nt, Mycobacterium avium subsp. paratuberculosis
ucguggauguugucg

SEQ ID NO: 2863454 - RNA, 18 nt, Mycobacterium avium subsp. paratuberculosis
ucguggcccugcucgucg

SEQ ID NO: 2863455 - RNA, 18 nt, Mycobacterium avium subsp. paratuberculosis
ucguggcgacaucgccgc

SEQ ID NO: 2863456 - RNA, 21 nt, Mycobacterium avium subsp. paratuberculosis
ucguggcgacaucgccgcggc

SEQ ID NO: 2863457 - RNA, 14 nt, Mycobacterium avium subsp. paratuberculosis
ucguggcgacgacg

SEQ ID NO: 2863458 - RNA, 17 nt, Mycobacterium avium subsp. paratuberculosis
ucguggcgcaucaccuu

SEQ ID NO: 2863459 - RNA, 21 nt, Mycobacterium avium subsp. paratuberculosis
ucguggcgggcccgggcgcug

SEQ ID NO: 2863460 - RNA, 15 nt, Mycobacterium avium subsp. paratuberculosis
ucguggcugaacagc

SEQ ID NO: 2863461 - RNA, 17 nt, Mycobacterium avium subsp. paratuberculosis
ucgugggaaugcggcug

SEQ ID NO: 2863462 - RNA, 23 nt, Mycobacterium avium subsp. paratuberculosis
ucgugggcaacacgucguccggc

SEQ ID NO: 2863463 - RNA, 17 nt, Mycobacterium avium subsp. paratuberculosis
ucgugggccaccacgua

SEQ ID NO: 2863464 - RNA, 20 nt, Mycobacterium avium subsp. paratuberculosis
ucguggguggucugcugggc

SEQ ID NO: 2863465 - RNA, 15 nt, Mycobacterium avium subsp. paratuberculosis
ucgugguaccggcgc

SEQ ID NO: 2863466 - RNA, 24 nt, Mycobacterium avium subsp. paratuberculosis
ucgugguaccggcgccaggccggc

SEQ ID NO: 2863467 - RNA, 20 nt, Mycobacterium avium subsp. paratuberculosis
ucguggucucgcaccugccg

SEQ ID NO: 2863468 - RNA, 18 nt, Mycobacterium avium subsp. paratuberculosis
ucguggugacgggcgucg

SEQ ID NO: 2863469 - RNA, 17 nt, Mycobacterium avium subsp. paratuberculosis
ucgugguucuccgcgac

SEQ ID NO: 2863470 - RNA, 17 nt, Mycobacterium avium subsp. paratuberculosis
ucgugucccggcgcccu

SEQ ID NO: 2863471 - RNA, 17 nt, Mycobacterium avium subsp. paratuberculosis
ucguguccgcgccggcg

SEQ ID NO: 2863472 - RNA, 18 nt, Mycobacterium avium subsp. paratuberculosis
ucguguccgcgccggcgc

SEQ ID NO: 2863473 - RNA, 16 nt, Mycobacterium avium subsp. paratuberculosis
ucguguccgggcccga

SEQ ID NO: 2863474 - RNA, 17 nt, Mycobacterium avium subsp. paratuberculosis
ucguguggcgcacgcug

SEQ ID NO: 2863475 - RNA, 20 nt, Mycobacterium avium subsp. paratuberculosis
ucgugugggcgcccgcggcg

SEQ ID NO: 2863476 - RNA, 23 nt, Mycobacterium avium subsp. paratuberculosis
ucgugugguacagcgccagcggc

SEQ ID NO: 2863477 - RNA, 19 nt, Mycobacterium avium subsp. paratuberculosis
ucguucagcugaacggugc

SEQ ID NO: 2863478 - RNA, 18 nt, Mycobacterium avium subsp. paratuberculosis
ucguucaugaucggcagg

SEQ ID NO: 2863479 - RNA, 16 nt, Mycobacterium avium subsp. paratuberculosis
ucguucggccagcacc

SEQ ID NO: 2863480 - RNA, 17 nt, Mycobacterium avium subsp. paratuberculosis
ucguucggccagcacca

SEQ ID NO: 2863481 - RNA, 16 nt, Mycobacterium avium subsp. paratuberculosis
ucguugaccgaggcga

SEQ ID NO: 2863482 - RNA, 20 nt, Mycobacterium avium subsp. paratuberculosis
ucguugaccgggucgccgau

SEQ ID NO: 2863483 - RNA, 19 nt, Mycobacterium avium subsp. paratuberculosis
ucguugacgcugggcggcg

SEQ ID NO: 2863484 - RNA, 21 nt, Mycobacterium avium subsp. paratuberculosis
ucguugagcacacacaggucg

SEQ ID NO: 2863485 - RNA, 17 nt, Mycobacterium avium subsp. paratuberculosis
ucguugagcaccacgag

SEQ ID NO: 2863486 - RNA, 13 nt, Mycobacterium avium subsp. paratuberculosis
ucguugagcaggc

SEQ ID NO: 2863487 - RNA, 22 nt, Mycobacterium avium subsp. paratuberculosis
ucguugagugcgcuguggugac

SEQ ID NO: 2863488 - RNA, 17 nt, Mycobacterium avium subsp. paratuberculosis
ucguugaucaggugcag

SEQ ID NO: 2863489 - RNA, 19 nt, Mycobacterium avium subsp. paratuberculosis
ucguugaugccgucgauca

SEQ ID NO: 2863490 - RNA, 21 nt, Mycobacterium avium subsp. paratuberculosis
ucguugauuagugcgucuuuu

SEQ ID NO: 2863491 - RNA, 13 nt, Mycobacterium avium subsp. paratuberculosis
ucguugcacacca

SEQ ID NO: 2863492 - RNA, 16 nt, Mycobacterium avium subsp. paratuberculosis
ucguugcacaccacca

SEQ ID NO: 2863493 - RNA, 19 nt, Mycobacterium avium subsp. paratuberculosis
ucguugcacaccaccagcg

SEQ ID NO: 2863494 - RNA, 22 nt, Mycobacterium avium subsp. paratuberculosis
ucguugcccugccugcugccca

SEQ ID NO: 2863495 - RNA, 15 nt, Mycobacterium avium subsp. paratuberculosis
ucguugccggcggcg

SEQ ID NO: 2863496 - RNA, 20 nt, Mycobacterium avium subsp. paratuberculosis
ucguugccggugccgacgau

SEQ ID NO: 2863497 - RNA, 18 nt, Mycobacterium avium subsp. paratuberculosis
ucguugcgccgccagggc

SEQ ID NO: 2863498 - RNA, 18 nt, Mycobacterium avium subsp. paratuberculosis
ucguugggcaugucgccg

SEQ ID NO: 2863499 - RNA, 14 nt, Mycobacterium avium subsp. paratuberculosis
ucguuggugcgcac

SEQ ID NO: 2863500 - RNA, 14 nt, Mycobacterium avium subsp. paratuberculosis
ucguugguggucga

SEQ ID NO: 2863501 - RNA, 21 nt, Mycobacterium avium subsp. paratuberculosis
ucguuggugucgaagcugcgc

SEQ ID NO: 2863502 - RNA, 21 nt, Mycobacterium avium subsp. paratuberculosis
ucguuguagcugauggcaccc

SEQ ID NO: 2863503 - RNA, 15 nt, Mycobacterium avium subsp. paratuberculosis
ucguuguccaccauc

SEQ ID NO: 2863504 - RNA, 19 nt, Mycobacterium avium subsp. paratuberculosis
ucguuguccaccaucaaca

SEQ ID NO: 2863505 - RNA, 13 nt, Mycobacterium avium subsp. paratuberculosis
ucguugucgucgc

SEQ ID NO: 2863506 - RNA, 20 nt, Mycobacterium avium subsp. paratuberculosis
ucguugugaauccagccgug

SEQ ID NO: 2863507 - RNA, 22 nt, Mycobacterium avium subsp. paratuberculosis
ucguugugaauccagccgugcg

SEQ ID NO: 2863508 - RNA, 20 nt, Mycobacterium avium subsp. paratuberculosis
ucuaacuguugucagccacu

SEQ ID NO: 2863509 - RNA, 16 nt, Mycobacterium avium subsp. paratuberculosis
ucuacgucggcuggcg

SEQ ID NO: 2863510 - RNA, 23 nt, Mycobacterium avium subsp. paratuberculosis
ucucacaggugacgacgcucuug

SEQ ID NO: 2863511 - RNA, 12 nt, Mycobacterium avium subsp. paratuberculosis
ucucacggcgaa

SEQ ID NO: 2863512 - RNA, 13 nt, Mycobacterium avium subsp. paratuberculosis
ucucagcggcgcu

SEQ ID NO: 2863513 - RNA, 18 nt, Mycobacterium avium subsp. paratuberculosis
ucucaggaauuugcggcc

SEQ ID NO: 2863514 - RNA, 13 nt, Mycobacterium avium subsp. paratuberculosis
ucucagucggcca

SEQ ID NO: 2863515 - RNA, 23 nt, Mycobacterium avium subsp. paratuberculosis
ucuccaacugcauuucggacggc

SEQ ID NO: 2863516 - RNA, 19 nt, Mycobacterium avium subsp. paratuberculosis
ucuccaccguguucaccag

SEQ ID NO: 2863517 - RNA, 12 nt, Mycobacterium avium subsp. paratuberculosis
ucuccacgcucg

SEQ ID NO: 2863518 - RNA, 12 nt, Mycobacterium avium subsp. paratuberculosis
ucuccagcagcu

SEQ ID NO: 2863519 - RNA, 13 nt, Mycobacterium avium subsp. paratuberculosis
ucuccagccgcgg

SEQ ID NO: 2863520 - RNA, 12 nt, Mycobacterium avium subsp. paratuberculosis
ucuccagcggcc

SEQ ID NO: 2863521 - RNA, 14 nt, Mycobacterium avium subsp. paratuberculosis
ucuccagcggccgc

SEQ ID NO: 2863522 - RNA, 12 nt, Mycobacterium avium subsp. paratuberculosis
ucuccagcuccg

SEQ ID NO: 2863523 - RNA, 19 nt, Mycobacterium avium subsp. paratuberculosis
ucuccagcuccgcggccag

SEQ ID NO: 2863524 - RNA, 20 nt, Mycobacterium avium subsp. paratuberculosis
ucucguagaagcucagcugc

SEQ ID NO: 2863525 - RNA, 14 nt, Mycobacterium avium subsp. paratuberculosis
ucucguagcccacc

SEQ ID NO: 2863526 - RNA, 18 nt, Mycobacterium avium subsp. paratuberculosis
ucucguagcccaccucga

SEQ ID NO: 2863527 - RNA, 13 nt, Mycobacterium avium subsp. paratuberculosis
ucucguagccgug

SEQ ID NO: 2863528 - RNA, 15 nt, Mycobacterium avium subsp. paratuberculosis
ucucgucccacggcg

SEQ ID NO: 2863529 - RNA, 13 nt, Mycobacterium avium subsp. paratuberculosis
ucucgucgacgau

SEQ ID NO: 2863530 - RNA, 21 nt, Mycobacterium avium subsp. paratuberculosis
ucucgucgacgauggcccgga

SEQ ID NO: 2863531 - RNA, 14 nt, Mycobacterium avium subsp. paratuberculosis
ucucgucgcggcug

SEQ ID NO: 2863532 - RNA, 19 nt, Mycobacterium avium subsp. paratuberculosis
ucucgucggcggcggccug

SEQ ID NO: 2863533 - RNA, 15 nt, Mycobacterium avium subsp. paratuberculosis
ucucgucgggccaca

SEQ ID NO: 2863534 - RNA, 12 nt, Mycobacterium avium subsp. paratuberculosis
ucucgucgucgg

SEQ ID NO: 2863535 - RNA, 15 nt, Mycobacterium avium subsp. paratuberculosis
ucucguugucgucgg

SEQ ID NO: 2863536 - RNA, 22 nt, Mycobacterium avium subsp. paratuberculosis
ucucuucgaugccgguggccuu

SEQ ID NO: 2863537 - RNA, 12 nt, Mycobacterium avium subsp. paratuberculosis
ucugaaagugac

SEQ ID NO: 2863538 - RNA, 18 nt, Mycobacterium avium subsp. paratuberculosis
ucugaaaugccgggccgg

SEQ ID NO: 2863539 - RNA, 15 nt, Mycobacterium avium subsp. paratuberculosis
ucugaauucggccac

SEQ ID NO: 2863540 - RNA, 16 nt, Mycobacterium avium subsp. paratuberculosis
ucugaccgagcagcgg

SEQ ID NO: 2863541 - RNA, 15 nt, Mycobacterium avium subsp. paratuberculosis
ucugagcccgggcag

SEQ ID NO: 2863542 - RNA, 18 nt, Mycobacterium avium subsp. paratuberculosis
ucugagcccgggcaggcg

SEQ ID NO: 2863543 - RNA, 18 nt, Mycobacterium avium subsp. paratuberculosis
ucugaucgcccagcaccg

SEQ ID NO: 2863544 - RNA, 20 nt, Mycobacterium avium subsp. paratuberculosis
ucugcacagcuucggcgccg

SEQ ID NO: 2863545 - RNA, 12 nt, Mycobacterium avium subsp. paratuberculosis
ucugcaccagcg

SEQ ID NO: 2863546 - RNA, 16 nt, Mycobacterium avium subsp. paratuberculosis
ucugcaccagcgcgga

SEQ ID NO: 2863547 - RNA, 15 nt, Mycobacterium avium subsp. paratuberculosis
ucugcaccagcgugg

SEQ ID NO: 2863548 - RNA, 23 nt, Mycobacterium avium subsp. paratuberculosis
ucugcaccagcguggugcgcccg

SEQ ID NO: 2863549 - RNA, 18 nt, Mycobacterium avium subsp. paratuberculosis
ucugcacgacgaacacca

SEQ ID NO: 2863550 - RNA, 21 nt, Mycobacterium avium subsp. paratuberculosis
ucugcacgaugccgaccaaca

SEQ ID NO: 2863551 - RNA, 20 nt, Mycobacterium avium subsp. paratuberculosis
ucugcacgucggcggccgcg

SEQ ID NO: 2863552 - RNA, 18 nt, Mycobacterium avium subsp. paratuberculosis
ucugcacucagagcagcg

SEQ ID NO: 2863553 - RNA, 23 nt, Mycobacterium avium subsp. paratuberculosis
ucugcagagcggugacaucgcca

SEQ ID NO: 2863554 - RNA, 23 nt, Mycobacterium avium subsp. paratuberculosis
ucugcagcgacggaucggccgcg

SEQ ID NO: 2863555 - RNA, 16 nt, Mycobacterium avium subsp. paratuberculosis
ucugcagcucgcugag

SEQ ID NO: 2863556 - RNA, 17 nt, Mycobacterium avium subsp. paratuberculosis
ucugcaggccgaggcug

SEQ ID NO: 2863557 - RNA, 18 nt, Mycobacterium avium subsp. paratuberculosis
ucugcaggguuuccucga

SEQ ID NO: 2863558 - RNA, 13 nt, Mycobacterium avium subsp. paratuberculosis
ucugccacgccca

SEQ ID NO: 2863559 - RNA, 14 nt, Mycobacterium avium subsp. paratuberculosis
ucugccacgcccac

SEQ ID NO: 2863560 - RNA, 14 nt, Mycobacterium avium subsp. paratuberculosis
ucugccacggcgga

SEQ ID NO: 2863561 - RNA, 16 nt, Mycobacterium avium subsp. paratuberculosis
ucugccacucgucgau

SEQ ID NO: 2863562 - RNA, 11 nt, Mycobacterium avium subsp. paratuberculosis
ucugcccgacc

SEQ ID NO: 2863563 - RNA, 17 nt, Mycobacterium avium subsp. paratuberculosis
ucugcccggccagcagg

SEQ ID NO: 2863564 - RNA, 13 nt, Mycobacterium avium subsp. paratuberculosis
ucugcccugcacu

SEQ ID NO: 2863565 - RNA, 14 nt, Mycobacterium avium subsp. paratuberculosis
ucugccggccgccg

SEQ ID NO: 2863566 - RNA, 14 nt, Mycobacterium avium subsp. paratuberculosis
ucugccgggccgca

SEQ ID NO: 2863567 - RNA, 16 nt, Mycobacterium avium subsp. paratuberculosis
ucugccgggccgcauc

SEQ ID NO: 2863568 - RNA, 20 nt, Mycobacterium avium subsp. paratuberculosis
ucugccgggcggcgacgucg

SEQ ID NO: 2863569 - RNA, 20 nt, Mycobacterium avium subsp. paratuberculosis
ucugccuacuugcggccgcg

SEQ ID NO: 2863570 - RNA, 13 nt, Mycobacterium avium subsp. paratuberculosis
ucugccugcagga

SEQ ID NO: 2863571 - RNA, 20 nt, Mycobacterium avium subsp. paratuberculosis
ucugccuugcugacgccgcg

SEQ ID NO: 2863572 - RNA, 17 nt, Mycobacterium avium subsp. paratuberculosis
ucugcgaccacccggac

SEQ ID NO: 2863573 - RNA, 20 nt, Mycobacterium avium subsp. paratuberculosis
ucugcgagaugcccacccgc

SEQ ID NO: 2863574 - RNA, 20 nt, Mycobacterium avium subsp. paratuberculosis
ucugcgccagcuccagcagc

SEQ ID NO: 2863575 - RNA, 21 nt, Mycobacterium avium subsp. paratuberculosis
ucugcgccagcuccagcagcc

SEQ ID NO: 2863576 - RNA, 22 nt, Mycobacterium avium subsp. paratuberculosis
ucugcgccagcuccagcagccc

SEQ ID NO: 2863577 - RNA, 22 nt, Mycobacterium avium subsp. paratuberculosis
ucugcgccagcuggguggucac

SEQ ID NO: 2863578 - RNA, 13 nt, Mycobacterium avium subsp. paratuberculosis
ucugcgccccggc

SEQ ID NO: 2863579 - RNA, 14 nt, Mycobacterium avium subsp. paratuberculosis
ucugcgccccggcg

SEQ ID NO: 2863580 - RNA, 16 nt, Mycobacterium avium subsp. paratuberculosis
ucugcgccccggcguc

SEQ ID NO: 2863581 - RNA, 17 nt, Mycobacterium avium subsp. paratuberculosis
ucugcgccccggcgucg

SEQ ID NO: 2863582 - RNA, 17 nt, Mycobacterium avium subsp. paratuberculosis
ucugcgccgucaccggc

SEQ ID NO: 2863583 - RNA, 20 nt, Mycobacterium avium subsp. paratuberculosis
ucugcgccgugaagggcccg

SEQ ID NO: 2863584 - RNA, 21 nt, Mycobacterium avium subsp. paratuberculosis
ucugcgccuuuugcacccgcc

SEQ ID NO: 2863585 - RNA, 14 nt, Mycobacterium avium subsp. paratuberculosis
ucugcgcgccgucg

SEQ ID NO: 2863586 - RNA, 16 nt, Mycobacterium avium subsp. paratuberculosis
ucugcgcgcggugcac

SEQ ID NO: 2863587 - RNA, 22 nt, Mycobacterium avium subsp. paratuberculosis
ucugcggaccaucuacgaccuc

SEQ ID NO: 2863588 - RNA, 13 nt, Mycobacterium avium subsp. paratuberculosis
ucugcggccgcga

SEQ ID NO: 2863589 - RNA, 14 nt, Mycobacterium avium subsp. paratuberculosis
ucugcggcucggcg

SEQ ID NO: 2863590 - RNA, 17 nt, Mycobacterium avium subsp. paratuberculosis
ucugcggcucggcgcug

SEQ ID NO: 2863591 - RNA, 21 nt, Mycobacterium avium subsp. paratuberculosis
ucugcgggaagcccaccgcgg

SEQ ID NO: 2863592 - RNA, 21 nt, Mycobacterium avium subsp. paratuberculosis
ucugcggugagcguagcccua

SEQ ID NO: 2863593 - RNA, 15 nt, Mycobacterium avium subsp. paratuberculosis
ucugcggugcgccca

SEQ ID NO: 2863594 - RNA, 18 nt, Mycobacterium avium subsp. paratuberculosis
ucugcggugcgcccaggu

SEQ ID NO: 2863595 - RNA, 12 nt, Mycobacterium avium subsp. paratuberculosis
ucugcucgaucu

SEQ ID NO: 2863596 - RNA, 17 nt, Mycobacterium avium subsp. paratuberculosis
ucugcucgccagacuca

SEQ ID NO: 2863597 - RNA, 21 nt, Mycobacterium avium subsp. paratuberculosis
ucugcucgccagacucacggc

SEQ ID NO: 2863598 - RNA, 12 nt, Mycobacterium avium subsp. paratuberculosis
ucugcucgccgg

SEQ ID NO: 2863599 - RNA, 13 nt, Mycobacterium avium subsp. paratuberculosis
ucugcucggcggg

SEQ ID NO: 2863600 - RNA, 14 nt, Mycobacterium avium subsp. paratuberculosis
ucugcucggcgggu

SEQ ID NO: 2863601 - RNA, 12 nt, Mycobacterium avium subsp. paratuberculosis
ucugcucggcgu

SEQ ID NO: 2863602 - RNA, 22 nt, Mycobacterium avium subsp. paratuberculosis
ucugcucgugcaaaccggaccg

SEQ ID NO: 2863603 - RNA, 17 nt, Mycobacterium avium subsp. paratuberculosis
ucugcuggauggucucg

SEQ ID NO: 2863604 - RNA, 22 nt, Mycobacterium avium subsp. paratuberculosis
ucugcuugaugaugucggcggc

SEQ ID NO: 2863605 - RNA, 21 nt, Mycobacterium avium subsp. paratuberculosis
ucuggaacgcgaaguccgacg

SEQ ID NO: 2863606 - RNA, 20 nt, Mycobacterium avium subsp. paratuberculosis
ucuggaagccuggcacgacg

SEQ ID NO: 2863607 - RNA, 22 nt, Mycobacterium avium subsp. paratuberculosis
ucuggaagccuggcacgacgcc

SEQ ID NO: 2863608 - RNA, 17 nt, Mycobacterium avium subsp. paratuberculosis
ucuggcagccggccggc

SEQ ID NO: 2863609 - RNA, 12 nt, Mycobacterium avium subsp. paratuberculosis
ucuuggccggag

SEQ ID NO: 2863610 - RNA, 18 nt, Mycobacterium avium subsp. paratuberculosis
ucuuggcgagcugaccgg

SEQ ID NO: 2863611 - RNA, 22 nt, Mycobacterium avium subsp. paratuberculosis
ucuuggcgagcugaccggccac

SEQ ID NO: 2863612 - RNA, 14 nt, Mycobacterium avium subsp. paratuberculosis
ucuuggcggcggcc

SEQ ID NO: 2863613 - RNA, 17 nt, Mycobacterium avium subsp. paratuberculosis
ucuugggacuggauggc

SEQ ID NO: 2863614 - RNA, 15 nt, Mycobacterium avium subsp. paratuberculosis
ucuuggucagccgcg

SEQ ID NO: 2863615 - RNA, 14 nt, Mycobacterium avium subsp. paratuberculosis
ucuuggucagcggc

SEQ ID NO: 2863616 - RNA, 15 nt, Mycobacterium avium subsp. paratuberculosis
ucuuggucagcggca

SEQ ID NO: 2863617 - RNA, 16 nt, Mycobacterium avium subsp. paratuberculosis
ucuuggucagcggcag

SEQ ID NO: 2863618 - RNA, 17 nt, Mycobacterium avium subsp. paratuberculosis
ucuuguacaugucgucg

SEQ ID NO: 2863619 - RNA, 16 nt, Mycobacterium avium subsp. paratuberculosis
ucuuguccucgaagau

SEQ ID NO: 2863620 - RNA, 23 nt, Mycobacterium avium subsp. paratuberculosis
ucuugucggggaagggcgcgucg

SEQ ID NO: 2863621 - RNA, 16 nt, Mycobacterium avium subsp. paratuberculosis
ucuuguugaccuucuc

SEQ ID NO: 2863622 - RNA, 13 nt, Mycobacterium avium subsp. paratuberculosis
ucuuugccggcca

SEQ ID NO: 2863623 - RNA, 14 nt, Mycobacterium avium subsp. paratuberculosis
ucuuugcggccgug

SEQ ID NO: 2863624 - RNA, 15 nt, Mycobacterium avium subsp. paratuberculosis
ugaaaccggccagca

SEQ ID NO: 2863625 - RNA, 18 nt, Mycobacterium avium subsp. paratuberculosis
ugaaaccggccagcagca

SEQ ID NO: 2863626 - RNA, 19 nt, Mycobacterium avium subsp. paratuberculosis
ugaaacuaacuucacgcuc

SEQ ID NO: 2863627 - RNA, 20 nt, Mycobacterium avium subsp. paratuberculosis
ugaaacuaacuucacgcucg

SEQ ID NO: 2863628 - RNA, 19 nt, Mycobacterium avium subsp. paratuberculosis
ugaaacuagcuucacgcuc

SEQ ID NO: 2863629 - RNA, 20 nt, Mycobacterium avium subsp. paratuberculosis
ugaaacuagcuucacgcucg

SEQ ID NO: 2863630 - RNA, 19 nt, Mycobacterium avium subsp. paratuberculosis
ugaaacuagcuucacguuc

SEQ ID NO: 2863631 - RNA, 20 nt, Mycobacterium avium subsp. paratuberculosis
ugaaacuagcuucacguucg

SEQ ID NO: 2863632 - RNA, 18 nt, Mycobacterium avium subsp. paratuberculosis
ugaacaccaccaggccgu

SEQ ID NO: 2863633 - RNA, 21 nt, Mycobacterium avium subsp. paratuberculosis
ugaacaccgcguuggccgcca

SEQ ID NO: 2863634 - RNA, 12 nt, Mycobacterium avium subsp. paratuberculosis
ugaacagcaccc

SEQ ID NO: 2863635 - RNA, 18 nt, Mycobacterium avium subsp. paratuberculosis
ugaacagcacgugcccgc

SEQ ID NO: 2863636 - RNA, 22 nt, Mycobacterium avium subsp. paratuberculosis
ugaacagcacgugcccgccgug

SEQ ID NO: 2863637 - RNA, 13 nt, Mycobacterium avium subsp. paratuberculosis
ugaacagcagcag

SEQ ID NO: 2863638 - RNA, 18 nt, Mycobacterium avium subsp. paratuberculosis
ugaacagcagcagcagcg

SEQ ID NO: 2863639 - RNA, 15 nt, Mycobacterium avium subsp. paratuberculosis
ugaacagcgcccggc

SEQ ID NO: 2863640 - RNA, 20 nt, Mycobacterium avium subsp. paratuberculosis
ugaacagcgcccggccguga

SEQ ID NO: 2863641 - RNA, 15 nt, Mycobacterium avium subsp. paratuberculosis
ugaacaucggccggg

SEQ ID NO: 2863642 - RNA, 20 nt, Mycobacterium avium subsp. paratuberculosis
ugaacaugcccugcacgauc

SEQ ID NO: 2863643 - RNA, 18 nt, Mycobacterium avium subsp. paratuberculosis
ugaaccgcgacgcgaucg

SEQ ID NO: 2863644 - RNA, 16 nt, Mycobacterium avium subsp. paratuberculosis
ugaaccgcugcugcuc

SEQ ID NO: 2863645 - RNA, 21 nt, Mycobacterium avium subsp. paratuberculosis
ugaaccgcugcugcucggccg

SEQ ID NO: 2863646 - RNA, 22 nt, Mycobacterium avium subsp. paratuberculosis
ugaaccgcugcugcucggccgc

SEQ ID NO: 2863647 - RNA, 13 nt, Mycobacterium avium subsp. paratuberculosis
ugaaccuggccac

SEQ ID NO: 2863648 - RNA, 18 nt, Mycobacterium avium subsp. paratuberculosis
ugaaccuggccaccagca

SEQ ID NO: 2863649 - RNA, 19 nt, Mycobacterium avium subsp. paratuberculosis
ugaaccuggccaccagcag

SEQ ID NO: 2863650 - RNA, 13 nt, Mycobacterium avium subsp. paratuberculosis
ugaacgaggccgc

SEQ ID NO: 2863651 - RNA, 15 nt, Mycobacterium avium subsp. paratuberculosis
ugaacgaggccgcgc

SEQ ID NO: 2863652 - RNA, 17 nt, Mycobacterium avium subsp. paratuberculosis
ugaacgcacucggugug

SEQ ID NO: 2863653 - RNA, 15 nt, Mycobacterium avium subsp. paratuberculosis
ugaacgccagcagcc

SEQ ID NO: 2863654 - RNA, 15 nt, Mycobacterium avium subsp. paratuberculosis
ugaacgccgccaaca

SEQ ID NO: 2863655 - RNA, 19 nt, Mycobacterium avium subsp. paratuberculosis
ugaacgccgccaacagguu

SEQ ID NO: 2863656 - RNA, 13 nt, Mycobacterium avium subsp. paratuberculosis
ugaacgccgcguc

SEQ ID NO: 2863657 - RNA, 15 nt, Mycobacterium avium subsp. paratuberculosis
ugaacgccgcguccu

SEQ ID NO: 2863658 - RNA, 21 nt, Mycobacterium avium subsp. paratuberculosis
ugaacgccgcguccucgucga

SEQ ID NO: 2863659 - RNA, 16 nt, Mycobacterium avium subsp. paratuberculosis
ugaacgccucgggccg

SEQ ID NO: 2863660 - RNA, 19 nt, Mycobacterium avium subsp. paratuberculosis
ugaacgccugccggcgccg

SEQ ID NO: 2863661 - RNA, 16 nt, Mycobacterium avium subsp. paratuberculosis
ugaacgcgccgucguc

SEQ ID NO: 2863662 - RNA, 21 nt, Mycobacterium avium subsp. paratuberculosis
ugaacgcguacagcgcccgga

SEQ ID NO: 2863663 - RNA, 19 nt, Mycobacterium avium subsp. paratuberculosis
ugaacggcaccccgcgguc

SEQ ID NO: 2863664 - RNA, 18 nt, Mycobacterium avium subsp. paratuberculosis
ugaacggcagcucgucga

SEQ ID NO: 2863665 - RNA, 14 nt, Mycobacterium avium subsp. paratuberculosis
ugaacgggaugaac

SEQ ID NO: 2863666 - RNA, 17 nt, Mycobacterium avium subsp. paratuberculosis
ugaacgggcagccacgc

SEQ ID NO: 2863667 - RNA, 12 nt, Mycobacterium avium subsp. paratuberculosis
ugaacgggccgc

SEQ ID NO: 2863668 - RNA, 21 nt, Mycobacterium avium subsp. paratuberculosis
ugaacgucccguuggucucga

SEQ ID NO: 2863669 - RNA, 18 nt, Mycobacterium avium subsp. paratuberculosis
ugaacuccgacuccagca

SEQ ID NO: 2863670 - RNA, 16 nt, Mycobacterium avium subsp. paratuberculosis
ugaacucgccgaucgg

SEQ ID NO: 2863671 - RNA, 15 nt, Mycobacterium avium subsp. paratuberculosis
ugaacucgcgggcga

SEQ ID NO: 2863672 - RNA, 14 nt, Mycobacterium avium subsp. paratuberculosis
ugaacugccgcggc

SEQ ID NO: 2863673 - RNA, 16 nt, Mycobacterium avium subsp. paratuberculosis
ugaacugguuccacac

SEQ ID NO: 2863674 - RNA, 20 nt, Mycobacterium avium subsp. paratuberculosis
ugaacugguuccacaccacc

SEQ ID NO: 2863675 - RNA, 14 nt, Mycobacterium avium subsp. paratuberculosis
ugaacuguuuuucc

SEQ ID NO: 2863676 - RNA, 20 nt, Mycobacterium avium subsp. paratuberculosis
ugaacuguuuuuccgccgga

SEQ ID NO: 2863677 - RNA, 19 nt, Mycobacterium avium subsp. paratuberculosis
ugaacuuaacuucacgcuc

SEQ ID NO: 2863678 - RNA, 20 nt, Mycobacterium avium subsp. paratuberculosis
ugaacuuaacuucacgcucg

SEQ ID NO: 2863679 - RNA, 21 nt, Mycobacterium avium subsp. paratuberculosis
ugaagaauuccaugucgucga

SEQ ID NO: 2863680 - RNA, 17 nt, Mycobacterium avium subsp. paratuberculosis
ugaagaucagcaccguc

SEQ ID NO: 2863681 - RNA, 18 nt, Mycobacterium avium subsp. paratuberculosis
ugaagaucagcaccgucc

SEQ ID NO: 2863682 - RNA, 18 nt, Mycobacterium avium subsp. paratuberculosis
ugaagaucagcgaaggca

SEQ ID NO: 2863683 - RNA, 22 nt, Mycobacterium avium subsp. paratuberculosis
ugaagaucagcgaaggcauggg

SEQ ID NO: 2863684 - RNA, 15 nt, Mycobacterium avium subsp. paratuberculosis
ugaagaucagcgcgu

SEQ ID NO: 2863685 - RNA, 15 nt, Mycobacterium avium subsp. paratuberculosis
ugaagcccaccgccg

SEQ ID NO: 2863686 - RNA, 21 nt, Mycobacterium avium subsp. paratuberculosis
ugaagccccggaccggagacg

SEQ ID NO: 2863687 - RNA, 11 nt, Mycobacterium avium subsp. paratuberculosis
ugaagcccugc

SEQ ID NO: 2863688 - RNA, 15 nt, Mycobacterium avium subsp. paratuberculosis
ugaagccgacgccgu

SEQ ID NO: 2863689 - RNA, 19 nt, Mycobacterium avium subsp. paratuberculosis
ugaagccggcgaacuccac

SEQ ID NO: 2863690 - RNA, 13 nt, Mycobacterium avium subsp. paratuberculosis
ugaagccggugag

SEQ ID NO: 2863691 - RNA, 13 nt, Mycobacterium avium subsp. paratuberculosis
ugaagccgugccc

SEQ ID NO: 2863692 - RNA, 17 nt, Mycobacterium avium subsp. paratuberculosis
ugaagcgggacagcaau

SEQ ID NO: 2863693 - RNA, 19 nt, Mycobacterium avium subsp. paratuberculosis
ugaagcuagcuucacgcuc

SEQ ID NO: 2863694 - RNA, 19 nt, Mycobacterium avium subsp. paratuberculosis
ugacccggccgugcgcagc

SEQ ID NO: 2863695 - RNA, 22 nt, Mycobacterium avium subsp. paratuberculosis
ugacccggccguugggccagcg

SEQ ID NO: 2863696 - RNA, 21 nt, Mycobacterium avium subsp. paratuberculosis
ugacccgggcggccugcugca

SEQ ID NO: 2863697 - RNA, 16 nt, Mycobacterium avium subsp. paratuberculosis
ugacccggucgcggcc

SEQ ID NO: 2863698 - RNA, 17 nt, Mycobacterium avium subsp. paratuberculosis
ugacccggucgcggccg

SEQ ID NO: 2863699 - RNA, 18 nt, Mycobacterium avium subsp. paratuberculosis
ugacccggucgcggccgu

SEQ ID NO: 2863700 - RNA, 19 nt, Mycobacterium avium subsp. paratuberculosis
ugacccggucgcggccgua

SEQ ID NO: 2863701 - RNA, 14 nt, Mycobacterium avium subsp. paratuberculosis
ugacccucagcagg

SEQ ID NO: 2863702 - RNA, 22 nt, Mycobacterium avium subsp. paratuberculosis
ugaccgacagcaaaccgaccgc

SEQ ID NO: 2863703 - RNA, 23 nt, Mycobacterium avium subsp. paratuberculosis
ugaccgacagcaaaccgaccgcc

SEQ ID NO: 2863704 - RNA, 18 nt, Mycobacterium avium subsp. paratuberculosis
ugaccgacauggccagca

SEQ ID NO: 2863705 - RNA, 22 nt, Mycobacterium avium subsp. paratuberculosis
ugaccgacauggccagcaccau

SEQ ID NO: 2863706 - RNA, 22 nt, Mycobacterium avium subsp. paratuberculosis
ugaccgaccuccaaugcgcccu

SEQ ID NO: 2863707 - RNA, 17 nt, Mycobacterium avium subsp. paratuberculosis
ugaccgacgacgugacg

SEQ ID NO: 2863708 - RNA, 19 nt, Mycobacterium avium subsp. paratuberculosis
ugaccgacgacgugacgac

SEQ ID NO: 2863709 - RNA, 13 nt, Mycobacterium avium subsp. paratuberculosis
ugaccgacgccuc

SEQ ID NO: 2863710 - RNA, 15 nt, Mycobacterium avium subsp. paratuberculosis
ugaccgagcggcgcu

SEQ ID NO: 2863711 - RNA, 18 nt, Mycobacterium avium subsp. paratuberculosis
ugaccgagcggcgcugca

SEQ ID NO: 2863712 - RNA, 15 nt, Mycobacterium avium subsp. paratuberculosis
ugaccgaggccgccc

SEQ ID NO: 2863713 - RNA, 21 nt, Mycobacterium avium subsp. paratuberculosis
ugaccgaggcgaucgcggcca

SEQ ID NO: 2863714 - RNA, 24 nt, Mycobacterium avium subsp. paratuberculosis
ugaccgagucgucgcgcaccagcu

SEQ ID NO: 2863715 - RNA, 14 nt, Mycobacterium avium subsp. paratuberculosis
ugaccgcagccuuc

SEQ ID NO: 2863716 - RNA, 15 nt, Mycobacterium avium subsp. paratuberculosis
ugaccgccagcaccg

SEQ ID NO: 2863717 - RNA, 18 nt, Mycobacterium avium subsp. paratuberculosis
ugaccgccauugucauca

SEQ ID NO: 2863718 - RNA, 14 nt, Mycobacterium avium subsp. paratuberculosis
ugaccgccgacacc

SEQ ID NO: 2863719 - RNA, 18 nt, Mycobacterium avium subsp. paratuberculosis
ugaccgccgacaccaccg

SEQ ID NO: 2863720 - RNA, 15 nt, Mycobacterium avium subsp. paratuberculosis
ugaccgccucgucga

SEQ ID NO: 2863721 - RNA, 20 nt, Mycobacterium avium subsp. paratuberculosis
ugaccgccugcuugaugaug

SEQ ID NO: 2863722 - RNA, 15 nt, Mycobacterium avium subsp. paratuberculosis
ugaccgcgacgcugc

SEQ ID NO: 2863723 - RNA, 15 nt, Mycobacterium avium subsp. paratuberculosis
ugaccgcgccgcggg

SEQ ID NO: 2863724 - RNA, 16 nt, Mycobacterium avium subsp. paratuberculosis
ugaccgcgccgcgggu

SEQ ID NO: 2863725 - RNA, 17 nt, Mycobacterium avium subsp. paratuberculosis
ugaccgcggcgauggug

SEQ ID NO: 2863726 - RNA, 14 nt, Mycobacterium avium subsp. paratuberculosis
ugaccgcgucggcg

SEQ ID NO: 2863727 - RNA, 19 nt, Mycobacterium avium subsp. paratuberculosis
ugaccgcgucggcgccgua

SEQ ID NO: 2863728 - RNA, 17 nt, Mycobacterium avium subsp. paratuberculosis
ugaccggaucggccagc

SEQ ID NO: 2863729 - RNA, 13 nt, Mycobacterium avium subsp. paratuberculosis
ugaccggccaccu

SEQ ID NO: 2863730 - RNA, 13 nt, Mycobacterium avium subsp. paratuberculosis
ugaccggcccggc

SEQ ID NO: 2863731 - RNA, 18 nt, Mycobacterium avium subsp. paratuberculosis
ugaccggcccggcggccg

SEQ ID NO: 2863732 - RNA, 23 nt, Mycobacterium avium subsp. paratuberculosis
ugaccggcccggcggccggccgc

SEQ ID NO: 2863733 - RNA, 20 nt, Mycobacterium avium subsp. paratuberculosis
ugaccggccggucgaaggcc

SEQ ID NO: 2863734 - RNA, 21 nt, Mycobacterium avium subsp. paratuberculosis
ugaccggccugcagcgcgguc

SEQ ID NO: 2863735 - RNA, 15 nt, Mycobacterium avium subsp. paratuberculosis
ugaccggcgccgggu

SEQ ID NO: 2863736 - RNA, 17 nt, Mycobacterium avium subsp. paratuberculosis
ugaccggcgccgggucg

SEQ ID NO: 2863737 - RNA, 15 nt, Mycobacterium avium subsp. paratuberculosis
ugaccggcgcgcccg

SEQ ID NO: 2863738 - RNA, 15 nt, Mycobacterium avium subsp. paratuberculosis
ugaccggcggccagc

SEQ ID NO: 2863739 - RNA, 16 nt, Mycobacterium avium subsp. paratuberculosis
ugaccggcggccagcg

SEQ ID NO: 2863740 - RNA, 20 nt, Mycobacterium avium subsp. paratuberculosis
ugaccggcggugccggccag

SEQ ID NO: 2863741 - RNA, 18 nt, Mycobacterium avium subsp. paratuberculosis
ugaccggcucgccggcgc

SEQ ID NO: 2863742 - RNA, 23 nt, Mycobacterium avium subsp. paratuberculosis
ugaccggcucgccggcgcgcacc

SEQ ID NO: 2863743 - RNA, 17 nt, Mycobacterium avium subsp. paratuberculosis
ugaccggugcgcccgcg

SEQ ID NO: 2863744 - RNA, 20 nt, Mycobacterium avium subsp. paratuberculosis
ugaccggugcgcccgcgauc

SEQ ID NO: 2863745 - RNA, 20 nt, Mycobacterium avium subsp. paratuberculosis
ugaccguacucgugggccac

SEQ ID NO: 2863746 - RNA, 22 nt, Mycobacterium avium subsp. paratuberculosis
ugaccgucacccccggcgcgac

SEQ ID NO: 2863747 - RNA, 14 nt, Mycobacterium avium subsp. paratuberculosis
ugaccgucgccgac

SEQ ID NO: 2863748 - RNA, 15 nt, Mycobacterium avium subsp. paratuberculosis
ugaccgucgccgacc

SEQ ID NO: 2863749 - RNA, 13 nt, Mycobacterium avium subsp. paratuberculosis
ugaccgucguugc

SEQ ID NO: 2863750 - RNA, 14 nt, Mycobacterium avium subsp. paratuberculosis
ugaccgugcuuggc

SEQ ID NO: 2863751 - RNA, 18 nt, Mycobacterium avium subsp. paratuberculosis
ugaccucgacacgggccg

SEQ ID NO: 2863752 - RNA, 18 nt, Mycobacterium avium subsp. paratuberculosis
ugaccucgagcaccggcg

SEQ ID NO: 2863753 - RNA, 16 nt, Mycobacterium avium subsp. paratuberculosis
ugaccucgagcagcgc

SEQ ID NO: 2863754 - RNA, 20 nt, Mycobacterium avium subsp. paratuberculosis
ugaccucgagcagcgcgcgc

SEQ ID NO: 2863755 - RNA, 15 nt, Mycobacterium avium subsp. paratuberculosis
ugaccucgcacagcu

SEQ ID NO: 2863756 - RNA, 18 nt, Mycobacterium avium subsp. paratuberculosis
ugaccucgcgcagccccc

SEQ ID NO: 2863757 - RNA, 16 nt, Mycobacterium avium subsp. paratuberculosis
ugaccucgcgcccggc

SEQ ID NO: 2863758 - RNA, 17 nt, Mycobacterium avium subsp. paratuberculosis
ugaccucgcgcccggcg

SEQ ID NO: 2863759 - RNA, 22 nt, Mycobacterium avium subsp. paratuberculosis
ugaccucgcgcccggcgccggc

SEQ ID NO: 2863760 - RNA, 15 nt, Mycobacterium avium subsp. paratuberculosis
ugaccucgcgccgcg

SEQ ID NO: 2863761 - RNA, 16 nt, Mycobacterium avium subsp. paratuberculosis
ugaccucgcgccgcga

SEQ ID NO: 2863762 - RNA, 22 nt, Mycobacterium avium subsp. paratuberculosis
ugaccucgucgggcgccagccc

SEQ ID NO: 2863763 - RNA, 15 nt, Mycobacterium avium subsp. paratuberculosis
ugaccugcagcgccu

SEQ ID NO: 2863764 - RNA, 11 nt, Mycobacterium avium subsp. paratuberculosis
ugaccugcgga

SEQ ID NO: 2863765 - RNA, 20 nt, Mycobacterium avium subsp. paratuberculosis
ugaccugcggaucgcgggcg

SEQ ID NO: 2863766 - RNA, 15 nt, Mycobacterium avium subsp. paratuberculosis
ugaccugcugggcgg

SEQ ID NO: 2863767 - RNA, 20 nt, Mycobacterium avium subsp. paratuberculosis
ugaccugcuugagcccgucg

SEQ ID NO: 2863768 - RNA, 16 nt, Mycobacterium avium subsp. paratuberculosis
ugaccuucucccgcgg

SEQ ID NO: 2863769 - RNA, 16 nt, Mycobacterium avium subsp. paratuberculosis
ugaccuugcgggcggu

SEQ ID NO: 2863770 - RNA, 20 nt, Mycobacterium avium subsp. paratuberculosis
ugaccuugcgggcggucagc

SEQ ID NO: 2863771 - RNA, 20 nt, Mycobacterium avium subsp. paratuberculosis
ugaccuugggcauccgcucg

SEQ ID NO: 2863772 - RNA, 13 nt, Mycobacterium avium subsp. paratuberculosis
ugacgaacagacu

SEQ ID NO: 2863773 - RNA, 18 nt, Mycobacterium avium subsp. paratuberculosis
ugacgaacaucgacgacg

SEQ ID NO: 2863774 - RNA, 19 nt, Mycobacterium avium subsp. paratuberculosis
ugacgaacaucgacgacgg

SEQ ID NO: 2863775 - RNA, 21 nt, Mycobacterium avium subsp. paratuberculosis
ugacgaacaugcugccgccgg

SEQ ID NO: 2863776 - RNA, 22 nt, Mycobacterium avium subsp. paratuberculosis
ugacgaacaugcugccgccggc

SEQ ID NO: 2863777 - RNA, 23 nt, Mycobacterium avium subsp. paratuberculosis
ugacgaacaugcugccgccggcg

SEQ ID NO: 2863778 - RNA, 23 nt, Mycobacterium avium subsp. paratuberculosis
ugacggccgcggcgcggcccggc

SEQ ID NO: 2863779 - RNA, 18 nt, Mycobacterium avium subsp. paratuberculosis
ugacggccgggcccucgg

SEQ ID NO: 2863780 - RNA, 23 nt, Mycobacterium avium subsp. paratuberculosis
ugacggccucccacucgucgauc

SEQ ID NO: 2863781 - RNA, 18 nt, Mycobacterium avium subsp. paratuberculosis
ugacggccugggcgacca

SEQ ID NO: 2863782 - RNA, 16 nt, Mycobacterium avium subsp. paratuberculosis
ugacggcgucggcgau

SEQ ID NO: 2863783 - RNA, 17 nt, Mycobacterium avium subsp. paratuberculosis
ugacggcucuucggcgc

SEQ ID NO: 2863784 - RNA, 22 nt, Mycobacterium avium subsp. paratuberculosis
ugacggcucuucggcgccgagc

SEQ ID NO: 2863785 - RNA, 16 nt, Mycobacterium avium subsp. paratuberculosis
ugacgggccgcggcca

SEQ ID NO: 2863786 - RNA, 18 nt, Mycobacterium avium subsp. paratuberculosis
ugacgggccgcggccagc

SEQ ID NO: 2863787 - RNA, 14 nt, Mycobacterium avium subsp. paratuberculosis
ugacgggccggcgg

SEQ ID NO: 2863788 - RNA, 15 nt, Mycobacterium avium subsp. paratuberculosis
ugacgggccggcggg

SEQ ID NO: 2863789 - RNA, 14 nt, Mycobacterium avium subsp. paratuberculosis
ugacgggcgucggc

SEQ ID NO: 2863790 - RNA, 18 nt, Mycobacterium avium subsp. paratuberculosis
ugacggguuggucggcgc

SEQ ID NO: 2863791 - RNA, 21 nt, Mycobacterium avium subsp. paratuberculosis
ugacggguuggucggcgcggc

SEQ ID NO: 2863792 - RNA, 15 nt, Mycobacterium avium subsp. paratuberculosis
ugacggucagggugu

SEQ ID NO: 2863793 - RNA, 18 nt, Mycobacterium avium subsp. paratuberculosis
ugacggucaugccgagcc

SEQ ID NO: 2863794 - RNA, 19 nt, Mycobacterium avium subsp. paratuberculosis
ugacggucaugccgagccg

SEQ ID NO: 2863795 - RNA, 16 nt, Mycobacterium avium subsp. paratuberculosis
ugacggugccgccgug

SEQ ID NO: 2863796 - RNA, 22 nt, Mycobacterium avium subsp. paratuberculosis
ugacggugccgccgugcgcggc

SEQ ID NO: 2863797 - RNA, 22 nt, Mycobacterium avium subsp. paratuberculosis
ugacgguggcguccucgacggu

SEQ ID NO: 2863798 - RNA, 18 nt, Mycobacterium avium subsp. paratuberculosis
ugacguacuggcgccggu

SEQ ID NO: 2863799 - RNA, 20 nt, Mycobacterium avium subsp. paratuberculosis
ugacguagacgacgggcagg

SEQ ID NO: 2863800 - RNA, 14 nt, Mycobacterium avium subsp. paratuberculosis
ugacguagaucauu

SEQ ID NO: 2863801 - RNA, 23 nt, Mycobacterium avium subsp. paratuberculosis
ugacguccaccaggguggccgcc

SEQ ID NO: 2863802 - RNA, 14 nt, Mycobacterium avium subsp. paratuberculosis
ugacguccuugacc

SEQ ID NO: 2863803 - RNA, 20 nt, Mycobacterium avium subsp. paratuberculosis
ugacguccuugacccggccg

SEQ ID NO: 2863804 - RNA, 15 nt, Mycobacterium avium subsp. paratuberculosis
ugacgucgaugccgg

SEQ ID NO: 2863805 - RNA, 14 nt, Mycobacterium avium subsp. paratuberculosis
ugacgucgcgccgc

SEQ ID NO: 2863806 - RNA, 21 nt, Mycobacterium avium subsp. paratuberculosis
ugacgucgcgccgcucggcca

SEQ ID NO: 2863807 - RNA, 19 nt, Mycobacterium avium subsp. paratuberculosis
ugacgucgcgcugccggcc

SEQ ID NO: 2863808 - RNA, 22 nt, Mycobacterium avium subsp. paratuberculosis
ugacgucgcgcugccggcccga

SEQ ID NO: 2863809 - RNA, 14 nt, Mycobacterium avium subsp. paratuberculosis
ugacgucggucagc

SEQ ID NO: 2863810 - RNA, 22 nt, Mycobacterium avium subsp. paratuberculosis
ugacgucggucagcaucgggua

SEQ ID NO: 2863811 - RNA, 16 nt, Mycobacterium avium subsp. paratuberculosis
ugacgucgguguagcc

SEQ ID NO: 2863812 - RNA, 16 nt, Mycobacterium avium subsp. paratuberculosis
ugacgucgucaggucc

SEQ ID NO: 2863813 - RNA, 12 nt, Mycobacterium avium subsp. paratuberculosis
ugacgucgucgc

SEQ ID NO: 2863814 - RNA, 16 nt, Mycobacterium avium subsp. paratuberculosis
ugacgucgucgcggcg

SEQ ID NO: 2863815 - RNA, 22 nt, Mycobacterium avium subsp. paratuberculosis
ugacgugauaucccuugccgcc

SEQ ID NO: 2863816 - RNA, 13 nt, Mycobacterium avium subsp. paratuberculosis
ugacgugcaccac

SEQ ID NO: 2863817 - RNA, 21 nt, Mycobacterium avium subsp. paratuberculosis
ugacgugcaccaccgcguuga

SEQ ID NO: 2863818 - RNA, 15 nt, Mycobacterium avium subsp. paratuberculosis
ugacgugcaccggcg

SEQ ID NO: 2863819 - RNA, 21 nt, Mycobacterium avium subsp. paratuberculosis
ugacgugcgacaccggcguga

SEQ ID NO: 2863820 - RNA, 21 nt, Mycobacterium avium subsp. paratuberculosis
ugacguggaaauugcugacca

SEQ ID NO: 2863821 - RNA, 16 nt, Mycobacterium avium subsp. paratuberculosis
ugacguggcggccguc

SEQ ID NO: 2863822 - RNA, 14 nt, Mycobacterium avium subsp. paratuberculosis
ugacguugaucgcg

SEQ ID NO: 2863823 - RNA, 20 nt, Mycobacterium avium subsp. paratuberculosis
ugacguugaucgcgccgauc

SEQ ID NO: 2863824 - RNA, 13 nt, Mycobacterium avium subsp. paratuberculosis
ugacguugcgcgc

SEQ ID NO: 2863825 - RNA, 15 nt, Mycobacterium avium subsp. paratuberculosis
ugacguugcgcgcca

SEQ ID NO: 2863826 - RNA, 15 nt, Mycobacterium avium subsp. paratuberculosis
ugacguuggugaucg

SEQ ID NO: 2863827 - RNA, 21 nt, Mycobacterium avium subsp. paratuberculosis
ugacguuggugaucgccgacg

SEQ ID NO: 2863828 - RNA, 17 nt, Mycobacterium avium subsp. paratuberculosis
ugacuaccgcgcccagg

SEQ ID NO: 2863829 - RNA, 13 nt, Mycobacterium avium subsp. paratuberculosis
ugacuccucugcc

SEQ ID NO: 2863830 - RNA, 13 nt, Mycobacterium avium subsp. paratuberculosis
ugacugacccgca

SEQ ID NO: 2863831 - RNA, 20 nt, Mycobacterium avium subsp. paratuberculosis
ugacugagucaagccggcau

SEQ ID NO: 2863832 - RNA, 20 nt, Mycobacterium avium subsp. paratuberculosis
ugacugcgaucgccgacgcc

SEQ ID NO: 2863833 - RNA, 23 nt, Mycobacterium avium subsp. paratuberculosis
ugacugcgaucgccgacgccagc

SEQ ID NO: 2863834 - RNA, 17 nt, Mycobacterium avium subsp. paratuberculosis
ugacuggcguugaugcg

SEQ ID NO: 2863835 - RNA, 20 nt, Mycobacterium avium subsp. paratuberculosis
ugacuucggaggucagcagg

SEQ ID NO: 2863836 - RNA, 18 nt, Mycobacterium avium subsp. paratuberculosis
ugagaaaagcgaccagcg

SEQ ID NO: 2863837 - RNA, 15 nt, Mycobacterium avium subsp. paratuberculosis
ugagauccagcagcc

SEQ ID NO: 2863838 - RNA, 14 nt, Mycobacterium avium subsp. paratuberculosis
ugagcacaaagccg

SEQ ID NO: 2863839 - RNA, 19 nt, Mycobacterium avium subsp. paratuberculosis
ugagcacaaagccggucac

SEQ ID NO: 2863840 - RNA, 20 nt, Mycobacterium avium subsp. paratuberculosis
ugagcacaaagccggucacg

SEQ ID NO: 2863841 - RNA, 21 nt, Mycobacterium avium subsp. paratuberculosis
ugagcacaaagccggucacgc

SEQ ID NO: 2863842 - RNA, 23 nt, Mycobacterium avium subsp. paratuberculosis
ugagcacacacaggucgcccggc

SEQ ID NO: 2863843 - RNA, 17 nt, Mycobacterium avium subsp. paratuberculosis
ugagcaccacgaggcug

SEQ ID NO: 2863844 - RNA, 12 nt, Mycobacterium avium subsp. paratuberculosis
ugagcaccagcc

SEQ ID NO: 2863845 - RNA, 14 nt, Mycobacterium avium subsp. paratuberculosis
ugagcaccagcccg

SEQ ID NO: 2863846 - RNA, 17 nt, Mycobacterium avium subsp. paratuberculosis
ugagcaccagcccggcc

SEQ ID NO: 2863847 - RNA, 21 nt, Mycobacterium avium subsp. paratuberculosis
ugagcaccagcccggccagcg

SEQ ID NO: 2863848 - RNA, 22 nt, Mycobacterium avium subsp. paratuberculosis
ugagcacccgcagcucgccgag

SEQ ID NO: 2863849 - RNA, 16 nt, Mycobacterium avium subsp. paratuberculosis
ugagcacccgcccgga

SEQ ID NO: 2863850 - RNA, 12 nt, Mycobacterium avium subsp. paratuberculosis
ugagcaccgccg

SEQ ID NO: 2863851 - RNA, 13 nt, Mycobacterium avium subsp. paratuberculosis
ugagcaccgcgac

SEQ ID NO: 2863852 - RNA, 16 nt, Mycobacterium avium subsp. paratuberculosis
ugagcaccgcgaccag

SEQ ID NO: 2863853 - RNA, 14 nt, Mycobacterium avium subsp. paratuberculosis
ugagcaccgcgauc

SEQ ID NO: 2863854 - RNA, 13 nt, Mycobacterium avium subsp. paratuberculosis
ugagcaccggauc

SEQ ID NO: 2863855 - RNA, 18 nt, Mycobacterium avium subsp. paratuberculosis
ugagcaccggaucgacca

SEQ ID NO: 2863856 - RNA, 20 nt, Mycobacterium avium subsp. paratuberculosis
ugagcaccgggaacagccag

SEQ ID NO: 2863857 - RNA, 23 nt, Mycobacterium avium subsp. paratuberculosis
ugagcacgaccgccagcagcagc

SEQ ID NO: 2863858 - RNA, 14 nt, Mycobacterium avium subsp. paratuberculosis
ugagcacgcccgcg

SEQ ID NO: 2863859 - RNA, 14 nt, Mycobacterium avium subsp. paratuberculosis
ugagcacggugggc

SEQ ID NO: 2863860 - RNA, 20 nt, Mycobacterium avium subsp. paratuberculosis
ugagcacggugggcgccggg

SEQ ID NO: 2863861 - RNA, 21 nt, Mycobacterium avium subsp. paratuberculosis
ugagcagaccgaacccgggcg

SEQ ID NO: 2863862 - RNA, 19 nt, Mycobacterium avium subsp. paratuberculosis
ugaguguugaagccgcgga

SEQ ID NO: 2863863 - RNA, 20 nt, Mycobacterium avium subsp. paratuberculosis
ugaguugcguuccagcaucc

SEQ ID NO: 2863864 - RNA, 20 nt, Mycobacterium avium subsp. paratuberculosis
ugauacaggagggccagggc

SEQ ID NO: 2863865 - RNA, 23 nt, Mycobacterium avium subsp. paratuberculosis
ugauacaggagggccagggcuuu

SEQ ID NO: 2863866 - RNA, 15 nt, Mycobacterium avium subsp. paratuberculosis
ugauagcggccgcgg

SEQ ID NO: 2863867 - RNA, 16 nt, Mycobacterium avium subsp. paratuberculosis
ugauaggggucggcga

SEQ ID NO: 2863868 - RNA, 16 nt, Mycobacterium avium subsp. paratuberculosis
ugauaguggucgucgu

SEQ ID NO: 2863869 - RNA, 18 nt, Mycobacterium avium subsp. paratuberculosis
ugaucaacacgucgucgu

SEQ ID NO: 2863870 - RNA, 12 nt, Mycobacterium avium subsp. paratuberculosis
ugaucacaccgc

SEQ ID NO: 2863871 - RNA, 18 nt, Mycobacterium avium subsp. paratuberculosis
ugaucacaccgucggcga

SEQ ID NO: 2863872 - RNA, 12 nt, Mycobacterium avium subsp. paratuberculosis
ugaucaccaccu

SEQ ID NO: 2863873 - RNA, 21 nt, Mycobacterium avium subsp. paratuberculosis
ugaucaccaccugguccugcc

SEQ ID NO: 2863874 - RNA, 19 nt, Mycobacterium avium subsp. paratuberculosis
ugaucaccgccagcgcgcc

SEQ ID NO: 2863875 - RNA, 20 nt, Mycobacterium avium subsp. paratuberculosis
ugaucaccgccagcgcgccg

SEQ ID NO: 2863876 - RNA, 17 nt, Mycobacterium avium subsp. paratuberculosis
ugaucaccgcgcucggc

SEQ ID NO: 2863877 - RNA, 17 nt, Mycobacterium avium subsp. paratuberculosis
ugaucaccucggugaug

SEQ ID NO: 2863878 - RNA, 20 nt, Mycobacterium avium subsp. paratuberculosis
ugaucacgaaguugaucgcg

SEQ ID NO: 2863879 - RNA, 17 nt, Mycobacterium avium subsp. paratuberculosis
ugaucacgggcacaccg

SEQ ID NO: 2863880 - RNA, 22 nt, Mycobacterium avium subsp. paratuberculosis
ugaucacgggcacaccgucguc

SEQ ID NO: 2863881 - RNA, 19 nt, Mycobacterium avium subsp. paratuberculosis
ugaucacguugucgcggcc

SEQ ID NO: 2863882 - RNA, 20 nt, Mycobacterium avium subsp. paratuberculosis
ugaucagcgccguggcccgg

SEQ ID NO: 2863883 - RNA, 14 nt, Mycobacterium avium subsp. paratuberculosis
ugaucagcgcgccc

SEQ ID NO: 2863884 - RNA, 12 nt, Mycobacterium avium subsp. paratuberculosis
ugaucagcucgc

SEQ ID NO: 2863885 - RNA, 20 nt, Mycobacterium avium subsp. paratuberculosis
ugaucaggcccucgucggcg

SEQ ID NO: 2863886 - RNA, 18 nt, Mycobacterium avium subsp. paratuberculosis
ugaucagggcggcgcgcg

SEQ ID NO: 2863887 - RNA, 19 nt, Mycobacterium avium subsp. paratuberculosis
ugaucagguccuugcgcgc

SEQ ID NO: 2863888 - RNA, 20 nt, Mycobacterium avium subsp. paratuberculosis
ugaucagguccuugcgcgcc

SEQ ID NO: 2863889 - RNA, 15 nt, Mycobacterium avium subsp. paratuberculosis
ugauccacgcccgga

SEQ ID NO: 2863890 - RNA, 16 nt, Mycobacterium avium subsp. paratuberculosis
ugauccacuccagcac

SEQ ID NO: 2863891 - RNA, 15 nt, Mycobacterium avium subsp. paratuberculosis
ugauccccagcggca

SEQ ID NO: 2863892 - RNA, 14 nt, Mycobacterium avium subsp. paratuberculosis
ugaucccggugaug

SEQ ID NO: 2863893 - RNA, 18 nt, Mycobacterium avium subsp. paratuberculosis
ugauccgaugcagggccg

SEQ ID NO: 2863894 - RNA, 16 nt, Mycobacterium avium subsp. paratuberculosis
ugauccgcccggcccg

SEQ ID NO: 2863895 - RNA, 18 nt, Mycobacterium avium subsp. paratuberculosis
ugauccgcccggcccgca

SEQ ID NO: 2863896 - RNA, 13 nt, Mycobacterium avium subsp. paratuberculosis
ugauccggaagcc

SEQ ID NO: 2863897 - RNA, 16 nt, Mycobacterium avium subsp. paratuberculosis
ugauccggcacugaag

SEQ ID NO: 2863898 - RNA, 13 nt, Mycobacterium avium subsp. paratuberculosis
ugauccggccgcg

SEQ ID NO: 2863899 - RNA, 15 nt, Mycobacterium avium subsp. paratuberculosis
ugauccggccgcgga

SEQ ID NO: 2863900 - RNA, 23 nt, Mycobacterium avium subsp. paratuberculosis
ugauccuggccuggucggccggc

SEQ ID NO: 2863901 - RNA, 14 nt, Mycobacterium avium subsp. paratuberculosis
ugaucgaaaggacg

SEQ ID NO: 2863902 - RNA, 19 nt, Mycobacterium avium subsp. paratuberculosis
ugaucgacgagccgggcca

SEQ ID NO: 2863903 - RNA, 16 nt, Mycobacterium avium subsp. paratuberculosis
ugaucgagcaccagcg

SEQ ID NO: 2863904 - RNA, 16 nt, Mycobacterium avium subsp. paratuberculosis
ugaucgagccgcggcc

SEQ ID NO: 2863905 - RNA, 14 nt, Mycobacterium avium subsp. paratuberculosis
ugaucgccagcccg

SEQ ID NO: 2863906 - RNA, 23 nt, Mycobacterium avium subsp. paratuberculosis
ugaucgccagcccggcguacagc

SEQ ID NO: 2863907 - RNA, 23 nt, Mycobacterium avium subsp. paratuberculosis
ugaucgccaguccggcgccgacc

SEQ ID NO: 2863908 - RNA, 23 nt, Mycobacterium avium subsp. paratuberculosis
ugaucgcccagcaccgcgacgau

SEQ ID NO: 2863909 - RNA, 20 nt, Mycobacterium avium subsp. paratuberculosis
ugaucgccgauccgggcggc

SEQ ID NO: 2863910 - RNA, 12 nt, Mycobacterium avium subsp. paratuberculosis
ugaucgccgcgg

SEQ ID NO: 2863911 - RNA, 14 nt, Mycobacterium avium subsp. paratuberculosis
ugaucgccggggcg

SEQ ID NO: 2863912 - RNA, 14 nt, Mycobacterium avium subsp. paratuberculosis
ugaucgcgaagacc

SEQ ID NO: 2863913 - RNA, 24 nt, Mycobacterium avium subsp. paratuberculosis
ugaucgcgauccgggcgccggccg

SEQ ID NO: 2863914 - RNA, 20 nt, Mycobacterium avium subsp. paratuberculosis
ugaucgcggcccacccgcag

SEQ ID NO: 2863915 - RNA, 21 nt, Mycobacterium avium subsp. paratuberculosis
ugaucgcggcccacccgcagg

SEQ ID NO: 2863916 - RNA, 15 nt, Mycobacterium avium subsp. paratuberculosis
ugaucgcggcggaca

SEQ ID NO: 2863917 - RNA, 14 nt, Mycobacterium avium subsp. paratuberculosis
ugaucggccaggcg

SEQ ID NO: 2863918 - RNA, 13 nt, Mycobacterium avium subsp. paratuberculosis
ugaucggccccuu

SEQ ID NO: 2863919 - RNA, 22 nt, Mycobacterium avium subsp. paratuberculosis
ugaucggcguuggcggcgucga

SEQ ID NO: 2863920 - RNA, 21 nt, Mycobacterium avium subsp. paratuberculosis
ugaucggggcccaccccggac

SEQ ID NO: 2863921 - RNA, 21 nt, Mycobacterium avium subsp. paratuberculosis
ugaucgggugagacggccagc

SEQ ID NO: 2863922 - RNA, 21 nt, Mycobacterium avium subsp. paratuberculosis
ugaucgguucgucguggccga

SEQ ID NO: 2863923 - RNA, 14 nt, Mycobacterium avium subsp. paratuberculosis
ugaucgucggcagc

SEQ ID NO: 2863924 - RNA, 18 nt, Mycobacterium avium subsp. paratuberculosis
ugaucgucucggccgcgg

SEQ ID NO: 2863925 - RNA, 22 nt, Mycobacterium avium subsp. paratuberculosis
ugaucgucucggccgcggugcg

SEQ ID NO: 2863926 - RNA, 15 nt, Mycobacterium avium subsp. paratuberculosis
ugaucucaccggcgg

SEQ ID NO: 2863927 - RNA, 20 nt, Mycobacterium avium subsp. paratuberculosis
ugaucuccgcggcgaugacc

SEQ ID NO: 2863928 - RNA, 15 nt, Mycobacterium avium subsp. paratuberculosis
ugaucucgccgagca

SEQ ID NO: 2863929 - RNA, 13 nt, Mycobacterium avium subsp. paratuberculosis
ugaucucgccgcg

SEQ ID NO: 2863930 - RNA, 14 nt, Mycobacterium avium subsp. paratuberculosis
ugaucucgccgcgg

SEQ ID NO: 2863931 - RNA, 15 nt, Mycobacterium avium subsp. paratuberculosis
ugaucucggcggcga

SEQ ID NO: 2863932 - RNA, 19 nt, Mycobacterium avium subsp. paratuberculosis
ugaucucggcggucugucg

SEQ ID NO: 2863933 - RNA, 16 nt, Mycobacterium avium subsp. paratuberculosis
ugaucugggugccgcg

SEQ ID NO: 2863934 - RNA, 18 nt, Mycobacterium avium subsp. paratuberculosis
ugaucugguuccacagcu

SEQ ID NO: 2863935 - RNA, 23 nt, Mycobacterium avium subsp. paratuberculosis
ugaucuucgagacacgcgccggc

SEQ ID NO: 2863936 - RNA, 13 nt, Mycobacterium avium subsp. paratuberculosis
ugaucuucuccag

SEQ ID NO: 2863937 - RNA, 21 nt, Mycobacterium avium subsp. paratuberculosis
ugaucuugcuggucuucggug

SEQ ID NO: 2863938 - RNA, 17 nt, Mycobacterium avium subsp. paratuberculosis
ugaugaaaaccgggccc

SEQ ID NO: 2863939 - RNA, 18 nt, Mycobacterium avium subsp. paratuberculosis
ugaugaacacggucgccg

SEQ ID NO: 2863940 - RNA, 22 nt, Mycobacterium avium subsp. paratuberculosis
ugaugaacgccucgagcgcccg

SEQ ID NO: 2863941 - RNA, 14 nt, Mycobacterium avium subsp. paratuberculosis
ugaugaacgcgccg

SEQ ID NO: 2863942 - RNA, 16 nt, Mycobacterium avium subsp. paratuberculosis
ugaugaacgcgccguc

SEQ ID NO: 2863943 - RNA, 22 nt, Mycobacterium avium subsp. paratuberculosis
ugaugaagaugaucucgccgag

SEQ ID NO: 2863944 - RNA, 13 nt, Mycobacterium avium subsp. paratuberculosis
ugaugacggggcg

SEQ ID NO: 2863945 - RNA, 21 nt, Mycobacterium avium subsp. paratuberculosis
ugaugacguagucguccucgu

SEQ ID NO: 2863946 - RNA, 20 nt, Mycobacterium avium subsp. paratuberculosis
ugaugagcaagucggcggug

SEQ ID NO: 2863947 - RNA, 22 nt, Mycobacterium avium subsp. paratuberculosis
ugcaccacgacgucgagccagc

SEQ ID NO: 2863948 - RNA, 12 nt, Mycobacterium avium subsp. paratuberculosis
ugcaccagcacg

SEQ ID NO: 2863949 - RNA, 21 nt, Mycobacterium avium subsp. paratuberculosis
ugcaccagcgauccggcgcgu

SEQ ID NO: 2863950 - RNA, 13 nt, Mycobacterium avium subsp. paratuberculosis
ugcaccagcgcgg

SEQ ID NO: 2863951 - RNA, 13 nt, Mycobacterium avium subsp. paratuberculosis
ugcaccagcgugg

SEQ ID NO: 2863952 - RNA, 13 nt, Mycobacterium avium subsp. paratuberculosis
ugcaccagcucgg

SEQ ID NO: 2863953 - RNA, 21 nt, Mycobacterium avium subsp. paratuberculosis
ugcaccagcucggugaucacc

SEQ ID NO: 2863954 - RNA, 20 nt, Mycobacterium avium subsp. paratuberculosis
ugcaccaggacgcgaccggc

SEQ ID NO: 2863955 - RNA, 14 nt, Mycobacterium avium subsp. paratuberculosis
ugcaccagguagau

SEQ ID NO: 2863956 - RNA, 21 nt, Mycobacterium avium subsp. paratuberculosis
ugcacccaccggcccagccgg

SEQ ID NO: 2863957 - RNA, 15 nt, Mycobacterium avium subsp. paratuberculosis
ugcacccaccggcgc

SEQ ID NO: 2863958 - RNA, 21 nt, Mycobacterium avium subsp. paratuberculosis
ugcacccaccggcgcagcgcg

SEQ ID NO: 2863959 - RNA, 14 nt, Mycobacterium avium subsp. paratuberculosis
ugcacccacgccag

SEQ ID NO: 2863960 - RNA, 21 nt, Mycobacterium avium subsp. paratuberculosis
ugcacccgaacggaccgggcg

SEQ ID NO: 2863961 - RNA, 15 nt, Mycobacterium avium subsp. paratuberculosis
ugcacccgggucagg

SEQ ID NO: 2863962 - RNA, 18 nt, Mycobacterium avium subsp. paratuberculosis
ugcacccgguucugggcg

SEQ ID NO: 2863963 - RNA, 21 nt, Mycobacterium avium subsp. paratuberculosis
ugcacccgguucugggcgggc

SEQ ID NO: 2863964 - RNA, 14 nt, Mycobacterium avium subsp. paratuberculosis
ugcacccucugcca

SEQ ID NO: 2863965 - RNA, 20 nt, Mycobacterium avium subsp. paratuberculosis
ugcaccgaguugaacgcguc

SEQ ID NO: 2863966 - RNA, 21 nt, Mycobacterium avium subsp. paratuberculosis
ugcaccgcagucuuguugacc

SEQ ID NO: 2863967 - RNA, 16 nt, Mycobacterium avium subsp. paratuberculosis
ugcaccgccagcgcgg

SEQ ID NO: 2863968 - RNA, 18 nt, Mycobacterium avium subsp. paratuberculosis
ugcaccgccagcgcggcg

SEQ ID NO: 2863969 - RNA, 19 nt, Mycobacterium avium subsp. paratuberculosis
ugcaccgcgauggcccgcg

SEQ ID NO: 2863970 - RNA, 13 nt, Mycobacterium avium subsp. paratuberculosis
ugcaccgcgcgca

SEQ ID NO: 2863971 - RNA, 13 nt, Mycobacterium avium subsp. paratuberculosis
ugcaccgcggcca

SEQ ID NO: 2863972 - RNA, 22 nt, Mycobacterium avium subsp. paratuberculosis
ugcaccgcggccaacccgggcg

SEQ ID NO: 2863973 - RNA, 23 nt, Mycobacterium avium subsp. paratuberculosis
ugcaccgcggccaacccgggcgc

SEQ ID NO: 2863974 - RNA, 14 nt, Mycobacterium avium subsp. paratuberculosis
ugcaccgcggcgcg

SEQ ID NO: 2863975 - RNA, 19 nt, Mycobacterium avium subsp. paratuberculosis
ugcaccgcgggcacggcga

SEQ ID NO: 2863976 - RNA, 18 nt, Mycobacterium avium subsp. paratuberculosis
ugcaccggcaccgcgguc

SEQ ID NO: 2863977 - RNA, 13 nt, Mycobacterium avium subsp. paratuberculosis
ugcaccggcacgu

SEQ ID NO: 2863978 - RNA, 23 nt, Mycobacterium avium subsp. paratuberculosis
ugcaccggcacgucgagcuccuc

SEQ ID NO: 2863979 - RNA, 15 nt, Mycobacterium avium subsp. paratuberculosis
ugcaccggcagccag

SEQ ID NO: 2863980 - RNA, 17 nt, Mycobacterium avium subsp. paratuberculosis
ugcaccggggccggcgg

SEQ ID NO: 2863981 - RNA, 19 nt, Mycobacterium avium subsp. paratuberculosis
ugcaccggguacaccggcu

SEQ ID NO: 2863982 - RNA, 14 nt, Mycobacterium avium subsp. paratuberculosis
ugcaccgucgccgg

SEQ ID NO: 2863983 - RNA, 17 nt, Mycobacterium avium subsp. paratuberculosis
ugcaccgucgccggcgg

SEQ ID NO: 2863984 - RNA, 14 nt, Mycobacterium avium subsp. paratuberculosis
ugcaccucgacgaa

SEQ ID NO: 2863985 - RNA, 15 nt, Mycobacterium avium subsp. paratuberculosis
ugcaccugcagccgg

SEQ ID NO: 2863986 - RNA, 13 nt, Mycobacterium avium subsp. paratuberculosis
ugcaccugcggca

SEQ ID NO: 2863987 - RNA, 17 nt, Mycobacterium avium subsp. paratuberculosis
ugcaccugggugaucuu

SEQ ID NO: 2863988 - RNA, 13 nt, Mycobacterium avium subsp. paratuberculosis
ugcaccuugcccg

SEQ ID NO: 2863989 - RNA, 16 nt, Mycobacterium avium subsp. paratuberculosis
ugcacgaacgcggcca

SEQ ID NO: 2863990 - RNA, 17 nt, Mycobacterium avium subsp. paratuberculosis
ugcacgaacgcggccag

SEQ ID NO: 2863991 - RNA, 16 nt, Mycobacterium avium subsp. paratuberculosis
ugcacgacgaacacca

SEQ ID NO: 2863992 - RNA, 17 nt, Mycobacterium avium subsp. paratuberculosis
ugcacgacgaccgcgac

SEQ ID NO: 2863993 - RNA, 20 nt, Mycobacterium avium subsp. paratuberculosis
ugcacgacgaccgcgacggc

SEQ ID NO: 2863994 - RNA, 19 nt, Mycobacterium avium subsp. paratuberculosis
ugcacgacgaccgcguccg

SEQ ID NO: 2863995 - RNA, 15 nt, Mycobacterium avium subsp. paratuberculosis
ugcacgaucgcggug

SEQ ID NO: 2863996 - RNA, 16 nt, Mycobacterium avium subsp. paratuberculosis
ugcacgaucgcgguga

SEQ ID NO: 2863997 - RNA, 18 nt, Mycobacterium avium subsp. paratuberculosis
ugcacgaucgcggugacg

SEQ ID NO: 2863998 - RNA, 13 nt, Mycobacterium avium subsp. paratuberculosis
ugcacgaucucgg

SEQ ID NO: 2863999 - RNA, 16 nt, Mycobacterium avium subsp. paratuberculosis
ugcacgaucucggcgg

SEQ ID NO: 2864000 - RNA, 16 nt, Mycobacterium avium subsp. paratuberculosis
ugcacgaugccgacca

SEQ ID NO: 2864001 - RNA, 23 nt, Mycobacterium avium subsp. paratuberculosis
ugcacgaugccgaccaacacccc

SEQ ID NO: 2864002 - RNA, 15 nt, Mycobacterium avium subsp. paratuberculosis
ugcacgcacggcgaa

SEQ ID NO: 2864003 - RNA, 14 nt, Mycobacterium avium subsp. paratuberculosis
ugcacgcaggccuc

SEQ ID NO: 2864004 - RNA, 16 nt, Mycobacterium avium subsp. paratuberculosis
ugcacgcaggccucua

SEQ ID NO: 2864005 - RNA, 14 nt, Mycobacterium avium subsp. paratuberculosis
ugcacgccgagcag

SEQ ID NO: 2864006 - RNA, 15 nt, Mycobacterium avium subsp. paratuberculosis
ugcacgccgagcagc

SEQ ID NO: 2864007 - RNA, 18 nt, Mycobacterium avium subsp. paratuberculosis
ugcacgccgagcagcacc

SEQ ID NO: 2864008 - RNA, 19 nt, Mycobacterium avium subsp. paratuberculosis
ugcacgccgagcagcaccg

SEQ ID NO: 2864009 - RNA, 14 nt, Mycobacterium avium subsp. paratuberculosis
ugcacgccgucgug

SEQ ID NO: 2864010 - RNA, 18 nt, Mycobacterium avium subsp. paratuberculosis
ugcacgcguugcagcgcc

SEQ ID NO: 2864011 - RNA, 18 nt, Mycobacterium avium subsp. paratuberculosis
ugcacgcucggcgggggg

SEQ ID NO: 2864012 - RNA, 19 nt, Mycobacterium avium subsp. paratuberculosis
ugcacgcuguuggaaccgg

SEQ ID NO: 2864013 - RNA, 16 nt, Mycobacterium avium subsp. paratuberculosis
ugcacggacagcucac

SEQ ID NO: 2864014 - RNA, 24 nt, Mycobacterium avium subsp. paratuberculosis
ugcacggacagcucaccgggcucg

SEQ ID NO: 2864015 - RNA, 18 nt, Mycobacterium avium subsp. paratuberculosis
ugcacggcgccaccagcc

SEQ ID NO: 2864016 - RNA, 14 nt, Mycobacterium avium subsp. paratuberculosis
ugcacggcgccgug

SEQ ID NO: 2864017 - RNA, 18 nt, Mycobacterium avium subsp. paratuberculosis
ugcacggcgccgugccgc

SEQ ID NO: 2864018 - RNA, 19 nt, Mycobacterium avium subsp. paratuberculosis
ugcacggcgcuggcgacca

SEQ ID NO: 2864019 - RNA, 22 nt, Mycobacterium avium subsp. paratuberculosis
ugcacggcggcgaacgccgccg

SEQ ID NO: 2864020 - RNA, 15 nt, Mycobacterium avium subsp. paratuberculosis
ugcacggugcgccgg

SEQ ID NO: 2864021 - RNA, 18 nt, Mycobacterium avium subsp. paratuberculosis
ugcacgguguagacgcgg

SEQ ID NO: 2864022 - RNA, 22 nt, Mycobacterium avium subsp. paratuberculosis
ugcacgguguagacgcgggccg

SEQ ID NO: 2864023 - RNA, 19 nt, Mycobacterium avium subsp. paratuberculosis
ugcacgucacgggccaggc

SEQ ID NO: 2864024 - RNA, 22 nt, Mycobacterium avium subsp. paratuberculosis
ugcacguccgccuccgaccagc

SEQ ID NO: 2864025 - RNA, 14 nt, Mycobacterium avium subsp. paratuberculosis
ugcacguccucguc

SEQ ID NO: 2864026 - RNA, 16 nt, Mycobacterium avium subsp. paratuberculosis
ugcacguccucgucgg

SEQ ID NO: 2864027 - RNA, 22 nt, Mycobacterium avium subsp. paratuberculosis
ugcacgucggcgcgcaggcugg

SEQ ID NO: 2864028 - RNA, 23 nt, Mycobacterium avium subsp. paratuberculosis
ugcacgucggcgcgcaggcuggc

SEQ ID NO: 2864029 - RNA, 17 nt, Mycobacterium avium subsp. paratuberculosis
ugcacgucggcggccgc

SEQ ID NO: 2864030 - RNA, 19 nt, Mycobacterium avium subsp. paratuberculosis
ugcacgucggcggccgcga

SEQ ID NO: 2864031 - RNA, 19 nt, Mycobacterium avium subsp. paratuberculosis
ugcacgugcaccgcggcca

SEQ ID NO: 2864032 - RNA, 22 nt, Mycobacterium avium subsp. paratuberculosis
ugcagcuuccgaaccgcacgag

SEQ ID NO: 2864033 - RNA, 21 nt, Mycobacterium avium subsp. paratuberculosis
ugcaggaacgccuugaccgcc

SEQ ID NO: 2864034 - RNA, 21 nt, Mycobacterium avium subsp. paratuberculosis
ugcaggaccuugucgggccgc

SEQ ID NO: 2864035 - RNA, 19 nt, Mycobacterium avium subsp. paratuberculosis
ugcaggauccgcucgacga

SEQ ID NO: 2864036 - RNA, 23 nt, Mycobacterium avium subsp. paratuberculosis
ugcaggauccgcucgacgaguuc

SEQ ID NO: 2864037 - RNA, 16 nt, Mycobacterium avium subsp. paratuberculosis
ugcaggaucgcgguga

SEQ ID NO: 2864038 - RNA, 20 nt, Mycobacterium avium subsp. paratuberculosis
ugcaggaugaccgcgucggc

SEQ ID NO: 2864039 - RNA, 23 nt, Mycobacterium avium subsp. paratuberculosis
ugcaggcagccguuguccacgau

SEQ ID NO: 2864040 - RNA, 14 nt, Mycobacterium avium subsp. paratuberculosis
ugcaggcaggccgg

SEQ ID NO: 2864041 - RNA, 14 nt, Mycobacterium avium subsp. paratuberculosis
ugcaggccacgccc

SEQ ID NO: 2864042 - RNA, 18 nt, Mycobacterium avium subsp. paratuberculosis
ugcaggcccgggcggcga

SEQ ID NO: 2864043 - RNA, 16 nt, Mycobacterium avium subsp. paratuberculosis
ugcaggcccucgacgu

SEQ ID NO: 2864044 - RNA, 17 nt, Mycobacterium avium subsp. paratuberculosis
ugcaggcccucgacgua

SEQ ID NO: 2864045 - RNA, 13 nt, Mycobacterium avium subsp. paratuberculosis
ugcaggccgaggc

SEQ ID NO: 2864046 - RNA, 13 nt, Mycobacterium avium subsp. paratuberculosis
ugcaggccgcgac

SEQ ID NO: 2864047 - RNA, 18 nt, Mycobacterium avium subsp. paratuberculosis
ugcaggcgaucucgccga

SEQ ID NO: 2864048 - RNA, 15 nt, Mycobacterium avium subsp. paratuberculosis
ugcaggcgcccagga

SEQ ID NO: 2864049 - RNA, 15 nt, Mycobacterium avium subsp. paratuberculosis
ugcaggcugacgcga

SEQ ID NO: 2864050 - RNA, 15 nt, Mycobacterium avium subsp. paratuberculosis
ugcagggccgggucg

SEQ ID NO: 2864051 - RNA, 15 nt, Mycobacterium avium subsp. paratuberculosis
ugcagggggcgcagc

SEQ ID NO: 2864052 - RNA, 16 nt, Mycobacterium avium subsp. paratuberculosis
ugcagggggcgcagcc

SEQ ID NO: 2864053 - RNA, 15 nt, Mycobacterium avium subsp. paratuberculosis
ugcagggucagcagc

SEQ ID NO: 2864054 - RNA, 23 nt, Mycobacterium avium subsp. paratuberculosis
ugcagggucagcagcacccgguc

SEQ ID NO: 2864055 - RNA, 15 nt, Mycobacterium avium subsp. paratuberculosis
ugcaggguccgccgu

SEQ ID NO: 2864056 - RNA, 19 nt, Mycobacterium avium subsp. paratuberculosis
ugcaggguuuccucgagca

SEQ ID NO: 2864057 - RNA, 15 nt, Mycobacterium avium subsp. paratuberculosis
ugcagguagguggcc

SEQ ID NO: 2864058 - RNA, 17 nt, Mycobacterium avium subsp. paratuberculosis
ugcagguagguggccag

SEQ ID NO: 2864059 - RNA, 21 nt, Mycobacterium avium subsp. paratuberculosis
ugcagguagguggccagccgg

SEQ ID NO: 2864060 - RNA, 22 nt, Mycobacterium avium subsp. paratuberculosis
ugcaggucguaguaggcgccga

SEQ ID NO: 2864061 - RNA, 22 nt, Mycobacterium avium subsp. paratuberculosis
ugcaggugcgcggucagcgcgu

SEQ ID NO: 2864062 - RNA, 23 nt, Mycobacterium avium subsp. paratuberculosis
ugcaggugcgcggucagcgcguc

SEQ ID NO: 2864063 - RNA, 14 nt, Mycobacterium avium subsp. paratuberculosis
ugcaggugcggcac

SEQ ID NO: 2864064 - RNA, 11 nt, Mycobacterium avium subsp. paratuberculosis
ugcagguggcc

SEQ ID NO: 2864065 - RNA, 15 nt, Mycobacterium avium subsp. paratuberculosis
ugcagguggcccaca

SEQ ID NO: 2864066 - RNA, 17 nt, Mycobacterium avium subsp. paratuberculosis
ugcagugcgaucgccgu

SEQ ID NO: 2864067 - RNA, 18 nt, Mycobacterium avium subsp. paratuberculosis
ugcauagucggcccgauc

SEQ ID NO: 2864068 - RNA, 18 nt, Mycobacterium avium subsp. paratuberculosis
ugcaucaugccgcccauc

SEQ ID NO: 2864069 - RNA, 20 nt, Mycobacterium avium subsp. paratuberculosis
ugcaucaugccgcccaucac

SEQ ID NO: 2864070 - RNA, 18 nt, Mycobacterium avium subsp. paratuberculosis
ugcauccgcagcaccagg

SEQ ID NO: 2864071 - RNA, 13 nt, Mycobacterium avium subsp. paratuberculosis
ugcauccggaacc

SEQ ID NO: 2864072 - RNA, 13 nt, Mycobacterium avium subsp. paratuberculosis
ugcauccugggcg

SEQ ID NO: 2864073 - RNA, 14 nt, Mycobacterium avium subsp. paratuberculosis
ugcaucgaugccgg

SEQ ID NO: 2864074 - RNA, 21 nt, Mycobacterium avium subsp. paratuberculosis
ugcaucgcgaucgacagcucc

SEQ ID NO: 2864075 - RNA, 22 nt, Mycobacterium avium subsp. paratuberculosis
ugcaucgcgaucgacagcucca

SEQ ID NO: 2864076 - RNA, 17 nt, Mycobacterium avium subsp. paratuberculosis
ugcaucucgacccgggc

SEQ ID NO: 2864077 - RNA, 20 nt, Mycobacterium avium subsp. paratuberculosis
ugcaucugcgagaugcccac

SEQ ID NO: 2864078 - RNA, 16 nt, Mycobacterium avium subsp. paratuberculosis
ugcaugccgggcagga

SEQ ID NO: 2864079 - RNA, 16 nt, Mycobacterium avium subsp. paratuberculosis
ugcaugugcucggcga

SEQ ID NO: 2864080 - RNA, 20 nt, Mycobacterium avium subsp. paratuberculosis
ugcauucagugcgagaaaau

SEQ ID NO: 2864081 - RNA, 15 nt, Mycobacterium avium subsp. paratuberculosis
ugcauucguccaucc

SEQ ID NO: 2864082 - RNA, 19 nt, Mycobacterium avium subsp. paratuberculosis
ugcauuucggcguccucga

SEQ ID NO: 2864083 - RNA, 15 nt, Mycobacterium avium subsp. paratuberculosis
ugccaacaccagggu

SEQ ID NO: 2864084 - RNA, 18 nt, Mycobacterium avium subsp. paratuberculosis
ugccaagacguccgcguc

SEQ ID NO: 2864085 - RNA, 19 nt, Mycobacterium avium subsp. paratuberculosis
ugccaagacguccgcgucg

SEQ ID NO: 2864086 - RNA, 21 nt, Mycobacterium avium subsp. paratuberculosis
ugccaagacguccgcgucggc

SEQ ID NO: 2864087 - RNA, 22 nt, Mycobacterium avium subsp. paratuberculosis
ugccaagacguccgcgucggcg

SEQ ID NO: 2864088 - RNA, 21 nt, Mycobacterium avium subsp. paratuberculosis
ugccaagccauuucagcagcg

SEQ ID NO: 2864089 - RNA, 18 nt, Mycobacterium avium subsp. paratuberculosis
ugccaagcgguuccagac

SEQ ID NO: 2864090 - RNA, 20 nt, Mycobacterium avium subsp. paratuberculosis
ugccaagcgguuccagaccg

SEQ ID NO: 2864091 - RNA, 17 nt, Mycobacterium avium subsp. paratuberculosis
ugccaaggucgccggug

SEQ ID NO: 2864092 - RNA, 19 nt, Mycobacterium avium subsp. paratuberculosis
ugccaaggucgccggugug

SEQ ID NO: 2864093 - RNA, 17 nt, Mycobacterium avium subsp. paratuberculosis
ugccacaggccgaacag

SEQ ID NO: 2864094 - RNA, 15 nt, Mycobacterium avium subsp. paratuberculosis
ugccaccaccacggc

SEQ ID NO: 2864095 - RNA, 18 nt, Mycobacterium avium subsp. paratuberculosis
ugccaccaccacggccag

SEQ ID NO: 2864096 - RNA, 20 nt, Mycobacterium avium subsp. paratuberculosis
ugccaccaccacggccagga

SEQ ID NO: 2864097 - RNA, 13 nt, Mycobacterium avium subsp. paratuberculosis
ugccaccgccgau

SEQ ID NO: 2864098 - RNA, 14 nt, Mycobacterium avium subsp. paratuberculosis
ugccaccgccgaug

SEQ ID NO: 2864099 - RNA, 22 nt, Mycobacterium avium subsp. paratuberculosis
ugccaccgcugggcggcgcggc

SEQ ID NO: 2864100 - RNA, 22 nt, Mycobacterium avium subsp. paratuberculosis
ugccacgcccaccgguggccgg

SEQ ID NO: 2864101 - RNA, 16 nt, Mycobacterium avium subsp. paratuberculosis
ugccacgccgauggcc

SEQ ID NO: 2864102 - RNA, 12 nt, Mycobacterium avium subsp. paratuberculosis
ugccacggccgc

SEQ ID NO: 2864103 - RNA, 19 nt, Mycobacterium avium subsp. paratuberculosis
ugccacggucaggcgcagc

SEQ ID NO: 2864104 - RNA, 23 nt, Mycobacterium avium subsp. paratuberculosis
ugccacgguuucgccguacagcu

SEQ ID NO: 2864105 - RNA, 17 nt, Mycobacterium avium subsp. paratuberculosis
ugccacguacaccggga

SEQ ID NO: 2864106 - RNA, 16 nt, Mycobacterium avium subsp. paratuberculosis
ugccacucgucgaugu

SEQ ID NO: 2864107 - RNA, 23 nt, Mycobacterium avium subsp. paratuberculosis
ugccacuucgacggcagcggcac

SEQ ID NO: 2864108 - RNA, 18 nt, Mycobacterium avium subsp. paratuberculosis
ugccagaacggcggcagc

SEQ ID NO: 2864109 - RNA, 22 nt, Mycobacterium avium subsp. paratuberculosis
ugccagaacggcggcagcgagg

SEQ ID NO: 2864110 - RNA, 23 nt, Mycobacterium avium subsp. paratuberculosis
ugccagaagaucugccggugccg

SEQ ID NO: 2864111 - RNA, 19 nt, Mycobacterium avium subsp. paratuberculosis
ugccagacgcgcaccgcca

SEQ ID NO: 2864112 - RNA, 20 nt, Mycobacterium avium subsp. paratuberculosis
ugccagacgcgcaccgccac

SEQ ID NO: 2864113 - RNA, 20 nt, Mycobacterium avium subsp. paratuberculosis
ugccagcagguccgccggug

SEQ ID NO: 2864114 - RNA, 21 nt, Mycobacterium avium subsp. paratuberculosis
ugccagcagguccgccggugc

SEQ ID NO: 2864115 - RNA, 12 nt, Mycobacterium avium subsp. paratuberculosis
ugccagccggcc

SEQ ID NO: 2864116 - RNA, 16 nt, Mycobacterium avium subsp. paratuberculosis
ugcccgagcaccugaa

SEQ ID NO: 2864117 - RNA, 23 nt, Mycobacterium avium subsp. paratuberculosis
ugcccgagcaccugaacggccgc

SEQ ID NO: 2864118 - RNA, 20 nt, Mycobacterium avium subsp. paratuberculosis
ugcccgagcugaucgcggcc

SEQ ID NO: 2864119 - RNA, 23 nt, Mycobacterium avium subsp. paratuberculosis
ugcccgagcugaucgcggccggc

SEQ ID NO: 2864120 - RNA, 21 nt, Mycobacterium avium subsp. paratuberculosis
ugcccgaggucauaucgacgg

SEQ ID NO: 2864121 - RNA, 14 nt, Mycobacterium avium subsp. paratuberculosis
ugcccgaucagccg

SEQ ID NO: 2864122 - RNA, 15 nt, Mycobacterium avium subsp. paratuberculosis
ugcccgaucagccgg

SEQ ID NO: 2864123 - RNA, 20 nt, Mycobacterium avium subsp. paratuberculosis
ugcccgauggugaagccgug

SEQ ID NO: 2864124 - RNA, 14 nt, Mycobacterium avium subsp. paratuberculosis
ugcccgccacggcc

SEQ ID NO: 2864125 - RNA, 16 nt, Mycobacterium avium subsp. paratuberculosis
ugcccgccacggccag

SEQ ID NO: 2864126 - RNA, 23 nt, Mycobacterium avium subsp. paratuberculosis
ugcccgcccacgggucgccgauc

SEQ ID NO: 2864127 - RNA, 14 nt, Mycobacterium avium subsp. paratuberculosis
ugcccgccccgccc

SEQ ID NO: 2864128 - RNA, 20 nt, Mycobacterium avium subsp. paratuberculosis
ugcccgccccgcccggcggc

SEQ ID NO: 2864129 - RNA, 19 nt, Mycobacterium avium subsp. paratuberculosis
ugcccgcccuugucgaucc

SEQ ID NO: 2864130 - RNA, 16 nt, Mycobacterium avium subsp. paratuberculosis
ugcccgccgacgccca

SEQ ID NO: 2864131 - RNA, 19 nt, Mycobacterium avium subsp. paratuberculosis
ugcccgccgacgcccaggc

SEQ ID NO: 2864132 - RNA, 21 nt, Mycobacterium avium subsp. paratuberculosis
ugcccgccgaucgaucagccg

SEQ ID NO: 2864133 - RNA, 12 nt, Mycobacterium avium subsp. paratuberculosis
ugcccgccgcga

SEQ ID NO: 2864134 - RNA, 13 nt, Mycobacterium avium subsp. paratuberculosis
ugcccgccgcgac

SEQ ID NO: 2864135 - RNA, 15 nt, Mycobacterium avium subsp. paratuberculosis
ugcccgccgcggccg

SEQ ID NO: 2864136 - RNA, 14 nt, Mycobacterium avium subsp. paratuberculosis
ugcccgccgcggcg

SEQ ID NO: 2864137 - RNA, 21 nt, Mycobacterium avium subsp. paratuberculosis
ugcccgccgcggcgagccggc

SEQ ID NO: 2864138 - RNA, 22 nt, Mycobacterium avium subsp. paratuberculosis
ugcccgccgcggcgagccggcc

SEQ ID NO: 2864139 - RNA, 20 nt, Mycobacterium avium subsp. paratuberculosis
ugcccgccgcggugcugauc

SEQ ID NO: 2864140 - RNA, 19 nt, Mycobacterium avium subsp. paratuberculosis
ugcccgccgcguacagcag

SEQ ID NO: 2864141 - RNA, 21 nt, Mycobacterium avium subsp. paratuberculosis
ugcccgccgcguacagcagcu

SEQ ID NO: 2864142 - RNA, 20 nt, Mycobacterium avium subsp. paratuberculosis
ugcccgccgcugacgcggcg

SEQ ID NO: 2864143 - RNA, 15 nt, Mycobacterium avium subsp. paratuberculosis
ugcccgccggcgucu

SEQ ID NO: 2864144 - RNA, 22 nt, Mycobacterium avium subsp. paratuberculosis
ugcccgccggcgucugcauccg

SEQ ID NO: 2864145 - RNA, 21 nt, Mycobacterium avium subsp. paratuberculosis
ugcccgccgugcgccccgccc

SEQ ID NO: 2864146 - RNA, 19 nt, Mycobacterium avium subsp. paratuberculosis
ugcccgccucacagcgaca

SEQ ID NO: 2864147 - RNA, 17 nt, Mycobacterium avium subsp. paratuberculosis
ugcccgccucgcagcga

SEQ ID NO: 2864148 - RNA, 15 nt, Mycobacterium avium subsp. paratuberculosis
ugcccgcgaacgccu

SEQ ID NO: 2864149 - RNA, 18 nt, Mycobacterium avium subsp. paratuberculosis
ugcccgcgacggcgagcc

SEQ ID NO: 2864150 - RNA, 15 nt, Mycobacterium avium subsp. paratuberculosis
ugcccgcgcaggccc

SEQ ID NO: 2864151 - RNA, 15 nt, Mycobacterium avium subsp. paratuberculosis
ugcccgcgccgacca

SEQ ID NO: 2864152 - RNA, 21 nt, Mycobacterium avium subsp. paratuberculosis
ugcccgcgccgaccagcgcgu

SEQ ID NO: 2864153 - RNA, 23 nt, Mycobacterium avium subsp. paratuberculosis
ugcccgcgcggcucacagcgcgg

SEQ ID NO: 2864154 - RNA, 13 nt, Mycobacterium avium subsp. paratuberculosis
ugcccgcggccgc

SEQ ID NO: 2864155 - RNA, 16 nt, Mycobacterium avium subsp. paratuberculosis
ugcccgcggccgccgc

SEQ ID NO: 2864156 - RNA, 24 nt, Mycobacterium avium subsp. paratuberculosis
ugcccgcggccgccgccgcggccg

SEQ ID NO: 2864157 - RNA, 17 nt, Mycobacterium avium subsp. paratuberculosis
ugcccgcgggacacggc

SEQ ID NO: 2864158 - RNA, 21 nt, Mycobacterium avium subsp. paratuberculosis
ugcccgcgggccagacugcgc

SEQ ID NO: 2864159 - RNA, 16 nt, Mycobacterium avium subsp. paratuberculosis
ugcccgcggguggccu

SEQ ID NO: 2864160 - RNA, 17 nt, Mycobacterium avium subsp. paratuberculosis
ugcccgcggguggccuu

SEQ ID NO: 2864161 - RNA, 16 nt, Mycobacterium avium subsp. paratuberculosis
ugcccgcguccugcag

SEQ ID NO: 2864162 - RNA, 21 nt, Mycobacterium avium subsp. paratuberculosis
ugcccgcguccugcagcgccg

SEQ ID NO: 2864163 - RNA, 22 nt, Mycobacterium avium subsp. paratuberculosis
ugcccgcugacaaagcacaacu

SEQ ID NO: 2864164 - RNA, 14 nt, Mycobacterium avium subsp. paratuberculosis
ugcccgcugcggca

SEQ ID NO: 2864165 - RNA, 17 nt, Mycobacterium avium subsp. paratuberculosis
ugcccggaacggcgggc

SEQ ID NO: 2864166 - RNA, 20 nt, Mycobacterium avium subsp. paratuberculosis
ugcccggacgaugccgcggc

SEQ ID NO: 2864167 - RNA, 18 nt, Mycobacterium avium subsp. paratuberculosis
ugcccggagaaaccgucg

SEQ ID NO: 2864168 - RNA, 15 nt, Mycobacterium avium subsp. paratuberculosis
ugcccggaucgccga

SEQ ID NO: 2864169 - RNA, 15 nt, Mycobacterium avium subsp. paratuberculosis
ugcccggccauaaag

SEQ ID NO: 2864170 - RNA, 15 nt, Mycobacterium avium subsp. paratuberculosis
ugcccggcccgccgc

SEQ ID NO: 2864171 - RNA, 16 nt, Mycobacterium avium subsp. paratuberculosis
ugcccggcccgccgcu

SEQ ID NO: 2864172 - RNA, 21 nt, Mycobacterium avium subsp. paratuberculosis
ugcccggcccgccgcugcagc

SEQ ID NO: 2864173 - RNA, 14 nt, Mycobacterium avium subsp. paratuberculosis
ugcccggcgacggc

SEQ ID NO: 2864174 - RNA, 16 nt, Mycobacterium avium subsp. paratuberculosis
ugcccggcgccgacca

SEQ ID NO: 2864175 - RNA, 16 nt, Mycobacterium avium subsp. paratuberculosis
ugcccggcgcggacag

SEQ ID NO: 2864176 - RNA, 23 nt, Mycobacterium avium subsp. paratuberculosis
ugcccggcgcggacagcgcggug

SEQ ID NO: 2864177 - RNA, 19 nt, Mycobacterium avium subsp. paratuberculosis
ugcccggcggugccgaacc

SEQ ID NO: 2864178 - RNA, 15 nt, Mycobacterium avium subsp. paratuberculosis
ugcccggcucggugc

SEQ ID NO: 2864179 - RNA, 16 nt, Mycobacterium avium subsp. paratuberculosis
ugcccggcucggugcg

SEQ ID NO: 2864180 - RNA, 17 nt, Mycobacterium avium subsp. paratuberculosis
ugcccggcucggugcgc

SEQ ID NO: 2864181 - RNA, 11 nt, Mycobacterium avium subsp. paratuberculosis
ugcccgggccg

SEQ ID NO: 2864182 - RNA, 23 nt, Mycobacterium avium subsp. paratuberculosis
ugcccgggccgucaucgccgacg

SEQ ID NO: 2864183 - RNA, 15 nt, Mycobacterium avium subsp. paratuberculosis
ugcccgggccguccg

SEQ ID NO: 2864184 - RNA, 22 nt, Mycobacterium avium subsp. paratuberculosis
ugcccgggcuguugaccacggc

SEQ ID NO: 2864185 - RNA, 16 nt, Mycobacterium avium subsp. paratuberculosis
ugcccgggguccaccg

SEQ ID NO: 2864186 - RNA, 17 nt, Mycobacterium avium subsp. paratuberculosis
ugcccgggguccaccgg

SEQ ID NO: 2864187 - RNA, 21 nt, Mycobacterium avium subsp. paratuberculosis
ugcccgggguccaccggccga

SEQ ID NO: 2864188 - RNA, 23 nt, Mycobacterium avium subsp. paratuberculosis
ugcccggggucugacccaugccc

SEQ ID NO: 2864189 - RNA, 20 nt, Mycobacterium avium subsp. paratuberculosis
ugcccggggugcuggcguag

SEQ ID NO: 2864190 - RNA, 20 nt, Mycobacterium avium subsp. paratuberculosis
ugcccggguccuggaucagc

SEQ ID NO: 2864191 - RNA, 23 nt, Mycobacterium avium subsp. paratuberculosis
ugcccggguccuggaucagccag

SEQ ID NO: 2864192 - RNA, 17 nt, Mycobacterium avium subsp. paratuberculosis
ugcccggucugcggccg

SEQ ID NO: 2864193 - RNA, 17 nt, Mycobacterium avium subsp. paratuberculosis
ugcccguagucggcggc

SEQ ID NO: 2864194 - RNA, 18 nt, Mycobacterium avium subsp. paratuberculosis
ugcccguagucggcggcg

SEQ ID NO: 2864195 - RNA, 19 nt, Mycobacterium avium subsp. paratuberculosis
ugcccguagucggcggcga

SEQ ID NO: 2864196 - RNA, 17 nt, Mycobacterium avium subsp. paratuberculosis
ugcccgucacggccguc

SEQ ID NO: 2864197 - RNA, 22 nt, Mycobacterium avium subsp. paratuberculosis
ugcccgucgaccuccucgaccc

SEQ ID NO: 2864198 - RNA, 14 nt, Mycobacterium avium subsp. paratuberculosis
ugcccgucgccucc

SEQ ID NO: 2864199 - RNA, 22 nt, Mycobacterium avium subsp. paratuberculosis
ugcccgucggaggacaacgcgu

SEQ ID NO: 2864200 - RNA, 14 nt, Mycobacterium avium subsp. paratuberculosis
ugccgaucaggcug

SEQ ID NO: 2864201 - RNA, 15 nt, Mycobacterium avium subsp. paratuberculosis
ugccgaucaggcugg

SEQ ID NO: 2864202 - RNA, 15 nt, Mycobacterium avium subsp. paratuberculosis
ugccgaucgagacca

SEQ ID NO: 2864203 - RNA, 15 nt, Mycobacterium avium subsp. paratuberculosis
ugccgaucgccgcgg

SEQ ID NO: 2864204 - RNA, 16 nt, Mycobacterium avium subsp. paratuberculosis
ugccgaucgccgcggc

SEQ ID NO: 2864205 - RNA, 18 nt, Mycobacterium avium subsp. paratuberculosis
ugccgaucggggcgcagc

SEQ ID NO: 2864206 - RNA, 22 nt, Mycobacterium avium subsp. paratuberculosis
ugccgaucggggcgcagcccgg

SEQ ID NO: 2864207 - RNA, 13 nt, Mycobacterium avium subsp. paratuberculosis
ugccgaucugguc

SEQ ID NO: 2864208 - RNA, 18 nt, Mycobacterium avium subsp. paratuberculosis
ugccgaugccggccuggc

SEQ ID NO: 2864209 - RNA, 14 nt, Mycobacterium avium subsp. paratuberculosis
ugccgaugccggcg

SEQ ID NO: 2864210 - RNA, 14 nt, Mycobacterium avium subsp. paratuberculosis
ugccgauggccacc

SEQ ID NO: 2864211 - RNA, 13 nt, Mycobacterium avium subsp. paratuberculosis
ugccgauggcggu

SEQ ID NO: 2864212 - RNA, 17 nt, Mycobacterium avium subsp. paratuberculosis
ugccgaugucggcguug

SEQ ID NO: 2864213 - RNA, 13 nt, Mycobacterium avium subsp. paratuberculosis
ugccgauuccagc

SEQ ID NO: 2864214 - RNA, 19 nt, Mycobacterium avium subsp. paratuberculosis
ugccgcaacgggccgcagc

SEQ ID NO: 2864215 - RNA, 18 nt, Mycobacterium avium subsp. paratuberculosis
ugccgcacaccgcgcaga

SEQ ID NO: 2864216 - RNA, 16 nt, Mycobacterium avium subsp. paratuberculosis
ugccgcacaccgucuc

SEQ ID NO: 2864217 - RNA, 16 nt, Mycobacterium avium subsp. paratuberculosis
ugccgcaccagcaccc

SEQ ID NO: 2864218 - RNA, 14 nt, Mycobacterium avium subsp. paratuberculosis
ugccgcacccgauc

SEQ ID NO: 2864219 - RNA, 13 nt, Mycobacterium avium subsp. paratuberculosis
ugccgcacgacca

SEQ ID NO: 2864220 - RNA, 22 nt, Mycobacterium avium subsp. paratuberculosis
ugccgcacgaccaugucggcga

SEQ ID NO: 2864221 - RNA, 15 nt, Mycobacterium avium subsp. paratuberculosis
ugccgcagccguccc

SEQ ID NO: 2864222 - RNA, 15 nt, Mycobacterium avium subsp. paratuberculosis
ugccgcagcggcggc

SEQ ID NO: 2864223 - RNA, 19 nt, Mycobacterium avium subsp. paratuberculosis
ugccgcagcggcggcacgg

SEQ ID NO: 2864224 - RNA, 15 nt, Mycobacterium avium subsp. paratuberculosis
ugccgccaccgcgaa

SEQ ID NO: 2864225 - RNA, 19 nt, Mycobacterium avium subsp. paratuberculosis
ugccgcccaacgacgucgg

SEQ ID NO: 2864226 - RNA, 21 nt, Mycobacterium avium subsp. paratuberculosis
ugccgcccaacgacgucggcg

SEQ ID NO: 2864227 - RNA, 15 nt, Mycobacterium avium subsp. paratuberculosis
ugccgccccugcugg

SEQ ID NO: 2864228 - RNA, 14 nt, Mycobacterium avium subsp. paratuberculosis
ugccgcccggaccg

SEQ ID NO: 2864229 - RNA, 18 nt, Mycobacterium avium subsp. paratuberculosis
ugccgcccgucgccuccu

SEQ ID NO: 2864230 - RNA, 13 nt, Mycobacterium avium subsp. paratuberculosis
ugccgcccucggc

SEQ ID NO: 2864231 - RNA, 20 nt, Mycobacterium avium subsp. paratuberculosis
ugccgcccuugcucgcggcg

SEQ ID NO: 2864232 - RNA, 12 nt, Mycobacterium avium subsp. paratuberculosis
ugccgccgaccg

SEQ ID NO: 2864233 - RNA, 14 nt, Mycobacterium avium subsp. paratuberculosis
ugccgccgaccgcc

SEQ ID NO: 2864234 - RNA, 13 nt, Mycobacterium avium subsp. paratuberculosis
ugccgccgacgau

SEQ ID NO: 2864235 - RNA, 23 nt, Mycobacterium avium subsp. paratuberculosis
ugccgccgacgaugucgaaaccc

SEQ ID NO: 2864236 - RNA, 17 nt, Mycobacterium avium subsp. paratuberculosis
ugccgccgagggccagc

SEQ ID NO: 2864237 - RNA, 22 nt, Mycobacterium avium subsp. paratuberculosis
ugccgccgcacacuuccgggaa

SEQ ID NO: 2864238 - RNA, 16 nt, Mycobacterium avium subsp. paratuberculosis
ugccgccgcagcagcc

SEQ ID NO: 2864239 - RNA, 16 nt, Mycobacterium avium subsp. paratuberculosis
ugccgccgcccaggcc

SEQ ID NO: 2864240 - RNA, 17 nt, Mycobacterium avium subsp. paratuberculosis
ugccgccgcccaggccg

SEQ ID NO: 2864241 - RNA, 18 nt, Mycobacterium avium subsp. paratuberculosis
ugccgccgcccaggccga

SEQ ID NO: 2864242 - RNA, 21 nt, Mycobacterium avium subsp. paratuberculosis
ugccgccgcccaggccgagcg

SEQ ID NO: 2864243 - RNA, 23 nt, Mycobacterium avium subsp. paratuberculosis
ugccgccgccgcugucgauggac

SEQ ID NO: 2864244 - RNA, 20 nt, Mycobacterium avium subsp. paratuberculosis
ugccgccgcgacgaugccgg

SEQ ID NO: 2864245 - RNA, 13 nt, Mycobacterium avium subsp. paratuberculosis
ugccgccgcgcgc

SEQ ID NO: 2864246 - RNA, 14 nt, Mycobacterium avium subsp. paratuberculosis
ugccgccgcgcgcg

SEQ ID NO: 2864247 - RNA, 18 nt, Mycobacterium avium subsp. paratuberculosis
ugccgccgcgcgcggcca

SEQ ID NO: 2864248 - RNA, 14 nt, Mycobacterium avium subsp. paratuberculosis
ugccgccggccucg

SEQ ID NO: 2864249 - RNA, 17 nt, Mycobacterium avium subsp. paratuberculosis
ugccgccggccucgggg

SEQ ID NO: 2864250 - RNA, 12 nt, Mycobacterium avium subsp. paratuberculosis
ugccgccggcgc

SEQ ID NO: 2864251 - RNA, 15 nt, Mycobacterium avium subsp. paratuberculosis
ugccgccggcgcagu

SEQ ID NO: 2864252 - RNA, 16 nt, Mycobacterium avium subsp. paratuberculosis
ugccgccggcgcgguu

SEQ ID NO: 2864253 - RNA, 14 nt, Mycobacterium avium subsp. paratuberculosis
ugccgccgggcacc

SEQ ID NO: 2864254 - RNA, 23 nt, Mycobacterium avium subsp. paratuberculosis
ugccgccgggcaccucggcgucg

SEQ ID NO: 2864255 - RNA, 16 nt, Mycobacterium avium subsp. paratuberculosis
ugccgccgggccaggu

SEQ ID NO: 2864256 - RNA, 22 nt, Mycobacterium avium subsp. paratuberculosis
ugccgccggggacccgcaccgg

SEQ ID NO: 2864257 - RNA, 16 nt, Mycobacterium avium subsp. paratuberculosis
ugccgccggggugcac

SEQ ID NO: 2864258 - RNA, 20 nt, Mycobacterium avium subsp. paratuberculosis
ugccgccggucacggcgucg

SEQ ID NO: 2864259 - RNA, 16 nt, Mycobacterium avium subsp. paratuberculosis
ugccgccgucgacgac

SEQ ID NO: 2864260 - RNA, 16 nt, Mycobacterium avium subsp. paratuberculosis
ugccgccgugcgcggc

SEQ ID NO: 2864261 - RNA, 17 nt, Mycobacterium avium subsp. paratuberculosis
ugccgcgacccgggccg

SEQ ID NO: 2864262 - RNA, 17 nt, Mycobacterium avium subsp. paratuberculosis
ugccgcgacucgguguc

SEQ ID NO: 2864263 - RNA, 15 nt, Mycobacterium avium subsp. paratuberculosis
ugccgcgaugcccgc

SEQ ID NO: 2864264 - RNA, 12 nt, Mycobacterium avium subsp. paratuberculosis
ugccgcgcacca

SEQ ID NO: 2864265 - RNA, 16 nt, Mycobacterium avium subsp. paratuberculosis
ugccgcgcaccaccuc

SEQ ID NO: 2864266 - RNA, 17 nt, Mycobacterium avium subsp. paratuberculosis
ugccgcgcacuggagug

SEQ ID NO: 2864267 - RNA, 20 nt, Mycobacterium avium subsp. paratuberculosis
ugccgcgcacuggagugcug

SEQ ID NO: 2864268 - RNA, 14 nt, Mycobacterium avium subsp. paratuberculosis
ugccgcgcagcacc

SEQ ID NO: 2864269 - RNA, 21 nt, Mycobacterium avium subsp. paratuberculosis
ugccgcgcaggccguccagca

SEQ ID NO: 2864270 - RNA, 22 nt, Mycobacterium avium subsp. paratuberculosis
ugccgcgccaacgaggcacggc

SEQ ID NO: 2864271 - RNA, 14 nt, Mycobacterium avium subsp. paratuberculosis
ugccgcgccccgag

SEQ ID NO: 2864272 - RNA, 16 nt, Mycobacterium avium subsp. paratuberculosis
ugccgcgccccgagca

SEQ ID NO: 2864273 - RNA, 17 nt, Mycobacterium avium subsp. paratuberculosis
ugccgcgccccgagcag

SEQ ID NO: 2864274 - RNA, 19 nt, Mycobacterium avium subsp. paratuberculosis
ugccgcgccccgagcagcg

SEQ ID NO: 2864275 - RNA, 20 nt, Mycobacterium avium subsp. paratuberculosis
ugccgcgccccgagcagcgg

SEQ ID NO: 2864276 - RNA, 21 nt, Mycobacterium avium subsp. paratuberculosis
ugccgcgccccgagcagcggg

SEQ ID NO: 2864277 - RNA, 22 nt, Mycobacterium avium subsp. paratuberculosis
ugccgcgccccgagcagcgggu

SEQ ID NO: 2864278 - RNA, 19 nt, Mycobacterium avium subsp. paratuberculosis
ugccgcgccgccacaccuc

SEQ ID NO: 2864279 - RNA, 12 nt, Mycobacterium avium subsp. paratuberculosis
ugccgcgccggg

SEQ ID NO: 2864280 - RNA, 13 nt, Mycobacterium avium subsp. paratuberculosis
ugccgcgccgggg

SEQ ID NO: 2864281 - RNA, 14 nt, Mycobacterium avium subsp. paratuberculosis
ugccgcgcgccgac

SEQ ID NO: 2864282 - RNA, 15 nt, Mycobacterium avium subsp. paratuberculosis
ugccgcgcgccgaca

SEQ ID NO: 2864283 - RNA, 20 nt, Mycobacterium avium subsp. paratuberculosis
ugccgcgcggacgcggcgga

SEQ ID NO: 2864284 - RNA, 13 nt, Mycobacterium avium subsp. paratuberculosis
ugccgcgcggcag

SEQ ID NO: 2864285 - RNA, 21 nt, Mycobacterium avium subsp. paratuberculosis
ugccggccuggcccagccgcg

SEQ ID NO: 2864286 - RNA, 17 nt, Mycobacterium avium subsp. paratuberculosis
ugccggcgaccagcccc

SEQ ID NO: 2864287 - RNA, 20 nt, Mycobacterium avium subsp. paratuberculosis
ugccggcgacgaacgcuucc

SEQ ID NO: 2864288 - RNA, 22 nt, Mycobacterium avium subsp. paratuberculosis
ugccggcgaucaccgggacacc

SEQ ID NO: 2864289 - RNA, 18 nt, Mycobacterium avium subsp. paratuberculosis
ugccggcgauccgcgcgg

SEQ ID NO: 2864290 - RNA, 20 nt, Mycobacterium avium subsp. paratuberculosis
ugccggcgauccgcgcggcg

SEQ ID NO: 2864291 - RNA, 16 nt, Mycobacterium avium subsp. paratuberculosis
ugccggcgcacccgca

SEQ ID NO: 2864292 - RNA, 18 nt, Mycobacterium avium subsp. paratuberculosis
ugccggcgcaccgcgucg

SEQ ID NO: 2864293 - RNA, 17 nt, Mycobacterium avium subsp. paratuberculosis
ugccggcgcccagcggc

SEQ ID NO: 2864294 - RNA, 18 nt, Mycobacterium avium subsp. paratuberculosis
ugccggcgcccagcggcg

SEQ ID NO: 2864295 - RNA, 19 nt, Mycobacterium avium subsp. paratuberculosis
ugccggcgcccagcggcga

SEQ ID NO: 2864296 - RNA, 13 nt, Mycobacterium avium subsp. paratuberculosis
ugccggcgccgau

SEQ ID NO: 2864297 - RNA, 14 nt, Mycobacterium avium subsp. paratuberculosis
ugccggcgccgauu

SEQ ID NO: 2864298 - RNA, 14 nt, Mycobacterium avium subsp. paratuberculosis
ugccggcgcucguc

SEQ ID NO: 2864299 - RNA, 19 nt, Mycobacterium avium subsp. paratuberculosis
ugccggcgcucgucgucgc

SEQ ID NO: 2864300 - RNA, 22 nt, Mycobacterium avium subsp. paratuberculosis
ugccggcgcucgucgucgccga

SEQ ID NO: 2864301 - RNA, 21 nt, Mycobacterium avium subsp. paratuberculosis
ugccggcgcugcccgucgacc

SEQ ID NO: 2864302 - RNA, 21 nt, Mycobacterium avium subsp. paratuberculosis
ugccggcgcuucugcgccggu

SEQ ID NO: 2864303 - RNA, 22 nt, Mycobacterium avium subsp. paratuberculosis
ugccggcgcuucugcgccgguu

SEQ ID NO: 2864304 - RNA, 21 nt, Mycobacterium avium subsp. paratuberculosis
ugccggcggcaggugaaggug

SEQ ID NO: 2864305 - RNA, 14 nt, Mycobacterium avium subsp. paratuberculosis
ugccggcggccagc

SEQ ID NO: 2864306 - RNA, 18 nt, Mycobacterium avium subsp. paratuberculosis
ugccggcggccgccggca

SEQ ID NO: 2864307 - RNA, 23 nt, Mycobacterium avium subsp. paratuberculosis
ugccggcggccgccggcaccguc

SEQ ID NO: 2864308 - RNA, 20 nt, Mycobacterium avium subsp. paratuberculosis
ugccggcggcgaagccggcc

SEQ ID NO: 2864309 - RNA, 19 nt, Mycobacterium avium subsp. paratuberculosis
ugccggcggcggaccgucg

SEQ ID NO: 2864310 - RNA, 15 nt, Mycobacterium avium subsp. paratuberculosis
ugccggcggcgggcu

SEQ ID NO: 2864311 - RNA, 19 nt, Mycobacterium avium subsp. paratuberculosis
ugccggcgguguccacgau

SEQ ID NO: 2864312 - RNA, 17 nt, Mycobacterium avium subsp. paratuberculosis
ugccggcguagcagucg

SEQ ID NO: 2864313 - RNA, 14 nt, Mycobacterium avium subsp. paratuberculosis
ugccggcucggcgg

SEQ ID NO: 2864314 - RNA, 15 nt, Mycobacterium avium subsp. paratuberculosis
ugccggcuugggcga

SEQ ID NO: 2864315 - RNA, 22 nt, Mycobacterium avium subsp. paratuberculosis
ugccgggacagguagcgcagcc

SEQ ID NO: 2864316 - RNA, 21 nt, Mycobacterium avium subsp. paratuberculosis
ugccgggcaaccacagcggcg

SEQ ID NO: 2864317 - RNA, 23 nt, Mycobacterium avium subsp. paratuberculosis
ugccgggcaaccacagcggcgca

SEQ ID NO: 2864318 - RNA, 19 nt, Mycobacterium avium subsp. paratuberculosis
ugccgggcagcggccccac

SEQ ID NO: 2864319 - RNA, 19 nt, Mycobacterium avium subsp. paratuberculosis
ugccgggcaggaugccgcg

SEQ ID NO: 2864320 - RNA, 20 nt, Mycobacterium avium subsp. paratuberculosis
ugccgggcauggcuggaagu

SEQ ID NO: 2864321 - RNA, 13 nt, Mycobacterium avium subsp. paratuberculosis
ugccgggccaggu

SEQ ID NO: 2864322 - RNA, 14 nt, Mycobacterium avium subsp. paratuberculosis
ugccgggccgcauc

SEQ ID NO: 2864323 - RNA, 23 nt, Mycobacterium avium subsp. paratuberculosis
ugccgggccgcauccagcgccgc

SEQ ID NO: 2864324 - RNA, 16 nt, Mycobacterium avium subsp. paratuberculosis
ugccgggcgucgacga

SEQ ID NO: 2864325 - RNA, 13 nt, Mycobacterium avium subsp. paratuberculosis
ugccggggcagca

SEQ ID NO: 2864326 - RNA, 13 nt, Mycobacterium avium subsp. paratuberculosis
ugccggggcgcag

SEQ ID NO: 2864327 - RNA, 22 nt, Mycobacterium avium subsp. paratuberculosis
ugccgggggaggcguugcgucc

SEQ ID NO: 2864328 - RNA, 17 nt, Mycobacterium avium subsp. paratuberculosis
ugccgggggccgagcag

SEQ ID NO: 2864329 - RNA, 14 nt, Mycobacterium avium subsp. paratuberculosis
ugccggggugcagc

SEQ ID NO: 2864330 - RNA, 19 nt, Mycobacterium avium subsp. paratuberculosis
ugccgggucgcagcggcac

SEQ ID NO: 2864331 - RNA, 18 nt, Mycobacterium avium subsp. paratuberculosis
ugccgggugaugcagugg

SEQ ID NO: 2864332 - RNA, 21 nt, Mycobacterium avium subsp. paratuberculosis
ugccgggugcugaacgccugc

SEQ ID NO: 2864333 - RNA, 19 nt, Mycobacterium avium subsp. paratuberculosis
ugccggguuucggcccggc

SEQ ID NO: 2864334 - RNA, 20 nt, Mycobacterium avium subsp. paratuberculosis
ugccggguuucggcccggcu

SEQ ID NO: 2864335 - RNA, 19 nt, Mycobacterium avium subsp. paratuberculosis
ugccgguacggccgacgcc

SEQ ID NO: 2864336 - RNA, 23 nt, Mycobacterium avium subsp. paratuberculosis
ugccggucaagcgcuuucgccga

SEQ ID NO: 2864337 - RNA, 13 nt, Mycobacterium avium subsp. paratuberculosis
ugccggucaggca

SEQ ID NO: 2864338 - RNA, 18 nt, Mycobacterium avium subsp. paratuberculosis
ugccggucauccgggcca

SEQ ID NO: 2864339 - RNA, 16 nt, Mycobacterium avium subsp. paratuberculosis
ugccgguccagccgcc

SEQ ID NO: 2864340 - RNA, 18 nt, Mycobacterium avium subsp. paratuberculosis
ugccggucgaugucggcg

SEQ ID NO: 2864341 - RNA, 23 nt, Mycobacterium avium subsp. paratuberculosis
ugccggucgggauggcggcguug

SEQ ID NO: 2864342 - RNA, 21 nt, Mycobacterium avium subsp. paratuberculosis
ugccggucuuguagucgacca

SEQ ID NO: 2864343 - RNA, 20 nt, Mycobacterium avium subsp. paratuberculosis
ugccggugaugaacgcgccg

SEQ ID NO: 2864344 - RNA, 23 nt, Mycobacterium avium subsp. paratuberculosis
ugccggugaugaacgcgccgucg

SEQ ID NO: 2864345 - RNA, 15 nt, Mycobacterium avium subsp. paratuberculosis
ugccggugcagcacc

SEQ ID NO: 2864346 - RNA, 17 nt, Mycobacterium avium subsp. paratuberculosis
ugccggugcagcaccuc

SEQ ID NO: 2864347 - RNA, 12 nt, Mycobacterium avium subsp. paratuberculosis
ugccggugccga

SEQ ID NO: 2864348 - RNA, 16 nt, Mycobacterium avium subsp. paratuberculosis
ugccggugcugcucga

SEQ ID NO: 2864349 - RNA, 15 nt, Mycobacterium avium subsp. paratuberculosis
ugccgguggacgagg

SEQ ID NO: 2864350 - RNA, 23 nt, Mycobacterium avium subsp. paratuberculosis
ugccgguggauauuucgcggccg

SEQ ID NO: 2864351 - RNA, 23 nt, Mycobacterium avium subsp. paratuberculosis
ugccgguggcguccuugccgauc

SEQ ID NO: 2864352 - RNA, 20 nt, Mycobacterium avium subsp. paratuberculosis
ugccgguguucaagccggcg

SEQ ID NO: 2864353 - RNA, 15 nt, Mycobacterium avium subsp. paratuberculosis
ugccgguguugccga

SEQ ID NO: 2864354 - RNA, 18 nt, Mycobacterium avium subsp. paratuberculosis
ugccgguguugccgacgg

SEQ ID NO: 2864355 - RNA, 21 nt, Mycobacterium avium subsp. paratuberculosis
ugccgguguugccgacggcgc

SEQ ID NO: 2864356 - RNA, 15 nt, Mycobacterium avium subsp. paratuberculosis
ugccguaaguggcgc

SEQ ID NO: 2864357 - RNA, 16 nt, Mycobacterium avium subsp. paratuberculosis
ugccguaaguggcgcc

SEQ ID NO: 2864358 - RNA, 22 nt, Mycobacterium avium subsp. paratuberculosis
ugccguaaguggcgccgcgguc

SEQ ID NO: 2864359 - RNA, 16 nt, Mycobacterium avium subsp. paratuberculosis
ugccguacauggugac

SEQ ID NO: 2864360 - RNA, 15 nt, Mycobacterium avium subsp. paratuberculosis
ugccguagaccagca

SEQ ID NO: 2864361 - RNA, 13 nt, Mycobacterium avium subsp. paratuberculosis
ugccguagagccg

SEQ ID NO: 2864362 - RNA, 18 nt, Mycobacterium avium subsp. paratuberculosis
ugccguagaucucgcgcc

SEQ ID NO: 2864363 - RNA, 21 nt, Mycobacterium avium subsp. paratuberculosis
ugccguagaucucgcgccgcg

SEQ ID NO: 2864364 - RNA, 17 nt, Mycobacterium avium subsp. paratuberculosis
ugccguagcgcugggug

SEQ ID NO: 2864365 - RNA, 14 nt, Mycobacterium avium subsp. paratuberculosis
ugccguagcggucg

SEQ ID NO: 2864366 - RNA, 19 nt, Mycobacterium avium subsp. paratuberculosis
ugccguagcggucgcccca

SEQ ID NO: 2864367 - RNA, 23 nt, Mycobacterium avium subsp. paratuberculosis
ugccguaggacaggaacgggccg

SEQ ID NO: 2864368 - RNA, 15 nt, Mycobacterium avium subsp. paratuberculosis
ugccgucaccggcca

SEQ ID NO: 2864369 - RNA, 20 nt, Mycobacterium avium subsp. paratuberculosis
ugccuuggcccgcgcggccg

SEQ ID NO: 2864370 - RNA, 15 nt, Mycobacterium avium subsp. paratuberculosis
ugccuuugccguggc

SEQ ID NO: 2864371 - RNA, 16 nt, Mycobacterium avium subsp. paratuberculosis
ugcgaacagccacggu

SEQ ID NO: 2864372 - RNA, 19 nt, Mycobacterium avium subsp. paratuberculosis
ugcgaauacccgcccagca

SEQ ID NO: 2864373 - RNA, 19 nt, Mycobacterium avium subsp. paratuberculosis
ugcgaaucaucguggcgcg

SEQ ID NO: 2864374 - RNA, 23 nt, Mycobacterium avium subsp. paratuberculosis
ugcgaauccgauugcggcgcagg

SEQ ID NO: 2864375 - RNA, 14 nt, Mycobacterium avium subsp. paratuberculosis
ugcgacaccgcguc

SEQ ID NO: 2864376 - RNA, 21 nt, Mycobacterium avium subsp. paratuberculosis
ugcgacagcacgggcgggcag

SEQ ID NO: 2864377 - RNA, 19 nt, Mycobacterium avium subsp. paratuberculosis
ugcgacaggucggcggucg

SEQ ID NO: 2864378 - RNA, 14 nt, Mycobacterium avium subsp. paratuberculosis
ugcgacccaccguc

SEQ ID NO: 2864379 - RNA, 17 nt, Mycobacterium avium subsp. paratuberculosis
ugcgaccgccgccgcga

SEQ ID NO: 2864380 - RNA, 15 nt, Mycobacterium avium subsp. paratuberculosis
ugcgacgacgucguc

SEQ ID NO: 2864381 - RNA, 13 nt, Mycobacterium avium subsp. paratuberculosis
ugcgacgcccacu

SEQ ID NO: 2864382 - RNA, 11 nt, Mycobacterium avium subsp. paratuberculosis
ugcgacgccgc

SEQ ID NO: 2864383 - RNA, 15 nt, Mycobacterium avium subsp. paratuberculosis
ugcgacgccgcgcag

SEQ ID NO: 2864384 - RNA, 21 nt, Mycobacterium avium subsp. paratuberculosis
ugcgacggcaauccggccccg

SEQ ID NO: 2864385 - RNA, 12 nt, Mycobacterium avium subsp. paratuberculosis
ugcgacggcagc

SEQ ID NO: 2864386 - RNA, 15 nt, Mycobacterium avium subsp. paratuberculosis
ugcgacggcagcacc

SEQ ID NO: 2864387 - RNA, 16 nt, Mycobacterium avium subsp. paratuberculosis
ugcgacggcagcaccu

SEQ ID NO: 2864388 - RNA, 17 nt, Mycobacterium avium subsp. paratuberculosis
ugcgacuucuacggcgg

SEQ ID NO: 2864389 - RNA, 18 nt, Mycobacterium avium subsp. paratuberculosis
ugcgacuucuacggcggg

SEQ ID NO: 2864390 - RNA, 21 nt, Mycobacterium avium subsp. paratuberculosis
ugcgacuucuacggcgggccg

SEQ ID NO: 2864391 - RNA, 19 nt, Mycobacterium avium subsp. paratuberculosis
ugcgagaucggcagaccgg

SEQ ID NO: 2864392 - RNA, 13 nt, Mycobacterium avium subsp. paratuberculosis
ugcgagccaccuc

SEQ ID NO: 2864393 - RNA, 18 nt, Mycobacterium avium subsp. paratuberculosis
ugcgagccaccucgauca

SEQ ID NO: 2864394 - RNA, 20 nt, Mycobacterium avium subsp. paratuberculosis
ugcgagccaccucgaucagc

SEQ ID NO: 2864395 - RNA, 12 nt, Mycobacterium avium subsp. paratuberculosis
ugcgagccagcu

SEQ ID NO: 2864396 - RNA, 17 nt, Mycobacterium avium subsp. paratuberculosis
ugcgagccagcugcgcg

SEQ ID NO: 2864397 - RNA, 17 nt, Mycobacterium avium subsp. paratuberculosis
ugcgagcccggccaguc

SEQ ID NO: 2864398 - RNA, 14 nt, Mycobacterium avium subsp. paratuberculosis
ugcgagccgagcac

SEQ ID NO: 2864399 - RNA, 19 nt, Mycobacterium avium subsp. paratuberculosis
ugcgagccgagcacgcagc

SEQ ID NO: 2864400 - RNA, 23 nt, Mycobacterium avium subsp. paratuberculosis
ugcgagccggagccuugcuggcg

SEQ ID NO: 2864401 - RNA, 22 nt, Mycobacterium avium subsp. paratuberculosis
ugcgagccggucugggcgacca

SEQ ID NO: 2864402 - RNA, 22 nt, Mycobacterium avium subsp. paratuberculosis
ugcgagcgugaaguuaguuuca

SEQ ID NO: 2864403 - RNA, 15 nt, Mycobacterium avium subsp. paratuberculosis
ugcgagucaucgcca

SEQ ID NO: 2864404 - RNA, 21 nt, Mycobacterium avium subsp. paratuberculosis
ugcgaucauuccgccgaaacc

SEQ ID NO: 2864405 - RNA, 23 nt, Mycobacterium avium subsp. paratuberculosis
ugcgaucgaugaauccgcgcagc

SEQ ID NO: 2864406 - RNA, 18 nt, Mycobacterium avium subsp. paratuberculosis
ugcgaucgccgacgccag

SEQ ID NO: 2864407 - RNA, 19 nt, Mycobacterium avium subsp. paratuberculosis
ugcgaucgccgacgccagc

SEQ ID NO: 2864408 - RNA, 14 nt, Mycobacterium avium subsp. paratuberculosis
ugcgaucgccgcgc

SEQ ID NO: 2864409 - RNA, 14 nt, Mycobacterium avium subsp. paratuberculosis
ugcgaugaccaccc

SEQ ID NO: 2864410 - RNA, 17 nt, Mycobacterium avium subsp. paratuberculosis
ugcgaugaccacccucg

SEQ ID NO: 2864411 - RNA, 19 nt, Mycobacterium avium subsp. paratuberculosis
ugcgaugagcucgcgcugc

SEQ ID NO: 2864412 - RNA, 15 nt, Mycobacterium avium subsp. paratuberculosis
ugcgaugggugaucg

SEQ ID NO: 2864413 - RNA, 16 nt, Mycobacterium avium subsp. paratuberculosis
ugcgaugguggucgcc

SEQ ID NO: 2864414 - RNA, 16 nt, Mycobacterium avium subsp. paratuberculosis
ugcgauugguggcccg

SEQ ID NO: 2864415 - RNA, 19 nt, Mycobacterium avium subsp. paratuberculosis
ugcgauugguggcccgguc

SEQ ID NO: 2864416 - RNA, 20 nt, Mycobacterium avium subsp. paratuberculosis
ugcgauugguggcccggucg

SEQ ID NO: 2864417 - RNA, 18 nt, Mycobacterium avium subsp. paratuberculosis
ugcgcaacaccucggcga

SEQ ID NO: 2864418 - RNA, 19 nt, Mycobacterium avium subsp. paratuberculosis
ugcgcaacaccucggcgac

SEQ ID NO: 2864419 - RNA, 23 nt, Mycobacterium avium subsp. paratuberculosis
ugcgcaacaccucggcgacgucc

SEQ ID NO: 2864420 - RNA, 21 nt, Mycobacterium avium subsp. paratuberculosis
ugcgcaacagcauuucgcgcg

SEQ ID NO: 2864421 - RNA, 19 nt, Mycobacterium avium subsp. paratuberculosis
ugcgcaagcaccggcuggc

SEQ ID NO: 2864422 - RNA, 23 nt, Mycobacterium avium subsp. paratuberculosis
ugcgcaaguagcgcuccaccagg

SEQ ID NO: 2864423 - RNA, 14 nt, Mycobacterium avium subsp. paratuberculosis
ugcgcaccacgccc

SEQ ID NO: 2864424 - RNA, 17 nt, Mycobacterium avium subsp. paratuberculosis
ugcgcaccacgucgggu

SEQ ID NO: 2864425 - RNA, 18 nt, Mycobacterium avium subsp. paratuberculosis
ugcgcacccccggggccu

SEQ ID NO: 2864426 - RNA, 12 nt, Mycobacterium avium subsp. paratuberculosis
ugcgcacccggu

SEQ ID NO: 2864427 - RNA, 17 nt, Mycobacterium avium subsp. paratuberculosis
ugcgcacccgguccggc

SEQ ID NO: 2864428 - RNA, 13 nt, Mycobacterium avium subsp. paratuberculosis
ugcgcaccgccag

SEQ ID NO: 2864429 - RNA, 23 nt, Mycobacterium avium subsp. paratuberculosis
ugcgcaccgcggauuccagcgcg

SEQ ID NO: 2864430 - RNA, 14 nt, Mycobacterium avium subsp. paratuberculosis
ugcgcaccgcggcg

SEQ ID NO: 2864431 - RNA, 20 nt, Mycobacterium avium subsp. paratuberculosis
ugcgcaccgugccgcccguc

SEQ ID NO: 2864432 - RNA, 20 nt, Mycobacterium avium subsp. paratuberculosis
ugcgcaccugcuccucgaac

SEQ ID NO: 2864433 - RNA, 17 nt, Mycobacterium avium subsp. paratuberculosis
ugcgcacgaucugcagg

SEQ ID NO: 2864434 - RNA, 20 nt, Mycobacterium avium subsp. paratuberculosis
ugcgcacgaucugcaggccg

SEQ ID NO: 2864435 - RNA, 18 nt, Mycobacterium avium subsp. paratuberculosis
ugcgcacguagcccagcg

SEQ ID NO: 2864436 - RNA, 18 nt, Mycobacterium avium subsp. paratuberculosis
ugcgcagacccgguggcc

SEQ ID NO: 2864437 - RNA, 12 nt, Mycobacterium avium subsp. paratuberculosis
ugcgcagcaccg

SEQ ID NO: 2864438 - RNA, 15 nt, Mycobacterium avium subsp. paratuberculosis
ugcgcagcaccgucc

SEQ ID NO: 2864439 - RNA, 13 nt, Mycobacterium avium subsp. paratuberculosis
ugcgcagcaccuu

SEQ ID NO: 2864440 - RNA, 12 nt, Mycobacterium avium subsp. paratuberculosis
ugcgcagcagca

SEQ ID NO: 2864441 - RNA, 23 nt, Mycobacterium avium subsp. paratuberculosis
ugcgcagcagcaggucggccagc

SEQ ID NO: 2864442 - RNA, 17 nt, Mycobacterium avium subsp. paratuberculosis
ugcgcagcagcgccagc

SEQ ID NO: 2864443 - RNA, 14 nt, Mycobacterium avium subsp. paratuberculosis
ugcgcagcagcggc

SEQ ID NO: 2864444 - RNA, 20 nt, Mycobacterium avium subsp. paratuberculosis
ugcgcagccgucgcaucagc

SEQ ID NO: 2864445 - RNA, 15 nt, Mycobacterium avium subsp. paratuberculosis
ugcgcagccgugccc

SEQ ID NO: 2864446 - RNA, 12 nt, Mycobacterium avium subsp. paratuberculosis
ugcgcagcgcgu

SEQ ID NO: 2864447 - RNA, 14 nt, Mycobacterium avium subsp. paratuberculosis
ugcgcagcgcgucg

SEQ ID NO: 2864448 - RNA, 19 nt, Mycobacterium avium subsp. paratuberculosis
ugcgcaggcggcgcgcagc

SEQ ID NO: 2864449 - RNA, 21 nt, Mycobacterium avium subsp. paratuberculosis
ugcgcaggcggcgcgcagccg

SEQ ID NO: 2864450 - RNA, 12 nt, Mycobacterium avium subsp. paratuberculosis
ugcgcaucagcg

SEQ ID NO: 2864451 - RNA, 15 nt, Mycobacterium avium subsp. paratuberculosis
ugcgcaucagcgcca

SEQ ID NO: 2864452 - RNA, 16 nt, Mycobacterium avium subsp. paratuberculosis
ugcgcaucgagcugca

SEQ ID NO: 2864453 - RNA, 22 nt, Mycobacterium avium subsp. paratuberculosis
ugcgcauggcgugcugaugcug

SEQ ID NO: 2864454 - RNA, 17 nt, Mycobacterium avium subsp. paratuberculosis
ugcgccggguggccggg

SEQ ID NO: 2864455 - RNA, 21 nt, Mycobacterium avium subsp. paratuberculosis
ugcgccgguucgcuggcggcc

SEQ ID NO: 2864456 - RNA, 18 nt, Mycobacterium avium subsp. paratuberculosis
ugcgccgucaccggcugc

SEQ ID NO: 2864457 - RNA, 15 nt, Mycobacterium avium subsp. paratuberculosis
ugcgccgucacguca

SEQ ID NO: 2864458 - RNA, 16 nt, Mycobacterium avium subsp. paratuberculosis
ugcgccguccggccac

SEQ ID NO: 2864459 - RNA, 20 nt, Mycobacterium avium subsp. paratuberculosis
ugcgccguccggccacgacc

SEQ ID NO: 2864460 - RNA, 21 nt, Mycobacterium avium subsp. paratuberculosis
ugcgccucgaucugguucacc

SEQ ID NO: 2864461 - RNA, 18 nt, Mycobacterium avium subsp. paratuberculosis
ugcgccugcacggugccg

SEQ ID NO: 2864462 - RNA, 12 nt, Mycobacterium avium subsp. paratuberculosis
ugcgccuuggcc

SEQ ID NO: 2864463 - RNA, 14 nt, Mycobacterium avium subsp. paratuberculosis
ugcgcgaacagcga

SEQ ID NO: 2864464 - RNA, 22 nt, Mycobacterium avium subsp. paratuberculosis
ugcgcgacaccugcucaccgag

SEQ ID NO: 2864465 - RNA, 15 nt, Mycobacterium avium subsp. paratuberculosis
ugcgcgacgccguca

SEQ ID NO: 2864466 - RNA, 20 nt, Mycobacterium avium subsp. paratuberculosis
ugcgcgacggccucgccguc

SEQ ID NO: 2864467 - RNA, 19 nt, Mycobacterium avium subsp. paratuberculosis
ugcgcgacgggcguccgag

SEQ ID NO: 2864468 - RNA, 15 nt, Mycobacterium avium subsp. paratuberculosis
ugcgcgagauggcga

SEQ ID NO: 2864469 - RNA, 19 nt, Mycobacterium avium subsp. paratuberculosis
ugcgcgagauggcgaucag

SEQ ID NO: 2864470 - RNA, 22 nt, Mycobacterium avium subsp. paratuberculosis
ugcgcgagauggcgaucagaug

SEQ ID NO: 2864471 - RNA, 12 nt, Mycobacterium avium subsp. paratuberculosis
ugcgcgagcaga

SEQ ID NO: 2864472 - RNA, 18 nt, Mycobacterium avium subsp. paratuberculosis
ugcgcgagcagcucgaca

SEQ ID NO: 2864473 - RNA, 22 nt, Mycobacterium avium subsp. paratuberculosis
ugcgcgaggaggggucggugcg

SEQ ID NO: 2864474 - RNA, 18 nt, Mycobacterium avium subsp. paratuberculosis
ugcgcgaguaggcgaaga

SEQ ID NO: 2864475 - RNA, 18 nt, Mycobacterium avium subsp. paratuberculosis
ugcgcgagucgagcaccg

SEQ ID NO: 2864476 - RNA, 23 nt, Mycobacterium avium subsp. paratuberculosis
ugcgcgagucgagcaccgcgacc

SEQ ID NO: 2864477 - RNA, 16 nt, Mycobacterium avium subsp. paratuberculosis
ugcgcgaugucgacgg

SEQ ID NO: 2864478 - RNA, 14 nt, Mycobacterium avium subsp. paratuberculosis
ugcgcgccagcagc

SEQ ID NO: 2864479 - RNA, 14 nt, Mycobacterium avium subsp. paratuberculosis
ugcgcgccccggcc

SEQ ID NO: 2864480 - RNA, 16 nt, Mycobacterium avium subsp. paratuberculosis
ugcgcgccccggcccg

SEQ ID NO: 2864481 - RNA, 14 nt, Mycobacterium avium subsp. paratuberculosis
ugcgcgccgaccgc

SEQ ID NO: 2864482 - RNA, 15 nt, Mycobacterium avium subsp. paratuberculosis
ugcgcgccgaccgcg

SEQ ID NO: 2864483 - RNA, 14 nt, Mycobacterium avium subsp. paratuberculosis
ugcgcgccgacgac

SEQ ID NO: 2864484 - RNA, 17 nt, Mycobacterium avium subsp. paratuberculosis
ugcgcgccgacgaccag

SEQ ID NO: 2864485 - RNA, 11 nt, Mycobacterium avium subsp. paratuberculosis
ugcgcgccgau

SEQ ID NO: 2864486 - RNA, 19 nt, Mycobacterium avium subsp. paratuberculosis
ugcgcgccgauguggccgg

SEQ ID NO: 2864487 - RNA, 15 nt, Mycobacterium avium subsp. paratuberculosis
ugcgcgccgcaaccg

SEQ ID NO: 2864488 - RNA, 12 nt, Mycobacterium avium subsp. paratuberculosis
ugcgcgccgccc

SEQ ID NO: 2864489 - RNA, 14 nt, Mycobacterium avium subsp. paratuberculosis
ugcgcgccgcccuc

SEQ ID NO: 2864490 - RNA, 21 nt, Mycobacterium avium subsp. paratuberculosis
ugcgcgccgcccucgccgaac

SEQ ID NO: 2864491 - RNA, 23 nt, Mycobacterium avium subsp. paratuberculosis
ugcgcgccgcccucgccgaaccg

SEQ ID NO: 2864492 - RNA, 13 nt, Mycobacterium avium subsp. paratuberculosis
ugcgcgccgcgac

SEQ ID NO: 2864493 - RNA, 22 nt, Mycobacterium avium subsp. paratuberculosis
ugcgcgccgcgacgucggugua

SEQ ID NO: 2864494 - RNA, 13 nt, Mycobacterium avium subsp. paratuberculosis
ugcgcgccggcgg

SEQ ID NO: 2864495 - RNA, 16 nt, Mycobacterium avium subsp. paratuberculosis
ugcgcgccgucggcga

SEQ ID NO: 2864496 - RNA, 17 nt, Mycobacterium avium subsp. paratuberculosis
ugcgcgccgucggcgau

SEQ ID NO: 2864497 - RNA, 13 nt, Mycobacterium avium subsp. paratuberculosis
ugcgcgccgugac

SEQ ID NO: 2864498 - RNA, 14 nt, Mycobacterium avium subsp. paratuberculosis
ugcgcgccgugacg

SEQ ID NO: 2864499 - RNA, 14 nt, Mycobacterium avium subsp. paratuberculosis
ugcgcgccuccgac

SEQ ID NO: 2864500 - RNA, 18 nt, Mycobacterium avium subsp. paratuberculosis
ugcgcgccuccgacgacg

SEQ ID NO: 2864501 - RNA, 20 nt, Mycobacterium avium subsp. paratuberculosis
ugcgcgccuccgacgacgau

SEQ ID NO: 2864502 - RNA, 22 nt, Mycobacterium avium subsp. paratuberculosis
ugcgcgcgcaucaccgagguca

SEQ ID NO: 2864503 - RNA, 15 nt, Mycobacterium avium subsp. paratuberculosis
ugcgcgcggugcacg

SEQ ID NO: 2864504 - RNA, 21 nt, Mycobacterium avium subsp. paratuberculosis
ugcgcgcuggugcugccgaac

SEQ ID NO: 2864505 - RNA, 18 nt, Mycobacterium avium subsp. paratuberculosis
ugcgcggaaugcucgaca

SEQ ID NO: 2864506 - RNA, 19 nt, Mycobacterium avium subsp. paratuberculosis
ugcgcggaaugcucgacac

SEQ ID NO: 2864507 - RNA, 16 nt, Mycobacterium avium subsp. paratuberculosis
ugcgcggcacgggccg

SEQ ID NO: 2864508 - RNA, 17 nt, Mycobacterium avium subsp. paratuberculosis
ugcgcggcacgggccgu

SEQ ID NO: 2864509 - RNA, 13 nt, Mycobacterium avium subsp. paratuberculosis
ugcgcggccgccc

SEQ ID NO: 2864510 - RNA, 15 nt, Mycobacterium avium subsp. paratuberculosis
ugcgcggccgcccag

SEQ ID NO: 2864511 - RNA, 16 nt, Mycobacterium avium subsp. paratuberculosis
ugcgcggccgcccagu

SEQ ID NO: 2864512 - RNA, 19 nt, Mycobacterium avium subsp. paratuberculosis
ugcgcggccgcgucggcgg

SEQ ID NO: 2864513 - RNA, 20 nt, Mycobacterium avium subsp. paratuberculosis
ugcgcggcgaccaccucggc

SEQ ID NO: 2864514 - RNA, 21 nt, Mycobacterium avium subsp. paratuberculosis
ugcgcggcgaccaccucggcg

SEQ ID NO: 2864515 - RNA, 22 nt, Mycobacterium avium subsp. paratuberculosis
ugcgcggcgagcgcguucucca

SEQ ID NO: 2864516 - RNA, 13 nt, Mycobacterium avium subsp. paratuberculosis
ugcgcggcgccgu

SEQ ID NO: 2864517 - RNA, 11 nt, Mycobacterium avium subsp. paratuberculosis
ugcgcggcgcg

SEQ ID NO: 2864518 - RNA, 19 nt, Mycobacterium avium subsp. paratuberculosis
ugcgcggcgcgaagcccuc

SEQ ID NO: 2864519 - RNA, 18 nt, Mycobacterium avium subsp. paratuberculosis
ugcgcggcggcggcgcgg

SEQ ID NO: 2864520 - RNA, 21 nt, Mycobacterium avium subsp. paratuberculosis
ugcgcggcggcggcgcgggcg

SEQ ID NO: 2864521 - RNA, 16 nt, Mycobacterium avium subsp. paratuberculosis
ugcgcggcggcguccg

SEQ ID NO: 2864522 - RNA, 17 nt, Mycobacterium avium subsp. paratuberculosis
ugcgcggcguccaccag

SEQ ID NO: 2864523 - RNA, 21 nt, Mycobacterium avium subsp. paratuberculosis
ugcgcggcguccucgaugacg

SEQ ID NO: 2864524 - RNA, 22 nt, Mycobacterium avium subsp. paratuberculosis
ugcgcggcguucuccagcaccc

SEQ ID NO: 2864525 - RNA, 17 nt, Mycobacterium avium subsp. paratuberculosis
ugcgcgggcaaucgcug

SEQ ID NO: 2864526 - RNA, 14 nt, Mycobacterium avium subsp. paratuberculosis
ugcgcgggcgcgga

SEQ ID NO: 2864527 - RNA, 16 nt, Mycobacterium avium subsp. paratuberculosis
ugcgcgggcgcggaca

SEQ ID NO: 2864528 - RNA, 20 nt, Mycobacterium avium subsp. paratuberculosis
ugcgcgggcgcggacagcug

SEQ ID NO: 2864529 - RNA, 15 nt, Mycobacterium avium subsp. paratuberculosis
ugcgcgggcgcggcc

SEQ ID NO: 2864530 - RNA, 16 nt, Mycobacterium avium subsp. paratuberculosis
ugcgcgggcgcggcca

SEQ ID NO: 2864531 - RNA, 22 nt, Mycobacterium avium subsp. paratuberculosis
ugcgcgggguggcgccggccag

SEQ ID NO: 2864532 - RNA, 15 nt, Mycobacterium avium subsp. paratuberculosis
ugcgcgggucgccgg

SEQ ID NO: 2864533 - RNA, 19 nt, Mycobacterium avium subsp. paratuberculosis
ugcgcgggucgccgggcag

SEQ ID NO: 2864534 - RNA, 17 nt, Mycobacterium avium subsp. paratuberculosis
ugcgcggucagcgcguc

SEQ ID NO: 2864535 - RNA, 16 nt, Mycobacterium avium subsp. paratuberculosis
ugcgcgucagccgucg

SEQ ID NO: 2864536 - RNA, 18 nt, Mycobacterium avium subsp. paratuberculosis
ugcgcgucgagcagcacc

SEQ ID NO: 2864537 - RNA, 13 nt, Mycobacterium avium subsp. paratuberculosis
ugcgcgucgcggc

SEQ ID NO: 2864538 - RNA, 23 nt, Mycobacterium avium subsp. paratuberculosis
ugcgcgucgcgguggagcacagc

SEQ ID NO: 2864539 - RNA, 19 nt, Mycobacterium avium subsp. paratuberculosis
ugcggccgcgacugcaccc

SEQ ID NO: 2864540 - RNA, 14 nt, Mycobacterium avium subsp. paratuberculosis
ugcggccgcgcagc

SEQ ID NO: 2864541 - RNA, 15 nt, Mycobacterium avium subsp. paratuberculosis
ugcggccgcgcagcu

SEQ ID NO: 2864542 - RNA, 13 nt, Mycobacterium avium subsp. paratuberculosis
ugcggccggacca

SEQ ID NO: 2864543 - RNA, 18 nt, Mycobacterium avium subsp. paratuberculosis
ugcggccggaccacccag

SEQ ID NO: 2864544 - RNA, 14 nt, Mycobacterium avium subsp. paratuberculosis
ugcggccggcgccg

SEQ ID NO: 2864545 - RNA, 18 nt, Mycobacterium avium subsp. paratuberculosis
ugcggccggcgccggcgg

SEQ ID NO: 2864546 - RNA, 13 nt, Mycobacterium avium subsp. paratuberculosis
ugcggccggcggg

SEQ ID NO: 2864547 - RNA, 17 nt, Mycobacterium avium subsp. paratuberculosis
ugcggccggggcagacc

SEQ ID NO: 2864548 - RNA, 15 nt, Mycobacterium avium subsp. paratuberculosis
ugcggccguccagcg

SEQ ID NO: 2864549 - RNA, 17 nt, Mycobacterium avium subsp. paratuberculosis
ugcggccguccagcguc

SEQ ID NO: 2864550 - RNA, 24 nt, Mycobacterium avium subsp. paratuberculosis
ugcggccguccagcgucuggcagc

SEQ ID NO: 2864551 - RNA, 14 nt, Mycobacterium avium subsp. paratuberculosis
ugcggccucgacga

SEQ ID NO: 2864552 - RNA, 14 nt, Mycobacterium avium subsp. paratuberculosis
ugcggccucggcac

SEQ ID NO: 2864553 - RNA, 15 nt, Mycobacterium avium subsp. paratuberculosis
ugcggcgaacgcguc

SEQ ID NO: 2864554 - RNA, 20 nt, Mycobacterium avium subsp. paratuberculosis
ugcggcgaacgcgucccggg

SEQ ID NO: 2864555 - RNA, 23 nt, Mycobacterium avium subsp. paratuberculosis
ugcggcgaacgcgucccgggccu

SEQ ID NO: 2864556 - RNA, 14 nt, Mycobacterium avium subsp. paratuberculosis
ugcggcgcaccccg

SEQ ID NO: 2864557 - RNA, 19 nt, Mycobacterium avium subsp. paratuberculosis
ugcggcgcaccccguccag

SEQ ID NO: 2864558 - RNA, 20 nt, Mycobacterium avium subsp. paratuberculosis
ugcggcgcaccccguccagg

SEQ ID NO: 2864559 - RNA, 11 nt, Mycobacterium avium subsp. paratuberculosis
ugcggcgcagc

SEQ ID NO: 2864560 - RNA, 15 nt, Mycobacterium avium subsp. paratuberculosis
ugcggcgcagccagc

SEQ ID NO: 2864561 - RNA, 18 nt, Mycobacterium avium subsp. paratuberculosis
ugcggcgcagcgucucga

SEQ ID NO: 2864562 - RNA, 16 nt, Mycobacterium avium subsp. paratuberculosis
ugcggcgcccacagca

SEQ ID NO: 2864563 - RNA, 18 nt, Mycobacterium avium subsp. paratuberculosis
ugcggcgcccacagcagg

SEQ ID NO: 2864564 - RNA, 20 nt, Mycobacterium avium subsp. paratuberculosis
ugcggcgccgcccggcgaua

SEQ ID NO: 2864565 - RNA, 13 nt, Mycobacterium avium subsp. paratuberculosis
ugcggcgcggcca

SEQ ID NO: 2864566 - RNA, 14 nt, Mycobacterium avium subsp. paratuberculosis
ugcggcgcggucgc

SEQ ID NO: 2864567 - RNA, 20 nt, Mycobacterium avium subsp. paratuberculosis
ugcggcgcggucgcaggccg

SEQ ID NO: 2864568 - RNA, 14 nt, Mycobacterium avium subsp. paratuberculosis
ugcggcgcggugcg

SEQ ID NO: 2864569 - RNA, 13 nt, Mycobacterium avium subsp. paratuberculosis
ugcggcgcucggu

SEQ ID NO: 2864570 - RNA, 17 nt, Mycobacterium avium subsp. paratuberculosis
ugcggcgcucggugugc

SEQ ID NO: 2864571 - RNA, 16 nt, Mycobacterium avium subsp. paratuberculosis
ugcggcgcuucgggug

SEQ ID NO: 2864572 - RNA, 18 nt, Mycobacterium avium subsp. paratuberculosis
ugcggcggcagucgcagc

SEQ ID NO: 2864573 - RNA, 22 nt, Mycobacterium avium subsp. paratuberculosis
ugcggcggcagucgcagcagca

SEQ ID NO: 2864574 - RNA, 18 nt, Mycobacterium avium subsp. paratuberculosis
ugcggcggccgcagcgug

SEQ ID NO: 2864575 - RNA, 13 nt, Mycobacterium avium subsp. paratuberculosis
ugcggcggccggc

SEQ ID NO: 2864576 - RNA, 18 nt, Mycobacterium avium subsp. paratuberculosis
ugcggcggccggccagca

SEQ ID NO: 2864577 - RNA, 21 nt, Mycobacterium avium subsp. paratuberculosis
ugcggcggccggccagcagcc

SEQ ID NO: 2864578 - RNA, 23 nt, Mycobacterium avium subsp. paratuberculosis
ugcggcggccggccagcagccgg

SEQ ID NO: 2864579 - RNA, 13 nt, Mycobacterium avium subsp. paratuberculosis
ugcggcgggccgc

SEQ ID NO: 2864580 - RNA, 17 nt, Mycobacterium avium subsp. paratuberculosis
ugcggcgggcucggacg

SEQ ID NO: 2864581 - RNA, 18 nt, Mycobacterium avium subsp. paratuberculosis
ugcggcgggcucggacga

SEQ ID NO: 2864582 - RNA, 19 nt, Mycobacterium avium subsp. paratuberculosis
ugcggcgggcucggacgac

SEQ ID NO: 2864583 - RNA, 11 nt, Mycobacterium avium subsp. paratuberculosis
ugcggcggugu

SEQ ID NO: 2864584 - RNA, 13 nt, Mycobacterium avium subsp. paratuberculosis
ugcggcgguguuc

SEQ ID NO: 2864585 - RNA, 22 nt, Mycobacterium avium subsp. paratuberculosis
ugcggcgucagguccgcgaacu

SEQ ID NO: 2864586 - RNA, 21 nt, Mycobacterium avium subsp. paratuberculosis
ugcggcgucgucuuggccugc

SEQ ID NO: 2864587 - RNA, 16 nt, Mycobacterium avium subsp. paratuberculosis
ugcggcucccaccgug

SEQ ID NO: 2864588 - RNA, 13 nt, Mycobacterium avium subsp. paratuberculosis
ugcggcucggcgc

SEQ ID NO: 2864589 - RNA, 16 nt, Mycobacterium avium subsp. paratuberculosis
ugcggcucggcgcuga

SEQ ID NO: 2864590 - RNA, 19 nt, Mycobacterium avium subsp. paratuberculosis
ugcggcucgucggcgaaca

SEQ ID NO: 2864591 - RNA, 13 nt, Mycobacterium avium subsp. paratuberculosis
ugcggcugcauca

SEQ ID NO: 2864592 - RNA, 20 nt, Mycobacterium avium subsp. paratuberculosis
ugcggcugcccaggaucacc

SEQ ID NO: 2864593 - RNA, 16 nt, Mycobacterium avium subsp. paratuberculosis
ugcggcugcgcguucg

SEQ ID NO: 2864594 - RNA, 14 nt, Mycobacterium avium subsp. paratuberculosis
ugcggcugggugga

SEQ ID NO: 2864595 - RNA, 19 nt, Mycobacterium avium subsp. paratuberculosis
ugcggcugguagaugccga

SEQ ID NO: 2864596 - RNA, 18 nt, Mycobacterium avium subsp. paratuberculosis
ugcggcuuugcugccaag

SEQ ID NO: 2864597 - RNA, 16 nt, Mycobacterium avium subsp. paratuberculosis
ugcgggaccagcgccu

SEQ ID NO: 2864598 - RNA, 22 nt, Mycobacterium avium subsp. paratuberculosis
ugcgggaccagcgccucggccu

SEQ ID NO: 2864599 - RNA, 13 nt, Mycobacterium avium subsp. paratuberculosis
ugcgggacgccgu

SEQ ID NO: 2864600 - RNA, 20 nt, Mycobacterium avium subsp. paratuberculosis
ugcgggagaaaugggccagg

SEQ ID NO: 2864601 - RNA, 15 nt, Mycobacterium avium subsp. paratuberculosis
ugcgggaugccgagc

SEQ ID NO: 2864602 - RNA, 20 nt, Mycobacterium avium subsp. paratuberculosis
ugcgggauucgcgcaccuuc

SEQ ID NO: 2864603 - RNA, 14 nt, Mycobacterium avium subsp. paratuberculosis
ugcgggcaucgcug

SEQ ID NO: 2864604 - RNA, 15 nt, Mycobacterium avium subsp. paratuberculosis
ugcgggcaucggcug

SEQ ID NO: 2864605 - RNA, 12 nt, Mycobacterium avium subsp. paratuberculosis
ugcgggccaccg

SEQ ID NO: 2864606 - RNA, 16 nt, Mycobacterium avium subsp. paratuberculosis
ugcgggccagcacgac

SEQ ID NO: 2864607 - RNA, 15 nt, Mycobacterium avium subsp. paratuberculosis
ugcgggccagcagcc

SEQ ID NO: 2864608 - RNA, 18 nt, Mycobacterium avium subsp. paratuberculosis
ugcgggccagugauccug

SEQ ID NO: 2864609 - RNA, 15 nt, Mycobacterium avium subsp. paratuberculosis
ugcgggcccaccgcg

SEQ ID NO: 2864610 - RNA, 22 nt, Mycobacterium avium subsp. paratuberculosis
ugcgggcccaccgcgcgcugca

SEQ ID NO: 2864611 - RNA, 11 nt, Mycobacterium avium subsp. paratuberculosis
ugcgggcccag

SEQ ID NO: 2864612 - RNA, 13 nt, Mycobacterium avium subsp. paratuberculosis
ugcgggcccagcu

SEQ ID NO: 2864613 - RNA, 12 nt, Mycobacterium avium subsp. paratuberculosis
ugcgggcccgca

SEQ ID NO: 2864614 - RNA, 19 nt, Mycobacterium avium subsp. paratuberculosis
ugcgggcccgcaacuguuc

SEQ ID NO: 2864615 - RNA, 12 nt, Mycobacterium avium subsp. paratuberculosis
ugcgggccgaac

SEQ ID NO: 2864616 - RNA, 19 nt, Mycobacterium avium subsp. paratuberculosis
ugcgggcgauggcgggccg

SEQ ID NO: 2864617 - RNA, 17 nt, Mycobacterium avium subsp. paratuberculosis
ugcgggcgggccgccag

SEQ ID NO: 2864618 - RNA, 20 nt, Mycobacterium avium subsp. paratuberculosis
ugcgggcggggcccgggccg

SEQ ID NO: 2864619 - RNA, 18 nt, Mycobacterium avium subsp. paratuberculosis
ugcgggcguccuugacca

SEQ ID NO: 2864620 - RNA, 14 nt, Mycobacterium avium subsp. paratuberculosis
ugcgggcugcacca

SEQ ID NO: 2864621 - RNA, 16 nt, Mycobacterium avium subsp. paratuberculosis
ugcgggcugcaccagg

SEQ ID NO: 2864622 - RNA, 14 nt, Mycobacterium avium subsp. paratuberculosis
ugcggggccgcggc

SEQ ID NO: 2864623 - RNA, 16 nt, Mycobacterium avium subsp. paratuberculosis
ugcggggccgcggccg

SEQ ID NO: 2864624 - RNA, 23 nt, Mycobacterium avium subsp. paratuberculosis
ugcugcagaccgaacgucacggc

SEQ ID NO: 2864625 - RNA, 21 nt, Mycobacterium avium subsp. paratuberculosis
ugcugcagcgcccgggccagg

SEQ ID NO: 2864626 - RNA, 13 nt, Mycobacterium avium subsp. paratuberculosis
ugcugcagcgcga

SEQ ID NO: 2864627 - RNA, 15 nt, Mycobacterium avium subsp. paratuberculosis
ugcugcaugcgcugc

SEQ ID NO: 2864628 - RNA, 21 nt, Mycobacterium avium subsp. paratuberculosis
ugcugcccagggcguuugcca

SEQ ID NO: 2864629 - RNA, 18 nt, Mycobacterium avium subsp. paratuberculosis
ugcugccccucgacgaac

SEQ ID NO: 2864630 - RNA, 16 nt, Mycobacterium avium subsp. paratuberculosis
ugcugcccgcgacggc

SEQ ID NO: 2864631 - RNA, 16 nt, Mycobacterium avium subsp. paratuberculosis
ugcugcccgcggccgc

SEQ ID NO: 2864632 - RNA, 19 nt, Mycobacterium avium subsp. paratuberculosis
ugcugccgccgcagcagcc

SEQ ID NO: 2864633 - RNA, 20 nt, Mycobacterium avium subsp. paratuberculosis
ugcugccggaacgagccgga

SEQ ID NO: 2864634 - RNA, 19 nt, Mycobacterium avium subsp. paratuberculosis
ugcugccggacaccccggc

SEQ ID NO: 2864635 - RNA, 14 nt, Mycobacterium avium subsp. paratuberculosis
ugcugccggccggc

SEQ ID NO: 2864636 - RNA, 17 nt, Mycobacterium avium subsp. paratuberculosis
ugcugccggccggcagc

SEQ ID NO: 2864637 - RNA, 23 nt, Mycobacterium avium subsp. paratuberculosis
ugcugccgugccgauuccagcaa

SEQ ID NO: 2864638 - RNA, 14 nt, Mycobacterium avium subsp. paratuberculosis
ugcugcgcagaccc

SEQ ID NO: 2864639 - RNA, 20 nt, Mycobacterium avium subsp. paratuberculosis
ugcugcgcagcagcgccagc

SEQ ID NO: 2864640 - RNA, 22 nt, Mycobacterium avium subsp. paratuberculosis
ugcugcggaacccacgugcggc

SEQ ID NO: 2864641 - RNA, 15 nt, Mycobacterium avium subsp. paratuberculosis
ugcugcgggucagca

SEQ ID NO: 2864642 - RNA, 19 nt, Mycobacterium avium subsp. paratuberculosis
ugcugcgggugcggccagc

SEQ ID NO: 2864643 - RNA, 17 nt, Mycobacterium avium subsp. paratuberculosis
ugcugcguucggcgauc

SEQ ID NO: 2864644 - RNA, 23 nt, Mycobacterium avium subsp. paratuberculosis
ugcugcucgagggccuccaccac

SEQ ID NO: 2864645 - RNA, 22 nt, Mycobacterium avium subsp. paratuberculosis
ugcugcuguagcucacgguguc

SEQ ID NO: 2864646 - RNA, 22 nt, Mycobacterium avium subsp. paratuberculosis
ugcuggacggcccgacgacgcc

SEQ ID NO: 2864647 - RNA, 16 nt, Mycobacterium avium subsp. paratuberculosis
ugcuggaugugguugc

SEQ ID NO: 2864648 - RNA, 16 nt, Mycobacterium avium subsp. paratuberculosis
ugcuggccaucgccga

SEQ ID NO: 2864649 - RNA, 18 nt, Mycobacterium avium subsp. paratuberculosis
ugcuggccaucgccgagc

SEQ ID NO: 2864650 - RNA, 22 nt, Mycobacterium avium subsp. paratuberculosis
ugcuggcccgguuccagcggca

SEQ ID NO: 2864651 - RNA, 20 nt, Mycobacterium avium subsp. paratuberculosis
ugcuggccggguuggcaucc

SEQ ID NO: 2864652 - RNA, 19 nt, Mycobacterium avium subsp. paratuberculosis
ugcuggcgaugugaucgcg

SEQ ID NO: 2864653 - RNA, 23 nt, Mycobacterium avium subsp. paratuberculosis
ugcuggcgaugugaucgcggccc

SEQ ID NO: 2864654 - RNA, 19 nt, Mycobacterium avium subsp. paratuberculosis
ugcuggcgcgauagccggu

SEQ ID NO: 2864655 - RNA, 22 nt, Mycobacterium avium subsp. paratuberculosis
ugcuggcgcuugcguucccagc

SEQ ID NO: 2864656 - RNA, 13 nt, Mycobacterium avium subsp. paratuberculosis
ugcuggcggccuu

SEQ ID NO: 2864657 - RNA, 23 nt, Mycobacterium avium subsp. paratuberculosis
ugcuggcgugaaucuuggccagc

SEQ ID NO: 2864658 - RNA, 17 nt, Mycobacterium avium subsp. paratuberculosis
ugcuggcuucgcggauc

SEQ ID NO: 2864659 - RNA, 19 nt, Mycobacterium avium subsp. paratuberculosis
ugcugggacgggucggcgg

SEQ ID NO: 2864660 - RNA, 13 nt, Mycobacterium avium subsp. paratuberculosis
ugcugggccacga

SEQ ID NO: 2864661 - RNA, 12 nt, Mycobacterium avium subsp. paratuberculosis
ugcugggccggg

SEQ ID NO: 2864662 - RNA, 15 nt, Mycobacterium avium subsp. paratuberculosis
ugcugggcggcacca

SEQ ID NO: 2864663 - RNA, 19 nt, Mycobacterium avium subsp. paratuberculosis
ugcuggggucggccagcga

SEQ ID NO: 2864664 - RNA, 22 nt, Mycobacterium avium subsp. paratuberculosis
ugcuggucaugccgucgacgac

SEQ ID NO: 2864665 - RNA, 14 nt, Mycobacterium avium subsp. paratuberculosis
ugcuggugccgccg

SEQ ID NO: 2864666 - RNA, 20 nt, Mycobacterium avium subsp. paratuberculosis
ugcugucgcgggucuggcuc

SEQ ID NO: 2864667 - RNA, 18 nt, Mycobacterium avium subsp. paratuberculosis
ugcugucgucgcccugac

SEQ ID NO: 2864668 - RNA, 20 nt, Mycobacterium avium subsp. paratuberculosis
ugcuguggaagggccccggc

SEQ ID NO: 2864669 - RNA, 13 nt, Mycobacterium avium subsp. paratuberculosis
ugcuguucgucga

SEQ ID NO: 2864670 - RNA, 14 nt, Mycobacterium avium subsp. paratuberculosis
ugcuguucgucgag

SEQ ID NO: 2864671 - RNA, 16 nt, Mycobacterium avium subsp. paratuberculosis
ugcuuaccggccggcc

SEQ ID NO: 2864672 - RNA, 17 nt, Mycobacterium avium subsp. paratuberculosis
ugcuuagccccucccac

SEQ ID NO: 2864673 - RNA, 23 nt, Mycobacterium avium subsp. paratuberculosis
ugcuuagccccucccaccacggc

SEQ ID NO: 2864674 - RNA, 17 nt, Mycobacterium avium subsp. paratuberculosis
ugcuucaucccgucguu

SEQ ID NO: 2864675 - RNA, 16 nt, Mycobacterium avium subsp. paratuberculosis
ugcuucgggucgccgg

SEQ ID NO: 2864676 - RNA, 15 nt, Mycobacterium avium subsp. paratuberculosis
ugcuucgucgccggg

SEQ ID NO: 2864677 - RNA, 13 nt, Mycobacterium avium subsp. paratuberculosis
ugcuucugggugu

SEQ ID NO: 2864678 - RNA, 17 nt, Mycobacterium avium subsp. paratuberculosis
ugcuucuugaagaaccg

SEQ ID NO: 2864679 - RNA, 12 nt, Mycobacterium avium subsp. paratuberculosis
ugcuugaacagc

SEQ ID NO: 2864680 - RNA, 14 nt, Mycobacterium avium subsp. paratuberculosis
ugcuugaccgccag

SEQ ID NO: 2864681 - RNA, 13 nt, Mycobacterium avium subsp. paratuberculosis
ugcuugaccgcga

SEQ ID NO: 2864682 - RNA, 22 nt, Mycobacterium avium subsp. paratuberculosis
ugcuugcccgacgagucgccgu

SEQ ID NO: 2864683 - RNA, 20 nt, Mycobacterium avium subsp. paratuberculosis
ugcuugccgaugucggcguu

SEQ ID NO: 2864684 - RNA, 12 nt, Mycobacterium avium subsp. paratuberculosis
ugcuugccgccg

SEQ ID NO: 2864685 - RNA, 17 nt, Mycobacterium avium subsp. paratuberculosis
ugcuugccgucgacgcg

SEQ ID NO: 2864686 - RNA, 22 nt, Mycobacterium avium subsp. paratuberculosis
ugcuuggcggcgcacuccauca

SEQ ID NO: 2864687 - RNA, 19 nt, Mycobacterium avium subsp. paratuberculosis
ugcuuucgcgucugcucgc

SEQ ID NO: 2864688 - RNA, 16 nt, Mycobacterium avium subsp. paratuberculosis
ugcuuugccuuagccc

SEQ ID NO: 2864689 - RNA, 16 nt, Mycobacterium avium subsp. paratuberculosis
ugcuuuuugaccaccg

SEQ ID NO: 2864690 - RNA, 14 nt, Mycobacterium avium subsp. paratuberculosis
ugcuuuuugcggac

SEQ ID NO: 2864691 - RNA, 20 nt, Mycobacterium avium subsp. paratuberculosis
uggaaaccucuugcggcgca

SEQ ID NO: 2864692 - RNA, 22 nt, Mycobacterium avium subsp. paratuberculosis
uggaaaguccuucucgggcaau

SEQ ID NO: 2864693 - RNA, 15 nt, Mycobacterium avium subsp. paratuberculosis
uggaaaucgagcgcg

SEQ ID NO: 2864694 - RNA, 22 nt, Mycobacterium avium subsp. paratuberculosis
uggaacacccaggucuuccgga

SEQ ID NO: 2864695 - RNA, 12 nt, Mycobacterium avium subsp. paratuberculosis
uggaacacgccc

SEQ ID NO: 2864696 - RNA, 15 nt, Mycobacterium avium subsp. paratuberculosis
uggaacacgcccagc

SEQ ID NO: 2864697 - RNA, 19 nt, Mycobacterium avium subsp. paratuberculosis
uggaacacgcccagcgccg

SEQ ID NO: 2864698 - RNA, 16 nt, Mycobacterium avium subsp. paratuberculosis
uggaacagcgggccgg

SEQ ID NO: 2864699 - RNA, 13 nt, Mycobacterium avium subsp. paratuberculosis
uggaacaucccgg

SEQ ID NO: 2864700 - RNA, 13 nt, Mycobacterium avium subsp. paratuberculosis
uggaacaucucca

SEQ ID NO: 2864701 - RNA, 19 nt, Mycobacterium avium subsp. paratuberculosis
uggaacaucuccagcgcgg

SEQ ID NO: 2864702 - RNA, 15 nt, Mycobacterium avium subsp. paratuberculosis
uggaaccgaaucggu

SEQ ID NO: 2864703 - RNA, 19 nt, Mycobacterium avium subsp. paratuberculosis
uggaaccgggucucgcgcc

SEQ ID NO: 2864704 - RNA, 22 nt, Mycobacterium avium subsp. paratuberculosis
uggaacgcaagaagucgguguu

SEQ ID NO: 2864705 - RNA, 20 nt, Mycobacterium avium subsp. paratuberculosis
uggaagagggccauccggcc

SEQ ID NO: 2864706 - RNA, 22 nt, Mycobacterium avium subsp. paratuberculosis
uggaagagggccauccggccgg

SEQ ID NO: 2864707 - RNA, 14 nt, Mycobacterium avium subsp. paratuberculosis
uggaagccgcgauc

SEQ ID NO: 2864708 - RNA, 16 nt, Mycobacterium avium subsp. paratuberculosis
uggaucuccagcagcu

SEQ ID NO: 2864709 - RNA, 15 nt, Mycobacterium avium subsp. paratuberculosis
uggaucugcccgacc

SEQ ID NO: 2864710 - RNA, 16 nt, Mycobacterium avium subsp. paratuberculosis
uggaucuugacggcga

SEQ ID NO: 2864711 - RNA, 18 nt, Mycobacterium avium subsp. paratuberculosis
uggaugaaggucgcggac

SEQ ID NO: 2864712 - RNA, 15 nt, Mycobacterium avium subsp. paratuberculosis
uggaugaugccggcg

SEQ ID NO: 2864713 - RNA, 21 nt, Mycobacterium avium subsp. paratuberculosis
uggaugcccagggcgcgucca

SEQ ID NO: 2864714 - RNA, 21 nt, Mycobacterium avium subsp. paratuberculosis
uggaugccgcccuugcucgcg

SEQ ID NO: 2864715 - RNA, 15 nt, Mycobacterium avium subsp. paratuberculosis
uggauggcgcccagc

SEQ ID NO: 2864716 - RNA, 16 nt, Mycobacterium avium subsp. paratuberculosis
uggauggcgcccagcc

SEQ ID NO: 2864717 - RNA, 20 nt, Mycobacterium avium subsp. paratuberculosis
uggauggcgcccagcccgag

SEQ ID NO: 2864718 - RNA, 23 nt, Mycobacterium avium subsp. paratuberculosis
uggauggucaccggggugccgcc

SEQ ID NO: 2864719 - RNA, 13 nt, Mycobacterium avium subsp. paratuberculosis
uggauuccaccgu

SEQ ID NO: 2864720 - RNA, 17 nt, Mycobacterium avium subsp. paratuberculosis
uggauucgucgcuggcc

SEQ ID NO: 2864721 - RNA, 20 nt, Mycobacterium avium subsp. paratuberculosis
uggauucgucgcuggccagg

SEQ ID NO: 2864722 - RNA, 15 nt, Mycobacterium avium subsp. paratuberculosis
uggauugucggccgc

SEQ ID NO: 2864723 - RNA, 17 nt, Mycobacterium avium subsp. paratuberculosis
uggcaaggccagcaacc

SEQ ID NO: 2864724 - RNA, 17 nt, Mycobacterium avium subsp. paratuberculosis
uggcaauacgccucgca

SEQ ID NO: 2864725 - RNA, 15 nt, Mycobacterium avium subsp. paratuberculosis
uggcaccccgcgccg

SEQ ID NO: 2864726 - RNA, 23 nt, Mycobacterium avium subsp. paratuberculosis
uggcacccgggcgcgacggucac

SEQ ID NO: 2864727 - RNA, 21 nt, Mycobacterium avium subsp. paratuberculosis
uggcaccgggugggccgaccu

SEQ ID NO: 2864728 - RNA, 13 nt, Mycobacterium avium subsp. paratuberculosis
uggcaccgucgac

SEQ ID NO: 2864729 - RNA, 18 nt, Mycobacterium avium subsp. paratuberculosis
uggcacgacgccgccgag

SEQ ID NO: 2864730 - RNA, 19 nt, Mycobacterium avium subsp. paratuberculosis
uggcacgccacucgucgac

SEQ ID NO: 2864731 - RNA, 19 nt, Mycobacterium avium subsp. paratuberculosis
uggcagcagccggaaggcc

SEQ ID NO: 2864732 - RNA, 18 nt, Mycobacterium avium subsp. paratuberculosis
uggcagcauccgccgacg

SEQ ID NO: 2864733 - RNA, 15 nt, Mycobacterium avium subsp. paratuberculosis
uggcagccggccggc

SEQ ID NO: 2864734 - RNA, 23 nt, Mycobacterium avium subsp. paratuberculosis
uggcagcggacccggucggccgc

SEQ ID NO: 2864735 - RNA, 14 nt, Mycobacterium avium subsp. paratuberculosis
uggcagcugccgaa

SEQ ID NO: 2864736 - RNA, 16 nt, Mycobacterium avium subsp. paratuberculosis
uggcaggccaucagcc

SEQ ID NO: 2864737 - RNA, 23 nt, Mycobacterium avium subsp. paratuberculosis
uggcaggccaucagcccggcguc

SEQ ID NO: 2864738 - RNA, 24 nt, Mycobacterium avium subsp. paratuberculosis
uggcaggcgauggcgucggccagc

SEQ ID NO: 2864739 - RNA, 17 nt, Mycobacterium avium subsp. paratuberculosis
uggcagggccagcagcc

SEQ ID NO: 2864740 - RNA, 23 nt, Mycobacterium avium subsp. paratuberculosis
uggcaggugagccgggugcccgc

SEQ ID NO: 2864741 - RNA, 11 nt, Mycobacterium avium subsp. paratuberculosis
uggcagguggc

SEQ ID NO: 2864742 - RNA, 14 nt, Mycobacterium avium subsp. paratuberculosis
uggcagguggcgua

SEQ ID NO: 2864743 - RNA, 17 nt, Mycobacterium avium subsp. paratuberculosis
uggcaucccgcgccugc

SEQ ID NO: 2864744 - RNA, 18 nt, Mycobacterium avium subsp. paratuberculosis
uggcaucccgcgccugcc

SEQ ID NO: 2864745 - RNA, 14 nt, Mycobacterium avium subsp. paratuberculosis
uggcauccgucggc

SEQ ID NO: 2864746 - RNA, 12 nt, Mycobacterium avium subsp. paratuberculosis
uggcaucgccaa

SEQ ID NO: 2864747 - RNA, 14 nt, Mycobacterium avium subsp. paratuberculosis
uggcaucgucggcg

SEQ ID NO: 2864748 - RNA, 15 nt, Mycobacterium avium subsp. paratuberculosis
uggcaucgucggcgc

SEQ ID NO: 2864749 - RNA, 16 nt, Mycobacterium avium subsp. paratuberculosis
uggcaucgucggcgcc

SEQ ID NO: 2864750 - RNA, 15 nt, Mycobacterium avium subsp. paratuberculosis
uggcaugccggaaca

SEQ ID NO: 2864751 - RNA, 12 nt, Mycobacterium avium subsp. paratuberculosis
uggccaccaccg

SEQ ID NO: 2864752 - RNA, 14 nt, Mycobacterium avium subsp. paratuberculosis
uggccaccaccgag

SEQ ID NO: 2864753 - RNA, 22 nt, Mycobacterium avium subsp. paratuberculosis
uggccaccacgggucggucggc

SEQ ID NO: 2864754 - RNA, 12 nt, Mycobacterium avium subsp. paratuberculosis
uggccaccagca

SEQ ID NO: 2864755 - RNA, 15 nt, Mycobacterium avium subsp. paratuberculosis
uggccaccagguccu

SEQ ID NO: 2864756 - RNA, 19 nt, Mycobacterium avium subsp. paratuberculosis
uggccaccaucaggccggc

SEQ ID NO: 2864757 - RNA, 18 nt, Mycobacterium avium subsp. paratuberculosis
uggccacccucgccgccg

SEQ ID NO: 2864758 - RNA, 19 nt, Mycobacterium avium subsp. paratuberculosis
uggccacccucgccgccgc

SEQ ID NO: 2864759 - RNA, 22 nt, Mycobacterium avium subsp. paratuberculosis
uggccaccgaugcccgacaccg

SEQ ID NO: 2864760 - RNA, 15 nt, Mycobacterium avium subsp. paratuberculosis
uggccaccucgacgg

SEQ ID NO: 2864761 - RNA, 14 nt, Mycobacterium avium subsp. paratuberculosis
uggccacgaugauc

SEQ ID NO: 2864762 - RNA, 13 nt, Mycobacterium avium subsp. paratuberculosis
uggccacgcccca

SEQ ID NO: 2864763 - RNA, 22 nt, Mycobacterium avium subsp. paratuberculosis
uggccacgccccauugccgcgc

SEQ ID NO: 2864764 - RNA, 20 nt, Mycobacterium avium subsp. paratuberculosis
uggccacgcucucgccgguc

SEQ ID NO: 2864765 - RNA, 17 nt, Mycobacterium avium subsp. paratuberculosis
uggccacgcuggcgucc

SEQ ID NO: 2864766 - RNA, 20 nt, Mycobacterium avium subsp. paratuberculosis
uggccagauacuccucggug

SEQ ID NO: 2864767 - RNA, 15 nt, Mycobacterium avium subsp. paratuberculosis
uggccagcaccaccg

SEQ ID NO: 2864768 - RNA, 17 nt, Mycobacterium avium subsp. paratuberculosis
uggccagcaccaccgcg

SEQ ID NO: 2864769 - RNA, 14 nt, Mycobacterium avium subsp. paratuberculosis
uggccagcaccagc

SEQ ID NO: 2864770 - RNA, 15 nt, Mycobacterium avium subsp. paratuberculosis
uggccagcaccagcc

SEQ ID NO: 2864771 - RNA, 16 nt, Mycobacterium avium subsp. paratuberculosis
uggccagcaccagccc

SEQ ID NO: 2864772 - RNA, 23 nt, Mycobacterium avium subsp. paratuberculosis
uggccagcaccauccagugcagu

SEQ ID NO: 2864773 - RNA, 12 nt, Mycobacterium avium subsp. paratuberculosis
uggccagcaccg

SEQ ID NO: 2864774 - RNA, 13 nt, Mycobacterium avium subsp. paratuberculosis
uggccagcaccgc

SEQ ID NO: 2864775 - RNA, 14 nt, Mycobacterium avium subsp. paratuberculosis
uggccagcaccgcg

SEQ ID NO: 2864776 - RNA, 24 nt, Mycobacterium avium subsp. paratuberculosis
uggccagcaccgcggcgaucgccg

SEQ ID NO: 2864777 - RNA, 15 nt, Mycobacterium avium subsp. paratuberculosis
uggccagcaccgcgu

SEQ ID NO: 2864778 - RNA, 22 nt, Mycobacterium avium subsp. paratuberculosis
uggccagcagccgcgacacgug

SEQ ID NO: 2864779 - RNA, 13 nt, Mycobacterium avium subsp. paratuberculosis
uggccagcagcgu

SEQ ID NO: 2864780 - RNA, 22 nt, Mycobacterium avium subsp. paratuberculosis
uggccagcagugccaccaccac

SEQ ID NO: 2864781 - RNA, 14 nt, Mycobacterium avium subsp. paratuberculosis
uggccagccgggcg

SEQ ID NO: 2864782 - RNA, 23 nt, Mycobacterium avium subsp. paratuberculosis
uggccagccgggcgaccgucuuc

SEQ ID NO: 2864783 - RNA, 16 nt, Mycobacterium avium subsp. paratuberculosis
uggccagcgccagcgc

SEQ ID NO: 2864784 - RNA, 14 nt, Mycobacterium avium subsp. paratuberculosis
uggccagcgccucc

SEQ ID NO: 2864785 - RNA, 16 nt, Mycobacterium avium subsp. paratuberculosis
uggccagcgccuccag

SEQ ID NO: 2864786 - RNA, 22 nt, Mycobacterium avium subsp. paratuberculosis
uggccagcgccuccagccgcuc

SEQ ID NO: 2864787 - RNA, 12 nt, Mycobacterium avium subsp. paratuberculosis
uggccagcgcga

SEQ ID NO: 2864788 - RNA, 17 nt, Mycobacterium avium subsp. paratuberculosis
uggccagcgcgacggcc

SEQ ID NO: 2864789 - RNA, 14 nt, Mycobacterium avium subsp. paratuberculosis
uggccagcgcggcg

SEQ ID NO: 2864790 - RNA, 12 nt, Mycobacterium avium subsp. paratuberculosis
uggccagcgcgu

SEQ ID NO: 2864791 - RNA, 15 nt, Mycobacterium avium subsp. paratuberculosis
uggccagcgucaggg

SEQ ID NO: 2864792 - RNA, 19 nt, Mycobacterium avium subsp. paratuberculosis
uggccagcgucagggcgac

SEQ ID NO: 2864793 - RNA, 16 nt, Mycobacterium avium subsp. paratuberculosis
uggccgcgaacggccc

SEQ ID NO: 2864794 - RNA, 23 nt, Mycobacterium avium subsp. paratuberculosis
uggccgcgaacgggugaccggcg

SEQ ID NO: 2864795 - RNA, 17 nt, Mycobacterium avium subsp. paratuberculosis
uggccgcgacgccgccg

SEQ ID NO: 2864796 - RNA, 15 nt, Mycobacterium avium subsp. paratuberculosis
uggccgcgccacagc

SEQ ID NO: 2864797 - RNA, 13 nt, Mycobacterium avium subsp. paratuberculosis
uggccgcgccgcc

SEQ ID NO: 2864798 - RNA, 12 nt, Mycobacterium avium subsp. paratuberculosis
uggccgcgccgu

SEQ ID NO: 2864799 - RNA, 18 nt, Mycobacterium avium subsp. paratuberculosis
uggccgcgcgcaggcgcu

SEQ ID NO: 2864800 - RNA, 21 nt, Mycobacterium avium subsp. paratuberculosis
uggccgcgcgcaggcgcugag

SEQ ID NO: 2864801 - RNA, 22 nt, Mycobacterium avium subsp. paratuberculosis
uggccgcggaguaggcgccgcc

SEQ ID NO: 2864802 - RNA, 17 nt, Mycobacterium avium subsp. paratuberculosis
uggccgcggccagcugc

SEQ ID NO: 2864803 - RNA, 15 nt, Mycobacterium avium subsp. paratuberculosis
uggccgcggccuugc

SEQ ID NO: 2864804 - RNA, 17 nt, Mycobacterium avium subsp. paratuberculosis
uggccgcgggcgggccg

SEQ ID NO: 2864805 - RNA, 21 nt, Mycobacterium avium subsp. paratuberculosis
uggccgcgggcgggccgaacc

SEQ ID NO: 2864806 - RNA, 17 nt, Mycobacterium avium subsp. paratuberculosis
uggccgcguuccaggac

SEQ ID NO: 2864807 - RNA, 16 nt, Mycobacterium avium subsp. paratuberculosis
uggccggagccuucuu

SEQ ID NO: 2864808 - RNA, 16 nt, Mycobacterium avium subsp. paratuberculosis
uggccggagccuuggu

SEQ ID NO: 2864809 - RNA, 19 nt, Mycobacterium avium subsp. paratuberculosis
uggccggagccuuggucgc

SEQ ID NO: 2864810 - RNA, 20 nt, Mycobacterium avium subsp. paratuberculosis
uggccggagcggugcggcuc

SEQ ID NO: 2864811 - RNA, 22 nt, Mycobacterium avium subsp. paratuberculosis
uggccggaucgaacuugaucac

SEQ ID NO: 2864812 - RNA, 20 nt, Mycobacterium avium subsp. paratuberculosis
uggccggcagguuguugacg

SEQ ID NO: 2864813 - RNA, 16 nt, Mycobacterium avium subsp. paratuberculosis
uggccggccaccagcg

SEQ ID NO: 2864814 - RNA, 18 nt, Mycobacterium avium subsp. paratuberculosis
uggccggccaccagcggc

SEQ ID NO: 2864815 - RNA, 19 nt, Mycobacterium avium subsp. paratuberculosis
uggccggccaccagcggcc

SEQ ID NO: 2864816 - RNA, 13 nt, Mycobacterium avium subsp. paratuberculosis
uggccggccagca

SEQ ID NO: 2864817 - RNA, 13 nt, Mycobacterium avium subsp. paratuberculosis
uggccggcccgcc

SEQ ID NO: 2864818 - RNA, 14 nt, Mycobacterium avium subsp. paratuberculosis
uggccggccgggcg

SEQ ID NO: 2864819 - RNA, 23 nt, Mycobacterium avium subsp. paratuberculosis
uggccggcguccaggcgcaccgc

SEQ ID NO: 2864820 - RNA, 21 nt, Mycobacterium avium subsp. paratuberculosis
uggccggcuggaacaucccgg

SEQ ID NO: 2864821 - RNA, 23 nt, Mycobacterium avium subsp. paratuberculosis
uggccgggcucgaguuuggccag

SEQ ID NO: 2864822 - RNA, 23 nt, Mycobacterium avium subsp. paratuberculosis
uggccggguuccgguuggccagg

SEQ ID NO: 2864823 - RNA, 18 nt, Mycobacterium avium subsp. paratuberculosis
uggccggugcggaugaag

SEQ ID NO: 2864824 - RNA, 16 nt, Mycobacterium avium subsp. paratuberculosis
uggccggugggcggcg

SEQ ID NO: 2864825 - RNA, 15 nt, Mycobacterium avium subsp. paratuberculosis
uggccguaaccgccg

SEQ ID NO: 2864826 - RNA, 14 nt, Mycobacterium avium subsp. paratuberculosis
uggccgucacgcug

SEQ ID NO: 2864827 - RNA, 16 nt, Mycobacterium avium subsp. paratuberculosis
uggccgucacgcuggc

SEQ ID NO: 2864828 - RNA, 16 nt, Mycobacterium avium subsp. paratuberculosis
uggccgucaucuccga

SEQ ID NO: 2864829 - RNA, 15 nt, Mycobacterium avium subsp. paratuberculosis
uggccguccggauag

SEQ ID NO: 2864830 - RNA, 14 nt, Mycobacterium avium subsp. paratuberculosis
uggccgucgcggcg

SEQ ID NO: 2864831 - RNA, 13 nt, Mycobacterium avium subsp. paratuberculosis
uggccgucgcuga

SEQ ID NO: 2864832 - RNA, 19 nt, Mycobacterium avium subsp. paratuberculosis
uggccgucggccugcgcug

SEQ ID NO: 2864833 - RNA, 20 nt, Mycobacterium avium subsp. paratuberculosis
uggccgucggccugcgcugc

SEQ ID NO: 2864834 - RNA, 13 nt, Mycobacterium avium subsp. paratuberculosis
uggccgucggcga

SEQ ID NO: 2864835 - RNA, 20 nt, Mycobacterium avium subsp. paratuberculosis
uggccgugcaccgucgccgg

SEQ ID NO: 2864836 - RNA, 12 nt, Mycobacterium avium subsp. paratuberculosis
uggccgugcagg

SEQ ID NO: 2864837 - RNA, 23 nt, Mycobacterium avium subsp. paratuberculosis
uggccgugcagggggcgcagccg

SEQ ID NO: 2864838 - RNA, 15 nt, Mycobacterium avium subsp. paratuberculosis
uggccguggucggcg

SEQ ID NO: 2864839 - RNA, 20 nt, Mycobacterium avium subsp. paratuberculosis
uggccguugaucgagcaccg

SEQ ID NO: 2864840 - RNA, 16 nt, Mycobacterium avium subsp. paratuberculosis
uggccucauuggccuu

SEQ ID NO: 2864841 - RNA, 14 nt, Mycobacterium avium subsp. paratuberculosis
uggccuccaccggc

SEQ ID NO: 2864842 - RNA, 13 nt, Mycobacterium avium subsp. paratuberculosis
uggccuccagcuu

SEQ ID NO: 2864843 - RNA, 21 nt, Mycobacterium avium subsp. paratuberculosis
uggccuccagguucgccgccc

SEQ ID NO: 2864844 - RNA, 23 nt, Mycobacterium avium subsp. paratuberculosis
uggccuccccauccgcggccacc

SEQ ID NO: 2864845 - RNA, 17 nt, Mycobacterium avium subsp. paratuberculosis
uggccucccccuugccg

SEQ ID NO: 2864846 - RNA, 18 nt, Mycobacterium avium subsp. paratuberculosis
uggccuccgacccgucca

SEQ ID NO: 2864847 - RNA, 20 nt, Mycobacterium avium subsp. paratuberculosis
uggccuccggagugacgucg

SEQ ID NO: 2864848 - RNA, 14 nt, Mycobacterium avium subsp. paratuberculosis
uggccuccgugcug

SEQ ID NO: 2864849 - RNA, 18 nt, Mycobacterium avium subsp. paratuberculosis
uggccuccgugcuggccg

SEQ ID NO: 2864850 - RNA, 20 nt, Mycobacterium avium subsp. paratuberculosis
uggccucgcgcaaugccgcc

SEQ ID NO: 2864851 - RNA, 15 nt, Mycobacterium avium subsp. paratuberculosis
uggccucggcgcggg

SEQ ID NO: 2864852 - RNA, 15 nt, Mycobacterium avium subsp. paratuberculosis
uggccucggcgcugc

SEQ ID NO: 2864853 - RNA, 19 nt, Mycobacterium avium subsp. paratuberculosis
uggccucggcgcugcccgc

SEQ ID NO: 2864854 - RNA, 18 nt, Mycobacterium avium subsp. paratuberculosis
uggccucgggcgacgacg

SEQ ID NO: 2864855 - RNA, 17 nt, Mycobacterium avium subsp. paratuberculosis
uggccucgggggugaag

SEQ ID NO: 2864856 - RNA, 22 nt, Mycobacterium avium subsp. paratuberculosis
uggccucgucgaugucggcggc

SEQ ID NO: 2864857 - RNA, 19 nt, Mycobacterium avium subsp. paratuberculosis
uggccucgucggcgccguc

SEQ ID NO: 2864858 - RNA, 17 nt, Mycobacterium avium subsp. paratuberculosis
uggccugaaccagcucg

SEQ ID NO: 2864859 - RNA, 23 nt, Mycobacterium avium subsp. paratuberculosis
uggccugcaacuggucgugcagc

SEQ ID NO: 2864860 - RNA, 22 nt, Mycobacterium avium subsp. paratuberculosis
uggccugcacggugcgccggca

SEQ ID NO: 2864861 - RNA, 11 nt, Mycobacterium avium subsp. paratuberculosis
uggccugcccg

SEQ ID NO: 2864862 - RNA, 13 nt, Mycobacterium avium subsp. paratuberculosis
uggccugcccggc

SEQ ID NO: 2864863 - RNA, 15 nt, Mycobacterium avium subsp. paratuberculosis
uggccugcccggcgg

SEQ ID NO: 2864864 - RNA, 21 nt, Mycobacterium avium subsp. paratuberculosis
uggccugcccggcggugccga

SEQ ID NO: 2864865 - RNA, 16 nt, Mycobacterium avium subsp. paratuberculosis
uggccugcgcgaccuc

SEQ ID NO: 2864866 - RNA, 17 nt, Mycobacterium avium subsp. paratuberculosis
uggccugcggcaacagc

SEQ ID NO: 2864867 - RNA, 17 nt, Mycobacterium avium subsp. paratuberculosis
uggccugcuugggcagc

SEQ ID NO: 2864868 - RNA, 21 nt, Mycobacterium avium subsp. paratuberculosis
uggccugcuugggcagcagcu

SEQ ID NO: 2864869 - RNA, 19 nt, Mycobacterium avium subsp. paratuberculosis
uggccuggaagaugacccg

SEQ ID NO: 2864870 - RNA, 16 nt, Mycobacterium avium subsp. paratuberculosis
uggccugggcgaccag

SEQ ID NO: 2864871 - RNA, 13 nt, Mycobacterium avium subsp. paratuberculosis
uggccuggucgaa

SEQ ID NO: 2864872 - RNA, 17 nt, Mycobacterium avium subsp. paratuberculosis
uggccuggucggccggc

SEQ ID NO: 2864873 - RNA, 23 nt, Mycobacterium avium subsp. paratuberculosis
uggccuucaucaccgccccgacg

SEQ ID NO: 2864874 - RNA, 20 nt, Mycobacterium avium subsp. paratuberculosis
uggccuucuggaagccuggc

SEQ ID NO: 2864875 - RNA, 15 nt, Mycobacterium avium subsp. paratuberculosis
uggccuugacgacgg

SEQ ID NO: 2864876 - RNA, 21 nt, Mycobacterium avium subsp. paratuberculosis
uggccuugacgacggccaccg

SEQ ID NO: 2864877 - RNA, 14 nt, Mycobacterium avium subsp. paratuberculosis
uggccuugcagccc

SEQ ID NO: 2864878 - RNA, 21 nt, Mycobacterium avium subsp. paratuberculosis
uggcgccggcguccagcgccg

SEQ ID NO: 2864879 - RNA, 13 nt, Mycobacterium avium subsp. paratuberculosis
uggcgccggggcg

SEQ ID NO: 2864880 - RNA, 19 nt, Mycobacterium avium subsp. paratuberculosis
uggcgccgguaggcgcggg

SEQ ID NO: 2864881 - RNA, 15 nt, Mycobacterium avium subsp. paratuberculosis
uggcgccggucgacg

SEQ ID NO: 2864882 - RNA, 16 nt, Mycobacterium avium subsp. paratuberculosis
uggcgccggucgacgc

SEQ ID NO: 2864883 - RNA, 17 nt, Mycobacterium avium subsp. paratuberculosis
uggcgccggugaagcgg

SEQ ID NO: 2864884 - RNA, 21 nt, Mycobacterium avium subsp. paratuberculosis
uggcgccggugaagcgggaca

SEQ ID NO: 2864885 - RNA, 13 nt, Mycobacterium avium subsp. paratuberculosis
uggcgccgguuuc

SEQ ID NO: 2864886 - RNA, 15 nt, Mycobacterium avium subsp. paratuberculosis
uggcgcgaaucccgg

SEQ ID NO: 2864887 - RNA, 21 nt, Mycobacterium avium subsp. paratuberculosis
uggcgcgaaucccggccucgu

SEQ ID NO: 2864888 - RNA, 13 nt, Mycobacterium avium subsp. paratuberculosis
uggcgcgacgcgg

SEQ ID NO: 2864889 - RNA, 23 nt, Mycobacterium avium subsp. paratuberculosis
uggcgcgauagccggugaucgcg

SEQ ID NO: 2864890 - RNA, 19 nt, Mycobacterium avium subsp. paratuberculosis
uggcgcgcaacgcuuucgg

SEQ ID NO: 2864891 - RNA, 22 nt, Mycobacterium avium subsp. paratuberculosis
uggcgcgcaccagcucggcgcu

SEQ ID NO: 2864892 - RNA, 16 nt, Mycobacterium avium subsp. paratuberculosis
uggcgcgcaucguggc

SEQ ID NO: 2864893 - RNA, 18 nt, Mycobacterium avium subsp. paratuberculosis
uggcgcgccccggcccgu

SEQ ID NO: 2864894 - RNA, 19 nt, Mycobacterium avium subsp. paratuberculosis
uggcgcgccccggcccguc

SEQ ID NO: 2864895 - RNA, 21 nt, Mycobacterium avium subsp. paratuberculosis
uggcgcgccccggcccgucca

SEQ ID NO: 2864896 - RNA, 15 nt, Mycobacterium avium subsp. paratuberculosis
uggcgcggccggccg

SEQ ID NO: 2864897 - RNA, 12 nt, Mycobacterium avium subsp. paratuberculosis
uggcgcggcggc

SEQ ID NO: 2864898 - RNA, 15 nt, Mycobacterium avium subsp. paratuberculosis
uggcgcucagcggca

SEQ ID NO: 2864899 - RNA, 13 nt, Mycobacterium avium subsp. paratuberculosis
uggcgcuccagcc

SEQ ID NO: 2864900 - RNA, 22 nt, Mycobacterium avium subsp. paratuberculosis
uggcgcuccagccacuccacca

SEQ ID NO: 2864901 - RNA, 19 nt, Mycobacterium avium subsp. paratuberculosis
uggcgcugaucgaguccuc

SEQ ID NO: 2864902 - RNA, 15 nt, Mycobacterium avium subsp. paratuberculosis
uggcgcugccgagca

SEQ ID NO: 2864903 - RNA, 16 nt, Mycobacterium avium subsp. paratuberculosis
uggcgcuggugcagca

SEQ ID NO: 2864904 - RNA, 24 nt, Mycobacterium avium subsp. paratuberculosis
uggcgcuugcguucccagcccggc

SEQ ID NO: 2864905 - RNA, 13 nt, Mycobacterium avium subsp. paratuberculosis
uggcggaagcgcg

SEQ ID NO: 2864906 - RNA, 14 nt, Mycobacterium avium subsp. paratuberculosis
uggcggaagcgcgu

SEQ ID NO: 2864907 - RNA, 12 nt, Mycobacterium avium subsp. paratuberculosis
uggcggaaggcc

SEQ ID NO: 2864908 - RNA, 19 nt, Mycobacterium avium subsp. paratuberculosis
uggcggaauuuucgccguc

SEQ ID NO: 2864909 - RNA, 20 nt, Mycobacterium avium subsp. paratuberculosis
uggcggaauuuucgccguca

SEQ ID NO: 2864910 - RNA, 16 nt, Mycobacterium avium subsp. paratuberculosis
uggcggauggcgcccu

SEQ ID NO: 2864911 - RNA, 18 nt, Mycobacterium avium subsp. paratuberculosis
uggcggcaacggccauga

SEQ ID NO: 2864912 - RNA, 22 nt, Mycobacterium avium subsp. paratuberculosis
uggcggccaacgccucgucgac

SEQ ID NO: 2864913 - RNA, 23 nt, Mycobacterium avium subsp. paratuberculosis
uggcggccaccaucuccgcggcg

SEQ ID NO: 2864914 - RNA, 17 nt, Mycobacterium avium subsp. paratuberculosis
uggcggccacgaucgcg

SEQ ID NO: 2864915 - RNA, 21 nt, Mycobacterium avium subsp. paratuberculosis
uggcggccagcgagaagucgc

SEQ ID NO: 2864916 - RNA, 22 nt, Mycobacterium avium subsp. paratuberculosis
uggcggccagcgccuucuccag

SEQ ID NO: 2864917 - RNA, 15 nt, Mycobacterium avium subsp. paratuberculosis
uggcggccagcgcgc

SEQ ID NO: 2864918 - RNA, 19 nt, Mycobacterium avium subsp. paratuberculosis
uggcggccagcgcgccgcc

SEQ ID NO: 2864919 - RNA, 20 nt, Mycobacterium avium subsp. paratuberculosis
uggcggccagcgucuugacg

SEQ ID NO: 2864920 - RNA, 19 nt, Mycobacterium avium subsp. paratuberculosis
uggcggccaggccggcgac

SEQ ID NO: 2864921 - RNA, 21 nt, Mycobacterium avium subsp. paratuberculosis
uggcggccaggccggcgacga

SEQ ID NO: 2864922 - RNA, 22 nt, Mycobacterium avium subsp. paratuberculosis
uggcggcccgaccagcgggccg

SEQ ID NO: 2864923 - RNA, 12 nt, Mycobacterium avium subsp. paratuberculosis
uggcggcccgcg

SEQ ID NO: 2864924 - RNA, 15 nt, Mycobacterium avium subsp. paratuberculosis
uggcggcccgcgccg

SEQ ID NO: 2864925 - RNA, 18 nt, Mycobacterium avium subsp. paratuberculosis
uggcggccgccgcgauca

SEQ ID NO: 2864926 - RNA, 21 nt, Mycobacterium avium subsp. paratuberculosis
uggcggccgccgcgaucaggg

SEQ ID NO: 2864927 - RNA, 13 nt, Mycobacterium avium subsp. paratuberculosis
uggcggccggccg

SEQ ID NO: 2864928 - RNA, 14 nt, Mycobacterium avium subsp. paratuberculosis
uggcggccggccgc

SEQ ID NO: 2864929 - RNA, 13 nt, Mycobacterium avium subsp. paratuberculosis
uggcggccugcuc

SEQ ID NO: 2864930 - RNA, 18 nt, Mycobacterium avium subsp. paratuberculosis
uggcggcgaacgcgcggu

SEQ ID NO: 2864931 - RNA, 22 nt, Mycobacterium avium subsp. paratuberculosis
uggcggcgaacgcgcggucguc

SEQ ID NO: 2864932 - RNA, 19 nt, Mycobacterium avium subsp. paratuberculosis
uggcggcgaggaacucagc

SEQ ID NO: 2864933 - RNA, 16 nt, Mycobacterium avium subsp. paratuberculosis
uggcggcgaucaccgc

SEQ ID NO: 2864934 - RNA, 21 nt, Mycobacterium avium subsp. paratuberculosis
uggcggcgaugaagccccgga

SEQ ID NO: 2864935 - RNA, 12 nt, Mycobacterium avium subsp. paratuberculosis
uggcggcgaugu

SEQ ID NO: 2864936 - RNA, 17 nt, Mycobacterium avium subsp. paratuberculosis
uggcggcgaugucgucg

SEQ ID NO: 2864937 - RNA, 18 nt, Mycobacterium avium subsp. paratuberculosis
uggcggcgaugucgucga

SEQ ID NO: 2864938 - RNA, 24 nt, Mycobacterium avium subsp. paratuberculosis
uggcggcgaugucgucgacgcugc

SEQ ID NO: 2864939 - RNA, 19 nt, Mycobacterium avium subsp. paratuberculosis
uggcggcgcacuccaucac

SEQ ID NO: 2864940 - RNA, 14 nt, Mycobacterium avium subsp. paratuberculosis
uggcggcgcgcucg

SEQ ID NO: 2864941 - RNA, 23 nt, Mycobacterium avium subsp. paratuberculosis
uggcggcgcgcucgucgucggug

SEQ ID NO: 2864942 - RNA, 11 nt, Mycobacterium avium subsp. paratuberculosis
uggcggcggcc

SEQ ID NO: 2864943 - RNA, 22 nt, Mycobacterium avium subsp. paratuberculosis
uggcggcggcccgccgcgcccg

SEQ ID NO: 2864944 - RNA, 15 nt, Mycobacterium avium subsp. paratuberculosis
uggcggcggcccgcg

SEQ ID NO: 2864945 - RNA, 13 nt, Mycobacterium avium subsp. paratuberculosis
uggcggcggccuu

SEQ ID NO: 2864946 - RNA, 15 nt, Mycobacterium avium subsp. paratuberculosis
uggcggcggcgacga

SEQ ID NO: 2864947 - RNA, 13 nt, Mycobacterium avium subsp. paratuberculosis
uggcggcggcugc

SEQ ID NO: 2864948 - RNA, 22 nt, Mycobacterium avium subsp. paratuberculosis
uggcggcggcugccucgacgau

SEQ ID NO: 2864949 - RNA, 18 nt, Mycobacterium avium subsp. paratuberculosis
uggcggcgggccagcucg

SEQ ID NO: 2864950 - RNA, 14 nt, Mycobacterium avium subsp. paratuberculosis
uggcggcggugauc

SEQ ID NO: 2864951 - RNA, 19 nt, Mycobacterium avium subsp. paratuberculosis
uggcggcggugaucgccgg

SEQ ID NO: 2864952 - RNA, 22 nt, Mycobacterium avium subsp. paratuberculosis
uggcggcggugaucgccggauc

SEQ ID NO: 2864953 - RNA, 17 nt, Mycobacterium avium subsp. paratuberculosis
uggcggcggugaucucg

SEQ ID NO: 2864954 - RNA, 18 nt, Mycobacterium avium subsp. paratuberculosis
uggcggcggugucgccca

SEQ ID NO: 2864955 - RNA, 18 nt, Mycobacterium avium subsp. paratuberculosis
uggcggcgucgucgccgu

SEQ ID NO: 2864956 - RNA, 19 nt, Mycobacterium avium subsp. paratuberculosis
uggcggcgucgucgccgug

SEQ ID NO: 2864957 - RNA, 18 nt, Mycobacterium avium subsp. paratuberculosis
uggcggcgugcaguccca

SEQ ID NO: 2864958 - RNA, 20 nt, Mycobacterium avium subsp. paratuberculosis
uggcggcgugcagucccaga

SEQ ID NO: 2864959 - RNA, 22 nt, Mycobacterium avium subsp. paratuberculosis
uggcggcgugggguucccggcc

SEQ ID NO: 2864960 - RNA, 13 nt, Mycobacterium avium subsp. paratuberculosis
uggcgggccaggc

SEQ ID NO: 2864961 - RNA, 14 nt, Mycobacterium avium subsp. paratuberculosis
uggcgggccaggcg

SEQ ID NO: 2864962 - RNA, 13 nt, Mycobacterium avium subsp. paratuberculosis
uggcuccccggcg

SEQ ID NO: 2864963 - RNA, 18 nt, Mycobacterium avium subsp. paratuberculosis
uggcucucguccucgaac

SEQ ID NO: 2864964 - RNA, 12 nt, Mycobacterium avium subsp. paratuberculosis
uggcugaacagc

SEQ ID NO: 2864965 - RNA, 19 nt, Mycobacterium avium subsp. paratuberculosis
uggcugaacagcgcgccga

SEQ ID NO: 2864966 - RNA, 17 nt, Mycobacterium avium subsp. paratuberculosis
uggcugagcagcacccg

SEQ ID NO: 2864967 - RNA, 15 nt, Mycobacterium avium subsp. paratuberculosis
uggcugaggccgccc

SEQ ID NO: 2864968 - RNA, 19 nt, Mycobacterium avium subsp. paratuberculosis
uggcugaggccgccccggc

SEQ ID NO: 2864969 - RNA, 16 nt, Mycobacterium avium subsp. paratuberculosis
uggcugcacgucacgg

SEQ ID NO: 2864970 - RNA, 20 nt, Mycobacterium avium subsp. paratuberculosis
uggcugcacgucacgggcca

SEQ ID NO: 2864971 - RNA, 12 nt, Mycobacterium avium subsp. paratuberculosis
uggcugcccggc

SEQ ID NO: 2864972 - RNA, 15 nt, Mycobacterium avium subsp. paratuberculosis
uggcugccugguugg

SEQ ID NO: 2864973 - RNA, 17 nt, Mycobacterium avium subsp. paratuberculosis
uggcuggcggcaacggc

SEQ ID NO: 2864974 - RNA, 21 nt, Mycobacterium avium subsp. paratuberculosis
uggcugggcgcuagcugcgcc

SEQ ID NO: 2864975 - RNA, 22 nt, Mycobacterium avium subsp. paratuberculosis
uggcuggucacccacuggcggc

SEQ ID NO: 2864976 - RNA, 15 nt, Mycobacterium avium subsp. paratuberculosis
uggcugucgcgcuga

SEQ ID NO: 2864977 - RNA, 18 nt, Mycobacterium avium subsp. paratuberculosis
uggcugucggggaccguc

SEQ ID NO: 2864978 - RNA, 18 nt, Mycobacterium avium subsp. paratuberculosis
uggcugugcacgauggac

SEQ ID NO: 2864979 - RNA, 18 nt, Mycobacterium avium subsp. paratuberculosis
uggcuuccgccgagacgg

SEQ ID NO: 2864980 - RNA, 17 nt, Mycobacterium avium subsp. paratuberculosis
uggcuuuggucgccagc

SEQ ID NO: 2864981 - RNA, 16 nt, Mycobacterium avium subsp. paratuberculosis
ugggaaugcggcuggg

SEQ ID NO: 2864982 - RNA, 20 nt, Mycobacterium avium subsp. paratuberculosis
ugggacagccggucgacgaa

SEQ ID NO: 2864983 - RNA, 16 nt, Mycobacterium avium subsp. paratuberculosis
ugggacggcggguggg

SEQ ID NO: 2864984 - RNA, 16 nt, Mycobacterium avium subsp. paratuberculosis
ugggacgggucggcgg

SEQ ID NO: 2864985 - RNA, 21 nt, Mycobacterium avium subsp. paratuberculosis
ugggacugggcgccgccggcg

SEQ ID NO: 2864986 - RNA, 17 nt, Mycobacterium avium subsp. paratuberculosis
ugggagacuuccacuua

SEQ ID NO: 2864987 - RNA, 16 nt, Mycobacterium avium subsp. paratuberculosis
ugggagcacgugauga

SEQ ID NO: 2864988 - RNA, 14 nt, Mycobacterium avium subsp. paratuberculosis
ugggaucagcagca

SEQ ID NO: 2864989 - RNA, 15 nt, Mycobacterium avium subsp. paratuberculosis
ugggaucagcagcac

SEQ ID NO: 2864990 - RNA, 22 nt, Mycobacterium avium subsp. paratuberculosis
ugggaucggugcgcggcgaagg

SEQ ID NO: 2864991 - RNA, 18 nt, Mycobacterium avium subsp. paratuberculosis
ugggaugucuagccgccg

SEQ ID NO: 2864992 - RNA, 17 nt, Mycobacterium avium subsp. paratuberculosis
ugggcaauaccggcagc

SEQ ID NO: 2864993 - RNA, 17 nt, Mycobacterium avium subsp. paratuberculosis
ugggcaauggccgcgac

SEQ ID NO: 2864994 - RNA, 20 nt, Mycobacterium avium subsp. paratuberculosis
ugggcaccagcagcgcgacg

SEQ ID NO: 2864995 - RNA, 14 nt, Mycobacterium avium subsp. paratuberculosis
ugggcaccgucgau

SEQ ID NO: 2864996 - RNA, 18 nt, Mycobacterium avium subsp. paratuberculosis
ugggcacgucggccagga

SEQ ID NO: 2864997 - RNA, 21 nt, Mycobacterium avium subsp. paratuberculosis
ugggcacgucggccaggaucu

SEQ ID NO: 2864998 - RNA, 19 nt, Mycobacterium avium subsp. paratuberculosis
ugggcagaugcccgcugac

SEQ ID NO: 2864999 - RNA, 20 nt, Mycobacterium avium subsp. paratuberculosis
ugggcagccaaccgccgggg

SEQ ID NO: 2865000 - RNA, 15 nt, Mycobacterium avium subsp. paratuberculosis
ugggcagccggcaac

SEQ ID NO: 2865001 - RNA, 12 nt, Mycobacterium avium subsp. paratuberculosis
ugggcagcgcgg

SEQ ID NO: 2865002 - RNA, 15 nt, Mycobacterium avium subsp. paratuberculosis
ugggcagcgcggcca

SEQ ID NO: 2865003 - RNA, 23 nt, Mycobacterium avium subsp. paratuberculosis
ugggcagcgcggccagcacgguc

SEQ ID NO: 2865004 - RNA, 16 nt, Mycobacterium avium subsp. paratuberculosis
ugggcagcggaaucgc

SEQ ID NO: 2865005 - RNA, 22 nt, Mycobacterium avium subsp. paratuberculosis
ugggcagcggaaucgcccgggc

SEQ ID NO: 2865006 - RNA, 12 nt, Mycobacterium avium subsp. paratuberculosis
ugggcagcucgg

SEQ ID NO: 2865007 - RNA, 23 nt, Mycobacterium avium subsp. paratuberculosis
ugggcaucaucggcacgccgggg

SEQ ID NO: 2865008 - RNA, 15 nt, Mycobacterium avium subsp. paratuberculosis
ugggcaucgucucgg

SEQ ID NO: 2865009 - RNA, 17 nt, Mycobacterium avium subsp. paratuberculosis
ugggcauggugaagccc

SEQ ID NO: 2865010 - RNA, 22 nt, Mycobacterium avium subsp. paratuberculosis
ugggcaugucgccgaacgccac

SEQ ID NO: 2865011 - RNA, 20 nt, Mycobacterium avium subsp. paratuberculosis
ugggcauugcccaucgccac

SEQ ID NO: 2865012 - RNA, 11 nt, Mycobacterium avium subsp. paratuberculosis
ugggccacggc

SEQ ID NO: 2865013 - RNA, 14 nt, Mycobacterium avium subsp. paratuberculosis
ugggccacggcgcg

SEQ ID NO: 2865014 - RNA, 17 nt, Mycobacterium avium subsp. paratuberculosis
ugggccagaucgacccc

SEQ ID NO: 2865015 - RNA, 19 nt, Mycobacterium avium subsp. paratuberculosis
ugggccagcagcgucguca

SEQ ID NO: 2865016 - RNA, 13 nt, Mycobacterium avium subsp. paratuberculosis
ugggccagcgcgg

SEQ ID NO: 2865017 - RNA, 15 nt, Mycobacterium avium subsp. paratuberculosis
ugggccagcgcggug

SEQ ID NO: 2865018 - RNA, 14 nt, Mycobacterium avium subsp. paratuberculosis
ugggccaggccucc

SEQ ID NO: 2865019 - RNA, 13 nt, Mycobacterium avium subsp. paratuberculosis
ugggccagguccu

SEQ ID NO: 2865020 - RNA, 19 nt, Mycobacterium avium subsp. paratuberculosis
ugggccagguccucgcugg

SEQ ID NO: 2865021 - RNA, 21 nt, Mycobacterium avium subsp. paratuberculosis
ugggccaucccggggacaccg

SEQ ID NO: 2865022 - RNA, 23 nt, Mycobacterium avium subsp. paratuberculosis
ugggccaucccggggacaccggg

SEQ ID NO: 2865023 - RNA, 14 nt, Mycobacterium avium subsp. paratuberculosis
ugggccaucgccag

SEQ ID NO: 2865024 - RNA, 22 nt, Mycobacterium avium subsp. paratuberculosis
ugggcccgcgcaucccgucgac

SEQ ID NO: 2865025 - RNA, 19 nt, Mycobacterium avium subsp. paratuberculosis
ugggccgcagcgcggcgac

SEQ ID NO: 2865026 - RNA, 23 nt, Mycobacterium avium subsp. paratuberculosis
ugggccgccggccgcucgcgggc

SEQ ID NO: 2865027 - RNA, 21 nt, Mycobacterium avium subsp. paratuberculosis
ugggccgccgucgccaccacc

SEQ ID NO: 2865028 - RNA, 16 nt, Mycobacterium avium subsp. paratuberculosis
ugggccgcggcgccgu

SEQ ID NO: 2865029 - RNA, 15 nt, Mycobacterium avium subsp. paratuberculosis
ugggccggcgcccgu

SEQ ID NO: 2865030 - RNA, 18 nt, Mycobacterium avium subsp. paratuberculosis
ugggccggcgcccgucac

SEQ ID NO: 2865031 - RNA, 19 nt, Mycobacterium avium subsp. paratuberculosis
ugggccgggaugaagccgc

SEQ ID NO: 2865032 - RNA, 15 nt, Mycobacterium avium subsp. paratuberculosis
ugggccuccggcggc

SEQ ID NO: 2865033 - RNA, 16 nt, Mycobacterium avium subsp. paratuberculosis
ugggccuccggcggca

SEQ ID NO: 2865034 - RNA, 17 nt, Mycobacterium avium subsp. paratuberculosis
ugggccucguccaggga

SEQ ID NO: 2865035 - RNA, 15 nt, Mycobacterium avium subsp. paratuberculosis
ugggcgaacagcagc

SEQ ID NO: 2865036 - RNA, 18 nt, Mycobacterium avium subsp. paratuberculosis
ugggcgaacagcagcacc

SEQ ID NO: 2865037 - RNA, 17 nt, Mycobacterium avium subsp. paratuberculosis
ugggcgaacgaggccga

SEQ ID NO: 2865038 - RNA, 18 nt, Mycobacterium avium subsp. paratuberculosis
ugggcgaacggcaacggc

SEQ ID NO: 2865039 - RNA, 16 nt, Mycobacterium avium subsp. paratuberculosis
ugggcgaaucugucga

SEQ ID NO: 2865040 - RNA, 22 nt, Mycobacterium avium subsp. paratuberculosis
ugggcgaaucugucgauggcgg

SEQ ID NO: 2865041 - RNA, 16 nt, Mycobacterium avium subsp. paratuberculosis
ugggcgaccacgucca

SEQ ID NO: 2865042 - RNA, 18 nt, Mycobacterium avium subsp. paratuberculosis
ugggcgaccacguccagc

SEQ ID NO: 2865043 - RNA, 17 nt, Mycobacterium avium subsp. paratuberculosis
ugggcgaccaugccgcg

SEQ ID NO: 2865044 - RNA, 14 nt, Mycobacterium avium subsp. paratuberculosis
ugggcgauccgcag

SEQ ID NO: 2865045 - RNA, 22 nt, Mycobacterium avium subsp. paratuberculosis
ugggcgaucgacaccagcgugu

SEQ ID NO: 2865046 - RNA, 15 nt, Mycobacterium avium subsp. paratuberculosis
ugggcgauggcggcg

SEQ ID NO: 2865047 - RNA, 18 nt, Mycobacterium avium subsp. paratuberculosis
ugggugcucccgccaaua

SEQ ID NO: 2865048 - RNA, 13 nt, Mycobacterium avium subsp. paratuberculosis
uggguggccccuc

SEQ ID NO: 2865049 - RNA, 15 nt, Mycobacterium avium subsp. paratuberculosis
uggguggccccucau

SEQ ID NO: 2865050 - RNA, 15 nt, Mycobacterium avium subsp. paratuberculosis
ugggugggcagcucg

SEQ ID NO: 2865051 - RNA, 16 nt, Mycobacterium avium subsp. paratuberculosis
uggguggucaccagcg

SEQ ID NO: 2865052 - RNA, 16 nt, Mycobacterium avium subsp. paratuberculosis
uggguggucagcgcgg

SEQ ID NO: 2865053 - RNA, 18 nt, Mycobacterium avium subsp. paratuberculosis
ugggugguccaggcgccg

SEQ ID NO: 2865054 - RNA, 14 nt, Mycobacterium avium subsp. paratuberculosis
ugggugguggugcc

SEQ ID NO: 2865055 - RNA, 19 nt, Mycobacterium avium subsp. paratuberculosis
uggguguccuugcgcacca

SEQ ID NO: 2865056 - RNA, 13 nt, Mycobacterium avium subsp. paratuberculosis
uggguguggcguc

SEQ ID NO: 2865057 - RNA, 14 nt, Mycobacterium avium subsp. paratuberculosis
uggguucggcggcg

SEQ ID NO: 2865058 - RNA, 23 nt, Mycobacterium avium subsp. paratuberculosis
uggguucuucgaccacgcgccaa

SEQ ID NO: 2865059 - RNA, 15 nt, Mycobacterium avium subsp. paratuberculosis
ugguacagcaccgcc

SEQ ID NO: 2865060 - RNA, 15 nt, Mycobacterium avium subsp. paratuberculosis
ugguacagcgccagc

SEQ ID NO: 2865061 - RNA, 18 nt, Mycobacterium avium subsp. paratuberculosis
ugguaccggcgccaggcc

SEQ ID NO: 2865062 - RNA, 14 nt, Mycobacterium avium subsp. paratuberculosis
ugguaccggguggc

SEQ ID NO: 2865063 - RNA, 13 nt, Mycobacterium avium subsp. paratuberculosis
ugguagacgccgg

SEQ ID NO: 2865064 - RNA, 13 nt, Mycobacterium avium subsp. paratuberculosis
ugguagcccagga

SEQ ID NO: 2865065 - RNA, 23 nt, Mycobacterium avium subsp. paratuberculosis
ugguagcccaggauucccgaccc

SEQ ID NO: 2865066 - RNA, 20 nt, Mycobacterium avium subsp. paratuberculosis
ugguagccgccguucucgcg

SEQ ID NO: 2865067 - RNA, 16 nt, Mycobacterium avium subsp. paratuberculosis
ugguagcugagcagca

SEQ ID NO: 2865068 - RNA, 19 nt, Mycobacterium avium subsp. paratuberculosis
ugguagcugagcagcaggu

SEQ ID NO: 2865069 - RNA, 21 nt, Mycobacterium avium subsp. paratuberculosis
ugguaggccgccuugggccgg

SEQ ID NO: 2865070 - RNA, 15 nt, Mycobacterium avium subsp. paratuberculosis
ugguaggcggccggg

SEQ ID NO: 2865071 - RNA, 14 nt, Mycobacterium avium subsp. paratuberculosis
ugguagggccgcuu

SEQ ID NO: 2865072 - RNA, 15 nt, Mycobacterium avium subsp. paratuberculosis
ugguagggcuccgcg

SEQ ID NO: 2865073 - RNA, 14 nt, Mycobacterium avium subsp. paratuberculosis
ugguagggguccuc

SEQ ID NO: 2865074 - RNA, 15 nt, Mycobacterium avium subsp. paratuberculosis
ugguaguacaccggg

SEQ ID NO: 2865075 - RNA, 18 nt, Mycobacterium avium subsp. paratuberculosis
uggucaacucgacccgca

SEQ ID NO: 2865076 - RNA, 13 nt, Mycobacterium avium subsp. paratuberculosis
uggucaauccggg

SEQ ID NO: 2865077 - RNA, 15 nt, Mycobacterium avium subsp. paratuberculosis
uggucaauccgggca

SEQ ID NO: 2865078 - RNA, 19 nt, Mycobacterium avium subsp. paratuberculosis
uggucaccaccaacgccac

SEQ ID NO: 2865079 - RNA, 13 nt, Mycobacterium avium subsp. paratuberculosis
uggucaccaccac

SEQ ID NO: 2865080 - RNA, 12 nt, Mycobacterium avium subsp. paratuberculosis
uggucaccagcg

SEQ ID NO: 2865081 - RNA, 15 nt, Mycobacterium avium subsp. paratuberculosis
uggucaccagcgcgg

SEQ ID NO: 2865082 - RNA, 12 nt, Mycobacterium avium subsp. paratuberculosis
uggucaccagcu

SEQ ID NO: 2865083 - RNA, 13 nt, Mycobacterium avium subsp. paratuberculosis
uggucaccagguc

SEQ ID NO: 2865084 - RNA, 17 nt, Mycobacterium avium subsp. paratuberculosis
uggucaccaggucgcgg

SEQ ID NO: 2865085 - RNA, 16 nt, Mycobacterium avium subsp. paratuberculosis
uggucaccaucagcgg

SEQ ID NO: 2865086 - RNA, 19 nt, Mycobacterium avium subsp. paratuberculosis
uggucacccacuggcggcc

SEQ ID NO: 2865087 - RNA, 13 nt, Mycobacterium avium subsp. paratuberculosis
uggucaccguguc

SEQ ID NO: 2865088 - RNA, 19 nt, Mycobacterium avium subsp. paratuberculosis
uggucaccgugucggcggg

SEQ ID NO: 2865089 - RNA, 21 nt, Mycobacterium avium subsp. paratuberculosis
uggucaccgugucggcgggcg

SEQ ID NO: 2865090 - RNA, 20 nt, Mycobacterium avium subsp. paratuberculosis
uggucaccguguuggugacg

SEQ ID NO: 2865091 - RNA, 21 nt, Mycobacterium avium subsp. paratuberculosis
uggucagagcccgaacacggg

SEQ ID NO: 2865092 - RNA, 20 nt, Mycobacterium avium subsp. paratuberculosis
uggucagcgcccccgaggag

SEQ ID NO: 2865093 - RNA, 12 nt, Mycobacterium avium subsp. paratuberculosis
uggucagcggcg

SEQ ID NO: 2865094 - RNA, 18 nt, Mycobacterium avium subsp. paratuberculosis
uggucagcgucucgccgg

SEQ ID NO: 2865095 - RNA, 16 nt, Mycobacterium avium subsp. paratuberculosis
uggucagcugccgcac

SEQ ID NO: 2865096 - RNA, 19 nt, Mycobacterium avium subsp. paratuberculosis
uggucagcugccgcaccgc

SEQ ID NO: 2865097 - RNA, 19 nt, Mycobacterium avium subsp. paratuberculosis
uggucaggguguaggccgc

SEQ ID NO: 2865098 - RNA, 22 nt, Mycobacterium avium subsp. paratuberculosis
uggucagguaggcgucgaacgg

SEQ ID NO: 2865099 - RNA, 16 nt, Mycobacterium avium subsp. paratuberculosis
uggucaugaacgccgg

SEQ ID NO: 2865100 - RNA, 18 nt, Mycobacterium avium subsp. paratuberculosis
uggucaugaacgccgggu

SEQ ID NO: 2865101 - RNA, 18 nt, Mycobacterium avium subsp. paratuberculosis
uggucaugaaggcgacgu

SEQ ID NO: 2865102 - RNA, 15 nt, Mycobacterium avium subsp. paratuberculosis
ugguccaccgccgcg

SEQ ID NO: 2865103 - RNA, 15 nt, Mycobacterium avium subsp. paratuberculosis
ugguccaccgcggcg

SEQ ID NO: 2865104 - RNA, 17 nt, Mycobacterium avium subsp. paratuberculosis
ugguccaccgcggcggc

SEQ ID NO: 2865105 - RNA, 13 nt, Mycobacterium avium subsp. paratuberculosis
ugguccagcaccg

SEQ ID NO: 2865106 - RNA, 14 nt, Mycobacterium avium subsp. paratuberculosis
ugguccagcaccgg

SEQ ID NO: 2865107 - RNA, 20 nt, Mycobacterium avium subsp. paratuberculosis
ugguccaggcguucgacccc

SEQ ID NO: 2865108 - RNA, 14 nt, Mycobacterium avium subsp. paratuberculosis
ugguccccgggccc

SEQ ID NO: 2865109 - RNA, 18 nt, Mycobacterium avium subsp. paratuberculosis
ugguccccgggcccagca

SEQ ID NO: 2865110 - RNA, 20 nt, Mycobacterium avium subsp. paratuberculosis
uggucccgaucaccuugccc

SEQ ID NO: 2865111 - RNA, 14 nt, Mycobacterium avium subsp. paratuberculosis
ugguccgcgcgacc

SEQ ID NO: 2865112 - RNA, 18 nt, Mycobacterium avium subsp. paratuberculosis
ugguccggucucuggccu

SEQ ID NO: 2865113 - RNA, 15 nt, Mycobacterium avium subsp. paratuberculosis
ugguccugcaccgag

SEQ ID NO: 2865114 - RNA, 18 nt, Mycobacterium avium subsp. paratuberculosis
ugguccugccccgggaaa

SEQ ID NO: 2865115 - RNA, 18 nt, Mycobacterium avium subsp. paratuberculosis
ugguccuuaaucgggacg

SEQ ID NO: 2865116 - RNA, 16 nt, Mycobacterium avium subsp. paratuberculosis
uggucgaacagcacgc

SEQ ID NO: 2865117 - RNA, 16 nt, Mycobacterium avium subsp. paratuberculosis
uggucgaacagcgcgc

SEQ ID NO: 2865118 - RNA, 23 nt, Mycobacterium avium subsp. paratuberculosis
uggucgaaccgcgagcgcgcggu

SEQ ID NO: 2865119 - RNA, 23 nt, Mycobacterium avium subsp. paratuberculosis
uggucgaacgccaccuucaccgc

SEQ ID NO: 2865120 - RNA, 19 nt, Mycobacterium avium subsp. paratuberculosis
uggucgaagauggccaggu

SEQ ID NO: 2865121 - RNA, 15 nt, Mycobacterium avium subsp. paratuberculosis
uggucgagccgcagu

SEQ ID NO: 2865122 - RNA, 18 nt, Mycobacterium avium subsp. paratuberculosis
uggucgagcuccuccggg

SEQ ID NO: 2865123 - RNA, 22 nt, Mycobacterium avium subsp. paratuberculosis
uggucgauccacucccgcgcgc

SEQ ID NO: 2865124 - RNA, 18 nt, Mycobacterium avium subsp. paratuberculosis
uggucgaucccgccggcg

SEQ ID NO: 2865125 - RNA, 17 nt, Mycobacterium avium subsp. paratuberculosis
uggucgcccacaccgga

SEQ ID NO: 2865126 - RNA, 13 nt, Mycobacterium avium subsp. paratuberculosis
uggucgccgacgg

SEQ ID NO: 2865127 - RNA, 22 nt, Mycobacterium avium subsp. paratuberculosis
uggucgccgucguauucgacgg

SEQ ID NO: 2865128 - RNA, 15 nt, Mycobacterium avium subsp. paratuberculosis
uggucgcgcagcaug

SEQ ID NO: 2865129 - RNA, 23 nt, Mycobacterium avium subsp. paratuberculosis
uggucgcggccguguacagcagg

SEQ ID NO: 2865130 - RNA, 12 nt, Mycobacterium avium subsp. paratuberculosis
uggucgcggccu

SEQ ID NO: 2865131 - RNA, 23 nt, Mycobacterium avium subsp. paratuberculosis
uggucgcggccuucuuggccgga

SEQ ID NO: 2865132 - RNA, 20 nt, Mycobacterium avium subsp. paratuberculosis
uggugccggccucgucggcg

SEQ ID NO: 2865133 - RNA, 22 nt, Mycobacterium avium subsp. paratuberculosis
uggugccggccucgucggcgag

SEQ ID NO: 2865134 - RNA, 14 nt, Mycobacterium avium subsp. paratuberculosis
uggugccgucggcg

SEQ ID NO: 2865135 - RNA, 16 nt, Mycobacterium avium subsp. paratuberculosis
uggugcgcagccgucg

SEQ ID NO: 2865136 - RNA, 18 nt, Mycobacterium avium subsp. paratuberculosis
uggugcgccgggucgcgg

SEQ ID NO: 2865137 - RNA, 12 nt, Mycobacterium avium subsp. paratuberculosis
uggugcgcgcgc

SEQ ID NO: 2865138 - RNA, 15 nt, Mycobacterium avium subsp. paratuberculosis
uggugcgggccagca

SEQ ID NO: 2865139 - RNA, 19 nt, Mycobacterium avium subsp. paratuberculosis
uggugcgggccagcacgac

SEQ ID NO: 2865140 - RNA, 15 nt, Mycobacterium avium subsp. paratuberculosis
uggugcucgccccgc

SEQ ID NO: 2865141 - RNA, 14 nt, Mycobacterium avium subsp. paratuberculosis
uggugcucgcgcuc

SEQ ID NO: 2865142 - RNA, 17 nt, Mycobacterium avium subsp. paratuberculosis
uggugcugcccggcgcg

SEQ ID NO: 2865143 - RNA, 23 nt, Mycobacterium avium subsp. paratuberculosis
ugguggaaggugacgucgccgau

SEQ ID NO: 2865144 - RNA, 21 nt, Mycobacterium avium subsp. paratuberculosis
ugguggaugaugccggcggug

SEQ ID NO: 2865145 - RNA, 20 nt, Mycobacterium avium subsp. paratuberculosis
ugguggccagcaccacgucc

SEQ ID NO: 2865146 - RNA, 19 nt, Mycobacterium avium subsp. paratuberculosis
ugguggcccaggcagaccc

SEQ ID NO: 2865147 - RNA, 15 nt, Mycobacterium avium subsp. paratuberculosis
ugguggccgcggccg

SEQ ID NO: 2865148 - RNA, 16 nt, Mycobacterium avium subsp. paratuberculosis
ugguggccgcggccgc

SEQ ID NO: 2865149 - RNA, 17 nt, Mycobacterium avium subsp. paratuberculosis
ugguggccgcggccgcc

SEQ ID NO: 2865150 - RNA, 20 nt, Mycobacterium avium subsp. paratuberculosis
ugguggccuugacgacggcc

SEQ ID NO: 2865151 - RNA, 14 nt, Mycobacterium avium subsp. paratuberculosis
ugguggcgccgguu

SEQ ID NO: 2865152 - RNA, 18 nt, Mycobacterium avium subsp. paratuberculosis
uggugggcagaugcccgc

SEQ ID NO: 2865153 - RNA, 13 nt, Mycobacterium avium subsp. paratuberculosis
uggugggcgccgg

SEQ ID NO: 2865154 - RNA, 13 nt, Mycobacterium avium subsp. paratuberculosis
uggugggcgcggu

SEQ ID NO: 2865155 - RNA, 14 nt, Mycobacterium avium subsp. paratuberculosis
uggugggcgggcac

SEQ ID NO: 2865156 - RNA, 14 nt, Mycobacterium avium subsp. paratuberculosis
uggugggcgucgug

SEQ ID NO: 2865157 - RNA, 16 nt, Mycobacterium avium subsp. paratuberculosis
uggugggcgugcaggc

SEQ ID NO: 2865158 - RNA, 14 nt, Mycobacterium avium subsp. paratuberculosis
uggugggcgugccg

SEQ ID NO: 2865159 - RNA, 13 nt, Mycobacterium avium subsp. paratuberculosis
ugguggggccggc

SEQ ID NO: 2865160 - RNA, 15 nt, Mycobacterium avium subsp. paratuberculosis
uggugggguagacgg

SEQ ID NO: 2865161 - RNA, 11 nt, Mycobacterium avium subsp. paratuberculosis
ugguggucgac

SEQ ID NO: 2865162 - RNA, 12 nt, Mycobacterium avium subsp. paratuberculosis
ugguggucgacg

SEQ ID NO: 2865163 - RNA, 17 nt, Mycobacterium avium subsp. paratuberculosis
ugguggucgacgcgccg

SEQ ID NO: 2865164 - RNA, 13 nt, Mycobacterium avium subsp. paratuberculosis
ugguggugcggac

SEQ ID NO: 2865165 - RNA, 17 nt, Mycobacterium avium subsp. paratuberculosis
ugguguacacgucgcgg

SEQ ID NO: 2865166 - RNA, 21 nt, Mycobacterium avium subsp. paratuberculosis
ugguguaggcgaucgggaaca

SEQ ID NO: 2865167 - RNA, 16 nt, Mycobacterium avium subsp. paratuberculosis
ugguguccacccgcgc

SEQ ID NO: 2865168 - RNA, 22 nt, Mycobacterium avium subsp. paratuberculosis
uggugucgaagcugcgcagccg

SEQ ID NO: 2865169 - RNA, 21 nt, Mycobacterium avium subsp. paratuberculosis
uggugucgaagucgaucccgg

SEQ ID NO: 2865170 - RNA, 13 nt, Mycobacterium avium subsp. paratuberculosis
uggugucggagau

SEQ ID NO: 2865171 - RNA, 22 nt, Mycobacterium avium subsp. paratuberculosis
uggugugauacaggagggccag

SEQ ID NO: 2865172 - RNA, 15 nt, Mycobacterium avium subsp. paratuberculosis
uggugugcaaaagca

SEQ ID NO: 2865173 - RNA, 19 nt, Mycobacterium avium subsp. paratuberculosis
uggugugcaccagcgaucc

SEQ ID NO: 2865174 - RNA, 14 nt, Mycobacterium avium subsp. paratuberculosis
ugguguggaagaag

SEQ ID NO: 2865175 - RNA, 20 nt, Mycobacterium avium subsp. paratuberculosis
ugguguuccaccagcggccg

SEQ ID NO: 2865176 - RNA, 22 nt, Mycobacterium avium subsp. paratuberculosis
ugguguuccaccagcggccguc

SEQ ID NO: 2865177 - RNA, 19 nt, Mycobacterium avium subsp. paratuberculosis
ugguguucuggaugcccag

SEQ ID NO: 2865178 - RNA, 15 nt, Mycobacterium avium subsp. paratuberculosis
ugguuaccagcucac

SEQ ID NO: 2865179 - RNA, 14 nt, Mycobacterium avium subsp. paratuberculosis
ugguucaccgccac

SEQ ID NO: 2865180 - RNA, 17 nt, Mycobacterium avium subsp. paratuberculosis
ugguuccccccauacac

SEQ ID NO: 2865181 - RNA, 20 nt, Mycobacterium avium subsp. paratuberculosis
ugguuccccccauacacggg

SEQ ID NO: 2865182 - RNA, 18 nt, Mycobacterium avium subsp. paratuberculosis
ugguugaaccgguacagg

SEQ ID NO: 2865183 - RNA, 19 nt, Mycobacterium avium subsp. paratuberculosis
ugguugaacggcaccccgc

SEQ ID NO: 2865184 - RNA, 14 nt, Mycobacterium avium subsp. paratuberculosis
ugguugagcaccgc

SEQ ID NO: 2865185 - RNA, 17 nt, Mycobacterium avium subsp. paratuberculosis
ugguugagcagcagacc

SEQ ID NO: 2865186 - RNA, 19 nt, Mycobacterium avium subsp. paratuberculosis
ugguugccgcccucggccg

SEQ ID NO: 2865187 - RNA, 19 nt, Mycobacterium avium subsp. paratuberculosis
ugguugcggccccgccagc

SEQ ID NO: 2865188 - RNA, 16 nt, Mycobacterium avium subsp. paratuberculosis
ugguugcggcgggccg

SEQ ID NO: 2865189 - RNA, 18 nt, Mycobacterium avium subsp. paratuberculosis
ugguuggcccgcaccacc

SEQ ID NO: 2865190 - RNA, 19 nt, Mycobacterium avium subsp. paratuberculosis
ugguuggcccgcaccaccc

SEQ ID NO: 2865191 - RNA, 16 nt, Mycobacterium avium subsp. paratuberculosis
ugguugucgacgcugc

SEQ ID NO: 2865192 - RNA, 17 nt, Mycobacterium avium subsp. paratuberculosis
ugguuucagguggcgcc

SEQ ID NO: 2865193 - RNA, 13 nt, Mycobacterium avium subsp. paratuberculosis
ugguuuccacugc

SEQ ID NO: 2865194 - RNA, 15 nt, Mycobacterium avium subsp. paratuberculosis
ugguuuccacugcca

SEQ ID NO: 2865195 - RNA, 15 nt, Mycobacterium avium subsp. paratuberculosis
ugguuucgguccagg

SEQ ID NO: 2865196 - RNA, 16 nt, Mycobacterium avium subsp. paratuberculosis
ugguuucgguccaggu

SEQ ID NO: 2865197 - RNA, 16 nt, Mycobacterium avium subsp. paratuberculosis
uguaaccguggcaggc

SEQ ID NO: 2865198 - RNA, 20 nt, Mycobacterium avium subsp. paratuberculosis
uguaccaggccuugucgucc

SEQ ID NO: 2865199 - RNA, 14 nt, Mycobacterium avium subsp. paratuberculosis
uguacucggcgucg

SEQ ID NO: 2865200 - RNA, 20 nt, Mycobacterium avium subsp. paratuberculosis
uguagcacccggccggcgaa

SEQ ID NO: 2865201 - RNA, 21 nt, Mycobacterium avium subsp. paratuberculosis
uguagcccucccggaacagcu

SEQ ID NO: 2865202 - RNA, 15 nt, Mycobacterium avium subsp. paratuberculosis
uguagccgguccugg

SEQ ID NO: 2865203 - RNA, 18 nt, Mycobacterium avium subsp. paratuberculosis
uguagccugcggccugca

SEQ ID NO: 2865204 - RNA, 22 nt, Mycobacterium avium subsp. paratuberculosis
uguagccugcggccugcacagg

SEQ ID NO: 2865205 - RNA, 11 nt, Mycobacterium avium subsp. paratuberculosis
uguagcgcagc

SEQ ID NO: 2865206 - RNA, 13 nt, Mycobacterium avium subsp. paratuberculosis
uguagcgcagcau

SEQ ID NO: 2865207 - RNA, 15 nt, Mycobacterium avium subsp. paratuberculosis
uguagcgcagcauca

SEQ ID NO: 2865208 - RNA, 15 nt, Mycobacterium avium subsp. paratuberculosis
uguagcggcggucgg

SEQ ID NO: 2865209 - RNA, 21 nt, Mycobacterium avium subsp. paratuberculosis
uguagcggcggucggcgccga

SEQ ID NO: 2865210 - RNA, 19 nt, Mycobacterium avium subsp. paratuberculosis
uguaggacaggucgcggua

SEQ ID NO: 2865211 - RNA, 14 nt, Mycobacterium avium subsp. paratuberculosis
uguaggacgccgca

SEQ ID NO: 2865212 - RNA, 18 nt, Mycobacterium avium subsp. paratuberculosis
uguaggacgccgcaccgc

SEQ ID NO: 2865213 - RNA, 22 nt, Mycobacterium avium subsp. paratuberculosis
uguaggccgcgcuggccagcgu

SEQ ID NO: 2865214 - RNA, 15 nt, Mycobacterium avium subsp. paratuberculosis
uguagucggcgaucg

SEQ ID NO: 2865215 - RNA, 11 nt, Mycobacterium avium subsp. paratuberculosis
uguaucaggau

SEQ ID NO: 2865216 - RNA, 22 nt, Mycobacterium avium subsp. paratuberculosis
uguaugcgguccucgagcuggc

SEQ ID NO: 2865217 - RNA, 19 nt, Mycobacterium avium subsp. paratuberculosis
uguauuaagcuggcagggu

SEQ ID NO: 2865218 - RNA, 22 nt, Mycobacterium avium subsp. paratuberculosis
ugucacccguuugaggcgagca

SEQ ID NO: 2865219 - RNA, 16 nt, Mycobacterium avium subsp. paratuberculosis
ugucacccucgaggcc

SEQ ID NO: 2865220 - RNA, 14 nt, Mycobacterium avium subsp. paratuberculosis
ugucaccgacgcca

SEQ ID NO: 2865221 - RNA, 18 nt, Mycobacterium avium subsp. paratuberculosis
ugucacgguccagguccu

SEQ ID NO: 2865222 - RNA, 20 nt, Mycobacterium avium subsp. paratuberculosis
ugucagcgcgaccucggugg

SEQ ID NO: 2865223 - RNA, 17 nt, Mycobacterium avium subsp. paratuberculosis
ugucaggaucgccgguc

SEQ ID NO: 2865224 - RNA, 15 nt, Mycobacterium avium subsp. paratuberculosis
uguccagcagcgccg

SEQ ID NO: 2865225 - RNA, 17 nt, Mycobacterium avium subsp. paratuberculosis
uguccaggccgucgagg

SEQ ID NO: 2865226 - RNA, 21 nt, Mycobacterium avium subsp. paratuberculosis
ugucccaguucccggcgggca

SEQ ID NO: 2865227 - RNA, 13 nt, Mycobacterium avium subsp. paratuberculosis
uguccccgaccau

SEQ ID NO: 2865228 - RNA, 19 nt, Mycobacterium avium subsp. paratuberculosis
uguccccgauuucgcggcc

SEQ ID NO: 2865229 - RNA, 15 nt, Mycobacterium avium subsp. paratuberculosis
ugucccgggcgaacg

SEQ ID NO: 2865230 - RNA, 23 nt, Mycobacterium avium subsp. paratuberculosis
uguccgagccgcccacguucagc

SEQ ID NO: 2865231 - RNA, 16 nt, Mycobacterium avium subsp. paratuberculosis
uguccgagcgggccgu

SEQ ID NO: 2865232 - RNA, 12 nt, Mycobacterium avium subsp. paratuberculosis
uguccgaugacg

SEQ ID NO: 2865233 - RNA, 14 nt, Mycobacterium avium subsp. paratuberculosis
uguccgcguggccg

SEQ ID NO: 2865234 - RNA, 14 nt, Mycobacterium avium subsp. paratuberculosis
uguccggcaggcuc

SEQ ID NO: 2865235 - RNA, 21 nt, Mycobacterium avium subsp. paratuberculosis
uguccggcaggcucagcagca

SEQ ID NO: 2865236 - RNA, 16 nt, Mycobacterium avium subsp. paratuberculosis
uguccggcucugccug

SEQ ID NO: 2865237 - RNA, 18 nt, Mycobacterium avium subsp. paratuberculosis
uguccgguaggccggccg

SEQ ID NO: 2865238 - RNA, 21 nt, Mycobacterium avium subsp. paratuberculosis
uguccggucucggucgcggcg

SEQ ID NO: 2865239 - RNA, 20 nt, Mycobacterium avium subsp. paratuberculosis
uguccucccagcgcccgggc

SEQ ID NO: 2865240 - RNA, 21 nt, Mycobacterium avium subsp. paratuberculosis
uguccucccagcgcccgggcg

SEQ ID NO: 2865241 - RNA, 14 nt, Mycobacterium avium subsp. paratuberculosis
uguccucgucgggg

SEQ ID NO: 2865242 - RNA, 17 nt, Mycobacterium avium subsp. paratuberculosis
uguccuggcccuugacc

SEQ ID NO: 2865243 - RNA, 22 nt, Mycobacterium avium subsp. paratuberculosis
ugucgaagaccggugcgcgcac

SEQ ID NO: 2865244 - RNA, 17 nt, Mycobacterium avium subsp. paratuberculosis
ugucgaagucgaucccg

SEQ ID NO: 2865245 - RNA, 22 nt, Mycobacterium avium subsp. paratuberculosis
ugucgaccaccggguagcccgc

SEQ ID NO: 2865246 - RNA, 12 nt, Mycobacterium avium subsp. paratuberculosis
ugucgacccgcg

SEQ ID NO: 2865247 - RNA, 20 nt, Mycobacterium avium subsp. paratuberculosis
ugucgaccucggccaccacc

SEQ ID NO: 2865248 - RNA, 23 nt, Mycobacterium avium subsp. paratuberculosis
ugucgacgacacccuucaucagc

SEQ ID NO: 2865249 - RNA, 12 nt, Mycobacterium avium subsp. paratuberculosis
ugucgacgacgu

SEQ ID NO: 2865250 - RNA, 19 nt, Mycobacterium avium subsp. paratuberculosis
ugucgacgcccuuggcgcc

SEQ ID NO: 2865251 - RNA, 21 nt, Mycobacterium avium subsp. paratuberculosis
ugucgacgcccuuggcgccca

SEQ ID NO: 2865252 - RNA, 12 nt, Mycobacterium avium subsp. paratuberculosis
ugucgacgccgg

SEQ ID NO: 2865253 - RNA, 22 nt, Mycobacterium avium subsp. paratuberculosis
ugucgacgcugagccgcucguc

SEQ ID NO: 2865254 - RNA, 14 nt, Mycobacterium avium subsp. paratuberculosis
ugucgacgcugcag

SEQ ID NO: 2865255 - RNA, 21 nt, Mycobacterium avium subsp. paratuberculosis
ugucgacguggugcaccgcca

SEQ ID NO: 2865256 - RNA, 17 nt, Mycobacterium avium subsp. paratuberculosis
ugucgagaugaccgucg

SEQ ID NO: 2865257 - RNA, 17 nt, Mycobacterium avium subsp. paratuberculosis
ugucgagcaccgcgauc

SEQ ID NO: 2865258 - RNA, 19 nt, Mycobacterium avium subsp. paratuberculosis
ugucgagcacgucgacgcc

SEQ ID NO: 2865259 - RNA, 23 nt, Mycobacterium avium subsp. paratuberculosis
ugucgagcacgucgacgccgguc

SEQ ID NO: 2865260 - RNA, 13 nt, Mycobacterium avium subsp. paratuberculosis
ugucgaggucggu

SEQ ID NO: 2865261 - RNA, 23 nt, Mycobacterium avium subsp. paratuberculosis
ugucgaucgaauacaccugccgc

SEQ ID NO: 2865262 - RNA, 23 nt, Mycobacterium avium subsp. paratuberculosis
ugucgaugaacgcacucggugug

SEQ ID NO: 2865263 - RNA, 20 nt, Mycobacterium avium subsp. paratuberculosis
ugucgauggcggaacugacu

SEQ ID NO: 2865264 - RNA, 22 nt, Mycobacterium avium subsp. paratuberculosis
ugucgauggucgccugcuggac

SEQ ID NO: 2865265 - RNA, 15 nt, Mycobacterium avium subsp. paratuberculosis
ugucgaugucgacgc

SEQ ID NO: 2865266 - RNA, 13 nt, Mycobacterium avium subsp. paratuberculosis
ugucgcacugcuu

SEQ ID NO: 2865267 - RNA, 20 nt, Mycobacterium avium subsp. paratuberculosis
ugucgcccagcugggccagc

SEQ ID NO: 2865268 - RNA, 14 nt, Mycobacterium avium subsp. paratuberculosis
ugucgcccgcgucg

SEQ ID NO: 2865269 - RNA, 16 nt, Mycobacterium avium subsp. paratuberculosis
ugucgcccggcgcggc

SEQ ID NO: 2865270 - RNA, 17 nt, Mycobacterium avium subsp. paratuberculosis
ugucgcccggcgcggca

SEQ ID NO: 2865271 - RNA, 23 nt, Mycobacterium avium subsp. paratuberculosis
ugucgcccucgaucgcgaccacc

SEQ ID NO: 2865272 - RNA, 13 nt, Mycobacterium avium subsp. paratuberculosis
ugucgccgaccag

SEQ ID NO: 2865273 - RNA, 23 nt, Mycobacterium avium subsp. paratuberculosis
ugucgccgaccagguagcgcugc

SEQ ID NO: 2865274 - RNA, 14 nt, Mycobacterium avium subsp. paratuberculosis
ugucgccgagccgc

SEQ ID NO: 2865275 - RNA, 20 nt, Mycobacterium avium subsp. paratuberculosis
ugucgccgauuucggugucg

SEQ ID NO: 2865276 - RNA, 14 nt, Mycobacterium avium subsp. paratuberculosis
ugucgccgcgccag

SEQ ID NO: 2865277 - RNA, 15 nt, Mycobacterium avium subsp. paratuberculosis
ugucgccgcgccagc

SEQ ID NO: 2865278 - RNA, 11 nt, Mycobacterium avium subsp. paratuberculosis
ugucgccggug

SEQ ID NO: 2865279 - RNA, 18 nt, Mycobacterium avium subsp. paratuberculosis
ugucgcgaaaaucggugg

SEQ ID NO: 2865280 - RNA, 13 nt, Mycobacterium avium subsp. paratuberculosis
ugucgcgcaccgc

SEQ ID NO: 2865281 - RNA, 14 nt, Mycobacterium avium subsp. paratuberculosis
ugucgcgggcgaaa

SEQ ID NO: 2865282 - RNA, 14 nt, Mycobacterium avium subsp. paratuberculosis
ugucgcucaucccg

SEQ ID NO: 2865283 - RNA, 15 nt, Mycobacterium avium subsp. paratuberculosis
ugucgcugccgccgc

SEQ ID NO: 2865284 - RNA, 21 nt, Mycobacterium avium subsp. paratuberculosis
ugucgcugcgaggcgggcaca

SEQ ID NO: 2865285 - RNA, 17 nt, Mycobacterium avium subsp. paratuberculosis
ugucgcuguaggccagc

SEQ ID NO: 2865286 - RNA, 22 nt, Mycobacterium avium subsp. paratuberculosis
ugucgcuguuagccucgccagc

SEQ ID NO: 2865287 - RNA, 22 nt, Mycobacterium avium subsp. paratuberculosis
ugucggagcugcgcgccccggc

SEQ ID NO: 2865288 - RNA, 19 nt, Mycobacterium avium subsp. paratuberculosis
ugucggaggccuccaggcu

SEQ ID NO: 2865289 - RNA, 16 nt, Mycobacterium avium subsp. paratuberculosis
ugucggccagcgcggc

SEQ ID NO: 2865290 - RNA, 12 nt, Mycobacterium avium subsp. paratuberculosis
ugucggccaggu

SEQ ID NO: 2865291 - RNA, 14 nt, Mycobacterium avium subsp. paratuberculosis
ugucggccgcccgu

SEQ ID NO: 2865292 - RNA, 21 nt, Mycobacterium avium subsp. paratuberculosis
ugucggcgaaccagggcagcc

SEQ ID NO: 2865293 - RNA, 21 nt, Mycobacterium avium subsp. paratuberculosis
ugucggcgauccacgccuccg

SEQ ID NO: 2865294 - RNA, 15 nt, Mycobacterium avium subsp. paratuberculosis
ugucggcgccaccgg

SEQ ID NO: 2865295 - RNA, 16 nt, Mycobacterium avium subsp. paratuberculosis
ugucggcgccaccggg

SEQ ID NO: 2865296 - RNA, 15 nt, Mycobacterium avium subsp. paratuberculosis
ugucggcgggcgggc

SEQ ID NO: 2865297 - RNA, 20 nt, Mycobacterium avium subsp. paratuberculosis
ugucggcggggccggugaug

SEQ ID NO: 2865298 - RNA, 15 nt, Mycobacterium avium subsp. paratuberculosis
ugucggcgucgccga

SEQ ID NO: 2865299 - RNA, 16 nt, Mycobacterium avium subsp. paratuberculosis
ugucggcucgccgauc

SEQ ID NO: 2865300 - RNA, 13 nt, Mycobacterium avium subsp. paratuberculosis
ugucgggcaccug

SEQ ID NO: 2865301 - RNA, 13 nt, Mycobacterium avium subsp. paratuberculosis
ugucgggccgcgg

SEQ ID NO: 2865302 - RNA, 14 nt, Mycobacterium avium subsp. paratuberculosis
ugugguagggccgc

SEQ ID NO: 2865303 - RNA, 20 nt, Mycobacterium avium subsp. paratuberculosis
uguggucugaccccccgacg

SEQ ID NO: 2865304 - RNA, 16 nt, Mycobacterium avium subsp. paratuberculosis
uguggugccgggucgc

SEQ ID NO: 2865305 - RNA, 17 nt, Mycobacterium avium subsp. paratuberculosis
ugugguugcuggcgucg

SEQ ID NO: 2865306 - RNA, 15 nt, Mycobacterium avium subsp. paratuberculosis
ugugguugggccagg

SEQ ID NO: 2865307 - RNA, 17 nt, Mycobacterium avium subsp. paratuberculosis
uguucaacgcgccgaug

SEQ ID NO: 2865308 - RNA, 12 nt, Mycobacterium avium subsp. paratuberculosis
uguucaccccga

SEQ ID NO: 2865309 - RNA, 12 nt, Mycobacterium avium subsp. paratuberculosis
uguucaccccgu

SEQ ID NO: 2865310 - RNA, 14 nt, Mycobacterium avium subsp. paratuberculosis
uguucaccggcguc

SEQ ID NO: 2865311 - RNA, 15 nt, Mycobacterium avium subsp. paratuberculosis
uguucagcccgguca

SEQ ID NO: 2865312 - RNA, 22 nt, Mycobacterium avium subsp. paratuberculosis
uguucaggucgauggucugccc

SEQ ID NO: 2865313 - RNA, 23 nt, Mycobacterium avium subsp. paratuberculosis
uguuccaacaacuucgagcagaa

SEQ ID NO: 2865314 - RNA, 19 nt, Mycobacterium avium subsp. paratuberculosis
uguuccaccagcggccguc

SEQ ID NO: 2865315 - RNA, 17 nt, Mycobacterium avium subsp. paratuberculosis
uguucgccgucgcgggu

SEQ ID NO: 2865316 - RNA, 14 nt, Mycobacterium avium subsp. paratuberculosis
uguucgcgccggua

SEQ ID NO: 2865317 - RNA, 14 nt, Mycobacterium avium subsp. paratuberculosis
uguucggccaccgc

SEQ ID NO: 2865318 - RNA, 20 nt, Mycobacterium avium subsp. paratuberculosis
uguucgucgaguucgcggcg

SEQ ID NO: 2865319 - RNA, 18 nt, Mycobacterium avium subsp. paratuberculosis
uguucguugucgagcgag

SEQ ID NO: 2865320 - RNA, 13 nt, Mycobacterium avium subsp. paratuberculosis
uguucucacggcg

SEQ ID NO: 2865321 - RNA, 16 nt, Mycobacterium avium subsp. paratuberculosis
uguucuccagcggccg

SEQ ID NO: 2865322 - RNA, 13 nt, Mycobacterium avium subsp. paratuberculosis
uguucuccggccc

SEQ ID NO: 2865323 - RNA, 20 nt, Mycobacterium avium subsp. paratuberculosis
uguucuggaugcccagggcg

SEQ ID NO: 2865324 - RNA, 19 nt, Mycobacterium avium subsp. paratuberculosis
uguugacgacguuggccag

SEQ ID NO: 2865325 - RNA, 15 nt, Mycobacterium avium subsp. paratuberculosis
uguugagcguggcag

SEQ ID NO: 2865326 - RNA, 23 nt, Mycobacterium avium subsp. paratuberculosis
uguugcaggcggaccugggugcg

SEQ ID NO: 2865327 - RNA, 14 nt, Mycobacterium avium subsp. paratuberculosis
uguugccgugcugg

SEQ ID NO: 2865328 - RNA, 20 nt, Mycobacterium avium subsp. paratuberculosis
uguugcgcgggaagccgccg

SEQ ID NO: 2865329 - RNA, 12 nt, Mycobacterium avium subsp. paratuberculosis
uguugcucgggg

SEQ ID NO: 2865330 - RNA, 14 nt, Mycobacterium avium subsp. paratuberculosis
uguuggagccgucc

SEQ ID NO: 2865331 - RNA, 19 nt, Mycobacterium avium subsp. paratuberculosis
uguugguagcccaggauuc

SEQ ID NO: 2865332 - RNA, 21 nt, Mycobacterium avium subsp. paratuberculosis
uguuguagucagacccugugg

SEQ ID NO: 2865333 - RNA, 21 nt, Mycobacterium avium subsp. paratuberculosis
uguugucgugccgggugaugc

SEQ ID NO: 2865334 - RNA, 20 nt, Mycobacterium avium subsp. paratuberculosis
uguugucguggucgcugcuc

SEQ ID NO: 2865335 - RNA, 23 nt, Mycobacterium avium subsp. paratuberculosis
uguuguuccagaagaucuucaug

SEQ ID NO: 2865336 - RNA, 14 nt, Mycobacterium avium subsp. paratuberculosis
uguuguugaccccc

SEQ ID NO: 2865337 - RNA, 16 nt, Mycobacterium avium subsp. paratuberculosis
uguuguugccggucgg

SEQ ID NO: 2865338 - RNA, 14 nt, Mycobacterium avium subsp. paratuberculosis
uguuuccccagccc

SEQ ID NO: 2865339 - RNA, 14 nt, Mycobacterium avium subsp. paratuberculosis
uguuuggcugucgc

SEQ ID NO: 2865340 - RNA, 13 nt, Mycobacterium avium subsp. paratuberculosis
uguuuuucugcuc

SEQ ID NO: 2865341 - RNA, 14 nt, Mycobacterium avium subsp. paratuberculosis
uuaaggagcaaucg

SEQ ID NO: 2865342 - RNA, 15 nt, Mycobacterium avium subsp. paratuberculosis
uuaccggccggccgc

SEQ ID NO: 2865343 - RNA, 16 nt, Mycobacterium avium subsp. paratuberculosis
uuaccggcgggcggcg

SEQ ID NO: 2865344 - RNA, 20 nt, Mycobacterium avium subsp. paratuberculosis
uuaccggcguagaacaccga

SEQ ID NO: 2865345 - RNA, 22 nt, Mycobacterium avium subsp. paratuberculosis
uuacgaccaguuccacaccgac

SEQ ID NO: 2865346 - RNA, 16 nt, Mycobacterium avium subsp. paratuberculosis
uuacgaggcgugcagc

SEQ ID NO: 2865347 - RNA, 13 nt, Mycobacterium avium subsp. paratuberculosis
uuacgcugcggcg

SEQ ID NO: 2865348 - RNA, 23 nt, Mycobacterium avium subsp. paratuberculosis
uuacggaccugggaugucuagcc

SEQ ID NO: 2865349 - RNA, 19 nt, Mycobacterium avium subsp. paratuberculosis
uuacucgccggcggcgccg

SEQ ID NO: 2865350 - RNA, 15 nt, Mycobacterium avium subsp. paratuberculosis
uuagcccggccgcgg

SEQ ID NO: 2865351 - RNA, 15 nt, Mycobacterium avium subsp. paratuberculosis
uuaggucgguggcca

SEQ ID NO: 2865352 - RNA, 21 nt, Mycobacterium avium subsp. paratuberculosis
uucaaccccgcgcgcgggcca

SEQ ID NO: 2865353 - RNA, 20 nt, Mycobacterium avium subsp. paratuberculosis
uucaacggccaaccgcccgg

SEQ ID NO: 2865354 - RNA, 21 nt, Mycobacterium avium subsp. paratuberculosis
uucaagauaggagacagccga

SEQ ID NO: 2865355 - RNA, 14 nt, Mycobacterium avium subsp. paratuberculosis
uucaagccgccgau

SEQ ID NO: 2865356 - RNA, 19 nt, Mycobacterium avium subsp. paratuberculosis
uucaagguggacgagcagc

SEQ ID NO: 2865357 - RNA, 13 nt, Mycobacterium avium subsp. paratuberculosis
uucaccagcgccu

SEQ ID NO: 2865358 - RNA, 16 nt, Mycobacterium avium subsp. paratuberculosis
uucaccagcgccucgg

SEQ ID NO: 2865359 - RNA, 22 nt, Mycobacterium avium subsp. paratuberculosis
uucacccagcgagcucaggccg

SEQ ID NO: 2865360 - RNA, 22 nt, Mycobacterium avium subsp. paratuberculosis
uucaccccgaucaacaccgcca

SEQ ID NO: 2865361 - RNA, 21 nt, Mycobacterium avium subsp. paratuberculosis
uucaccccguaugcgccaacg

SEQ ID NO: 2865362 - RNA, 23 nt, Mycobacterium avium subsp. paratuberculosis
uucacccuggcgaaccgcggcgg

SEQ ID NO: 2865363 - RNA, 14 nt, Mycobacterium avium subsp. paratuberculosis
uucaccgcgccggg

SEQ ID NO: 2865364 - RNA, 23 nt, Mycobacterium avium subsp. paratuberculosis
uucaccgcgccgggcaccaccac

SEQ ID NO: 2865365 - RNA, 21 nt, Mycobacterium avium subsp. paratuberculosis
uucaccgcgccgguccggccc

SEQ ID NO: 2865366 - RNA, 19 nt, Mycobacterium avium subsp. paratuberculosis
uucaccggcgucauggugc

SEQ ID NO: 2865367 - RNA, 11 nt, Mycobacterium avium subsp. paratuberculosis
uucaccgugcg

SEQ ID NO: 2865368 - RNA, 14 nt, Mycobacterium avium subsp. paratuberculosis
uucacgcucggcag

SEQ ID NO: 2865369 - RNA, 14 nt, Mycobacterium avium subsp. paratuberculosis
uucacgcucggcga

SEQ ID NO: 2865370 - RNA, 13 nt, Mycobacterium avium subsp. paratuberculosis
uucacgucgagcg

SEQ ID NO: 2865371 - RNA, 18 nt, Mycobacterium avium subsp. paratuberculosis
uucacgucgaucacgccg

SEQ ID NO: 2865372 - RNA, 15 nt, Mycobacterium avium subsp. paratuberculosis
uucacgucugcucgg

SEQ ID NO: 2865373 - RNA, 18 nt, Mycobacterium avium subsp. paratuberculosis
uucacgucugcucggcgg

SEQ ID NO: 2865374 - RNA, 22 nt, Mycobacterium avium subsp. paratuberculosis
uucagcaacccgaaagccccca

SEQ ID NO: 2865375 - RNA, 13 nt, Mycobacterium avium subsp. paratuberculosis
uucagcccggcgc

SEQ ID NO: 2865376 - RNA, 16 nt, Mycobacterium avium subsp. paratuberculosis
uucagccugaugccgg

SEQ ID NO: 2865377 - RNA, 19 nt, Mycobacterium avium subsp. paratuberculosis
uucagcgggcgcagcucgu

SEQ ID NO: 2865378 - RNA, 22 nt, Mycobacterium avium subsp. paratuberculosis
uucagcugcagccggccggcgg

SEQ ID NO: 2865379 - RNA, 22 nt, Mycobacterium avium subsp. paratuberculosis
uucagcuugaccgugacggugc

SEQ ID NO: 2865380 - RNA, 15 nt, Mycobacterium avium subsp. paratuberculosis
uucaggccacgcagg

SEQ ID NO: 2865381 - RNA, 21 nt, Mycobacterium avium subsp. paratuberculosis
uucaggcccucaucgucgacc

SEQ ID NO: 2865382 - RNA, 21 nt, Mycobacterium avium subsp. paratuberculosis
uucaggcugaucuggaugcgg

SEQ ID NO: 2865383 - RNA, 22 nt, Mycobacterium avium subsp. paratuberculosis
uucagggcggugcggugcgccg

SEQ ID NO: 2865384 - RNA, 13 nt, Mycobacterium avium subsp. paratuberculosis
uucaggucaccgc

SEQ ID NO: 2865385 - RNA, 15 nt, Mycobacterium avium subsp. paratuberculosis
uucaggucaccgcgc

SEQ ID NO: 2865386 - RNA, 14 nt, Mycobacterium avium subsp. paratuberculosis
uucauguagcagcg

SEQ ID NO: 2865387 - RNA, 22 nt, Mycobacterium avium subsp. paratuberculosis
uucgagaguuugcccucgucga

SEQ ID NO: 2865388 - RNA, 15 nt, Mycobacterium avium subsp. paratuberculosis
uucgagccgccgccg

SEQ ID NO: 2865389 - RNA, 16 nt, Mycobacterium avium subsp. paratuberculosis
uucgagccgccgccgg

SEQ ID NO: 2865390 - RNA, 13 nt, Mycobacterium avium subsp. paratuberculosis
uucgagcgccgcg

SEQ ID NO: 2865391 - RNA, 19 nt, Mycobacterium avium subsp. paratuberculosis
uucgaggugcucgcgcagg

SEQ ID NO: 2865392 - RNA, 20 nt, Mycobacterium avium subsp. paratuberculosis
uucgaguuuggccugaacca

SEQ ID NO: 2865393 - RNA, 21 nt, Mycobacterium avium subsp. paratuberculosis
uucgaucaaaucccgcagcuc

SEQ ID NO: 2865394 - RNA, 17 nt, Mycobacterium avium subsp. paratuberculosis
uucgaucagcagcucgg

SEQ ID NO: 2865395 - RNA, 20 nt, Mycobacterium avium subsp. paratuberculosis
uucgaucagcagcucggugg

SEQ ID NO: 2865396 - RNA, 16 nt, Mycobacterium avium subsp. paratuberculosis
uucgaucaggcgcagc

SEQ ID NO: 2865397 - RNA, 17 nt, Mycobacterium avium subsp. paratuberculosis
uucgaucaucuccaccc

SEQ ID NO: 2865398 - RNA, 16 nt, Mycobacterium avium subsp. paratuberculosis
uucgauccgccggugc

SEQ ID NO: 2865399 - RNA, 17 nt, Mycobacterium avium subsp. paratuberculosis
uucgaucuccucggcgu

SEQ ID NO: 2865400 - RNA, 18 nt, Mycobacterium avium subsp. paratuberculosis
uucgaugcggucccgcgg

SEQ ID NO: 2865401 - RNA, 13 nt, Mycobacterium avium subsp. paratuberculosis
uucgauguagaag

SEQ ID NO: 2865402 - RNA, 14 nt, Mycobacterium avium subsp. paratuberculosis
uucgaugucgccgg

SEQ ID NO: 2865403 - RNA, 16 nt, Mycobacterium avium subsp. paratuberculosis
uucgaugucgccggcg

SEQ ID NO: 2865404 - RNA, 20 nt, Mycobacterium avium subsp. paratuberculosis
uucgaugucgccggcgaccg

SEQ ID NO: 2865405 - RNA, 20 nt, Mycobacterium avium subsp. paratuberculosis
uucgcagaaccguugagcag

SEQ ID NO: 2865406 - RNA, 17 nt, Mycobacterium avium subsp. paratuberculosis
uucgcccgcagcacgcc

SEQ ID NO: 2865407 - RNA, 19 nt, Mycobacterium avium subsp. paratuberculosis
uucgcccuccccggccagc

SEQ ID NO: 2865408 - RNA, 13 nt, Mycobacterium avium subsp. paratuberculosis
uucgccgacagca

SEQ ID NO: 2865409 - RNA, 14 nt, Mycobacterium avium subsp. paratuberculosis
uucgccgacagcag

SEQ ID NO: 2865410 - RNA, 17 nt, Mycobacterium avium subsp. paratuberculosis
uucgccgacagcagcuc

SEQ ID NO: 2865411 - RNA, 18 nt, Mycobacterium avium subsp. paratuberculosis
uucgccgacagcagcuca

SEQ ID NO: 2865412 - RNA, 17 nt, Mycobacterium avium subsp. paratuberculosis
uucgccgcaaccuucuu

SEQ ID NO: 2865413 - RNA, 22 nt, Mycobacterium avium subsp. paratuberculosis
uucgccgcagccuucuuggcgg

SEQ ID NO: 2865414 - RNA, 11 nt, Mycobacterium avium subsp. paratuberculosis
uucgccgccgc

SEQ ID NO: 2865415 - RNA, 18 nt, Mycobacterium avium subsp. paratuberculosis
uucgccgccgcaccggcc

SEQ ID NO: 2865416 - RNA, 16 nt, Mycobacterium avium subsp. paratuberculosis
uucgccggacagccgg

SEQ ID NO: 2865417 - RNA, 22 nt, Mycobacterium avium subsp. paratuberculosis
uucgccggggccuucuuggcgg

SEQ ID NO: 2865418 - RNA, 12 nt, Mycobacterium avium subsp. paratuberculosis
uucgccggugac

SEQ ID NO: 2865419 - RNA, 23 nt, Mycobacterium avium subsp. paratuberculosis
uucgccggugaccugcagcgccu

SEQ ID NO: 2865420 - RNA, 21 nt, Mycobacterium avium subsp. paratuberculosis
uucgccgucgugguggccgcg

SEQ ID NO: 2865421 - RNA, 21 nt, Mycobacterium avium subsp. paratuberculosis
uucgcgaucacguucucggcg

SEQ ID NO: 2865422 - RNA, 18 nt, Mycobacterium avium subsp. paratuberculosis
uucgcgcagccaccgccc

SEQ ID NO: 2865423 - RNA, 22 nt, Mycobacterium avium subsp. paratuberculosis
uucgcgccucgguucugcagcg

SEQ ID NO: 2865424 - RNA, 12 nt, Mycobacterium avium subsp. paratuberculosis
uucgcgcggcau

SEQ ID NO: 2865425 - RNA, 14 nt, Mycobacterium avium subsp. paratuberculosis
uucgcgcuguucgg

SEQ ID NO: 2865426 - RNA, 22 nt, Mycobacterium avium subsp. paratuberculosis
uucgcggcaaagggcuagguga

SEQ ID NO: 2865427 - RNA, 14 nt, Mycobacterium avium subsp. paratuberculosis
uucgcggcgcagca

SEQ ID NO: 2865428 - RNA, 12 nt, Mycobacterium avium subsp. paratuberculosis
uucgcggcggcg

SEQ ID NO: 2865429 - RNA, 13 nt, Mycobacterium avium subsp. paratuberculosis
uucgcggcggcgc

SEQ ID NO: 2865430 - RNA, 14 nt, Mycobacterium avium subsp. paratuberculosis
uucgcgggcggcgc

SEQ ID NO: 2865431 - RNA, 22 nt, Mycobacterium avium subsp. paratuberculosis
uucgcgggugccuucuuggcgg

SEQ ID NO: 2865432 - RNA, 17 nt, Mycobacterium avium subsp. paratuberculosis
uucgcggucggcaaccc

SEQ ID NO: 2865433 - RNA, 19 nt, Mycobacterium avium subsp. paratuberculosis
uucgcggugggcucgucga

SEQ ID NO: 2865434 - RNA, 18 nt, Mycobacterium avium subsp. paratuberculosis
uucgcgucugcucgccgg

SEQ ID NO: 2865435 - RNA, 22 nt, Mycobacterium avium subsp. paratuberculosis
uucgcugccccggcgaggccag

SEQ ID NO: 2865436 - RNA, 13 nt, Mycobacterium avium subsp. paratuberculosis
uucgcugcgccgg

SEQ ID NO: 2865437 - RNA, 23 nt, Mycobacterium avium subsp. paratuberculosis
uucgcuggacagccacagcucgg

SEQ ID NO: 2865438 - RNA, 12 nt, Mycobacterium avium subsp. paratuberculosis
uucgcuggucgc

SEQ ID NO: 2865439 - RNA, 17 nt, Mycobacterium avium subsp. paratuberculosis
uucggaacccugcccca

SEQ ID NO: 2865440 - RNA, 23 nt, Mycobacterium avium subsp. paratuberculosis
uucggaacccugccccacggccc

SEQ ID NO: 2865441 - RNA, 20 nt, Mycobacterium avium subsp. paratuberculosis
uucggacaccucggccagcg

SEQ ID NO: 2865442 - RNA, 19 nt, Mycobacterium avium subsp. paratuberculosis
uucggacgagccgucgcgg

SEQ ID NO: 2865443 - RNA, 19 nt, Mycobacterium avium subsp. paratuberculosis
uucggagaccaggucggcc

SEQ ID NO: 2865444 - RNA, 19 nt, Mycobacterium avium subsp. paratuberculosis
uucggaugaccaagccccg

SEQ ID NO: 2865445 - RNA, 16 nt, Mycobacterium avium subsp. paratuberculosis
uucggcaucccggaga

SEQ ID NO: 2865446 - RNA, 16 nt, Mycobacterium avium subsp. paratuberculosis
uucggccaccgcgcgg

SEQ ID NO: 2865447 - RNA, 18 nt, Mycobacterium avium subsp. paratuberculosis
uucggccaccgcgcggcg

SEQ ID NO: 2865448 - RNA, 21 nt, Mycobacterium avium subsp. paratuberculosis
uucggccaccgcgcggcgguc

SEQ ID NO: 2865449 - RNA, 12 nt, Mycobacterium avium subsp. paratuberculosis
uucggccagcgc

SEQ ID NO: 2865450 - RNA, 17 nt, Mycobacterium avium subsp. paratuberculosis
uucggccagcgcgucgg

SEQ ID NO: 2865451 - RNA, 14 nt, Mycobacterium avium subsp. paratuberculosis
uucggccgcagcgg

SEQ ID NO: 2865452 - RNA, 13 nt, Mycobacterium avium subsp. paratuberculosis
uucggccgccgug

SEQ ID NO: 2865453 - RNA, 23 nt, Mycobacterium avium subsp. paratuberculosis
uucggccgcucgggugucgccga

SEQ ID NO: 2865454 - RNA, 20 nt, Mycobacterium avium subsp. paratuberculosis
uucggccggcagcggugccg

SEQ ID NO: 2865455 - RNA, 16 nt, Mycobacterium avium subsp. paratuberculosis
uucggccggccccgcc

SEQ ID NO: 2865456 - RNA, 17 nt, Mycobacterium avium subsp. paratuberculosis
uucggccggccccgccc

SEQ ID NO: 2865457 - RNA, 15 nt, Mycobacterium avium subsp. paratuberculosis
uucggccuugucgug

SEQ ID NO: 2865458 - RNA, 19 nt, Mycobacterium avium subsp. paratuberculosis
uucggccuugucgugucga

SEQ ID NO: 2865459 - RNA, 15 nt, Mycobacterium avium subsp. paratuberculosis
uucggcgccagccgc

SEQ ID NO: 2865460 - RNA, 13 nt, Mycobacterium avium subsp. paratuberculosis
uucggcgccgcga

SEQ ID NO: 2865461 - RNA, 13 nt, Mycobacterium avium subsp. paratuberculosis
uucggcgcgccgg

SEQ ID NO: 2865462 - RNA, 23 nt, Mycobacterium avium subsp. paratuberculosis
uucggcgcggaucgucaccgacc

SEQ ID NO: 2865463 - RNA, 17 nt, Mycobacterium avium subsp. paratuberculosis
uucggcgcggcucacga

SEQ ID NO: 2865464 - RNA, 13 nt, Mycobacterium avium subsp. paratuberculosis
uucggcggcccgc

SEQ ID NO: 2865465 - RNA, 20 nt, Mycobacterium avium subsp. paratuberculosis
uucggcggcgauccggccgg

SEQ ID NO: 2865466 - RNA, 21 nt, Mycobacterium avium subsp. paratuberculosis
uucggcguccucgacgccgcg

SEQ ID NO: 2865467 - RNA, 12 nt, Mycobacterium avium subsp. paratuberculosis
uucggcucggcg

SEQ ID NO: 2865468 - RNA, 19 nt, Mycobacterium avium subsp. paratuberculosis
uucgggauccucgccgcgg

SEQ ID NO: 2865469 - RNA, 17 nt, Mycobacterium avium subsp. paratuberculosis
uucgggaucgucgccgg

SEQ ID NO: 2865470 - RNA, 23 nt, Mycobacterium avium subsp. paratuberculosis
uucgggcagauggucgccgacgg

SEQ ID NO: 2865471 - RNA, 13 nt, Mycobacterium avium subsp. paratuberculosis
uucgggccagcgc

SEQ ID NO: 2865472 - RNA, 22 nt, Mycobacterium avium subsp. paratuberculosis
uucuuggccggagccuucuucg

SEQ ID NO: 2865473 - RNA, 15 nt, Mycobacterium avium subsp. paratuberculosis
uucuuggcggccugc

SEQ ID NO: 2865474 - RNA, 22 nt, Mycobacterium avium subsp. paratuberculosis
uucuuggcgggcgacuucuucg

SEQ ID NO: 2865475 - RNA, 16 nt, Mycobacterium avium subsp. paratuberculosis
uucuuggcgggcgccu

SEQ ID NO: 2865476 - RNA, 21 nt, Mycobacterium avium subsp. paratuberculosis
uucuuggcgggcgccuucuug

SEQ ID NO: 2865477 - RNA, 18 nt, Mycobacterium avium subsp. paratuberculosis
uugaaauagccgcgccgc

SEQ ID NO: 2865478 - RNA, 11 nt, Mycobacterium avium subsp. paratuberculosis
uugaacagcac

SEQ ID NO: 2865479 - RNA, 14 nt, Mycobacterium avium subsp. paratuberculosis
uugaacgccgccaa

SEQ ID NO: 2865480 - RNA, 21 nt, Mycobacterium avium subsp. paratuberculosis
uugaacgcguacagcgcccgg

SEQ ID NO: 2865481 - RNA, 22 nt, Mycobacterium avium subsp. paratuberculosis
uugaacgcguccgacggcuggg

SEQ ID NO: 2865482 - RNA, 13 nt, Mycobacterium avium subsp. paratuberculosis
uugaagcccugcu

SEQ ID NO: 2865483 - RNA, 22 nt, Mycobacterium avium subsp. paratuberculosis
uugaauggaaugugccugcggg

SEQ ID NO: 2865484 - RNA, 13 nt, Mycobacterium avium subsp. paratuberculosis
uugaccaccagcg

SEQ ID NO: 2865485 - RNA, 14 nt, Mycobacterium avium subsp. paratuberculosis
uugaccaccaggua

SEQ ID NO: 2865486 - RNA, 21 nt, Mycobacterium avium subsp. paratuberculosis
uugaccagcgugaauugcccc

SEQ ID NO: 2865487 - RNA, 22 nt, Mycobacterium avium subsp. paratuberculosis
uugaccccggccccggccggcg

SEQ ID NO: 2865488 - RNA, 13 nt, Mycobacterium avium subsp. paratuberculosis
uugacccggccgc

SEQ ID NO: 2865489 - RNA, 12 nt, Mycobacterium avium subsp. paratuberculosis
uugaccgcccgg

SEQ ID NO: 2865490 - RNA, 16 nt, Mycobacterium avium subsp. paratuberculosis
uugaccggugcgcccg

SEQ ID NO: 2865491 - RNA, 13 nt, Mycobacterium avium subsp. paratuberculosis
uugaccgucgcgg

SEQ ID NO: 2865492 - RNA, 19 nt, Mycobacterium avium subsp. paratuberculosis
uugaccuucucgaccaggc

SEQ ID NO: 2865493 - RNA, 14 nt, Mycobacterium avium subsp. paratuberculosis
uugaccuugaccag

SEQ ID NO: 2865494 - RNA, 23 nt, Mycobacterium avium subsp. paratuberculosis
uugaccuugaccagcuugaagcc

SEQ ID NO: 2865495 - RNA, 21 nt, Mycobacterium avium subsp. paratuberculosis
uugacgaacuccugcucgcgg

SEQ ID NO: 2865496 - RNA, 15 nt, Mycobacterium avium subsp. paratuberculosis
uugacgaugacgcgg

SEQ ID NO: 2865497 - RNA, 17 nt, Mycobacterium avium subsp. paratuberculosis
uugacgcccccggugac

SEQ ID NO: 2865498 - RNA, 13 nt, Mycobacterium avium subsp. paratuberculosis
uugacgcccuccu

SEQ ID NO: 2865499 - RNA, 14 nt, Mycobacterium avium subsp. paratuberculosis
uugacgcugggcgg

SEQ ID NO: 2865500 - RNA, 15 nt, Mycobacterium avium subsp. paratuberculosis
uugacggccgcggcg

SEQ ID NO: 2865501 - RNA, 23 nt, Mycobacterium avium subsp. paratuberculosis
uugacggccgggcccucggacgg

SEQ ID NO: 2865502 - RNA, 20 nt, Mycobacterium avium subsp. paratuberculosis
uugacguacuggcgccgguc

SEQ ID NO: 2865503 - RNA, 15 nt, Mycobacterium avium subsp. paratuberculosis
uugacguccgcggga

SEQ ID NO: 2865504 - RNA, 17 nt, Mycobacterium avium subsp. paratuberculosis
uugacgugcgacaccgg

SEQ ID NO: 2865505 - RNA, 22 nt, Mycobacterium avium subsp. paratuberculosis
uugagcaccacgaggcuguggg

SEQ ID NO: 2865506 - RNA, 23 nt, Mycobacterium avium subsp. paratuberculosis
uugagcaccagcccggccagcgg

SEQ ID NO: 2865507 - RNA, 23 nt, Mycobacterium avium subsp. paratuberculosis
uugagcacggugaucagcagcag

SEQ ID NO: 2865508 - RNA, 18 nt, Mycobacterium avium subsp. paratuberculosis
uugagcauguugaacgcc

SEQ ID NO: 2865509 - RNA, 14 nt, Mycobacterium avium subsp. paratuberculosis
uugagccccgccgg

SEQ ID NO: 2865510 - RNA, 10 nt, Mycobacterium avium subsp. paratuberculosis
uugagcccgg

SEQ ID NO: 2865511 - RNA, 14 nt, Mycobacterium avium subsp. paratuberculosis
uugagccgccacgg

SEQ ID NO: 2865512 - RNA, 13 nt, Mycobacterium avium subsp. paratuberculosis
uugagccgccgcg

SEQ ID NO: 2865513 - RNA, 23 nt, Mycobacterium avium subsp. paratuberculosis
uugagccggauguccuacggcgg

SEQ ID NO: 2865514 - RNA, 18 nt, Mycobacterium avium subsp. paratuberculosis
uugagccggcgcaccgcg

SEQ ID NO: 2865515 - RNA, 11 nt, Mycobacterium avium subsp. paratuberculosis
uugagcgccag

SEQ ID NO: 2865516 - RNA, 19 nt, Mycobacterium avium subsp. paratuberculosis
uugagcgccagcgcggugc

SEQ ID NO: 2865517 - RNA, 16 nt, Mycobacterium avium subsp. paratuberculosis
uugagcgcgucgucgc

SEQ ID NO: 2865518 - RNA, 16 nt, Mycobacterium avium subsp. paratuberculosis
uugagcgugccgccgg

SEQ ID NO: 2865519 - RNA, 19 nt, Mycobacterium avium subsp. paratuberculosis
uugagcguggacaccgcac

SEQ ID NO: 2865520 - RNA, 12 nt, Mycobacterium avium subsp. paratuberculosis
uugagcucgcgg

SEQ ID NO: 2865521 - RNA, 22 nt, Mycobacterium avium subsp. paratuberculosis
uugagcucgcggcgcagcucgc

SEQ ID NO: 2865522 - RNA, 18 nt, Mycobacterium avium subsp. paratuberculosis
uugaggaacgcgaccguc

SEQ ID NO: 2865523 - RNA, 22 nt, Mycobacterium avium subsp. paratuberculosis
uugaggaucugcacgucggcgg

SEQ ID NO: 2865524 - RNA, 16 nt, Mycobacterium avium subsp. paratuberculosis
uugaggaugacgacgg

SEQ ID NO: 2865525 - RNA, 16 nt, Mycobacterium avium subsp. paratuberculosis
uugaggcgagcaauua

SEQ ID NO: 2865526 - RNA, 22 nt, Mycobacterium avium subsp. paratuberculosis
uugaggcggcggcgggccaggg

SEQ ID NO: 2865527 - RNA, 21 nt, Mycobacterium avium subsp. paratuberculosis
uugaguaguagucgauucauc

SEQ ID NO: 2865528 - RNA, 15 nt, Mycobacterium avium subsp. paratuberculosis
uugagucccucggcg

SEQ ID NO: 2865529 - RNA, 15 nt, Mycobacterium avium subsp. paratuberculosis
uugaucaccgugauc

SEQ ID NO: 2865530 - RNA, 21 nt, Mycobacterium avium subsp. paratuberculosis
uugaucagcccgacccggcuc

SEQ ID NO: 2865531 - RNA, 15 nt, Mycobacterium avium subsp. paratuberculosis
uugaucagggcggcg

SEQ ID NO: 2865532 - RNA, 17 nt, Mycobacterium avium subsp. paratuberculosis
uugaucauccggcgggg

SEQ ID NO: 2865533 - RNA, 23 nt, Mycobacterium avium subsp. paratuberculosis
uugaucgagagcuucaugcccuu

SEQ ID NO: 2865534 - RNA, 15 nt, Mycobacterium avium subsp. paratuberculosis
uugaucucaucgucg

SEQ ID NO: 2865535 - RNA, 18 nt, Mycobacterium avium subsp. paratuberculosis
uugaucugggugccgcgg

SEQ ID NO: 2865536 - RNA, 17 nt, Mycobacterium avium subsp. paratuberculosis
uugaugaaaaccaccug

SEQ ID NO: 2865537 - RNA, 21 nt, Mycobacterium avium subsp. paratuberculosis
uugaugaaacuuccgcccggc

SEQ ID NO: 2865538 - RNA, 21 nt, Mycobacterium avium subsp. paratuberculosis
uugaugaacgcguugaccaga

SEQ ID NO: 2865539 - RNA, 17 nt, Mycobacterium avium subsp. paratuberculosis
uugaugaugccggccgc

SEQ ID NO: 2865540 - RNA, 16 nt, Mycobacterium avium subsp. paratuberculosis
uugaugccgacgucgg

SEQ ID NO: 2865541 - RNA, 14 nt, Mycobacterium avium subsp. paratuberculosis
uugaugguguugcu

SEQ ID NO: 2865542 - RNA, 16 nt, Mycobacterium avium subsp. paratuberculosis
uugaugucgcgcggcu

SEQ ID NO: 2865543 - RNA, 16 nt, Mycobacterium avium subsp. paratuberculosis
uugcacacccggugcg

SEQ ID NO: 2865544 - RNA, 17 nt, Mycobacterium avium subsp. paratuberculosis
uugcacggcagcaacug

SEQ ID NO: 2865545 - RNA, 20 nt, Mycobacterium avium subsp. paratuberculosis
uugcagcccgcguccagcag

SEQ ID NO: 2865546 - RNA, 22 nt, Mycobacterium avium subsp. paratuberculosis
uugcagcccgcguccagcagca

SEQ ID NO: 2865547 - RNA, 12 nt, Mycobacterium avium subsp. paratuberculosis
uugccaacacca

SEQ ID NO: 2865548 - RNA, 18 nt, Mycobacterium avium subsp. paratuberculosis
uugccagaaaucgccggg

SEQ ID NO: 2865549 - RNA, 17 nt, Mycobacterium avium subsp. paratuberculosis
uugcccaucgccacgcc

SEQ ID NO: 2865550 - RNA, 12 nt, Mycobacterium avium subsp. paratuberculosis
uugcccgccgcg

SEQ ID NO: 2865551 - RNA, 13 nt, Mycobacterium avium subsp. paratuberculosis
uugcccgcugcgg

SEQ ID NO: 2865552 - RNA, 16 nt, Mycobacterium avium subsp. paratuberculosis
uugcccggcucggugc

SEQ ID NO: 2865553 - RNA, 17 nt, Mycobacterium avium subsp. paratuberculosis
uugcccggcucggugcg

SEQ ID NO: 2865554 - RNA, 20 nt, Mycobacterium avium subsp. paratuberculosis
uugcccucgucgaccagggc

SEQ ID NO: 2865555 - RNA, 20 nt, Mycobacterium avium subsp. paratuberculosis
uugcccugguacgcgccguc

SEQ ID NO: 2865556 - RNA, 20 nt, Mycobacterium avium subsp. paratuberculosis
uugccgaagaugucggugcc

SEQ ID NO: 2865557 - RNA, 17 nt, Mycobacterium avium subsp. paratuberculosis
uuggccgcgcgcaggcg

SEQ ID NO: 2865558 - RNA, 20 nt, Mycobacterium avium subsp. paratuberculosis
uuggccggcacucgccucgg

SEQ ID NO: 2865559 - RNA, 11 nt, Mycobacterium avium subsp. paratuberculosis
uuggccggccg

SEQ ID NO: 2865560 - RNA, 19 nt, Mycobacterium avium subsp. paratuberculosis
uuggccggcuucucggcgu

SEQ ID NO: 2865561 - RNA, 22 nt, Mycobacterium avium subsp. paratuberculosis
uuggccggcuucucggcgugcc

SEQ ID NO: 2865562 - RNA, 18 nt, Mycobacterium avium subsp. paratuberculosis
uuggccguauacgccaga

SEQ ID NO: 2865563 - RNA, 16 nt, Mycobacterium avium subsp. paratuberculosis
uuggccgucaucuccg

SEQ ID NO: 2865564 - RNA, 19 nt, Mycobacterium avium subsp. paratuberculosis
uuggccucgguggcggugg

SEQ ID NO: 2865565 - RNA, 21 nt, Mycobacterium avium subsp. paratuberculosis
uuggccugguagcugagcagc

SEQ ID NO: 2865566 - RNA, 22 nt, Mycobacterium avium subsp. paratuberculosis
uuggccugguagcugagcagca

SEQ ID NO: 2865567 - RNA, 15 nt, Mycobacterium avium subsp. paratuberculosis
uuggcgacggcgcug

SEQ ID NO: 2865568 - RNA, 14 nt, Mycobacterium avium subsp. paratuberculosis
uuggcgacguccgg

SEQ ID NO: 2865569 - RNA, 22 nt, Mycobacterium avium subsp. paratuberculosis
uuggcgcccuugccgaugccgg

SEQ ID NO: 2865570 - RNA, 19 nt, Mycobacterium avium subsp. paratuberculosis
uuggcgccggucgacgcgg

SEQ ID NO: 2865571 - RNA, 14 nt, Mycobacterium avium subsp. paratuberculosis
uuggcgccggugaa

SEQ ID NO: 2865572 - RNA, 18 nt, Mycobacterium avium subsp. paratuberculosis
uuggcgccguccgcggcg

SEQ ID NO: 2865573 - RNA, 19 nt, Mycobacterium avium subsp. paratuberculosis
uuggcgccguccgcggcgg

SEQ ID NO: 2865574 - RNA, 13 nt, Mycobacterium avium subsp. paratuberculosis
uuggcgcucaacg

SEQ ID NO: 2865575 - RNA, 22 nt, Mycobacterium avium subsp. paratuberculosis
uuggcggccaacgccucgucga

SEQ ID NO: 2865576 - RNA, 14 nt, Mycobacterium avium subsp. paratuberculosis
uuggcggccagcgc

SEQ ID NO: 2865577 - RNA, 22 nt, Mycobacterium avium subsp. paratuberculosis
uuggcggccagcgcgccgccga

SEQ ID NO: 2865578 - RNA, 17 nt, Mycobacterium avium subsp. paratuberculosis
uuggcggcgcacuccau

SEQ ID NO: 2865579 - RNA, 13 nt, Mycobacterium avium subsp. paratuberculosis
uuggcggcggcca

SEQ ID NO: 2865580 - RNA, 13 nt, Mycobacterium avium subsp. paratuberculosis
uuggcggcggccu

SEQ ID NO: 2865581 - RNA, 13 nt, Mycobacterium avium subsp. paratuberculosis
uuggcggcgguga

SEQ ID NO: 2865582 - RNA, 19 nt, Mycobacterium avium subsp. paratuberculosis
uuggcggcggugaucucgu

SEQ ID NO: 2865583 - RNA, 22 nt, Mycobacterium avium subsp. paratuberculosis
uuggcggcggugaucucgucgg

SEQ ID NO: 2865584 - RNA, 12 nt, Mycobacterium avium subsp. paratuberculosis
uuggcggcgugg

SEQ ID NO: 2865585 - RNA, 17 nt, Mycobacterium avium subsp. paratuberculosis
uuggcgggcgccuucuu

SEQ ID NO: 2865586 - RNA, 20 nt, Mycobacterium avium subsp. paratuberculosis
uuggcguagugggucggcgg

SEQ ID NO: 2865587 - RNA, 18 nt, Mycobacterium avium subsp. paratuberculosis
uuggcguaguggugcagg

SEQ ID NO: 2865588 - RNA, 12 nt, Mycobacterium avium subsp. paratuberculosis
uuggcguccaug

SEQ ID NO: 2865589 - RNA, 14 nt, Mycobacterium avium subsp. paratuberculosis
uuggcgucgaugcg

SEQ ID NO: 2865590 - RNA, 13 nt, Mycobacterium avium subsp. paratuberculosis
uuggcgucgucgg

SEQ ID NO: 2865591 - RNA, 16 nt, Mycobacterium avium subsp. paratuberculosis
uugggcagcagcucga

SEQ ID NO: 2865592 - RNA, 16 nt, Mycobacterium avium subsp. paratuberculosis
uugggcagcucggcgg

SEQ ID NO: 2865593 - RNA, 12 nt, Mycobacterium avium subsp. paratuberculosis
uugggccagcgg

SEQ ID NO: 2865594 - RNA, 14 nt, Mycobacterium avium subsp. paratuberculosis
uugggccaggccuc

SEQ ID NO: 2865595 - RNA, 15 nt, Mycobacterium avium subsp. paratuberculosis
uugggccgccggccg

SEQ ID NO: 2865596 - RNA, 22 nt, Mycobacterium avium subsp. paratuberculosis
uugggccgccggccgcucgcgg

SEQ ID NO: 2865597 - RNA, 15 nt, Mycobacterium avium subsp. paratuberculosis
uugggccggcgcccg

SEQ ID NO: 2865598 - RNA, 22 nt, Mycobacterium avium subsp. paratuberculosis
uugggccggugcagcacgugcg

SEQ ID NO: 2865599 - RNA, 15 nt, Mycobacterium avium subsp. paratuberculosis
uugggcgccagcagc

SEQ ID NO: 2865600 - RNA, 16 nt, Mycobacterium avium subsp. paratuberculosis
uugggcgccugcggug

SEQ ID NO: 2865601 - RNA, 23 nt, Mycobacterium avium subsp. paratuberculosis
uugggcggcggccaccucgccgc

SEQ ID NO: 2865602 - RNA, 18 nt, Mycobacterium avium subsp. paratuberculosis
uugggcgggaucgcggcg

SEQ ID NO: 2865603 - RNA, 19 nt, Mycobacterium avium subsp. paratuberculosis
uugggcgggaucgcggcgg

SEQ ID NO: 2865604 - RNA, 23 nt, Mycobacterium avium subsp. paratuberculosis
uugggcgugcggccgcagcgccc

SEQ ID NO: 2865605 - RNA, 16 nt, Mycobacterium avium subsp. paratuberculosis
uugggcuccucgacca

SEQ ID NO: 2865606 - RNA, 13 nt, Mycobacterium avium subsp. paratuberculosis
uugggcucggcgc

SEQ ID NO: 2865607 - RNA, 20 nt, Mycobacterium avium subsp. paratuberculosis
uugggcucggcgcgggagga

SEQ ID NO: 2865608 - RNA, 15 nt, Mycobacterium avium subsp. paratuberculosis
uuggucaccaccaac

SEQ ID NO: 2865609 - RNA, 14 nt, Mycobacterium avium subsp. paratuberculosis
uuggucaccagguc

SEQ ID NO: 2865610 - RNA, 20 nt, Mycobacterium avium subsp. paratuberculosis
uuggucaccaggucgcggua

SEQ ID NO: 2865611 - RNA, 21 nt, Mycobacterium avium subsp. paratuberculosis
uuggucagcccgcgcaccgcg

SEQ ID NO: 2865612 - RNA, 19 nt, Mycobacterium avium subsp. paratuberculosis
uugguccgcaacgcggcgg

SEQ ID NO: 2865613 - RNA, 10 nt, Mycobacterium avium subsp. paratuberculosis
uuggucucga

SEQ ID NO: 2865614 - RNA, 12 nt, Mycobacterium avium subsp. paratuberculosis
uuggucucgaug

SEQ ID NO: 2865615 - RNA, 21 nt, Mycobacterium avium subsp. paratuberculosis
uuggugaacagguaggcggcg

SEQ ID NO: 2865616 - RNA, 15 nt, Mycobacterium avium subsp. paratuberculosis
uuggugccggccucg

SEQ ID NO: 2865617 - RNA, 17 nt, Mycobacterium avium subsp. paratuberculosis
uuggugcgcaccagcag

SEQ ID NO: 2865618 - RNA, 12 nt, Mycobacterium avium subsp. paratuberculosis
uugguggcgccg

SEQ ID NO: 2865619 - RNA, 21 nt, Mycobacterium avium subsp. paratuberculosis
uuggugggcgccggcgucauc

SEQ ID NO: 2865620 - RNA, 17 nt, Mycobacterium avium subsp. paratuberculosis
uuggugguggucgucga

SEQ ID NO: 2865621 - RNA, 19 nt, Mycobacterium avium subsp. paratuberculosis
uugguguccagcggcucgg

SEQ ID NO: 2865622 - RNA, 20 nt, Mycobacterium avium subsp. paratuberculosis
uuguagcugauggcacccuc

SEQ ID NO: 2865623 - RNA, 23 nt, Mycobacterium avium subsp. paratuberculosis
uuguaggagaacgucaggcccag

SEQ ID NO: 2865624 - RNA, 22 nt, Mycobacterium avium subsp. paratuberculosis
uugucagccacucgccgugaga

SEQ ID NO: 2865625 - RNA, 15 nt, Mycobacterium avium subsp. paratuberculosis
uugucagcggccucg

SEQ ID NO: 2865626 - RNA, 13 nt, Mycobacterium avium subsp. paratuberculosis
uuguccagcgucu

SEQ ID NO: 2865627 - RNA, 14 nt, Mycobacterium avium subsp. paratuberculosis
uuguccgaccagga

SEQ ID NO: 2865628 - RNA, 14 nt, Mycobacterium avium subsp. paratuberculosis
uuguccucgagccg

SEQ ID NO: 2865629 - RNA, 16 nt, Mycobacterium avium subsp. paratuberculosis
uuguccugcucggcga

SEQ ID NO: 2865630 - RNA, 15 nt, Mycobacterium avium subsp. paratuberculosis
uugucgaaguaguag

SEQ ID NO: 2865631 - RNA, 14 nt, Mycobacterium avium subsp. paratuberculosis
uugucgaccaccag

SEQ ID NO: 2865632 - RNA, 17 nt, Mycobacterium avium subsp. paratuberculosis
uugucgaggucggugag

SEQ ID NO: 2865633 - RNA, 13 nt, Mycobacterium avium subsp. paratuberculosis
uugucgccgugcg

SEQ ID NO: 2865634 - RNA, 20 nt, Mycobacterium avium subsp. paratuberculosis
uugucgccgugcggcguucg

SEQ ID NO: 2865635 - RNA, 19 nt, Mycobacterium avium subsp. paratuberculosis
uugucgcggcccagcacca

SEQ ID NO: 2865636 - RNA, 20 nt, Mycobacterium avium subsp. paratuberculosis
uugucgcggcccagcaccac

SEQ ID NO: 2865637 - RNA, 16 nt, Mycobacterium avium subsp. paratuberculosis
uugucgcuggcguacg

SEQ ID NO: 2865638 - RNA, 13 nt, Mycobacterium avium subsp. paratuberculosis
uugucggcguggc

SEQ ID NO: 2865639 - RNA, 15 nt, Mycobacterium avium subsp. paratuberculosis
uugucggcucgccga

SEQ ID NO: 2865640 - RNA, 23 nt, Mycobacterium avium subsp. paratuberculosis
uugucgggccgcgggcccaccgc

SEQ ID NO: 2865641 - RNA, 15 nt, Mycobacterium avium subsp. paratuberculosis
uugucgucgggcacc

SEQ ID NO: 2865642 - RNA, 17 nt, Mycobacterium avium subsp. paratuberculosis
aaaaccagcgacgccag

SEQ ID NO: 2865643 - RNA, 20 nt, Mycobacterium avium subsp. paratuberculosis
aaaaccccaccccgagcagg

SEQ ID NO: 2865644 - RNA, 13 nt, Mycobacterium avium subsp. paratuberculosis
aaaaccuguccgg

SEQ ID NO: 2865645 - RNA, 21 nt, Mycobacterium avium subsp. paratuberculosis
aaaagauguaucaggaucugc

SEQ ID NO: 2865646 - RNA, 13 nt, Mycobacterium avium subsp. paratuberculosis
aaaagugggucag

SEQ ID NO: 2865647 - RNA, 23 nt, Mycobacterium avium subsp. paratuberculosis
aaaaugcccagugucgcaaagac

SEQ ID NO: 2865648 - RNA, 13 nt, Mycobacterium avium subsp. paratuberculosis
aaacacagcagca

SEQ ID NO: 2865649 - RNA, 14 nt, Mycobacterium avium subsp. paratuberculosis
aaacacagcagcac

SEQ ID NO: 2865650 - RNA, 15 nt, Mycobacterium avium subsp. paratuberculosis
aaacagugcucaugu

SEQ ID NO: 2865651 - RNA, 22 nt, Mycobacterium avium subsp. paratuberculosis
aaaccagcagcgccacaaugga

SEQ ID NO: 2865652 - RNA, 22 nt, Mycobacterium avium subsp. paratuberculosis
aaacccagcaccaacagcggcc

SEQ ID NO: 2865653 - RNA, 19 nt, Mycobacterium avium subsp. paratuberculosis
aaaccgcugcggcacacca

SEQ ID NO: 2865654 - RNA, 16 nt, Mycobacterium avium subsp. paratuberculosis
aaaccggaccgccgcg

SEQ ID NO: 2865655 - RNA, 16 nt, Mycobacterium avium subsp. paratuberculosis
aaaccggccagcagca

SEQ ID NO: 2865656 - RNA, 15 nt, Mycobacterium avium subsp. paratuberculosis
aaaccggccggcgcg

SEQ ID NO: 2865657 - RNA, 13 nt, Mycobacterium avium subsp. paratuberculosis
aaaccggcgccga

SEQ ID NO: 2865658 - RNA, 14 nt, Mycobacterium avium subsp. paratuberculosis
aaaccgucggcccg

SEQ ID NO: 2865659 - RNA, 17 nt, Mycobacterium avium subsp. paratuberculosis
aaaccgucuccggcgcg

SEQ ID NO: 2865660 - RNA, 17 nt, Mycobacterium avium subsp. paratuberculosis
aaaccguuuucggcgcg

SEQ ID NO: 2865661 - RNA, 17 nt, Mycobacterium avium subsp. paratuberculosis
aaaccuugaucggcccc

SEQ ID NO: 2865662 - RNA, 12 nt, Mycobacterium avium subsp. paratuberculosis
aaacgcagcguc

SEQ ID NO: 2865663 - RNA, 14 nt, Mycobacterium avium subsp. paratuberculosis
aaacgcccggcuca

SEQ ID NO: 2865664 - RNA, 14 nt, Mycobacterium avium subsp. paratuberculosis
aaacgcgcgaucgg

SEQ ID NO: 2865665 - RNA, 16 nt, Mycobacterium avium subsp. paratuberculosis
aaacgcugggcgccgg

SEQ ID NO: 2865666 - RNA, 14 nt, Mycobacterium avium subsp. paratuberculosis
aaacuaacuucacg

SEQ ID NO: 2865667 - RNA, 17 nt, Mycobacterium avium subsp. paratuberculosis
aaacuccgggggauugc

SEQ ID NO: 2865668 - RNA, 20 nt, Mycobacterium avium subsp. paratuberculosis
aaacuuguggaaggcgccgg

SEQ ID NO: 2865669 - RNA, 18 nt, Mycobacterium avium subsp. paratuberculosis
aaagaucaaggaaccggc

SEQ ID NO: 2865670 - RNA, 16 nt, Mycobacterium avium subsp. paratuberculosis
aaagauguaucaggau

SEQ ID NO: 2865671 - RNA, 21 nt, Mycobacterium avium subsp. paratuberculosis
aaagauguaucaggaucugcg

SEQ ID NO: 2865672 - RNA, 20 nt, Mycobacterium avium subsp. paratuberculosis
aaagcagcguucggucagca

SEQ ID NO: 2865673 - RNA, 10 nt, Mycobacterium avium subsp. paratuberculosis
aaagccgacu

SEQ ID NO: 2865674 - RNA, 21 nt, Mycobacterium avium subsp. paratuberculosis
aaagccggucacgcugaucga

SEQ ID NO: 2865675 - RNA, 17 nt, Mycobacterium avium subsp. paratuberculosis
aaagccgguggcagccc

SEQ ID NO: 2865676 - RNA, 18 nt, Mycobacterium avium subsp. paratuberculosis
aaagccgguggcagcccg

SEQ ID NO: 2865677 - RNA, 20 nt, Mycobacterium avium subsp. paratuberculosis
aaagccguaccgcaacaccg

SEQ ID NO: 2865678 - RNA, 22 nt, Mycobacterium avium subsp. paratuberculosis
aaagccguaccgcaacaccgaa

SEQ ID NO: 2865679 - RNA, 17 nt, Mycobacterium avium subsp. paratuberculosis
aaagccuccaacccaac

SEQ ID NO: 2865680 - RNA, 15 nt, Mycobacterium avium subsp. paratuberculosis
aaagcgaccagcgcg

SEQ ID NO: 2865681 - RNA, 17 nt, Mycobacterium avium subsp. paratuberculosis
aaagcgcgggcagccca

SEQ ID NO: 2865682 - RNA, 20 nt, Mycobacterium avium subsp. paratuberculosis
aaagcggcuaagccggcguc

SEQ ID NO: 2865683 - RNA, 16 nt, Mycobacterium avium subsp. paratuberculosis
aaagcguugccgcgcg

SEQ ID NO: 2865684 - RNA, 14 nt, Mycobacterium avium subsp. paratuberculosis
aaagcguugcgaaa

SEQ ID NO: 2865685 - RNA, 19 nt, Mycobacterium avium subsp. paratuberculosis
aaagcguugcgccagcagg

SEQ ID NO: 2865686 - RNA, 17 nt, Mycobacterium avium subsp. paratuberculosis
aaagcuguugaccacca

SEQ ID NO: 2865687 - RNA, 19 nt, Mycobacterium avium subsp. paratuberculosis
aaagcuucuugcugccguc

SEQ ID NO: 2865688 - RNA, 14 nt, Mycobacterium avium subsp. paratuberculosis
aaaggaugucgccg

SEQ ID NO: 2865689 - RNA, 11 nt, Mycobacterium avium subsp. paratuberculosis
aaaggccgccg

SEQ ID NO: 2865690 - RNA, 21 nt, Mycobacterium avium subsp. paratuberculosis
aaaggcguuguugaggaacgc

SEQ ID NO: 2865691 - RNA, 15 nt, Mycobacterium avium subsp. paratuberculosis
aaagugcaacuggca

SEQ ID NO: 2865692 - RNA, 19 nt, Mycobacterium avium subsp. paratuberculosis
aaaguuggcaucccgcgcc

SEQ ID NO: 2865693 - RNA, 23 nt, Mycobacterium avium subsp. paratuberculosis
aaaucagccgagccgggucaucc

SEQ ID NO: 2865694 - RNA, 13 nt, Mycobacterium avium subsp. paratuberculosis
aaaucccgcagcu

SEQ ID NO: 2865695 - RNA, 13 nt, Mycobacterium avium subsp. paratuberculosis
aaauccgggcgcg

SEQ ID NO: 2865696 - RNA, 22 nt, Mycobacterium avium subsp. paratuberculosis
aaaucggacccagcccggcgac

SEQ ID NO: 2865697 - RNA, 23 nt, Mycobacterium avium subsp. paratuberculosis
aaaucggacccagcccggcgacg

SEQ ID NO: 2865698 - RNA, 22 nt, Mycobacterium avium subsp. paratuberculosis
aaaucguauugguagaacucgg

SEQ ID NO: 2865699 - RNA, 13 nt, Mycobacterium avium subsp. paratuberculosis
aaaugaccgcgcc

SEQ ID NO: 2865700 - RNA, 20 nt, Mycobacterium avium subsp. paratuberculosis
aaaugcccgcgccccggccu

SEQ ID NO: 2865701 - RNA, 22 nt, Mycobacterium avium subsp. paratuberculosis
aaaugcccgcgccccggccuga

SEQ ID NO: 2865702 - RNA, 17 nt, Mycobacterium avium subsp. paratuberculosis
aaaugccgugccagccg

SEQ ID NO: 2865703 - RNA, 20 nt, Mycobacterium avium subsp. paratuberculosis
aaaugcggaauagcgcucca

SEQ ID NO: 2865704 - RNA, 13 nt, Mycobacterium avium subsp. paratuberculosis
aacaacagggccg

SEQ ID NO: 2865705 - RNA, 12 nt, Mycobacterium avium subsp. paratuberculosis
aacaacgccaca

SEQ ID NO: 2865706 - RNA, 16 nt, Mycobacterium avium subsp. paratuberculosis
aacaacuacgagcagc

SEQ ID NO: 2865707 - RNA, 20 nt, Mycobacterium avium subsp. paratuberculosis
aacaacucgacguucggcgg

SEQ ID NO: 2865708 - RNA, 14 nt, Mycobacterium avium subsp. paratuberculosis
aacaacucgccgga

SEQ ID NO: 2865709 - RNA, 14 nt, Mycobacterium avium subsp. paratuberculosis
aacaacuucgagca

SEQ ID NO: 2865710 - RNA, 22 nt, Mycobacterium avium subsp. paratuberculosis
aacaagguguggaucaccauca

SEQ ID NO: 2865711 - RNA, 23 nt, Mycobacterium avium subsp. paratuberculosis
aacaagguguggaucaccaucac

SEQ ID NO: 2865712 - RNA, 18 nt, Mycobacterium avium subsp. paratuberculosis
aacacagccaaucgccga

SEQ ID NO: 2865713 - RNA, 21 nt, Mycobacterium avium subsp. paratuberculosis
aacacaucguggcgcaucacc

SEQ ID NO: 2865714 - RNA, 18 nt, Mycobacterium avium subsp. paratuberculosis
aacaccaacgacagcgac

SEQ ID NO: 2865715 - RNA, 15 nt, Mycobacterium avium subsp. paratuberculosis
aacaccaccaggccg

SEQ ID NO: 2865716 - RNA, 17 nt, Mycobacterium avium subsp. paratuberculosis
aacaccaccgccaggua

SEQ ID NO: 2865717 - RNA, 16 nt, Mycobacterium avium subsp. paratuberculosis
aacaccacgccgagca

SEQ ID NO: 2865718 - RNA, 22 nt, Mycobacterium avium subsp. paratuberculosis
aacaccacgguguagcggcggc

SEQ ID NO: 2865719 - RNA, 14 nt, Mycobacterium avium subsp. paratuberculosis
aacaccagcccggc

SEQ ID NO: 2865720 - RNA, 13 nt, Mycobacterium avium subsp. paratuberculosis
aacaccaucgcuu

SEQ ID NO: 2865721 - RNA, 17 nt, Mycobacterium avium subsp. paratuberculosis
aacacccccgcgcugcc

SEQ ID NO: 2865722 - RNA, 14 nt, Mycobacterium avium subsp. paratuberculosis
aacacccugcgcca

SEQ ID NO: 2865723 - RNA, 16 nt, Mycobacterium avium subsp. paratuberculosis
aacacccugcgccaca

SEQ ID NO: 2865724 - RNA, 16 nt, Mycobacterium avium subsp. paratuberculosis
aacaccgaaagccgac

SEQ ID NO: 2865725 - RNA, 17 nt, Mycobacterium avium subsp. paratuberculosis
aacaccgaaagccguac

SEQ ID NO: 2865726 - RNA, 21 nt, Mycobacterium avium subsp. paratuberculosis
aacaccgagccggcggcguug

SEQ ID NO: 2865727 - RNA, 13 nt, Mycobacterium avium subsp. paratuberculosis
aacaccgcaccgg

SEQ ID NO: 2865728 - RNA, 14 nt, Mycobacterium avium subsp. paratuberculosis
aacaccgccagcac

SEQ ID NO: 2865729 - RNA, 22 nt, Mycobacterium avium subsp. paratuberculosis
aacaccgccuugcccggcucgg

SEQ ID NO: 2865730 - RNA, 19 nt, Mycobacterium avium subsp. paratuberculosis
aacaccggcagcgccacca

SEQ ID NO: 2865731 - RNA, 12 nt, Mycobacterium avium subsp. paratuberculosis
aacaccggcgag

SEQ ID NO: 2865732 - RNA, 23 nt, Mycobacterium avium subsp. paratuberculosis
aacaccggcgaggugaaccgcga

SEQ ID NO: 2865733 - RNA, 15 nt, Mycobacterium avium subsp. paratuberculosis
aacaccggcggcgac

SEQ ID NO: 2865734 - RNA, 17 nt, Mycobacterium avium subsp. paratuberculosis
aacaccgguccggccgu

SEQ ID NO: 2865735 - RNA, 20 nt, Mycobacterium avium subsp. paratuberculosis
aacaccgugguggacaacuc

SEQ ID NO: 2865736 - RNA, 15 nt, Mycobacterium avium subsp. paratuberculosis
aacaccucgccucca

SEQ ID NO: 2865737 - RNA, 18 nt, Mycobacterium avium subsp. paratuberculosis
aacaccucgccuccagca

SEQ ID NO: 2865738 - RNA, 15 nt, Mycobacterium avium subsp. paratuberculosis
aacaccucggcgaug

SEQ ID NO: 2865739 - RNA, 15 nt, Mycobacterium avium subsp. paratuberculosis
aacaccucgggaucc

SEQ ID NO: 2865740 - RNA, 15 nt, Mycobacterium avium subsp. paratuberculosis
aacaccugcggcggc

SEQ ID NO: 2865741 - RNA, 15 nt, Mycobacterium avium subsp. paratuberculosis
aacaccuuucggccg

SEQ ID NO: 2865742 - RNA, 16 nt, Mycobacterium avium subsp. paratuberculosis
aacaccuuucggccgc

SEQ ID NO: 2865743 - RNA, 17 nt, Mycobacterium avium subsp. paratuberculosis
aacaccuuucggccgcg

SEQ ID NO: 2865744 - RNA, 19 nt, Mycobacterium avium subsp. paratuberculosis
aacaccuuucggccgcgga

SEQ ID NO: 2865745 - RNA, 13 nt, Mycobacterium avium subsp. paratuberculosis
aacacgaacccgg

SEQ ID NO: 2865746 - RNA, 23 nt, Mycobacterium avium subsp. paratuberculosis
aacacgagcagacccgccgcggc

SEQ ID NO: 2865747 - RNA, 22 nt, Mycobacterium avium subsp. paratuberculosis
aacacgaucucggucgccagca

SEQ ID NO: 2865748 - RNA, 17 nt, Mycobacterium avium subsp. paratuberculosis
aacacgcccugcagguu

SEQ ID NO: 2865749 - RNA, 12 nt, Mycobacterium avium subsp. paratuberculosis
aacacgccggcg

SEQ ID NO: 2865750 - RNA, 17 nt, Mycobacterium avium subsp. paratuberculosis
aacacggucgccggcuu

SEQ ID NO: 2865751 - RNA, 16 nt, Mycobacterium avium subsp. paratuberculosis
aacacguacagcggcg

SEQ ID NO: 2865752 - RNA, 18 nt, Mycobacterium avium subsp. paratuberculosis
aacacguacagcggcggc

SEQ ID NO: 2865753 - RNA, 14 nt, Mycobacterium avium subsp. paratuberculosis
aacacguccuggcg

SEQ ID NO: 2865754 - RNA, 23 nt, Mycobacterium avium subsp. paratuberculosis
aacacguccuggcgccaguagug

SEQ ID NO: 2865755 - RNA, 20 nt, Mycobacterium avium subsp. paratuberculosis
aacacgugggcaaucugccc

SEQ ID NO: 2865756 - RNA, 23 nt, Mycobacterium avium subsp. paratuberculosis
aacacguugagucccucggcgag

SEQ ID NO: 2865757 - RNA, 15 nt, Mycobacterium avium subsp. paratuberculosis
aacagacucagcccg

SEQ ID NO: 2865758 - RNA, 16 nt, Mycobacterium avium subsp. paratuberculosis
aacagacucagcccgg

SEQ ID NO: 2865759 - RNA, 21 nt, Mycobacterium avium subsp. paratuberculosis
aacagagcgggaucccgcagc

SEQ ID NO: 2865760 - RNA, 17 nt, Mycobacterium avium subsp. paratuberculosis
aacagcaccagcaccac

SEQ ID NO: 2865761 - RNA, 19 nt, Mycobacterium avium subsp. paratuberculosis
aacagcaccagcaccaccg

SEQ ID NO: 2865762 - RNA, 16 nt, Mycobacterium avium subsp. paratuberculosis
aacagcaccucgucgc

SEQ ID NO: 2865763 - RNA, 20 nt, Mycobacterium avium subsp. paratuberculosis
aacagcaccucgucgcccgg

SEQ ID NO: 2865764 - RNA, 21 nt, Mycobacterium avium subsp. paratuberculosis
aacagcaccucgucgcccggc

SEQ ID NO: 2865765 - RNA, 18 nt, Mycobacterium avium subsp. paratuberculosis
aacagcacgaacagcagc

SEQ ID NO: 2865766 - RNA, 19 nt, Mycobacterium avium subsp. paratuberculosis
aacagcacgaacagcagcg

SEQ ID NO: 2865767 - RNA, 13 nt, Mycobacterium avium subsp. paratuberculosis
aacagcacgccgg

SEQ ID NO: 2865768 - RNA, 10 nt, Mycobacterium avium subsp. paratuberculosis
aacagcagca

SEQ ID NO: 2865769 - RNA, 14 nt, Mycobacterium avium subsp. paratuberculosis
aacagcagcacccg

SEQ ID NO: 2865770 - RNA, 16 nt, Mycobacterium avium subsp. paratuberculosis
aacagcagcagcagcg

SEQ ID NO: 2865771 - RNA, 14 nt, Mycobacterium avium subsp. paratuberculosis
aacagcagccacga

SEQ ID NO: 2865772 - RNA, 17 nt, Mycobacterium avium subsp. paratuberculosis
aacagcagcgaacccgc

SEQ ID NO: 2865773 - RNA, 19 nt, Mycobacterium avium subsp. paratuberculosis
aacagcagcgaacccgcca

SEQ ID NO: 2865774 - RNA, 20 nt, Mycobacterium avium subsp. paratuberculosis
aacagcagcgccgcggccgg

SEQ ID NO: 2865775 - RNA, 12 nt, Mycobacterium avium subsp. paratuberculosis
aacagcagcgcg

SEQ ID NO: 2865776 - RNA, 14 nt, Mycobacterium avium subsp. paratuberculosis
aacagcagcgcgcc

SEQ ID NO: 2865777 - RNA, 17 nt, Mycobacterium avium subsp. paratuberculosis
aacagcagcgcgccgac

SEQ ID NO: 2865778 - RNA, 19 nt, Mycobacterium avium subsp. paratuberculosis
aacagcagcgcgccgacca

SEQ ID NO: 2865779 - RNA, 14 nt, Mycobacterium avium subsp. paratuberculosis
aacagcagcggcau

SEQ ID NO: 2865780 - RNA, 18 nt, Mycobacterium avium subsp. paratuberculosis
aacagcauuucgcgcggc

SEQ ID NO: 2865781 - RNA, 19 nt, Mycobacterium avium subsp. paratuberculosis
aacagccggcccgagcccu

SEQ ID NO: 2865782 - RNA, 22 nt, Mycobacterium avium subsp. paratuberculosis
aacagccggcucagggugcgcu

SEQ ID NO: 2865783 - RNA, 22 nt, Mycobacterium avium subsp. paratuberculosis
aacagccgggccagcagcuuga

SEQ ID NO: 2865784 - RNA, 17 nt, Mycobacterium avium subsp. paratuberculosis
aacagccgggccgcccg

SEQ ID NO: 2865785 - RNA, 14 nt, Mycobacterium avium subsp. paratuberculosis
aacagccgggcggc

SEQ ID NO: 2865786 - RNA, 22 nt, Mycobacterium avium subsp. paratuberculosis
aacagcgacgucugcggcucgg

SEQ ID NO: 2865787 - RNA, 19 nt, Mycobacterium avium subsp. paratuberculosis
aacagcgccgagacguggu

SEQ ID NO: 2865788 - RNA, 17 nt, Mycobacterium avium subsp. paratuberculosis
aacagcgcgccggccgg

SEQ ID NO: 2865789 - RNA, 18 nt, Mycobacterium avium subsp. paratuberculosis
aacagcgcgccggccggc

SEQ ID NO: 2865790 - RNA, 13 nt, Mycobacterium avium subsp. paratuberculosis
aacagcgcggcca

SEQ ID NO: 2865791 - RNA, 16 nt, Mycobacterium avium subsp. paratuberculosis
aacagcgcggccacca

SEQ ID NO: 2865792 - RNA, 13 nt, Mycobacterium avium subsp. paratuberculosis
aacagcggggugc

SEQ ID NO: 2865793 - RNA, 17 nt, Mycobacterium avium subsp. paratuberculosis
aacagcggguucuucag

SEQ ID NO: 2865794 - RNA, 17 nt, Mycobacterium avium subsp. paratuberculosis
aacagcgucgccgacgg

SEQ ID NO: 2865795 - RNA, 18 nt, Mycobacterium avium subsp. paratuberculosis
aacagcucgaccagccgg

SEQ ID NO: 2865796 - RNA, 18 nt, Mycobacterium avium subsp. paratuberculosis
aacagcuggucccacagc

SEQ ID NO: 2865797 - RNA, 19 nt, Mycobacterium avium subsp. paratuberculosis
aacaggaugcagccggcca

SEQ ID NO: 2865798 - RNA, 16 nt, Mycobacterium avium subsp. paratuberculosis
aacaggcccagcagcg

SEQ ID NO: 2865799 - RNA, 15 nt, Mycobacterium avium subsp. paratuberculosis
aacagggccaccgcg

SEQ ID NO: 2865800 - RNA, 23 nt, Mycobacterium avium subsp. paratuberculosis
aacagguaggcggcgccgucgac

SEQ ID NO: 2865801 - RNA, 21 nt, Mycobacterium avium subsp. paratuberculosis
aacaggugcuuggucagcgcg

SEQ ID NO: 2865802 - RNA, 23 nt, Mycobacterium avium subsp. paratuberculosis
aacagucggccggcguuguccag

SEQ ID NO: 2865803 - RNA, 10 nt, Mycobacterium avium subsp. paratuberculosis
aacagugcac

SEQ ID NO: 2865804 - RNA, 17 nt, Mycobacterium avium subsp. paratuberculosis
aacagugcgcaggcggc

SEQ ID NO: 2865805 - RNA, 20 nt, Mycobacterium avium subsp. paratuberculosis
aacaguuccucggcgaugcc

SEQ ID NO: 2865806 - RNA, 13 nt, Mycobacterium avium subsp. paratuberculosis
aacaguucgacgu

SEQ ID NO: 2865807 - RNA, 21 nt, Mycobacterium avium subsp. paratuberculosis
aacaguucggugcacggcgcc

SEQ ID NO: 2865808 - RNA, 16 nt, Mycobacterium avium subsp. paratuberculosis
aacaucacccggcggc

SEQ ID NO: 2865809 - RNA, 22 nt, Mycobacterium avium subsp. paratuberculosis
aacaucacccggcggcaccgcg

SEQ ID NO: 2865810 - RNA, 16 nt, Mycobacterium avium subsp. paratuberculosis
aacaucccggagccgu

SEQ ID NO: 2865811 - RNA, 16 nt, Mycobacterium avium subsp. paratuberculosis
aacauccgcgacgaca

SEQ ID NO: 2865812 - RNA, 18 nt, Mycobacterium avium subsp. paratuberculosis
aacauccugguccggcgc

SEQ ID NO: 2865813 - RNA, 15 nt, Mycobacterium avium subsp. paratuberculosis
aacaucgagcccacc

SEQ ID NO: 2865814 - RNA, 14 nt, Mycobacterium avium subsp. paratuberculosis
aacaucgccucggc

SEQ ID NO: 2865815 - RNA, 16 nt, Mycobacterium avium subsp. paratuberculosis
aacaucgccucggccg

SEQ ID NO: 2865816 - RNA, 18 nt, Mycobacterium avium subsp. paratuberculosis
aacaugcugcacggggug

SEQ ID NO: 2865817 - RNA, 13 nt, Mycobacterium avium subsp. paratuberculosis
aacauggcggcca

SEQ ID NO: 2865818 - RNA, 11 nt, Mycobacterium avium subsp. paratuberculosis
aaccaacgcgg

SEQ ID NO: 2865819 - RNA, 13 nt, Mycobacterium avium subsp. paratuberculosis
aaccaagaccgcg

SEQ ID NO: 2865820 - RNA, 14 nt, Mycobacterium avium subsp. paratuberculosis
aaccacaccagcau

SEQ ID NO: 2865821 - RNA, 14 nt, Mycobacterium avium subsp. paratuberculosis
aaccacaccccggc

SEQ ID NO: 2865822 - RNA, 15 nt, Mycobacterium avium subsp. paratuberculosis
aaccacaccccggcc

SEQ ID NO: 2865823 - RNA, 15 nt, Mycobacterium avium subsp. paratuberculosis
aaccaccguggcccc

SEQ ID NO: 2865824 - RNA, 15 nt, Mycobacterium avium subsp. paratuberculosis
aaccaccugaccgcg

SEQ ID NO: 2865825 - RNA, 16 nt, Mycobacterium avium subsp. paratuberculosis
aaccacugauccguca

SEQ ID NO: 2865826 - RNA, 16 nt, Mycobacterium avium subsp. paratuberculosis
aaccagaucggcgggu

SEQ ID NO: 2865827 - RNA, 17 nt, Mycobacterium avium subsp. paratuberculosis
aaccagcaccggcaccg

SEQ ID NO: 2865828 - RNA, 19 nt, Mycobacterium avium subsp. paratuberculosis
aaccagcaccggcaccgcc

SEQ ID NO: 2865829 - RNA, 14 nt, Mycobacterium avium subsp. paratuberculosis
aaccagcagcgcca

SEQ ID NO: 2865830 - RNA, 16 nt, Mycobacterium avium subsp. paratuberculosis
aaccagcagcgccaca

SEQ ID NO: 2865831 - RNA, 17 nt, Mycobacterium avium subsp. paratuberculosis
aaccagcaugcgccaga

SEQ ID NO: 2865832 - RNA, 15 nt, Mycobacterium avium subsp. paratuberculosis
aaccagcccggcccg

SEQ ID NO: 2865833 - RNA, 14 nt, Mycobacterium avium subsp. paratuberculosis
aaccagcgacgcca

SEQ ID NO: 2865834 - RNA, 13 nt, Mycobacterium avium subsp. paratuberculosis
aaccagcgcccgc

SEQ ID NO: 2865835 - RNA, 14 nt, Mycobacterium avium subsp. paratuberculosis
aaccagcuccggca

SEQ ID NO: 2865836 - RNA, 13 nt, Mycobacterium avium subsp. paratuberculosis
aaccaggccgcgc

SEQ ID NO: 2865837 - RNA, 22 nt, Mycobacterium avium subsp. paratuberculosis
aaccaggccgcgcuggcgcagg

SEQ ID NO: 2865838 - RNA, 15 nt, Mycobacterium avium subsp. paratuberculosis
aaccagggcagccag

SEQ ID NO: 2865839 - RNA, 16 nt, Mycobacterium avium subsp. paratuberculosis
aaccagggcagccagc

SEQ ID NO: 2865840 - RNA, 14 nt, Mycobacterium avium subsp. paratuberculosis
aaccaggucgcggc

SEQ ID NO: 2865841 - RNA, 17 nt, Mycobacterium avium subsp. paratuberculosis
aaccaugccagucaagc

SEQ ID NO: 2865842 - RNA, 14 nt, Mycobacterium avium subsp. paratuberculosis
aaccauugcaccgc

SEQ ID NO: 2865843 - RNA, 15 nt, Mycobacterium avium subsp. paratuberculosis
aaccauugcaccgca

SEQ ID NO: 2865844 - RNA, 15 nt, Mycobacterium avium subsp. paratuberculosis
aacccagcaccaaca

SEQ ID NO: 2865845 - RNA, 15 nt, Mycobacterium avium subsp. paratuberculosis
aacccagcaccacca

SEQ ID NO: 2865846 - RNA, 14 nt, Mycobacterium avium subsp. paratuberculosis
aacccagcaccccg

SEQ ID NO: 2865847 - RNA, 13 nt, Mycobacterium avium subsp. paratuberculosis
aacccagcgccuc

SEQ ID NO: 2865848 - RNA, 14 nt, Mycobacterium avium subsp. paratuberculosis
aaccccacggccgc

SEQ ID NO: 2865849 - RNA, 15 nt, Mycobacterium avium subsp. paratuberculosis
aaccccacggccgca

SEQ ID NO: 2865850 - RNA, 23 nt, Mycobacterium avium subsp. paratuberculosis
aaccccacguaggcgaugucgac

SEQ ID NO: 2865851 - RNA, 16 nt, Mycobacterium avium subsp. paratuberculosis
aaccccgcucccaucc

SEQ ID NO: 2865852 - RNA, 17 nt, Mycobacterium avium subsp. paratuberculosis
aacccgaaaagcaccag

SEQ ID NO: 2865853 - RNA, 14 nt, Mycobacterium avium subsp. paratuberculosis
aacccgaccccggc

SEQ ID NO: 2865854 - RNA, 14 nt, Mycobacterium avium subsp. paratuberculosis
aacccgaccgcgau

SEQ ID NO: 2865855 - RNA, 17 nt, Mycobacterium avium subsp. paratuberculosis
aacccgaccucgucgac

SEQ ID NO: 2865856 - RNA, 22 nt, Mycobacterium avium subsp. paratuberculosis
aacccgagcaccccggcggccg

SEQ ID NO: 2865857 - RNA, 17 nt, Mycobacterium avium subsp. paratuberculosis
aacccgaucggcccggc

SEQ ID NO: 2865858 - RNA, 20 nt, Mycobacterium avium subsp. paratuberculosis
aacccgaucggcccggccaa

SEQ ID NO: 2865859 - RNA, 21 nt, Mycobacterium avium subsp. paratuberculosis
aacccgccagggcgacgccgc

SEQ ID NO: 2865860 - RNA, 13 nt, Mycobacterium avium subsp. paratuberculosis
aacccgccgcggc

SEQ ID NO: 2865861 - RNA, 19 nt, Mycobacterium avium subsp. paratuberculosis
aacccggcgcccggccggu

SEQ ID NO: 2865862 - RNA, 19 nt, Mycobacterium avium subsp. paratuberculosis
aacccggcgugcuccagca

SEQ ID NO: 2865863 - RNA, 21 nt, Mycobacterium avium subsp. paratuberculosis
aacccggcgugcuccagcagg

SEQ ID NO: 2865864 - RNA, 23 nt, Mycobacterium avium subsp. paratuberculosis
aacccggugccggccgggucgac

SEQ ID NO: 2865865 - RNA, 18 nt, Mycobacterium avium subsp. paratuberculosis
aacccucagaccauggcg

SEQ ID NO: 2865866 - RNA, 16 nt, Mycobacterium avium subsp. paratuberculosis
aacccuccggcgccug

SEQ ID NO: 2865867 - RNA, 14 nt, Mycobacterium avium subsp. paratuberculosis
aacccucgacgccg

SEQ ID NO: 2865868 - RNA, 17 nt, Mycobacterium avium subsp. paratuberculosis
aacccucgacgccgggc

SEQ ID NO: 2865869 - RNA, 11 nt, Mycobacterium avium subsp. paratuberculosis
aacccugcccc

SEQ ID NO: 2865870 - RNA, 20 nt, Mycobacterium avium subsp. paratuberculosis
aacccugccccacggcccgg

SEQ ID NO: 2865871 - RNA, 21 nt, Mycobacterium avium subsp. paratuberculosis
aaccgaagggaaaggcagcag

SEQ ID NO: 2865872 - RNA, 23 nt, Mycobacterium avium subsp. paratuberculosis
aaccgaagggaaaggcagcagcc

SEQ ID NO: 2865873 - RNA, 18 nt, Mycobacterium avium subsp. paratuberculosis
aaccgaaucgagccgagg

SEQ ID NO: 2865874 - RNA, 18 nt, Mycobacterium avium subsp. paratuberculosis
aaccgaaucggucgacca

SEQ ID NO: 2865875 - RNA, 18 nt, Mycobacterium avium subsp. paratuberculosis
aaccgacauaggucaggu

SEQ ID NO: 2865876 - RNA, 17 nt, Mycobacterium avium subsp. paratuberculosis
aaccgaccgccgcggcc

SEQ ID NO: 2865877 - RNA, 22 nt, Mycobacterium avium subsp. paratuberculosis
aaccgccagcagcgcaagcuga

SEQ ID NO: 2865878 - RNA, 15 nt, Mycobacterium avium subsp. paratuberculosis
aaccgcccggcgccg

SEQ ID NO: 2865879 - RNA, 17 nt, Mycobacterium avium subsp. paratuberculosis
aaccgcccuuccagcac

SEQ ID NO: 2865880 - RNA, 14 nt, Mycobacterium avium subsp. paratuberculosis
aaccgccgcaccca

SEQ ID NO: 2865881 - RNA, 21 nt, Mycobacterium avium subsp. paratuberculosis
aaccgccggggaagaucucgg

SEQ ID NO: 2865882 - RNA, 23 nt, Mycobacterium avium subsp. paratuberculosis
aaccgcgcacucgaacggcccgg

SEQ ID NO: 2865883 - RNA, 23 nt, Mycobacterium avium subsp. paratuberculosis
aaccgcgccuucgacccgguggc

SEQ ID NO: 2865884 - RNA, 22 nt, Mycobacterium avium subsp. paratuberculosis
aaccgcgcggcgcccccgcgac

SEQ ID NO: 2865885 - RNA, 21 nt, Mycobacterium avium subsp. paratuberculosis
aaccgcggacuggccaccgcg

SEQ ID NO: 2865886 - RNA, 13 nt, Mycobacterium avium subsp. paratuberculosis
aaccgcggcggca

SEQ ID NO: 2865887 - RNA, 19 nt, Mycobacterium avium subsp. paratuberculosis
aaccgcggcggcggcccgu

SEQ ID NO: 2865888 - RNA, 21 nt, Mycobacterium avium subsp. paratuberculosis
aaccgcggcggcggcccgucc

SEQ ID NO: 2865889 - RNA, 18 nt, Mycobacterium avium subsp. paratuberculosis
aaccgcguggcgcacagc

SEQ ID NO: 2865890 - RNA, 13 nt, Mycobacterium avium subsp. paratuberculosis
aaccgcucggcga

SEQ ID NO: 2865891 - RNA, 18 nt, Mycobacterium avium subsp. paratuberculosis
aaccgcucggcggcgccg

SEQ ID NO: 2865892 - RNA, 18 nt, Mycobacterium avium subsp. paratuberculosis
aaccgcugcggcacacca

SEQ ID NO: 2865893 - RNA, 19 nt, Mycobacterium avium subsp. paratuberculosis
aaccgcugcuccggguccg

SEQ ID NO: 2865894 - RNA, 19 nt, Mycobacterium avium subsp. paratuberculosis
aaccggaauggcagcagcc

SEQ ID NO: 2865895 - RNA, 17 nt, Mycobacterium avium subsp. paratuberculosis
aaccggaccgccgcggc

SEQ ID NO: 2865896 - RNA, 22 nt, Mycobacterium avium subsp. paratuberculosis
aaccggaccgccgcggcgcccg

SEQ ID NO: 2865897 - RNA, 13 nt, Mycobacterium avium subsp. paratuberculosis
aaccggaggccgc

SEQ ID NO: 2865898 - RNA, 16 nt, Mycobacterium avium subsp. paratuberculosis
aaccggaucuggcccu

SEQ ID NO: 2865899 - RNA, 14 nt, Mycobacterium avium subsp. paratuberculosis
aaccggcagccggc

SEQ ID NO: 2865900 - RNA, 15 nt, Mycobacterium avium subsp. paratuberculosis
aaccggccagcagca

SEQ ID NO: 2865901 - RNA, 12 nt, Mycobacterium avium subsp. paratuberculosis
aaccggccggcg

SEQ ID NO: 2865902 - RNA, 12 nt, Mycobacterium avium subsp. paratuberculosis
aaccggccgggg

SEQ ID NO: 2865903 - RNA, 14 nt, Mycobacterium avium subsp. paratuberculosis
aaccggccggggcg

SEQ ID NO: 2865904 - RNA, 17 nt, Mycobacterium avium subsp. paratuberculosis
aaccggcggcugggcag

SEQ ID NO: 2865905 - RNA, 21 nt, Mycobacterium avium subsp. paratuberculosis
aaccgggacagccgcgccgac

SEQ ID NO: 2865906 - RNA, 22 nt, Mycobacterium avium subsp. paratuberculosis
aaccgggacagccgcgccgaca

SEQ ID NO: 2865907 - RNA, 17 nt, Mycobacterium avium subsp. paratuberculosis
aaccgggcacccggcgc

SEQ ID NO: 2865908 - RNA, 18 nt, Mycobacterium avium subsp. paratuberculosis
aaccgggcacccggcgcg

SEQ ID NO: 2865909 - RNA, 19 nt, Mycobacterium avium subsp. paratuberculosis
aaccgggccaacgguucgg

SEQ ID NO: 2865910 - RNA, 16 nt, Mycobacterium avium subsp. paratuberculosis
aaccgggcccguaggu

SEQ ID NO: 2865911 - RNA, 19 nt, Mycobacterium avium subsp. paratuberculosis
aaccgggcccucguccgac

SEQ ID NO: 2865912 - RNA, 22 nt, Mycobacterium avium subsp. paratuberculosis
aaccgggccgcacccccuccac

SEQ ID NO: 2865913 - RNA, 16 nt, Mycobacterium avium subsp. paratuberculosis
aaccgggccugcgcgc

SEQ ID NO: 2865914 - RNA, 19 nt, Mycobacterium avium subsp. paratuberculosis
aaccgggccugcgcgccga

SEQ ID NO: 2865915 - RNA, 20 nt, Mycobacterium avium subsp. paratuberculosis
aaccgggccugcgcgccgau

SEQ ID NO: 2865916 - RNA, 23 nt, Mycobacterium avium subsp. paratuberculosis
aaccgggcgcgcagaucgucgac

SEQ ID NO: 2865917 - RNA, 22 nt, Mycobacterium avium subsp. paratuberculosis
aaccgggucacgaacuccuuga

SEQ ID NO: 2865918 - RNA, 17 nt, Mycobacterium avium subsp. paratuberculosis
aaccgggucagcaccac

SEQ ID NO: 2865919 - RNA, 19 nt, Mycobacterium avium subsp. paratuberculosis
aaccgggucagcaccacca

SEQ ID NO: 2865920 - RNA, 20 nt, Mycobacterium avium subsp. paratuberculosis
aaccgggucucgcgccacca

SEQ ID NO: 2865921 - RNA, 16 nt, Mycobacterium avium subsp. paratuberculosis
aaccgggugacgacca

SEQ ID NO: 2865922 - RNA, 15 nt, Mycobacterium avium subsp. paratuberculosis
aaccgguacaggccc

SEQ ID NO: 2865923 - RNA, 19 nt, Mycobacterium avium subsp. paratuberculosis
aaccggucaacggcucggu

SEQ ID NO: 2865924 - RNA, 15 nt, Mycobacterium avium subsp. paratuberculosis
aaccguagaccaccu

SEQ ID NO: 2865925 - RNA, 18 nt, Mycobacterium avium subsp. paratuberculosis
aaccgucuccggcgcggu

SEQ ID NO: 2865926 - RNA, 19 nt, Mycobacterium avium subsp. paratuberculosis
aaccguggaagucgccguc

SEQ ID NO: 2865927 - RNA, 21 nt, Mycobacterium avium subsp. paratuberculosis
aaccguggaagucgccguccg

SEQ ID NO: 2865928 - RNA, 15 nt, Mycobacterium avium subsp. paratuberculosis
aaccguugaccacca

SEQ ID NO: 2865929 - RNA, 20 nt, Mycobacterium avium subsp. paratuberculosis
aaccguuggccugcgcgacc

SEQ ID NO: 2865930 - RNA, 23 nt, Mycobacterium avium subsp. paratuberculosis
aaccucgagauucugcagccgca

SEQ ID NO: 2865931 - RNA, 12 nt, Mycobacterium avium subsp. paratuberculosis
aaccucgcggcg

SEQ ID NO: 2865932 - RNA, 15 nt, Mycobacterium avium subsp. paratuberculosis
aaccucggcggcggc

SEQ ID NO: 2865933 - RNA, 16 nt, Mycobacterium avium subsp. paratuberculosis
aaccugcggugccaau

SEQ ID NO: 2865934 - RNA, 20 nt, Mycobacterium avium subsp. paratuberculosis
aaccugcugggcggcaccac

SEQ ID NO: 2865935 - RNA, 13 nt, Mycobacterium avium subsp. paratuberculosis
aaccuggccacca

SEQ ID NO: 2865936 - RNA, 18 nt, Mycobacterium avium subsp. paratuberculosis
aaccuggccaccagcagc

SEQ ID NO: 2865937 - RNA, 14 nt, Mycobacterium avium subsp. paratuberculosis
aacgaaucgagccg

SEQ ID NO: 2865938 - RNA, 21 nt, Mycobacterium avium subsp. paratuberculosis
aacgacacguggaccgagcgc

SEQ ID NO: 2865939 - RNA, 22 nt, Mycobacterium avium subsp. paratuberculosis
aacgacagcaggaucuccggcc

SEQ ID NO: 2865940 - RNA, 13 nt, Mycobacterium avium subsp. paratuberculosis
aacgacagcgacg

SEQ ID NO: 2865941 - RNA, 21 nt, Mycobacterium avium subsp. paratuberculosis
aacgacagcgacgggccgggc

SEQ ID NO: 2865942 - RNA, 22 nt, Mycobacterium avium subsp. paratuberculosis
aacgacauccagaugcccagca

SEQ ID NO: 2865943 - RNA, 15 nt, Mycobacterium avium subsp. paratuberculosis
aacgacccggccacc

SEQ ID NO: 2865944 - RNA, 15 nt, Mycobacterium avium subsp. paratuberculosis
aacgacccgucgggg

SEQ ID NO: 2865945 - RNA, 23 nt, Mycobacterium avium subsp. paratuberculosis
aacgacgaagucggucagcgucg

SEQ ID NO: 2865946 - RNA, 19 nt, Mycobacterium avium subsp. paratuberculosis
aacgacgacaggucgagca

SEQ ID NO: 2865947 - RNA, 13 nt, Mycobacterium avium subsp. paratuberculosis
aacgacgccaccg

SEQ ID NO: 2865948 - RNA, 18 nt, Mycobacterium avium subsp. paratuberculosis
aacgacgcggcacgccgc

SEQ ID NO: 2865949 - RNA, 14 nt, Mycobacterium avium subsp. paratuberculosis
aacgacggugcgcc

SEQ ID NO: 2865950 - RNA, 14 nt, Mycobacterium avium subsp. paratuberculosis
aacgacgucggcgu

SEQ ID NO: 2865951 - RNA, 19 nt, Mycobacterium avium subsp. paratuberculosis
aacgacguguucaacgcgc

SEQ ID NO: 2865952 - RNA, 22 nt, Mycobacterium avium subsp. paratuberculosis
aacgacguguucaacgcgccga

SEQ ID NO: 2865953 - RNA, 15 nt, Mycobacterium avium subsp. paratuberculosis
aacgacuggcggcgg

SEQ ID NO: 2865954 - RNA, 16 nt, Mycobacterium avium subsp. paratuberculosis
aacgacuggcggcggc

SEQ ID NO: 2865955 - RNA, 14 nt, Mycobacterium avium subsp. paratuberculosis
aacgagcgcgccga

SEQ ID NO: 2865956 - RNA, 16 nt, Mycobacterium avium subsp. paratuberculosis
aacgagcgcgccgagg

SEQ ID NO: 2865957 - RNA, 13 nt, Mycobacterium avium subsp. paratuberculosis
aacgaggccaggg

SEQ ID NO: 2865958 - RNA, 22 nt, Mycobacterium avium subsp. paratuberculosis
aacgaggccgacguggagcuga

SEQ ID NO: 2865959 - RNA, 21 nt, Mycobacterium avium subsp. paratuberculosis
aacgaggccgcgccgugcgcc

SEQ ID NO: 2865960 - RNA, 22 nt, Mycobacterium avium subsp. paratuberculosis
aacgaggccgcgccgugcgcca

SEQ ID NO: 2865961 - RNA, 15 nt, Mycobacterium avium subsp. paratuberculosis
aacgaucggcuccag

SEQ ID NO: 2865962 - RNA, 17 nt, Mycobacterium avium subsp. paratuberculosis
aacgaucggcuccagcg

SEQ ID NO: 2865963 - RNA, 22 nt, Mycobacterium avium subsp. paratuberculosis
aacgaucggcuccagcgcccgc

SEQ ID NO: 2865964 - RNA, 19 nt, Mycobacterium avium subsp. paratuberculosis
aacgauucacccagcgagc

SEQ ID NO: 2865965 - RNA, 23 nt, Mycobacterium avium subsp. paratuberculosis
aacgauuuccgguuccucggcgu

SEQ ID NO: 2865966 - RNA, 18 nt, Mycobacterium avium subsp. paratuberculosis
aacgcaacagcgagucgg

SEQ ID NO: 2865967 - RNA, 15 nt, Mycobacterium avium subsp. paratuberculosis
aacgcaaugcgucgc

SEQ ID NO: 2865968 - RNA, 18 nt, Mycobacterium avium subsp. paratuberculosis
aacgcaaugcgucgcggc

SEQ ID NO: 2865969 - RNA, 22 nt, Mycobacterium avium subsp. paratuberculosis
aacgccacaaacagcgcggccg

SEQ ID NO: 2865970 - RNA, 20 nt, Mycobacterium avium subsp. paratuberculosis
aacgccaccuucaccgcgcc

SEQ ID NO: 2865971 - RNA, 16 nt, Mycobacterium avium subsp. paratuberculosis
aacgccacggcggccg

SEQ ID NO: 2865972 - RNA, 18 nt, Mycobacterium avium subsp. paratuberculosis
aacgccacguagcagcag

SEQ ID NO: 2865973 - RNA, 16 nt, Mycobacterium avium subsp. paratuberculosis
aacgccagcagccgca

SEQ ID NO: 2865974 - RNA, 18 nt, Mycobacterium avium subsp. paratuberculosis
aacgccagcagccgcagc

SEQ ID NO: 2865975 - RNA, 16 nt, Mycobacterium avium subsp. paratuberculosis
aacgccagcagcugcg

SEQ ID NO: 2865976 - RNA, 11 nt, Mycobacterium avium subsp. paratuberculosis
aacgccagcca

SEQ ID NO: 2865977 - RNA, 12 nt, Mycobacterium avium subsp. paratuberculosis
aacgccagcgcg

SEQ ID NO: 2865978 - RNA, 21 nt, Mycobacterium avium subsp. paratuberculosis
aacgccagcugggcagccaga

SEQ ID NO: 2865979 - RNA, 18 nt, Mycobacterium avium subsp. paratuberculosis
aacgcccgcaacuccaca

SEQ ID NO: 2865980 - RNA, 21 nt, Mycobacterium avium subsp. paratuberculosis
aacgcccgcaacuccacaacc

SEQ ID NO: 2865981 - RNA, 11 nt, Mycobacterium avium subsp. paratuberculosis
aacgcccggcu

SEQ ID NO: 2865982 - RNA, 13 nt, Mycobacterium avium subsp. paratuberculosis
aacgcccggcuca

SEQ ID NO: 2865983 - RNA, 17 nt, Mycobacterium avium subsp. paratuberculosis
aacgccgaggaggccgc

SEQ ID NO: 2865984 - RNA, 23 nt, Mycobacterium avium subsp. paratuberculosis
aacgccgaggaggccgcggcgac

SEQ ID NO: 2865985 - RNA, 18 nt, Mycobacterium avium subsp. paratuberculosis
aacgccgaggugcaacac

SEQ ID NO: 2865986 - RNA, 12 nt, Mycobacterium avium subsp. paratuberculosis
aacgccgccgac

SEQ ID NO: 2865987 - RNA, 13 nt, Mycobacterium avium subsp. paratuberculosis
aacgccgccgaca

SEQ ID NO: 2865988 - RNA, 13 nt, Mycobacterium avium subsp. paratuberculosis
aacgccgccuccg

SEQ ID NO: 2865989 - RNA, 21 nt, Mycobacterium avium subsp. paratuberculosis
aacgccgccuccgacagccgc

SEQ ID NO: 2865990 - RNA, 17 nt, Mycobacterium avium subsp. paratuberculosis
aacgccggccccggcga

SEQ ID NO: 2865991 - RNA, 20 nt, Mycobacterium avium subsp. paratuberculosis
aacgccgggucgacgccgag

SEQ ID NO: 2865992 - RNA, 19 nt, Mycobacterium avium subsp. paratuberculosis
aacgccggugagguggcgu

SEQ ID NO: 2865993 - RNA, 21 nt, Mycobacterium avium subsp. paratuberculosis
aacgccuccgaauccagcgcg

SEQ ID NO: 2865994 - RNA, 18 nt, Mycobacterium avium subsp. paratuberculosis
aacgccuccgccgccccg

SEQ ID NO: 2865995 - RNA, 22 nt, Mycobacterium avium subsp. paratuberculosis
aacgccucgggccggcagccgg

SEQ ID NO: 2865996 - RNA, 14 nt, Mycobacterium avium subsp. paratuberculosis
aacgccucgucgac

SEQ ID NO: 2865997 - RNA, 23 nt, Mycobacterium avium subsp. paratuberculosis
aacgccucgucgaccgcggccug

SEQ ID NO: 2865998 - RNA, 17 nt, Mycobacterium avium subsp. paratuberculosis
aacgccucguuggccag

SEQ ID NO: 2865999 - RNA, 13 nt, Mycobacterium avium subsp. paratuberculosis
aacgccugccggc

SEQ ID NO: 2866000 - RNA, 15 nt, Mycobacterium avium subsp. paratuberculosis
aacgccugccggcgc

SEQ ID NO: 2866001 - RNA, 13 nt, Mycobacterium avium subsp. paratuberculosis
aacgccugcgccg

SEQ ID NO: 2866002 - RNA, 19 nt, Mycobacterium avium subsp. paratuberculosis
aacgccugcgccgccguag

SEQ ID NO: 2866003 - RNA, 16 nt, Mycobacterium avium subsp. paratuberculosis
aacgcgaacggguagc

SEQ ID NO: 2866004 - RNA, 19 nt, Mycobacterium avium subsp. paratuberculosis
aacgcgacgaagcggucgc

SEQ ID NO: 2866005 - RNA, 13 nt, Mycobacterium avium subsp. paratuberculosis
aacgcgacggccc

SEQ ID NO: 2866006 - RNA, 21 nt, Mycobacterium avium subsp. paratuberculosis
aacgcgacgguggcggcgaug

SEQ ID NO: 2866007 - RNA, 21 nt, Mycobacterium avium subsp. paratuberculosis
aacgcgaugugccacuucgac

SEQ ID NO: 2866008 - RNA, 23 nt, Mycobacterium avium subsp. paratuberculosis
aacgcgaugugccacuucgacgg

SEQ ID NO: 2866009 - RNA, 20 nt, Mycobacterium avium subsp. paratuberculosis
aacgcgauucucgcugcggc

SEQ ID NO: 2866010 - RNA, 16 nt, Mycobacterium avium subsp. paratuberculosis
aacgcgcacaacagcc

SEQ ID NO: 2866011 - RNA, 13 nt, Mycobacterium avium subsp. paratuberculosis
aacgcgccccgcc

SEQ ID NO: 2866012 - RNA, 15 nt, Mycobacterium avium subsp. paratuberculosis
aacgcgccccgccgg

SEQ ID NO: 2866013 - RNA, 13 nt, Mycobacterium avium subsp. paratuberculosis
aacgcgccgccca

SEQ ID NO: 2866014 - RNA, 13 nt, Mycobacterium avium subsp. paratuberculosis
aacgcgccggcgc

SEQ ID NO: 2866015 - RNA, 21 nt, Mycobacterium avium subsp. paratuberculosis
aacgcgccgggcaacagcgcg

SEQ ID NO: 2866016 - RNA, 17 nt, Mycobacterium avium subsp. paratuberculosis
aacgcgccggugacccc

SEQ ID NO: 2866017 - RNA, 22 nt, Mycobacterium avium subsp. paratuberculosis
aacgcgccggugaccccgucga

SEQ ID NO: 2866018 - RNA, 11 nt, Mycobacterium avium subsp. paratuberculosis
aacgcgccguc

SEQ ID NO: 2866019 - RNA, 22 nt, Mycobacterium avium subsp. paratuberculosis
aacgcgccgucgucggacacca

SEQ ID NO: 2866020 - RNA, 12 nt, Mycobacterium avium subsp. paratuberculosis
aacgcgcgcgac

SEQ ID NO: 2866021 - RNA, 20 nt, Mycobacterium avium subsp. paratuberculosis
aacgcggacagcucgccggc

SEQ ID NO: 2866022 - RNA, 19 nt, Mycobacterium avium subsp. paratuberculosis
aacgcggcaugaccggcca

SEQ ID NO: 2866023 - RNA, 13 nt, Mycobacterium avium subsp. paratuberculosis
aacgcggccagcg

SEQ ID NO: 2866024 - RNA, 13 nt, Mycobacterium avium subsp. paratuberculosis
aacgcggccaggg

SEQ ID NO: 2866025 - RNA, 13 nt, Mycobacterium avium subsp. paratuberculosis
aacgcggccgcca

SEQ ID NO: 2866026 - RNA, 17 nt, Mycobacterium avium subsp. paratuberculosis
aacgcggcgaagcaggc

SEQ ID NO: 2866027 - RNA, 18 nt, Mycobacterium avium subsp. paratuberculosis
aacgcggcgaagcaggcc

SEQ ID NO: 2866028 - RNA, 19 nt, Mycobacterium avium subsp. paratuberculosis
aacgcggcgaaggccagcg

SEQ ID NO: 2866029 - RNA, 14 nt, Mycobacterium avium subsp. paratuberculosis
aacgcggcgccgac

SEQ ID NO: 2866030 - RNA, 22 nt, Mycobacterium avium subsp. paratuberculosis
aacgcggcggugacgaacccgc

SEQ ID NO: 2866031 - RNA, 19 nt, Mycobacterium avium subsp. paratuberculosis
aacgcggugggcaccagca

SEQ ID NO: 2866032 - RNA, 21 nt, Mycobacterium avium subsp. paratuberculosis
aacgcggugggcaccagcagc

SEQ ID NO: 2866033 - RNA, 22 nt, Mycobacterium avium subsp. paratuberculosis
aacgcggugggcaccagcagcg

SEQ ID NO: 2866034 - RNA, 18 nt, Mycobacterium avium subsp. paratuberculosis
aacgcguacagcgcccgg

SEQ ID NO: 2866035 - RNA, 23 nt, Mycobacterium avium subsp. paratuberculosis
aacgcguacuucgugguggugcg

SEQ ID NO: 2866036 - RNA, 14 nt, Mycobacterium avium subsp. paratuberculosis
aacgcgucgacggc

SEQ ID NO: 2866037 - RNA, 17 nt, Mycobacterium avium subsp. paratuberculosis
aacgcgucggcgccgga

SEQ ID NO: 2866038 - RNA, 15 nt, Mycobacterium avium subsp. paratuberculosis
aacgcgucggucagc

SEQ ID NO: 2866039 - RNA, 19 nt, Mycobacterium avium subsp. paratuberculosis
aacgcgucggucagcggcg

SEQ ID NO: 2866040 - RNA, 17 nt, Mycobacterium avium subsp. paratuberculosis
aacgcguucgucggcgc

SEQ ID NO: 2866041 - RNA, 22 nt, Mycobacterium avium subsp. paratuberculosis
aacgcguucuccucgaacaccg

SEQ ID NO: 2866042 - RNA, 23 nt, Mycobacterium avium subsp. paratuberculosis
aacgcguuucccgaguggcgccg

SEQ ID NO: 2866043 - RNA, 21 nt, Mycobacterium avium subsp. paratuberculosis
aacgcucccgguagagcggca

SEQ ID NO: 2866044 - RNA, 14 nt, Mycobacterium avium subsp. paratuberculosis
aacgcugggcgccg

SEQ ID NO: 2866045 - RNA, 19 nt, Mycobacterium avium subsp. paratuberculosis
aacgcuggucgaacgccac

SEQ ID NO: 2866046 - RNA, 14 nt, Mycobacterium avium subsp. paratuberculosis
aacgcuuccagcac

SEQ ID NO: 2866047 - RNA, 17 nt, Mycobacterium avium subsp. paratuberculosis
aacgcuuucgggucgac

SEQ ID NO: 2866048 - RNA, 22 nt, Mycobacterium avium subsp. paratuberculosis
aacggaauucagugaggccagc

SEQ ID NO: 2866049 - RNA, 21 nt, Mycobacterium avium subsp. paratuberculosis
aacggauagcguccgcccacu

SEQ ID NO: 2866050 - RNA, 19 nt, Mycobacterium avium subsp. paratuberculosis
aacggaucgagcgcaccgc

SEQ ID NO: 2866051 - RNA, 21 nt, Mycobacterium avium subsp. paratuberculosis
aacggcaaccugggcggcggc

SEQ ID NO: 2866052 - RNA, 15 nt, Mycobacterium avium subsp. paratuberculosis
aacggcaacggcggc

SEQ ID NO: 2866053 - RNA, 17 nt, Mycobacterium avium subsp. paratuberculosis
aacggcaacggcggcgg

SEQ ID NO: 2866054 - RNA, 14 nt, Mycobacterium avium subsp. paratuberculosis
aacggcaccagcgg

SEQ ID NO: 2866055 - RNA, 21 nt, Mycobacterium avium subsp. paratuberculosis
aacggcaccccgcggucggcg

SEQ ID NO: 2866056 - RNA, 23 nt, Mycobacterium avium subsp. paratuberculosis
aacggcaccccgcggucggcggc

SEQ ID NO: 2866057 - RNA, 12 nt, Mycobacterium avium subsp. paratuberculosis
aacggcacccgc

SEQ ID NO: 2866058 - RNA, 18 nt, Mycobacterium avium subsp. paratuberculosis
aacggcaccucgaucacc

SEQ ID NO: 2866059 - RNA, 19 nt, Mycobacterium avium subsp. paratuberculosis
aacggcaccucgaucaccg

SEQ ID NO: 2866060 - RNA, 21 nt, Mycobacterium avium subsp. paratuberculosis
aacggcaccucgaucaccggg

SEQ ID NO: 2866061 - RNA, 17 nt, Mycobacterium avium subsp. paratuberculosis
aacggcagcucgucgac

SEQ ID NO: 2866062 - RNA, 22 nt, Mycobacterium avium subsp. paratuberculosis
aacggcagcucgucgacguccu

SEQ ID NO: 2866063 - RNA, 13 nt, Mycobacterium avium subsp. paratuberculosis
aacggccaaccgc

SEQ ID NO: 2866064 - RNA, 18 nt, Mycobacterium avium subsp. paratuberculosis
aacggccaaccgcccggc

SEQ ID NO: 2866065 - RNA, 19 nt, Mycobacterium avium subsp. paratuberculosis
aacggccaguccaggccgc

SEQ ID NO: 2866066 - RNA, 17 nt, Mycobacterium avium subsp. paratuberculosis
aacggcccgccgccggc

SEQ ID NO: 2866067 - RNA, 21 nt, Mycobacterium avium subsp. paratuberculosis
aacggccggauggccagcagg

SEQ ID NO: 2866068 - RNA, 20 nt, Mycobacterium avium subsp. paratuberculosis
aacggccggcgccgccgggg

SEQ ID NO: 2866069 - RNA, 21 nt, Mycobacterium avium subsp. paratuberculosis
aacggccggcgccgccggggc

SEQ ID NO: 2866070 - RNA, 21 nt, Mycobacterium avium subsp. paratuberculosis
aacggcgcgaaccgggccagg

SEQ ID NO: 2866071 - RNA, 22 nt, Mycobacterium avium subsp. paratuberculosis
aacggcgcggcaguccgccgga

SEQ ID NO: 2866072 - RNA, 14 nt, Mycobacterium avium subsp. paratuberculosis
aacggcgcucccga

SEQ ID NO: 2866073 - RNA, 17 nt, Mycobacterium avium subsp. paratuberculosis
aacggcggaccggcggc

SEQ ID NO: 2866074 - RNA, 17 nt, Mycobacterium avium subsp. paratuberculosis
aacggcggcagcgaggc

SEQ ID NO: 2866075 - RNA, 22 nt, Mycobacterium avium subsp. paratuberculosis
aacggcucccaggcccaucgcg

SEQ ID NO: 2866076 - RNA, 13 nt, Mycobacterium avium subsp. paratuberculosis
aacggcucgccgc

SEQ ID NO: 2866077 - RNA, 14 nt, Mycobacterium avium subsp. paratuberculosis
aacggcucgccgcg

SEQ ID NO: 2866078 - RNA, 13 nt, Mycobacterium avium subsp. paratuberculosis
aacggcuggcgca

SEQ ID NO: 2866079 - RNA, 18 nt, Mycobacterium avium subsp. paratuberculosis
aacggcuugcgcucggcc

SEQ ID NO: 2866080 - RNA, 21 nt, Mycobacterium avium subsp. paratuberculosis
aacgggccgcagccgcgcggc

SEQ ID NO: 2866081 - RNA, 14 nt, Mycobacterium avium subsp. paratuberculosis
aacgggccgccuca

SEQ ID NO: 2866082 - RNA, 12 nt, Mycobacterium avium subsp. paratuberculosis
aacgggccggcg

SEQ ID NO: 2866083 - RNA, 12 nt, Mycobacterium avium subsp. paratuberculosis
aacgggccgggc

SEQ ID NO: 2866084 - RNA, 16 nt, Mycobacterium avium subsp. paratuberculosis
aacgggccgggcaccg

SEQ ID NO: 2866085 - RNA, 18 nt, Mycobacterium avium subsp. paratuberculosis
aacgggccgggcaccgcg

SEQ ID NO: 2866086 - RNA, 20 nt, Mycobacterium avium subsp. paratuberculosis
aacgggccgggcaccgcgcc

SEQ ID NO: 2866087 - RNA, 12 nt, Mycobacterium avium subsp. paratuberculosis
aacgggcggcgg

SEQ ID NO: 2866088 - RNA, 22 nt, Mycobacterium avium subsp. paratuberculosis
aacgggcggcggaucagcaccg

SEQ ID NO: 2866089 - RNA, 16 nt, Mycobacterium avium subsp. paratuberculosis
aacgggcuggccaggc

SEQ ID NO: 2866090 - RNA, 18 nt, Mycobacterium avium subsp. paratuberculosis
aacggguccuugccggcg

SEQ ID NO: 2866091 - RNA, 22 nt, Mycobacterium avium subsp. paratuberculosis
aacgggucgagggucgccaggc

SEQ ID NO: 2866092 - RNA, 19 nt, Mycobacterium avium subsp. paratuberculosis
aacgggucgaucucggcgc

SEQ ID NO: 2866093 - RNA, 19 nt, Mycobacterium avium subsp. paratuberculosis
aacgggugcggcgcucggu

SEQ ID NO: 2866094 - RNA, 19 nt, Mycobacterium avium subsp. paratuberculosis
aacggguucggucucggcg

SEQ ID NO: 2866095 - RNA, 23 nt, Mycobacterium avium subsp. paratuberculosis
aacggguucggucucggcggcgc

SEQ ID NO: 2866096 - RNA, 22 nt, Mycobacterium avium subsp. paratuberculosis
aacggguugcgaaagcccaggc

SEQ ID NO: 2866097 - RNA, 14 nt, Mycobacterium avium subsp. paratuberculosis
aacggucagccgcg

SEQ ID NO: 2866098 - RNA, 16 nt, Mycobacterium avium subsp. paratuberculosis
aacggucagccgcggc

SEQ ID NO: 2866099 - RNA, 17 nt, Mycobacterium avium subsp. paratuberculosis
aacggucggggcggcgg

SEQ ID NO: 2866100 - RNA, 16 nt, Mycobacterium avium subsp. paratuberculosis
aacggugcccgccgau

SEQ ID NO: 2866101 - RNA, 13 nt, Mycobacterium avium subsp. paratuberculosis
aacgguucggccg

SEQ ID NO: 2866102 - RNA, 18 nt, Mycobacterium avium subsp. paratuberculosis
aacgguucggccgcucgg

SEQ ID NO: 2866103 - RNA, 22 nt, Mycobacterium avium subsp. paratuberculosis
aacgguucgggaaccuggccgu

SEQ ID NO: 2866104 - RNA, 18 nt, Mycobacterium avium subsp. paratuberculosis
aacgguuuuucccagcgg

SEQ ID NO: 2866105 - RNA, 22 nt, Mycobacterium avium subsp. paratuberculosis
aacgguuuuucccagcggccga

SEQ ID NO: 2866106 - RNA, 13 nt, Mycobacterium avium subsp. paratuberculosis
aacgucaccaaca

SEQ ID NO: 2866107 - RNA, 22 nt, Mycobacterium avium subsp. paratuberculosis
aacgucacggcgaggauggcga

SEQ ID NO: 2866108 - RNA, 17 nt, Mycobacterium avium subsp. paratuberculosis
aacgucgacuuguugcg

SEQ ID NO: 2866109 - RNA, 20 nt, Mycobacterium avium subsp. paratuberculosis
aacgucgacuuguugcguga

SEQ ID NO: 2866110 - RNA, 17 nt, Mycobacterium avium subsp. paratuberculosis
aacgucgagcgcggccc

SEQ ID NO: 2866111 - RNA, 22 nt, Mycobacterium avium subsp. paratuberculosis
aacgucgagcgcggcccgccga

SEQ ID NO: 2866112 - RNA, 15 nt, Mycobacterium avium subsp. paratuberculosis
aacgucgcagcccgg

SEQ ID NO: 2866113 - RNA, 16 nt, Mycobacterium avium subsp. paratuberculosis
aacgucucggugucgg

SEQ ID NO: 2866114 - RNA, 18 nt, Mycobacterium avium subsp. paratuberculosis
aacgucucugucgucgac

SEQ ID NO: 2866115 - RNA, 16 nt, Mycobacterium avium subsp. paratuberculosis
aacgugaugagcgcgu

SEQ ID NO: 2866116 - RNA, 17 nt, Mycobacterium avium subsp. paratuberculosis
aacgugccacaggccga

SEQ ID NO: 2866117 - RNA, 14 nt, Mycobacterium avium subsp. paratuberculosis
aacgugcgccggcc

SEQ ID NO: 2866118 - RNA, 19 nt, Mycobacterium avium subsp. paratuberculosis
aacguguacucggcgucgc

SEQ ID NO: 2866119 - RNA, 14 nt, Mycobacterium avium subsp. paratuberculosis
aacuaacuucacgc

SEQ ID NO: 2866120 - RNA, 22 nt, Mycobacterium avium subsp. paratuberculosis
aacuaccgacggcaccucucgg

SEQ ID NO: 2866121 - RNA, 14 nt, Mycobacterium avium subsp. paratuberculosis
aacuacgagcagca

SEQ ID NO: 2866122 - RNA, 22 nt, Mycobacterium avium subsp. paratuberculosis
aacuacgcacccgacacgccga

SEQ ID NO: 2866123 - RNA, 22 nt, Mycobacterium avium subsp. paratuberculosis
aacuacuucgucagcagcgaca

SEQ ID NO: 2866124 - RNA, 14 nt, Mycobacterium avium subsp. paratuberculosis
aacuagcuucacgg

SEQ ID NO: 2866125 - RNA, 22 nt, Mycobacterium avium subsp. paratuberculosis
aacucaccgcgucagcagcgcg

SEQ ID NO: 2866126 - RNA, 19 nt, Mycobacterium avium subsp. paratuberculosis
aacuccauccgccgucgac

SEQ ID NO: 2866127 - RNA, 17 nt, Mycobacterium avium subsp. paratuberculosis
aacucccgcgccgcggc

SEQ ID NO: 2866128 - RNA, 17 nt, Mycobacterium avium subsp. paratuberculosis
aacuccgacuccagcag

SEQ ID NO: 2866129 - RNA, 19 nt, Mycobacterium avium subsp. paratuberculosis
aacuccgccgaaccgauca

SEQ ID NO: 2866130 - RNA, 17 nt, Mycobacterium avium subsp. paratuberculosis
aacuccgcgcgcggcac

SEQ ID NO: 2866131 - RNA, 12 nt, Mycobacterium avium subsp. paratuberculosis
aacuccggcggc

SEQ ID NO: 2866132 - RNA, 17 nt, Mycobacterium avium subsp. paratuberculosis
aacuccgucucgccgua

SEQ ID NO: 2866133 - RNA, 22 nt, Mycobacterium avium subsp. paratuberculosis
aacuccucgaagaguugggucg

SEQ ID NO: 2866134 - RNA, 13 nt, Mycobacterium avium subsp. paratuberculosis
aacuccugcagga

SEQ ID NO: 2866135 - RNA, 19 nt, Mycobacterium avium subsp. paratuberculosis
aacucgaagcugcgccaca

SEQ ID NO: 2866136 - RNA, 12 nt, Mycobacterium avium subsp. paratuberculosis
aacucgacccgc

SEQ ID NO: 2866137 - RNA, 16 nt, Mycobacterium avium subsp. paratuberculosis
aacucgacgaucucgu

SEQ ID NO: 2866138 - RNA, 14 nt, Mycobacterium avium subsp. paratuberculosis
aacucgacgcucgg

SEQ ID NO: 2866139 - RNA, 15 nt, Mycobacterium avium subsp. paratuberculosis
aacucgacggagugc

SEQ ID NO: 2866140 - RNA, 20 nt, Mycobacterium avium subsp. paratuberculosis
aacucgacguucggcgggca

SEQ ID NO: 2866141 - RNA, 21 nt, Mycobacterium avium subsp. paratuberculosis
aacucgaucugcagccggcgc

SEQ ID NO: 2866142 - RNA, 22 nt, Mycobacterium avium subsp. paratuberculosis
aacucgaugggggugccgcagc

SEQ ID NO: 2866143 - RNA, 11 nt, Mycobacterium avium subsp. paratuberculosis
aacucgccgau

SEQ ID NO: 2866144 - RNA, 15 nt, Mycobacterium avium subsp. paratuberculosis
aacucggcggcgguu

SEQ ID NO: 2866145 - RNA, 16 nt, Mycobacterium avium subsp. paratuberculosis
aacucgggcucgucgu

SEQ ID NO: 2866146 - RNA, 21 nt, Mycobacterium avium subsp. paratuberculosis
aacucguugccagccggugcu

SEQ ID NO: 2866147 - RNA, 19 nt, Mycobacterium avium subsp. paratuberculosis
aacucuacugcugcgggug

SEQ ID NO: 2866148 - RNA, 16 nt, Mycobacterium avium subsp. paratuberculosis
aacugaauuccuggcc

SEQ ID NO: 2866149 - RNA, 14 nt, Mycobacterium avium subsp. paratuberculosis
aacugagcgcccgg

SEQ ID NO: 2866150 - RNA, 13 nt, Mycobacterium avium subsp. paratuberculosis
aacugcaccagca

SEQ ID NO: 2866151 - RNA, 23 nt, Mycobacterium avium subsp. paratuberculosis
aacugcaccagcacgacaccgac

SEQ ID NO: 2866152 - RNA, 15 nt, Mycobacterium avium subsp. paratuberculosis
aacugcaccagcggc

SEQ ID NO: 2866153 - RNA, 15 nt, Mycobacterium avium subsp. paratuberculosis
aacugcagcaacgaa

SEQ ID NO: 2866154 - RNA, 19 nt, Mycobacterium avium subsp. paratuberculosis
aacugcaucauguccaggu

SEQ ID NO: 2866155 - RNA, 20 nt, Mycobacterium avium subsp. paratuberculosis
aacugcauuucggacggcga

SEQ ID NO: 2866156 - RNA, 18 nt, Mycobacterium avium subsp. paratuberculosis
aacugccgacggucccac

SEQ ID NO: 2866157 - RNA, 14 nt, Mycobacterium avium subsp. paratuberculosis
aacugccgaugcug

SEQ ID NO: 2866158 - RNA, 13 nt, Mycobacterium avium subsp. paratuberculosis
aacugccgcgcac

SEQ ID NO: 2866159 - RNA, 21 nt, Mycobacterium avium subsp. paratuberculosis
aacugccggcauaggccagca

SEQ ID NO: 2866160 - RNA, 22 nt, Mycobacterium avium subsp. paratuberculosis
aacugccggcauaggccagcac

SEQ ID NO: 2866161 - RNA, 22 nt, Mycobacterium avium subsp. paratuberculosis
aacugccguugauugaccaucc

SEQ ID NO: 2866162 - RNA, 19 nt, Mycobacterium avium subsp. paratuberculosis
aacugcucccaggcgucgu

SEQ ID NO: 2866163 - RNA, 16 nt, Mycobacterium avium subsp. paratuberculosis
aacugcucgaccagcg

SEQ ID NO: 2866164 - RNA, 18 nt, Mycobacterium avium subsp. paratuberculosis
aacugcucgaccagcgcc

SEQ ID NO: 2866165 - RNA, 22 nt, Mycobacterium avium subsp. paratuberculosis
aacugcucgaccagcgccgagg

SEQ ID NO: 2866166 - RNA, 20 nt, Mycobacterium avium subsp. paratuberculosis
aacugggaguugacuccucu

SEQ ID NO: 2866167 - RNA, 22 nt, Mycobacterium avium subsp. paratuberculosis
aacugggaguugacuccucugc

SEQ ID NO: 2866168 - RNA, 22 nt, Mycobacterium avium subsp. paratuberculosis
aacugggccgccgucgccacca

SEQ ID NO: 2866169 - RNA, 13 nt, Mycobacterium avium subsp. paratuberculosis
aacugguccucca

SEQ ID NO: 2866170 - RNA, 16 nt, Mycobacterium avium subsp. paratuberculosis
aacugguccugcggcu

SEQ ID NO: 2866171 - RNA, 17 nt, Mycobacterium avium subsp. paratuberculosis
aacugguccugcggcug

SEQ ID NO: 2866172 - RNA, 19 nt, Mycobacterium avium subsp. paratuberculosis
aacugguccugcggcuggu

SEQ ID NO: 2866173 - RNA, 21 nt, Mycobacterium avium subsp. paratuberculosis
aacuggucgugcagcaccgcc

SEQ ID NO: 2866174 - RNA, 19 nt, Mycobacterium avium subsp. paratuberculosis
aacugguuccacaccacca

SEQ ID NO: 2866175 - RNA, 23 nt, Mycobacterium avium subsp. paratuberculosis
aacuguucgcggcuggccgcggc

SEQ ID NO: 2866176 - RNA, 18 nt, Mycobacterium avium subsp. paratuberculosis
aacuucacgcucggcgag

SEQ ID NO: 2866177 - RNA, 13 nt, Mycobacterium avium subsp. paratuberculosis
aacuucagcugcu

SEQ ID NO: 2866178 - RNA, 16 nt, Mycobacterium avium subsp. paratuberculosis
aacuucagcugcuccg

SEQ ID NO: 2866179 - RNA, 21 nt, Mycobacterium avium subsp. paratuberculosis
aacuucagcugcuccgggggc

SEQ ID NO: 2866180 - RNA, 17 nt, Mycobacterium avium subsp. paratuberculosis
aacuuccgcccggcgag

SEQ ID NO: 2866181 - RNA, 14 nt, Mycobacterium avium subsp. paratuberculosis
aacuugcuggccga

SEQ ID NO: 2866182 - RNA, 21 nt, Mycobacterium avium subsp. paratuberculosis
aacuuguugacgaaaccgcca

SEQ ID NO: 2866183 - RNA, 15 nt, Mycobacterium avium subsp. paratuberculosis
aagaacucagccgaa

SEQ ID NO: 2866184 - RNA, 20 nt, Mycobacterium avium subsp. paratuberculosis
aagaagcgggccaaagagcu

SEQ ID NO: 2866185 - RNA, 19 nt, Mycobacterium avium subsp. paratuberculosis
aagaaggacaagccggaga

SEQ ID NO: 2866186 - RNA, 19 nt, Mycobacterium avium subsp. paratuberculosis
aagaaggcuccgccgaugu

SEQ ID NO: 2866187 - RNA, 14 nt, Mycobacterium avium subsp. paratuberculosis
aagaagugggccau

SEQ ID NO: 2866188 - RNA, 12 nt, Mycobacterium avium subsp. paratuberculosis
aagacccgaaac

SEQ ID NO: 2866189 - RNA, 23 nt, Mycobacterium avium subsp. paratuberculosis
aagaccggaagccuguuggccag

SEQ ID NO: 2866190 - RNA, 23 nt, Mycobacterium avium subsp. paratuberculosis
aagacggugggcccgccgucgac

SEQ ID NO: 2866191 - RNA, 17 nt, Mycobacterium avium subsp. paratuberculosis
aagacguaggcggccag

SEQ ID NO: 2866192 - RNA, 19 nt, Mycobacterium avium subsp. paratuberculosis
aagacguaggcggccagca

SEQ ID NO: 2866193 - RNA, 18 nt, Mycobacterium avium subsp. paratuberculosis
aagacguccgcgucggcg

SEQ ID NO: 2866194 - RNA, 17 nt, Mycobacterium avium subsp. paratuberculosis
aagacguugaccgcgaa

SEQ ID NO: 2866195 - RNA, 15 nt, Mycobacterium avium subsp. paratuberculosis
aagacguugaugcga

SEQ ID NO: 2866196 - RNA, 20 nt, Mycobacterium avium subsp. paratuberculosis
aagagggccauccggccggc

SEQ ID NO: 2866197 - RNA, 16 nt, Mycobacterium avium subsp. paratuberculosis
aagaggugcucgacgg

SEQ ID NO: 2866198 - RNA, 21 nt, Mycobacterium avium subsp. paratuberculosis
aagagugcgauagcuucccuu

SEQ ID NO: 2866199 - RNA, 15 nt, Mycobacterium avium subsp. paratuberculosis
aagauaccggccggc

SEQ ID NO: 2866200 - RNA, 21 nt, Mycobacterium avium subsp. paratuberculosis
aagaucagcaccguccacagc

SEQ ID NO: 2866201 - RNA, 15 nt, Mycobacterium avium subsp. paratuberculosis
aagaucagcaggcug

SEQ ID NO: 2866202 - RNA, 21 nt, Mycobacterium avium subsp. paratuberculosis
aagaucagcgcgucggugaug

SEQ ID NO: 2866203 - RNA, 16 nt, Mycobacterium avium subsp. paratuberculosis
aagaucgucuugaccg

SEQ ID NO: 2866204 - RNA, 22 nt, Mycobacterium avium subsp. paratuberculosis
aagaugaucagcgcgcccaggc

SEQ ID NO: 2866205 - RNA, 18 nt, Mycobacterium avium subsp. paratuberculosis
aagaugaucucgccgagc

SEQ ID NO: 2866206 - RNA, 15 nt, Mycobacterium avium subsp. paratuberculosis
aagaugggcgccgag

SEQ ID NO: 2866207 - RNA, 19 nt, Mycobacterium avium subsp. paratuberculosis
aagauggucgcgccgcggc

SEQ ID NO: 2866208 - RNA, 15 nt, Mycobacterium avium subsp. paratuberculosis
aagauguaucaggau

SEQ ID NO: 2866209 - RNA, 18 nt, Mycobacterium avium subsp. paratuberculosis
aagauguaucaggaucug

SEQ ID NO: 2866210 - RNA, 16 nt, Mycobacterium avium subsp. paratuberculosis
aagauguccucgggaa

SEQ ID NO: 2866211 - RNA, 14 nt, Mycobacterium avium subsp. paratuberculosis
aagauguugcggcg

SEQ ID NO: 2866212 - RNA, 15 nt, Mycobacterium avium subsp. paratuberculosis
aagcaccaggcucgc

SEQ ID NO: 2866213 - RNA, 19 nt, Mycobacterium avium subsp. paratuberculosis
aagcaccgcgaacagcacg

SEQ ID NO: 2866214 - RNA, 20 nt, Mycobacterium avium subsp. paratuberculosis
aagcagaacgccaucaccag

SEQ ID NO: 2866215 - RNA, 17 nt, Mycobacterium avium subsp. paratuberculosis
aagcagagcagcgagau

SEQ ID NO: 2866216 - RNA, 13 nt, Mycobacterium avium subsp. paratuberculosis
aagccacccgcgc

SEQ ID NO: 2866217 - RNA, 13 nt, Mycobacterium avium subsp. paratuberculosis
aagccacggaguc

SEQ ID NO: 2866218 - RNA, 13 nt, Mycobacterium avium subsp. paratuberculosis
aagccauggcggc

SEQ ID NO: 2866219 - RNA, 16 nt, Mycobacterium avium subsp. paratuberculosis
aagccauggcggcccg

SEQ ID NO: 2866220 - RNA, 17 nt, Mycobacterium avium subsp. paratuberculosis
aagccauuucagcagcg

SEQ ID NO: 2866221 - RNA, 23 nt, Mycobacterium avium subsp. paratuberculosis
aagcccacgaucacgucggugac

SEQ ID NO: 2866222 - RNA, 16 nt, Mycobacterium avium subsp. paratuberculosis
aagcccaggcccggca

SEQ ID NO: 2866223 - RNA, 12 nt, Mycobacterium avium subsp. paratuberculosis
aagcccgccgcc

SEQ ID NO: 2866224 - RNA, 16 nt, Mycobacterium avium subsp. paratuberculosis
aagccgaccgccccgc

SEQ ID NO: 2866225 - RNA, 14 nt, Mycobacterium avium subsp. paratuberculosis
aagccgacgucgac

SEQ ID NO: 2866226 - RNA, 17 nt, Mycobacterium avium subsp. paratuberculosis
aagccgagcuugggccg

SEQ ID NO: 2866227 - RNA, 19 nt, Mycobacterium avium subsp. paratuberculosis
aagccgaggcgcaacaccg

SEQ ID NO: 2866228 - RNA, 19 nt, Mycobacterium avium subsp. paratuberculosis
aagccgaggucgccgacgc

SEQ ID NO: 2866229 - RNA, 23 nt, Mycobacterium avium subsp. paratuberculosis
aagccgaggucgcggcggccggc

SEQ ID NO: 2866230 - RNA, 18 nt, Mycobacterium avium subsp. paratuberculosis
aagccgaucaccggcgcg

SEQ ID NO: 2866231 - RNA, 22 nt, Mycobacterium avium subsp. paratuberculosis
aagccgcagcaggugcgccaga

SEQ ID NO: 2866232 - RNA, 21 nt, Mycobacterium avium subsp. paratuberculosis
aagccgcgaacgccucggcga

SEQ ID NO: 2866233 - RNA, 13 nt, Mycobacterium avium subsp. paratuberculosis
aagccgcgaucgg

SEQ ID NO: 2866234 - RNA, 14 nt, Mycobacterium avium subsp. paratuberculosis
aagccgcggacggc

SEQ ID NO: 2866235 - RNA, 21 nt, Mycobacterium avium subsp. paratuberculosis
aagccgcuggaagucggucug

SEQ ID NO: 2866236 - RNA, 13 nt, Mycobacterium avium subsp. paratuberculosis
aagccggccagca

SEQ ID NO: 2866237 - RNA, 19 nt, Mycobacterium avium subsp. paratuberculosis
aagccggccagcagcggcu

SEQ ID NO: 2866238 - RNA, 16 nt, Mycobacterium avium subsp. paratuberculosis
aagccggccaggccca

SEQ ID NO: 2866239 - RNA, 12 nt, Mycobacterium avium subsp. paratuberculosis
aagccggcgacg

SEQ ID NO: 2866240 - RNA, 14 nt, Mycobacterium avium subsp. paratuberculosis
aagccggcgacgac

SEQ ID NO: 2866241 - RNA, 13 nt, Mycobacterium avium subsp. paratuberculosis
aagccggcgucga

SEQ ID NO: 2866242 - RNA, 14 nt, Mycobacterium avium subsp. paratuberculosis
aagccggcgucgau

SEQ ID NO: 2866243 - RNA, 13 nt, Mycobacterium avium subsp. paratuberculosis
aagccggucuugg

SEQ ID NO: 2866244 - RNA, 19 nt, Mycobacterium avium subsp. paratuberculosis
aagccguaccgcaacaccg

SEQ ID NO: 2866245 - RNA, 22 nt, Mycobacterium avium subsp. paratuberculosis
aagccguagacggucagguucu

SEQ ID NO: 2866246 - RNA, 20 nt, Mycobacterium avium subsp. paratuberculosis
aagccgucgaccccgccggc

SEQ ID NO: 2866247 - RNA, 15 nt, Mycobacterium avium subsp. paratuberculosis
aagccgugacccgcc

SEQ ID NO: 2866248 - RNA, 16 nt, Mycobacterium avium subsp. paratuberculosis
aagccgugacccgccg

SEQ ID NO: 2866249 - RNA, 19 nt, Mycobacterium avium subsp. paratuberculosis
aagccgugggugccgacga

SEQ ID NO: 2866250 - RNA, 16 nt, Mycobacterium avium subsp. paratuberculosis
aagccguucgcgccga

SEQ ID NO: 2866251 - RNA, 18 nt, Mycobacterium avium subsp. paratuberculosis
aagccguucgcgccgaga

SEQ ID NO: 2866252 - RNA, 18 nt, Mycobacterium avium subsp. paratuberculosis
aagccguugccgccgcgc

SEQ ID NO: 2866253 - RNA, 15 nt, Mycobacterium avium subsp. paratuberculosis
aagccuguuggccag

SEQ ID NO: 2866254 - RNA, 17 nt, Mycobacterium avium subsp. paratuberculosis
aagcgaccagcgcgccg

SEQ ID NO: 2866255 - RNA, 19 nt, Mycobacterium avium subsp. paratuberculosis
aagcgcagcaccuccgaca

SEQ ID NO: 2866256 - RNA, 13 nt, Mycobacterium avium subsp. paratuberculosis
aagcgcagcagcu

SEQ ID NO: 2866257 - RNA, 15 nt, Mycobacterium avium subsp. paratuberculosis
aagcgcaucgccggc

SEQ ID NO: 2866258 - RNA, 15 nt, Mycobacterium avium subsp. paratuberculosis
aagcgccgcaugccc

SEQ ID NO: 2866259 - RNA, 21 nt, Mycobacterium avium subsp. paratuberculosis
aagcgcgaugcggcucaccag

SEQ ID NO: 2866260 - RNA, 21 nt, Mycobacterium avium subsp. paratuberculosis
aagcgcggguccugcaaccgc

SEQ ID NO: 2866261 - RNA, 17 nt, Mycobacterium avium subsp. paratuberculosis
aagcgcuugucgcagac

SEQ ID NO: 2866262 - RNA, 14 nt, Mycobacterium avium subsp. paratuberculosis
aagcgcuuucgccg

SEQ ID NO: 2866263 - RNA, 17 nt, Mycobacterium avium subsp. paratuberculosis
aagcggauugaccagca

SEQ ID NO: 2866264 - RNA, 14 nt, Mycobacterium avium subsp. paratuberculosis
aagcgggugaccga

SEQ ID NO: 2866265 - RNA, 16 nt, Mycobacterium avium subsp. paratuberculosis
aagcggugcaccaccg

SEQ ID NO: 2866266 - RNA, 17 nt, Mycobacterium avium subsp. paratuberculosis
aagcgguuccagaccgg

SEQ ID NO: 2866267 - RNA, 17 nt, Mycobacterium avium subsp. paratuberculosis
aagcgguugagccacaa

SEQ ID NO: 2866268 - RNA, 22 nt, Mycobacterium avium subsp. paratuberculosis
aagcguugcgcguucaagccgc

SEQ ID NO: 2866269 - RNA, 18 nt, Mycobacterium avium subsp. paratuberculosis
aagcuaguuucacgcucg

SEQ ID NO: 2866270 - RNA, 22 nt, Mycobacterium avium subsp. paratuberculosis
aagcuaguuucacgcucggcgg

SEQ ID NO: 2866271 - RNA, 14 nt, Mycobacterium avium subsp. paratuberculosis
aagcuccacgccgc

SEQ ID NO: 2866272 - RNA, 17 nt, Mycobacterium avium subsp. paratuberculosis
aagcuccacgccgccgg

SEQ ID NO: 2866273 - RNA, 13 nt, Mycobacterium avium subsp. paratuberculosis
aagcugccgacca

SEQ ID NO: 2866274 - RNA, 12 nt, Mycobacterium avium subsp. paratuberculosis
aagcugccguug

SEQ ID NO: 2866275 - RNA, 16 nt, Mycobacterium avium subsp. paratuberculosis
aagcugcgccacaacu

SEQ ID NO: 2866276 - RNA, 22 nt, Mycobacterium avium subsp. paratuberculosis
aagcugggcgcccagaugccgc

SEQ ID NO: 2866277 - RNA, 18 nt, Mycobacterium avium subsp. paratuberculosis
aagcuggucgccaaacug

SEQ ID NO: 2866278 - RNA, 20 nt, Mycobacterium avium subsp. paratuberculosis
aagcuggucgccaaacugcg

SEQ ID NO: 2866279 - RNA, 21 nt, Mycobacterium avium subsp. paratuberculosis
aagcugguggugaucggccag

SEQ ID NO: 2866280 - RNA, 14 nt, Mycobacterium avium subsp. paratuberculosis
aagcugucgccgag

SEQ ID NO: 2866281 - RNA, 16 nt, Mycobacterium avium subsp. paratuberculosis
aagcuguugaccacca

SEQ ID NO: 2866282 - RNA, 23 nt, Mycobacterium avium subsp. paratuberculosis
aagcuucaagauaggagacagcc

SEQ ID NO: 2866283 - RNA, 16 nt, Mycobacterium avium subsp. paratuberculosis
aaggacaagccggaga

SEQ ID NO: 2866284 - RNA, 22 nt, Mycobacterium avium subsp. paratuberculosis
aaggacaagccggagaaggcga

SEQ ID NO: 2866285 - RNA, 16 nt, Mycobacterium avium subsp. paratuberculosis
aaggacgucaggccgg

SEQ ID NO: 2866286 - RNA, 22 nt, Mycobacterium avium subsp. paratuberculosis
aaggacucaaucggucagggug

SEQ ID NO: 2866287 - RNA, 21 nt, Mycobacterium avium subsp. paratuberculosis
aaggacuggcccacgcagccg

SEQ ID NO: 2866288 - RNA, 16 nt, Mycobacterium avium subsp. paratuberculosis
aaggagaaggccgcgc

SEQ ID NO: 2866289 - RNA, 22 nt, Mycobacterium avium subsp. paratuberculosis
aaggagaaggccgcgcgcaucu

SEQ ID NO: 2866290 - RNA, 14 nt, Mycobacterium avium subsp. paratuberculosis
aaggcagcagccau

SEQ ID NO: 2866291 - RNA, 11 nt, Mycobacterium avium subsp. paratuberculosis
aaggcccaccg

SEQ ID NO: 2866292 - RNA, 21 nt, Mycobacterium avium subsp. paratuberculosis
aaggccgcgcgcaucucgaau

SEQ ID NO: 2866293 - RNA, 17 nt, Mycobacterium avium subsp. paratuberculosis
aaggccgcugcccggcg

SEQ ID NO: 2866294 - RNA, 20 nt, Mycobacterium avium subsp. paratuberculosis
aaggccgggguguagcggau

SEQ ID NO: 2866295 - RNA, 12 nt, Mycobacterium avium subsp. paratuberculosis
aaggccugcgcc

SEQ ID NO: 2866296 - RNA, 15 nt, Mycobacterium avium subsp. paratuberculosis
aaggcgaacaccagc

SEQ ID NO: 2866297 - RNA, 16 nt, Mycobacterium avium subsp. paratuberculosis
aaggcgaacaccagcc

SEQ ID NO: 2866298 - RNA, 22 nt, Mycobacterium avium subsp. paratuberculosis
aaggcgaacgggcuggccaggc

SEQ ID NO: 2866299 - RNA, 22 nt, Mycobacterium avium subsp. paratuberculosis
aaggcgcagaagcuaacgccag

SEQ ID NO: 2866300 - RNA, 14 nt, Mycobacterium avium subsp. paratuberculosis
aaggcgccggcgcg

SEQ ID NO: 2866301 - RNA, 13 nt, Mycobacterium avium subsp. paratuberculosis
aaggcggccaccg

SEQ ID NO: 2866302 - RNA, 14 nt, Mycobacterium avium subsp. paratuberculosis
aaggcggccgcgag

SEQ ID NO: 2866303 - RNA, 13 nt, Mycobacterium avium subsp. paratuberculosis
aaggcggcgccgg

SEQ ID NO: 2866304 - RNA, 22 nt, Mycobacterium avium subsp. paratuberculosis
aaggcgucaucguggacaggag

SEQ ID NO: 2866305 - RNA, 15 nt, Mycobacterium avium subsp. paratuberculosis
aaggcucgccacgcg

SEQ ID NO: 2866306 - RNA, 15 nt, Mycobacterium avium subsp. paratuberculosis
aagggaaaggcagca

SEQ ID NO: 2866307 - RNA, 16 nt, Mycobacterium avium subsp. paratuberculosis
aagggaaaggcagcag

SEQ ID NO: 2866308 - RNA, 15 nt, Mycobacterium avium subsp. paratuberculosis
aagggcccaugccgc

SEQ ID NO: 2866309 - RNA, 20 nt, Mycobacterium avium subsp. paratuberculosis
aagggccccggcaucgacau

SEQ ID NO: 2866310 - RNA, 19 nt, Mycobacterium avium subsp. paratuberculosis
aagggcgucacgagcucca

SEQ ID NO: 2866311 - RNA, 20 nt, Mycobacterium avium subsp. paratuberculosis
aagggcuugggcgcgaucgg

SEQ ID NO: 2866312 - RNA, 23 nt, Mycobacterium avium subsp. paratuberculosis
aagggcuugggcgcgaucggcag

SEQ ID NO: 2866313 - RNA, 19 nt, Mycobacterium avium subsp. paratuberculosis
aagggcuuuagaaggccgc

SEQ ID NO: 2866314 - RNA, 12 nt, Mycobacterium avium subsp. paratuberculosis
aaggguuuugcg

SEQ ID NO: 2866315 - RNA, 22 nt, Mycobacterium avium subsp. paratuberculosis
aaggucgaccgcgcaccggcgc

SEQ ID NO: 2866316 - RNA, 18 nt, Mycobacterium avium subsp. paratuberculosis
aaggucugcagcagccgc

SEQ ID NO: 2866317 - RNA, 20 nt, Mycobacterium avium subsp. paratuberculosis
aaggugacgucgccgauggc

SEQ ID NO: 2866318 - RNA, 13 nt, Mycobacterium avium subsp. paratuberculosis
aaggugcccgcau

SEQ ID NO: 2866319 - RNA, 22 nt, Mycobacterium avium subsp. paratuberculosis
aaggugccgcgaugcccgccgg

SEQ ID NO: 2866320 - RNA, 16 nt, Mycobacterium avium subsp. paratuberculosis
aaggugccguccgggu

SEQ ID NO: 2866321 - RNA, 14 nt, Mycobacterium avium subsp. paratuberculosis
aagguguuggugcg

SEQ ID NO: 2866322 - RNA, 14 nt, Mycobacterium avium subsp. paratuberculosis
aaguagccggccag

SEQ ID NO: 2866323 - RNA, 20 nt, Mycobacterium avium subsp. paratuberculosis
aaguagccggcgaucgucgc

SEQ ID NO: 2866324 - RNA, 15 nt, Mycobacterium avium subsp. paratuberculosis
aaguagggccgcagc

SEQ ID NO: 2866325 - RNA, 17 nt, Mycobacterium avium subsp. paratuberculosis
aaguaguacgaccgcga

SEQ ID NO: 2866326 - RNA, 14 nt, Mycobacterium avium subsp. paratuberculosis
aaguaguagcuguu

SEQ ID NO: 2866327 - RNA, 14 nt, Mycobacterium avium subsp. paratuberculosis
aagucagcgcguga

SEQ ID NO: 2866328 - RNA, 19 nt, Mycobacterium avium subsp. paratuberculosis
aaguccgaaacaucaaacg

SEQ ID NO: 2866329 - RNA, 23 nt, Mycobacterium avium subsp. paratuberculosis
aaguccggguccuaucaggacug

SEQ ID NO: 2866330 - RNA, 22 nt, Mycobacterium avium subsp. paratuberculosis
aaguccgggucgcggaucucgu

SEQ ID NO: 2866331 - RNA, 14 nt, Mycobacterium avium subsp. paratuberculosis
aagucgaccggggc

SEQ ID NO: 2866332 - RNA, 12 nt, Mycobacterium avium subsp. paratuberculosis
aagucgagcagg

SEQ ID NO: 2866333 - RNA, 18 nt, Mycobacterium avium subsp. paratuberculosis
aagucgaucccgggugcg

SEQ ID NO: 2866334 - RNA, 16 nt, Mycobacterium avium subsp. paratuberculosis
aagucgccgacgccga

SEQ ID NO: 2866335 - RNA, 13 nt, Mycobacterium avium subsp. paratuberculosis
aagucgccggcca

SEQ ID NO: 2866336 - RNA, 22 nt, Mycobacterium avium subsp. paratuberculosis
aagucgccguccggggccggug

SEQ ID NO: 2866337 - RNA, 17 nt, Mycobacterium avium subsp. paratuberculosis
aagucgggcgcggagaa

SEQ ID NO: 2866338 - RNA, 13 nt, Mycobacterium avium subsp. paratuberculosis
aagucggugcccu

SEQ ID NO: 2866339 - RNA, 21 nt, Mycobacterium avium subsp. paratuberculosis
aagucggugugggucagcgag

SEQ ID NO: 2866340 - RNA, 22 nt, Mycobacterium avium subsp. paratuberculosis
aagucguucagcugcagccggc

SEQ ID NO: 2866341 - RNA, 20 nt, Mycobacterium avium subsp. paratuberculosis
aagucguuggggaugucgaa

SEQ ID NO: 2866342 - RNA, 13 nt, Mycobacterium avium subsp. paratuberculosis
aagucuucggcca

SEQ ID NO: 2866343 - RNA, 15 nt, Mycobacterium avium subsp. paratuberculosis
aagucuucggcgaug

SEQ ID NO: 2866344 - RNA, 17 nt, Mycobacterium avium subsp. paratuberculosis
aagugcccgccucacag

SEQ ID NO: 2866345 - RNA, 18 nt, Mycobacterium avium subsp. paratuberculosis
aagugcccgccucacagc

SEQ ID NO: 2866346 - RNA, 18 nt, Mycobacterium avium subsp. paratuberculosis
aagugccgguccagccgc

SEQ ID NO: 2866347 - RNA, 13 nt, Mycobacterium avium subsp. paratuberculosis
aagugcgccagcg

SEQ ID NO: 2866348 - RNA, 19 nt, Mycobacterium avium subsp. paratuberculosis
aaguguuguuugagaacuc

SEQ ID NO: 2866349 - RNA, 19 nt, Mycobacterium avium subsp. paratuberculosis
aaguucggcgggggcaggg

SEQ ID NO: 2866350 - RNA, 16 nt, Mycobacterium avium subsp. paratuberculosis
aaguucucgcacccgg

SEQ ID NO: 2866351 - RNA, 15 nt, Mycobacterium avium subsp. paratuberculosis
aaguugaucgcggcg

SEQ ID NO: 2866352 - RNA, 19 nt, Mycobacterium avium subsp. paratuberculosis
aaguuggcgucgggcaccu

SEQ ID NO: 2866353 - RNA, 15 nt, Mycobacterium avium subsp. paratuberculosis
aaguuggucaccacc

SEQ ID NO: 2866354 - RNA, 22 nt, Mycobacterium avium subsp. paratuberculosis
aaguuggucaccaccaacgcca

SEQ ID NO: 2866355 - RNA, 17 nt, Mycobacterium avium subsp. paratuberculosis
aaguugguguccacccg

SEQ ID NO: 2866356 - RNA, 13 nt, Mycobacterium avium subsp. paratuberculosis
aauaacgccggcc

SEQ ID NO: 2866357 - RNA, 22 nt, Mycobacterium avium subsp. paratuberculosis
aauacaccguccagcucagcgc

SEQ ID NO: 2866358 - RNA, 16 nt, Mycobacterium avium subsp. paratuberculosis
aauaccacugcgcgcc

SEQ ID NO: 2866359 - RNA, 13 nt, Mycobacterium avium subsp. paratuberculosis
aauacccgaccag

SEQ ID NO: 2866360 - RNA, 19 nt, Mycobacterium avium subsp. paratuberculosis
aauacccgcccagcaccag

SEQ ID NO: 2866361 - RNA, 13 nt, Mycobacterium avium subsp. paratuberculosis
aauaccgccggcc

SEQ ID NO: 2866362 - RNA, 15 nt, Mycobacterium avium subsp. paratuberculosis
aauacggcccggcga

SEQ ID NO: 2866363 - RNA, 16 nt, Mycobacterium avium subsp. paratuberculosis
aauagccgucggcggc

SEQ ID NO: 2866364 - RNA, 17 nt, Mycobacterium avium subsp. paratuberculosis
aaucaccaagcgcgaca

SEQ ID NO: 2866365 - RNA, 21 nt, Mycobacterium avium subsp. paratuberculosis
aaucaccuugcccugcgugca

SEQ ID NO: 2866366 - RNA, 15 nt, Mycobacterium avium subsp. paratuberculosis
aaucacgcaccgucc

SEQ ID NO: 2866367 - RNA, 11 nt, Mycobacterium avium subsp. paratuberculosis
aaucagcagcu

SEQ ID NO: 2866368 - RNA, 13 nt, Mycobacterium avium subsp. paratuberculosis
aauccccccgcgc

SEQ ID NO: 2866369 - RNA, 17 nt, Mycobacterium avium subsp. paratuberculosis
aauccgccguugaccgg

SEQ ID NO: 2866370 - RNA, 21 nt, Mycobacterium avium subsp. paratuberculosis
aauccggccccgcugccgucc

SEQ ID NO: 2866371 - RNA, 19 nt, Mycobacterium avium subsp. paratuberculosis
aauccgggaccggcgucac

SEQ ID NO: 2866372 - RNA, 15 nt, Mycobacterium avium subsp. paratuberculosis
aauccgggugucgac

SEQ ID NO: 2866373 - RNA, 22 nt, Mycobacterium avium subsp. paratuberculosis
aauccgggugucgacgccgggc

SEQ ID NO: 2866374 - RNA, 13 nt, Mycobacterium avium subsp. paratuberculosis
aauccucgccgag

SEQ ID NO: 2866375 - RNA, 14 nt, Mycobacterium avium subsp. paratuberculosis
aauccucgccgagc

SEQ ID NO: 2866376 - RNA, 12 nt, Mycobacterium avium subsp. paratuberculosis
aauccuggccga

SEQ ID NO: 2866377 - RNA, 21 nt, Mycobacterium avium subsp. paratuberculosis
aaucgaccggguuggcgcgca

SEQ ID NO: 2866378 - RNA, 15 nt, Mycobacterium avium subsp. paratuberculosis
aaucgagggcgcgca

SEQ ID NO: 2866379 - RNA, 15 nt, Mycobacterium avium subsp. paratuberculosis
aaucgcagacguagc

SEQ ID NO: 2866380 - RNA, 20 nt, Mycobacterium avium subsp. paratuberculosis
aaucgcagacguagcaccag

SEQ ID NO: 2866381 - RNA, 16 nt, Mycobacterium avium subsp. paratuberculosis
aaucgccccaggcgga

SEQ ID NO: 2866382 - RNA, 14 nt, Mycobacterium avium subsp. paratuberculosis
aaucgcccgcgaaa

SEQ ID NO: 2866383 - RNA, 19 nt, Mycobacterium avium subsp. paratuberculosis
aaucgccgggauauucgcc

SEQ ID NO: 2866384 - RNA, 20 nt, Mycobacterium avium subsp. paratuberculosis
aaucgccuguccgaccagcg

SEQ ID NO: 2866385 - RNA, 19 nt, Mycobacterium avium subsp. paratuberculosis
aaucgccuuggcucgggcc

SEQ ID NO: 2866386 - RNA, 19 nt, Mycobacterium avium subsp. paratuberculosis
aaucgcugcgagcccggcc

SEQ ID NO: 2866387 - RNA, 17 nt, Mycobacterium avium subsp. paratuberculosis
aaucgcugcgcccgccg

SEQ ID NO: 2866388 - RNA, 14 nt, Mycobacterium avium subsp. paratuberculosis
aaucggcgcacagc

SEQ ID NO: 2866389 - RNA, 15 nt, Mycobacterium avium subsp. paratuberculosis
aaucggcgccggcuc

SEQ ID NO: 2866390 - RNA, 15 nt, Mycobacterium avium subsp. paratuberculosis
aaucgguucggccag

SEQ ID NO: 2866391 - RNA, 14 nt, Mycobacterium avium subsp. paratuberculosis
aaucgucggccacg

SEQ ID NO: 2866392 - RNA, 16 nt, Mycobacterium avium subsp. paratuberculosis
aaucgucgggcaccag

SEQ ID NO: 2866393 - RNA, 19 nt, Mycobacterium avium subsp. paratuberculosis
aaucucgaaguggacaugc

SEQ ID NO: 2866394 - RNA, 15 nt, Mycobacterium avium subsp. paratuberculosis
aaucucgucggggcg

SEQ ID NO: 2866395 - RNA, 14 nt, Mycobacterium avium subsp. paratuberculosis
aaugaacgcggcca

SEQ ID NO: 2866396 - RNA, 17 nt, Mycobacterium avium subsp. paratuberculosis
aaugaacgcggccaggg

SEQ ID NO: 2866397 - RNA, 23 nt, Mycobacterium avium subsp. paratuberculosis
aaugagacgacccgagagcugcu

SEQ ID NO: 2866398 - RNA, 23 nt, Mycobacterium avium subsp. paratuberculosis
aaugaugccgacccgcugcagcu

SEQ ID NO: 2866399 - RNA, 14 nt, Mycobacterium avium subsp. paratuberculosis
aaugauggucagcc

SEQ ID NO: 2866400 - RNA, 18 nt, Mycobacterium avium subsp. paratuberculosis
aaugauggucagccgcac

SEQ ID NO: 2866401 - RNA, 16 nt, Mycobacterium avium subsp. paratuberculosis
aaugccgcagccgauc

SEQ ID NO: 2866402 - RNA, 20 nt, Mycobacterium avium subsp. paratuberculosis
aaugccgugccagccggccg

SEQ ID NO: 2866403 - RNA, 21 nt, Mycobacterium avium subsp. paratuberculosis
aaugccgugccagccggccgc

SEQ ID NO: 2866404 - RNA, 16 nt, Mycobacterium avium subsp. paratuberculosis
aaugccuuggcggcgu

SEQ ID NO: 2866405 - RNA, 12 nt, Mycobacterium avium subsp. paratuberculosis
aaugcgccggcg

SEQ ID NO: 2866406 - RNA, 22 nt, Mycobacterium avium subsp. paratuberculosis
aaugcgggcgauggcgggccgc

SEQ ID NO: 2866407 - RNA, 13 nt, Mycobacterium avium subsp. paratuberculosis
aaugcgucgccag

SEQ ID NO: 2866408 - RNA, 14 nt, Mycobacterium avium subsp. paratuberculosis
aaugcgucgcggcg

SEQ ID NO: 2866409 - RNA, 16 nt, Mycobacterium avium subsp. paratuberculosis
aaugcguuccgcgaca

SEQ ID NO: 2866410 - RNA, 14 nt, Mycobacterium avium subsp. paratuberculosis
aauggcaaggccag

SEQ ID NO: 2866411 - RNA, 16 nt, Mycobacterium avium subsp. paratuberculosis
aauggcaaggccagca

SEQ ID NO: 2866412 - RNA, 18 nt, Mycobacterium avium subsp. paratuberculosis
aauggcaaggccagcaac

SEQ ID NO: 2866413 - RNA, 18 nt, Mycobacterium avium subsp. paratuberculosis
aauggcaauacgccucgc

SEQ ID NO: 2866414 - RNA, 11 nt, Mycobacterium avium subsp. paratuberculosis
aauggcagcag

SEQ ID NO: 2866415 - RNA, 13 nt, Mycobacterium avium subsp. paratuberculosis
aauggcagcagcc

SEQ ID NO: 2866416 - RNA, 23 nt, Mycobacterium avium subsp. paratuberculosis
aauggcgaacauggucgcccaca

SEQ ID NO: 2866417 - RNA, 17 nt, Mycobacterium avium subsp. paratuberculosis
aauggcggccgccgcga

SEQ ID NO: 2866418 - RNA, 12 nt, Mycobacterium avium subsp. paratuberculosis
aaugggccaugc

SEQ ID NO: 2866419 - RNA, 20 nt, Mycobacterium avium subsp. paratuberculosis
aauggguguaacgcgucgac

SEQ ID NO: 2866420 - RNA, 17 nt, Mycobacterium avium subsp. paratuberculosis
aaugucauuugagcggc

SEQ ID NO: 2866421 - RNA, 18 nt, Mycobacterium avium subsp. paratuberculosis
aaugucauuugagcggcc

SEQ ID NO: 2866422 - RNA, 16 nt, Mycobacterium avium subsp. paratuberculosis
aaugucgaccaccggg

SEQ ID NO: 2866423 - RNA, 23 nt, Mycobacterium avium subsp. paratuberculosis
aaugucgcccuggauauccagcc

SEQ ID NO: 2866424 - RNA, 17 nt, Mycobacterium avium subsp. paratuberculosis
aauuccucagcccggca

SEQ ID NO: 2866425 - RNA, 15 nt, Mycobacterium avium subsp. paratuberculosis
aauuccucagcgccc

SEQ ID NO: 2866426 - RNA, 22 nt, Mycobacterium avium subsp. paratuberculosis
aauucgaccgucuccaacugca

SEQ ID NO: 2866427 - RNA, 16 nt, Mycobacterium avium subsp. paratuberculosis
aauucgccggggcacc

SEQ ID NO: 2866428 - RNA, 13 nt, Mycobacterium avium subsp. paratuberculosis
aauucgcgcugcc

SEQ ID NO: 2866429 - RNA, 22 nt, Mycobacterium avium subsp. paratuberculosis
aauucggagaccaggucggccu

SEQ ID NO: 2866430 - RNA, 12 nt, Mycobacterium avium subsp. paratuberculosis
aauucggcgauc

SEQ ID NO: 2866431 - RNA, 16 nt, Mycobacterium avium subsp. paratuberculosis
aauucggcgaucucgu

SEQ ID NO: 2866432 - RNA, 14 nt, Mycobacterium avium subsp. paratuberculosis
aauucgggccgccg

SEQ ID NO: 2866433 - RNA, 17 nt, Mycobacterium avium subsp. paratuberculosis
aauucggucagcgcgua

SEQ ID NO: 2866434 - RNA, 23 nt, Mycobacterium avium subsp. paratuberculosis
aauucgguggcgauggugcugcc

SEQ ID NO: 2866435 - RNA, 14 nt, Mycobacterium avium subsp. paratuberculosis
aauucgucggcggu

SEQ ID NO: 2866436 - RNA, 18 nt, Mycobacterium avium subsp. paratuberculosis
aauucuguugucggcucg

SEQ ID NO: 2866437 - RNA, 20 nt, Mycobacterium avium subsp. paratuberculosis
aauugagguagucggcccag

SEQ ID NO: 2866438 - RNA, 19 nt, Mycobacterium avium subsp. paratuberculosis
aauugcuuuuugaccaccg

SEQ ID NO: 2866439 - RNA, 23 nt, Mycobacterium avium subsp. paratuberculosis
aauugcuuuuugaccaccggcac

SEQ ID NO: 2866440 - RNA, 13 nt, Mycobacterium avium subsp. paratuberculosis
aauuguggcggcc

SEQ ID NO: 2866441 - RNA, 22 nt, Mycobacterium avium subsp. paratuberculosis
aauuuaugaugccaguuuuugg

SEQ ID NO: 2866442 - RNA, 13 nt, Mycobacterium avium subsp. paratuberculosis
acaaacagcgcgg

SEQ ID NO: 2866443 - RNA, 23 nt, Mycobacterium avium subsp. paratuberculosis
acaaagccggucacgcugaucga

SEQ ID NO: 2866444 - RNA, 15 nt, Mycobacterium avium subsp. paratuberculosis
acaacaccaccucuu

SEQ ID NO: 2866445 - RNA, 15 nt, Mycobacterium avium subsp. paratuberculosis
acaacagggccgcgc

SEQ ID NO: 2866446 - RNA, 22 nt, Mycobacterium avium subsp. paratuberculosis
acaacagggccgcgcgggcgac

SEQ ID NO: 2866447 - RNA, 21 nt, Mycobacterium avium subsp. paratuberculosis
acaacauccgcgacgacacca

SEQ ID NO: 2866448 - RNA, 18 nt, Mycobacterium avium subsp. paratuberculosis
acaacccggacagcgcga

SEQ ID NO: 2866449 - RNA, 21 nt, Mycobacterium avium subsp. paratuberculosis
acaaccgauguggacgaugcg

SEQ ID NO: 2866450 - RNA, 15 nt, Mycobacterium avium subsp. paratuberculosis
acaaccgcugcugcu

SEQ ID NO: 2866451 - RNA, 20 nt, Mycobacterium avium subsp. paratuberculosis
acaaccguugaggcgagccg

SEQ ID NO: 2866452 - RNA, 14 nt, Mycobacterium avium subsp. paratuberculosis
acaacgacagcacc

SEQ ID NO: 2866453 - RNA, 23 nt, Mycobacterium avium subsp. paratuberculosis
acaacgccuccgaauccagcgcg

SEQ ID NO: 2866454 - RNA, 12 nt, Mycobacterium avium subsp. paratuberculosis
acaacgcgcagc

SEQ ID NO: 2866455 - RNA, 18 nt, Mycobacterium avium subsp. paratuberculosis
acaacgcggugaccgcgg

SEQ ID NO: 2866456 - RNA, 20 nt, Mycobacterium avium subsp. paratuberculosis
acaacggaucgagcgcaccg

SEQ ID NO: 2866457 - RNA, 18 nt, Mycobacterium avium subsp. paratuberculosis
acaacggcggaccggcgg

SEQ ID NO: 2866458 - RNA, 21 nt, Mycobacterium avium subsp. paratuberculosis
acaacgucucugucgucgacc

SEQ ID NO: 2866459 - RNA, 17 nt, Mycobacterium avium subsp. paratuberculosis
acaacuacgagcagcaa

SEQ ID NO: 2866460 - RNA, 17 nt, Mycobacterium avium subsp. paratuberculosis
acaacucgaagcugcgc

SEQ ID NO: 2866461 - RNA, 20 nt, Mycobacterium avium subsp. paratuberculosis
acaacucgaagcugcgccac

SEQ ID NO: 2866462 - RNA, 21 nt, Mycobacterium avium subsp. paratuberculosis
acaacucgacgcucggcgaug

SEQ ID NO: 2866463 - RNA, 19 nt, Mycobacterium avium subsp. paratuberculosis
acaacucgccggagcgccc

SEQ ID NO: 2866464 - RNA, 21 nt, Mycobacterium avium subsp. paratuberculosis
acaacucgccggagcgcccca

SEQ ID NO: 2866465 - RNA, 23 nt, Mycobacterium avium subsp. paratuberculosis
acaacuggucgugcucgucggcg

SEQ ID NO: 2866466 - RNA, 13 nt, Mycobacterium avium subsp. paratuberculosis
acaacuucggggu

SEQ ID NO: 2866467 - RNA, 22 nt, Mycobacterium avium subsp. paratuberculosis
acaaggucgaccgcgcaccggc

SEQ ID NO: 2866468 - RNA, 15 nt, Mycobacterium avium subsp. paratuberculosis
acaauccggucagcg

SEQ ID NO: 2866469 - RNA, 18 nt, Mycobacterium avium subsp. paratuberculosis
acaaucgcugcgagcccg

SEQ ID NO: 2866470 - RNA, 23 nt, Mycobacterium avium subsp. paratuberculosis
acaaucucgggcaccccugccgc

SEQ ID NO: 2866471 - RNA, 21 nt, Mycobacterium avium subsp. paratuberculosis
acaauggauccgaucagcagc

SEQ ID NO: 2866472 - RNA, 16 nt, Mycobacterium avium subsp. paratuberculosis
acaauggccccggcgu

SEQ ID NO: 2866473 - RNA, 18 nt, Mycobacterium avium subsp. paratuberculosis
acaauguuuuucugcucu

SEQ ID NO: 2866474 - RNA, 12 nt, Mycobacterium avium subsp. paratuberculosis
acacacaggucg

SEQ ID NO: 2866475 - RNA, 21 nt, Mycobacterium avium subsp. paratuberculosis
acacacaggucgcccggcucg

SEQ ID NO: 2866476 - RNA, 12 nt, Mycobacterium avium subsp. paratuberculosis
acacagcaccgg

SEQ ID NO: 2866477 - RNA, 16 nt, Mycobacterium avium subsp. paratuberculosis
acacagcacgcccugg

SEQ ID NO: 2866478 - RNA, 11 nt, Mycobacterium avium subsp. paratuberculosis
acacagcagca

SEQ ID NO: 2866479 - RNA, 15 nt, Mycobacterium avium subsp. paratuberculosis
acacagcagcacgcc

SEQ ID NO: 2866480 - RNA, 22 nt, Mycobacterium avium subsp. paratuberculosis
acacagcagcacgcccagcccg

SEQ ID NO: 2866481 - RNA, 12 nt, Mycobacterium avium subsp. paratuberculosis
acacagcagcag

SEQ ID NO: 2866482 - RNA, 13 nt, Mycobacterium avium subsp. paratuberculosis
acacagcagcagc

SEQ ID NO: 2866483 - RNA, 23 nt, Mycobacterium avium subsp. paratuberculosis
acacagccaaagccuacggcgcc

SEQ ID NO: 2866484 - RNA, 16 nt, Mycobacterium avium subsp. paratuberculosis
acacagccgcuuggcg

SEQ ID NO: 2866485 - RNA, 21 nt, Mycobacterium avium subsp. paratuberculosis
acacagccgcuuggcgcgccg

SEQ ID NO: 2866486 - RNA, 14 nt, Mycobacterium avium subsp. paratuberculosis
acacaggaccagca

SEQ ID NO: 2866487 - RNA, 16 nt, Mycobacterium avium subsp. paratuberculosis
acacaggucgcccggc

SEQ ID NO: 2866488 - RNA, 12 nt, Mycobacterium avium subsp. paratuberculosis
acacaucguggc

SEQ ID NO: 2866489 - RNA, 13 nt, Mycobacterium avium subsp. paratuberculosis
acacaucguggcg

SEQ ID NO: 2866490 - RNA, 15 nt, Mycobacterium avium subsp. paratuberculosis
acacaugguccugca

SEQ ID NO: 2866491 - RNA, 14 nt, Mycobacterium avium subsp. paratuberculosis
acaccaacgacagc

SEQ ID NO: 2866492 - RNA, 14 nt, Mycobacterium avium subsp. paratuberculosis
acaccaccaccgag

SEQ ID NO: 2866493 - RNA, 23 nt, Mycobacterium avium subsp. paratuberculosis
acaccaccaccgagccggcgucg

SEQ ID NO: 2866494 - RNA, 15 nt, Mycobacterium avium subsp. paratuberculosis
acaccaccagcgagg

SEQ ID NO: 2866495 - RNA, 14 nt, Mycobacterium avium subsp. paratuberculosis
acaccaccaggccg

SEQ ID NO: 2866496 - RNA, 13 nt, Mycobacterium avium subsp. paratuberculosis
acaccaccgacgc

SEQ ID NO: 2866497 - RNA, 14 nt, Mycobacterium avium subsp. paratuberculosis
acaccaccgacgcg

SEQ ID NO: 2866498 - RNA, 21 nt, Mycobacterium avium subsp. paratuberculosis
acaccaccgacgcgucgcggc

SEQ ID NO: 2866499 - RNA, 22 nt, Mycobacterium avium subsp. paratuberculosis
acaccaccgacgcgucgcggcg

SEQ ID NO: 2866500 - RNA, 13 nt, Mycobacterium avium subsp. paratuberculosis
acaccaccgccag

SEQ ID NO: 2866501 - RNA, 12 nt, Mycobacterium avium subsp. paratuberculosis
acaccaccgcgc

SEQ ID NO: 2866502 - RNA, 20 nt, Mycobacterium avium subsp. paratuberculosis
acaccaccggcaaccgccac

SEQ ID NO: 2866503 - RNA, 12 nt, Mycobacterium avium subsp. paratuberculosis
acaccaccggcc

SEQ ID NO: 2866504 - RNA, 14 nt, Mycobacterium avium subsp. paratuberculosis
acaccaccggccgc

SEQ ID NO: 2866505 - RNA, 19 nt, Mycobacterium avium subsp. paratuberculosis
acaccaccggccgcccggc

SEQ ID NO: 2866506 - RNA, 21 nt, Mycobacterium avium subsp. paratuberculosis
acaccaccggccgcccggcga

SEQ ID NO: 2866507 - RNA, 14 nt, Mycobacterium avium subsp. paratuberculosis
acaccaccgugcug

SEQ ID NO: 2866508 - RNA, 21 nt, Mycobacterium avium subsp. paratuberculosis
acaccaccgugcuggccacca

SEQ ID NO: 2866509 - RNA, 15 nt, Mycobacterium avium subsp. paratuberculosis
acaccaccugcacgg

SEQ ID NO: 2866510 - RNA, 16 nt, Mycobacterium avium subsp. paratuberculosis
acaccaccuugguggc

SEQ ID NO: 2866511 - RNA, 20 nt, Mycobacterium avium subsp. paratuberculosis
acaccaccuugguggccgcg

SEQ ID NO: 2866512 - RNA, 14 nt, Mycobacterium avium subsp. paratuberculosis
acaccacggccggc

SEQ ID NO: 2866513 - RNA, 17 nt, Mycobacterium avium subsp. paratuberculosis
acaccacggccggcaac

SEQ ID NO: 2866514 - RNA, 18 nt, Mycobacterium avium subsp. paratuberculosis
acaccacgguccccgcgc

SEQ ID NO: 2866515 - RNA, 16 nt, Mycobacterium avium subsp. paratuberculosis
acaccacggucgccgc

SEQ ID NO: 2866516 - RNA, 21 nt, Mycobacterium avium subsp. paratuberculosis
acaccacggugaacgggccgc

SEQ ID NO: 2866517 - RNA, 14 nt, Mycobacterium avium subsp. paratuberculosis
acaccacgguggcg

SEQ ID NO: 2866518 - RNA, 15 nt, Mycobacterium avium subsp. paratuberculosis
acaccacgguggcgu

SEQ ID NO: 2866519 - RNA, 16 nt, Mycobacterium avium subsp. paratuberculosis
acaccacguagccgac

SEQ ID NO: 2866520 - RNA, 13 nt, Mycobacterium avium subsp. paratuberculosis
acaccacgucguc

SEQ ID NO: 2866521 - RNA, 16 nt, Mycobacterium avium subsp. paratuberculosis
acaccacgucgucggc

SEQ ID NO: 2866522 - RNA, 19 nt, Mycobacterium avium subsp. paratuberculosis
acaccagaugccgcucggc

SEQ ID NO: 2866523 - RNA, 11 nt, Mycobacterium avium subsp. paratuberculosis
acaccagcacc

SEQ ID NO: 2866524 - RNA, 16 nt, Mycobacterium avium subsp. paratuberculosis
acaccagcacggcggc

SEQ ID NO: 2866525 - RNA, 17 nt, Mycobacterium avium subsp. paratuberculosis
acaccagcacggcggcg

SEQ ID NO: 2866526 - RNA, 14 nt, Mycobacterium avium subsp. paratuberculosis
acaccagcccggcc

SEQ ID NO: 2866527 - RNA, 17 nt, Mycobacterium avium subsp. paratuberculosis
acaccagcgcgcacgcg

SEQ ID NO: 2866528 - RNA, 21 nt, Mycobacterium avium subsp. paratuberculosis
acaccagcggucggcgguucg

SEQ ID NO: 2866529 - RNA, 24 nt, Mycobacterium avium subsp. paratuberculosis
acaccagcguguugagcucgcggc

SEQ ID NO: 2866530 - RNA, 22 nt, Mycobacterium avium subsp. paratuberculosis
acaccagcuggauggcgcccag

SEQ ID NO: 2866531 - RNA, 19 nt, Mycobacterium avium subsp. paratuberculosis
acaccagggugcgcacgau

SEQ ID NO: 2866532 - RNA, 15 nt, Mycobacterium avium subsp. paratuberculosis
acaccagguaggcgg

SEQ ID NO: 2866533 - RNA, 20 nt, Mycobacterium avium subsp. paratuberculosis
acaccagguaggcgguggcg

SEQ ID NO: 2866534 - RNA, 22 nt, Mycobacterium avium subsp. paratuberculosis
acacccacgaacgucugcggga

SEQ ID NO: 2866535 - RNA, 20 nt, Mycobacterium avium subsp. paratuberculosis
acacccagaugcccagcggc

SEQ ID NO: 2866536 - RNA, 13 nt, Mycobacterium avium subsp. paratuberculosis
acacccagccgcu

SEQ ID NO: 2866537 - RNA, 12 nt, Mycobacterium avium subsp. paratuberculosis
acacccagcgcc

SEQ ID NO: 2866538 - RNA, 13 nt, Mycobacterium avium subsp. paratuberculosis
acacccagcgcca

SEQ ID NO: 2866539 - RNA, 14 nt, Mycobacterium avium subsp. paratuberculosis
acacccaugacccg

SEQ ID NO: 2866540 - RNA, 21 nt, Mycobacterium avium subsp. paratuberculosis
acaccccgaccgacgcgguca

SEQ ID NO: 2866541 - RNA, 12 nt, Mycobacterium avium subsp. paratuberculosis
acaccccgcgag

SEQ ID NO: 2866542 - RNA, 22 nt, Mycobacterium avium subsp. paratuberculosis
acaccccgcgagucaccggcuc

SEQ ID NO: 2866543 - RNA, 23 nt, Mycobacterium avium subsp. paratuberculosis
acaccccgcgagucaccggcucg

SEQ ID NO: 2866544 - RNA, 22 nt, Mycobacterium avium subsp. paratuberculosis
acaccccgcgggaguccacgcc

SEQ ID NO: 2866545 - RNA, 14 nt, Mycobacterium avium subsp. paratuberculosis
acaccccgcucggc

SEQ ID NO: 2866546 - RNA, 15 nt, Mycobacterium avium subsp. paratuberculosis
acaccccgcucggcc

SEQ ID NO: 2866547 - RNA, 21 nt, Mycobacterium avium subsp. paratuberculosis
acaccccgcucggccagcgcg

SEQ ID NO: 2866548 - RNA, 13 nt, Mycobacterium avium subsp. paratuberculosis
acaccccggccac

SEQ ID NO: 2866549 - RNA, 17 nt, Mycobacterium avium subsp. paratuberculosis
acaccccggccaccagg

SEQ ID NO: 2866550 - RNA, 13 nt, Mycobacterium avium subsp. paratuberculosis
acacccgucgacu

SEQ ID NO: 2866551 - RNA, 20 nt, Mycobacterium avium subsp. paratuberculosis
acacccgucgacucggcggu

SEQ ID NO: 2866552 - RNA, 11 nt, Mycobacterium avium subsp. paratuberculosis
acacccucacc

SEQ ID NO: 2866553 - RNA, 19 nt, Mycobacterium avium subsp. paratuberculosis
acacccucaccccgcccag

SEQ ID NO: 2866554 - RNA, 12 nt, Mycobacterium avium subsp. paratuberculosis
acacccucggcc

SEQ ID NO: 2866555 - RNA, 13 nt, Mycobacterium avium subsp. paratuberculosis
acacccugcgcca

SEQ ID NO: 2866556 - RNA, 22 nt, Mycobacterium avium subsp. paratuberculosis
acacccuuuuccaucugggcgc

SEQ ID NO: 2866557 - RNA, 12 nt, Mycobacterium avium subsp. paratuberculosis
acaccgaaagcc

SEQ ID NO: 2866558 - RNA, 14 nt, Mycobacterium avium subsp. paratuberculosis
acaccgaaagccga

SEQ ID NO: 2866559 - RNA, 18 nt, Mycobacterium avium subsp. paratuberculosis
acaccgaaagccgacacc

SEQ ID NO: 2866560 - RNA, 21 nt, Mycobacterium avium subsp. paratuberculosis
acaccgaaagccguagcgcaa

SEQ ID NO: 2866561 - RNA, 20 nt, Mycobacterium avium subsp. paratuberculosis
acaccgaacccaccagcgcc

SEQ ID NO: 2866562 - RNA, 19 nt, Mycobacterium avium subsp. paratuberculosis
acaccgaaccgccccgcgc

SEQ ID NO: 2866563 - RNA, 20 nt, Mycobacterium avium subsp. paratuberculosis
acaccgaaccgccccgcgcg

SEQ ID NO: 2866564 - RNA, 22 nt, Mycobacterium avium subsp. paratuberculosis
acaccgaaccgccccgcgcgau

SEQ ID NO: 2866565 - RNA, 24 nt, Mycobacterium avium subsp. paratuberculosis
acaccgaaccgccccgcgcgauca

SEQ ID NO: 2866566 - RNA, 15 nt, Mycobacterium avium subsp. paratuberculosis
acaccgaacgccgag

SEQ ID NO: 2866567 - RNA, 18 nt, Mycobacterium avium subsp. paratuberculosis
acaccgaagaaccccgag

SEQ ID NO: 2866568 - RNA, 20 nt, Mycobacterium avium subsp. paratuberculosis
acaccgaauuguccagcagu

SEQ ID NO: 2866569 - RNA, 15 nt, Mycobacterium avium subsp. paratuberculosis
acaccgacaccggcc

SEQ ID NO: 2866570 - RNA, 16 nt, Mycobacterium avium subsp. paratuberculosis
acaccgacaccggccg

SEQ ID NO: 2866571 - RNA, 18 nt, Mycobacterium avium subsp. paratuberculosis
acaccgacaccggccggg

SEQ ID NO: 2866572 - RNA, 17 nt, Mycobacterium avium subsp. paratuberculosis
acaccgcauuugccgac

SEQ ID NO: 2866573 - RNA, 15 nt, Mycobacterium avium subsp. paratuberculosis
acaccgccagcagcg

SEQ ID NO: 2866574 - RNA, 20 nt, Mycobacterium avium subsp. paratuberculosis
acaccgccagcagcgccgcu

SEQ ID NO: 2866575 - RNA, 13 nt, Mycobacterium avium subsp. paratuberculosis
acaccgccccgcc

SEQ ID NO: 2866576 - RNA, 22 nt, Mycobacterium avium subsp. paratuberculosis
acaccgccccgccgcgccgggc

SEQ ID NO: 2866577 - RNA, 14 nt, Mycobacterium avium subsp. paratuberculosis
acaccgccgcggcg

SEQ ID NO: 2866578 - RNA, 17 nt, Mycobacterium avium subsp. paratuberculosis
acaccgccgcggcggug

SEQ ID NO: 2866579 - RNA, 14 nt, Mycobacterium avium subsp. paratuberculosis
acaccgccggcgcg

SEQ ID NO: 2866580 - RNA, 20 nt, Mycobacterium avium subsp. paratuberculosis
acaccgccuucgacggccgg

SEQ ID NO: 2866581 - RNA, 20 nt, Mycobacterium avium subsp. paratuberculosis
acaccgccuugcccggcucg

SEQ ID NO: 2866582 - RNA, 21 nt, Mycobacterium avium subsp. paratuberculosis
acaccgccuugcccggcucgg

SEQ ID NO: 2866583 - RNA, 20 nt, Mycobacterium avium subsp. paratuberculosis
acaccgcgcagaaccgcacc

SEQ ID NO: 2866584 - RNA, 23 nt, Mycobacterium avium subsp. paratuberculosis
acaccgcgcugagcaggcuggca

SEQ ID NO: 2866585 - RNA, 14 nt, Mycobacterium avium subsp. paratuberculosis
acaccgcggccagc

SEQ ID NO: 2866586 - RNA, 17 nt, Mycobacterium avium subsp. paratuberculosis
acaccgcggccagcgcg

SEQ ID NO: 2866587 - RNA, 18 nt, Mycobacterium avium subsp. paratuberculosis
acaccgcggccagcgcgc

SEQ ID NO: 2866588 - RNA, 19 nt, Mycobacterium avium subsp. paratuberculosis
acaccgcggcggcgucggc

SEQ ID NO: 2866589 - RNA, 14 nt, Mycobacterium avium subsp. paratuberculosis
acaccgcguuggcc

SEQ ID NO: 2866590 - RNA, 17 nt, Mycobacterium avium subsp. paratuberculosis
acaccgcguuggccgcc

SEQ ID NO: 2866591 - RNA, 14 nt, Mycobacterium avium subsp. paratuberculosis
acaccgcuggccga

SEQ ID NO: 2866592 - RNA, 17 nt, Mycobacterium avium subsp. paratuberculosis
acaccgcuggccgaggc

SEQ ID NO: 2866593 - RNA, 18 nt, Mycobacterium avium subsp. paratuberculosis
acaccgcuggccgaggcc

SEQ ID NO: 2866594 - RNA, 13 nt, Mycobacterium avium subsp. paratuberculosis
acaccgcugucgg

SEQ ID NO: 2866595 - RNA, 23 nt, Mycobacterium avium subsp. paratuberculosis
acaccggacugcuugggcgccuc

SEQ ID NO: 2866596 - RNA, 17 nt, Mycobacterium avium subsp. paratuberculosis
acaccggaucggcugcg

SEQ ID NO: 2866597 - RNA, 20 nt, Mycobacterium avium subsp. paratuberculosis
acaccggaucggcugcgggc

SEQ ID NO: 2866598 - RNA, 21 nt, Mycobacterium avium subsp. paratuberculosis
acaccggauggcuguggauga

SEQ ID NO: 2866599 - RNA, 22 nt, Mycobacterium avium subsp. paratuberculosis
acaccggcacgaucgucgccgc

SEQ ID NO: 2866600 - RNA, 16 nt, Mycobacterium avium subsp. paratuberculosis
acaccggcacgucggc

SEQ ID NO: 2866601 - RNA, 20 nt, Mycobacterium avium subsp. paratuberculosis
acaccggcacgucggccacg

SEQ ID NO: 2866602 - RNA, 16 nt, Mycobacterium avium subsp. paratuberculosis
acaccggcagcgccac

SEQ ID NO: 2866603 - RNA, 14 nt, Mycobacterium avium subsp. paratuberculosis
acaccggccgggac

SEQ ID NO: 2866604 - RNA, 23 nt, Mycobacterium avium subsp. paratuberculosis
acaccggcgaggugaaccgcgac

SEQ ID NO: 2866605 - RNA, 13 nt, Mycobacterium avium subsp. paratuberculosis
acaccggcgcgac

SEQ ID NO: 2866606 - RNA, 16 nt, Mycobacterium avium subsp. paratuberculosis
acaccggcgcgaccac

SEQ ID NO: 2866607 - RNA, 14 nt, Mycobacterium avium subsp. paratuberculosis
acaccggcggcgac

SEQ ID NO: 2866608 - RNA, 22 nt, Mycobacterium avium subsp. paratuberculosis
acaccggcgugaugacggcggc

SEQ ID NO: 2866609 - RNA, 23 nt, Mycobacterium avium subsp. paratuberculosis
acaccggcgugaugacggcggcg

SEQ ID NO: 2866610 - RNA, 16 nt, Mycobacterium avium subsp. paratuberculosis
acaccggcucgcugau

SEQ ID NO: 2866611 - RNA, 14 nt, Mycobacterium avium subsp. paratuberculosis
acaccggcugaccg

SEQ ID NO: 2866612 - RNA, 15 nt, Mycobacterium avium subsp. paratuberculosis
acaccggcugaccgg

SEQ ID NO: 2866613 - RNA, 17 nt, Mycobacterium avium subsp. paratuberculosis
acaccgggauccggcgc

SEQ ID NO: 2866614 - RNA, 22 nt, Mycobacterium avium subsp. paratuberculosis
acaccgggauccggcgcgccgc

SEQ ID NO: 2866615 - RNA, 17 nt, Mycobacterium avium subsp. paratuberculosis
acaccgggaucggcggc

SEQ ID NO: 2866616 - RNA, 16 nt, Mycobacterium avium subsp. paratuberculosis
acaccgggaucggggu

SEQ ID NO: 2866617 - RNA, 17 nt, Mycobacterium avium subsp. paratuberculosis
acaccgggcaccgacau

SEQ ID NO: 2866618 - RNA, 15 nt, Mycobacterium avium subsp. paratuberculosis
acaccggggccaggu

SEQ ID NO: 2866619 - RNA, 18 nt, Mycobacterium avium subsp. paratuberculosis
acaccggggccagguacu

SEQ ID NO: 2866620 - RNA, 17 nt, Mycobacterium avium subsp. paratuberculosis
acaccgggucccccgcc

SEQ ID NO: 2866621 - RNA, 21 nt, Mycobacterium avium subsp. paratuberculosis
acaccgggucccccgccgacc

SEQ ID NO: 2866622 - RNA, 19 nt, Mycobacterium avium subsp. paratuberculosis
acaccgggugcguccagac

SEQ ID NO: 2866623 - RNA, 22 nt, Mycobacterium avium subsp. paratuberculosis
acaccgggugcguccagaccgg

SEQ ID NO: 2866624 - RNA, 15 nt, Mycobacterium avium subsp. paratuberculosis
acaccgguccggccg

SEQ ID NO: 2866625 - RNA, 18 nt, Mycobacterium avium subsp. paratuberculosis
acaccgguccggccgugc

SEQ ID NO: 2866626 - RNA, 17 nt, Mycobacterium avium subsp. paratuberculosis
acaccgguugcgccgag

SEQ ID NO: 2866627 - RNA, 16 nt, Mycobacterium avium subsp. paratuberculosis
acaccguccagcucag

SEQ ID NO: 2866628 - RNA, 19 nt, Mycobacterium avium subsp. paratuberculosis
acaccguccagcucagcgc

SEQ ID NO: 2866629 - RNA, 21 nt, Mycobacterium avium subsp. paratuberculosis
acaccguccagcucagcgcgc

SEQ ID NO: 2866630 - RNA, 23 nt, Mycobacterium avium subsp. paratuberculosis
acaccguccagcucagcgcgcac

SEQ ID NO: 2866631 - RNA, 14 nt, Mycobacterium avium subsp. paratuberculosis
acaccgucgacgac

SEQ ID NO: 2866632 - RNA, 16 nt, Mycobacterium avium subsp. paratuberculosis
acaccgucgcccgccc

SEQ ID NO: 2866633 - RNA, 18 nt, Mycobacterium avium subsp. paratuberculosis
acaccgucgcccgcccag

SEQ ID NO: 2866634 - RNA, 15 nt, Mycobacterium avium subsp. paratuberculosis
acaccgucgcgcacc

SEQ ID NO: 2866635 - RNA, 13 nt, Mycobacterium avium subsp. paratuberculosis
acaccgucggcga

SEQ ID NO: 2866636 - RNA, 14 nt, Mycobacterium avium subsp. paratuberculosis
acaccgucggcgau

SEQ ID NO: 2866637 - RNA, 16 nt, Mycobacterium avium subsp. paratuberculosis
acaccgugcccgagcc

SEQ ID NO: 2866638 - RNA, 12 nt, Mycobacterium avium subsp. paratuberculosis
acaccgugccgu

SEQ ID NO: 2866639 - RNA, 13 nt, Mycobacterium avium subsp. paratuberculosis
acaccgugccguc

SEQ ID NO: 2866640 - RNA, 14 nt, Mycobacterium avium subsp. paratuberculosis
acaccgugccguca

SEQ ID NO: 2866641 - RNA, 18 nt, Mycobacterium avium subsp. paratuberculosis
acaccgugccgucacgcc

SEQ ID NO: 2866642 - RNA, 13 nt, Mycobacterium avium subsp. paratuberculosis
acaccgugguggc

SEQ ID NO: 2866643 - RNA, 16 nt, Mycobacterium avium subsp. paratuberculosis
acaccgugguggcggc

SEQ ID NO: 2866644 - RNA, 17 nt, Mycobacterium avium subsp. paratuberculosis
acaccgugguggcggcg

SEQ ID NO: 2866645 - RNA, 21 nt, Mycobacterium avium subsp. paratuberculosis
acaccuccuuggguucggcgg

SEQ ID NO: 2866646 - RNA, 23 nt, Mycobacterium avium subsp. paratuberculosis
acaccuccuuggguucggcggcg

SEQ ID NO: 2866647 - RNA, 22 nt, Mycobacterium avium subsp. paratuberculosis
acaccucgaagccgaucgcggc

SEQ ID NO: 2866648 - RNA, 16 nt, Mycobacterium avium subsp. paratuberculosis
acaccucgccuccagc

SEQ ID NO: 2866649 - RNA, 18 nt, Mycobacterium avium subsp. paratuberculosis
acaccucggccagcgccg

SEQ ID NO: 2866650 - RNA, 22 nt, Mycobacterium avium subsp. paratuberculosis
acaccucggccagcgccgcgcg

SEQ ID NO: 2866651 - RNA, 12 nt, Mycobacterium avium subsp. paratuberculosis
acaccucggcga

SEQ ID NO: 2866652 - RNA, 18 nt, Mycobacterium avium subsp. paratuberculosis
acaccucggcgaccucgg

SEQ ID NO: 2866653 - RNA, 14 nt, Mycobacterium avium subsp. paratuberculosis
acaccucggcgacg

SEQ ID NO: 2866654 - RNA, 14 nt, Mycobacterium avium subsp. paratuberculosis
acaccucggcgaug

SEQ ID NO: 2866655 - RNA, 13 nt, Mycobacterium avium subsp. paratuberculosis
acaccucggucgg

SEQ ID NO: 2866656 - RNA, 14 nt, Mycobacterium avium subsp. paratuberculosis
acaccugcaucacg

SEQ ID NO: 2866657 - RNA, 14 nt, Mycobacterium avium subsp. paratuberculosis
acaccugcggcggc

SEQ ID NO: 2866658 - RNA, 17 nt, Mycobacterium avium subsp. paratuberculosis
acaccuuccaccaccgc

SEQ ID NO: 2866659 - RNA, 19 nt, Mycobacterium avium subsp. paratuberculosis
acaccuucgcggucggcaa

SEQ ID NO: 2866660 - RNA, 11 nt, Mycobacterium avium subsp. paratuberculosis
acaccuuggcu

SEQ ID NO: 2866661 - RNA, 15 nt, Mycobacterium avium subsp. paratuberculosis
acacgaacccggcgg

SEQ ID NO: 2866662 - RNA, 16 nt, Mycobacterium avium subsp. paratuberculosis
acacgaacccggcggc

SEQ ID NO: 2866663 - RNA, 16 nt, Mycobacterium avium subsp. paratuberculosis
acacgaacgacgcggc

SEQ ID NO: 2866664 - RNA, 22 nt, Mycobacterium avium subsp. paratuberculosis
acacgaauacccuccgggcggc

SEQ ID NO: 2866665 - RNA, 20 nt, Mycobacterium avium subsp. paratuberculosis
acacgaauacccuucggccg

SEQ ID NO: 2866666 - RNA, 22 nt, Mycobacterium avium subsp. paratuberculosis
acacgaauacccuucggccggc

SEQ ID NO: 2866667 - RNA, 13 nt, Mycobacterium avium subsp. paratuberculosis
acacgaccgccug

SEQ ID NO: 2866668 - RNA, 22 nt, Mycobacterium avium subsp. paratuberculosis
acacgagcagacccgccgcggc

SEQ ID NO: 2866669 - RNA, 12 nt, Mycobacterium avium subsp. paratuberculosis
acacgaucggca

SEQ ID NO: 2866670 - RNA, 14 nt, Mycobacterium avium subsp. paratuberculosis
acacgaucggcaug

SEQ ID NO: 2866671 - RNA, 16 nt, Mycobacterium avium subsp. paratuberculosis
acacgaucucggucgc

SEQ ID NO: 2866672 - RNA, 19 nt, Mycobacterium avium subsp. paratuberculosis
acacgaucucguagguggc

SEQ ID NO: 2866673 - RNA, 20 nt, Mycobacterium avium subsp. paratuberculosis
acacgaucucguagguggcc

SEQ ID NO: 2866674 - RNA, 19 nt, Mycobacterium avium subsp. paratuberculosis
acacgaugcccuuggccag

SEQ ID NO: 2866675 - RNA, 20 nt, Mycobacterium avium subsp. paratuberculosis
acacgaugcccuuggccagc

SEQ ID NO: 2866676 - RNA, 20 nt, Mycobacterium avium subsp. paratuberculosis
acacgaugcgcugugcgggu

SEQ ID NO: 2866677 - RNA, 13 nt, Mycobacterium avium subsp. paratuberculosis
acacgcccagcgc

SEQ ID NO: 2866678 - RNA, 15 nt, Mycobacterium avium subsp. paratuberculosis
acacgcccagcgccg

SEQ ID NO: 2866679 - RNA, 16 nt, Mycobacterium avium subsp. paratuberculosis
acacgcccagcgccgc

SEQ ID NO: 2866680 - RNA, 17 nt, Mycobacterium avium subsp. paratuberculosis
acacgcccagcgccgcg

SEQ ID NO: 2866681 - RNA, 18 nt, Mycobacterium avium subsp. paratuberculosis
acacgcccagcgccgcgu

SEQ ID NO: 2866682 - RNA, 14 nt, Mycobacterium avium subsp. paratuberculosis
acacgccccggcgg

SEQ ID NO: 2866683 - RNA, 16 nt, Mycobacterium avium subsp. paratuberculosis
acacgccccggcgggu

SEQ ID NO: 2866684 - RNA, 15 nt, Mycobacterium avium subsp. paratuberculosis
acacgcccugcaggu

SEQ ID NO: 2866685 - RNA, 16 nt, Mycobacterium avium subsp. paratuberculosis
acacgcccugcagguu

SEQ ID NO: 2866686 - RNA, 20 nt, Mycobacterium avium subsp. paratuberculosis
acacgccgacgauccgcgcc

SEQ ID NO: 2866687 - RNA, 15 nt, Mycobacterium avium subsp. paratuberculosis
acacgccgcgcauca

SEQ ID NO: 2866688 - RNA, 21 nt, Mycobacterium avium subsp. paratuberculosis
acacgccggccguucgccggc

SEQ ID NO: 2866689 - RNA, 23 nt, Mycobacterium avium subsp. paratuberculosis
acacgccggccguucgccggcca

SEQ ID NO: 2866690 - RNA, 21 nt, Mycobacterium avium subsp. paratuberculosis
acacgcgaugaucagcucgcg

SEQ ID NO: 2866691 - RNA, 12 nt, Mycobacterium avium subsp. paratuberculosis
acacgcgccggc

SEQ ID NO: 2866692 - RNA, 13 nt, Mycobacterium avium subsp. paratuberculosis
acacgcgccggcg

SEQ ID NO: 2866693 - RNA, 14 nt, Mycobacterium avium subsp. paratuberculosis
acacgcgccggcgc

SEQ ID NO: 2866694 - RNA, 14 nt, Mycobacterium avium subsp. paratuberculosis
acacgcggacaggg

SEQ ID NO: 2866695 - RNA, 20 nt, Mycobacterium avium subsp. paratuberculosis
acacgcggacagggcggcga

SEQ ID NO: 2866696 - RNA, 21 nt, Mycobacterium avium subsp. paratuberculosis
acacgcggacagggcggcgac

SEQ ID NO: 2866697 - RNA, 20 nt, Mycobacterium avium subsp. paratuberculosis
acacgcucacgcucggccag

SEQ ID NO: 2866698 - RNA, 13 nt, Mycobacterium avium subsp. paratuberculosis
acacgcugccgag

SEQ ID NO: 2866699 - RNA, 17 nt, Mycobacterium avium subsp. paratuberculosis
acacggaaaccgcugcg

SEQ ID NO: 2866700 - RNA, 19 nt, Mycobacterium avium subsp. paratuberculosis
acacggaaaccgcugcggc

SEQ ID NO: 2866701 - RNA, 21 nt, Mycobacterium avium subsp. paratuberculosis
acacggcaggcggcccgcucg

SEQ ID NO: 2866702 - RNA, 14 nt, Mycobacterium avium subsp. paratuberculosis
acacggccagcgcc

SEQ ID NO: 2866703 - RNA, 16 nt, Mycobacterium avium subsp. paratuberculosis
acacggccagcgccgu

SEQ ID NO: 2866704 - RNA, 17 nt, Mycobacterium avium subsp. paratuberculosis
acacggccagcgccguc

SEQ ID NO: 2866705 - RNA, 18 nt, Mycobacterium avium subsp. paratuberculosis
acacggccagcgccguca

SEQ ID NO: 2866706 - RNA, 14 nt, Mycobacterium avium subsp. paratuberculosis
acacggcccgcggc

SEQ ID NO: 2866707 - RNA, 22 nt, Mycobacterium avium subsp. paratuberculosis
acacggccgggauuucccgggc

SEQ ID NO: 2866708 - RNA, 22 nt, Mycobacterium avium subsp. paratuberculosis
acacggccucgcccagcgccgc

SEQ ID NO: 2866709 - RNA, 19 nt, Mycobacterium avium subsp. paratuberculosis
acacggcgccgugcgccuc

SEQ ID NO: 2866710 - RNA, 21 nt, Mycobacterium avium subsp. paratuberculosis
acacggcgccgugcgccucga

SEQ ID NO: 2866711 - RNA, 13 nt, Mycobacterium avium subsp. paratuberculosis
acacggcgcugag

SEQ ID NO: 2866712 - RNA, 12 nt, Mycobacterium avium subsp. paratuberculosis
acacggcggcgc

SEQ ID NO: 2866713 - RNA, 13 nt, Mycobacterium avium subsp. paratuberculosis
acacggcggcgcg

SEQ ID NO: 2866714 - RNA, 22 nt, Mycobacterium avium subsp. paratuberculosis
acacggcggcgcgggcggcguc

SEQ ID NO: 2866715 - RNA, 13 nt, Mycobacterium avium subsp. paratuberculosis
acacgggccgcgc

SEQ ID NO: 2866716 - RNA, 18 nt, Mycobacterium avium subsp. paratuberculosis
acacgggccgcgccgagg

SEQ ID NO: 2866717 - RNA, 20 nt, Mycobacterium avium subsp. paratuberculosis
acacgggcggcagggccagc

SEQ ID NO: 2866718 - RNA, 21 nt, Mycobacterium avium subsp. paratuberculosis
acacgggcggcagggccagca

SEQ ID NO: 2866719 - RNA, 15 nt, Mycobacterium avium subsp. paratuberculosis
acacguacagcggcg

SEQ ID NO: 2866720 - RNA, 13 nt, Mycobacterium avium subsp. paratuberculosis
acacguagcgguc

SEQ ID NO: 2866721 - RNA, 16 nt, Mycobacterium avium subsp. paratuberculosis
acacguagucgccgau

SEQ ID NO: 2866722 - RNA, 15 nt, Mycobacterium avium subsp. paratuberculosis
acacguccuggcgcc

SEQ ID NO: 2866723 - RNA, 18 nt, Mycobacterium avium subsp. paratuberculosis
acacguccuggcgccagu

SEQ ID NO: 2866724 - RNA, 20 nt, Mycobacterium avium subsp. paratuberculosis
acacgucgcgggugaccggc

SEQ ID NO: 2866725 - RNA, 13 nt, Mycobacterium avium subsp. paratuberculosis
acacgucggccag

SEQ ID NO: 2866726 - RNA, 14 nt, Mycobacterium avium subsp. paratuberculosis
acacgucggccagc

SEQ ID NO: 2866727 - RNA, 16 nt, Mycobacterium avium subsp. paratuberculosis
acacgucggccagcgc

SEQ ID NO: 2866728 - RNA, 17 nt, Mycobacterium avium subsp. paratuberculosis
acacgucggccagcgcg

SEQ ID NO: 2866729 - RNA, 16 nt, Mycobacterium avium subsp. paratuberculosis
acacgugcaucugcga

SEQ ID NO: 2866730 - RNA, 24 nt, Mycobacterium avium subsp. paratuberculosis
acacguggccgaucagcugcucgg

SEQ ID NO: 2866731 - RNA, 21 nt, Mycobacterium avium subsp. paratuberculosis
acacguugagucccucggcga

SEQ ID NO: 2866732 - RNA, 21 nt, Mycobacterium avium subsp. paratuberculosis
acacguugcgcaucagcgcca

SEQ ID NO: 2866733 - RNA, 13 nt, Mycobacterium avium subsp. paratuberculosis
acacucgagcgcg

SEQ ID NO: 2866734 - RNA, 17 nt, Mycobacterium avium subsp. paratuberculosis
acacucgagcgcgcuca

SEQ ID NO: 2866735 - RNA, 14 nt, Mycobacterium avium subsp. paratuberculosis
acacugaaagccga

SEQ ID NO: 2866736 - RNA, 17 nt, Mycobacterium avium subsp. paratuberculosis
acacugaaagccgaggc

SEQ ID NO: 2866737 - RNA, 21 nt, Mycobacterium avium subsp. paratuberculosis
acacugaaagccgaggcgcaa

SEQ ID NO: 2866738 - RNA, 21 nt, Mycobacterium avium subsp. paratuberculosis
acacugcaacuacgcacccga

SEQ ID NO: 2866739 - RNA, 16 nt, Mycobacterium avium subsp. paratuberculosis
acacugcugcgcagac

SEQ ID NO: 2866740 - RNA, 23 nt, Mycobacterium avium subsp. paratuberculosis
acacuggcgugacgcucggccuc

SEQ ID NO: 2866741 - RNA, 17 nt, Mycobacterium avium subsp. paratuberculosis
acacuuuuaaggagcaa

SEQ ID NO: 2866742 - RNA, 19 nt, Mycobacterium avium subsp. paratuberculosis
acacuuuuaaggagcaauc

SEQ ID NO: 2866743 - RNA, 16 nt, Mycobacterium avium subsp. paratuberculosis
acagaaaucgcgcaga

SEQ ID NO: 2866744 - RNA, 19 nt, Mycobacterium avium subsp. paratuberculosis
acagacacagcacgcccug

SEQ ID NO: 2866745 - RNA, 14 nt, Mycobacterium avium subsp. paratuberculosis
acagacucagcccg

SEQ ID NO: 2866746 - RNA, 18 nt, Mycobacterium avium subsp. paratuberculosis
acagacucagcccggccc

SEQ ID NO: 2866747 - RNA, 21 nt, Mycobacterium avium subsp. paratuberculosis
acagacucagcccggcccagc

SEQ ID NO: 2866748 - RNA, 22 nt, Mycobacterium avium subsp. paratuberculosis
acagacugaugaagccgccgac

SEQ ID NO: 2866749 - RNA, 20 nt, Mycobacterium avium subsp. paratuberculosis
acagagcgggaucccgcagc

SEQ ID NO: 2866750 - RNA, 14 nt, Mycobacterium avium subsp. paratuberculosis
acagauacgcgacg

SEQ ID NO: 2866751 - RNA, 19 nt, Mycobacterium avium subsp. paratuberculosis
acagaucgcccaucaccgc

SEQ ID NO: 2866752 - RNA, 18 nt, Mycobacterium avium subsp. paratuberculosis
acagaucgucucggccag

SEQ ID NO: 2866753 - RNA, 21 nt, Mycobacterium avium subsp. paratuberculosis
acagaucgucucggccagccg

SEQ ID NO: 2866754 - RNA, 16 nt, Mycobacterium avium subsp. paratuberculosis
acagaugccagacgaa

SEQ ID NO: 2866755 - RNA, 22 nt, Mycobacterium avium subsp. paratuberculosis
acagaugccagacgaacgcggc

SEQ ID NO: 2866756 - RNA, 13 nt, Mycobacterium avium subsp. paratuberculosis
acagaugccugcc

SEQ ID NO: 2866757 - RNA, 15 nt, Mycobacterium avium subsp. paratuberculosis
acagcaacgccaggg

SEQ ID NO: 2866758 - RNA, 16 nt, Mycobacterium avium subsp. paratuberculosis
acagcaccagcaccac

SEQ ID NO: 2866759 - RNA, 18 nt, Mycobacterium avium subsp. paratuberculosis
acagcaccagcaccaccg

SEQ ID NO: 2866760 - RNA, 13 nt, Mycobacterium avium subsp. paratuberculosis
acagcaccaguug

SEQ ID NO: 2866761 - RNA, 15 nt, Mycobacterium avium subsp. paratuberculosis
acagcacccaggugc

SEQ ID NO: 2866762 - RNA, 21 nt, Mycobacterium avium subsp. paratuberculosis
acagcacccccucggcgccgg

SEQ ID NO: 2866763 - RNA, 17 nt, Mycobacterium avium subsp. paratuberculosis
acagcacccgcugcagc

SEQ ID NO: 2866764 - RNA, 11 nt, Mycobacterium avium subsp. paratuberculosis
acagcaccgcc

SEQ ID NO: 2866765 - RNA, 13 nt, Mycobacterium avium subsp. paratuberculosis
acagcaccgccac

SEQ ID NO: 2866766 - RNA, 13 nt, Mycobacterium avium subsp. paratuberculosis
acagcaccgccau

SEQ ID NO: 2866767 - RNA, 14 nt, Mycobacterium avium subsp. paratuberculosis
acagcaccgccauc

SEQ ID NO: 2866768 - RNA, 19 nt, Mycobacterium avium subsp. paratuberculosis
acagcaccgccgcgggcuc

SEQ ID NO: 2866769 - RNA, 14 nt, Mycobacterium avium subsp. paratuberculosis
acagcaccggcguc

SEQ ID NO: 2866770 - RNA, 18 nt, Mycobacterium avium subsp. paratuberculosis
acagcaccggcgucgaca

SEQ ID NO: 2866771 - RNA, 22 nt, Mycobacterium avium subsp. paratuberculosis
acagcacgaacagcagcgggac

SEQ ID NO: 2866772 - RNA, 23 nt, Mycobacterium avium subsp. paratuberculosis
acagcacgaacagcagcgggacg

SEQ ID NO: 2866773 - RNA, 21 nt, Mycobacterium avium subsp. paratuberculosis
acagcacgcccuggaaggcga

SEQ ID NO: 2866774 - RNA, 22 nt, Mycobacterium avium subsp. paratuberculosis
acagcacgcccuggaaggcgau

SEQ ID NO: 2866775 - RNA, 15 nt, Mycobacterium avium subsp. paratuberculosis
acagcacgccggccg

SEQ ID NO: 2866776 - RNA, 16 nt, Mycobacterium avium subsp. paratuberculosis
acagcacgccggccgg

SEQ ID NO: 2866777 - RNA, 14 nt, Mycobacterium avium subsp. paratuberculosis
acagcacguagguc

SEQ ID NO: 2866778 - RNA, 16 nt, Mycobacterium avium subsp. paratuberculosis
acagcagcaccagcgc

SEQ ID NO: 2866779 - RNA, 20 nt, Mycobacterium avium subsp. paratuberculosis
acagcagcacccgggugauc

SEQ ID NO: 2866780 - RNA, 13 nt, Mycobacterium avium subsp. paratuberculosis
acagcagcacgcc

SEQ ID NO: 2866781 - RNA, 23 nt, Mycobacterium avium subsp. paratuberculosis
acagcagcagaaccagcaccgcc

SEQ ID NO: 2866782 - RNA, 21 nt, Mycobacterium avium subsp. paratuberculosis
acagcagcagcaccaggcuga

SEQ ID NO: 2866783 - RNA, 17 nt, Mycobacterium avium subsp. paratuberculosis
acagcagcagcagcggc

SEQ ID NO: 2866784 - RNA, 18 nt, Mycobacterium avium subsp. paratuberculosis
acagcagcagcagcggca

SEQ ID NO: 2866785 - RNA, 22 nt, Mycobacterium avium subsp. paratuberculosis
acagcagcagcagcggcagcga

SEQ ID NO: 2866786 - RNA, 17 nt, Mycobacterium avium subsp. paratuberculosis
acagcagcagcucccac

SEQ ID NO: 2866787 - RNA, 9 nt, Mycobacterium avium subsp. paratuberculosis
acagcagcc

SEQ ID NO: 2866788 - RNA, 16 nt, Mycobacterium avium subsp. paratuberculosis
acagcagccccugcac

SEQ ID NO: 2866789 - RNA, 12 nt, Mycobacterium avium subsp. paratuberculosis
acagcagccgca

SEQ ID NO: 2866790 - RNA, 13 nt, Mycobacterium avium subsp. paratuberculosis
acagcagccgcac

SEQ ID NO: 2866791 - RNA, 22 nt, Mycobacterium avium subsp. paratuberculosis
acagcagccgcaccucggggcg

SEQ ID NO: 2866792 - RNA, 13 nt, Mycobacterium avium subsp. paratuberculosis
acagcagccgcuc

SEQ ID NO: 2866793 - RNA, 20 nt, Mycobacterium avium subsp. paratuberculosis
acagcagccgcucacacagc

SEQ ID NO: 2866794 - RNA, 14 nt, Mycobacterium avium subsp. paratuberculosis
acagcagcgaaccc

SEQ ID NO: 2866795 - RNA, 21 nt, Mycobacterium avium subsp. paratuberculosis
acagcagcgaacccgccaggg

SEQ ID NO: 2866796 - RNA, 16 nt, Mycobacterium avium subsp. paratuberculosis
acagcagcgaggcguc

SEQ ID NO: 2866797 - RNA, 15 nt, Mycobacterium avium subsp. paratuberculosis
acagcagcgccgcgg

SEQ ID NO: 2866798 - RNA, 13 nt, Mycobacterium avium subsp. paratuberculosis
acagcagcgcgcc

SEQ ID NO: 2866799 - RNA, 14 nt, Mycobacterium avium subsp. paratuberculosis
acagcagcgcgccg

SEQ ID NO: 2866800 - RNA, 16 nt, Mycobacterium avium subsp. paratuberculosis
acagcagcgcgccgac

SEQ ID NO: 2866801 - RNA, 9 nt, Mycobacterium avium subsp. paratuberculosis
acagcagcu

SEQ ID NO: 2866802 - RNA, 23 nt, Mycobacterium avium subsp. paratuberculosis
acagcagcucauacagcggcgcg

SEQ ID NO: 2866803 - RNA, 16 nt, Mycobacterium avium subsp. paratuberculosis
acagcaggaucuccgg

SEQ ID NO: 2866804 - RNA, 19 nt, Mycobacterium avium subsp. paratuberculosis
acagcaggaucuccggccg

SEQ ID NO: 2866805 - RNA, 12 nt, Mycobacterium avium subsp. paratuberculosis
acagcaggcugu

SEQ ID NO: 2866806 - RNA, 14 nt, Mycobacterium avium subsp. paratuberculosis
acagcagggcaccg

SEQ ID NO: 2866807 - RNA, 22 nt, Mycobacterium avium subsp. paratuberculosis
acagcagggcaccgacggccgc

SEQ ID NO: 2866808 - RNA, 20 nt, Mycobacterium avium subsp. paratuberculosis
acagcagguauuuggugacc

SEQ ID NO: 2866809 - RNA, 19 nt, Mycobacterium avium subsp. paratuberculosis
acagcaugaagaucagcac

SEQ ID NO: 2866810 - RNA, 23 nt, Mycobacterium avium subsp. paratuberculosis
acagcaugaagaucagcaccguc

SEQ ID NO: 2866811 - RNA, 17 nt, Mycobacterium avium subsp. paratuberculosis
acagcauuggaaagucc

SEQ ID NO: 2866812 - RNA, 17 nt, Mycobacterium avium subsp. paratuberculosis
acagcauuucgcgcggc

SEQ ID NO: 2866813 - RNA, 20 nt, Mycobacterium avium subsp. paratuberculosis
acagccacagcucgggcagc

SEQ ID NO: 2866814 - RNA, 15 nt, Mycobacterium avium subsp. paratuberculosis
acagccacuccaucc

SEQ ID NO: 2866815 - RNA, 22 nt, Mycobacterium avium subsp. paratuberculosis
acagccagcccguggccagcgc

SEQ ID NO: 2866816 - RNA, 16 nt, Mycobacterium avium subsp. paratuberculosis
acagccagcgcccggc

SEQ ID NO: 2866817 - RNA, 13 nt, Mycobacterium avium subsp. paratuberculosis
acagccaggcgaa

SEQ ID NO: 2866818 - RNA, 18 nt, Mycobacterium avium subsp. paratuberculosis
acagccagucgaagacca

SEQ ID NO: 2866819 - RNA, 20 nt, Mycobacterium avium subsp. paratuberculosis
acagcccccacgcucggcgc

SEQ ID NO: 2866820 - RNA, 13 nt, Mycobacterium avium subsp. paratuberculosis
acagcccccgcag

SEQ ID NO: 2866821 - RNA, 19 nt, Mycobacterium avium subsp. paratuberculosis
acagccccgagccgcggau

SEQ ID NO: 2866822 - RNA, 15 nt, Mycobacterium avium subsp. paratuberculosis
acagcccgaacagcu

SEQ ID NO: 2866823 - RNA, 16 nt, Mycobacterium avium subsp. paratuberculosis
acagcccgaccgucgu

SEQ ID NO: 2866824 - RNA, 14 nt, Mycobacterium avium subsp. paratuberculosis
acagcccgagcacg

SEQ ID NO: 2866825 - RNA, 15 nt, Mycobacterium avium subsp. paratuberculosis
acagcccgugcagga

SEQ ID NO: 2866826 - RNA, 16 nt, Mycobacterium avium subsp. paratuberculosis
acagcccguugcugcg

SEQ ID NO: 2866827 - RNA, 19 nt, Mycobacterium avium subsp. paratuberculosis
acagcccguugcugcguuc

SEQ ID NO: 2866828 - RNA, 17 nt, Mycobacterium avium subsp. paratuberculosis
acagccgagauggcaac

SEQ ID NO: 2866829 - RNA, 13 nt, Mycobacterium avium subsp. paratuberculosis
acagccgcaccgg

SEQ ID NO: 2866830 - RNA, 16 nt, Mycobacterium avium subsp. paratuberculosis
acagccgcaccggcgc

SEQ ID NO: 2866831 - RNA, 19 nt, Mycobacterium avium subsp. paratuberculosis
acagccgcaccggcgccgc

SEQ ID NO: 2866832 - RNA, 14 nt, Mycobacterium avium subsp. paratuberculosis
acagccgcagcagc

SEQ ID NO: 2866833 - RNA, 19 nt, Mycobacterium avium subsp. paratuberculosis
acagccgcagcagccgcgc

SEQ ID NO: 2866834 - RNA, 20 nt, Mycobacterium avium subsp. paratuberculosis
acagccgcagcagccgcgcc

SEQ ID NO: 2866835 - RNA, 15 nt, Mycobacterium avium subsp. paratuberculosis
acagccgcccggcgc

SEQ ID NO: 2866836 - RNA, 14 nt, Mycobacterium avium subsp. paratuberculosis
acagccgcgccgac

SEQ ID NO: 2866837 - RNA, 17 nt, Mycobacterium avium subsp. paratuberculosis
acagccggacgaacgag

SEQ ID NO: 2866838 - RNA, 23 nt, Mycobacterium avium subsp. paratuberculosis
acagccggacgggaucggcgcgu

SEQ ID NO: 2866839 - RNA, 23 nt, Mycobacterium avium subsp. paratuberculosis
acagccggaucagcguuccggcg

SEQ ID NO: 2866840 - RNA, 16 nt, Mycobacterium avium subsp. paratuberculosis
acagccggcccgagcc

SEQ ID NO: 2866841 - RNA, 14 nt, Mycobacterium avium subsp. paratuberculosis
acagccggcggcgg

SEQ ID NO: 2866842 - RNA, 22 nt, Mycobacterium avium subsp. paratuberculosis
acagccggcggcggcggucggc

SEQ ID NO: 2866843 - RNA, 20 nt, Mycobacterium avium subsp. paratuberculosis
acagccgggaaucgagggcg

SEQ ID NO: 2866844 - RNA, 17 nt, Mycobacterium avium subsp. paratuberculosis
acagccgggccgcccgc

SEQ ID NO: 2866845 - RNA, 20 nt, Mycobacterium avium subsp. paratuberculosis
acagccggggaucgcgcagc

SEQ ID NO: 2866846 - RNA, 22 nt, Mycobacterium avium subsp. paratuberculosis
acagccggggaucgcgcagccg

SEQ ID NO: 2866847 - RNA, 15 nt, Mycobacterium avium subsp. paratuberculosis
acagccggggcagcu

SEQ ID NO: 2866848 - RNA, 17 nt, Mycobacterium avium subsp. paratuberculosis
acagccggggcagcugc

SEQ ID NO: 2866849 - RNA, 21 nt, Mycobacterium avium subsp. paratuberculosis
acagccggucauaggccgcgc

SEQ ID NO: 2866850 - RNA, 20 nt, Mycobacterium avium subsp. paratuberculosis
acagccgguccgaccgccac

SEQ ID NO: 2866851 - RNA, 21 nt, Mycobacterium avium subsp. paratuberculosis
acagccgguccgaccgccacc

SEQ ID NO: 2866852 - RNA, 22 nt, Mycobacterium avium subsp. paratuberculosis
acagccgguccgaccgccacca

SEQ ID NO: 2866853 - RNA, 14 nt, Mycobacterium avium subsp. paratuberculosis
acagcgacaaucuc

SEQ ID NO: 2866854 - RNA, 18 nt, Mycobacterium avium subsp. paratuberculosis
acagcgacaaucucgggc

SEQ ID NO: 2866855 - RNA, 20 nt, Mycobacterium avium subsp. paratuberculosis
acagcgacccgaaccggauc

SEQ ID NO: 2866856 - RNA, 15 nt, Mycobacterium avium subsp. paratuberculosis
acagcgacgggccgg

SEQ ID NO: 2866857 - RNA, 15 nt, Mycobacterium avium subsp. paratuberculosis
acagcgacuccagcg

SEQ ID NO: 2866858 - RNA, 18 nt, Mycobacterium avium subsp. paratuberculosis
acagcgagaagucgccga

SEQ ID NO: 2866859 - RNA, 14 nt, Mycobacterium avium subsp. paratuberculosis
acagcgagccgucg

SEQ ID NO: 2866860 - RNA, 15 nt, Mycobacterium avium subsp. paratuberculosis
acagcgaggcgacgu

SEQ ID NO: 2866861 - RNA, 16 nt, Mycobacterium avium subsp. paratuberculosis
acagcgaggcgacguc

SEQ ID NO: 2866862 - RNA, 18 nt, Mycobacterium avium subsp. paratuberculosis
acagcgaggcgacgucga

SEQ ID NO: 2866863 - RNA, 14 nt, Mycobacterium avium subsp. paratuberculosis
acagcgccagcacg

SEQ ID NO: 2866864 - RNA, 23 nt, Mycobacterium avium subsp. paratuberculosis
acagcgccagggugccccgcacc

SEQ ID NO: 2866865 - RNA, 17 nt, Mycobacterium avium subsp. paratuberculosis
acagcgcccggccguga

SEQ ID NO: 2866866 - RNA, 14 nt, Mycobacterium avium subsp. paratuberculosis
acagcgcccuugag

SEQ ID NO: 2866867 - RNA, 11 nt, Mycobacterium avium subsp. paratuberculosis
acagcgccgag

SEQ ID NO: 2866868 - RNA, 15 nt, Mycobacterium avium subsp. paratuberculosis
acagcgccgagacgu

SEQ ID NO: 2866869 - RNA, 13 nt, Mycobacterium avium subsp. paratuberculosis
acagcgccgcggc

SEQ ID NO: 2866870 - RNA, 23 nt, Mycobacterium avium subsp. paratuberculosis
acagcgccgcggccagccggucg

SEQ ID NO: 2866871 - RNA, 20 nt, Mycobacterium avium subsp. paratuberculosis
acagcgccucgcggucgacg

SEQ ID NO: 2866872 - RNA, 14 nt, Mycobacterium avium subsp. paratuberculosis
acagcgccucgucg

SEQ ID NO: 2866873 - RNA, 15 nt, Mycobacterium avium subsp. paratuberculosis
acagcgccucgucga

SEQ ID NO: 2866874 - RNA, 11 nt, Mycobacterium avium subsp. paratuberculosis
acagcgcgacg

SEQ ID NO: 2866875 - RNA, 22 nt, Mycobacterium avium subsp. paratuberculosis
acagcgcgacgcacgccggcgg

SEQ ID NO: 2866876 - RNA, 18 nt, Mycobacterium avium subsp. paratuberculosis
acagcgcgacgggcaccc

SEQ ID NO: 2866877 - RNA, 23 nt, Mycobacterium avium subsp. paratuberculosis
acagcgcgacgggcacccgcgcg

SEQ ID NO: 2866878 - RNA, 11 nt, Mycobacterium avium subsp. paratuberculosis
acagcgcgccg

SEQ ID NO: 2866879 - RNA, 13 nt, Mycobacterium avium subsp. paratuberculosis
acagcgcgccgcg

SEQ ID NO: 2866880 - RNA, 17 nt, Mycobacterium avium subsp. paratuberculosis
acagcgcgccggccggc

SEQ ID NO: 2866881 - RNA, 13 nt, Mycobacterium avium subsp. paratuberculosis
acagcgcggccgg

SEQ ID NO: 2866882 - RNA, 14 nt, Mycobacterium avium subsp. paratuberculosis
acagcgcggccgga

SEQ ID NO: 2866883 - RNA, 12 nt, Mycobacterium avium subsp. paratuberculosis
acagcgcgguga

SEQ ID NO: 2866884 - RNA, 13 nt, Mycobacterium avium subsp. paratuberculosis
acagcgcggugau

SEQ ID NO: 2866885 - RNA, 19 nt, Mycobacterium avium subsp. paratuberculosis
acagcgcggugauguuguc

SEQ ID NO: 2866886 - RNA, 15 nt, Mycobacterium avium subsp. paratuberculosis
acagcgcgucggcca

SEQ ID NO: 2866887 - RNA, 21 nt, Mycobacterium avium subsp. paratuberculosis
acagcggccuaugcgcccggg

SEQ ID NO: 2866888 - RNA, 20 nt, Mycobacterium avium subsp. paratuberculosis
acagcggcgacagcggccua

SEQ ID NO: 2866889 - RNA, 15 nt, Mycobacterium avium subsp. paratuberculosis
acagcggcgcaugac

SEQ ID NO: 2866890 - RNA, 13 nt, Mycobacterium avium subsp. paratuberculosis
acagcggcgcgcg

SEQ ID NO: 2866891 - RNA, 19 nt, Mycobacterium avium subsp. paratuberculosis
acagcggcggaugggugcg

SEQ ID NO: 2866892 - RNA, 19 nt, Mycobacterium avium subsp. paratuberculosis
acagcgggccgacccggcc

SEQ ID NO: 2866893 - RNA, 21 nt, Mycobacterium avium subsp. paratuberculosis
acagcgggccgacccggccga

SEQ ID NO: 2866894 - RNA, 17 nt, Mycobacterium avium subsp. paratuberculosis
acagcgggucguuggcg

SEQ ID NO: 2866895 - RNA, 14 nt, Mycobacterium avium subsp. paratuberculosis
acagcgucaauacg

SEQ ID NO: 2866896 - RNA, 13 nt, Mycobacterium avium subsp. paratuberculosis
acagcgucagcau

SEQ ID NO: 2866897 - RNA, 17 nt, Mycobacterium avium subsp. paratuberculosis
acagcgucagcaucgcc

SEQ ID NO: 2866898 - RNA, 20 nt, Mycobacterium avium subsp. paratuberculosis
acagcgucagcaucgccguc

SEQ ID NO: 2866899 - RNA, 22 nt, Mycobacterium avium subsp. paratuberculosis
acagcgucagcaucgccgucgu

SEQ ID NO: 2866900 - RNA, 15 nt, Mycobacterium avium subsp. paratuberculosis
acagcgucagccccg

SEQ ID NO: 2866901 - RNA, 22 nt, Mycobacterium avium subsp. paratuberculosis
acagcgucguccaugcccgccc

SEQ ID NO: 2866902 - RNA, 22 nt, Mycobacterium avium subsp. paratuberculosis
acagcgucucgacggcgccgac

SEQ ID NO: 2866903 - RNA, 20 nt, Mycobacterium avium subsp. paratuberculosis
acagcgugacccugccguca

SEQ ID NO: 2866904 - RNA, 16 nt, Mycobacterium avium subsp. paratuberculosis
acagcgugcacacccg

SEQ ID NO: 2866905 - RNA, 13 nt, Mycobacterium avium subsp. paratuberculosis
acagcguggucgc

SEQ ID NO: 2866906 - RNA, 15 nt, Mycobacterium avium subsp. paratuberculosis
acagcguggucgcgc

SEQ ID NO: 2866907 - RNA, 19 nt, Mycobacterium avium subsp. paratuberculosis
acagcuaggccagcagcgc

SEQ ID NO: 2866908 - RNA, 22 nt, Mycobacterium avium subsp. paratuberculosis
acagcuaggucguggcgccgag

SEQ ID NO: 2866909 - RNA, 15 nt, Mycobacterium avium subsp. paratuberculosis
acagcucaccgggcu

SEQ ID NO: 2866910 - RNA, 13 nt, Mycobacterium avium subsp. paratuberculosis
acagcucaccugc

SEQ ID NO: 2866911 - RNA, 19 nt, Mycobacterium avium subsp. paratuberculosis
acagcuccaacagccgguc

SEQ ID NO: 2866912 - RNA, 19 nt, Mycobacterium avium subsp. paratuberculosis
acagcucgaccagccgggu

SEQ ID NO: 2866913 - RNA, 13 nt, Mycobacterium avium subsp. paratuberculosis
acagcucgacgaa

SEQ ID NO: 2866914 - RNA, 21 nt, Mycobacterium avium subsp. paratuberculosis
acagcucgacgaacuccgcgc

SEQ ID NO: 2866915 - RNA, 19 nt, Mycobacterium avium subsp. paratuberculosis
acagcucgcgggccugcuc

SEQ ID NO: 2866916 - RNA, 23 nt, Mycobacterium avium subsp. paratuberculosis
acagcucgggcagcgugucccgg

SEQ ID NO: 2866917 - RNA, 18 nt, Mycobacterium avium subsp. paratuberculosis
acagcugagcagcccgac

SEQ ID NO: 2866918 - RNA, 14 nt, Mycobacterium avium subsp. paratuberculosis
acagcugccggccg

SEQ ID NO: 2866919 - RNA, 21 nt, Mycobacterium avium subsp. paratuberculosis
acagcugccggccguugcggg

SEQ ID NO: 2866920 - RNA, 17 nt, Mycobacterium avium subsp. paratuberculosis
acagcugcgcgggcgcg

SEQ ID NO: 2866921 - RNA, 21 nt, Mycobacterium avium subsp. paratuberculosis
acagcugggcguacugcucgg

SEQ ID NO: 2866922 - RNA, 17 nt, Mycobacterium avium subsp. paratuberculosis
acagcuggucccacagc

SEQ ID NO: 2866923 - RNA, 17 nt, Mycobacterium avium subsp. paratuberculosis
acagcugguccggccgg

SEQ ID NO: 2866924 - RNA, 19 nt, Mycobacterium avium subsp. paratuberculosis
acagcugguccggccggcc

SEQ ID NO: 2866925 - RNA, 17 nt, Mycobacterium avium subsp. paratuberculosis
acagcuucggcgccgag

SEQ ID NO: 2866926 - RNA, 13 nt, Mycobacterium avium subsp. paratuberculosis
acagcuugauguu

SEQ ID NO: 2866927 - RNA, 21 nt, Mycobacterium avium subsp. paratuberculosis
acagcuugauguugccgugcu

SEQ ID NO: 2866928 - RNA, 18 nt, Mycobacterium avium subsp. paratuberculosis
acagcuugucccagugcu

SEQ ID NO: 2866929 - RNA, 15 nt, Mycobacterium avium subsp. paratuberculosis
acagcuuucgggcgg

SEQ ID NO: 2866930 - RNA, 16 nt, Mycobacterium avium subsp. paratuberculosis
acagcuuucgggcggc

SEQ ID NO: 2866931 - RNA, 22 nt, Mycobacterium avium subsp. paratuberculosis
acagcuuucgggcggccugccg

SEQ ID NO: 2866932 - RNA, 17 nt, Mycobacterium avium subsp. paratuberculosis
acaggaacgggccggcg

SEQ ID NO: 2866933 - RNA, 18 nt, Mycobacterium avium subsp. paratuberculosis
acaggaacgggccggcgu

SEQ ID NO: 2866934 - RNA, 19 nt, Mycobacterium avium subsp. paratuberculosis
acaggacguugaggcggcg

SEQ ID NO: 2866935 - RNA, 21 nt, Mycobacterium avium subsp. paratuberculosis
acaggacguugaggcggcggc

SEQ ID NO: 2866936 - RNA, 21 nt, Mycobacterium avium subsp. paratuberculosis
acaggaggguuuucggggcgu

SEQ ID NO: 2866937 - RNA, 18 nt, Mycobacterium avium subsp. paratuberculosis
acaggaugcagccggcca

SEQ ID NO: 2866938 - RNA, 22 nt, Mycobacterium avium subsp. paratuberculosis
acaggaugcccaacagcucgcg

SEQ ID NO: 2866939 - RNA, 18 nt, Mycobacterium avium subsp. paratuberculosis
acaggaugcgggugaugc

SEQ ID NO: 2866940 - RNA, 14 nt, Mycobacterium avium subsp. paratuberculosis
acaggcagcccggc

SEQ ID NO: 2866941 - RNA, 16 nt, Mycobacterium avium subsp. paratuberculosis
acaggcagcccggcug

SEQ ID NO: 2866942 - RNA, 17 nt, Mycobacterium avium subsp. paratuberculosis
acaggcagcccggcugc

SEQ ID NO: 2866943 - RNA, 22 nt, Mycobacterium avium subsp. paratuberculosis
acaggcagcccggcugcgcagc

SEQ ID NO: 2866944 - RNA, 14 nt, Mycobacterium avium subsp. paratuberculosis
acaggcccagcagc

SEQ ID NO: 2866945 - RNA, 15 nt, Mycobacterium avium subsp. paratuberculosis
acaggcccagcagcg

SEQ ID NO: 2866946 - RNA, 22 nt, Mycobacterium avium subsp. paratuberculosis
acaggcccagcagcgcaccggc

SEQ ID NO: 2866947 - RNA, 13 nt, Mycobacterium avium subsp. paratuberculosis
acaggcccagcgg

SEQ ID NO: 2866948 - RNA, 14 nt, Mycobacterium avium subsp. paratuberculosis
acaggcccagcggc

SEQ ID NO: 2866949 - RNA, 13 nt, Mycobacterium avium subsp. paratuberculosis
acaggccccacgc

SEQ ID NO: 2866950 - RNA, 21 nt, Mycobacterium avium subsp. paratuberculosis
acaggccccacgcgcucagcg

SEQ ID NO: 2866951 - RNA, 22 nt, Mycobacterium avium subsp. paratuberculosis
acaggccccacgcgcucagcgc

SEQ ID NO: 2866952 - RNA, 18 nt, Mycobacterium avium subsp. paratuberculosis
acaggccgaacagcagcg

SEQ ID NO: 2866953 - RNA, 14 nt, Mycobacterium avium subsp. paratuberculosis
acaggccgagcgcg

SEQ ID NO: 2866954 - RNA, 15 nt, Mycobacterium avium subsp. paratuberculosis
acaggccgccugcgg

SEQ ID NO: 2866955 - RNA, 14 nt, Mycobacterium avium subsp. paratuberculosis
acaggccggcgacg

SEQ ID NO: 2866956 - RNA, 22 nt, Mycobacterium avium subsp. paratuberculosis
acaggccguagcgagcgcuggc

SEQ ID NO: 2866957 - RNA, 14 nt, Mycobacterium avium subsp. paratuberculosis
acaggccgucgggg

SEQ ID NO: 2866958 - RNA, 17 nt, Mycobacterium avium subsp. paratuberculosis
acaggccgucggggaug

SEQ ID NO: 2866959 - RNA, 20 nt, Mycobacterium avium subsp. paratuberculosis
acaggcgaguuaugccguca

SEQ ID NO: 2866960 - RNA, 15 nt, Mycobacterium avium subsp. paratuberculosis
acaggcuggccagcu

SEQ ID NO: 2866961 - RNA, 17 nt, Mycobacterium avium subsp. paratuberculosis
acaggcuggccagcucg

SEQ ID NO: 2866962 - RNA, 18 nt, Mycobacterium avium subsp. paratuberculosis
acaggcuggccagcucgg

SEQ ID NO: 2866963 - RNA, 15 nt, Mycobacterium avium subsp. paratuberculosis
acagggagccgacga

SEQ ID NO: 2866964 - RNA, 16 nt, Mycobacterium avium subsp. paratuberculosis
acagggagccgacgaa

SEQ ID NO: 2866965 - RNA, 17 nt, Mycobacterium avium subsp. paratuberculosis
acagggaggacagcacc

SEQ ID NO: 2866966 - RNA, 23 nt, Mycobacterium avium subsp. paratuberculosis
acagggaggacagcaccgccauc

SEQ ID NO: 2866967 - RNA, 14 nt, Mycobacterium avium subsp. paratuberculosis
acagggccaccgcg

SEQ ID NO: 2866968 - RNA, 12 nt, Mycobacterium avium subsp. paratuberculosis
acagggccgcgc

SEQ ID NO: 2866969 - RNA, 16 nt, Mycobacterium avium subsp. paratuberculosis
acagggcgacggcggc

SEQ ID NO: 2866970 - RNA, 20 nt, Mycobacterium avium subsp. paratuberculosis
acagggcgacggcggcgacg

SEQ ID NO: 2866971 - RNA, 20 nt, Mycobacterium avium subsp. paratuberculosis
acagggcggcgacacgccga

SEQ ID NO: 2866972 - RNA, 19 nt, Mycobacterium avium subsp. paratuberculosis
acagggucaucgcgccgga

SEQ ID NO: 2866973 - RNA, 14 nt, Mycobacterium avium subsp. paratuberculosis
acagguagcaggcg

SEQ ID NO: 2866974 - RNA, 22 nt, Mycobacterium avium subsp. paratuberculosis
acagguagcaggcgcgcagcag

SEQ ID NO: 2866975 - RNA, 14 nt, Mycobacterium avium subsp. paratuberculosis
acagguagcgcagc

SEQ ID NO: 2866976 - RNA, 20 nt, Mycobacterium avium subsp. paratuberculosis
acagguagcgcaucagcucu

SEQ ID NO: 2866977 - RNA, 18 nt, Mycobacterium avium subsp. paratuberculosis
acagguaggcggcgccgu

SEQ ID NO: 2866978 - RNA, 20 nt, Mycobacterium avium subsp. paratuberculosis
acagguaggcggcgccgucg

SEQ ID NO: 2866979 - RNA, 18 nt, Mycobacterium avium subsp. paratuberculosis
acagguccuugcccagca

SEQ ID NO: 2866980 - RNA, 19 nt, Mycobacterium avium subsp. paratuberculosis
acagguccuugcccagcag

SEQ ID NO: 2866981 - RNA, 15 nt, Mycobacterium avium subsp. paratuberculosis
acaggucgaccaucu

SEQ ID NO: 2866982 - RNA, 22 nt, Mycobacterium avium subsp. paratuberculosis
acaggucgagggugacccgggc

SEQ ID NO: 2866983 - RNA, 23 nt, Mycobacterium avium subsp. paratuberculosis
acaggucgaugauguugccccgc

SEQ ID NO: 2866984 - RNA, 18 nt, Mycobacterium avium subsp. paratuberculosis
acaggucgcacaggaugc

SEQ ID NO: 2866985 - RNA, 17 nt, Mycobacterium avium subsp. paratuberculosis
acaggucgcugcccggc

SEQ ID NO: 2866986 - RNA, 13 nt, Mycobacterium avium subsp. paratuberculosis
acaggucggcggu

SEQ ID NO: 2866987 - RNA, 16 nt, Mycobacterium avium subsp. paratuberculosis
acaggucggcggucgc

SEQ ID NO: 2866988 - RNA, 17 nt, Mycobacterium avium subsp. paratuberculosis
acaggucggcgugcagc

SEQ ID NO: 2866989 - RNA, 18 nt, Mycobacterium avium subsp. paratuberculosis
acaggucggcgugcagca

SEQ ID NO: 2866990 - RNA, 11 nt, Mycobacterium avium subsp. paratuberculosis
acaggugacga

SEQ ID NO: 2866991 - RNA, 20 nt, Mycobacterium avium subsp. paratuberculosis
acaggugcauccagucggcg

SEQ ID NO: 2866992 - RNA, 21 nt, Mycobacterium avium subsp. paratuberculosis
acaggugccggcggcgcggca

SEQ ID NO: 2866993 - RNA, 20 nt, Mycobacterium avium subsp. paratuberculosis
acaggugcuuggucagcgcg

SEQ ID NO: 2866994 - RNA, 13 nt, Mycobacterium avium subsp. paratuberculosis
acagguggccgau

SEQ ID NO: 2866995 - RNA, 14 nt, Mycobacterium avium subsp. paratuberculosis
acaggugugggcgu

SEQ ID NO: 2866996 - RNA, 19 nt, Mycobacterium avium subsp. paratuberculosis
acagguucuuggcggccug

SEQ ID NO: 2866997 - RNA, 23 nt, Mycobacterium avium subsp. paratuberculosis
acagguugggaaaacccggaacc

SEQ ID NO: 2866998 - RNA, 16 nt, Mycobacterium avium subsp. paratuberculosis
acagguuucgcucguc

SEQ ID NO: 2866999 - RNA, 17 nt, Mycobacterium avium subsp. paratuberculosis
acagguuucgcucgucg

SEQ ID NO: 2867000 - RNA, 12 nt, Mycobacterium avium subsp. paratuberculosis
acaguaggcggc

SEQ ID NO: 2867001 - RNA, 20 nt, Mycobacterium avium subsp. paratuberculosis
acagucccgcguugugcacc

SEQ ID NO: 2867002 - RNA, 21 nt, Mycobacterium avium subsp. paratuberculosis
acaguccgaccgcguacaggg

SEQ ID NO: 2867003 - RNA, 16 nt, Mycobacterium avium subsp. paratuberculosis
acagucgaccucgcgc

SEQ ID NO: 2867004 - RNA, 15 nt, Mycobacterium avium subsp. paratuberculosis
acagucgcgggcagc

SEQ ID NO: 2867005 - RNA, 19 nt, Mycobacterium avium subsp. paratuberculosis
acagucgcgggcagccggc

SEQ ID NO: 2867006 - RNA, 21 nt, Mycobacterium avium subsp. paratuberculosis
acagucgcgggcagccggcgc

SEQ ID NO: 2867007 - RNA, 23 nt, Mycobacterium avium subsp. paratuberculosis
acagucgcgggcggggcgccgac

SEQ ID NO: 2867008 - RNA, 13 nt, Mycobacterium avium subsp. paratuberculosis
acagucgcugggu

SEQ ID NO: 2867009 - RNA, 14 nt, Mycobacterium avium subsp. paratuberculosis
acagucggccggcg

SEQ ID NO: 2867010 - RNA, 13 nt, Mycobacterium avium subsp. paratuberculosis
acagugcgggcuc

SEQ ID NO: 2867011 - RNA, 22 nt, Mycobacterium avium subsp. paratuberculosis
acaguucggugcacggcgccac

SEQ ID NO: 2867012 - RNA, 22 nt, Mycobacterium avium subsp. paratuberculosis
acauaccgggacaucgucgcgc

SEQ ID NO: 2867013 - RNA, 21 nt, Mycobacterium avium subsp. paratuberculosis
acauacgcggcggccugcgcg

SEQ ID NO: 2867014 - RNA, 16 nt, Mycobacterium avium subsp. paratuberculosis
acauagcgcagcucua

SEQ ID NO: 2867015 - RNA, 21 nt, Mycobacterium avium subsp. paratuberculosis
acaucaccaaccgcucggcga

SEQ ID NO: 2867016 - RNA, 20 nt, Mycobacterium avium subsp. paratuberculosis
acaucaccaccgccggggug

SEQ ID NO: 2867017 - RNA, 14 nt, Mycobacterium avium subsp. paratuberculosis
acaucacccggcgg

SEQ ID NO: 2867018 - RNA, 15 nt, Mycobacterium avium subsp. paratuberculosis
acaucacccggcggc

SEQ ID NO: 2867019 - RNA, 17 nt, Mycobacterium avium subsp. paratuberculosis
acaucaccgcgggcgcg

SEQ ID NO: 2867020 - RNA, 23 nt, Mycobacterium avium subsp. paratuberculosis
acaucaccgcgggcgcgccgucc

SEQ ID NO: 2867021 - RNA, 13 nt, Mycobacterium avium subsp. paratuberculosis
acaucacgguggc

SEQ ID NO: 2867022 - RNA, 14 nt, Mycobacterium avium subsp. paratuberculosis
acaucacgguggcc

SEQ ID NO: 2867023 - RNA, 19 nt, Mycobacterium avium subsp. paratuberculosis
acaucacgguggccgccac

SEQ ID NO: 2867024 - RNA, 16 nt, Mycobacterium avium subsp. paratuberculosis
acaucacgucccgcuc

SEQ ID NO: 2867025 - RNA, 17 nt, Mycobacterium avium subsp. paratuberculosis
acaucagaucgccgacg

SEQ ID NO: 2867026 - RNA, 18 nt, Mycobacterium avium subsp. paratuberculosis
acaucagaucgccgacga

SEQ ID NO: 2867027 - RNA, 21 nt, Mycobacterium avium subsp. paratuberculosis
acaucagaucgccgacgacga

SEQ ID NO: 2867028 - RNA, 16 nt, Mycobacterium avium subsp. paratuberculosis
acaucagcucggcggc

SEQ ID NO: 2867029 - RNA, 17 nt, Mycobacterium avium subsp. paratuberculosis
acaucagcucggcggcc

SEQ ID NO: 2867030 - RNA, 20 nt, Mycobacterium avium subsp. paratuberculosis
acaucaggcccuugccccac

SEQ ID NO: 2867031 - RNA, 21 nt, Mycobacterium avium subsp. paratuberculosis
acauccacggcauggugauga

SEQ ID NO: 2867032 - RNA, 16 nt, Mycobacterium avium subsp. paratuberculosis
acauccagaugcccag

SEQ ID NO: 2867033 - RNA, 18 nt, Mycobacterium avium subsp. paratuberculosis
acauccaggaccgcgcgc

SEQ ID NO: 2867034 - RNA, 22 nt, Mycobacterium avium subsp. paratuberculosis
acauccaggaccgcgcgccggc

SEQ ID NO: 2867035 - RNA, 18 nt, Mycobacterium avium subsp. paratuberculosis
acauccauugggccgcgg

SEQ ID NO: 2867036 - RNA, 19 nt, Mycobacterium avium subsp. paratuberculosis
acauccauugggccgcggc

SEQ ID NO: 2867037 - RNA, 14 nt, Mycobacterium avium subsp. paratuberculosis
acaucccggacagg

SEQ ID NO: 2867038 - RNA, 20 nt, Mycobacterium avium subsp. paratuberculosis
acaucccggacaggucgggc

SEQ ID NO: 2867039 - RNA, 16 nt, Mycobacterium avium subsp. paratuberculosis
acaucccggagccguc

SEQ ID NO: 2867040 - RNA, 17 nt, Mycobacterium avium subsp. paratuberculosis
acaucccggagccgucg

SEQ ID NO: 2867041 - RNA, 17 nt, Mycobacterium avium subsp. paratuberculosis
acauccgguugcaccgc

SEQ ID NO: 2867042 - RNA, 18 nt, Mycobacterium avium subsp. paratuberculosis
acauccgucacgcccguc

SEQ ID NO: 2867043 - RNA, 22 nt, Mycobacterium avium subsp. paratuberculosis
acauccgucacgcccgucccug

SEQ ID NO: 2867044 - RNA, 13 nt, Mycobacterium avium subsp. paratuberculosis
acauccgugaggg

SEQ ID NO: 2867045 - RNA, 21 nt, Mycobacterium avium subsp. paratuberculosis
acauccgugagggaccuccag

SEQ ID NO: 2867046 - RNA, 22 nt, Mycobacterium avium subsp. paratuberculosis
acauccgugagggaccuccagc

SEQ ID NO: 2867047 - RNA, 17 nt, Mycobacterium avium subsp. paratuberculosis
acauccugguccggcgc

SEQ ID NO: 2867048 - RNA, 20 nt, Mycobacterium avium subsp. paratuberculosis
acauccugguccggcgcccg

SEQ ID NO: 2867049 - RNA, 24 nt, Mycobacterium avium subsp. paratuberculosis
acauccugguccggcgcccgaucg

SEQ ID NO: 2867050 - RNA, 16 nt, Mycobacterium avium subsp. paratuberculosis
acaucgacgacgggug

SEQ ID NO: 2867051 - RNA, 20 nt, Mycobacterium avium subsp. paratuberculosis
acaucgacgcgaccggcccg

SEQ ID NO: 2867052 - RNA, 13 nt, Mycobacterium avium subsp. paratuberculosis
acaucgagcccac

SEQ ID NO: 2867053 - RNA, 21 nt, Mycobacterium avium subsp. paratuberculosis
acaucgagcccaccgcgccca

SEQ ID NO: 2867054 - RNA, 16 nt, Mycobacterium avium subsp. paratuberculosis
acaucgccaccuggaa

SEQ ID NO: 2867055 - RNA, 18 nt, Mycobacterium avium subsp. paratuberculosis
acaucgccaucagcagcg

SEQ ID NO: 2867056 - RNA, 12 nt, Mycobacterium avium subsp. paratuberculosis
acaucgccgaga

SEQ ID NO: 2867057 - RNA, 15 nt, Mycobacterium avium subsp. paratuberculosis
acaucgccgagacga

SEQ ID NO: 2867058 - RNA, 13 nt, Mycobacterium avium subsp. paratuberculosis
acaucgccgcggc

SEQ ID NO: 2867059 - RNA, 16 nt, Mycobacterium avium subsp. paratuberculosis
acaucgccgcggccgg

SEQ ID NO: 2867060 - RNA, 23 nt, Mycobacterium avium subsp. paratuberculosis
acaucgccggcgaccgugcccac

SEQ ID NO: 2867061 - RNA, 17 nt, Mycobacterium avium subsp. paratuberculosis
acaucgccucggcgucc

SEQ ID NO: 2867062 - RNA, 13 nt, Mycobacterium avium subsp. paratuberculosis
acaucggcgccga

SEQ ID NO: 2867063 - RNA, 14 nt, Mycobacterium avium subsp. paratuberculosis
acaucggcgccgac

SEQ ID NO: 2867064 - RNA, 15 nt, Mycobacterium avium subsp. paratuberculosis
acaucggcgccgacg

SEQ ID NO: 2867065 - RNA, 21 nt, Mycobacterium avium subsp. paratuberculosis
acaucggugaccgucgccgac

SEQ ID NO: 2867066 - RNA, 22 nt, Mycobacterium avium subsp. paratuberculosis
acaucggugaccgucgccgacc

SEQ ID NO: 2867067 - RNA, 20 nt, Mycobacterium avium subsp. paratuberculosis
acaucgguugcuccggcguc

SEQ ID NO: 2867068 - RNA, 22 nt, Mycobacterium avium subsp. paratuberculosis
acaucgucgcgcccaggaacgc

SEQ ID NO: 2867069 - RNA, 14 nt, Mycobacterium avium subsp. paratuberculosis
acaucgucggcucg

SEQ ID NO: 2867070 - RNA, 20 nt, Mycobacterium avium subsp. paratuberculosis
acaucguggcgcaucaccuu

SEQ ID NO: 2867071 - RNA, 12 nt, Mycobacterium avium subsp. paratuberculosis
acaucuccagcg

SEQ ID NO: 2867072 - RNA, 14 nt, Mycobacterium avium subsp. paratuberculosis
acaucuccagcgcg

SEQ ID NO: 2867073 - RNA, 16 nt, Mycobacterium avium subsp. paratuberculosis
acaucuccagcgcggu

SEQ ID NO: 2867074 - RNA, 12 nt, Mycobacterium avium subsp. paratuberculosis
acaucucgacgg

SEQ ID NO: 2867075 - RNA, 20 nt, Mycobacterium avium subsp. paratuberculosis
acaucucgacggugaccggc

SEQ ID NO: 2867076 - RNA, 16 nt, Mycobacterium avium subsp. paratuberculosis
acaucugccgggcggc

SEQ ID NO: 2867077 - RNA, 21 nt, Mycobacterium avium subsp. paratuberculosis
acaucuuggucagccgcggcg

SEQ ID NO: 2867078 - RNA, 16 nt, Mycobacterium avium subsp. paratuberculosis
acaugcagccgccgcg

SEQ ID NO: 2867079 - RNA, 17 nt, Mycobacterium avium subsp. paratuberculosis
acaugcagccgccgcgg

SEQ ID NO: 2867080 - RNA, 13 nt, Mycobacterium avium subsp. paratuberculosis
acaugcccggcga

SEQ ID NO: 2867081 - RNA, 15 nt, Mycobacterium avium subsp. paratuberculosis
acaugcccggcgacg

SEQ ID NO: 2867082 - RNA, 12 nt, Mycobacterium avium subsp. paratuberculosis
acaugcccgucg

SEQ ID NO: 2867083 - RNA, 19 nt, Mycobacterium avium subsp. paratuberculosis
acaugccgaggcacagcag

SEQ ID NO: 2867084 - RNA, 20 nt, Mycobacterium avium subsp. paratuberculosis
acaugccgaggcacagcagc

SEQ ID NO: 2867085 - RNA, 15 nt, Mycobacterium avium subsp. paratuberculosis
acaugccggcgccga

SEQ ID NO: 2867086 - RNA, 16 nt, Mycobacterium avium subsp. paratuberculosis
acaugccggcgccgau

SEQ ID NO: 2867087 - RNA, 15 nt, Mycobacterium avium subsp. paratuberculosis
acaugcgcagcgccc

SEQ ID NO: 2867088 - RNA, 16 nt, Mycobacterium avium subsp. paratuberculosis
acaugcugccgccggc

SEQ ID NO: 2867089 - RNA, 17 nt, Mycobacterium avium subsp. paratuberculosis
acaugcugccgccggcg

SEQ ID NO: 2867090 - RNA, 18 nt, Mycobacterium avium subsp. paratuberculosis
acaugcugccgccggcga

SEQ ID NO: 2867091 - RNA, 20 nt, Mycobacterium avium subsp. paratuberculosis
acaugcugggcuaccagccc

SEQ ID NO: 2867092 - RNA, 22 nt, Mycobacterium avium subsp. paratuberculosis
acaugcuguuccagacgucggc

SEQ ID NO: 2867093 - RNA, 18 nt, Mycobacterium avium subsp. paratuberculosis
acauggacgcggccucac

SEQ ID NO: 2867094 - RNA, 16 nt, Mycobacterium avium subsp. paratuberculosis
acauggccagcaccau

SEQ ID NO: 2867095 - RNA, 12 nt, Mycobacterium avium subsp. paratuberculosis
acaugggccacg

SEQ ID NO: 2867096 - RNA, 24 nt, Mycobacterium avium subsp. paratuberculosis
acauggucgcccacaccggauggc

SEQ ID NO: 2867097 - RNA, 21 nt, Mycobacterium avium subsp. paratuberculosis
acaugguggucgaacuggcgc

SEQ ID NO: 2867098 - RNA, 14 nt, Mycobacterium avium subsp. paratuberculosis
acaugugagguggc

SEQ ID NO: 2867099 - RNA, 23 nt, Mycobacterium avium subsp. paratuberculosis
acauucacgaggccgggcuggcg

SEQ ID NO: 2867100 - RNA, 20 nt, Mycobacterium avium subsp. paratuberculosis
acauucgcgugugcccagca

SEQ ID NO: 2867101 - RNA, 16 nt, Mycobacterium avium subsp. paratuberculosis
acauuggccgcgcgca

SEQ ID NO: 2867102 - RNA, 17 nt, Mycobacterium avium subsp. paratuberculosis
acauuggccgcgcgcag

SEQ ID NO: 2867103 - RNA, 22 nt, Mycobacterium avium subsp. paratuberculosis
accaaauagccgucggcggccu

SEQ ID NO: 2867104 - RNA, 19 nt, Mycobacterium avium subsp. paratuberculosis
accaacacccccgcgcugc

SEQ ID NO: 2867105 - RNA, 19 nt, Mycobacterium avium subsp. paratuberculosis
accaacacccuugcgccgc

SEQ ID NO: 2867106 - RNA, 14 nt, Mycobacterium avium subsp. paratuberculosis
accaacacgucgag

SEQ ID NO: 2867107 - RNA, 15 nt, Mycobacterium avium subsp. paratuberculosis
accaacacgucgagu

SEQ ID NO: 2867108 - RNA, 23 nt, Mycobacterium avium subsp. paratuberculosis
accaacagcagcgaggcguccag

SEQ ID NO: 2867109 - RNA, 18 nt, Mycobacterium avium subsp. paratuberculosis
accaacagcggcccgauc

SEQ ID NO: 2867110 - RNA, 19 nt, Mycobacterium avium subsp. paratuberculosis
accaacaggucggcgugca

SEQ ID NO: 2867111 - RNA, 16 nt, Mycobacterium avium subsp. paratuberculosis
accaaccacagcugcu

SEQ ID NO: 2867112 - RNA, 18 nt, Mycobacterium avium subsp. paratuberculosis
accaacccgaucggcccg

SEQ ID NO: 2867113 - RNA, 14 nt, Mycobacterium avium subsp. paratuberculosis
accaaccgcucggc

SEQ ID NO: 2867114 - RNA, 14 nt, Mycobacterium avium subsp. paratuberculosis
accaacgcggcgcc

SEQ ID NO: 2867115 - RNA, 16 nt, Mycobacterium avium subsp. paratuberculosis
accaacggcagcagca

SEQ ID NO: 2867116 - RNA, 17 nt, Mycobacterium avium subsp. paratuberculosis
accaacggcucgccgcg

SEQ ID NO: 2867117 - RNA, 18 nt, Mycobacterium avium subsp. paratuberculosis
accaacggcucgccgcgc

SEQ ID NO: 2867118 - RNA, 15 nt, Mycobacterium avium subsp. paratuberculosis
accaacgggcggcgg

SEQ ID NO: 2867119 - RNA, 14 nt, Mycobacterium avium subsp. paratuberculosis
accaacuccaccgc

SEQ ID NO: 2867120 - RNA, 15 nt, Mycobacterium avium subsp. paratuberculosis
accaacuccaccgcc

SEQ ID NO: 2867121 - RNA, 17 nt, Mycobacterium avium subsp. paratuberculosis
accaacuccaccgcccg

SEQ ID NO: 2867122 - RNA, 12 nt, Mycobacterium avium subsp. paratuberculosis
accaacucgcga

SEQ ID NO: 2867123 - RNA, 12 nt, Mycobacterium avium subsp. paratuberculosis
accaacugcaga

SEQ ID NO: 2867124 - RNA, 16 nt, Mycobacterium avium subsp. paratuberculosis
accaagacggugggcc

SEQ ID NO: 2867125 - RNA, 14 nt, Mycobacterium avium subsp. paratuberculosis
accaagcaccagau

SEQ ID NO: 2867126 - RNA, 14 nt, Mycobacterium avium subsp. paratuberculosis
accaagcgcgacaa

SEQ ID NO: 2867127 - RNA, 20 nt, Mycobacterium avium subsp. paratuberculosis
accaagcgcgacaagcagau

SEQ ID NO: 2867128 - RNA, 18 nt, Mycobacterium avium subsp. paratuberculosis
accaaugcccugaccccg

SEQ ID NO: 2867129 - RNA, 15 nt, Mycobacterium avium subsp. paratuberculosis
accaaugcgccggcg

SEQ ID NO: 2867130 - RNA, 18 nt, Mycobacterium avium subsp. paratuberculosis
accaaugcgccggcggcc

SEQ ID NO: 2867131 - RNA, 19 nt, Mycobacterium avium subsp. paratuberculosis
accaaugcgccggcggccg

SEQ ID NO: 2867132 - RNA, 16 nt, Mycobacterium avium subsp. paratuberculosis
accaauugcgagcagg

SEQ ID NO: 2867133 - RNA, 14 nt, Mycobacterium avium subsp. paratuberculosis
accacaccagcaug

SEQ ID NO: 2867134 - RNA, 14 nt, Mycobacterium avium subsp. paratuberculosis
accacacccagcgc

SEQ ID NO: 2867135 - RNA, 15 nt, Mycobacterium avium subsp. paratuberculosis
accacacccagcgcc

SEQ ID NO: 2867136 - RNA, 14 nt, Mycobacterium avium subsp. paratuberculosis
accacaccccggcc

SEQ ID NO: 2867137 - RNA, 16 nt, Mycobacterium avium subsp. paratuberculosis
accacacccgcggccg

SEQ ID NO: 2867138 - RNA, 17 nt, Mycobacterium avium subsp. paratuberculosis
accacacccgcggccgc

SEQ ID NO: 2867139 - RNA, 15 nt, Mycobacterium avium subsp. paratuberculosis
accacaccggcgcug

SEQ ID NO: 2867140 - RNA, 17 nt, Mycobacterium avium subsp. paratuberculosis
accacaccggcgcugcc

SEQ ID NO: 2867141 - RNA, 16 nt, Mycobacterium avium subsp. paratuberculosis
accacaccgucgacga

SEQ ID NO: 2867142 - RNA, 13 nt, Mycobacterium avium subsp. paratuberculosis
accacagcgccuc

SEQ ID NO: 2867143 - RNA, 12 nt, Mycobacterium avium subsp. paratuberculosis
accacagcggcg

SEQ ID NO: 2867144 - RNA, 14 nt, Mycobacterium avium subsp. paratuberculosis
accacagcggcgca

SEQ ID NO: 2867145 - RNA, 21 nt, Mycobacterium avium subsp. paratuberculosis
accacagcggcgcaugaccga

SEQ ID NO: 2867146 - RNA, 21 nt, Mycobacterium avium subsp. paratuberculosis
accacagcugcuggcugcggc

SEQ ID NO: 2867147 - RNA, 15 nt, Mycobacterium avium subsp. paratuberculosis
accacaguggccgcc

SEQ ID NO: 2867148 - RNA, 17 nt, Mycobacterium avium subsp. paratuberculosis
accacaguggccgccag

SEQ ID NO: 2867149 - RNA, 12 nt, Mycobacterium avium subsp. paratuberculosis
accacaucggag

SEQ ID NO: 2867150 - RNA, 19 nt, Mycobacterium avium subsp. paratuberculosis
accacaucgguugcuccgg

SEQ ID NO: 2867151 - RNA, 16 nt, Mycobacterium avium subsp. paratuberculosis
accacauucccgccgc

SEQ ID NO: 2867152 - RNA, 19 nt, Mycobacterium avium subsp. paratuberculosis
accacauuggcgaccgcgg

SEQ ID NO: 2867153 - RNA, 22 nt, Mycobacterium avium subsp. paratuberculosis
accacauuggcgaccgcggccg

SEQ ID NO: 2867154 - RNA, 15 nt, Mycobacterium avium subsp. paratuberculosis
accaccaacccgguc

SEQ ID NO: 2867155 - RNA, 19 nt, Mycobacterium avium subsp. paratuberculosis
accaccaacggcucgccgc

SEQ ID NO: 2867156 - RNA, 18 nt, Mycobacterium avium subsp. paratuberculosis
accaccacacccagcgcc

SEQ ID NO: 2867157 - RNA, 19 nt, Mycobacterium avium subsp. paratuberculosis
accaccacacccagcgcca

SEQ ID NO: 2867158 - RNA, 14 nt, Mycobacterium avium subsp. paratuberculosis
accaccacacccgc

SEQ ID NO: 2867159 - RNA, 17 nt, Mycobacterium avium subsp. paratuberculosis
accaccacacccgcggc

SEQ ID NO: 2867160 - RNA, 15 nt, Mycobacterium avium subsp. paratuberculosis
accaccaccagucgg

SEQ ID NO: 2867161 - RNA, 13 nt, Mycobacterium avium subsp. paratuberculosis
accaccacccccg

SEQ ID NO: 2867162 - RNA, 14 nt, Mycobacterium avium subsp. paratuberculosis
accaccaccgagcc

SEQ ID NO: 2867163 - RNA, 12 nt, Mycobacterium avium subsp. paratuberculosis
accaccaccgcc

SEQ ID NO: 2867164 - RNA, 13 nt, Mycobacterium avium subsp. paratuberculosis
accaccaccgccc

SEQ ID NO: 2867165 - RNA, 14 nt, Mycobacterium avium subsp. paratuberculosis
accaccaccgccgu

SEQ ID NO: 2867166 - RNA, 15 nt, Mycobacterium avium subsp. paratuberculosis
accaccaccgccguc

SEQ ID NO: 2867167 - RNA, 14 nt, Mycobacterium avium subsp. paratuberculosis
accaccacgaccag

SEQ ID NO: 2867168 - RNA, 15 nt, Mycobacterium avium subsp. paratuberculosis
accaccacgaccagu

SEQ ID NO: 2867169 - RNA, 13 nt, Mycobacterium avium subsp. paratuberculosis
accaccacgcugg

SEQ ID NO: 2867170 - RNA, 16 nt, Mycobacterium avium subsp. paratuberculosis
accaccacggagcgcc

SEQ ID NO: 2867171 - RNA, 22 nt, Mycobacterium avium subsp. paratuberculosis
accaccacggagcgcccggcca

SEQ ID NO: 2867172 - RNA, 13 nt, Mycobacterium avium subsp. paratuberculosis
accaccacggcca

SEQ ID NO: 2867173 - RNA, 14 nt, Mycobacterium avium subsp. paratuberculosis
accaccacggccag

SEQ ID NO: 2867174 - RNA, 14 nt, Mycobacterium avium subsp. paratuberculosis
accaccacggccgc

SEQ ID NO: 2867175 - RNA, 15 nt, Mycobacterium avium subsp. paratuberculosis
accaccacggccgca

SEQ ID NO: 2867176 - RNA, 18 nt, Mycobacterium avium subsp. paratuberculosis
accaccacgugccccucc

SEQ ID NO: 2867177 - RNA, 21 nt, Mycobacterium avium subsp. paratuberculosis
accaccacguugcacggcagc

SEQ ID NO: 2867178 - RNA, 22 nt, Mycobacterium avium subsp. paratuberculosis
accaccagccgcaggugcucgc

SEQ ID NO: 2867179 - RNA, 20 nt, Mycobacterium avium subsp. paratuberculosis
accaccagcgugcugccgga

SEQ ID NO: 2867180 - RNA, 16 nt, Mycobacterium avium subsp. paratuberculosis
accaccagcucgucgc

SEQ ID NO: 2867181 - RNA, 17 nt, Mycobacterium avium subsp. paratuberculosis
accaccagcucgucgcc

SEQ ID NO: 2867182 - RNA, 20 nt, Mycobacterium avium subsp. paratuberculosis
accaccagcucgucgccgac

SEQ ID NO: 2867183 - RNA, 16 nt, Mycobacterium avium subsp. paratuberculosis
accaccaggagcaccu

SEQ ID NO: 2867184 - RNA, 17 nt, Mycobacterium avium subsp. paratuberculosis
accaccaggagcaccug

SEQ ID NO: 2867185 - RNA, 19 nt, Mycobacterium avium subsp. paratuberculosis
accaccaggagcaccugcg

SEQ ID NO: 2867186 - RNA, 20 nt, Mycobacterium avium subsp. paratuberculosis
accaccaggagcaccugcgc

SEQ ID NO: 2867187 - RNA, 21 nt, Mycobacterium avium subsp. paratuberculosis
accaccaggagcaccugcgcg

SEQ ID NO: 2867188 - RNA, 22 nt, Mycobacterium avium subsp. paratuberculosis
accaccaggagcaccugcgcga

SEQ ID NO: 2867189 - RNA, 23 nt, Mycobacterium avium subsp. paratuberculosis
accaccaggagcaccugcgcgac

SEQ ID NO: 2867190 - RNA, 14 nt, Mycobacterium avium subsp. paratuberculosis
accaccaggcccac

SEQ ID NO: 2867191 - RNA, 17 nt, Mycobacterium avium subsp. paratuberculosis
accaccagguaggcgac

SEQ ID NO: 2867192 - RNA, 16 nt, Mycobacterium avium subsp. paratuberculosis
accaccagucggcgcg

SEQ ID NO: 2867193 - RNA, 17 nt, Mycobacterium avium subsp. paratuberculosis
accaccagucggcgcgu

SEQ ID NO: 2867194 - RNA, 22 nt, Mycobacterium avium subsp. paratuberculosis
accaccaguuccaccagugucc

SEQ ID NO: 2867195 - RNA, 17 nt, Mycobacterium avium subsp. paratuberculosis
accaccauguuccagaa

SEQ ID NO: 2867196 - RNA, 13 nt, Mycobacterium avium subsp. paratuberculosis
accacccacuccc

SEQ ID NO: 2867197 - RNA, 20 nt, Mycobacterium avium subsp. paratuberculosis
accacccacucccagccgcc

SEQ ID NO: 2867198 - RNA, 15 nt, Mycobacterium avium subsp. paratuberculosis
accacccagcccuug

SEQ ID NO: 2867199 - RNA, 12 nt, Mycobacterium avium subsp. paratuberculosis
accacccaggcc

SEQ ID NO: 2867200 - RNA, 17 nt, Mycobacterium avium subsp. paratuberculosis
accacccaggccacccg

SEQ ID NO: 2867201 - RNA, 13 nt, Mycobacterium avium subsp. paratuberculosis
accacccaggugg

SEQ ID NO: 2867202 - RNA, 13 nt, Mycobacterium avium subsp. paratuberculosis
accaccccggugc

SEQ ID NO: 2867203 - RNA, 15 nt, Mycobacterium avium subsp. paratuberculosis
accaccccggugccg

SEQ ID NO: 2867204 - RNA, 22 nt, Mycobacterium avium subsp. paratuberculosis
accacccgcaccucgcccggcu

SEQ ID NO: 2867205 - RNA, 14 nt, Mycobacterium avium subsp. paratuberculosis
accacccgcagcga

SEQ ID NO: 2867206 - RNA, 16 nt, Mycobacterium avium subsp. paratuberculosis
accacccgcagcgcgg

SEQ ID NO: 2867207 - RNA, 20 nt, Mycobacterium avium subsp. paratuberculosis
accacccgcagcucgccggu

SEQ ID NO: 2867208 - RNA, 14 nt, Mycobacterium avium subsp. paratuberculosis
accacccgcggccg

SEQ ID NO: 2867209 - RNA, 21 nt, Mycobacterium avium subsp. paratuberculosis
accacccggacgaugacccag

SEQ ID NO: 2867210 - RNA, 16 nt, Mycobacterium avium subsp. paratuberculosis
accacccucggucagg

SEQ ID NO: 2867211 - RNA, 14 nt, Mycobacterium avium subsp. paratuberculosis
accaccgacacccc

SEQ ID NO: 2867212 - RNA, 20 nt, Mycobacterium avium subsp. paratuberculosis
accaccgacagcacccggcc

SEQ ID NO: 2867213 - RNA, 16 nt, Mycobacterium avium subsp. paratuberculosis
accaccgacgcgucgc

SEQ ID NO: 2867214 - RNA, 16 nt, Mycobacterium avium subsp. paratuberculosis
accaccgagccggcgu

SEQ ID NO: 2867215 - RNA, 22 nt, Mycobacterium avium subsp. paratuberculosis
accaccgagccggcgucgccgc

SEQ ID NO: 2867216 - RNA, 17 nt, Mycobacterium avium subsp. paratuberculosis
accaccgagccgggcag

SEQ ID NO: 2867217 - RNA, 18 nt, Mycobacterium avium subsp. paratuberculosis
accaccgagccggugccg

SEQ ID NO: 2867218 - RNA, 19 nt, Mycobacterium avium subsp. paratuberculosis
accaccgagccggugccgc

SEQ ID NO: 2867219 - RNA, 23 nt, Mycobacterium avium subsp. paratuberculosis
accaccgagguggcccagccgcu

SEQ ID NO: 2867220 - RNA, 18 nt, Mycobacterium avium subsp. paratuberculosis
accaccgccaccagcgca

SEQ ID NO: 2867221 - RNA, 14 nt, Mycobacterium avium subsp. paratuberculosis
accaccgcccacag

SEQ ID NO: 2867222 - RNA, 14 nt, Mycobacterium avium subsp. paratuberculosis
accaccgccgccga

SEQ ID NO: 2867223 - RNA, 15 nt, Mycobacterium avium subsp. paratuberculosis
accaccgccgccgac

SEQ ID NO: 2867224 - RNA, 14 nt, Mycobacterium avium subsp. paratuberculosis
accaccgccggccc

SEQ ID NO: 2867225 - RNA, 15 nt, Mycobacterium avium subsp. paratuberculosis
accaccgccggcccg

SEQ ID NO: 2867226 - RNA, 13 nt, Mycobacterium avium subsp. paratuberculosis
accaccgccgggg

SEQ ID NO: 2867227 - RNA, 20 nt, Mycobacterium avium subsp. paratuberculosis
accaccgccgucaccgccag

SEQ ID NO: 2867228 - RNA, 17 nt, Mycobacterium avium subsp. paratuberculosis
accaccgccucgacggu

SEQ ID NO: 2867229 - RNA, 12 nt, Mycobacterium avium subsp. paratuberculosis
accaccgcgccc

SEQ ID NO: 2867230 - RNA, 18 nt, Mycobacterium avium subsp. paratuberculosis
accaccgcgccgucgucg

SEQ ID NO: 2867231 - RNA, 13 nt, Mycobacterium avium subsp. paratuberculosis
accaccgcgcgca

SEQ ID NO: 2867232 - RNA, 13 nt, Mycobacterium avium subsp. paratuberculosis
accaccgcgcugc

SEQ ID NO: 2867233 - RNA, 17 nt, Mycobacterium avium subsp. paratuberculosis
accaccgcgcugcgcgc

SEQ ID NO: 2867234 - RNA, 19 nt, Mycobacterium avium subsp. paratuberculosis
accaccgcgcugcgcgcgu

SEQ ID NO: 2867235 - RNA, 13 nt, Mycobacterium avium subsp. paratuberculosis
accaccgcggcga

SEQ ID NO: 2867236 - RNA, 14 nt, Mycobacterium avium subsp. paratuberculosis
accaccgcggcgau

SEQ ID NO: 2867237 - RNA, 13 nt, Mycobacterium avium subsp. paratuberculosis
accaccgcggcgc

SEQ ID NO: 2867238 - RNA, 14 nt, Mycobacterium avium subsp. paratuberculosis
accaccgcggcgcc

SEQ ID NO: 2867239 - RNA, 22 nt, Mycobacterium avium subsp. paratuberculosis
accaccgcguugaucagcgcca

SEQ ID NO: 2867240 - RNA, 23 nt, Mycobacterium avium subsp. paratuberculosis
accaccgcguugaucagcgccag

SEQ ID NO: 2867241 - RNA, 17 nt, Mycobacterium avium subsp. paratuberculosis
accaccggagcggcggu

SEQ ID NO: 2867242 - RNA, 18 nt, Mycobacterium avium subsp. paratuberculosis
accaccggcaaccgccac

SEQ ID NO: 2867243 - RNA, 21 nt, Mycobacterium avium subsp. paratuberculosis
accaccggguagcccgcgugc

SEQ ID NO: 2867244 - RNA, 16 nt, Mycobacterium avium subsp. paratuberculosis
accaccgucaccgccg

SEQ ID NO: 2867245 - RNA, 18 nt, Mycobacterium avium subsp. paratuberculosis
accaccgucaccgccgca

SEQ ID NO: 2867246 - RNA, 23 nt, Mycobacterium avium subsp. paratuberculosis
accaccgucaccgccgcaccguc

SEQ ID NO: 2867247 - RNA, 19 nt, Mycobacterium avium subsp. paratuberculosis
accaccgucuugccguuga

SEQ ID NO: 2867248 - RNA, 14 nt, Mycobacterium avium subsp. paratuberculosis
accaccgugccguc

SEQ ID NO: 2867249 - RNA, 16 nt, Mycobacterium avium subsp. paratuberculosis
accaccguggccccag

SEQ ID NO: 2867250 - RNA, 17 nt, Mycobacterium avium subsp. paratuberculosis
accaccguggccccagc

SEQ ID NO: 2867251 - RNA, 18 nt, Mycobacterium avium subsp. paratuberculosis
accaccguggccccagcc

SEQ ID NO: 2867252 - RNA, 13 nt, Mycobacterium avium subsp. paratuberculosis
accaccuccccgc

SEQ ID NO: 2867253 - RNA, 20 nt, Mycobacterium avium subsp. paratuberculosis
accaccuccccgcggugccg

SEQ ID NO: 2867254 - RNA, 17 nt, Mycobacterium avium subsp. paratuberculosis
accaccucggcgacgau

SEQ ID NO: 2867255 - RNA, 22 nt, Mycobacterium avium subsp. paratuberculosis
accaccucgguggacgccgcgc

SEQ ID NO: 2867256 - RNA, 23 nt, Mycobacterium avium subsp. paratuberculosis
accaccugccgcaacgggccgca

SEQ ID NO: 2867257 - RNA, 15 nt, Mycobacterium avium subsp. paratuberculosis
accaccuggccggcc

SEQ ID NO: 2867258 - RNA, 17 nt, Mycobacterium avium subsp. paratuberculosis
accaccugggcgucguc

SEQ ID NO: 2867259 - RNA, 16 nt, Mycobacterium avium subsp. paratuberculosis
accaccugguccugcc

SEQ ID NO: 2867260 - RNA, 17 nt, Mycobacterium avium subsp. paratuberculosis
accaccuucaucgccgu

SEQ ID NO: 2867261 - RNA, 18 nt, Mycobacterium avium subsp. paratuberculosis
accaccuucaucgccguc

SEQ ID NO: 2867262 - RNA, 19 nt, Mycobacterium avium subsp. paratuberculosis
accaccuucaucgccgucg

SEQ ID NO: 2867263 - RNA, 20 nt, Mycobacterium avium subsp. paratuberculosis
accaccuucaucgccgucgc

SEQ ID NO: 2867264 - RNA, 21 nt, Mycobacterium avium subsp. paratuberculosis
accaccuucaucgccgucgcc

SEQ ID NO: 2867265 - RNA, 16 nt, Mycobacterium avium subsp. paratuberculosis
accaccuugcgcagca

SEQ ID NO: 2867266 - RNA, 19 nt, Mycobacterium avium subsp. paratuberculosis
accaccuugcgcagcagca

SEQ ID NO: 2867267 - RNA, 23 nt, Mycobacterium avium subsp. paratuberculosis
accaccuugcgcagcagcagguc

SEQ ID NO: 2867268 - RNA, 17 nt, Mycobacterium avium subsp. paratuberculosis
accaccuuggccggugc

SEQ ID NO: 2867269 - RNA, 22 nt, Mycobacterium avium subsp. paratuberculosis
accaccuuggccggugcgccga

SEQ ID NO: 2867270 - RNA, 23 nt, Mycobacterium avium subsp. paratuberculosis
accaccuuggccggugcgccgac

SEQ ID NO: 2867271 - RNA, 19 nt, Mycobacterium avium subsp. paratuberculosis
accaccuugguggccgcgg

SEQ ID NO: 2867272 - RNA, 21 nt, Mycobacterium avium subsp. paratuberculosis
accaccuugguggccgcggcc

SEQ ID NO: 2867273 - RNA, 22 nt, Mycobacterium avium subsp. paratuberculosis
accaccuugguggccgcggccg

SEQ ID NO: 2867274 - RNA, 16 nt, Mycobacterium avium subsp. paratuberculosis
accaccuugucaccga

SEQ ID NO: 2867275 - RNA, 17 nt, Mycobacterium avium subsp. paratuberculosis
accaccuugucaccgaa

SEQ ID NO: 2867276 - RNA, 16 nt, Mycobacterium avium subsp. paratuberculosis
accacgaacaccggcg

SEQ ID NO: 2867277 - RNA, 20 nt, Mycobacterium avium subsp. paratuberculosis
accacgaacaccggcgcgac

SEQ ID NO: 2867278 - RNA, 19 nt, Mycobacterium avium subsp. paratuberculosis
accacgaaccaggcgccgg

SEQ ID NO: 2867279 - RNA, 22 nt, Mycobacterium avium subsp. paratuberculosis
accacgaaccaggcgccggcca

SEQ ID NO: 2867280 - RNA, 17 nt, Mycobacterium avium subsp. paratuberculosis
accacgaacgcgccgcc

SEQ ID NO: 2867281 - RNA, 16 nt, Mycobacterium avium subsp. paratuberculosis
accacgaacgcugcca

SEQ ID NO: 2867282 - RNA, 17 nt, Mycobacterium avium subsp. paratuberculosis
accacgaacugggugcc

SEQ ID NO: 2867283 - RNA, 22 nt, Mycobacterium avium subsp. paratuberculosis
accacgaacugggugccccgcc

SEQ ID NO: 2867284 - RNA, 19 nt, Mycobacterium avium subsp. paratuberculosis
accacgaagcgggcggcga

SEQ ID NO: 2867285 - RNA, 14 nt, Mycobacterium avium subsp. paratuberculosis
accacgaagcuggc

SEQ ID NO: 2867286 - RNA, 15 nt, Mycobacterium avium subsp. paratuberculosis
accacgaagggcgcc

SEQ ID NO: 2867287 - RNA, 18 nt, Mycobacterium avium subsp. paratuberculosis
accacgaagggcgccagc

SEQ ID NO: 2867288 - RNA, 20 nt, Mycobacterium avium subsp. paratuberculosis
accacgaagggcgccagcac

SEQ ID NO: 2867289 - RNA, 23 nt, Mycobacterium avium subsp. paratuberculosis
accacgaagggcgccagcaccuc

SEQ ID NO: 2867290 - RNA, 13 nt, Mycobacterium avium subsp. paratuberculosis
accacgaccagug

SEQ ID NO: 2867291 - RNA, 17 nt, Mycobacterium avium subsp. paratuberculosis
accacgaccagugcccg

SEQ ID NO: 2867292 - RNA, 20 nt, Mycobacterium avium subsp. paratuberculosis
accacgaccagugcccggcc

SEQ ID NO: 2867293 - RNA, 21 nt, Mycobacterium avium subsp. paratuberculosis
accacgaccagugcccggcca

SEQ ID NO: 2867294 - RNA, 24 nt, Mycobacterium avium subsp. paratuberculosis
accacgaccagugcccggccaacu

SEQ ID NO: 2867295 - RNA, 20 nt, Mycobacterium avium subsp. paratuberculosis
accacgaccuccgugccgau

SEQ ID NO: 2867296 - RNA, 15 nt, Mycobacterium avium subsp. paratuberculosis
accacgacgccgggc

SEQ ID NO: 2867297 - RNA, 16 nt, Mycobacterium avium subsp. paratuberculosis
accacgacgccgggcg

SEQ ID NO: 2867298 - RNA, 17 nt, Mycobacterium avium subsp. paratuberculosis
accacgacgccgggcgc

SEQ ID NO: 2867299 - RNA, 22 nt, Mycobacterium avium subsp. paratuberculosis
accacgacgucgagccagcggg

SEQ ID NO: 2867300 - RNA, 20 nt, Mycobacterium avium subsp. paratuberculosis
accacgaggcugugggccag

SEQ ID NO: 2867301 - RNA, 15 nt, Mycobacterium avium subsp. paratuberculosis
accacgaucagcgcg

SEQ ID NO: 2867302 - RNA, 18 nt, Mycobacterium avium subsp. paratuberculosis
accacgaucagcgcgucg

SEQ ID NO: 2867303 - RNA, 19 nt, Mycobacterium avium subsp. paratuberculosis
accacgaucagcgcgucga

SEQ ID NO: 2867304 - RNA, 24 nt, Mycobacterium avium subsp. paratuberculosis
accacgaucagcgcgucgaggucg

SEQ ID NO: 2867305 - RNA, 22 nt, Mycobacterium avium subsp. paratuberculosis
accacgaucugcuuggucaccu

SEQ ID NO: 2867306 - RNA, 20 nt, Mycobacterium avium subsp. paratuberculosis
accacgaugaagccgugccc

SEQ ID NO: 2867307 - RNA, 21 nt, Mycobacterium avium subsp. paratuberculosis
accacgaugaagccgugcccg

SEQ ID NO: 2867308 - RNA, 16 nt, Mycobacterium avium subsp. paratuberculosis
accacgauguugaucg

SEQ ID NO: 2867309 - RNA, 13 nt, Mycobacterium avium subsp. paratuberculosis
accacgcacacca

SEQ ID NO: 2867310 - RNA, 13 nt, Mycobacterium avium subsp. paratuberculosis
accacgccagccu

SEQ ID NO: 2867311 - RNA, 12 nt, Mycobacterium avium subsp. paratuberculosis
accacgccgacg

SEQ ID NO: 2867312 - RNA, 21 nt, Mycobacterium avium subsp. paratuberculosis
accacgccgcgcuugacggcc

SEQ ID NO: 2867313 - RNA, 19 nt, Mycobacterium avium subsp. paratuberculosis
accacgccgugcccggcgc

SEQ ID NO: 2867314 - RNA, 23 nt, Mycobacterium avium subsp. paratuberculosis
accacgccgugcccggcgcccug

SEQ ID NO: 2867315 - RNA, 18 nt, Mycobacterium avium subsp. paratuberculosis
accacgcgaucagguccg

SEQ ID NO: 2867316 - RNA, 17 nt, Mycobacterium avium subsp. paratuberculosis
accacgcgccaaugguu

SEQ ID NO: 2867317 - RNA, 12 nt, Mycobacterium avium subsp. paratuberculosis
accacgcggcgg

SEQ ID NO: 2867318 - RNA, 14 nt, Mycobacterium avium subsp. paratuberculosis
accacgcggcggcg

SEQ ID NO: 2867319 - RNA, 18 nt, Mycobacterium avium subsp. paratuberculosis
accacgcugagcaaccgc

SEQ ID NO: 2867320 - RNA, 21 nt, Mycobacterium avium subsp. paratuberculosis
accacgcugagcaaccgccga

SEQ ID NO: 2867321 - RNA, 14 nt, Mycobacterium avium subsp. paratuberculosis
accacgcuguaggg

SEQ ID NO: 2867322 - RNA, 15 nt, Mycobacterium avium subsp. paratuberculosis
accacggagcgcccg

SEQ ID NO: 2867323 - RNA, 18 nt, Mycobacterium avium subsp. paratuberculosis
accacggagcgcccggcc

SEQ ID NO: 2867324 - RNA, 22 nt, Mycobacterium avium subsp. paratuberculosis
accacggccaucacggugccga

SEQ ID NO: 2867325 - RNA, 12 nt, Mycobacterium avium subsp. paratuberculosis
accacggccaug

SEQ ID NO: 2867326 - RNA, 13 nt, Mycobacterium avium subsp. paratuberculosis
accacggccaugc

SEQ ID NO: 2867327 - RNA, 21 nt, Mycobacterium avium subsp. paratuberculosis
accacggccccagccgccgcg

SEQ ID NO: 2867328 - RNA, 12 nt, Mycobacterium avium subsp. paratuberculosis
accacggcccgc

SEQ ID NO: 2867329 - RNA, 14 nt, Mycobacterium avium subsp. paratuberculosis
accacggcccgcgc

SEQ ID NO: 2867330 - RNA, 19 nt, Mycobacterium avium subsp. paratuberculosis
accacggccgcagcggcag

SEQ ID NO: 2867331 - RNA, 15 nt, Mycobacterium avium subsp. paratuberculosis
accacggccgccgag

SEQ ID NO: 2867332 - RNA, 12 nt, Mycobacterium avium subsp. paratuberculosis
accacggcggca

SEQ ID NO: 2867333 - RNA, 12 nt, Mycobacterium avium subsp. paratuberculosis
accacggggcgg

SEQ ID NO: 2867334 - RNA, 15 nt, Mycobacterium avium subsp. paratuberculosis
accacgggucggucg

SEQ ID NO: 2867335 - RNA, 23 nt, Mycobacterium avium subsp. paratuberculosis
accacgggucggucggcccgcug

SEQ ID NO: 2867336 - RNA, 15 nt, Mycobacterium avium subsp. paratuberculosis
accacggucacagcc

SEQ ID NO: 2867337 - RNA, 16 nt, Mycobacterium avium subsp. paratuberculosis
accacggucacagccg

SEQ ID NO: 2867338 - RNA, 19 nt, Mycobacterium avium subsp. paratuberculosis
accacggucacagccgcga

SEQ ID NO: 2867339 - RNA, 20 nt, Mycobacterium avium subsp. paratuberculosis
accacggucacagccgcgau

SEQ ID NO: 2867340 - RNA, 17 nt, Mycobacterium avium subsp. paratuberculosis
accacggucaccccgag

SEQ ID NO: 2867341 - RNA, 18 nt, Mycobacterium avium subsp. paratuberculosis
accacggucagggccagc

SEQ ID NO: 2867342 - RNA, 15 nt, Mycobacterium avium subsp. paratuberculosis
accacgguccccgcg

SEQ ID NO: 2867343 - RNA, 20 nt, Mycobacterium avium subsp. paratuberculosis
accacgguccccgcgcccgc

SEQ ID NO: 2867344 - RNA, 23 nt, Mycobacterium avium subsp. paratuberculosis
accacgguccccgcgcccgccgc

SEQ ID NO: 2867345 - RNA, 14 nt, Mycobacterium avium subsp. paratuberculosis
accacggucgccgc

SEQ ID NO: 2867346 - RNA, 15 nt, Mycobacterium avium subsp. paratuberculosis
accacggucgccgcg

SEQ ID NO: 2867347 - RNA, 16 nt, Mycobacterium avium subsp. paratuberculosis
accacggucgccgcgc

SEQ ID NO: 2867348 - RNA, 14 nt, Mycobacterium avium subsp. paratuberculosis
accacggucggcgg

SEQ ID NO: 2867349 - RNA, 15 nt, Mycobacterium avium subsp. paratuberculosis
accacggucggcggg

SEQ ID NO: 2867350 - RNA, 20 nt, Mycobacterium avium subsp. paratuberculosis
accacggugaacgggccgca

SEQ ID NO: 2867351 - RNA, 20 nt, Mycobacterium avium subsp. paratuberculosis
accacggugaucucgccgag

SEQ ID NO: 2867352 - RNA, 19 nt, Mycobacterium avium subsp. paratuberculosis
accacggugcgcucgugac

SEQ ID NO: 2867353 - RNA, 14 nt, Mycobacterium avium subsp. paratuberculosis
accacgguggccgc

SEQ ID NO: 2867354 - RNA, 12 nt, Mycobacterium avium subsp. paratuberculosis
accacgguggcg

SEQ ID NO: 2867355 - RNA, 14 nt, Mycobacterium avium subsp. paratuberculosis
accacgguggcgcc

SEQ ID NO: 2867356 - RNA, 15 nt, Mycobacterium avium subsp. paratuberculosis
accacgguggcgccg

SEQ ID NO: 2867357 - RNA, 16 nt, Mycobacterium avium subsp. paratuberculosis
accacgguggcgccgc

SEQ ID NO: 2867358 - RNA, 17 nt, Mycobacterium avium subsp. paratuberculosis
accacgguggcgccgcg

SEQ ID NO: 2867359 - RNA, 18 nt, Mycobacterium avium subsp. paratuberculosis
accacgguggcgccgcgc

SEQ ID NO: 2867360 - RNA, 22 nt, Mycobacterium avium subsp. paratuberculosis
accacgguggcguccagcgggu

SEQ ID NO: 2867361 - RNA, 15 nt, Mycobacterium avium subsp. paratuberculosis
accacgguguagcgg

SEQ ID NO: 2867362 - RNA, 20 nt, Mycobacterium avium subsp. paratuberculosis
accacgguguagcggcggcu

SEQ ID NO: 2867363 - RNA, 16 nt, Mycobacterium avium subsp. paratuberculosis
accacguagccgaccu

SEQ ID NO: 2867364 - RNA, 23 nt, Mycobacterium avium subsp. paratuberculosis
accacguagccgaccuugaccca

SEQ ID NO: 2867365 - RNA, 21 nt, Mycobacterium avium subsp. paratuberculosis
accacguaggcgaucagcgcg

SEQ ID NO: 2867366 - RNA, 22 nt, Mycobacterium avium subsp. paratuberculosis
accacguaggcgaucagcgcgc

SEQ ID NO: 2867367 - RNA, 19 nt, Mycobacterium avium subsp. paratuberculosis
accacguccaccagcacca

SEQ ID NO: 2867368 - RNA, 15 nt, Mycobacterium avium subsp. paratuberculosis
accacguccagcugg

SEQ ID NO: 2867369 - RNA, 16 nt, Mycobacterium avium subsp. paratuberculosis
accacguccagcuggg

SEQ ID NO: 2867370 - RNA, 15 nt, Mycobacterium avium subsp. paratuberculosis
accacguccccgggc

SEQ ID NO: 2867371 - RNA, 15 nt, Mycobacterium avium subsp. paratuberculosis
accacguccgcggug

SEQ ID NO: 2867372 - RNA, 20 nt, Mycobacterium avium subsp. paratuberculosis
accacgucggguucgccggu

SEQ ID NO: 2867373 - RNA, 13 nt, Mycobacterium avium subsp. paratuberculosis
accacgucggugc

SEQ ID NO: 2867374 - RNA, 15 nt, Mycobacterium avium subsp. paratuberculosis
accacgucggugccg

SEQ ID NO: 2867375 - RNA, 20 nt, Mycobacterium avium subsp. paratuberculosis
accacgucgucggccugcac

SEQ ID NO: 2867376 - RNA, 14 nt, Mycobacterium avium subsp. paratuberculosis
accacgugccccuc

SEQ ID NO: 2867377 - RNA, 19 nt, Mycobacterium avium subsp. paratuberculosis
accacgugcgcgaagcugg

SEQ ID NO: 2867378 - RNA, 19 nt, Mycobacterium avium subsp. paratuberculosis
accacguugcacggcagca

SEQ ID NO: 2867379 - RNA, 15 nt, Mycobacterium avium subsp. paratuberculosis
accacguugcgcccg

SEQ ID NO: 2867380 - RNA, 16 nt, Mycobacterium avium subsp. paratuberculosis
accacguugcgcccgg

SEQ ID NO: 2867381 - RNA, 20 nt, Mycobacterium avium subsp. paratuberculosis
accacguugcgcccggccau

SEQ ID NO: 2867382 - RNA, 21 nt, Mycobacterium avium subsp. paratuberculosis
accacguugcgcccggccauc

SEQ ID NO: 2867383 - RNA, 17 nt, Mycobacterium avium subsp. paratuberculosis
accacguugcgcggccg

SEQ ID NO: 2867384 - RNA, 19 nt, Mycobacterium avium subsp. paratuberculosis
accacguugcgcggccgca

SEQ ID NO: 2867385 - RNA, 15 nt, Mycobacterium avium subsp. paratuberculosis
accacugcgccguca

SEQ ID NO: 2867386 - RNA, 23 nt, Mycobacterium avium subsp. paratuberculosis
accacugcgccgucaucgacacc

SEQ ID NO: 2867387 - RNA, 12 nt, Mycobacterium avium subsp. paratuberculosis
accacugcgcgc

SEQ ID NO: 2867388 - RNA, 18 nt, Mycobacterium avium subsp. paratuberculosis
accacuuccagcaccggc

SEQ ID NO: 2867389 - RNA, 22 nt, Mycobacterium avium subsp. paratuberculosis
accacuucuggcgcugcucgga

SEQ ID NO: 2867390 - RNA, 15 nt, Mycobacterium avium subsp. paratuberculosis
accacuugaaggagg

SEQ ID NO: 2867391 - RNA, 18 nt, Mycobacterium avium subsp. paratuberculosis
accagaaguggucgaucu

SEQ ID NO: 2867392 - RNA, 23 nt, Mycobacterium avium subsp. paratuberculosis
accagaccgaagaucaccgcgac

SEQ ID NO: 2867393 - RNA, 14 nt, Mycobacterium avium subsp. paratuberculosis
accagagcgccgga

SEQ ID NO: 2867394 - RNA, 18 nt, Mycobacterium avium subsp. paratuberculosis
accagagcgccggacucg

SEQ ID NO: 2867395 - RNA, 23 nt, Mycobacterium avium subsp. paratuberculosis
accagauccucgaauccgcgggc

SEQ ID NO: 2867396 - RNA, 23 nt, Mycobacterium avium subsp. paratuberculosis
accagaucgagcugggcccgcgc

SEQ ID NO: 2867397 - RNA, 12 nt, Mycobacterium avium subsp. paratuberculosis
accagaucggcg

SEQ ID NO: 2867398 - RNA, 17 nt, Mycobacterium avium subsp. paratuberculosis
accagaucggcgggugc

SEQ ID NO: 2867399 - RNA, 15 nt, Mycobacterium avium subsp. paratuberculosis
accagaucgucgggc

SEQ ID NO: 2867400 - RNA, 22 nt, Mycobacterium avium subsp. paratuberculosis
accagaucguguccgcgccggc

SEQ ID NO: 2867401 - RNA, 23 nt, Mycobacterium avium subsp. paratuberculosis
accagaucguguccgcgccggcg

SEQ ID NO: 2867402 - RNA, 16 nt, Mycobacterium avium subsp. paratuberculosis
accagaugcaccucgc

SEQ ID NO: 2867403 - RNA, 16 nt, Mycobacterium avium subsp. paratuberculosis
accagaugccgcucgg

SEQ ID NO: 2867404 - RNA, 14 nt, Mycobacterium avium subsp. paratuberculosis
accagaugccgggc

SEQ ID NO: 2867405 - RNA, 15 nt, Mycobacterium avium subsp. paratuberculosis
accagaugccgggcu

SEQ ID NO: 2867406 - RNA, 17 nt, Mycobacterium avium subsp. paratuberculosis
accagauucaccagcgc

SEQ ID NO: 2867407 - RNA, 18 nt, Mycobacterium avium subsp. paratuberculosis
accagauucaccagcgcc

SEQ ID NO: 2867408 - RNA, 19 nt, Mycobacterium avium subsp. paratuberculosis
accagauucaccagcgccu

SEQ ID NO: 2867409 - RNA, 23 nt, Mycobacterium avium subsp. paratuberculosis
accagcaacaccuuucggccgcg

SEQ ID NO: 2867410 - RNA, 15 nt, Mycobacterium avium subsp. paratuberculosis
accagcacccagcac

SEQ ID NO: 2867411 - RNA, 23 nt, Mycobacterium avium subsp. paratuberculosis
accagcacccagcacagcgaggc

SEQ ID NO: 2867412 - RNA, 19 nt, Mycobacterium avium subsp. paratuberculosis
accagcaccccgccgcagc

SEQ ID NO: 2867413 - RNA, 21 nt, Mycobacterium avium subsp. paratuberculosis
accagcaccccgccgcagccc

SEQ ID NO: 2867414 - RNA, 12 nt, Mycobacterium avium subsp. paratuberculosis
accagcacccgg

SEQ ID NO: 2867415 - RNA, 15 nt, Mycobacterium avium subsp. paratuberculosis
accagcaccgcaucc

SEQ ID NO: 2867416 - RNA, 12 nt, Mycobacterium avium subsp. paratuberculosis
accagcaccgcc

SEQ ID NO: 2867417 - RNA, 14 nt, Mycobacterium avium subsp. paratuberculosis
accagcaccgccgc

SEQ ID NO: 2867418 - RNA, 16 nt, Mycobacterium avium subsp. paratuberculosis
accagcaccgccgcgg

SEQ ID NO: 2867419 - RNA, 17 nt, Mycobacterium avium subsp. paratuberculosis
accagcaccgccgcggc

SEQ ID NO: 2867420 - RNA, 20 nt, Mycobacterium avium subsp. paratuberculosis
accagcaccgccgcggccgc

SEQ ID NO: 2867421 - RNA, 22 nt, Mycobacterium avium subsp. paratuberculosis
accagcaccgcggcguagcgcc

SEQ ID NO: 2867422 - RNA, 12 nt, Mycobacterium avium subsp. paratuberculosis
accagcaccggc

SEQ ID NO: 2867423 - RNA, 21 nt, Mycobacterium avium subsp. paratuberculosis
accagcaccggcaccgccagc

SEQ ID NO: 2867424 - RNA, 20 nt, Mycobacterium avium subsp. paratuberculosis
accagcacgacaccgacgac

SEQ ID NO: 2867425 - RNA, 12 nt, Mycobacterium avium subsp. paratuberculosis
accagcacggcg

SEQ ID NO: 2867426 - RNA, 18 nt, Mycobacterium avium subsp. paratuberculosis
accagcacggcgaccagc

SEQ ID NO: 2867427 - RNA, 19 nt, Mycobacterium avium subsp. paratuberculosis
accagcacggcgaccagcg

SEQ ID NO: 2867428 - RNA, 14 nt, Mycobacterium avium subsp. paratuberculosis
accagcacggcggc

SEQ ID NO: 2867429 - RNA, 16 nt, Mycobacterium avium subsp. paratuberculosis
accagcacggcggcgc

SEQ ID NO: 2867430 - RNA, 18 nt, Mycobacterium avium subsp. paratuberculosis
accagcacggcggcgcug

SEQ ID NO: 2867431 - RNA, 19 nt, Mycobacterium avium subsp. paratuberculosis
accagcagacccgacggga

SEQ ID NO: 2867432 - RNA, 10 nt, Mycobacterium avium subsp. paratuberculosis
accagcagcc

SEQ ID NO: 2867433 - RNA, 16 nt, Mycobacterium avium subsp. paratuberculosis
accagcagccagccca

SEQ ID NO: 2867434 - RNA, 18 nt, Mycobacterium avium subsp. paratuberculosis
accagcagccagcccagc

SEQ ID NO: 2867435 - RNA, 13 nt, Mycobacterium avium subsp. paratuberculosis
accagcagccgca

SEQ ID NO: 2867436 - RNA, 16 nt, Mycobacterium avium subsp. paratuberculosis
accagcagccgcagcg

SEQ ID NO: 2867437 - RNA, 17 nt, Mycobacterium avium subsp. paratuberculosis
accagcagccgcagcgc

SEQ ID NO: 2867438 - RNA, 12 nt, Mycobacterium avium subsp. paratuberculosis
accagcagccgg

SEQ ID NO: 2867439 - RNA, 19 nt, Mycobacterium avium subsp. paratuberculosis
accagcagccggucgaggu

SEQ ID NO: 2867440 - RNA, 11 nt, Mycobacterium avium subsp. paratuberculosis
accagcagcgc

SEQ ID NO: 2867441 - RNA, 12 nt, Mycobacterium avium subsp. paratuberculosis
accagcagcgcg

SEQ ID NO: 2867442 - RNA, 14 nt, Mycobacterium avium subsp. paratuberculosis
accagcagcgcgac

SEQ ID NO: 2867443 - RNA, 16 nt, Mycobacterium avium subsp. paratuberculosis
accagcagcgcgacgc

SEQ ID NO: 2867444 - RNA, 16 nt, Mycobacterium avium subsp. paratuberculosis
accagcaggacgcgcc

SEQ ID NO: 2867445 - RNA, 20 nt, Mycobacterium avium subsp. paratuberculosis
accagcaggacgcgcccggc

SEQ ID NO: 2867446 - RNA, 23 nt, Mycobacterium avium subsp. paratuberculosis
accagcaggacgcgcccggcgac

SEQ ID NO: 2867447 - RNA, 12 nt, Mycobacterium avium subsp. paratuberculosis
accagcaggucg

SEQ ID NO: 2867448 - RNA, 14 nt, Mycobacterium avium subsp. paratuberculosis
accagcaggucgag

SEQ ID NO: 2867449 - RNA, 16 nt, Mycobacterium avium subsp. paratuberculosis
accagcaggucgagca

SEQ ID NO: 2867450 - RNA, 15 nt, Mycobacterium avium subsp. paratuberculosis
accagcaugcgccag

SEQ ID NO: 2867451 - RNA, 22 nt, Mycobacterium avium subsp. paratuberculosis
accagcauggcgaucaccccgg

SEQ ID NO: 2867452 - RNA, 15 nt, Mycobacterium avium subsp. paratuberculosis
accagccacaccgcc

SEQ ID NO: 2867453 - RNA, 20 nt, Mycobacterium avium subsp. paratuberculosis
accagccacaccgccgcggc

SEQ ID NO: 2867454 - RNA, 18 nt, Mycobacterium avium subsp. paratuberculosis
accagccagaacgaacag

SEQ ID NO: 2867455 - RNA, 15 nt, Mycobacterium avium subsp. paratuberculosis
accagccccaggagg

SEQ ID NO: 2867456 - RNA, 23 nt, Mycobacterium avium subsp. paratuberculosis
accagcccccgcgggucgucgac

SEQ ID NO: 2867457 - RNA, 19 nt, Mycobacterium avium subsp. paratuberculosis
accagccccucgaccaccu

SEQ ID NO: 2867458 - RNA, 20 nt, Mycobacterium avium subsp. paratuberculosis
accagcccgaugccgccgag

SEQ ID NO: 2867459 - RNA, 21 nt, Mycobacterium avium subsp. paratuberculosis
accagcccgaugccgccgagg

SEQ ID NO: 2867460 - RNA, 13 nt, Mycobacterium avium subsp. paratuberculosis
accagcccgccgu

SEQ ID NO: 2867461 - RNA, 15 nt, Mycobacterium avium subsp. paratuberculosis
accagcccgccgucg

SEQ ID NO: 2867462 - RNA, 16 nt, Mycobacterium avium subsp. paratuberculosis
accagcccgccgucgg

SEQ ID NO: 2867463 - RNA, 12 nt, Mycobacterium avium subsp. paratuberculosis
accagcccggcc

SEQ ID NO: 2867464 - RNA, 14 nt, Mycobacterium avium subsp. paratuberculosis
accagcccggccag

SEQ ID NO: 2867465 - RNA, 20 nt, Mycobacterium avium subsp. paratuberculosis
accagcccggcccgucgagc

SEQ ID NO: 2867466 - RNA, 14 nt, Mycobacterium avium subsp. paratuberculosis
accagcccggccgc

SEQ ID NO: 2867467 - RNA, 19 nt, Mycobacterium avium subsp. paratuberculosis
accagccgagaucgacccg

SEQ ID NO: 2867468 - RNA, 22 nt, Mycobacterium avium subsp. paratuberculosis
accagccgagaucgacccgcuc

SEQ ID NO: 2867469 - RNA, 16 nt, Mycobacterium avium subsp. paratuberculosis
accagccgaggcgcuc

SEQ ID NO: 2867470 - RNA, 23 nt, Mycobacterium avium subsp. paratuberculosis
accagccgcaggugcucgccggc

SEQ ID NO: 2867471 - RNA, 19 nt, Mycobacterium avium subsp. paratuberculosis
accagccgcggacggccag

SEQ ID NO: 2867472 - RNA, 20 nt, Mycobacterium avium subsp. paratuberculosis
accagccgcggacggccagc

SEQ ID NO: 2867473 - RNA, 22 nt, Mycobacterium avium subsp. paratuberculosis
accagccgcggacggccagccc

SEQ ID NO: 2867474 - RNA, 14 nt, Mycobacterium avium subsp. paratuberculosis
accagccggccggc

SEQ ID NO: 2867475 - RNA, 20 nt, Mycobacterium avium subsp. paratuberculosis
accagccggccggccgacaa

SEQ ID NO: 2867476 - RNA, 19 nt, Mycobacterium avium subsp. paratuberculosis
accagccggccggcgaagc

SEQ ID NO: 2867477 - RNA, 21 nt, Mycobacterium avium subsp. paratuberculosis
accagccggguccgcacccgg

SEQ ID NO: 2867478 - RNA, 20 nt, Mycobacterium avium subsp. paratuberculosis
accagccgguaggccugcgu

SEQ ID NO: 2867479 - RNA, 20 nt, Mycobacterium avium subsp. paratuberculosis
accagccggucuuggacagc

SEQ ID NO: 2867480 - RNA, 23 nt, Mycobacterium avium subsp. paratuberculosis
accagccggucuuggacagcagc

SEQ ID NO: 2867481 - RNA, 20 nt, Mycobacterium avium subsp. paratuberculosis
accagccguucucguccugg

SEQ ID NO: 2867482 - RNA, 18 nt, Mycobacterium avium subsp. paratuberculosis
accagcgacagcacccgc

SEQ ID NO: 2867483 - RNA, 12 nt, Mycobacterium avium subsp. paratuberculosis
accagcgacgcc

SEQ ID NO: 2867484 - RNA, 14 nt, Mycobacterium avium subsp. paratuberculosis
accagcgacgccag

SEQ ID NO: 2867485 - RNA, 18 nt, Mycobacterium avium subsp. paratuberculosis
accagcgacgccagcggc

SEQ ID NO: 2867486 - RNA, 14 nt, Mycobacterium avium subsp. paratuberculosis
accagcgacggcag

SEQ ID NO: 2867487 - RNA, 20 nt, Mycobacterium avium subsp. paratuberculosis
accagcgagcccagcugcgc

SEQ ID NO: 2867488 - RNA, 16 nt, Mycobacterium avium subsp. paratuberculosis
accagcgauccggcgc

SEQ ID NO: 2867489 - RNA, 17 nt, Mycobacterium avium subsp. paratuberculosis
accagcgauccggcgcg

SEQ ID NO: 2867490 - RNA, 18 nt, Mycobacterium avium subsp. paratuberculosis
accagcgcaaccgcggcg

SEQ ID NO: 2867491 - RNA, 21 nt, Mycobacterium avium subsp. paratuberculosis
accagcgcacacagcagcagc

SEQ ID NO: 2867492 - RNA, 21 nt, Mycobacterium avium subsp. paratuberculosis
accagcgccacggguugagcc

SEQ ID NO: 2867493 - RNA, 13 nt, Mycobacterium avium subsp. paratuberculosis
accagcgcccgcc

SEQ ID NO: 2867494 - RNA, 18 nt, Mycobacterium avium subsp. paratuberculosis
accagcgcccgcccggac

SEQ ID NO: 2867495 - RNA, 12 nt, Mycobacterium avium subsp. paratuberculosis
accagcgccgcg

SEQ ID NO: 2867496 - RNA, 12 nt, Mycobacterium avium subsp. paratuberculosis
accagcgccucg

SEQ ID NO: 2867497 - RNA, 13 nt, Mycobacterium avium subsp. paratuberculosis
accagcgccucgc

SEQ ID NO: 2867498 - RNA, 20 nt, Mycobacterium avium subsp. paratuberculosis
accagcgcgaacagcgcggc

SEQ ID NO: 2867499 - RNA, 12 nt, Mycobacterium avium subsp. paratuberculosis
accagcgcgacg

SEQ ID NO: 2867500 - RNA, 15 nt, Mycobacterium avium subsp. paratuberculosis
accagcgcgacggug

SEQ ID NO: 2867501 - RNA, 12 nt, Mycobacterium avium subsp. paratuberculosis
accagcgcgccg

SEQ ID NO: 2867502 - RNA, 15 nt, Mycobacterium avium subsp. paratuberculosis
accagcgcgccgccc

SEQ ID NO: 2867503 - RNA, 22 nt, Mycobacterium avium subsp. paratuberculosis
accagcgcgccgcccagcggcc

SEQ ID NO: 2867504 - RNA, 14 nt, Mycobacterium avium subsp. paratuberculosis
accagcgcgccggc

SEQ ID NO: 2867505 - RNA, 18 nt, Mycobacterium avium subsp. paratuberculosis
accagcgcgccggccagc

SEQ ID NO: 2867506 - RNA, 22 nt, Mycobacterium avium subsp. paratuberculosis
accagcgcgccggccagcagca

SEQ ID NO: 2867507 - RNA, 17 nt, Mycobacterium avium subsp. paratuberculosis
accagcgcggacaccag

SEQ ID NO: 2867508 - RNA, 19 nt, Mycobacterium avium subsp. paratuberculosis
accagcgcggccaccacca

SEQ ID NO: 2867509 - RNA, 16 nt, Mycobacterium avium subsp. paratuberculosis
accagcgcguagagca

SEQ ID NO: 2867510 - RNA, 17 nt, Mycobacterium avium subsp. paratuberculosis
accagcgcguagagcau

SEQ ID NO: 2867511 - RNA, 12 nt, Mycobacterium avium subsp. paratuberculosis
accagcgcuggu

SEQ ID NO: 2867512 - RNA, 22 nt, Mycobacterium avium subsp. paratuberculosis
accagcggaucggcggucccgu

SEQ ID NO: 2867513 - RNA, 14 nt, Mycobacterium avium subsp. paratuberculosis
accagcggcaccag

SEQ ID NO: 2867514 - RNA, 11 nt, Mycobacterium avium subsp. paratuberculosis
accagcggcag

SEQ ID NO: 2867515 - RNA, 16 nt, Mycobacterium avium subsp. paratuberculosis
accagcggcagcacgu

SEQ ID NO: 2867516 - RNA, 15 nt, Mycobacterium avium subsp. paratuberculosis
accagcggcagcagc

SEQ ID NO: 2867517 - RNA, 18 nt, Mycobacterium avium subsp. paratuberculosis
accagcggcagcagcacc

SEQ ID NO: 2867518 - RNA, 19 nt, Mycobacterium avium subsp. paratuberculosis
accagcggcagcagcacca

SEQ ID NO: 2867519 - RNA, 13 nt, Mycobacterium avium subsp. paratuberculosis
accagcggcaucg

SEQ ID NO: 2867520 - RNA, 15 nt, Mycobacterium avium subsp. paratuberculosis
accagcggcaucgcc

SEQ ID NO: 2867521 - RNA, 17 nt, Mycobacterium avium subsp. paratuberculosis
accagcggcaucgccgc

SEQ ID NO: 2867522 - RNA, 19 nt, Mycobacterium avium subsp. paratuberculosis
accagcggcccaccgcgac

SEQ ID NO: 2867523 - RNA, 15 nt, Mycobacterium avium subsp. paratuberculosis
accagcggcccgcug

SEQ ID NO: 2867524 - RNA, 13 nt, Mycobacterium avium subsp. paratuberculosis
accagcggccgga

SEQ ID NO: 2867525 - RNA, 15 nt, Mycobacterium avium subsp. paratuberculosis
accagcggccgucgc

SEQ ID NO: 2867526 - RNA, 22 nt, Mycobacterium avium subsp. paratuberculosis
accagcggccgucgccgggcgg

SEQ ID NO: 2867527 - RNA, 17 nt, Mycobacterium avium subsp. paratuberculosis
accagcggccgucgcgc

SEQ ID NO: 2867528 - RNA, 12 nt, Mycobacterium avium subsp. paratuberculosis
accagcggcgcg

SEQ ID NO: 2867529 - RNA, 14 nt, Mycobacterium avium subsp. paratuberculosis
accagcggcgcgcc

SEQ ID NO: 2867530 - RNA, 21 nt, Mycobacterium avium subsp. paratuberculosis
accagcggcgcgccgggcagc

SEQ ID NO: 2867531 - RNA, 21 nt, Mycobacterium avium subsp. paratuberculosis
accagcggcgcgucgcugggc

SEQ ID NO: 2867532 - RNA, 19 nt, Mycobacterium avium subsp. paratuberculosis
accagcggcugcagcagau

SEQ ID NO: 2867533 - RNA, 15 nt, Mycobacterium avium subsp. paratuberculosis
accagcgggccgaca

SEQ ID NO: 2867534 - RNA, 22 nt, Mycobacterium avium subsp. paratuberculosis
accagcgggccgacagcacgcc

SEQ ID NO: 2867535 - RNA, 16 nt, Mycobacterium avium subsp. paratuberculosis
accagcgggcugucgg

SEQ ID NO: 2867536 - RNA, 19 nt, Mycobacterium avium subsp. paratuberculosis
accagcgggcugugccggc

SEQ ID NO: 2867537 - RNA, 22 nt, Mycobacterium avium subsp. paratuberculosis
accagcgggcugugccggcggg

SEQ ID NO: 2867538 - RNA, 21 nt, Mycobacterium avium subsp. paratuberculosis
accagcgggguguucaccgcg

SEQ ID NO: 2867539 - RNA, 13 nt, Mycobacterium avium subsp. paratuberculosis
accagcgggucga

SEQ ID NO: 2867540 - RNA, 19 nt, Mycobacterium avium subsp. paratuberculosis
accagcgggucgauggcga

SEQ ID NO: 2867541 - RNA, 18 nt, Mycobacterium avium subsp. paratuberculosis
accagcgguaaccacccg

SEQ ID NO: 2867542 - RNA, 18 nt, Mycobacterium avium subsp. paratuberculosis
accagcggucggcgguuc

SEQ ID NO: 2867543 - RNA, 14 nt, Mycobacterium avium subsp. paratuberculosis
accagcgucgacgc

SEQ ID NO: 2867544 - RNA, 19 nt, Mycobacterium avium subsp. paratuberculosis
accagcgugaccucgacgg

SEQ ID NO: 2867545 - RNA, 12 nt, Mycobacterium avium subsp. paratuberculosis
accagcgugacg

SEQ ID NO: 2867546 - RNA, 13 nt, Mycobacterium avium subsp. paratuberculosis
accagcgugacgc

SEQ ID NO: 2867547 - RNA, 15 nt, Mycobacterium avium subsp. paratuberculosis
accagcguggccggc

SEQ ID NO: 2867548 - RNA, 15 nt, Mycobacterium avium subsp. paratuberculosis
accagcguggugcgc

SEQ ID NO: 2867549 - RNA, 17 nt, Mycobacterium avium subsp. paratuberculosis
accagcguggugcgccc

SEQ ID NO: 2867550 - RNA, 20 nt, Mycobacterium avium subsp. paratuberculosis
accagcguggugcgcccguc

SEQ ID NO: 2867551 - RNA, 21 nt, Mycobacterium avium subsp. paratuberculosis
accagcguggugcgcccgucg

SEQ ID NO: 2867552 - RNA, 18 nt, Mycobacterium avium subsp. paratuberculosis
accagcgugucgccgggg

SEQ ID NO: 2867553 - RNA, 19 nt, Mycobacterium avium subsp. paratuberculosis
accagcgugucgccggggc

SEQ ID NO: 2867554 - RNA, 20 nt, Mycobacterium avium subsp. paratuberculosis
accagcgugucgccggggcg

SEQ ID NO: 2867555 - RNA, 12 nt, Mycobacterium avium subsp. paratuberculosis
accagcguguug

SEQ ID NO: 2867556 - RNA, 17 nt, Mycobacterium avium subsp. paratuberculosis
accagcguuccagcacc

SEQ ID NO: 2867557 - RNA, 22 nt, Mycobacterium avium subsp. paratuberculosis
accagcguuccagcacccggcc

SEQ ID NO: 2867558 - RNA, 18 nt, Mycobacterium avium subsp. paratuberculosis
accagcucgaggccgcgg

SEQ ID NO: 2867559 - RNA, 15 nt, Mycobacterium avium subsp. paratuberculosis
accagcucgaugccg

SEQ ID NO: 2867560 - RNA, 16 nt, Mycobacterium avium subsp. paratuberculosis
accagcucgccgaugu

SEQ ID NO: 2867561 - RNA, 20 nt, Mycobacterium avium subsp. paratuberculosis
accagcucggugaucaccau

SEQ ID NO: 2867562 - RNA, 13 nt, Mycobacterium avium subsp. paratuberculosis
accagcucgucgc

SEQ ID NO: 2867563 - RNA, 15 nt, Mycobacterium avium subsp. paratuberculosis
accagcucgugcagc

SEQ ID NO: 2867564 - RNA, 21 nt, Mycobacterium avium subsp. paratuberculosis
accagcugauucgcgguggcg

SEQ ID NO: 2867565 - RNA, 18 nt, Mycobacterium avium subsp. paratuberculosis
accagcugcccaccagca

SEQ ID NO: 2867566 - RNA, 20 nt, Mycobacterium avium subsp. paratuberculosis
accagcuggauggcgcccag

SEQ ID NO: 2867567 - RNA, 15 nt, Mycobacterium avium subsp. paratuberculosis
accagcugucccagu

SEQ ID NO: 2867568 - RNA, 22 nt, Mycobacterium avium subsp. paratuberculosis
accaggaacacggcucgggggc

SEQ ID NO: 2867569 - RNA, 23 nt, Mycobacterium avium subsp. paratuberculosis
accaggaacacggcucgggggcc

SEQ ID NO: 2867570 - RNA, 21 nt, Mycobacterium avium subsp. paratuberculosis
accaggaaggcgaccgcguag

SEQ ID NO: 2867571 - RNA, 20 nt, Mycobacterium avium subsp. paratuberculosis
accaggaaguacaccaccgc

SEQ ID NO: 2867572 - RNA, 21 nt, Mycobacterium avium subsp. paratuberculosis
accaggaaguacaccaccgcg

SEQ ID NO: 2867573 - RNA, 14 nt, Mycobacterium avium subsp. paratuberculosis
accaggaccagguu

SEQ ID NO: 2867574 - RNA, 14 nt, Mycobacterium avium subsp. paratuberculosis
accaggacgucggc

SEQ ID NO: 2867575 - RNA, 18 nt, Mycobacterium avium subsp. paratuberculosis
accaggacgucggccggc

SEQ ID NO: 2867576 - RNA, 17 nt, Mycobacterium avium subsp. paratuberculosis
accaggagcaccugcgc

SEQ ID NO: 2867577 - RNA, 18 nt, Mycobacterium avium subsp. paratuberculosis
accaggagcaccugcgcg

SEQ ID NO: 2867578 - RNA, 20 nt, Mycobacterium avium subsp. paratuberculosis
accaggagcaccugcgcgac

SEQ ID NO: 2867579 - RNA, 20 nt, Mycobacterium avium subsp. paratuberculosis
accaggaugcccaggaugau

SEQ ID NO: 2867580 - RNA, 21 nt, Mycobacterium avium subsp. paratuberculosis
accaggaugucuccgcgcagc

SEQ ID NO: 2867581 - RNA, 22 nt, Mycobacterium avium subsp. paratuberculosis
accaggcccagcggaucgaggu

SEQ ID NO: 2867582 - RNA, 12 nt, Mycobacterium avium subsp. paratuberculosis
accaggcccagg

SEQ ID NO: 2867583 - RNA, 18 nt, Mycobacterium avium subsp. paratuberculosis
accaggcccuccugggug

SEQ ID NO: 2867584 - RNA, 17 nt, Mycobacterium avium subsp. paratuberculosis
accaggcccucgccgcg

SEQ ID NO: 2867585 - RNA, 20 nt, Mycobacterium avium subsp. paratuberculosis
accaggccgacgcuggccga

SEQ ID NO: 2867586 - RNA, 14 nt, Mycobacterium avium subsp. paratuberculosis
accaggccgcgcug

SEQ ID NO: 2867587 - RNA, 19 nt, Mycobacterium avium subsp. paratuberculosis
accaggccgcgcuggcgca

SEQ ID NO: 2867588 - RNA, 17 nt, Mycobacterium avium subsp. paratuberculosis
accaggccuuccgcaac

SEQ ID NO: 2867589 - RNA, 20 nt, Mycobacterium avium subsp. paratuberculosis
accaggccuuccgcaacauc

SEQ ID NO: 2867590 - RNA, 13 nt, Mycobacterium avium subsp. paratuberculosis
accaggcgacguu

SEQ ID NO: 2867591 - RNA, 13 nt, Mycobacterium avium subsp. paratuberculosis
accaggcgcacca

SEQ ID NO: 2867592 - RNA, 16 nt, Mycobacterium avium subsp. paratuberculosis
accaggcgcaccagcu

SEQ ID NO: 2867593 - RNA, 17 nt, Mycobacterium avium subsp. paratuberculosis
accaggcgccacagcag

SEQ ID NO: 2867594 - RNA, 19 nt, Mycobacterium avium subsp. paratuberculosis
accaggcgccacagcagca

SEQ ID NO: 2867595 - RNA, 13 nt, Mycobacterium avium subsp. paratuberculosis
accaggcgccggc

SEQ ID NO: 2867596 - RNA, 20 nt, Mycobacterium avium subsp. paratuberculosis
accaggcgccggccagcacg

SEQ ID NO: 2867597 - RNA, 15 nt, Mycobacterium avium subsp. paratuberculosis
accaggcgccgucga

SEQ ID NO: 2867598 - RNA, 20 nt, Mycobacterium avium subsp. paratuberculosis
accaggcgugcacccgguuc

SEQ ID NO: 2867599 - RNA, 19 nt, Mycobacterium avium subsp. paratuberculosis
accaggcucgcucccgcgc

SEQ ID NO: 2867600 - RNA, 20 nt, Mycobacterium avium subsp. paratuberculosis
accaggcucgcucccgcgcg

SEQ ID NO: 2867601 - RNA, 22 nt, Mycobacterium avium subsp. paratuberculosis
accaggcucgcucccgcgcggg

SEQ ID NO: 2867602 - RNA, 21 nt, Mycobacterium avium subsp. paratuberculosis
accaggcugaacgucgucagc

SEQ ID NO: 2867603 - RNA, 18 nt, Mycobacterium avium subsp. paratuberculosis
accaggcugcucggcggg

SEQ ID NO: 2867604 - RNA, 21 nt, Mycobacterium avium subsp. paratuberculosis
accaggcuuggcccgccgccg

SEQ ID NO: 2867605 - RNA, 22 nt, Mycobacterium avium subsp. paratuberculosis
accaggcuuggcccgccgccgg

SEQ ID NO: 2867606 - RNA, 14 nt, Mycobacterium avium subsp. paratuberculosis
accagggacaugcc

SEQ ID NO: 2867607 - RNA, 16 nt, Mycobacterium avium subsp. paratuberculosis
accagggacaugccga

SEQ ID NO: 2867608 - RNA, 19 nt, Mycobacterium avium subsp. paratuberculosis
accagggacaugccgagca

SEQ ID NO: 2867609 - RNA, 21 nt, Mycobacterium avium subsp. paratuberculosis
accagggacaugccgagcagc

SEQ ID NO: 2867610 - RNA, 14 nt, Mycobacterium avium subsp. paratuberculosis
accagggcagccag

SEQ ID NO: 2867611 - RNA, 17 nt, Mycobacterium avium subsp. paratuberculosis
accagggcagccagccc

SEQ ID NO: 2867612 - RNA, 18 nt, Mycobacterium avium subsp. paratuberculosis
accagggcagccagcccg

SEQ ID NO: 2867613 - RNA, 14 nt, Mycobacterium avium subsp. paratuberculosis
accagggcagcgcc

SEQ ID NO: 2867614 - RNA, 14 nt, Mycobacterium avium subsp. paratuberculosis
accagggccugcag

SEQ ID NO: 2867615 - RNA, 15 nt, Mycobacterium avium subsp. paratuberculosis
accagggccugcagc

SEQ ID NO: 2867616 - RNA, 16 nt, Mycobacterium avium subsp. paratuberculosis
accagggcgaccgccg

SEQ ID NO: 2867617 - RNA, 17 nt, Mycobacterium avium subsp. paratuberculosis
accagggcgaccgccgc

SEQ ID NO: 2867618 - RNA, 18 nt, Mycobacterium avium subsp. paratuberculosis
accagggcgaggaacccg

SEQ ID NO: 2867619 - RNA, 19 nt, Mycobacterium avium subsp. paratuberculosis
accagggcgaggaacccga

SEQ ID NO: 2867620 - RNA, 20 nt, Mycobacterium avium subsp. paratuberculosis
accagggcgaggaacccgac

SEQ ID NO: 2867621 - RNA, 20 nt, Mycobacterium avium subsp. paratuberculosis
accagggcgaucaccgcggc

SEQ ID NO: 2867622 - RNA, 22 nt, Mycobacterium avium subsp. paratuberculosis
accagggcgaucaccgcggcca

SEQ ID NO: 2867623 - RNA, 19 nt, Mycobacterium avium subsp. paratuberculosis
accagggcgguggcggcga

SEQ ID NO: 2867624 - RNA, 18 nt, Mycobacterium avium subsp. paratuberculosis
accagggcgucgagcgcg

SEQ ID NO: 2867625 - RNA, 21 nt, Mycobacterium avium subsp. paratuberculosis
accagggcgucgagcgcgucg

SEQ ID NO: 2867626 - RNA, 15 nt, Mycobacterium avium subsp. paratuberculosis
accaggggcagcuga

SEQ ID NO: 2867627 - RNA, 18 nt, Mycobacterium avium subsp. paratuberculosis
accagggucuucagcccg

SEQ ID NO: 2867628 - RNA, 18 nt, Mycobacterium avium subsp. paratuberculosis
accagggugccccgcgac

SEQ ID NO: 2867629 - RNA, 24 nt, Mycobacterium avium subsp. paratuberculosis
accagggugccccgcgaccgcagc

SEQ ID NO: 2867630 - RNA, 13 nt, Mycobacterium avium subsp. paratuberculosis
accagggugccgc

SEQ ID NO: 2867631 - RNA, 18 nt, Mycobacterium avium subsp. paratuberculosis
accagggugccgccgggc

SEQ ID NO: 2867632 - RNA, 12 nt, Mycobacterium avium subsp. paratuberculosis
accagggugcgc

SEQ ID NO: 2867633 - RNA, 13 nt, Mycobacterium avium subsp. paratuberculosis
accagggugcgca

SEQ ID NO: 2867634 - RNA, 20 nt, Mycobacterium avium subsp. paratuberculosis
accagggugcgcagcgcguc

SEQ ID NO: 2867635 - RNA, 21 nt, Mycobacterium avium subsp. paratuberculosis
accagggugcgcagcgcgucg

SEQ ID NO: 2867636 - RNA, 12 nt, Mycobacterium avium subsp. paratuberculosis
accaggguggcc

SEQ ID NO: 2867637 - RNA, 15 nt, Mycobacterium avium subsp. paratuberculosis
accaggguggcccca

SEQ ID NO: 2867638 - RNA, 18 nt, Mycobacterium avium subsp. paratuberculosis
accaggguggccccagcc

SEQ ID NO: 2867639 - RNA, 17 nt, Mycobacterium avium subsp. paratuberculosis
accaggguggccgccac

SEQ ID NO: 2867640 - RNA, 18 nt, Mycobacterium avium subsp. paratuberculosis
accaggguggccgccacc

SEQ ID NO: 2867641 - RNA, 19 nt, Mycobacterium avium subsp. paratuberculosis
accaggguggccgccacca

SEQ ID NO: 2867642 - RNA, 15 nt, Mycobacterium avium subsp. paratuberculosis
accaggguggucagc

SEQ ID NO: 2867643 - RNA, 23 nt, Mycobacterium avium subsp. paratuberculosis
accaggguggucagcgucucggc

SEQ ID NO: 2867644 - RNA, 22 nt, Mycobacterium avium subsp. paratuberculosis
accaggguuucaugcacggcgc

SEQ ID NO: 2867645 - RNA, 17 nt, Mycobacterium avium subsp. paratuberculosis
accagguaccggcgggc

SEQ ID NO: 2867646 - RNA, 19 nt, Mycobacterium avium subsp. paratuberculosis
accagguagauggugaucg

SEQ ID NO: 2867647 - RNA, 23 nt, Mycobacterium avium subsp. paratuberculosis
accagguagcgcugcauagucgg

SEQ ID NO: 2867648 - RNA, 17 nt, Mycobacterium avium subsp. paratuberculosis
accagguaggcgaccau

SEQ ID NO: 2867649 - RNA, 19 nt, Mycobacterium avium subsp. paratuberculosis
accagguaggcgaccaugc

SEQ ID NO: 2867650 - RNA, 21 nt, Mycobacterium avium subsp. paratuberculosis
accagguaggcgguggcgcac

SEQ ID NO: 2867651 - RNA, 17 nt, Mycobacterium avium subsp. paratuberculosis
accagguccaccccgcc

SEQ ID NO: 2867652 - RNA, 12 nt, Mycobacterium avium subsp. paratuberculosis
accagguccggu

SEQ ID NO: 2867653 - RNA, 19 nt, Mycobacterium avium subsp. paratuberculosis
accaggucgagggucgaga

SEQ ID NO: 2867654 - RNA, 20 nt, Mycobacterium avium subsp. paratuberculosis
accaggucgagguccucggc

SEQ ID NO: 2867655 - RNA, 18 nt, Mycobacterium avium subsp. paratuberculosis
accaggucgcacaccagc

SEQ ID NO: 2867656 - RNA, 21 nt, Mycobacterium avium subsp. paratuberculosis
accaggucgcacaccagcacg

SEQ ID NO: 2867657 - RNA, 14 nt, Mycobacterium avium subsp. paratuberculosis
accaggucgccggc

SEQ ID NO: 2867658 - RNA, 15 nt, Mycobacterium avium subsp. paratuberculosis
accaggucgccggcg

SEQ ID NO: 2867659 - RNA, 17 nt, Mycobacterium avium subsp. paratuberculosis
accaggucgccggcggc

SEQ ID NO: 2867660 - RNA, 21 nt, Mycobacterium avium subsp. paratuberculosis
accaggucgccggcggccgac

SEQ ID NO: 2867661 - RNA, 22 nt, Mycobacterium avium subsp. paratuberculosis
accaggucgccggcggccgaca

SEQ ID NO: 2867662 - RNA, 18 nt, Mycobacterium avium subsp. paratuberculosis
accaggucgcggcgcugc

SEQ ID NO: 2867663 - RNA, 15 nt, Mycobacterium avium subsp. paratuberculosis
accaggucuccgucg

SEQ ID NO: 2867664 - RNA, 17 nt, Mycobacterium avium subsp. paratuberculosis
accaggucuccgucggc

SEQ ID NO: 2867665 - RNA, 18 nt, Mycobacterium avium subsp. paratuberculosis
accaggucuccgucggcg

SEQ ID NO: 2867666 - RNA, 16 nt, Mycobacterium avium subsp. paratuberculosis
accaggugggcggcca

SEQ ID NO: 2867667 - RNA, 16 nt, Mycobacterium avium subsp. paratuberculosis
accagguucgcgcagc

SEQ ID NO: 2867668 - RNA, 18 nt, Mycobacterium avium subsp. paratuberculosis
accagguucgcgcagcuc

SEQ ID NO: 2867669 - RNA, 16 nt, Mycobacterium avium subsp. paratuberculosis
accagguugucgccgc

SEQ ID NO: 2867670 - RNA, 17 nt, Mycobacterium avium subsp. paratuberculosis
accagguugucgccgcg

SEQ ID NO: 2867671 - RNA, 18 nt, Mycobacterium avium subsp. paratuberculosis
accagguugucgccgcgc

SEQ ID NO: 2867672 - RNA, 21 nt, Mycobacterium avium subsp. paratuberculosis
accagguugucgccgcgccag

SEQ ID NO: 2867673 - RNA, 23 nt, Mycobacterium avium subsp. paratuberculosis
accagguugucgccgcgccagcc

SEQ ID NO: 2867674 - RNA, 18 nt, Mycobacterium avium subsp. paratuberculosis
accaguagaaguggccga

SEQ ID NO: 2867675 - RNA, 16 nt, Mycobacterium avium subsp. paratuberculosis
accaguaggucacccg

SEQ ID NO: 2867676 - RNA, 17 nt, Mycobacterium avium subsp. paratuberculosis
accaguaggucacccgg

SEQ ID NO: 2867677 - RNA, 14 nt, Mycobacterium avium subsp. paratuberculosis
accagucgcgcagc

SEQ ID NO: 2867678 - RNA, 16 nt, Mycobacterium avium subsp. paratuberculosis
accagucgcgcagcgu

SEQ ID NO: 2867679 - RNA, 12 nt, Mycobacterium avium subsp. paratuberculosis
accagucggcca

SEQ ID NO: 2867680 - RNA, 21 nt, Mycobacterium avium subsp. paratuberculosis
accagucggcgcguuggccga

SEQ ID NO: 2867681 - RNA, 15 nt, Mycobacterium avium subsp. paratuberculosis
accagugcacgcucg

SEQ ID NO: 2867682 - RNA, 17 nt, Mycobacterium avium subsp. paratuberculosis
accagugcacgcucggc

SEQ ID NO: 2867683 - RNA, 15 nt, Mycobacterium avium subsp. paratuberculosis
accagugcagagcga

SEQ ID NO: 2867684 - RNA, 13 nt, Mycobacterium avium subsp. paratuberculosis
accagugcccggc

SEQ ID NO: 2867685 - RNA, 16 nt, Mycobacterium avium subsp. paratuberculosis
accagugcccggccaa

SEQ ID NO: 2867686 - RNA, 16 nt, Mycobacterium avium subsp. paratuberculosis
accagugcccggccau

SEQ ID NO: 2867687 - RNA, 15 nt, Mycobacterium avium subsp. paratuberculosis
accagugguggccga

SEQ ID NO: 2867688 - RNA, 15 nt, Mycobacterium avium subsp. paratuberculosis
accagugucagggca

SEQ ID NO: 2867689 - RNA, 16 nt, Mycobacterium avium subsp. paratuberculosis
accagugucagggcag

SEQ ID NO: 2867690 - RNA, 21 nt, Mycobacterium avium subsp. paratuberculosis
accagugucagggcagcggug

SEQ ID NO: 2867691 - RNA, 20 nt, Mycobacterium avium subsp. paratuberculosis
accaguguccgggcgcccag

SEQ ID NO: 2867692 - RNA, 18 nt, Mycobacterium avium subsp. paratuberculosis
accaguuccugcaugccg

SEQ ID NO: 2867693 - RNA, 23 nt, Mycobacterium avium subsp. paratuberculosis
accaguuccugcaugccgggcag

SEQ ID NO: 2867694 - RNA, 18 nt, Mycobacterium avium subsp. paratuberculosis
accaguucgccaccacgg

SEQ ID NO: 2867695 - RNA, 20 nt, Mycobacterium avium subsp. paratuberculosis
accaguucgcccuggccgcg

SEQ ID NO: 2867696 - RNA, 15 nt, Mycobacterium avium subsp. paratuberculosis
accaguugcaccggc

SEQ ID NO: 2867697 - RNA, 17 nt, Mycobacterium avium subsp. paratuberculosis
accaguuucacgucggc

SEQ ID NO: 2867698 - RNA, 18 nt, Mycobacterium avium subsp. paratuberculosis
accaguuucacgucggcg

SEQ ID NO: 2867699 - RNA, 20 nt, Mycobacterium avium subsp. paratuberculosis
accaguuucacgucggcgau

SEQ ID NO: 2867700 - RNA, 19 nt, Mycobacterium avium subsp. paratuberculosis
accaucaccuguacguguc

SEQ ID NO: 2867701 - RNA, 13 nt, Mycobacterium avium subsp. paratuberculosis
accaucagcgccc

SEQ ID NO: 2867702 - RNA, 15 nt, Mycobacterium avium subsp. paratuberculosis
accaucagcggcucg

SEQ ID NO: 2867703 - RNA, 18 nt, Mycobacterium avium subsp. paratuberculosis
accaucaggccggccugc

SEQ ID NO: 2867704 - RNA, 23 nt, Mycobacterium avium subsp. paratuberculosis
accauccagugcaguucgaugcc

SEQ ID NO: 2867705 - RNA, 20 nt, Mycobacterium avium subsp. paratuberculosis
accaucccgccgccgaacag

SEQ ID NO: 2867706 - RNA, 17 nt, Mycobacterium avium subsp. paratuberculosis
accauccgcgacgccag

SEQ ID NO: 2867707 - RNA, 20 nt, Mycobacterium avium subsp. paratuberculosis
accauccgcgacgccagcac

SEQ ID NO: 2867708 - RNA, 14 nt, Mycobacterium avium subsp. paratuberculosis
accaucgaggcgau

SEQ ID NO: 2867709 - RNA, 21 nt, Mycobacterium avium subsp. paratuberculosis
accaucgcgauggaagcgccc

SEQ ID NO: 2867710 - RNA, 20 nt, Mycobacterium avium subsp. paratuberculosis
accaucgggucgucggcguc

SEQ ID NO: 2867711 - RNA, 14 nt, Mycobacterium avium subsp. paratuberculosis
accaucuacgaccu

SEQ ID NO: 2867712 - RNA, 15 nt, Mycobacterium avium subsp. paratuberculosis
accaucugccggcgc

SEQ ID NO: 2867713 - RNA, 12 nt, Mycobacterium avium subsp. paratuberculosis
accaucuuccau

SEQ ID NO: 2867714 - RNA, 18 nt, Mycobacterium avium subsp. paratuberculosis
accaugaucagcgccgug

SEQ ID NO: 2867715 - RNA, 18 nt, Mycobacterium avium subsp. paratuberculosis
accaugaucaggccccac

SEQ ID NO: 2867716 - RNA, 15 nt, Mycobacterium avium subsp. paratuberculosis
accaugauguagcgg

SEQ ID NO: 2867717 - RNA, 13 nt, Mycobacterium avium subsp. paratuberculosis
accaugcccggcg

SEQ ID NO: 2867718 - RNA, 14 nt, Mycobacterium avium subsp. paratuberculosis
accaugccgccgaa

SEQ ID NO: 2867719 - RNA, 22 nt, Mycobacterium avium subsp. paratuberculosis
accaugccgccgaagcccgaca

SEQ ID NO: 2867720 - RNA, 14 nt, Mycobacterium avium subsp. paratuberculosis
accaugccggcguc

SEQ ID NO: 2867721 - RNA, 20 nt, Mycobacterium avium subsp. paratuberculosis
accaugccguagcggucgcc

SEQ ID NO: 2867722 - RNA, 23 nt, Mycobacterium avium subsp. paratuberculosis
accauggcuuccgccgagacggc

SEQ ID NO: 2867723 - RNA, 16 nt, Mycobacterium avium subsp. paratuberculosis
accaugucggccaggu

SEQ ID NO: 2867724 - RNA, 14 nt, Mycobacterium avium subsp. paratuberculosis
accaugucggcgac

SEQ ID NO: 2867725 - RNA, 20 nt, Mycobacterium avium subsp. paratuberculosis
accaugucggcgacccgcac

SEQ ID NO: 2867726 - RNA, 21 nt, Mycobacterium avium subsp. paratuberculosis
accaugucggcgucgccgagc

SEQ ID NO: 2867727 - RNA, 21 nt, Mycobacterium avium subsp. paratuberculosis
accauguuccagaaccggcag

SEQ ID NO: 2867728 - RNA, 20 nt, Mycobacterium avium subsp. paratuberculosis
accauugcgggaagggcccg

SEQ ID NO: 2867729 - RNA, 16 nt, Mycobacterium avium subsp. paratuberculosis
acccaaaaaggcgcgg

SEQ ID NO: 2867730 - RNA, 15 nt, Mycobacterium avium subsp. paratuberculosis
acccaaaacaucggc

SEQ ID NO: 2867731 - RNA, 15 nt, Mycobacterium avium subsp. paratuberculosis
acccacaccucgcag

SEQ ID NO: 2867732 - RNA, 20 nt, Mycobacterium avium subsp. paratuberculosis
acccacacguugagcccgga

SEQ ID NO: 2867733 - RNA, 22 nt, Mycobacterium avium subsp. paratuberculosis
acccacacguugagcccggacc

SEQ ID NO: 2867734 - RNA, 23 nt, Mycobacterium avium subsp. paratuberculosis
acccaccagccgagaucgacccg

SEQ ID NO: 2867735 - RNA, 21 nt, Mycobacterium avium subsp. paratuberculosis
acccaccccgaucggggccag

SEQ ID NO: 2867736 - RNA, 14 nt, Mycobacterium avium subsp. paratuberculosis
acccaccggcccag

SEQ ID NO: 2867737 - RNA, 19 nt, Mycobacterium avium subsp. paratuberculosis
acccaccggcccagccggc

SEQ ID NO: 2867738 - RNA, 21 nt, Mycobacterium avium subsp. paratuberculosis
acccaccggcccagccggcgg

SEQ ID NO: 2867739 - RNA, 22 nt, Mycobacterium avium subsp. paratuberculosis
acccaccggcccagccggcggu

SEQ ID NO: 2867740 - RNA, 14 nt, Mycobacterium avium subsp. paratuberculosis
acccaccggcgcag

SEQ ID NO: 2867741 - RNA, 19 nt, Mycobacterium avium subsp. paratuberculosis
acccacgccagccgggugg

SEQ ID NO: 2867742 - RNA, 12 nt, Mycobacterium avium subsp. paratuberculosis
acccacggccac

SEQ ID NO: 2867743 - RNA, 14 nt, Mycobacterium avium subsp. paratuberculosis
acccacggccacaa

SEQ ID NO: 2867744 - RNA, 15 nt, Mycobacterium avium subsp. paratuberculosis
acccacggccacaac

SEQ ID NO: 2867745 - RNA, 17 nt, Mycobacterium avium subsp. paratuberculosis
acccacggccacaacgu

SEQ ID NO: 2867746 - RNA, 20 nt, Mycobacterium avium subsp. paratuberculosis
acccacggccacaacgucuc

SEQ ID NO: 2867747 - RNA, 13 nt, Mycobacterium avium subsp. paratuberculosis
acccacgugcggc

SEQ ID NO: 2867748 - RNA, 16 nt, Mycobacterium avium subsp. paratuberculosis
acccacgugcggcgcc

SEQ ID NO: 2867749 - RNA, 17 nt, Mycobacterium avium subsp. paratuberculosis
acccacgugcggcgccc

SEQ ID NO: 2867750 - RNA, 16 nt, Mycobacterium avium subsp. paratuberculosis
acccacucccagccgc

SEQ ID NO: 2867751 - RNA, 23 nt, Mycobacterium avium subsp. paratuberculosis
acccacucccagccgccggccac

SEQ ID NO: 2867752 - RNA, 11 nt, Mycobacterium avium subsp. paratuberculosis
acccacuggcg

SEQ ID NO: 2867753 - RNA, 15 nt, Mycobacterium avium subsp. paratuberculosis
acccacuggcggccg

SEQ ID NO: 2867754 - RNA, 17 nt, Mycobacterium avium subsp. paratuberculosis
acccacuggcggccggc

SEQ ID NO: 2867755 - RNA, 19 nt, Mycobacterium avium subsp. paratuberculosis
acccacuggcggccggccg

SEQ ID NO: 2867756 - RNA, 20 nt, Mycobacterium avium subsp. paratuberculosis
acccacuggcggccggccgc

SEQ ID NO: 2867757 - RNA, 22 nt, Mycobacterium avium subsp. paratuberculosis
acccacuggcggccggccgcgc

SEQ ID NO: 2867758 - RNA, 16 nt, Mycobacterium avium subsp. paratuberculosis
acccagaaacaccauc

SEQ ID NO: 2867759 - RNA, 22 nt, Mycobacterium avium subsp. paratuberculosis
acccagacguguggcacccggg

SEQ ID NO: 2867760 - RNA, 22 nt, Mycobacterium avium subsp. paratuberculosis
acccagacuugggcagcaggug

SEQ ID NO: 2867761 - RNA, 16 nt, Mycobacterium avium subsp. paratuberculosis
acccagaugcccagcg

SEQ ID NO: 2867762 - RNA, 20 nt, Mycobacterium avium subsp. paratuberculosis
acccagcacagcgaggcgac

SEQ ID NO: 2867763 - RNA, 15 nt, Mycobacterium avium subsp. paratuberculosis
acccagcaccaccac

SEQ ID NO: 2867764 - RNA, 18 nt, Mycobacterium avium subsp. paratuberculosis
acccagcaccaccacgcu

SEQ ID NO: 2867765 - RNA, 21 nt, Mycobacterium avium subsp. paratuberculosis
acccagcaccaccacgcuggc

SEQ ID NO: 2867766 - RNA, 19 nt, Mycobacterium avium subsp. paratuberculosis
acccagcaccccgguccag

SEQ ID NO: 2867767 - RNA, 17 nt, Mycobacterium avium subsp. paratuberculosis
acccagcagcggccggc

SEQ ID NO: 2867768 - RNA, 18 nt, Mycobacterium avium subsp. paratuberculosis
acccagcagcggccggcg

SEQ ID NO: 2867769 - RNA, 13 nt, Mycobacterium avium subsp. paratuberculosis
acccagcaucgcc

SEQ ID NO: 2867770 - RNA, 17 nt, Mycobacterium avium subsp. paratuberculosis
acccagcaucgccgcgg

SEQ ID NO: 2867771 - RNA, 19 nt, Mycobacterium avium subsp. paratuberculosis
acccagcaucgccgcggug

SEQ ID NO: 2867772 - RNA, 19 nt, Mycobacterium avium subsp. paratuberculosis
acccagcccagcugcucga

SEQ ID NO: 2867773 - RNA, 15 nt, Mycobacterium avium subsp. paratuberculosis
acccagcccggcgac

SEQ ID NO: 2867774 - RNA, 16 nt, Mycobacterium avium subsp. paratuberculosis
acccagcccggcgacg

SEQ ID NO: 2867775 - RNA, 17 nt, Mycobacterium avium subsp. paratuberculosis
acccagcccggcgacga

SEQ ID NO: 2867776 - RNA, 11 nt, Mycobacterium avium subsp. paratuberculosis
acccagccgca

SEQ ID NO: 2867777 - RNA, 16 nt, Mycobacterium avium subsp. paratuberculosis
acccagccgcauucgg

SEQ ID NO: 2867778 - RNA, 22 nt, Mycobacterium avium subsp. paratuberculosis
acccagccgugccccaggucgg

SEQ ID NO: 2867779 - RNA, 21 nt, Mycobacterium avium subsp. paratuberculosis
acccagcgagcucaggccggc

SEQ ID NO: 2867780 - RNA, 14 nt, Mycobacterium avium subsp. paratuberculosis
acccagcgccagga

SEQ ID NO: 2867781 - RNA, 13 nt, Mycobacterium avium subsp. paratuberculosis
acccagcgccucg

SEQ ID NO: 2867782 - RNA, 14 nt, Mycobacterium avium subsp. paratuberculosis
acccagcgccucga

SEQ ID NO: 2867783 - RNA, 21 nt, Mycobacterium avium subsp. paratuberculosis
acccagcgccucgagcaccac

SEQ ID NO: 2867784 - RNA, 23 nt, Mycobacterium avium subsp. paratuberculosis
acccagcggaaccgggggccguc

SEQ ID NO: 2867785 - RNA, 13 nt, Mycobacterium avium subsp. paratuberculosis
acccagcggcgcg

SEQ ID NO: 2867786 - RNA, 17 nt, Mycobacterium avium subsp. paratuberculosis
acccagcggcgcggccg

SEQ ID NO: 2867787 - RNA, 21 nt, Mycobacterium avium subsp. paratuberculosis
acccagcgggcgacgucgggg

SEQ ID NO: 2867788 - RNA, 24 nt, Mycobacterium avium subsp. paratuberculosis
acccagcgggcgacgucggggucg

SEQ ID NO: 2867789 - RNA, 15 nt, Mycobacterium avium subsp. paratuberculosis
acccagcgucaggau

SEQ ID NO: 2867790 - RNA, 18 nt, Mycobacterium avium subsp. paratuberculosis
acccagcuccucggccag

SEQ ID NO: 2867791 - RNA, 21 nt, Mycobacterium avium subsp. paratuberculosis
acccagcuccucggccagcac

SEQ ID NO: 2867792 - RNA, 18 nt, Mycobacterium avium subsp. paratuberculosis
acccagcuugaccacccg

SEQ ID NO: 2867793 - RNA, 23 nt, Mycobacterium avium subsp. paratuberculosis
acccagcuugaccacccggucga

SEQ ID NO: 2867794 - RNA, 18 nt, Mycobacterium avium subsp. paratuberculosis
acccaggaaaaccagcga

SEQ ID NO: 2867795 - RNA, 22 nt, Mycobacterium avium subsp. paratuberculosis
acccaggcagcgcgacugggug

SEQ ID NO: 2867796 - RNA, 13 nt, Mycobacterium avium subsp. paratuberculosis
acccaggccaccc

SEQ ID NO: 2867797 - RNA, 15 nt, Mycobacterium avium subsp. paratuberculosis
acccaggccacccgg

SEQ ID NO: 2867798 - RNA, 17 nt, Mycobacterium avium subsp. paratuberculosis
acccaggccacccgggc

SEQ ID NO: 2867799 - RNA, 19 nt, Mycobacterium avium subsp. paratuberculosis
acccaggccacccgggcgc

SEQ ID NO: 2867800 - RNA, 23 nt, Mycobacterium avium subsp. paratuberculosis
acccaggccgaguauccgcgcag

SEQ ID NO: 2867801 - RNA, 22 nt, Mycobacterium avium subsp. paratuberculosis
acccagggcaacgaacgcggcg

SEQ ID NO: 2867802 - RNA, 23 nt, Mycobacterium avium subsp. paratuberculosis
acccaggucaugguggcggcgcc

SEQ ID NO: 2867803 - RNA, 14 nt, Mycobacterium avium subsp. paratuberculosis
acccaggucggcgu

SEQ ID NO: 2867804 - RNA, 16 nt, Mycobacterium avium subsp. paratuberculosis
acccaggucggcguga

SEQ ID NO: 2867805 - RNA, 22 nt, Mycobacterium avium subsp. paratuberculosis
acccaggucuucucguccgcgc

SEQ ID NO: 2867806 - RNA, 16 nt, Mycobacterium avium subsp. paratuberculosis
acccagguggaugcga

SEQ ID NO: 2867807 - RNA, 18 nt, Mycobacterium avium subsp. paratuberculosis
acccagguguccggcccg

SEQ ID NO: 2867808 - RNA, 21 nt, Mycobacterium avium subsp. paratuberculosis
acccauccccaggauggccgc

SEQ ID NO: 2867809 - RNA, 12 nt, Mycobacterium avium subsp. paratuberculosis
acccaugaucgc

SEQ ID NO: 2867810 - RNA, 23 nt, Mycobacterium avium subsp. paratuberculosis
acccaugccccaggugacgccgc

SEQ ID NO: 2867811 - RNA, 18 nt, Mycobacterium avium subsp. paratuberculosis
acccauucgucggcgguc

SEQ ID NO: 2867812 - RNA, 20 nt, Mycobacterium avium subsp. paratuberculosis
acccauugucgccgugcggc

SEQ ID NO: 2867813 - RNA, 22 nt, Mycobacterium avium subsp. paratuberculosis
accccacaccuucgcggucggc

SEQ ID NO: 2867814 - RNA, 14 nt, Mycobacterium avium subsp. paratuberculosis
accccacagcgcgc

SEQ ID NO: 2867815 - RNA, 17 nt, Mycobacterium avium subsp. paratuberculosis
accccacagcgcgcccc

SEQ ID NO: 2867816 - RNA, 14 nt, Mycobacterium avium subsp. paratuberculosis
accccacccgcgcg

SEQ ID NO: 2867817 - RNA, 15 nt, Mycobacterium avium subsp. paratuberculosis
accccacccgcgcga

SEQ ID NO: 2867818 - RNA, 13 nt, Mycobacterium avium subsp. paratuberculosis
accccaccgagca

SEQ ID NO: 2867819 - RNA, 16 nt, Mycobacterium avium subsp. paratuberculosis
accccaccgagcagcu

SEQ ID NO: 2867820 - RNA, 18 nt, Mycobacterium avium subsp. paratuberculosis
accccaccggaagcgcgc

SEQ ID NO: 2867821 - RNA, 13 nt, Mycobacterium avium subsp. paratuberculosis
accccacggccgc

SEQ ID NO: 2867822 - RNA, 14 nt, Mycobacterium avium subsp. paratuberculosis
accccacggccgca

SEQ ID NO: 2867823 - RNA, 22 nt, Mycobacterium avium subsp. paratuberculosis
accccacggccgcaacggcggu

SEQ ID NO: 2867824 - RNA, 15 nt, Mycobacterium avium subsp. paratuberculosis
accccagcaaaaccc

SEQ ID NO: 2867825 - RNA, 19 nt, Mycobacterium avium subsp. paratuberculosis
accccagcaaaaccccgcc

SEQ ID NO: 2867826 - RNA, 13 nt, Mycobacterium avium subsp. paratuberculosis
accccagccggcc

SEQ ID NO: 2867827 - RNA, 16 nt, Mycobacterium avium subsp. paratuberculosis
accccagcgugacguc

SEQ ID NO: 2867828 - RNA, 18 nt, Mycobacterium avium subsp. paratuberculosis
accccagcgugacgucga

SEQ ID NO: 2867829 - RNA, 15 nt, Mycobacterium avium subsp. paratuberculosis
accccagcuccgggu

SEQ ID NO: 2867830 - RNA, 20 nt, Mycobacterium avium subsp. paratuberculosis
accccaggcgaugccgccga

SEQ ID NO: 2867831 - RNA, 24 nt, Mycobacterium avium subsp. paratuberculosis
accccaggcgaugccgccgacgau

SEQ ID NO: 2867832 - RNA, 14 nt, Mycobacterium avium subsp. paratuberculosis
accccagugcaggc

SEQ ID NO: 2867833 - RNA, 23 nt, Mycobacterium avium subsp. paratuberculosis
accccagugcaggcugacgcgac

SEQ ID NO: 2867834 - RNA, 14 nt, Mycobacterium avium subsp. paratuberculosis
accccaucggccag

SEQ ID NO: 2867835 - RNA, 17 nt, Mycobacterium avium subsp. paratuberculosis
accccaucggccaggaa

SEQ ID NO: 2867836 - RNA, 18 nt, Mycobacterium avium subsp. paratuberculosis
acccccaauugccgggcc

SEQ ID NO: 2867837 - RNA, 19 nt, Mycobacterium avium subsp. paratuberculosis
acccccaauugccgggcca

SEQ ID NO: 2867838 - RNA, 14 nt, Mycobacterium avium subsp. paratuberculosis
acccccaccgcgac

SEQ ID NO: 2867839 - RNA, 12 nt, Mycobacterium avium subsp. paratuberculosis
acccccagcccg

SEQ ID NO: 2867840 - RNA, 13 nt, Mycobacterium avium subsp. paratuberculosis
acccccagcucga

SEQ ID NO: 2867841 - RNA, 22 nt, Mycobacterium avium subsp. paratuberculosis
acccccagcucgacgacuucgg

SEQ ID NO: 2867842 - RNA, 12 nt, Mycobacterium avium subsp. paratuberculosis
accccccacgcu

SEQ ID NO: 2867843 - RNA, 16 nt, Mycobacterium avium subsp. paratuberculosis
accccccacgcucggc

SEQ ID NO: 2867844 - RNA, 19 nt, Mycobacterium avium subsp. paratuberculosis
acccccgcacgccagcauc

SEQ ID NO: 2867845 - RNA, 21 nt, Mycobacterium avium subsp. paratuberculosis
acccccgcacgccagcaucga

SEQ ID NO: 2867846 - RNA, 19 nt, Mycobacterium avium subsp. paratuberculosis
acccccgccgcgucgguca

SEQ ID NO: 2867847 - RNA, 13 nt, Mycobacterium avium subsp. paratuberculosis
acccccgccgggg

SEQ ID NO: 2867848 - RNA, 16 nt, Mycobacterium avium subsp. paratuberculosis
acccccgcgcugccca

SEQ ID NO: 2867849 - RNA, 21 nt, Mycobacterium avium subsp. paratuberculosis
acccccgcgcugcccagcgcg

SEQ ID NO: 2867850 - RNA, 16 nt, Mycobacterium avium subsp. paratuberculosis
acccccgcggugaguu

SEQ ID NO: 2867851 - RNA, 13 nt, Mycobacterium avium subsp. paratuberculosis
acccccggcgcga

SEQ ID NO: 2867852 - RNA, 20 nt, Mycobacterium avium subsp. paratuberculosis
acccccggggccuccagcca

SEQ ID NO: 2867853 - RNA, 18 nt, Mycobacterium avium subsp. paratuberculosis
acccccguuuccucgcgc

SEQ ID NO: 2867854 - RNA, 20 nt, Mycobacterium avium subsp. paratuberculosis
acccccguuuccucgcgcac

SEQ ID NO: 2867855 - RNA, 12 nt, Mycobacterium avium subsp. paratuberculosis
acccccucgcgc

SEQ ID NO: 2867856 - RNA, 19 nt, Mycobacterium avium subsp. paratuberculosis
acccccuucuccacgcucg

SEQ ID NO: 2867857 - RNA, 20 nt, Mycobacterium avium subsp. paratuberculosis
accccgaaccaguucgccac

SEQ ID NO: 2867858 - RNA, 17 nt, Mycobacterium avium subsp. paratuberculosis
accccgaaccgcccgcc

SEQ ID NO: 2867859 - RNA, 18 nt, Mycobacterium avium subsp. paratuberculosis
accccgaaccgcccgccc

SEQ ID NO: 2867860 - RNA, 23 nt, Mycobacterium avium subsp. paratuberculosis
accccgaaccgcccgcccggcac

SEQ ID NO: 2867861 - RNA, 18 nt, Mycobacterium avium subsp. paratuberculosis
accccgaaggcguuggag

SEQ ID NO: 2867862 - RNA, 23 nt, Mycobacterium avium subsp. paratuberculosis
accccgaaggcguuggagccgac

SEQ ID NO: 2867863 - RNA, 17 nt, Mycobacterium avium subsp. paratuberculosis
accccgacggagacgac

SEQ ID NO: 2867864 - RNA, 13 nt, Mycobacterium avium subsp. paratuberculosis
accccgacggcgc

SEQ ID NO: 2867865 - RNA, 19 nt, Mycobacterium avium subsp. paratuberculosis
accccgacggcgccgcggc

SEQ ID NO: 2867866 - RNA, 18 nt, Mycobacterium avium subsp. paratuberculosis
accccgagaucgcgggcu

SEQ ID NO: 2867867 - RNA, 15 nt, Mycobacterium avium subsp. paratuberculosis
accccgagcucgggc

SEQ ID NO: 2867868 - RNA, 17 nt, Mycobacterium avium subsp. paratuberculosis
accccgaguucggccag

SEQ ID NO: 2867869 - RNA, 20 nt, Mycobacterium avium subsp. paratuberculosis
accccgaucaacaccgccag

SEQ ID NO: 2867870 - RNA, 21 nt, Mycobacterium avium subsp. paratuberculosis
accccgaucaacaccgccagc

SEQ ID NO: 2867871 - RNA, 22 nt, Mycobacterium avium subsp. paratuberculosis
accccgaucaacaccgccagca

SEQ ID NO: 2867872 - RNA, 15 nt, Mycobacterium avium subsp. paratuberculosis
accccgaucagguca

SEQ ID NO: 2867873 - RNA, 22 nt, Mycobacterium avium subsp. paratuberculosis
accccgaucgcgaucaccgcgg

SEQ ID NO: 2867874 - RNA, 16 nt, Mycobacterium avium subsp. paratuberculosis
accccgaugcgcucgc

SEQ ID NO: 2867875 - RNA, 17 nt, Mycobacterium avium subsp. paratuberculosis
accccgaugcggugccg

SEQ ID NO: 2867876 - RNA, 21 nt, Mycobacterium avium subsp. paratuberculosis
accccgaugcggugccgggcc

SEQ ID NO: 2867877 - RNA, 23 nt, Mycobacterium avium subsp. paratuberculosis
accccgaugcggugccgggccag

SEQ ID NO: 2867878 - RNA, 20 nt, Mycobacterium avium subsp. paratuberculosis
accccgcagaacaccagcgc

SEQ ID NO: 2867879 - RNA, 21 nt, Mycobacterium avium subsp. paratuberculosis
accccgcagaacaccagcgca

SEQ ID NO: 2867880 - RNA, 17 nt, Mycobacterium avium subsp. paratuberculosis
accccgccaaucaccgc

SEQ ID NO: 2867881 - RNA, 16 nt, Mycobacterium avium subsp. paratuberculosis
accccgccagcaccga

SEQ ID NO: 2867882 - RNA, 15 nt, Mycobacterium avium subsp. paratuberculosis
accccgcccagcgac

SEQ ID NO: 2867883 - RNA, 22 nt, Mycobacterium avium subsp. paratuberculosis
accccgcccagcgacucggcca

SEQ ID NO: 2867884 - RNA, 23 nt, Mycobacterium avium subsp. paratuberculosis
accccgcccagcgacucggccag

SEQ ID NO: 2867885 - RNA, 14 nt, Mycobacterium avium subsp. paratuberculosis
accccgcccagcgc

SEQ ID NO: 2867886 - RNA, 15 nt, Mycobacterium avium subsp. paratuberculosis
accccgcccagcgca

SEQ ID NO: 2867887 - RNA, 14 nt, Mycobacterium avium subsp. paratuberculosis
accccgccgcagcc

SEQ ID NO: 2867888 - RNA, 13 nt, Mycobacterium avium subsp. paratuberculosis
accccgccggccc

SEQ ID NO: 2867889 - RNA, 14 nt, Mycobacterium avium subsp. paratuberculosis
accccgccggcccg

SEQ ID NO: 2867890 - RNA, 14 nt, Mycobacterium avium subsp. paratuberculosis
accccgccgucgac

SEQ ID NO: 2867891 - RNA, 16 nt, Mycobacterium avium subsp. paratuberculosis
accccgccgucgacgc

SEQ ID NO: 2867892 - RNA, 20 nt, Mycobacterium avium subsp. paratuberculosis
accccgcgagucaccggcuc

SEQ ID NO: 2867893 - RNA, 14 nt, Mycobacterium avium subsp. paratuberculosis
accccgcgccgggc

SEQ ID NO: 2867894 - RNA, 14 nt, Mycobacterium avium subsp. paratuberculosis
accccgcggucggc

SEQ ID NO: 2867895 - RNA, 18 nt, Mycobacterium avium subsp. paratuberculosis
accccgcggucggcggcg

SEQ ID NO: 2867896 - RNA, 19 nt, Mycobacterium avium subsp. paratuberculosis
accccgcggucggcggcgu

SEQ ID NO: 2867897 - RNA, 12 nt, Mycobacterium avium subsp. paratuberculosis
accccgcucggc

SEQ ID NO: 2867898 - RNA, 16 nt, Mycobacterium avium subsp. paratuberculosis
accccgcucggccagc

SEQ ID NO: 2867899 - RNA, 20 nt, Mycobacterium avium subsp. paratuberculosis
accccgcucggccagcgcgc

SEQ ID NO: 2867900 - RNA, 21 nt, Mycobacterium avium subsp. paratuberculosis
accccgcucggccagcgcgcc

SEQ ID NO: 2867901 - RNA, 23 nt, Mycobacterium avium subsp. paratuberculosis
accccgcucggccagcgcgccgc

SEQ ID NO: 2867902 - RNA, 18 nt, Mycobacterium avium subsp. paratuberculosis
accccggccaccagggcg

SEQ ID NO: 2867903 - RNA, 11 nt, Mycobacterium avium subsp. paratuberculosis
accccggccag

SEQ ID NO: 2867904 - RNA, 15 nt, Mycobacterium avium subsp. paratuberculosis
accccggccaguccg

SEQ ID NO: 2867905 - RNA, 14 nt, Mycobacterium avium subsp. paratuberculosis
accccggccccggc

SEQ ID NO: 2867906 - RNA, 15 nt, Mycobacterium avium subsp. paratuberculosis
accccggccccggcc

SEQ ID NO: 2867907 - RNA, 22 nt, Mycobacterium avium subsp. paratuberculosis
accccggccccggccggcgggu

SEQ ID NO: 2867908 - RNA, 14 nt, Mycobacterium avium subsp. paratuberculosis
accccggcgacggc

SEQ ID NO: 2867909 - RNA, 15 nt, Mycobacterium avium subsp. paratuberculosis
accccggcgacggcg

SEQ ID NO: 2867910 - RNA, 16 nt, Mycobacterium avium subsp. paratuberculosis
accccggcgaugaccg

SEQ ID NO: 2867911 - RNA, 20 nt, Mycobacterium avium subsp. paratuberculosis
accccggcgaugaccgggac

SEQ ID NO: 2867912 - RNA, 15 nt, Mycobacterium avium subsp. paratuberculosis
accccggcggcaccg

SEQ ID NO: 2867913 - RNA, 17 nt, Mycobacterium avium subsp. paratuberculosis
accccggcggcaccgcc

SEQ ID NO: 2867914 - RNA, 22 nt, Mycobacterium avium subsp. paratuberculosis
accccggcggcaccgccgcggu

SEQ ID NO: 2867915 - RNA, 23 nt, Mycobacterium avium subsp. paratuberculosis
accccggcggccgcgucggcggu

SEQ ID NO: 2867916 - RNA, 11 nt, Mycobacterium avium subsp. paratuberculosis
accccggcggu

SEQ ID NO: 2867917 - RNA, 17 nt, Mycobacterium avium subsp. paratuberculosis
accccggcguccacgcc

SEQ ID NO: 2867918 - RNA, 18 nt, Mycobacterium avium subsp. paratuberculosis
accccggcguccacgccg

SEQ ID NO: 2867919 - RNA, 14 nt, Mycobacterium avium subsp. paratuberculosis
accccgggcggcuc

SEQ ID NO: 2867920 - RNA, 21 nt, Mycobacterium avium subsp. paratuberculosis
accccgguccaggcgaccggc

SEQ ID NO: 2867921 - RNA, 23 nt, Mycobacterium avium subsp. paratuberculosis
accccgguccaggcgaccggccc

SEQ ID NO: 2867922 - RNA, 15 nt, Mycobacterium avium subsp. paratuberculosis
accccggugccgcag

SEQ ID NO: 2867923 - RNA, 16 nt, Mycobacterium avium subsp. paratuberculosis
accccguaccagcgcu

SEQ ID NO: 2867924 - RNA, 22 nt, Mycobacterium avium subsp. paratuberculosis
accccguaccagcgcucgacga

SEQ ID NO: 2867925 - RNA, 21 nt, Mycobacterium avium subsp. paratuberculosis
accccgucgagcagccgcaac

SEQ ID NO: 2867926 - RNA, 18 nt, Mycobacterium avium subsp. paratuberculosis
accccgucgagguucaug

SEQ ID NO: 2867927 - RNA, 19 nt, Mycobacterium avium subsp. paratuberculosis
accccgucgcggacccugg

SEQ ID NO: 2867928 - RNA, 13 nt, Mycobacterium avium subsp. paratuberculosis
accccguucgccg

SEQ ID NO: 2867929 - RNA, 16 nt, Mycobacterium avium subsp. paratuberculosis
accccguucgccgaca

SEQ ID NO: 2867930 - RNA, 23 nt, Mycobacterium avium subsp. paratuberculosis
accccguucgccgacagcagcuc

SEQ ID NO: 2867931 - RNA, 18 nt, Mycobacterium avium subsp. paratuberculosis
accccguugccgccggcg

SEQ ID NO: 2867932 - RNA, 20 nt, Mycobacterium avium subsp. paratuberculosis
accccguugccgccggcgcc

SEQ ID NO: 2867933 - RNA, 14 nt, Mycobacterium avium subsp. paratuberculosis
accccuacgggcgc

SEQ ID NO: 2867934 - RNA, 22 nt, Mycobacterium avium subsp. paratuberculosis
accccuacgggcgcaccgcgcg

SEQ ID NO: 2867935 - RNA, 13 nt, Mycobacterium avium subsp. paratuberculosis
accccucagccgg

SEQ ID NO: 2867936 - RNA, 16 nt, Mycobacterium avium subsp. paratuberculosis
accccuccaacggccg

SEQ ID NO: 2867937 - RNA, 17 nt, Mycobacterium avium subsp. paratuberculosis
accccucggcggccguc

SEQ ID NO: 2867938 - RNA, 19 nt, Mycobacterium avium subsp. paratuberculosis
accccucggcggccgucgg

SEQ ID NO: 2867939 - RNA, 19 nt, Mycobacterium avium subsp. paratuberculosis
accccugcacuaccccguc

SEQ ID NO: 2867940 - RNA, 21 nt, Mycobacterium avium subsp. paratuberculosis
accccugcacuaccccgucga

SEQ ID NO: 2867941 - RNA, 21 nt, Mycobacterium avium subsp. paratuberculosis
accccuggcggguacagccgc

SEQ ID NO: 2867942 - RNA, 22 nt, Mycobacterium avium subsp. paratuberculosis
accccuggcggguacagccgca

SEQ ID NO: 2867943 - RNA, 21 nt, Mycobacterium avium subsp. paratuberculosis
acccgaaaagguauucgcgca

SEQ ID NO: 2867944 - RNA, 22 nt, Mycobacterium avium subsp. paratuberculosis
acccgaaaagguauucgcgcaa

SEQ ID NO: 2867945 - RNA, 23 nt, Mycobacterium avium subsp. paratuberculosis
acccgaaaagguauucgcgcaac

SEQ ID NO: 2867946 - RNA, 14 nt, Mycobacterium avium subsp. paratuberculosis
acccgaacccagcg

SEQ ID NO: 2867947 - RNA, 17 nt, Mycobacterium avium subsp. paratuberculosis
acccgaacccagcgccu

SEQ ID NO: 2867948 - RNA, 17 nt, Mycobacterium avium subsp. paratuberculosis
acccgaacuucagcgcg

SEQ ID NO: 2867949 - RNA, 20 nt, Mycobacterium avium subsp. paratuberculosis
acccgaagcccaagugcccg

SEQ ID NO: 2867950 - RNA, 18 nt, Mycobacterium avium subsp. paratuberculosis
acccgaaggugguggcgu

SEQ ID NO: 2867951 - RNA, 14 nt, Mycobacterium avium subsp. paratuberculosis
acccgaagucgacg

SEQ ID NO: 2867952 - RNA, 20 nt, Mycobacterium avium subsp. paratuberculosis
acccgaauuccgcuggggcc

SEQ ID NO: 2867953 - RNA, 22 nt, Mycobacterium avium subsp. paratuberculosis
acccgaauuccgcuggggccca

SEQ ID NO: 2867954 - RNA, 14 nt, Mycobacterium avium subsp. paratuberculosis
acccgacacgccga

SEQ ID NO: 2867955 - RNA, 15 nt, Mycobacterium avium subsp. paratuberculosis
acccgacacgccgau

SEQ ID NO: 2867956 - RNA, 17 nt, Mycobacterium avium subsp. paratuberculosis
acccgacacgccgaucg

SEQ ID NO: 2867957 - RNA, 18 nt, Mycobacterium avium subsp. paratuberculosis
acccgacaguccgaccgc

SEQ ID NO: 2867958 - RNA, 18 nt, Mycobacterium avium subsp. paratuberculosis
acccgaccccggcgagcg

SEQ ID NO: 2867959 - RNA, 18 nt, Mycobacterium avium subsp. paratuberculosis
acccgaccgacgcccggc

SEQ ID NO: 2867960 - RNA, 14 nt, Mycobacterium avium subsp. paratuberculosis
acccgaccgcgaug

SEQ ID NO: 2867961 - RNA, 17 nt, Mycobacterium avium subsp. paratuberculosis
acccgaccucgucgacg

SEQ ID NO: 2867962 - RNA, 19 nt, Mycobacterium avium subsp. paratuberculosis
acccgaccuuuugcccggc

SEQ ID NO: 2867963 - RNA, 15 nt, Mycobacterium avium subsp. paratuberculosis
acccgacggucgggc

SEQ ID NO: 2867964 - RNA, 19 nt, Mycobacterium avium subsp. paratuberculosis
acccgacggucgggcccag

SEQ ID NO: 2867965 - RNA, 14 nt, Mycobacterium avium subsp. paratuberculosis
acccgacgucgacg

SEQ ID NO: 2867966 - RNA, 17 nt, Mycobacterium avium subsp. paratuberculosis
acccgacguugccgcug

SEQ ID NO: 2867967 - RNA, 16 nt, Mycobacterium avium subsp. paratuberculosis
acccgacuucggcucg

SEQ ID NO: 2867968 - RNA, 12 nt, Mycobacterium avium subsp. paratuberculosis
acccgagcaccc

SEQ ID NO: 2867969 - RNA, 19 nt, Mycobacterium avium subsp. paratuberculosis
acccgagcaccccggcggc

SEQ ID NO: 2867970 - RNA, 15 nt, Mycobacterium avium subsp. paratuberculosis
acccgagcaccgggc

SEQ ID NO: 2867971 - RNA, 13 nt, Mycobacterium avium subsp. paratuberculosis
acccgaggccguu

SEQ ID NO: 2867972 - RNA, 15 nt, Mycobacterium avium subsp. paratuberculosis
acccgauccacggcg

SEQ ID NO: 2867973 - RNA, 16 nt, Mycobacterium avium subsp. paratuberculosis
acccgauccagacggu

SEQ ID NO: 2867974 - RNA, 13 nt, Mycobacterium avium subsp. paratuberculosis
acccgaucgagga

SEQ ID NO: 2867975 - RNA, 14 nt, Mycobacterium avium subsp. paratuberculosis
acccgaucgaucau

SEQ ID NO: 2867976 - RNA, 20 nt, Mycobacterium avium subsp. paratuberculosis
acccgaucgaucaucgccuc

SEQ ID NO: 2867977 - RNA, 21 nt, Mycobacterium avium subsp. paratuberculosis
acccgaucgaucaucgccucg

SEQ ID NO: 2867978 - RNA, 23 nt, Mycobacterium avium subsp. paratuberculosis
acccgaucgaucaucgccucggu

SEQ ID NO: 2867979 - RNA, 16 nt, Mycobacterium avium subsp. paratuberculosis
acccgaucgccgaguc

SEQ ID NO: 2867980 - RNA, 17 nt, Mycobacterium avium subsp. paratuberculosis
acccgaucgccgagucg

SEQ ID NO: 2867981 - RNA, 19 nt, Mycobacterium avium subsp. paratuberculosis
acccgaucggcccggccaa

SEQ ID NO: 2867982 - RNA, 16 nt, Mycobacterium avium subsp. paratuberculosis
acccgaugaccggccc

SEQ ID NO: 2867983 - RNA, 19 nt, Mycobacterium avium subsp. paratuberculosis
acccgaugaccggcccggc

SEQ ID NO: 2867984 - RNA, 22 nt, Mycobacterium avium subsp. paratuberculosis
acccgaugaccggcccggcggc

SEQ ID NO: 2867985 - RNA, 22 nt, Mycobacterium avium subsp. paratuberculosis
acccgauuucauauugguucgc

SEQ ID NO: 2867986 - RNA, 17 nt, Mycobacterium avium subsp. paratuberculosis
acccgcaacaccacguc

SEQ ID NO: 2867987 - RNA, 15 nt, Mycobacterium avium subsp. paratuberculosis
acccgcaacgcgcgc

SEQ ID NO: 2867988 - RNA, 17 nt, Mycobacterium avium subsp. paratuberculosis
acccgcaacgcgcgcga

SEQ ID NO: 2867989 - RNA, 15 nt, Mycobacterium avium subsp. paratuberculosis
acccgcaacgcugac

SEQ ID NO: 2867990 - RNA, 17 nt, Mycobacterium avium subsp. paratuberculosis
acccgcaacgcugaccg

SEQ ID NO: 2867991 - RNA, 18 nt, Mycobacterium avium subsp. paratuberculosis
acccgcaacgcugaccgc

SEQ ID NO: 2867992 - RNA, 17 nt, Mycobacterium avium subsp. paratuberculosis
acccgcaaggccgccag

SEQ ID NO: 2867993 - RNA, 18 nt, Mycobacterium avium subsp. paratuberculosis
acccgcaaggccgccagc

SEQ ID NO: 2867994 - RNA, 20 nt, Mycobacterium avium subsp. paratuberculosis
acccgcaaggccgccagccg

SEQ ID NO: 2867995 - RNA, 21 nt, Mycobacterium avium subsp. paratuberculosis
acccgcaaggccgccagccgc

SEQ ID NO: 2867996 - RNA, 23 nt, Mycobacterium avium subsp. paratuberculosis
acccgcaaggccgccagccgcgu

SEQ ID NO: 2867997 - RNA, 12 nt, Mycobacterium avium subsp. paratuberculosis
acccgcaccacc

SEQ ID NO: 2867998 - RNA, 14 nt, Mycobacterium avium subsp. paratuberculosis
acccgcaccaccgc

SEQ ID NO: 2867999 - RNA, 16 nt, Mycobacterium avium subsp. paratuberculosis
acccgcaccaccgccc

SEQ ID NO: 2868000 - RNA, 18 nt, Mycobacterium avium subsp. paratuberculosis
acccgcaccaccgcccgg

SEQ ID NO: 2868001 - RNA, 24 nt, Mycobacterium avium subsp. paratuberculosis
acccgcaccaccgcccggaccggc

SEQ ID NO: 2868002 - RNA, 20 nt, Mycobacterium avium subsp. paratuberculosis
acccgcaccguguagccgac

SEQ ID NO: 2868003 - RNA, 20 nt, Mycobacterium avium subsp. paratuberculosis
acccgcaccucgcccggcuc

SEQ ID NO: 2868004 - RNA, 17 nt, Mycobacterium avium subsp. paratuberculosis
acccgcaccucgcuggc

SEQ ID NO: 2868005 - RNA, 20 nt, Mycobacterium avium subsp. paratuberculosis
acccgcacgaaaugcgggcg

SEQ ID NO: 2868006 - RNA, 18 nt, Mycobacterium avium subsp. paratuberculosis
acccgcacgaugccgcgc

SEQ ID NO: 2868007 - RNA, 19 nt, Mycobacterium avium subsp. paratuberculosis
acccgcacgaugccgcgcu

SEQ ID NO: 2868008 - RNA, 23 nt, Mycobacterium avium subsp. paratuberculosis
acccgcacgauguguaacaacuc

SEQ ID NO: 2868009 - RNA, 18 nt, Mycobacterium avium subsp. paratuberculosis
acccgcacggucgcggug

SEQ ID NO: 2868010 - RNA, 16 nt, Mycobacterium avium subsp. paratuberculosis
acccgcacgugcgcgc

SEQ ID NO: 2868011 - RNA, 20 nt, Mycobacterium avium subsp. paratuberculosis
acccgcacgugcgcgccgac

SEQ ID NO: 2868012 - RNA, 15 nt, Mycobacterium avium subsp. paratuberculosis
acccgcagccgcgag

SEQ ID NO: 2868013 - RNA, 15 nt, Mycobacterium avium subsp. paratuberculosis
acccgcagcgaccgc

SEQ ID NO: 2868014 - RNA, 15 nt, Mycobacterium avium subsp. paratuberculosis
acccgcagcgcggcg

SEQ ID NO: 2868015 - RNA, 13 nt, Mycobacterium avium subsp. paratuberculosis
acccgcagcucca

SEQ ID NO: 2868016 - RNA, 18 nt, Mycobacterium avium subsp. paratuberculosis
acccgcagcuccagcgag

SEQ ID NO: 2868017 - RNA, 22 nt, Mycobacterium avium subsp. paratuberculosis
acccgcagcucgccgguggcgg

SEQ ID NO: 2868018 - RNA, 23 nt, Mycobacterium avium subsp. paratuberculosis
acccgcaggccaugaucgaaagg

SEQ ID NO: 2868019 - RNA, 13 nt, Mycobacterium avium subsp. paratuberculosis
acccgcagggcgc

SEQ ID NO: 2868020 - RNA, 14 nt, Mycobacterium avium subsp. paratuberculosis
acccgcagggcgcc

SEQ ID NO: 2868021 - RNA, 15 nt, Mycobacterium avium subsp. paratuberculosis
acccgcagggcgccg

SEQ ID NO: 2868022 - RNA, 19 nt, Mycobacterium avium subsp. paratuberculosis
acccgcaucaacugcacca

SEQ ID NO: 2868023 - RNA, 24 nt, Mycobacterium avium subsp. paratuberculosis
acccgcaucaacugcaccagcggc

SEQ ID NO: 2868024 - RNA, 21 nt, Mycobacterium avium subsp. paratuberculosis
acccgcauccgccgggcggcg

SEQ ID NO: 2868025 - RNA, 22 nt, Mycobacterium avium subsp. paratuberculosis
acccgcauccgccgggcggcgu

SEQ ID NO: 2868026 - RNA, 23 nt, Mycobacterium avium subsp. paratuberculosis
acccgcauccgccgggcggcguc

SEQ ID NO: 2868027 - RNA, 12 nt, Mycobacterium avium subsp. paratuberculosis
acccgccagccc

SEQ ID NO: 2868028 - RNA, 14 nt, Mycobacterium avium subsp. paratuberculosis
acccgccagcccgc

SEQ ID NO: 2868029 - RNA, 17 nt, Mycobacterium avium subsp. paratuberculosis
acccgccagcccgcguc

SEQ ID NO: 2868030 - RNA, 20 nt, Mycobacterium avium subsp. paratuberculosis
acccgccagggcgacgccgc

SEQ ID NO: 2868031 - RNA, 14 nt, Mycobacterium avium subsp. paratuberculosis
acccgccauggcgg

SEQ ID NO: 2868032 - RNA, 18 nt, Mycobacterium avium subsp. paratuberculosis
acccgccauggcggcauc

SEQ ID NO: 2868033 - RNA, 16 nt, Mycobacterium avium subsp. paratuberculosis
acccgcccaugcacga

SEQ ID NO: 2868034 - RNA, 17 nt, Mycobacterium avium subsp. paratuberculosis
acccgcccaugcacgau

SEQ ID NO: 2868035 - RNA, 12 nt, Mycobacterium avium subsp. paratuberculosis
acccgccccgcc

SEQ ID NO: 2868036 - RNA, 14 nt, Mycobacterium avium subsp. paratuberculosis
acccgccccgccgc

SEQ ID NO: 2868037 - RNA, 16 nt, Mycobacterium avium subsp. paratuberculosis
acccgccccgccgcgg

SEQ ID NO: 2868038 - RNA, 17 nt, Mycobacterium avium subsp. paratuberculosis
acccgccccgccgcggc

SEQ ID NO: 2868039 - RNA, 19 nt, Mycobacterium avium subsp. paratuberculosis
acccgccccgccgcggcca

SEQ ID NO: 2868040 - RNA, 22 nt, Mycobacterium avium subsp. paratuberculosis
acccgccccgccgcggccaggu

SEQ ID NO: 2868041 - RNA, 13 nt, Mycobacterium avium subsp. paratuberculosis
acccgcccgccgg

SEQ ID NO: 2868042 - RNA, 14 nt, Mycobacterium avium subsp. paratuberculosis
acccgcccgccggg

SEQ ID NO: 2868043 - RNA, 18 nt, Mycobacterium avium subsp. paratuberculosis
acccgcccgccgggcacc

SEQ ID NO: 2868044 - RNA, 19 nt, Mycobacterium avium subsp. paratuberculosis
acccgcccgccgggcaccc

SEQ ID NO: 2868045 - RNA, 23 nt, Mycobacterium avium subsp. paratuberculosis
acccgcccgccgggcacccgggu

SEQ ID NO: 2868046 - RNA, 22 nt, Mycobacterium avium subsp. paratuberculosis
acccgcccgggugugggcgccg

SEQ ID NO: 2868047 - RNA, 20 nt, Mycobacterium avium subsp. paratuberculosis
acccgccgacgccugcgcga

SEQ ID NO: 2868048 - RNA, 12 nt, Mycobacterium avium subsp. paratuberculosis
acccgccgagcg

SEQ ID NO: 2868049 - RNA, 20 nt, Mycobacterium avium subsp. paratuberculosis
acccgccgcaacagccggcc

SEQ ID NO: 2868050 - RNA, 23 nt, Mycobacterium avium subsp. paratuberculosis
acccgccgcaacagccggcccga

SEQ ID NO: 2868051 - RNA, 16 nt, Mycobacterium avium subsp. paratuberculosis
acccgccgcaccucgc

SEQ ID NO: 2868052 - RNA, 17 nt, Mycobacterium avium subsp. paratuberculosis
acccgccgcaccucgcc

SEQ ID NO: 2868053 - RNA, 23 nt, Mycobacterium avium subsp. paratuberculosis
acccgccgcaccucgccggccgc

SEQ ID NO: 2868054 - RNA, 14 nt, Mycobacterium avium subsp. paratuberculosis
acccgccgcagccc

SEQ ID NO: 2868055 - RNA, 20 nt, Mycobacterium avium subsp. paratuberculosis
acccgccgcggcaacgccag

SEQ ID NO: 2868056 - RNA, 23 nt, Mycobacterium avium subsp. paratuberculosis
acccgccggcgaacgacgucgag

SEQ ID NO: 2868057 - RNA, 15 nt, Mycobacterium avium subsp. paratuberculosis
acccgccgugaccgg

SEQ ID NO: 2868058 - RNA, 14 nt, Mycobacterium avium subsp. paratuberculosis
acccgcgaccccuc

SEQ ID NO: 2868059 - RNA, 21 nt, Mycobacterium avium subsp. paratuberculosis
acccgcgaccccuccaacggc

SEQ ID NO: 2868060 - RNA, 15 nt, Mycobacterium avium subsp. paratuberculosis
acccgcgcacgcucg

SEQ ID NO: 2868061 - RNA, 14 nt, Mycobacterium avium subsp. paratuberculosis
acccgcgccggcag

SEQ ID NO: 2868062 - RNA, 23 nt, Mycobacterium avium subsp. paratuberculosis
acccgcgcgacaucaccgcgggc

SEQ ID NO: 2868063 - RNA, 19 nt, Mycobacterium avium subsp. paratuberculosis
acccgcgcggcgucggccu

SEQ ID NO: 2868064 - RNA, 18 nt, Mycobacterium avium subsp. paratuberculosis
acccgcgcggugcccgga

SEQ ID NO: 2868065 - RNA, 18 nt, Mycobacterium avium subsp. paratuberculosis
acccgcgcgucgcgcagc

SEQ ID NO: 2868066 - RNA, 17 nt, Mycobacterium avium subsp. paratuberculosis
acccgcggaacgcucac

SEQ ID NO: 2868067 - RNA, 12 nt, Mycobacterium avium subsp. paratuberculosis
acccgcggccgc

SEQ ID NO: 2868068 - RNA, 17 nt, Mycobacterium avium subsp. paratuberculosis
acccgcggccggcccag

SEQ ID NO: 2868069 - RNA, 12 nt, Mycobacterium avium subsp. paratuberculosis
acccgcggccuc

SEQ ID NO: 2868070 - RNA, 14 nt, Mycobacterium avium subsp. paratuberculosis
acccgcggcgccgc

SEQ ID NO: 2868071 - RNA, 16 nt, Mycobacterium avium subsp. paratuberculosis
acccgcggcgccgcgg

SEQ ID NO: 2868072 - RNA, 17 nt, Mycobacterium avium subsp. paratuberculosis
acccgcggcgccgcggc

SEQ ID NO: 2868073 - RNA, 19 nt, Mycobacterium avium subsp. paratuberculosis
acccgcggcgccgcggcgg

SEQ ID NO: 2868074 - RNA, 12 nt, Mycobacterium avium subsp. paratuberculosis
acccgcggcgcg

SEQ ID NO: 2868075 - RNA, 15 nt, Mycobacterium avium subsp. paratuberculosis
acccgcggcgcgaug

SEQ ID NO: 2868076 - RNA, 16 nt, Mycobacterium avium subsp. paratuberculosis
acccgcggcgcgauga

SEQ ID NO: 2868077 - RNA, 20 nt, Mycobacterium avium subsp. paratuberculosis
acccgcgucaucgggcccga

SEQ ID NO: 2868078 - RNA, 21 nt, Mycobacterium avium subsp. paratuberculosis
acccgcgucaucgggcccgac

SEQ ID NO: 2868079 - RNA, 12 nt, Mycobacterium avium subsp. paratuberculosis
acccgcgucgau

SEQ ID NO: 2868080 - RNA, 18 nt, Mycobacterium avium subsp. paratuberculosis
acccgcguggcaggucgg

SEQ ID NO: 2868081 - RNA, 17 nt, Mycobacterium avium subsp. paratuberculosis
acccgcucaggucggcc

SEQ ID NO: 2868082 - RNA, 18 nt, Mycobacterium avium subsp. paratuberculosis
acccgcucaggucggccg

SEQ ID NO: 2868083 - RNA, 14 nt, Mycobacterium avium subsp. paratuberculosis
acccgcuccagcgg

SEQ ID NO: 2868084 - RNA, 15 nt, Mycobacterium avium subsp. paratuberculosis
acccgcuccagcggc

SEQ ID NO: 2868085 - RNA, 16 nt, Mycobacterium avium subsp. paratuberculosis
acccgcuccagcggcc

SEQ ID NO: 2868086 - RNA, 18 nt, Mycobacterium avium subsp. paratuberculosis
acccgcuccagcggccac

SEQ ID NO: 2868087 - RNA, 20 nt, Mycobacterium avium subsp. paratuberculosis
acccgcuccccgauccggcu

SEQ ID NO: 2868088 - RNA, 21 nt, Mycobacterium avium subsp. paratuberculosis
acccgcuccgacgcgguggcg

SEQ ID NO: 2868089 - RNA, 13 nt, Mycobacterium avium subsp. paratuberculosis
acccgcucgacgc

SEQ ID NO: 2868090 - RNA, 15 nt, Mycobacterium avium subsp. paratuberculosis
acccgcucgacgcgc

SEQ ID NO: 2868091 - RNA, 14 nt, Mycobacterium avium subsp. paratuberculosis
acccgcucgccgaa

SEQ ID NO: 2868092 - RNA, 14 nt, Mycobacterium avium subsp. paratuberculosis
acccgcucgccgau

SEQ ID NO: 2868093 - RNA, 20 nt, Mycobacterium avium subsp. paratuberculosis
acccgcucgcgggcccgcgc

SEQ ID NO: 2868094 - RNA, 15 nt, Mycobacterium avium subsp. paratuberculosis
acccgcucggcgauc

SEQ ID NO: 2868095 - RNA, 17 nt, Mycobacterium avium subsp. paratuberculosis
acccgcucgggcgccuc

SEQ ID NO: 2868096 - RNA, 17 nt, Mycobacterium avium subsp. paratuberculosis
acccgcugcaccagccc

SEQ ID NO: 2868097 - RNA, 20 nt, Mycobacterium avium subsp. paratuberculosis
acccgcugcaccagcccguc

SEQ ID NO: 2868098 - RNA, 16 nt, Mycobacterium avium subsp. paratuberculosis
acccgcugcagccggu

SEQ ID NO: 2868099 - RNA, 18 nt, Mycobacterium avium subsp. paratuberculosis
acccgcugcucgaccucg

SEQ ID NO: 2868100 - RNA, 19 nt, Mycobacterium avium subsp. paratuberculosis
acccgcugucaauccccgc

SEQ ID NO: 2868101 - RNA, 19 nt, Mycobacterium avium subsp. paratuberculosis
acccgcuucgcccggcugc

SEQ ID NO: 2868102 - RNA, 16 nt, Mycobacterium avium subsp. paratuberculosis
acccgcuuuugccguc

SEQ ID NO: 2868103 - RNA, 18 nt, Mycobacterium avium subsp. paratuberculosis
acccgcuuuugccgucgg

SEQ ID NO: 2868104 - RNA, 22 nt, Mycobacterium avium subsp. paratuberculosis
acccgcuuuugccgucggugcg

SEQ ID NO: 2868105 - RNA, 13 nt, Mycobacterium avium subsp. paratuberculosis
acccggaacccgc

SEQ ID NO: 2868106 - RNA, 19 nt, Mycobacterium avium subsp. paratuberculosis
acccggacagcgcgacgca

SEQ ID NO: 2868107 - RNA, 11 nt, Mycobacterium avium subsp. paratuberculosis
acccggacgau

SEQ ID NO: 2868108 - RNA, 22 nt, Mycobacterium avium subsp. paratuberculosis
acccggacgaugacccagccca

SEQ ID NO: 2868109 - RNA, 18 nt, Mycobacterium avium subsp. paratuberculosis
acccggacgugaucgcgg

SEQ ID NO: 2868110 - RNA, 13 nt, Mycobacterium avium subsp. paratuberculosis
acccggaggcggc

SEQ ID NO: 2868111 - RNA, 21 nt, Mycobacterium avium subsp. paratuberculosis
acccggaucuugccgucggcc

SEQ ID NO: 2868112 - RNA, 18 nt, Mycobacterium avium subsp. paratuberculosis
acccggauggucugcagc

SEQ ID NO: 2868113 - RNA, 20 nt, Mycobacterium avium subsp. paratuberculosis
acccggauggucugcagcga

SEQ ID NO: 2868114 - RNA, 21 nt, Mycobacterium avium subsp. paratuberculosis
acccggauggucugcagcgac

SEQ ID NO: 2868115 - RNA, 19 nt, Mycobacterium avium subsp. paratuberculosis
acccggaugucgugcgguc

SEQ ID NO: 2868116 - RNA, 12 nt, Mycobacterium avium subsp. paratuberculosis
acccggccaccg

SEQ ID NO: 2868117 - RNA, 16 nt, Mycobacterium avium subsp. paratuberculosis
acccggccaccgccgc

SEQ ID NO: 2868118 - RNA, 19 nt, Mycobacterium avium subsp. paratuberculosis
acccggccaccgccgccag

SEQ ID NO: 2868119 - RNA, 16 nt, Mycobacterium avium subsp. paratuberculosis
acccggccacgccggg

SEQ ID NO: 2868120 - RNA, 17 nt, Mycobacterium avium subsp. paratuberculosis
acccggccacgccgggu

SEQ ID NO: 2868121 - RNA, 13 nt, Mycobacterium avium subsp. paratuberculosis
acccggccagcgg

SEQ ID NO: 2868122 - RNA, 20 nt, Mycobacterium avium subsp. paratuberculosis
acccggccagcggcagcggc

SEQ ID NO: 2868123 - RNA, 22 nt, Mycobacterium avium subsp. paratuberculosis
acccggccagcggcagcggcgu

SEQ ID NO: 2868124 - RNA, 17 nt, Mycobacterium avium subsp. paratuberculosis
acccggcccaccaccgc

SEQ ID NO: 2868125 - RNA, 20 nt, Mycobacterium avium subsp. paratuberculosis
acccggcccaccaccgccuc

SEQ ID NO: 2868126 - RNA, 14 nt, Mycobacterium avium subsp. paratuberculosis
acccggcccaccgg

SEQ ID NO: 2868127 - RNA, 20 nt, Mycobacterium avium subsp. paratuberculosis
acccggcccaccggcccggc

SEQ ID NO: 2868128 - RNA, 15 nt, Mycobacterium avium subsp. paratuberculosis
acccggcccacgccg

SEQ ID NO: 2868129 - RNA, 19 nt, Mycobacterium avium subsp. paratuberculosis
acccggcccacgccgucgu

SEQ ID NO: 2868130 - RNA, 20 nt, Mycobacterium avium subsp. paratuberculosis
acccggcccaucaccggacc

SEQ ID NO: 2868131 - RNA, 19 nt, Mycobacterium avium subsp. paratuberculosis
acccggcccuauggcaucg

SEQ ID NO: 2868132 - RNA, 21 nt, Mycobacterium avium subsp. paratuberculosis
acccggcccuauggcaucgcc

SEQ ID NO: 2868133 - RNA, 22 nt, Mycobacterium avium subsp. paratuberculosis
acccggcccuauggcaucgcca

SEQ ID NO: 2868134 - RNA, 13 nt, Mycobacterium avium subsp. paratuberculosis
acccggccgagcg

SEQ ID NO: 2868135 - RNA, 20 nt, Mycobacterium avium subsp. paratuberculosis
acccggccgagcgcgccgag

SEQ ID NO: 2868136 - RNA, 17 nt, Mycobacterium avium subsp. paratuberculosis
acccggccgcacaccac

SEQ ID NO: 2868137 - RNA, 12 nt, Mycobacterium avium subsp. paratuberculosis
acccggccgcgc

SEQ ID NO: 2868138 - RNA, 13 nt, Mycobacterium avium subsp. paratuberculosis
acccggccggcga

SEQ ID NO: 2868139 - RNA, 15 nt, Mycobacterium avium subsp. paratuberculosis
acccggccguggacc

SEQ ID NO: 2868140 - RNA, 20 nt, Mycobacterium avium subsp. paratuberculosis
acccggccguggacccgccc

SEQ ID NO: 2868141 - RNA, 18 nt, Mycobacterium avium subsp. paratuberculosis
acccggccguugggccag

SEQ ID NO: 2868142 - RNA, 23 nt, Mycobacterium avium subsp. paratuberculosis
acccggccguugggccagcggcg

SEQ ID NO: 2868143 - RNA, 19 nt, Mycobacterium avium subsp. paratuberculosis
acccggcgcccggccggug

SEQ ID NO: 2868144 - RNA, 20 nt, Mycobacterium avium subsp. paratuberculosis
acccggcgcccggccggugc

SEQ ID NO: 2868145 - RNA, 21 nt, Mycobacterium avium subsp. paratuberculosis
acccggcgcccggccggugcu

SEQ ID NO: 2868146 - RNA, 15 nt, Mycobacterium avium subsp. paratuberculosis
acccggcgcgcggag

SEQ ID NO: 2868147 - RNA, 16 nt, Mycobacterium avium subsp. paratuberculosis
acccggcgcggccgcc

SEQ ID NO: 2868148 - RNA, 19 nt, Mycobacterium avium subsp. paratuberculosis
acccggcgcggccgcccag

SEQ ID NO: 2868149 - RNA, 14 nt, Mycobacterium avium subsp. paratuberculosis
acccggcggacggu

SEQ ID NO: 2868150 - RNA, 13 nt, Mycobacterium avium subsp. paratuberculosis
acccggcggcacc

SEQ ID NO: 2868151 - RNA, 20 nt, Mycobacterium avium subsp. paratuberculosis
acccggcggcaccgcggcuc

SEQ ID NO: 2868152 - RNA, 23 nt, Mycobacterium avium subsp. paratuberculosis
acccggcggcaccgcggcucggu

SEQ ID NO: 2868153 - RNA, 16 nt, Mycobacterium avium subsp. paratuberculosis
acccggcggccccggu

SEQ ID NO: 2868154 - RNA, 21 nt, Mycobacterium avium subsp. paratuberculosis
acccggcgugcuccagcaggc

SEQ ID NO: 2868155 - RNA, 16 nt, Mycobacterium avium subsp. paratuberculosis
acccggcucuccaucu

SEQ ID NO: 2868156 - RNA, 17 nt, Mycobacterium avium subsp. paratuberculosis
acccggcucuccaucuu

SEQ ID NO: 2868157 - RNA, 19 nt, Mycobacterium avium subsp. paratuberculosis
acccggcucuccaucuucg

SEQ ID NO: 2868158 - RNA, 21 nt, Mycobacterium avium subsp. paratuberculosis
acccggcucuccaucuucggc

SEQ ID NO: 2868159 - RNA, 16 nt, Mycobacterium avium subsp. paratuberculosis
acccggcuggccgcac

SEQ ID NO: 2868160 - RNA, 18 nt, Mycobacterium avium subsp. paratuberculosis
acccggcuucgcugcgcc

SEQ ID NO: 2868161 - RNA, 19 nt, Mycobacterium avium subsp. paratuberculosis
acccggcuucgcugcgccg

SEQ ID NO: 2868162 - RNA, 21 nt, Mycobacterium avium subsp. paratuberculosis
acccggcuucgcugcgccggc

SEQ ID NO: 2868163 - RNA, 13 nt, Mycobacterium avium subsp. paratuberculosis
acccgggaugccg

SEQ ID NO: 2868164 - RNA, 21 nt, Mycobacterium avium subsp. paratuberculosis
acccgggcagcuuccgccucg

SEQ ID NO: 2868165 - RNA, 13 nt, Mycobacterium avium subsp. paratuberculosis
acccgggccagca

SEQ ID NO: 2868166 - RNA, 23 nt, Mycobacterium avium subsp. paratuberculosis
acccgggcccggucgucgccgga

SEQ ID NO: 2868167 - RNA, 13 nt, Mycobacterium avium subsp. paratuberculosis
acccgggccggac

SEQ ID NO: 2868168 - RNA, 21 nt, Mycobacterium avium subsp. paratuberculosis
acccgggccugcggcggccgc

SEQ ID NO: 2868169 - RNA, 20 nt, Mycobacterium avium subsp. paratuberculosis
acccgggccuugacggccug

SEQ ID NO: 2868170 - RNA, 23 nt, Mycobacterium avium subsp. paratuberculosis
acccgggccuugacggccugggc

SEQ ID NO: 2868171 - RNA, 22 nt, Mycobacterium avium subsp. paratuberculosis
acccgggccuuguugcggcgca

SEQ ID NO: 2868172 - RNA, 18 nt, Mycobacterium avium subsp. paratuberculosis
acccgggcgauggugccg

SEQ ID NO: 2868173 - RNA, 21 nt, Mycobacterium avium subsp. paratuberculosis
acccgggcgauggugccgccg

SEQ ID NO: 2868174 - RNA, 14 nt, Mycobacterium avium subsp. paratuberculosis
acccgggcgccauc

SEQ ID NO: 2868175 - RNA, 16 nt, Mycobacterium avium subsp. paratuberculosis
acccgggcgccggcga

SEQ ID NO: 2868176 - RNA, 11 nt, Mycobacterium avium subsp. paratuberculosis
acccgggcgcg

SEQ ID NO: 2868177 - RNA, 13 nt, Mycobacterium avium subsp. paratuberculosis
acccgggcgcgac

SEQ ID NO: 2868178 - RNA, 14 nt, Mycobacterium avium subsp. paratuberculosis
acccgggcgcgacg

SEQ ID NO: 2868179 - RNA, 13 nt, Mycobacterium avium subsp. paratuberculosis
acccgggcgcgcc

SEQ ID NO: 2868180 - RNA, 23 nt, Mycobacterium avium subsp. paratuberculosis
acccgggcgcgcccacccgcgcc

SEQ ID NO: 2868181 - RNA, 14 nt, Mycobacterium avium subsp. paratuberculosis
acccgggcggccug

SEQ ID NO: 2868182 - RNA, 18 nt, Mycobacterium avium subsp. paratuberculosis
acccgggcggccugcugc

SEQ ID NO: 2868183 - RNA, 19 nt, Mycobacterium avium subsp. paratuberculosis
acccgggcggccugcugca

SEQ ID NO: 2868184 - RNA, 15 nt, Mycobacterium avium subsp. paratuberculosis
acccggggccguccg

SEQ ID NO: 2868185 - RNA, 22 nt, Mycobacterium avium subsp. paratuberculosis
acccggggguccagggugccga

SEQ ID NO: 2868186 - RNA, 13 nt, Mycobacterium avium subsp. paratuberculosis
acccgggucgagc

SEQ ID NO: 2868187 - RNA, 13 nt, Mycobacterium avium subsp. paratuberculosis
acccgggugcccg

SEQ ID NO: 2868188 - RNA, 21 nt, Mycobacterium avium subsp. paratuberculosis
acccgggugcccggcugggcg

SEQ ID NO: 2868189 - RNA, 14 nt, Mycobacterium avium subsp. paratuberculosis
acccggguggacac

SEQ ID NO: 2868190 - RNA, 18 nt, Mycobacterium avium subsp. paratuberculosis
acccggguggacaccgcg

SEQ ID NO: 2868191 - RNA, 21 nt, Mycobacterium avium subsp. paratuberculosis
acccggguguuggagccgucc

SEQ ID NO: 2868192 - RNA, 21 nt, Mycobacterium avium subsp. paratuberculosis
acccggguguuggcgcacagc

SEQ ID NO: 2868193 - RNA, 22 nt, Mycobacterium avium subsp. paratuberculosis
acccggguugcgugcagccgca

SEQ ID NO: 2868194 - RNA, 15 nt, Mycobacterium avium subsp. paratuberculosis
acccgguagcgcagc

SEQ ID NO: 2868195 - RNA, 19 nt, Mycobacterium avium subsp. paratuberculosis
acccgguagcgcagcacca

SEQ ID NO: 2868196 - RNA, 19 nt, Mycobacterium avium subsp. paratuberculosis
acccggucagcucgccguc

SEQ ID NO: 2868197 - RNA, 18 nt, Mycobacterium avium subsp. paratuberculosis
acccgguccggcuggucg

SEQ ID NO: 2868198 - RNA, 19 nt, Mycobacterium avium subsp. paratuberculosis
acccgguccggcuggucgg

SEQ ID NO: 2868199 - RNA, 21 nt, Mycobacterium avium subsp. paratuberculosis
acccgguccggcuggucggcc

SEQ ID NO: 2868200 - RNA, 22 nt, Mycobacterium avium subsp. paratuberculosis
acccgguccggcuggucggccu

SEQ ID NO: 2868201 - RNA, 21 nt, Mycobacterium avium subsp. paratuberculosis
acccgguccuucucgcacagc

SEQ ID NO: 2868202 - RNA, 13 nt, Mycobacterium avium subsp. paratuberculosis
acccggucgacga

SEQ ID NO: 2868203 - RNA, 13 nt, Mycobacterium avium subsp. paratuberculosis
acccggucgaugu

SEQ ID NO: 2868204 - RNA, 14 nt, Mycobacterium avium subsp. paratuberculosis
acccggucgccggu

SEQ ID NO: 2868205 - RNA, 15 nt, Mycobacterium avium subsp. paratuberculosis
acccggucgccggug

SEQ ID NO: 2868206 - RNA, 14 nt, Mycobacterium avium subsp. paratuberculosis
acccggucgcggcc

SEQ ID NO: 2868207 - RNA, 18 nt, Mycobacterium avium subsp. paratuberculosis
acccggucggccgcgugc

SEQ ID NO: 2868208 - RNA, 13 nt, Mycobacterium avium subsp. paratuberculosis
acccggucgguga

SEQ ID NO: 2868209 - RNA, 18 nt, Mycobacterium avium subsp. paratuberculosis
acccggucugaucgccca

SEQ ID NO: 2868210 - RNA, 21 nt, Mycobacterium avium subsp. paratuberculosis
acccggucugaucgcccagca

SEQ ID NO: 2868211 - RNA, 21 nt, Mycobacterium avium subsp. paratuberculosis
acccggucuuguugugcugca

SEQ ID NO: 2868212 - RNA, 17 nt, Mycobacterium avium subsp. paratuberculosis
acccggugcccgagauc

SEQ ID NO: 2868213 - RNA, 15 nt, Mycobacterium avium subsp. paratuberculosis
acccggugccggccg

SEQ ID NO: 2868214 - RNA, 17 nt, Mycobacterium avium subsp. paratuberculosis
acccggugccggccggg

SEQ ID NO: 2868215 - RNA, 19 nt, Mycobacterium avium subsp. paratuberculosis
acccggugccggccggguc

SEQ ID NO: 2868216 - RNA, 21 nt, Mycobacterium avium subsp. paratuberculosis
acccggugccggccgggucga

SEQ ID NO: 2868217 - RNA, 15 nt, Mycobacterium avium subsp. paratuberculosis
acccggugcgccggu

SEQ ID NO: 2868218 - RNA, 20 nt, Mycobacterium avium subsp. paratuberculosis
acccgguucugggcgggcuc

SEQ ID NO: 2868219 - RNA, 19 nt, Mycobacterium avium subsp. paratuberculosis
acccgguugaaggccgcgc

SEQ ID NO: 2868220 - RNA, 19 nt, Mycobacterium avium subsp. paratuberculosis
acccgguugagcaccgcau

SEQ ID NO: 2868221 - RNA, 14 nt, Mycobacterium avium subsp. paratuberculosis
acccgguugauccg

SEQ ID NO: 2868222 - RNA, 17 nt, Mycobacterium avium subsp. paratuberculosis
acccguaggagcugacg

SEQ ID NO: 2868223 - RNA, 23 nt, Mycobacterium avium subsp. paratuberculosis
acccguaggagcugacggccaug

SEQ ID NO: 2868224 - RNA, 15 nt, Mycobacterium avium subsp. paratuberculosis
acccguccagcagca

SEQ ID NO: 2868225 - RNA, 14 nt, Mycobacterium avium subsp. paratuberculosis
acccguccagcgcg

SEQ ID NO: 2868226 - RNA, 15 nt, Mycobacterium avium subsp. paratuberculosis
acccgucgacucggc

SEQ ID NO: 2868227 - RNA, 21 nt, Mycobacterium avium subsp. paratuberculosis
acccgucgacucggcggugcc

SEQ ID NO: 2868228 - RNA, 22 nt, Mycobacterium avium subsp. paratuberculosis
acccgucgcgggucagcgucgc

SEQ ID NO: 2868229 - RNA, 23 nt, Mycobacterium avium subsp. paratuberculosis
acccgucgcgggucagcgucgcc

SEQ ID NO: 2868230 - RNA, 16 nt, Mycobacterium avium subsp. paratuberculosis
acccgucggggugcgc

SEQ ID NO: 2868231 - RNA, 19 nt, Mycobacterium avium subsp. paratuberculosis
acccgucggggugcgccag

SEQ ID NO: 2868232 - RNA, 20 nt, Mycobacterium avium subsp. paratuberculosis
acccgugggccgaccggccg

SEQ ID NO: 2868233 - RNA, 23 nt, Mycobacterium avium subsp. paratuberculosis
acccguggugggcgaacagcagc

SEQ ID NO: 2868234 - RNA, 17 nt, Mycobacterium avium subsp. paratuberculosis
acccguuccccggccga

SEQ ID NO: 2868235 - RNA, 18 nt, Mycobacterium avium subsp. paratuberculosis
acccguuccccggccgac

SEQ ID NO: 2868236 - RNA, 15 nt, Mycobacterium avium subsp. paratuberculosis
acccguuccggcgag

SEQ ID NO: 2868237 - RNA, 16 nt, Mycobacterium avium subsp. paratuberculosis
acccguuccucgacgu

SEQ ID NO: 2868238 - RNA, 17 nt, Mycobacterium avium subsp. paratuberculosis
acccguucggcgucgaa

SEQ ID NO: 2868239 - RNA, 20 nt, Mycobacterium avium subsp. paratuberculosis
acccguugcgccccacgguc

SEQ ID NO: 2868240 - RNA, 14 nt, Mycobacterium avium subsp. paratuberculosis
acccguugucgguc

SEQ ID NO: 2868241 - RNA, 21 nt, Mycobacterium avium subsp. paratuberculosis
acccguuugaggcgagcaauu

SEQ ID NO: 2868242 - RNA, 21 nt, Mycobacterium avium subsp. paratuberculosis
acccucaccccgcccagcgca

SEQ ID NO: 2868243 - RNA, 14 nt, Mycobacterium avium subsp. paratuberculosis
acccucagaccaug

SEQ ID NO: 2868244 - RNA, 15 nt, Mycobacterium avium subsp. paratuberculosis
acccuccggcgccug

SEQ ID NO: 2868245 - RNA, 13 nt, Mycobacterium avium subsp. paratuberculosis
acccuccgggcgg

SEQ ID NO: 2868246 - RNA, 16 nt, Mycobacterium avium subsp. paratuberculosis
acccucgacgccgggc

SEQ ID NO: 2868247 - RNA, 15 nt, Mycobacterium avium subsp. paratuberculosis
acccucgaggccgac

SEQ ID NO: 2868248 - RNA, 14 nt, Mycobacterium avium subsp. paratuberculosis
acccucgccgccgc

SEQ ID NO: 2868249 - RNA, 18 nt, Mycobacterium avium subsp. paratuberculosis
acccucgccgccgccgau

SEQ ID NO: 2868250 - RNA, 17 nt, Mycobacterium avium subsp. paratuberculosis
acccucggcccgccacc

SEQ ID NO: 2868251 - RNA, 15 nt, Mycobacterium avium subsp. paratuberculosis
acccucggcgucccg

SEQ ID NO: 2868252 - RNA, 17 nt, Mycobacterium avium subsp. paratuberculosis
acccucugccacggcgg

SEQ ID NO: 2868253 - RNA, 18 nt, Mycobacterium avium subsp. paratuberculosis
acccugccccacggcccg

SEQ ID NO: 2868254 - RNA, 20 nt, Mycobacterium avium subsp. paratuberculosis
acccugccgaccugcgcgac

SEQ ID NO: 2868255 - RNA, 20 nt, Mycobacterium avium subsp. paratuberculosis
acccugccgucaccggccau

SEQ ID NO: 2868256 - RNA, 21 nt, Mycobacterium avium subsp. paratuberculosis
acccugccgucaccggccauc

SEQ ID NO: 2868257 - RNA, 24 nt, Mycobacterium avium subsp. paratuberculosis
acccugccgucaccggccauccgc

SEQ ID NO: 2868258 - RNA, 16 nt, Mycobacterium avium subsp. paratuberculosis
acccugcgcaccgcgg

SEQ ID NO: 2868259 - RNA, 14 nt, Mycobacterium avium subsp. paratuberculosis
acccugcguccggc

SEQ ID NO: 2868260 - RNA, 16 nt, Mycobacterium avium subsp. paratuberculosis
acccugcguccggccc

SEQ ID NO: 2868261 - RNA, 17 nt, Mycobacterium avium subsp. paratuberculosis
acccugcguccggcccg

SEQ ID NO: 2868262 - RNA, 20 nt, Mycobacterium avium subsp. paratuberculosis
acccugcguccggcccggcg

SEQ ID NO: 2868263 - RNA, 21 nt, Mycobacterium avium subsp. paratuberculosis
acccugcguccggcccggcgu

SEQ ID NO: 2868264 - RNA, 15 nt, Mycobacterium avium subsp. paratuberculosis
acccuggccagcacc

SEQ ID NO: 2868265 - RNA, 19 nt, Mycobacterium avium subsp. paratuberculosis
acccuggcgaaccgcggcg

SEQ ID NO: 2868266 - RNA, 16 nt, Mycobacterium avium subsp. paratuberculosis
acccugggcggcgaca

SEQ ID NO: 2868267 - RNA, 14 nt, Mycobacterium avium subsp. paratuberculosis
acccuucagccaga

SEQ ID NO: 2868268 - RNA, 16 nt, Mycobacterium avium subsp. paratuberculosis
acccuucgaacgcgac

SEQ ID NO: 2868269 - RNA, 13 nt, Mycobacterium avium subsp. paratuberculosis
acccuucggccgg

SEQ ID NO: 2868270 - RNA, 14 nt, Mycobacterium avium subsp. paratuberculosis
acccuucggccggc

SEQ ID NO: 2868271 - RNA, 17 nt, Mycobacterium avium subsp. paratuberculosis
acccuucggccggcagc

SEQ ID NO: 2868272 - RNA, 19 nt, Mycobacterium avium subsp. paratuberculosis
acccuugacuaccgcgccc

SEQ ID NO: 2868273 - RNA, 14 nt, Mycobacterium avium subsp. paratuberculosis
accgaaacggcagg

SEQ ID NO: 2868274 - RNA, 15 nt, Mycobacterium avium subsp. paratuberculosis
accgaaacggcaggu

SEQ ID NO: 2868275 - RNA, 13 nt, Mycobacterium avium subsp. paratuberculosis
accgaaagccgac

SEQ ID NO: 2868276 - RNA, 20 nt, Mycobacterium avium subsp. paratuberculosis
accgaacccggaucggccau

SEQ ID NO: 2868277 - RNA, 18 nt, Mycobacterium avium subsp. paratuberculosis
accgaacgacgagccguc

SEQ ID NO: 2868278 - RNA, 13 nt, Mycobacterium avium subsp. paratuberculosis
accgaacgccagc

SEQ ID NO: 2868279 - RNA, 16 nt, Mycobacterium avium subsp. paratuberculosis
accgaacgucacggcg

SEQ ID NO: 2868280 - RNA, 17 nt, Mycobacterium avium subsp. paratuberculosis
accgaacgucacggcga

SEQ ID NO: 2868281 - RNA, 21 nt, Mycobacterium avium subsp. paratuberculosis
accgaagaaccccgagaucgc

SEQ ID NO: 2868282 - RNA, 20 nt, Mycobacterium avium subsp. paratuberculosis
accgaagaucaccgcgacga

SEQ ID NO: 2868283 - RNA, 14 nt, Mycobacterium avium subsp. paratuberculosis
accgaagccgacgu

SEQ ID NO: 2868284 - RNA, 17 nt, Mycobacterium avium subsp. paratuberculosis
accgaagccgacgucga

SEQ ID NO: 2868285 - RNA, 16 nt, Mycobacterium avium subsp. paratuberculosis
accgaagcggcccgag

SEQ ID NO: 2868286 - RNA, 18 nt, Mycobacterium avium subsp. paratuberculosis
accgaagggaaaggcagc

SEQ ID NO: 2868287 - RNA, 19 nt, Mycobacterium avium subsp. paratuberculosis
accgaagggaaaggcagca

SEQ ID NO: 2868288 - RNA, 22 nt, Mycobacterium avium subsp. paratuberculosis
accgaagggaaaggcagcagcc

SEQ ID NO: 2868289 - RNA, 14 nt, Mycobacterium avium subsp. paratuberculosis
accgaaucgagccg

SEQ ID NO: 2868290 - RNA, 23 nt, Mycobacterium avium subsp. paratuberculosis
accgacaagggccgggcgcuggc

SEQ ID NO: 2868291 - RNA, 16 nt, Mycobacterium avium subsp. paratuberculosis
accgacaccaccggcc

SEQ ID NO: 2868292 - RNA, 18 nt, Mycobacterium avium subsp. paratuberculosis
accgacaccaccggccgc

SEQ ID NO: 2868293 - RNA, 21 nt, Mycobacterium avium subsp. paratuberculosis
accgacaccaccggccgcccg

SEQ ID NO: 2868294 - RNA, 17 nt, Mycobacterium avium subsp. paratuberculosis
accgacaccggccggga

SEQ ID NO: 2868295 - RNA, 17 nt, Mycobacterium avium subsp. paratuberculosis
accgacaccucgccguc

SEQ ID NO: 2868296 - RNA, 18 nt, Mycobacterium avium subsp. paratuberculosis
accgacaccucgccgucc

SEQ ID NO: 2868297 - RNA, 19 nt, Mycobacterium avium subsp. paratuberculosis
accgacaccucgccguccu

SEQ ID NO: 2868298 - RNA, 19 nt, Mycobacterium avium subsp. paratuberculosis
accgacagcaaaccgaccg

SEQ ID NO: 2868299 - RNA, 22 nt, Mycobacterium avium subsp. paratuberculosis
accgacagcaaaccgaccgccg

SEQ ID NO: 2868300 - RNA, 23 nt, Mycobacterium avium subsp. paratuberculosis
accgacagcaaaccgaccgccgc

SEQ ID NO: 2868301 - RNA, 14 nt, Mycobacterium avium subsp. paratuberculosis
accgacagcacccg

SEQ ID NO: 2868302 - RNA, 15 nt, Mycobacterium avium subsp. paratuberculosis
accgacagcacccgg

SEQ ID NO: 2868303 - RNA, 12 nt, Mycobacterium avium subsp. paratuberculosis
accgacagcgcg

SEQ ID NO: 2868304 - RNA, 14 nt, Mycobacterium avium subsp. paratuberculosis
accgacagggccag

SEQ ID NO: 2868305 - RNA, 17 nt, Mycobacterium avium subsp. paratuberculosis
accgacagggccagcgc

SEQ ID NO: 2868306 - RNA, 18 nt, Mycobacterium avium subsp. paratuberculosis
accgacagggccagcgcc

SEQ ID NO: 2868307 - RNA, 19 nt, Mycobacterium avium subsp. paratuberculosis
accgacagggccagcgcca

SEQ ID NO: 2868308 - RNA, 21 nt, Mycobacterium avium subsp. paratuberculosis
accgacagggccagcgccaug

SEQ ID NO: 2868309 - RNA, 13 nt, Mycobacterium avium subsp. paratuberculosis
accgacaguccca

SEQ ID NO: 2868310 - RNA, 17 nt, Mycobacterium avium subsp. paratuberculosis
accgacagucccaccag

SEQ ID NO: 2868311 - RNA, 19 nt, Mycobacterium avium subsp. paratuberculosis
accgacaguucggcgcgca

SEQ ID NO: 2868312 - RNA, 21 nt, Mycobacterium avium subsp. paratuberculosis
accgacaguucggcgcgcauc

SEQ ID NO: 2868313 - RNA, 23 nt, Mycobacterium avium subsp. paratuberculosis
accgacaucaccaaccgcucggc

SEQ ID NO: 2868314 - RNA, 16 nt, Mycobacterium avium subsp. paratuberculosis
accgacaucagaucgc

SEQ ID NO: 2868315 - RNA, 19 nt, Mycobacterium avium subsp. paratuberculosis
accgacaucagaucgccga

SEQ ID NO: 2868316 - RNA, 20 nt, Mycobacterium avium subsp. paratuberculosis
accgacaucagaucgccgac

SEQ ID NO: 2868317 - RNA, 17 nt, Mycobacterium avium subsp. paratuberculosis
accgacauggccagcac

SEQ ID NO: 2868318 - RNA, 19 nt, Mycobacterium avium subsp. paratuberculosis
accgacaugucgccgggcg

SEQ ID NO: 2868319 - RNA, 13 nt, Mycobacterium avium subsp. paratuberculosis
accgaccagcggg

SEQ ID NO: 2868320 - RNA, 14 nt, Mycobacterium avium subsp. paratuberculosis
accgaccagcggga

SEQ ID NO: 2868321 - RNA, 17 nt, Mycobacterium avium subsp. paratuberculosis
accgaccccucggcggc

SEQ ID NO: 2868322 - RNA, 19 nt, Mycobacterium avium subsp. paratuberculosis
accgaccccucggcggccg

SEQ ID NO: 2868323 - RNA, 20 nt, Mycobacterium avium subsp. paratuberculosis
accgaccccucggcggccgu

SEQ ID NO: 2868324 - RNA, 18 nt, Mycobacterium avium subsp. paratuberculosis
accgacccggccagcggc

SEQ ID NO: 2868325 - RNA, 17 nt, Mycobacterium avium subsp. paratuberculosis
accgaccgccgcggccg

SEQ ID NO: 2868326 - RNA, 19 nt, Mycobacterium avium subsp. paratuberculosis
accgaccggcucucagccg

SEQ ID NO: 2868327 - RNA, 14 nt, Mycobacterium avium subsp. paratuberculosis
accgaccuguccga

SEQ ID NO: 2868328 - RNA, 12 nt, Mycobacterium avium subsp. paratuberculosis
accgacgaccau

SEQ ID NO: 2868329 - RNA, 18 nt, Mycobacterium avium subsp. paratuberculosis
accgacgaccaucagcgc

SEQ ID NO: 2868330 - RNA, 23 nt, Mycobacterium avium subsp. paratuberculosis
accgacgaccaucagcgcccggg

SEQ ID NO: 2868331 - RNA, 20 nt, Mycobacterium avium subsp. paratuberculosis
accgacgacgugacgaccug

SEQ ID NO: 2868332 - RNA, 16 nt, Mycobacterium avium subsp. paratuberculosis
accgacgaggagaccu

SEQ ID NO: 2868333 - RNA, 20 nt, Mycobacterium avium subsp. paratuberculosis
accgacgaggagaccuccug

SEQ ID NO: 2868334 - RNA, 12 nt, Mycobacterium avium subsp. paratuberculosis
accgacgccagc

SEQ ID NO: 2868335 - RNA, 15 nt, Mycobacterium avium subsp. paratuberculosis
accgacgccagcggg

SEQ ID NO: 2868336 - RNA, 24 nt, Mycobacterium avium subsp. paratuberculosis
accgacgccagcgggccgugccgc

SEQ ID NO: 2868337 - RNA, 13 nt, Mycobacterium avium subsp. paratuberculosis
accgacgcccggc

SEQ ID NO: 2868338 - RNA, 14 nt, Mycobacterium avium subsp. paratuberculosis
accgacgcccggcu

SEQ ID NO: 2868339 - RNA, 12 nt, Mycobacterium avium subsp. paratuberculosis
accgacgcggcg

SEQ ID NO: 2868340 - RNA, 14 nt, Mycobacterium avium subsp. paratuberculosis
accgacgcggcggc

SEQ ID NO: 2868341 - RNA, 16 nt, Mycobacterium avium subsp. paratuberculosis
accgacgcggcggccg

SEQ ID NO: 2868342 - RNA, 21 nt, Mycobacterium avium subsp. paratuberculosis
accgacgcggucaccggcucg

SEQ ID NO: 2868343 - RNA, 13 nt, Mycobacterium avium subsp. paratuberculosis
accgacgcgucgc

SEQ ID NO: 2868344 - RNA, 17 nt, Mycobacterium avium subsp. paratuberculosis
accgacgcucgccaccc

SEQ ID NO: 2868345 - RNA, 20 nt, Mycobacterium avium subsp. paratuberculosis
accgacggagccgagcacca

SEQ ID NO: 2868346 - RNA, 13 nt, Mycobacterium avium subsp. paratuberculosis
accgacggccgca

SEQ ID NO: 2868347 - RNA, 14 nt, Mycobacterium avium subsp. paratuberculosis
accgacggccgcac

SEQ ID NO: 2868348 - RNA, 18 nt, Mycobacterium avium subsp. paratuberculosis
accgacggccgcacccca

SEQ ID NO: 2868349 - RNA, 15 nt, Mycobacterium avium subsp. paratuberculosis
accgacggcgaccag

SEQ ID NO: 2868350 - RNA, 22 nt, Mycobacterium avium subsp. paratuberculosis
accgacggcuggaaucccgccu

SEQ ID NO: 2868351 - RNA, 18 nt, Mycobacterium avium subsp. paratuberculosis
accgacuccuccggcccg

SEQ ID NO: 2868352 - RNA, 14 nt, Mycobacterium avium subsp. paratuberculosis
accgacuccuuggg

SEQ ID NO: 2868353 - RNA, 14 nt, Mycobacterium avium subsp. paratuberculosis
accgacugcgacgg

SEQ ID NO: 2868354 - RNA, 19 nt, Mycobacterium avium subsp. paratuberculosis
accgagaucaugccggcga

SEQ ID NO: 2868355 - RNA, 18 nt, Mycobacterium avium subsp. paratuberculosis
accgagaucucgucgaug

SEQ ID NO: 2868356 - RNA, 22 nt, Mycobacterium avium subsp. paratuberculosis
accgagaugaagacccggccgu

SEQ ID NO: 2868357 - RNA, 21 nt, Mycobacterium avium subsp. paratuberculosis
accgagcccguucagugacca

SEQ ID NO: 2868358 - RNA, 13 nt, Mycobacterium avium subsp. paratuberculosis
accgagccgcgcg

SEQ ID NO: 2868359 - RNA, 14 nt, Mycobacterium avium subsp. paratuberculosis
accgagccgcgcgc

SEQ ID NO: 2868360 - RNA, 14 nt, Mycobacterium avium subsp. paratuberculosis
accgagccggcggc

SEQ ID NO: 2868361 - RNA, 15 nt, Mycobacterium avium subsp. paratuberculosis
accgagccggcggcg

SEQ ID NO: 2868362 - RNA, 16 nt, Mycobacterium avium subsp. paratuberculosis
accgagccggcggcgu

SEQ ID NO: 2868363 - RNA, 15 nt, Mycobacterium avium subsp. paratuberculosis
accgagccggcgucg

SEQ ID NO: 2868364 - RNA, 19 nt, Mycobacterium avium subsp. paratuberculosis
accgagccggcgucgccgc

SEQ ID NO: 2868365 - RNA, 15 nt, Mycobacterium avium subsp. paratuberculosis
accgagccgggcagc

SEQ ID NO: 2868366 - RNA, 18 nt, Mycobacterium avium subsp. paratuberculosis
accgagccgggcagcgcg

SEQ ID NO: 2868367 - RNA, 20 nt, Mycobacterium avium subsp. paratuberculosis
accgagccgggcagcgcgac

SEQ ID NO: 2868368 - RNA, 12 nt, Mycobacterium avium subsp. paratuberculosis
accgagccgggg

SEQ ID NO: 2868369 - RNA, 15 nt, Mycobacterium avium subsp. paratuberculosis
accgagccggggcug

SEQ ID NO: 2868370 - RNA, 13 nt, Mycobacterium avium subsp. paratuberculosis
accgagcgagcgc

SEQ ID NO: 2868371 - RNA, 17 nt, Mycobacterium avium subsp. paratuberculosis
accgagcgagcgcacca

SEQ ID NO: 2868372 - RNA, 13 nt, Mycobacterium avium subsp. paratuberculosis
accgagcgcgcga

SEQ ID NO: 2868373 - RNA, 12 nt, Mycobacterium avium subsp. paratuberculosis
accgagcggccg

SEQ ID NO: 2868374 - RNA, 13 nt, Mycobacterium avium subsp. paratuberculosis
accgagcggccgu

SEQ ID NO: 2868375 - RNA, 14 nt, Mycobacterium avium subsp. paratuberculosis
accgagcggccguc

SEQ ID NO: 2868376 - RNA, 15 nt, Mycobacterium avium subsp. paratuberculosis
accgagcggccgucc

SEQ ID NO: 2868377 - RNA, 16 nt, Mycobacterium avium subsp. paratuberculosis
accgagcggcgcugca

SEQ ID NO: 2868378 - RNA, 18 nt, Mycobacterium avium subsp. paratuberculosis
accgagcggcgcugcagc

SEQ ID NO: 2868379 - RNA, 14 nt, Mycobacterium avium subsp. paratuberculosis
accgagcugggccg

SEQ ID NO: 2868380 - RNA, 21 nt, Mycobacterium avium subsp. paratuberculosis
accgagcugggccggcgccga

SEQ ID NO: 2868381 - RNA, 19 nt, Mycobacterium avium subsp. paratuberculosis
accgaggaugaccgcggcg

SEQ ID NO: 2868382 - RNA, 21 nt, Mycobacterium avium subsp. paratuberculosis
accgaggcaaucgagcgggcg

SEQ ID NO: 2868383 - RNA, 15 nt, Mycobacterium avium subsp. paratuberculosis
accgaggccagcaga

SEQ ID NO: 2868384 - RNA, 14 nt, Mycobacterium avium subsp. paratuberculosis
accgaggccgcccg

SEQ ID NO: 2868385 - RNA, 13 nt, Mycobacterium avium subsp. paratuberculosis
accgaggcgaucg

SEQ ID NO: 2868386 - RNA, 18 nt, Mycobacterium avium subsp. paratuberculosis
accgagguagggccgggu

SEQ ID NO: 2868387 - RNA, 17 nt, Mycobacterium avium subsp. paratuberculosis
accgaggugacgaggcc

SEQ ID NO: 2868388 - RNA, 22 nt, Mycobacterium avium subsp. paratuberculosis
accgaggugacgucgcgccgcu

SEQ ID NO: 2868389 - RNA, 14 nt, Mycobacterium avium subsp. paratuberculosis
accgaggugccgcg

SEQ ID NO: 2868390 - RNA, 15 nt, Mycobacterium avium subsp. paratuberculosis
accgagguggcccag

SEQ ID NO: 2868391 - RNA, 17 nt, Mycobacterium avium subsp. paratuberculosis
accgagguggcccagcc

SEQ ID NO: 2868392 - RNA, 19 nt, Mycobacterium avium subsp. paratuberculosis
accgagguggcccagccgc

SEQ ID NO: 2868393 - RNA, 15 nt, Mycobacterium avium subsp. paratuberculosis
accgagucgcgcgac

SEQ ID NO: 2868394 - RNA, 16 nt, Mycobacterium avium subsp. paratuberculosis
accgagucgcgcgacc

SEQ ID NO: 2868395 - RNA, 19 nt, Mycobacterium avium subsp. paratuberculosis
accgagucgcgcgaccagu

SEQ ID NO: 2868396 - RNA, 16 nt, Mycobacterium avium subsp. paratuberculosis
accgagucgcugcagc

SEQ ID NO: 2868397 - RNA, 17 nt, Mycobacterium avium subsp. paratuberculosis
accgagucgcugcagca

SEQ ID NO: 2868398 - RNA, 19 nt, Mycobacterium avium subsp. paratuberculosis
accgagucggugaccaccu

SEQ ID NO: 2868399 - RNA, 13 nt, Mycobacterium avium subsp. paratuberculosis
accgagucgucgc

SEQ ID NO: 2868400 - RNA, 17 nt, Mycobacterium avium subsp. paratuberculosis
accgagucgucgcgcac

SEQ ID NO: 2868401 - RNA, 19 nt, Mycobacterium avium subsp. paratuberculosis
accgagucgucgcgcacca

SEQ ID NO: 2868402 - RNA, 22 nt, Mycobacterium avium subsp. paratuberculosis
accgagucgucgcgcaccagcu

SEQ ID NO: 2868403 - RNA, 15 nt, Mycobacterium avium subsp. paratuberculosis
accgaguugaacgcg

SEQ ID NO: 2868404 - RNA, 19 nt, Mycobacterium avium subsp. paratuberculosis
accgaguugaacgcgucga

SEQ ID NO: 2868405 - RNA, 20 nt, Mycobacterium avium subsp. paratuberculosis
accgaguugaacgcgucgaa

SEQ ID NO: 2868406 - RNA, 13 nt, Mycobacterium avium subsp. paratuberculosis
accgaucaccggc

SEQ ID NO: 2868407 - RNA, 17 nt, Mycobacterium avium subsp. paratuberculosis
accgaucaccggcagca

SEQ ID NO: 2868408 - RNA, 22 nt, Mycobacterium avium subsp. paratuberculosis
accgaucaccggcagcagcgcg

SEQ ID NO: 2868409 - RNA, 17 nt, Mycobacterium avium subsp. paratuberculosis
accgaucagcaugccgg

SEQ ID NO: 2868410 - RNA, 19 nt, Mycobacterium avium subsp. paratuberculosis
accgaucagcaugccgguc

SEQ ID NO: 2868411 - RNA, 12 nt, Mycobacterium avium subsp. paratuberculosis
accgaucaggau

SEQ ID NO: 2868412 - RNA, 17 nt, Mycobacterium avium subsp. paratuberculosis
accgauccgccggcgaa

SEQ ID NO: 2868413 - RNA, 16 nt, Mycobacterium avium subsp. paratuberculosis
accgauccgcgggccg

SEQ ID NO: 2868414 - RNA, 13 nt, Mycobacterium avium subsp. paratuberculosis
accgauccggcgc

SEQ ID NO: 2868415 - RNA, 14 nt, Mycobacterium avium subsp. paratuberculosis
accgauccggcgcc

SEQ ID NO: 2868416 - RNA, 20 nt, Mycobacterium avium subsp. paratuberculosis
accgaucggauucggguggc

SEQ ID NO: 2868417 - RNA, 22 nt, Mycobacterium avium subsp. paratuberculosis
accgaucggauucggguggcgu

SEQ ID NO: 2868418 - RNA, 12 nt, Mycobacterium avium subsp. paratuberculosis
accgaucggcac

SEQ ID NO: 2868419 - RNA, 14 nt, Mycobacterium avium subsp. paratuberculosis
accgaucggcacgu

SEQ ID NO: 2868420 - RNA, 17 nt, Mycobacterium avium subsp. paratuberculosis
accgaucggcacgucga

SEQ ID NO: 2868421 - RNA, 15 nt, Mycobacterium avium subsp. paratuberculosis
accgaugaccaccgc

SEQ ID NO: 2868422 - RNA, 15 nt, Mycobacterium avium subsp. paratuberculosis
accgaugcgggccag

SEQ ID NO: 2868423 - RNA, 12 nt, Mycobacterium avium subsp. paratuberculosis
accgauggccgc

SEQ ID NO: 2868424 - RNA, 16 nt, Mycobacterium avium subsp. paratuberculosis
accgauggccgcccgc

SEQ ID NO: 2868425 - RNA, 18 nt, Mycobacterium avium subsp. paratuberculosis
accgauggccgcccgcag

SEQ ID NO: 2868426 - RNA, 15 nt, Mycobacterium avium subsp. paratuberculosis
accgauggcggcggc

SEQ ID NO: 2868427 - RNA, 18 nt, Mycobacterium avium subsp. paratuberculosis
accgauggcggcggcccg

SEQ ID NO: 2868428 - RNA, 19 nt, Mycobacterium avium subsp. paratuberculosis
accgauggcggcggcccgc

SEQ ID NO: 2868429 - RNA, 20 nt, Mycobacterium avium subsp. paratuberculosis
accgauggcggcggcccgcc

SEQ ID NO: 2868430 - RNA, 21 nt, Mycobacterium avium subsp. paratuberculosis
accgauggcggcggcccgccg

SEQ ID NO: 2868431 - RNA, 23 nt, Mycobacterium avium subsp. paratuberculosis
accgauggcggcggcccgccgcg

SEQ ID NO: 2868432 - RNA, 15 nt, Mycobacterium avium subsp. paratuberculosis
accgauuucggccag

SEQ ID NO: 2868433 - RNA, 16 nt, Mycobacterium avium subsp. paratuberculosis
accgauuucggccagc

SEQ ID NO: 2868434 - RNA, 19 nt, Mycobacterium avium subsp. paratuberculosis
accgauuucggccagccgg

SEQ ID NO: 2868435 - RNA, 21 nt, Mycobacterium avium subsp. paratuberculosis
accgauuucggccagccgggg

SEQ ID NO: 2868436 - RNA, 15 nt, Mycobacterium avium subsp. paratuberculosis
accgcaaagcaccgc

SEQ ID NO: 2868437 - RNA, 16 nt, Mycobacterium avium subsp. paratuberculosis
accgcaaagcaccgcg

SEQ ID NO: 2868438 - RNA, 18 nt, Mycobacterium avium subsp. paratuberculosis
accgcaaagcaccgcgaa

SEQ ID NO: 2868439 - RNA, 21 nt, Mycobacterium avium subsp. paratuberculosis
accgcaacaccgaaagccgac

SEQ ID NO: 2868440 - RNA, 20 nt, Mycobacterium avium subsp. paratuberculosis
accgcaacguuguuccacgu

SEQ ID NO: 2868441 - RNA, 18 nt, Mycobacterium avium subsp. paratuberculosis
accgcaagugcggucagc

SEQ ID NO: 2868442 - RNA, 19 nt, Mycobacterium avium subsp. paratuberculosis
accgcaauccuguuccccg

SEQ ID NO: 2868443 - RNA, 23 nt, Mycobacterium avium subsp. paratuberculosis
accgcaauccuguuccccggcgg

SEQ ID NO: 2868444 - RNA, 18 nt, Mycobacterium avium subsp. paratuberculosis
accgcacaauccggucag

SEQ ID NO: 2868445 - RNA, 19 nt, Mycobacterium avium subsp. paratuberculosis
accgcacaauccggucagc

SEQ ID NO: 2868446 - RNA, 20 nt, Mycobacterium avium subsp. paratuberculosis
accgcaccaccacguugcac

SEQ ID NO: 2868447 - RNA, 12 nt, Mycobacterium avium subsp. paratuberculosis
accgcacccaga

SEQ ID NO: 2868448 - RNA, 21 nt, Mycobacterium avium subsp. paratuberculosis
accgcaccgaccagcgggaug

SEQ ID NO: 2868449 - RNA, 22 nt, Mycobacterium avium subsp. paratuberculosis
accgcaccgaccagcgggauga

SEQ ID NO: 2868450 - RNA, 16 nt, Mycobacterium avium subsp. paratuberculosis
accgcaccuugcgccc

SEQ ID NO: 2868451 - RNA, 18 nt, Mycobacterium avium subsp. paratuberculosis
accgcacgagcacccaga

SEQ ID NO: 2868452 - RNA, 22 nt, Mycobacterium avium subsp. paratuberculosis
accgcacgaucagggugucgaa

SEQ ID NO: 2868453 - RNA, 13 nt, Mycobacterium avium subsp. paratuberculosis
accgcacgccggg

SEQ ID NO: 2868454 - RNA, 24 nt, Mycobacterium avium subsp. paratuberculosis
accgcacggcccaucaccagcggc

SEQ ID NO: 2868455 - RNA, 21 nt, Mycobacterium avium subsp. paratuberculosis
accgcagcaggcggacggcga

SEQ ID NO: 2868456 - RNA, 22 nt, Mycobacterium avium subsp. paratuberculosis
accgcagcaggcggacggcgac

SEQ ID NO: 2868457 - RNA, 20 nt, Mycobacterium avium subsp. paratuberculosis
accgcagccgggugcgggcc

SEQ ID NO: 2868458 - RNA, 16 nt, Mycobacterium avium subsp. paratuberculosis
accgcagccuucuucg

SEQ ID NO: 2868459 - RNA, 22 nt, Mycobacterium avium subsp. paratuberculosis
accgcagcggcuugaccggcuc

SEQ ID NO: 2868460 - RNA, 21 nt, Mycobacterium avium subsp. paratuberculosis
accgcaggaaaggaaggcgca

SEQ ID NO: 2868461 - RNA, 14 nt, Mycobacterium avium subsp. paratuberculosis
accgcagucguucg

SEQ ID NO: 2868462 - RNA, 20 nt, Mycobacterium avium subsp. paratuberculosis
accgcagucguucggccagc

SEQ ID NO: 2868463 - RNA, 17 nt, Mycobacterium avium subsp. paratuberculosis
accgcauagcgggagcc

SEQ ID NO: 2868464 - RNA, 21 nt, Mycobacterium avium subsp. paratuberculosis
accgcauagcgggagccggcc

SEQ ID NO: 2868465 - RNA, 17 nt, Mycobacterium avium subsp. paratuberculosis
accgcaucgaaccgccg

SEQ ID NO: 2868466 - RNA, 20 nt, Mycobacterium avium subsp. paratuberculosis
accgcaucgaaccgccgcgc

SEQ ID NO: 2868467 - RNA, 14 nt, Mycobacterium avium subsp. paratuberculosis
accgcaucgccgag

SEQ ID NO: 2868468 - RNA, 15 nt, Mycobacterium avium subsp. paratuberculosis
accgcaucgccgagg

SEQ ID NO: 2868469 - RNA, 16 nt, Mycobacterium avium subsp. paratuberculosis
accgcaucgccgaggg

SEQ ID NO: 2868470 - RNA, 21 nt, Mycobacterium avium subsp. paratuberculosis
accgcaucgccgagggcgacg

SEQ ID NO: 2868471 - RNA, 15 nt, Mycobacterium avium subsp. paratuberculosis
accgcauucggccgc

SEQ ID NO: 2868472 - RNA, 18 nt, Mycobacterium avium subsp. paratuberculosis
accgcauucggccgccac

SEQ ID NO: 2868473 - RNA, 21 nt, Mycobacterium avium subsp. paratuberculosis
accgcauucggccgccaccga

SEQ ID NO: 2868474 - RNA, 14 nt, Mycobacterium avium subsp. paratuberculosis
accgccaccacccg

SEQ ID NO: 2868475 - RNA, 18 nt, Mycobacterium avium subsp. paratuberculosis
accgccaccacccggcga

SEQ ID NO: 2868476 - RNA, 17 nt, Mycobacterium avium subsp. paratuberculosis
accgccaccagcaggcc

SEQ ID NO: 2868477 - RNA, 19 nt, Mycobacterium avium subsp. paratuberculosis
accgccaccagcaggccca

SEQ ID NO: 2868478 - RNA, 15 nt, Mycobacterium avium subsp. paratuberculosis
accgccaccagcgca

SEQ ID NO: 2868479 - RNA, 13 nt, Mycobacterium avium subsp. paratuberculosis
accgccaccaggc

SEQ ID NO: 2868480 - RNA, 14 nt, Mycobacterium avium subsp. paratuberculosis
accgccaccaggcc

SEQ ID NO: 2868481 - RNA, 19 nt, Mycobacterium avium subsp. paratuberculosis
accgccaccaggccguggu

SEQ ID NO: 2868482 - RNA, 13 nt, Mycobacterium avium subsp. paratuberculosis
accgccaccgccc

SEQ ID NO: 2868483 - RNA, 14 nt, Mycobacterium avium subsp. paratuberculosis
accgccaccgcccg

SEQ ID NO: 2868484 - RNA, 15 nt, Mycobacterium avium subsp. paratuberculosis
accgccaccgcccgc

SEQ ID NO: 2868485 - RNA, 13 nt, Mycobacterium avium subsp. paratuberculosis
accgccaccgcga

SEQ ID NO: 2868486 - RNA, 13 nt, Mycobacterium avium subsp. paratuberculosis
accgccaccggcc

SEQ ID NO: 2868487 - RNA, 15 nt, Mycobacterium avium subsp. paratuberculosis
accgccaccggcccg

SEQ ID NO: 2868488 - RNA, 18 nt, Mycobacterium avium subsp. paratuberculosis
accgccacgacgcggcga

SEQ ID NO: 2868489 - RNA, 19 nt, Mycobacterium avium subsp. paratuberculosis
accgccacgacgcggcgau

SEQ ID NO: 2868490 - RNA, 20 nt, Mycobacterium avium subsp. paratuberculosis
accgccacgccguugggcgc

SEQ ID NO: 2868491 - RNA, 13 nt, Mycobacterium avium subsp. paratuberculosis
accgccacggcga

SEQ ID NO: 2868492 - RNA, 17 nt, Mycobacterium avium subsp. paratuberculosis
accgccacggcgacgac

SEQ ID NO: 2868493 - RNA, 20 nt, Mycobacterium avium subsp. paratuberculosis
accgccacggcgacgaccac

SEQ ID NO: 2868494 - RNA, 18 nt, Mycobacterium avium subsp. paratuberculosis
accgccacgucgaacccg

SEQ ID NO: 2868495 - RNA, 21 nt, Mycobacterium avium subsp. paratuberculosis
accgccagacugaugcccucg

SEQ ID NO: 2868496 - RNA, 12 nt, Mycobacterium avium subsp. paratuberculosis
accgccagcacc

SEQ ID NO: 2868497 - RNA, 14 nt, Mycobacterium avium subsp. paratuberculosis
accgccagcaccgc

SEQ ID NO: 2868498 - RNA, 18 nt, Mycobacterium avium subsp. paratuberculosis
accgccagcaccgccacc

SEQ ID NO: 2868499 - RNA, 15 nt, Mycobacterium avium subsp. paratuberculosis
accgccagcaccgcg

SEQ ID NO: 2868500 - RNA, 16 nt, Mycobacterium avium subsp. paratuberculosis
accgccagcagcagcc

SEQ ID NO: 2868501 - RNA, 18 nt, Mycobacterium avium subsp. paratuberculosis
accgccagcagcagccgc

SEQ ID NO: 2868502 - RNA, 20 nt, Mycobacterium avium subsp. paratuberculosis
accgccagcagcagccgcgc

SEQ ID NO: 2868503 - RNA, 21 nt, Mycobacterium avium subsp. paratuberculosis
accgccagcagcagccgcgcc

SEQ ID NO: 2868504 - RNA, 23 nt, Mycobacterium avium subsp. paratuberculosis
accgccagcagcagccgcgccgc

SEQ ID NO: 2868505 - RNA, 13 nt, Mycobacterium avium subsp. paratuberculosis
accgccagcagcg

SEQ ID NO: 2868506 - RNA, 19 nt, Mycobacterium avium subsp. paratuberculosis
accgccagcagcgcaagcu

SEQ ID NO: 2868507 - RNA, 17 nt, Mycobacterium avium subsp. paratuberculosis
accgccagcagcgccgc

SEQ ID NO: 2868508 - RNA, 18 nt, Mycobacterium avium subsp. paratuberculosis
accgccagcagcgccgcu

SEQ ID NO: 2868509 - RNA, 22 nt, Mycobacterium avium subsp. paratuberculosis
accgccagcagcgccgcuucgu

SEQ ID NO: 2868510 - RNA, 15 nt, Mycobacterium avium subsp. paratuberculosis
accgccagcauccgc

SEQ ID NO: 2868511 - RNA, 23 nt, Mycobacterium avium subsp. paratuberculosis
accgccagcauccgcuggugcgc

SEQ ID NO: 2868512 - RNA, 12 nt, Mycobacterium avium subsp. paratuberculosis
accgccagccac

SEQ ID NO: 2868513 - RNA, 15 nt, Mycobacterium avium subsp. paratuberculosis
accgccagcgccggc

SEQ ID NO: 2868514 - RNA, 18 nt, Mycobacterium avium subsp. paratuberculosis
accgccagcgccggcagc

SEQ ID NO: 2868515 - RNA, 12 nt, Mycobacterium avium subsp. paratuberculosis
accgccagcgcg

SEQ ID NO: 2868516 - RNA, 13 nt, Mycobacterium avium subsp. paratuberculosis
accgccagcgcgc

SEQ ID NO: 2868517 - RNA, 14 nt, Mycobacterium avium subsp. paratuberculosis
accgccagcgcgcc

SEQ ID NO: 2868518 - RNA, 19 nt, Mycobacterium avium subsp. paratuberculosis
accgccagcgcgccgaucg

SEQ ID NO: 2868519 - RNA, 23 nt, Mycobacterium avium subsp. paratuberculosis
accgccagcgcgccgaucgccca

SEQ ID NO: 2868520 - RNA, 15 nt, Mycobacterium avium subsp. paratuberculosis
accgccagcgcggcg

SEQ ID NO: 2868521 - RNA, 16 nt, Mycobacterium avium subsp. paratuberculosis
accgccagcgcggcgg

SEQ ID NO: 2868522 - RNA, 21 nt, Mycobacterium avium subsp. paratuberculosis
accgccagcgcggcggcgccg

SEQ ID NO: 2868523 - RNA, 13 nt, Mycobacterium avium subsp. paratuberculosis
accgccaggcugg

SEQ ID NO: 2868524 - RNA, 17 nt, Mycobacterium avium subsp. paratuberculosis
accgccaggcuggccag

SEQ ID NO: 2868525 - RNA, 19 nt, Mycobacterium avium subsp. paratuberculosis
accgccaggcuggccaggc

SEQ ID NO: 2868526 - RNA, 15 nt, Mycobacterium avium subsp. paratuberculosis
accgccaucgcggcg

SEQ ID NO: 2868527 - RNA, 16 nt, Mycobacterium avium subsp. paratuberculosis
accgccaucgcggcgu

SEQ ID NO: 2868528 - RNA, 22 nt, Mycobacterium avium subsp. paratuberculosis
accgccaucgcggcguuguggc

SEQ ID NO: 2868529 - RNA, 22 nt, Mycobacterium avium subsp. paratuberculosis
accgccaucggcaucgcgcgcg

SEQ ID NO: 2868530 - RNA, 18 nt, Mycobacterium avium subsp. paratuberculosis
accgccaucucgggagug

SEQ ID NO: 2868531 - RNA, 14 nt, Mycobacterium avium subsp. paratuberculosis
accgcccacagcaa

SEQ ID NO: 2868532 - RNA, 13 nt, Mycobacterium avium subsp. paratuberculosis
accgcccagcggc

SEQ ID NO: 2868533 - RNA, 19 nt, Mycobacterium avium subsp. paratuberculosis
accgcccaguugcacggug

SEQ ID NO: 2868534 - RNA, 17 nt, Mycobacterium avium subsp. paratuberculosis
accgccccagccgacca

SEQ ID NO: 2868535 - RNA, 19 nt, Mycobacterium avium subsp. paratuberculosis
accgccccagccgaccagu

SEQ ID NO: 2868536 - RNA, 18 nt, Mycobacterium avium subsp. paratuberculosis
accgccccgccgcgccgg

SEQ ID NO: 2868537 - RNA, 22 nt, Mycobacterium avium subsp. paratuberculosis
accgccccgccggugucggcga

SEQ ID NO: 2868538 - RNA, 14 nt, Mycobacterium avium subsp. paratuberculosis
accgccccgcgcga

SEQ ID NO: 2868539 - RNA, 20 nt, Mycobacterium avium subsp. paratuberculosis
accgccccgcuaaagccgac

SEQ ID NO: 2868540 - RNA, 16 nt, Mycobacterium avium subsp. paratuberculosis
accgccccggucaccc

SEQ ID NO: 2868541 - RNA, 20 nt, Mycobacterium avium subsp. paratuberculosis
accgccccggucaccccggc

SEQ ID NO: 2868542 - RNA, 17 nt, Mycobacterium avium subsp. paratuberculosis
accgcccgaaccgcguc

SEQ ID NO: 2868543 - RNA, 20 nt, Mycobacterium avium subsp. paratuberculosis
accgcccgaaccgcguccac

SEQ ID NO: 2868544 - RNA, 14 nt, Mycobacterium avium subsp. paratuberculosis
accgcccgcccggc

SEQ ID NO: 2868545 - RNA, 15 nt, Mycobacterium avium subsp. paratuberculosis
accgcccgcgcgaug

SEQ ID NO: 2868546 - RNA, 12 nt, Mycobacterium avium subsp. paratuberculosis
accgcccgcgcu

SEQ ID NO: 2868547 - RNA, 12 nt, Mycobacterium avium subsp. paratuberculosis
accgcccgcggu

SEQ ID NO: 2868548 - RNA, 17 nt, Mycobacterium avium subsp. paratuberculosis
accgcccggaugccggc

SEQ ID NO: 2868549 - RNA, 19 nt, Mycobacterium avium subsp. paratuberculosis
accgcccggaugccggcgc

SEQ ID NO: 2868550 - RNA, 23 nt, Mycobacterium avium subsp. paratuberculosis
accgcccggaugccggcgcccag

SEQ ID NO: 2868551 - RNA, 15 nt, Mycobacterium avium subsp. paratuberculosis
accgcccggcgccga

SEQ ID NO: 2868552 - RNA, 19 nt, Mycobacterium avium subsp. paratuberculosis
accgcccggggcgcggacc

SEQ ID NO: 2868553 - RNA, 20 nt, Mycobacterium avium subsp. paratuberculosis
accgcccggggcgcggaccg

SEQ ID NO: 2868554 - RNA, 21 nt, Mycobacterium avium subsp. paratuberculosis
accgcccggggcgcggaccgc

SEQ ID NO: 2868555 - RNA, 22 nt, Mycobacterium avium subsp. paratuberculosis
accgcccggggcgcggaccgca

SEQ ID NO: 2868556 - RNA, 14 nt, Mycobacterium avium subsp. paratuberculosis
accgcccgggugau

SEQ ID NO: 2868557 - RNA, 15 nt, Mycobacterium avium subsp. paratuberculosis
accgcccgggugaug

SEQ ID NO: 2868558 - RNA, 21 nt, Mycobacterium avium subsp. paratuberculosis
accgcccggguugucgacgug

SEQ ID NO: 2868559 - RNA, 17 nt, Mycobacterium avium subsp. paratuberculosis
accgccgaaacaccggc

SEQ ID NO: 2868560 - RNA, 18 nt, Mycobacterium avium subsp. paratuberculosis
accgccgaaacaccggcu

SEQ ID NO: 2868561 - RNA, 20 nt, Mycobacterium avium subsp. paratuberculosis
accgccgaaacaccggcuuc

SEQ ID NO: 2868562 - RNA, 14 nt, Mycobacterium avium subsp. paratuberculosis
accgccgacaccac

SEQ ID NO: 2868563 - RNA, 15 nt, Mycobacterium avium subsp. paratuberculosis
accgccgacaccacc

SEQ ID NO: 2868564 - RNA, 16 nt, Mycobacterium avium subsp. paratuberculosis
accgccgacaccaccg

SEQ ID NO: 2868565 - RNA, 21 nt, Mycobacterium avium subsp. paratuberculosis
accgccgacaccaccgcgcgc

SEQ ID NO: 2868566 - RNA, 20 nt, Mycobacterium avium subsp. paratuberculosis
accgccgacaucgcccgguc

SEQ ID NO: 2868567 - RNA, 22 nt, Mycobacterium avium subsp. paratuberculosis
accgccgagagcucuugcgccc

SEQ ID NO: 2868568 - RNA, 20 nt, Mycobacterium avium subsp. paratuberculosis
accgccgagccgcuccaccg

SEQ ID NO: 2868569 - RNA, 15 nt, Mycobacterium avium subsp. paratuberculosis
accgccgagccgucg

SEQ ID NO: 2868570 - RNA, 16 nt, Mycobacterium avium subsp. paratuberculosis
accgccgagccgucgu

SEQ ID NO: 2868571 - RNA, 20 nt, Mycobacterium avium subsp. paratuberculosis
accgccgagccgucgucgcu

SEQ ID NO: 2868572 - RNA, 15 nt, Mycobacterium avium subsp. paratuberculosis
accgccgagcgugaa

SEQ ID NO: 2868573 - RNA, 20 nt, Mycobacterium avium subsp. paratuberculosis
accgccgagggcccgggcag

SEQ ID NO: 2868574 - RNA, 22 nt, Mycobacterium avium subsp. paratuberculosis
accgccgagggcccgggcaggc

SEQ ID NO: 2868575 - RNA, 23 nt, Mycobacterium avium subsp. paratuberculosis
accgccgagggcccgggcaggca

SEQ ID NO: 2868576 - RNA, 14 nt, Mycobacterium avium subsp. paratuberculosis
accgccgaucguga

SEQ ID NO: 2868577 - RNA, 20 nt, Mycobacterium avium subsp. paratuberculosis
accgccgaucgugacgccgu

SEQ ID NO: 2868578 - RNA, 22 nt, Mycobacterium avium subsp. paratuberculosis
accgccgaugaugguggcggcc

SEQ ID NO: 2868579 - RNA, 22 nt, Mycobacterium avium subsp. paratuberculosis
accgccgauggcgacggucugc

SEQ ID NO: 2868580 - RNA, 16 nt, Mycobacterium avium subsp. paratuberculosis
accgccgcacccagcg

SEQ ID NO: 2868581 - RNA, 20 nt, Mycobacterium avium subsp. paratuberculosis
accgccgcacccagcgggcg

SEQ ID NO: 2868582 - RNA, 18 nt, Mycobacterium avium subsp. paratuberculosis
accgccgcaccgucgugc

SEQ ID NO: 2868583 - RNA, 12 nt, Mycobacterium avium subsp. paratuberculosis
accgccgccagc

SEQ ID NO: 2868584 - RNA, 13 nt, Mycobacterium avium subsp. paratuberculosis
accgccgccagca

SEQ ID NO: 2868585 - RNA, 15 nt, Mycobacterium avium subsp. paratuberculosis
accgccgccagcagc

SEQ ID NO: 2868586 - RNA, 16 nt, Mycobacterium avium subsp. paratuberculosis
accgccgccagcagca

SEQ ID NO: 2868587 - RNA, 22 nt, Mycobacterium avium subsp. paratuberculosis
accgccgccagcagcagcgccg

SEQ ID NO: 2868588 - RNA, 23 nt, Mycobacterium avium subsp. paratuberculosis
accgccgccagcagcagcgccgc

SEQ ID NO: 2868589 - RNA, 18 nt, Mycobacterium avium subsp. paratuberculosis
accgccgccauccgcgcc

SEQ ID NO: 2868590 - RNA, 20 nt, Mycobacterium avium subsp. paratuberculosis
accgccgccauccgcgccga

SEQ ID NO: 2868591 - RNA, 22 nt, Mycobacterium avium subsp. paratuberculosis
accgccgcgaacgggucggggg

SEQ ID NO: 2868592 - RNA, 12 nt, Mycobacterium avium subsp. paratuberculosis
accgccgcgccg

SEQ ID NO: 2868593 - RNA, 14 nt, Mycobacterium avium subsp. paratuberculosis
accgccgcgccgag

SEQ ID NO: 2868594 - RNA, 13 nt, Mycobacterium avium subsp. paratuberculosis
accgccgcgcggc

SEQ ID NO: 2868595 - RNA, 18 nt, Mycobacterium avium subsp. paratuberculosis
accgccgcgcggccgggc

SEQ ID NO: 2868596 - RNA, 19 nt, Mycobacterium avium subsp. paratuberculosis
accgccgcgcggccgggcu

SEQ ID NO: 2868597 - RNA, 14 nt, Mycobacterium avium subsp. paratuberculosis
accgccgcgcucgc

SEQ ID NO: 2868598 - RNA, 22 nt, Mycobacterium avium subsp. paratuberculosis
accgccgcgcucgcaccagcgc

SEQ ID NO: 2868599 - RNA, 15 nt, Mycobacterium avium subsp. paratuberculosis
accgccgcgcucggc

SEQ ID NO: 2868600 - RNA, 16 nt, Mycobacterium avium subsp. paratuberculosis
accgccgcgcucggcc

SEQ ID NO: 2868601 - RNA, 21 nt, Mycobacterium avium subsp. paratuberculosis
accgccgcgcucggccauccg

SEQ ID NO: 2868602 - RNA, 16 nt, Mycobacterium avium subsp. paratuberculosis
accgccgcggccgcga

SEQ ID NO: 2868603 - RNA, 17 nt, Mycobacterium avium subsp. paratuberculosis
accgccgcggccgcgau

SEQ ID NO: 2868604 - RNA, 23 nt, Mycobacterium avium subsp. paratuberculosis
accgccgcggcgaccacgaacac

SEQ ID NO: 2868605 - RNA, 18 nt, Mycobacterium avium subsp. paratuberculosis
accgccgcggcgcccggc

SEQ ID NO: 2868606 - RNA, 20 nt, Mycobacterium avium subsp. paratuberculosis
accgccgcggcgcccggcgc

SEQ ID NO: 2868607 - RNA, 13 nt, Mycobacterium avium subsp. paratuberculosis
accgccgcggcgg

SEQ ID NO: 2868608 - RNA, 14 nt, Mycobacterium avium subsp. paratuberculosis
accgccgcggcggc

SEQ ID NO: 2868609 - RNA, 16 nt, Mycobacterium avium subsp. paratuberculosis
accgccgcggcggccu

SEQ ID NO: 2868610 - RNA, 18 nt, Mycobacterium avium subsp. paratuberculosis
accgccgcggcgguggcc

SEQ ID NO: 2868611 - RNA, 20 nt, Mycobacterium avium subsp. paratuberculosis
accgccgcgggcucccgcuc

SEQ ID NO: 2868612 - RNA, 14 nt, Mycobacterium avium subsp. paratuberculosis
accgccgcgguggg

SEQ ID NO: 2868613 - RNA, 21 nt, Mycobacterium avium subsp. paratuberculosis
accgccgcguacagccagccc

SEQ ID NO: 2868614 - RNA, 23 nt, Mycobacterium avium subsp. paratuberculosis
accgccgcguacagccagcccgu

SEQ ID NO: 2868615 - RNA, 21 nt, Mycobacterium avium subsp. paratuberculosis
accgccgcuagaccgauggcg

SEQ ID NO: 2868616 - RNA, 22 nt, Mycobacterium avium subsp. paratuberculosis
accgccgcuagguuuggccagc

SEQ ID NO: 2868617 - RNA, 23 nt, Mycobacterium avium subsp. paratuberculosis
accgccgcucagcgauugcggcc

SEQ ID NO: 2868618 - RNA, 15 nt, Mycobacterium avium subsp. paratuberculosis
accgccgcugcgcgc

SEQ ID NO: 2868619 - RNA, 16 nt, Mycobacterium avium subsp. paratuberculosis
accgccgcugcgcgcg

SEQ ID NO: 2868620 - RNA, 17 nt, Mycobacterium avium subsp. paratuberculosis
accgccgcugcgcgcgc

SEQ ID NO: 2868621 - RNA, 20 nt, Mycobacterium avium subsp. paratuberculosis
accgccgcugcgcgcgcgau

SEQ ID NO: 2868622 - RNA, 23 nt, Mycobacterium avium subsp. paratuberculosis
accgccgcugcgcgcgcgaucgg

SEQ ID NO: 2868623 - RNA, 22 nt, Mycobacterium avium subsp. paratuberculosis
accgccggacaccaccgcggug

SEQ ID NO: 2868624 - RNA, 12 nt, Mycobacterium avium subsp. paratuberculosis
accgccggcagc

SEQ ID NO: 2868625 - RNA, 16 nt, Mycobacterium avium subsp. paratuberculosis
accgccggcagcggcu

SEQ ID NO: 2868626 - RNA, 19 nt, Mycobacterium avium subsp. paratuberculosis
accgccggcagcggcugcu

SEQ ID NO: 2868627 - RNA, 15 nt, Mycobacterium avium subsp. paratuberculosis
accgccggccaggcg

SEQ ID NO: 2868628 - RNA, 16 nt, Mycobacterium avium subsp. paratuberculosis
accgccggccaggcga

SEQ ID NO: 2868629 - RNA, 12 nt, Mycobacterium avium subsp. paratuberculosis
accgccggccca

SEQ ID NO: 2868630 - RNA, 13 nt, Mycobacterium avium subsp. paratuberculosis
accgccggcccgg

SEQ ID NO: 2868631 - RNA, 14 nt, Mycobacterium avium subsp. paratuberculosis
accgccggcgccgu

SEQ ID NO: 2868632 - RNA, 15 nt, Mycobacterium avium subsp. paratuberculosis
accgccggcgccguc

SEQ ID NO: 2868633 - RNA, 17 nt, Mycobacterium avium subsp. paratuberculosis
accgccggcgccgucga

SEQ ID NO: 2868634 - RNA, 15 nt, Mycobacterium avium subsp. paratuberculosis
accgccggcgcggac

SEQ ID NO: 2868635 - RNA, 16 nt, Mycobacterium avium subsp. paratuberculosis
accgccggcgcggacg

SEQ ID NO: 2868636 - RNA, 17 nt, Mycobacterium avium subsp. paratuberculosis
accgccggcgcggacgg

SEQ ID NO: 2868637 - RNA, 14 nt, Mycobacterium avium subsp. paratuberculosis
accgccgggcaucc

SEQ ID NO: 2868638 - RNA, 19 nt, Mycobacterium avium subsp. paratuberculosis
accgccgggcauccgggcc

SEQ ID NO: 2868639 - RNA, 16 nt, Mycobacterium avium subsp. paratuberculosis
accgccgggcgggccg

SEQ ID NO: 2868640 - RNA, 17 nt, Mycobacterium avium subsp. paratuberculosis
accgccgggcgggccgc

SEQ ID NO: 2868641 - RNA, 18 nt, Mycobacterium avium subsp. paratuberculosis
accgccgggcgggccgca

SEQ ID NO: 2868642 - RNA, 20 nt, Mycobacterium avium subsp. paratuberculosis
accgccgggcgggccgcagc

SEQ ID NO: 2868643 - RNA, 22 nt, Mycobacterium avium subsp. paratuberculosis
accgccgggcgggccgcagcac

SEQ ID NO: 2868644 - RNA, 16 nt, Mycobacterium avium subsp. paratuberculosis
accgccggugcgcagc

SEQ ID NO: 2868645 - RNA, 17 nt, Mycobacterium avium subsp. paratuberculosis
accgccggugcgcagcu

SEQ ID NO: 2868646 - RNA, 17 nt, Mycobacterium avium subsp. paratuberculosis
accgccgucaccgccag

SEQ ID NO: 2868647 - RNA, 23 nt, Mycobacterium avium subsp. paratuberculosis
accgccgucccguccgacggcua

SEQ ID NO: 2868648 - RNA, 21 nt, Mycobacterium avium subsp. paratuberculosis
accgccguccgggcacccgac

SEQ ID NO: 2868649 - RNA, 15 nt, Mycobacterium avium subsp. paratuberculosis
accgccgucggggcg

SEQ ID NO: 2868650 - RNA, 22 nt, Mycobacterium avium subsp. paratuberculosis
accgccgucggggcgucggcgg

SEQ ID NO: 2868651 - RNA, 23 nt, Mycobacterium avium subsp. paratuberculosis
accgccguggcagggccagcagc

SEQ ID NO: 2868652 - RNA, 17 nt, Mycobacterium avium subsp. paratuberculosis
accgccguuccgaugaa

SEQ ID NO: 2868653 - RNA, 23 nt, Mycobacterium avium subsp. paratuberculosis
accgccguuccgaugaagaacac

SEQ ID NO: 2868654 - RNA, 13 nt, Mycobacterium avium subsp. paratuberculosis
accgccucaugcc

SEQ ID NO: 2868655 - RNA, 20 nt, Mycobacterium avium subsp. paratuberculosis
accgccuccucgaugucggu

SEQ ID NO: 2868656 - RNA, 23 nt, Mycobacterium avium subsp. paratuberculosis
accgccuccucgaugucgguggu

SEQ ID NO: 2868657 - RNA, 16 nt, Mycobacterium avium subsp. paratuberculosis
accgccucgacgguga

SEQ ID NO: 2868658 - RNA, 16 nt, Mycobacterium avium subsp. paratuberculosis
accgccucgauggccc

SEQ ID NO: 2868659 - RNA, 22 nt, Mycobacterium avium subsp. paratuberculosis
accgccucgauggcccgcucgg

SEQ ID NO: 2868660 - RNA, 14 nt, Mycobacterium avium subsp. paratuberculosis
accgccucgccagc

SEQ ID NO: 2868661 - RNA, 13 nt, Mycobacterium avium subsp. paratuberculosis
accgccugcgcga

SEQ ID NO: 2868662 - RNA, 16 nt, Mycobacterium avium subsp. paratuberculosis
accgccugcgcgaucg

SEQ ID NO: 2868663 - RNA, 17 nt, Mycobacterium avium subsp. paratuberculosis
accgccugcgcgaucgc

SEQ ID NO: 2868664 - RNA, 13 nt, Mycobacterium avium subsp. paratuberculosis
accgccugcggca

SEQ ID NO: 2868665 - RNA, 19 nt, Mycobacterium avium subsp. paratuberculosis
accgccugcuugagguuga

SEQ ID NO: 2868666 - RNA, 23 nt, Mycobacterium avium subsp. paratuberculosis
accgccugcuugaugaugccggc

SEQ ID NO: 2868667 - RNA, 23 nt, Mycobacterium avium subsp. paratuberculosis
accgccugggucucgggaucgcc

SEQ ID NO: 2868668 - RNA, 14 nt, Mycobacterium avium subsp. paratuberculosis
accgccugugcgac

SEQ ID NO: 2868669 - RNA, 15 nt, Mycobacterium avium subsp. paratuberculosis
accgccugugcgacg

SEQ ID NO: 2868670 - RNA, 16 nt, Mycobacterium avium subsp. paratuberculosis
accgccugugcgacgg

SEQ ID NO: 2868671 - RNA, 17 nt, Mycobacterium avium subsp. paratuberculosis
accgccugugcgacggc

SEQ ID NO: 2868672 - RNA, 19 nt, Mycobacterium avium subsp. paratuberculosis
accgccugugcgacggcgu

SEQ ID NO: 2868673 - RNA, 23 nt, Mycobacterium avium subsp. paratuberculosis
accgccugugcgacggcgucggc

SEQ ID NO: 2868674 - RNA, 18 nt, Mycobacterium avium subsp. paratuberculosis
accgccuuccgccacgcc

SEQ ID NO: 2868675 - RNA, 19 nt, Mycobacterium avium subsp. paratuberculosis
accgccuucgacggccggc

SEQ ID NO: 2868676 - RNA, 15 nt, Mycobacterium avium subsp. paratuberculosis
accgccuugcccggc

SEQ ID NO: 2868677 - RNA, 16 nt, Mycobacterium avium subsp. paratuberculosis
accgccuugcccggcu

SEQ ID NO: 2868678 - RNA, 13 nt, Mycobacterium avium subsp. paratuberculosis
accgccuuggcgc

SEQ ID NO: 2868679 - RNA, 16 nt, Mycobacterium avium subsp. paratuberculosis
accgccuuggcgcgcu

SEQ ID NO: 2868680 - RNA, 19 nt, Mycobacterium avium subsp. paratuberculosis
accgccuuggcgcgcucgg

SEQ ID NO: 2868681 - RNA, 20 nt, Mycobacterium avium subsp. paratuberculosis
accgcgaaacgcaacagcga

SEQ ID NO: 2868682 - RNA, 17 nt, Mycobacterium avium subsp. paratuberculosis
accgcgaaagcgucggc

SEQ ID NO: 2868683 - RNA, 18 nt, Mycobacterium avium subsp. paratuberculosis
accgcgaaagcgucggcu

SEQ ID NO: 2868684 - RNA, 22 nt, Mycobacterium avium subsp. paratuberculosis
accgcgaaagugcaacuggcaa

SEQ ID NO: 2868685 - RNA, 16 nt, Mycobacterium avium subsp. paratuberculosis
accgcgaacagcacgu

SEQ ID NO: 2868686 - RNA, 14 nt, Mycobacterium avium subsp. paratuberculosis
accgcgaacaucgc

SEQ ID NO: 2868687 - RNA, 18 nt, Mycobacterium avium subsp. paratuberculosis
accgcgaacaucgccagc

SEQ ID NO: 2868688 - RNA, 22 nt, Mycobacterium avium subsp. paratuberculosis
accgcgaacgucucgcgggagu

SEQ ID NO: 2868689 - RNA, 16 nt, Mycobacterium avium subsp. paratuberculosis
accgcgaagguggcac

SEQ ID NO: 2868690 - RNA, 18 nt, Mycobacterium avium subsp. paratuberculosis
accgcgacacgucgacac

SEQ ID NO: 2868691 - RNA, 20 nt, Mycobacterium avium subsp. paratuberculosis
accgcgacacgucgacacgc

SEQ ID NO: 2868692 - RNA, 20 nt, Mycobacterium avium subsp. paratuberculosis
accgcgaccacgccgcgguc

SEQ ID NO: 2868693 - RNA, 18 nt, Mycobacterium avium subsp. paratuberculosis
accgcgaccaugcccggc

SEQ ID NO: 2868694 - RNA, 20 nt, Mycobacterium avium subsp. paratuberculosis
accgcgaccaugcccggcgc

SEQ ID NO: 2868695 - RNA, 16 nt, Mycobacterium avium subsp. paratuberculosis
accgcgacccaggccg

SEQ ID NO: 2868696 - RNA, 19 nt, Mycobacterium avium subsp. paratuberculosis
accgcgacccaggccgccg

SEQ ID NO: 2868697 - RNA, 20 nt, Mycobacterium avium subsp. paratuberculosis
accgcgacccaggccgccgc

SEQ ID NO: 2868698 - RNA, 22 nt, Mycobacterium avium subsp. paratuberculosis
accgcgacccaggccgccgcca

SEQ ID NO: 2868699 - RNA, 13 nt, Mycobacterium avium subsp. paratuberculosis
accgcgacccggc

SEQ ID NO: 2868700 - RNA, 15 nt, Mycobacterium avium subsp. paratuberculosis
accgcgacccggccg

SEQ ID NO: 2868701 - RNA, 14 nt, Mycobacterium avium subsp. paratuberculosis
accgcgaccgccuc

SEQ ID NO: 2868702 - RNA, 17 nt, Mycobacterium avium subsp. paratuberculosis
accgcgaccgccucguc

SEQ ID NO: 2868703 - RNA, 15 nt, Mycobacterium avium subsp. paratuberculosis
accgcgaccgguccg

SEQ ID NO: 2868704 - RNA, 22 nt, Mycobacterium avium subsp. paratuberculosis
accgcgacgaccucgcccgccg

SEQ ID NO: 2868705 - RNA, 16 nt, Mycobacterium avium subsp. paratuberculosis
accgcgacgaucgcga

SEQ ID NO: 2868706 - RNA, 13 nt, Mycobacterium avium subsp. paratuberculosis
accgcgacgccca

SEQ ID NO: 2868707 - RNA, 13 nt, Mycobacterium avium subsp. paratuberculosis
accgcgacgcugc

SEQ ID NO: 2868708 - RNA, 14 nt, Mycobacterium avium subsp. paratuberculosis
accgcgacgcugcc

SEQ ID NO: 2868709 - RNA, 14 nt, Mycobacterium avium subsp. paratuberculosis
accgcgacggcgcc

SEQ ID NO: 2868710 - RNA, 18 nt, Mycobacterium avium subsp. paratuberculosis
accgcgacggcgcccgcc

SEQ ID NO: 2868711 - RNA, 21 nt, Mycobacterium avium subsp. paratuberculosis
accgcgacggcgcccgccccg

SEQ ID NO: 2868712 - RNA, 19 nt, Mycobacterium avium subsp. paratuberculosis
accgcgacgggcucggcgu

SEQ ID NO: 2868713 - RNA, 23 nt, Mycobacterium avium subsp. paratuberculosis
accgcgacggugagcaacaccgg

SEQ ID NO: 2868714 - RNA, 20 nt, Mycobacterium avium subsp. paratuberculosis
accgcgacguggcgcaguua

SEQ ID NO: 2868715 - RNA, 17 nt, Mycobacterium avium subsp. paratuberculosis
accgcgagaucagcgcc

SEQ ID NO: 2868716 - RNA, 19 nt, Mycobacterium avium subsp. paratuberculosis
accgcgagaucagcgccau

SEQ ID NO: 2868717 - RNA, 20 nt, Mycobacterium avium subsp. paratuberculosis
accgcgagaucagcgccaug

SEQ ID NO: 2868718 - RNA, 16 nt, Mycobacterium avium subsp. paratuberculosis
accgcgagcaccgcga

SEQ ID NO: 2868719 - RNA, 20 nt, Mycobacterium avium subsp. paratuberculosis
accgcgagcaccgcgaucgc

SEQ ID NO: 2868720 - RNA, 23 nt, Mycobacterium avium subsp. paratuberculosis
accgcgagcaccgcgaucgccga

SEQ ID NO: 2868721 - RNA, 17 nt, Mycobacterium avium subsp. paratuberculosis
accgcgagcgcgcggug

SEQ ID NO: 2868722 - RNA, 18 nt, Mycobacterium avium subsp. paratuberculosis
accgcgagcgcgcgguga

SEQ ID NO: 2868723 - RNA, 17 nt, Mycobacterium avium subsp. paratuberculosis
accgcgaguucgcgcac

SEQ ID NO: 2868724 - RNA, 21 nt, Mycobacterium avium subsp. paratuberculosis
accgcgaguucgcgcacgcug

SEQ ID NO: 2868725 - RNA, 23 nt, Mycobacterium avium subsp. paratuberculosis
accgcgaguucgcgcacgcuggc

SEQ ID NO: 2868726 - RNA, 23 nt, Mycobacterium avium subsp. paratuberculosis
accgcgaucaccgagauggccac

SEQ ID NO: 2868727 - RNA, 17 nt, Mycobacterium avium subsp. paratuberculosis
accgcgaucagccccag

SEQ ID NO: 2868728 - RNA, 17 nt, Mycobacterium avium subsp. paratuberculosis
accgcgaucagggccgc

SEQ ID NO: 2868729 - RNA, 20 nt, Mycobacterium avium subsp. paratuberculosis
accgcgaucagggccgcggc

SEQ ID NO: 2868730 - RNA, 13 nt, Mycobacterium avium subsp. paratuberculosis
accgcgaucgagu

SEQ ID NO: 2868731 - RNA, 22 nt, Mycobacterium avium subsp. paratuberculosis
accgcgaucgccgacgucggaa

SEQ ID NO: 2868732 - RNA, 15 nt, Mycobacterium avium subsp. paratuberculosis
accgcgaucugcucg

SEQ ID NO: 2868733 - RNA, 19 nt, Mycobacterium avium subsp. paratuberculosis
accgcgaugauggcgucga

SEQ ID NO: 2868734 - RNA, 22 nt, Mycobacterium avium subsp. paratuberculosis
accgcgaugauggcgucgacgu

SEQ ID NO: 2868735 - RNA, 23 nt, Mycobacterium avium subsp. paratuberculosis
accgcgaugauggcgucgacgug

SEQ ID NO: 2868736 - RNA, 23 nt, Mycobacterium avium subsp. paratuberculosis
accgcgaugcagaacagccgguc

SEQ ID NO: 2868737 - RNA, 22 nt, Mycobacterium avium subsp. paratuberculosis
accgcgaugcgacaccgcgucc

SEQ ID NO: 2868738 - RNA, 16 nt, Mycobacterium avium subsp. paratuberculosis
accgcgauggcccgcg

SEQ ID NO: 2868739 - RNA, 14 nt, Mycobacterium avium subsp. paratuberculosis
accgcgaugguggc

SEQ ID NO: 2868740 - RNA, 17 nt, Mycobacterium avium subsp. paratuberculosis
accgcgaugguggcguc

SEQ ID NO: 2868741 - RNA, 18 nt, Mycobacterium avium subsp. paratuberculosis
accgcgcaaccgggccgc

SEQ ID NO: 2868742 - RNA, 13 nt, Mycobacterium avium subsp. paratuberculosis
accgcgcaccggc

SEQ ID NO: 2868743 - RNA, 17 nt, Mycobacterium avium subsp. paratuberculosis
accgcgcaccggcgcug

SEQ ID NO: 2868744 - RNA, 22 nt, Mycobacterium avium subsp. paratuberculosis
accgcgcacucgaacggcccgg

SEQ ID NO: 2868745 - RNA, 16 nt, Mycobacterium avium subsp. paratuberculosis
accgcgcaggcggcga

SEQ ID NO: 2868746 - RNA, 18 nt, Mycobacterium avium subsp. paratuberculosis
accgcgcaggcggcgacg

SEQ ID NO: 2868747 - RNA, 20 nt, Mycobacterium avium subsp. paratuberculosis
accgcgcaggcggcgacggc

SEQ ID NO: 2868748 - RNA, 16 nt, Mycobacterium avium subsp. paratuberculosis
accgcgcagucggcgu

SEQ ID NO: 2868749 - RNA, 18 nt, Mycobacterium avium subsp. paratuberculosis
accgcgcagucggcgucg

SEQ ID NO: 2868750 - RNA, 19 nt, Mycobacterium avium subsp. paratuberculosis
accgcgcagucggcgucgc

SEQ ID NO: 2868751 - RNA, 23 nt, Mycobacterium avium subsp. paratuberculosis
accgcgcagucggcgucgcggcg

SEQ ID NO: 2868752 - RNA, 12 nt, Mycobacterium avium subsp. paratuberculosis
accgcgcccagg

SEQ ID NO: 2868753 - RNA, 13 nt, Mycobacterium avium subsp. paratuberculosis
accgcgccccggc

SEQ ID NO: 2868754 - RNA, 15 nt, Mycobacterium avium subsp. paratuberculosis
accgcgccccggcgc

SEQ ID NO: 2868755 - RNA, 16 nt, Mycobacterium avium subsp. paratuberculosis
accgcgccccggcgca

SEQ ID NO: 2868756 - RNA, 18 nt, Mycobacterium avium subsp. paratuberculosis
accgcgccccggcgcagc

SEQ ID NO: 2868757 - RNA, 20 nt, Mycobacterium avium subsp. paratuberculosis
accgcgccccggcgcagcgc

SEQ ID NO: 2868758 - RNA, 13 nt, Mycobacterium avium subsp. paratuberculosis
accgcgcccgccc

SEQ ID NO: 2868759 - RNA, 14 nt, Mycobacterium avium subsp. paratuberculosis
accgcgccgcgggu

SEQ ID NO: 2868760 - RNA, 15 nt, Mycobacterium avium subsp. paratuberculosis
accgcgccgcgggug

SEQ ID NO: 2868761 - RNA, 13 nt, Mycobacterium avium subsp. paratuberculosis
accgcgccgggca

SEQ ID NO: 2868762 - RNA, 22 nt, Mycobacterium avium subsp. paratuberculosis
accgcgccgggcaccaccaccg

SEQ ID NO: 2868763 - RNA, 18 nt, Mycobacterium avium subsp. paratuberculosis
accgcgccggggugggcc

SEQ ID NO: 2868764 - RNA, 11 nt, Mycobacterium avium subsp. paratuberculosis
accgcgccggu

SEQ ID NO: 2868765 - RNA, 15 nt, Mycobacterium avium subsp. paratuberculosis
accgcgccgguccgg

SEQ ID NO: 2868766 - RNA, 13 nt, Mycobacterium avium subsp. paratuberculosis
accgcgccgucgu

SEQ ID NO: 2868767 - RNA, 18 nt, Mycobacterium avium subsp. paratuberculosis
accgcgccgucgucgagc

SEQ ID NO: 2868768 - RNA, 19 nt, Mycobacterium avium subsp. paratuberculosis
accgcgccgucgucgagca

SEQ ID NO: 2868769 - RNA, 16 nt, Mycobacterium avium subsp. paratuberculosis
accgcgccgucgucgu

SEQ ID NO: 2868770 - RNA, 12 nt, Mycobacterium avium subsp. paratuberculosis
accgcgccgucu

SEQ ID NO: 2868771 - RNA, 21 nt, Mycobacterium avium subsp. paratuberculosis
accgcgccgugggcgucacgc

SEQ ID NO: 2868772 - RNA, 13 nt, Mycobacterium avium subsp. paratuberculosis
accgcgccuucga

SEQ ID NO: 2868773 - RNA, 21 nt, Mycobacterium avium subsp. paratuberculosis
accgcgcgcaacgaggcggug

SEQ ID NO: 2868774 - RNA, 12 nt, Mycobacterium avium subsp. paratuberculosis
accgcgcgcacc

SEQ ID NO: 2868775 - RNA, 16 nt, Mycobacterium avium subsp. paratuberculosis
accgcgcgcaccacgu

SEQ ID NO: 2868776 - RNA, 18 nt, Mycobacterium avium subsp. paratuberculosis
accgcgcgcaccacgugc

SEQ ID NO: 2868777 - RNA, 13 nt, Mycobacterium avium subsp. paratuberculosis
accgcgcgcaggc

SEQ ID NO: 2868778 - RNA, 14 nt, Mycobacterium avium subsp. paratuberculosis
accgcgcgcaggcc

SEQ ID NO: 2868779 - RNA, 23 nt, Mycobacterium avium subsp. paratuberculosis
accgcgcgcaggccccggcgcgc

SEQ ID NO: 2868780 - RNA, 13 nt, Mycobacterium avium subsp. paratuberculosis
accgcgcgccggc

SEQ ID NO: 2868781 - RNA, 17 nt, Mycobacterium avium subsp. paratuberculosis
accgcgcgccggccagc

SEQ ID NO: 2868782 - RNA, 14 nt, Mycobacterium avium subsp. paratuberculosis
accgcgcgcggcgc

SEQ ID NO: 2868783 - RNA, 15 nt, Mycobacterium avium subsp. paratuberculosis
accgcgcgcggcgcc

SEQ ID NO: 2868784 - RNA, 16 nt, Mycobacterium avium subsp. paratuberculosis
accgcgcgcggcgccg

SEQ ID NO: 2868785 - RNA, 17 nt, Mycobacterium avium subsp. paratuberculosis
accgcgcgcggcgccgc

SEQ ID NO: 2868786 - RNA, 18 nt, Mycobacterium avium subsp. paratuberculosis
accgcgcgcggcgccgcg

SEQ ID NO: 2868787 - RNA, 12 nt, Mycobacterium avium subsp. paratuberculosis
accgcgcgcugc

SEQ ID NO: 2868788 - RNA, 13 nt, Mycobacterium avium subsp. paratuberculosis
accgcgcgcugcc

SEQ ID NO: 2868789 - RNA, 18 nt, Mycobacterium avium subsp. paratuberculosis
accgcgcgcugccgcgcc

SEQ ID NO: 2868790 - RNA, 21 nt, Mycobacterium avium subsp. paratuberculosis
accgcgcgcugccgcgccccg

SEQ ID NO: 2868791 - RNA, 12 nt, Mycobacterium avium subsp. paratuberculosis
accgcgcggaga

SEQ ID NO: 2868792 - RNA, 20 nt, Mycobacterium avium subsp. paratuberculosis
accgcgcggccagcggcgcc

SEQ ID NO: 2868793 - RNA, 12 nt, Mycobacterium avium subsp. paratuberculosis
accgcgcggcga

SEQ ID NO: 2868794 - RNA, 13 nt, Mycobacterium avium subsp. paratuberculosis
accgcgcggcgag

SEQ ID NO: 2868795 - RNA, 12 nt, Mycobacterium avium subsp. paratuberculosis
accgcgcggcgc

SEQ ID NO: 2868796 - RNA, 14 nt, Mycobacterium avium subsp. paratuberculosis
accgcgcggcgcag

SEQ ID NO: 2868797 - RNA, 20 nt, Mycobacterium avium subsp. paratuberculosis
accgcgcggcgcccccgcga

SEQ ID NO: 2868798 - RNA, 21 nt, Mycobacterium avium subsp. paratuberculosis
accgcgcggcgcccccgcgac

SEQ ID NO: 2868799 - RNA, 22 nt, Mycobacterium avium subsp. paratuberculosis
accgcgcggcgcccccgcgacg

SEQ ID NO: 2868800 - RNA, 14 nt, Mycobacterium avium subsp. paratuberculosis
accgcgcggcgguc

SEQ ID NO: 2868801 - RNA, 22 nt, Mycobacterium avium subsp. paratuberculosis
accgcgcggcggugcucgcgcc

SEQ ID NO: 2868802 - RNA, 19 nt, Mycobacterium avium subsp. paratuberculosis
accgcgcgggccagcgccu

SEQ ID NO: 2868803 - RNA, 20 nt, Mycobacterium avium subsp. paratuberculosis
accgcgcggugcaccaggac

SEQ ID NO: 2868804 - RNA, 21 nt, Mycobacterium avium subsp. paratuberculosis
accgcgcuccugccagcggcg

SEQ ID NO: 2868805 - RNA, 22 nt, Mycobacterium avium subsp. paratuberculosis
accgcgcuccugccagcggcgc

SEQ ID NO: 2868806 - RNA, 15 nt, Mycobacterium avium subsp. paratuberculosis
accgcgcucggcgac

SEQ ID NO: 2868807 - RNA, 15 nt, Mycobacterium avium subsp. paratuberculosis
accgcgcuugccgcg

SEQ ID NO: 2868808 - RNA, 23 nt, Mycobacterium avium subsp. paratuberculosis
accgcgcuugccgcgacccgggc

SEQ ID NO: 2868809 - RNA, 14 nt, Mycobacterium avium subsp. paratuberculosis
accgcggaccaccg

SEQ ID NO: 2868810 - RNA, 15 nt, Mycobacterium avium subsp. paratuberculosis
accgcggaccaccgc

SEQ ID NO: 2868811 - RNA, 23 nt, Mycobacterium avium subsp. paratuberculosis
accgcggaggaauucgccgacgc

SEQ ID NO: 2868812 - RNA, 13 nt, Mycobacterium avium subsp. paratuberculosis
accgcggaugacg

SEQ ID NO: 2868813 - RNA, 17 nt, Mycobacterium avium subsp. paratuberculosis
accgcggauuccagcgc

SEQ ID NO: 2868814 - RNA, 19 nt, Mycobacterium avium subsp. paratuberculosis
accgcggauuccagcgcgu

SEQ ID NO: 2868815 - RNA, 18 nt, Mycobacterium avium subsp. paratuberculosis
accgcggccaacccgggc

SEQ ID NO: 2868816 - RNA, 19 nt, Mycobacterium avium subsp. paratuberculosis
accgcggccaacccgggcg

SEQ ID NO: 2868817 - RNA, 20 nt, Mycobacterium avium subsp. paratuberculosis
accgcggccaacccgggcgc

SEQ ID NO: 2868818 - RNA, 17 nt, Mycobacterium avium subsp. paratuberculosis
accgcggccaccaccgc

SEQ ID NO: 2868819 - RNA, 20 nt, Mycobacterium avium subsp. paratuberculosis
accgcggccaccaccgccac

SEQ ID NO: 2868820 - RNA, 19 nt, Mycobacterium avium subsp. paratuberculosis
accgcggccaccugggcgg

SEQ ID NO: 2868821 - RNA, 22 nt, Mycobacterium avium subsp. paratuberculosis
accgcggccaccugggcggggc

SEQ ID NO: 2868822 - RNA, 23 nt, Mycobacterium avium subsp. paratuberculosis
accgcggccaccugggcggggcu

SEQ ID NO: 2868823 - RNA, 16 nt, Mycobacterium avium subsp. paratuberculosis
accgcggccagcgcgc

SEQ ID NO: 2868824 - RNA, 20 nt, Mycobacterium avium subsp. paratuberculosis
accgcggccagcgcgcgggc

SEQ ID NO: 2868825 - RNA, 23 nt, Mycobacterium avium subsp. paratuberculosis
accgcggccagcgcgcgggcguc

SEQ ID NO: 2868826 - RNA, 17 nt, Mycobacterium avium subsp. paratuberculosis
accgcggccagcugcga

SEQ ID NO: 2868827 - RNA, 12 nt, Mycobacterium avium subsp. paratuberculosis
accgcggccucg

SEQ ID NO: 2868828 - RNA, 14 nt, Mycobacterium avium subsp. paratuberculosis
accgcggccucggc

SEQ ID NO: 2868829 - RNA, 16 nt, Mycobacterium avium subsp. paratuberculosis
accgcggccucggcgu

SEQ ID NO: 2868830 - RNA, 19 nt, Mycobacterium avium subsp. paratuberculosis
accgcggccucggcgucga

SEQ ID NO: 2868831 - RNA, 15 nt, Mycobacterium avium subsp. paratuberculosis
accgcggccugggug

SEQ ID NO: 2868832 - RNA, 14 nt, Mycobacterium avium subsp. paratuberculosis
accgcggcgacguc

SEQ ID NO: 2868833 - RNA, 20 nt, Mycobacterium avium subsp. paratuberculosis
accgcggcgacgucgugcac

SEQ ID NO: 2868834 - RNA, 24 nt, Mycobacterium avium subsp. paratuberculosis
accgcggcgacgucgugcacgccg

SEQ ID NO: 2868835 - RNA, 12 nt, Mycobacterium avium subsp. paratuberculosis
accgcggcgaug

SEQ ID NO: 2868836 - RNA, 24 nt, Mycobacterium avium subsp. paratuberculosis
accgcggcgaugauccgcggcgcc

SEQ ID NO: 2868837 - RNA, 20 nt, Mycobacterium avium subsp. paratuberculosis
accgcggcgauggcccgcug

SEQ ID NO: 2868838 - RNA, 23 nt, Mycobacterium avium subsp. paratuberculosis
accgcggcgauggcccgcugcgc

SEQ ID NO: 2868839 - RNA, 13 nt, Mycobacterium avium subsp. paratuberculosis
accgcggcgccga

SEQ ID NO: 2868840 - RNA, 14 nt, Mycobacterium avium subsp. paratuberculosis
accgcggcgccgau

SEQ ID NO: 2868841 - RNA, 14 nt, Mycobacterium avium subsp. paratuberculosis
accgcggcgccguc

SEQ ID NO: 2868842 - RNA, 15 nt, Mycobacterium avium subsp. paratuberculosis
accgcggcgccgucg

SEQ ID NO: 2868843 - RNA, 13 nt, Mycobacterium avium subsp. paratuberculosis
accgcggcgcgca

SEQ ID NO: 2868844 - RNA, 19 nt, Mycobacterium avium subsp. paratuberculosis
accgcggcgcgcaucgccg

SEQ ID NO: 2868845 - RNA, 20 nt, Mycobacterium avium subsp. paratuberculosis
accgcggcgcgcaucgccgu

SEQ ID NO: 2868846 - RNA, 21 nt, Mycobacterium avium subsp. paratuberculosis
accgcggcgcgcaucgccguc

SEQ ID NO: 2868847 - RNA, 15 nt, Mycobacterium avium subsp. paratuberculosis
accgcggcgcgcggc

SEQ ID NO: 2868848 - RNA, 18 nt, Mycobacterium avium subsp. paratuberculosis
accgcggcgcgcggccgc

SEQ ID NO: 2868849 - RNA, 23 nt, Mycobacterium avium subsp. paratuberculosis
accgcggcgcgcggccgcgacug

SEQ ID NO: 2868850 - RNA, 14 nt, Mycobacterium avium subsp. paratuberculosis
accgcggcggccag

SEQ ID NO: 2868851 - RNA, 12 nt, Mycobacterium avium subsp. paratuberculosis
accgcggcggcg

SEQ ID NO: 2868852 - RNA, 17 nt, Mycobacterium avium subsp. paratuberculosis
accgcggcggcggcccg

SEQ ID NO: 2868853 - RNA, 19 nt, Mycobacterium avium subsp. paratuberculosis
accgcggcggcggcccguc

SEQ ID NO: 2868854 - RNA, 22 nt, Mycobacterium avium subsp. paratuberculosis
accgcggcggcggcccguccgc

SEQ ID NO: 2868855 - RNA, 13 nt, Mycobacterium avium subsp. paratuberculosis
accgcggcggcgu

SEQ ID NO: 2868856 - RNA, 14 nt, Mycobacterium avium subsp. paratuberculosis
accgcggcggcguc

SEQ ID NO: 2868857 - RNA, 15 nt, Mycobacterium avium subsp. paratuberculosis
accgcggcggcgucg

SEQ ID NO: 2868858 - RNA, 16 nt, Mycobacterium avium subsp. paratuberculosis
accgcggcggcgucga

SEQ ID NO: 2868859 - RNA, 23 nt, Mycobacterium avium subsp. paratuberculosis
accgcggcggcgucgaccgcccc

SEQ ID NO: 2868860 - RNA, 19 nt, Mycobacterium avium subsp. paratuberculosis
accgcggcgggguccacgc

SEQ ID NO: 2868861 - RNA, 15 nt, Mycobacterium avium subsp. paratuberculosis
accgcggcggucgcc

SEQ ID NO: 2868862 - RNA, 19 nt, Mycobacterium avium subsp. paratuberculosis
accgcggcggugucggcgc

SEQ ID NO: 2868863 - RNA, 20 nt, Mycobacterium avium subsp. paratuberculosis
accgcggcguugcccggguc

SEQ ID NO: 2868864 - RNA, 14 nt, Mycobacterium avium subsp. paratuberculosis
accgcggcuccggc

SEQ ID NO: 2868865 - RNA, 16 nt, Mycobacterium avium subsp. paratuberculosis
accgcggcuccggccg

SEQ ID NO: 2868866 - RNA, 17 nt, Mycobacterium avium subsp. paratuberculosis
accgcggcuccggccgc

SEQ ID NO: 2868867 - RNA, 18 nt, Mycobacterium avium subsp. paratuberculosis
accgcggcucggucgcga

SEQ ID NO: 2868868 - RNA, 20 nt, Mycobacterium avium subsp. paratuberculosis
accgcgggaauggccgcgcc

SEQ ID NO: 2868869 - RNA, 16 nt, Mycobacterium avium subsp. paratuberculosis
accgcgggcacggcga

SEQ ID NO: 2868870 - RNA, 16 nt, Mycobacterium avium subsp. paratuberculosis
accgcgggcagcagcu

SEQ ID NO: 2868871 - RNA, 15 nt, Mycobacterium avium subsp. paratuberculosis
accgcgggcaucgcc

SEQ ID NO: 2868872 - RNA, 19 nt, Mycobacterium avium subsp. paratuberculosis
accgcgggcaucgccguca

SEQ ID NO: 2868873 - RNA, 15 nt, Mycobacterium avium subsp. paratuberculosis
accgcgggccaggcc

SEQ ID NO: 2868874 - RNA, 20 nt, Mycobacterium avium subsp. paratuberculosis
accgcgggccaggcccaccg

SEQ ID NO: 2868875 - RNA, 13 nt, Mycobacterium avium subsp. paratuberculosis
accgcgggcccgc

SEQ ID NO: 2868876 - RNA, 15 nt, Mycobacterium avium subsp. paratuberculosis
accgcgggcccgccg

SEQ ID NO: 2868877 - RNA, 22 nt, Mycobacterium avium subsp. paratuberculosis
accgcgggcccgccguagcgcc

SEQ ID NO: 2868878 - RNA, 21 nt, Mycobacterium avium subsp. paratuberculosis
accgcgggcgcauaccagcgc

SEQ ID NO: 2868879 - RNA, 15 nt, Mycobacterium avium subsp. paratuberculosis
accgcgggcgcgccg

SEQ ID NO: 2868880 - RNA, 20 nt, Mycobacterium avium subsp. paratuberculosis
accgcggggcugggcgccau

SEQ ID NO: 2868881 - RNA, 15 nt, Mycobacterium avium subsp. paratuberculosis
accgcgggggcggcc

SEQ ID NO: 2868882 - RNA, 18 nt, Mycobacterium avium subsp. paratuberculosis
accgcgggggcggccggg

SEQ ID NO: 2868883 - RNA, 18 nt, Mycobacterium avium subsp. paratuberculosis
accgcgggugaggggcgc

SEQ ID NO: 2868884 - RNA, 23 nt, Mycobacterium avium subsp. paratuberculosis
accgcgggugaggggcgcgcgcc

SEQ ID NO: 2868885 - RNA, 21 nt, Mycobacterium avium subsp. paratuberculosis
accgcgggugaucugcgccgu

SEQ ID NO: 2868886 - RNA, 22 nt, Mycobacterium avium subsp. paratuberculosis
accgcgggugaucugcgccgug

SEQ ID NO: 2868887 - RNA, 13 nt, Mycobacterium avium subsp. paratuberculosis
accgcggucgacg

SEQ ID NO: 2868888 - RNA, 16 nt, Mycobacterium avium subsp. paratuberculosis
accgcggucgacggga

SEQ ID NO: 2868889 - RNA, 16 nt, Mycobacterium avium subsp. paratuberculosis
accgcggucgcggcgc

SEQ ID NO: 2868890 - RNA, 21 nt, Mycobacterium avium subsp. paratuberculosis
accgcggucugcgccagcucc

SEQ ID NO: 2868891 - RNA, 19 nt, Mycobacterium avium subsp. paratuberculosis
accgcggugagcggccgca

SEQ ID NO: 2868892 - RNA, 20 nt, Mycobacterium avium subsp. paratuberculosis
accgcgguggcggugcgguc

SEQ ID NO: 2868893 - RNA, 22 nt, Mycobacterium avium subsp. paratuberculosis
accgcgguggcggugcggucgc

SEQ ID NO: 2868894 - RNA, 19 nt, Mycobacterium avium subsp. paratuberculosis
accgcggugggccagucga

SEQ ID NO: 2868895 - RNA, 21 nt, Mycobacterium avium subsp. paratuberculosis
accgcgguguugagcgcguug

SEQ ID NO: 2868896 - RNA, 21 nt, Mycobacterium avium subsp. paratuberculosis
accgcguacagggcgucggac

SEQ ID NO: 2868897 - RNA, 15 nt, Mycobacterium avium subsp. paratuberculosis
accgcguagcgccgc

SEQ ID NO: 2868898 - RNA, 17 nt, Mycobacterium avium subsp. paratuberculosis
accgcguagcgccgccc

SEQ ID NO: 2868899 - RNA, 20 nt, Mycobacterium avium subsp. paratuberculosis
accgcguagcgccgcccguc

SEQ ID NO: 2868900 - RNA, 19 nt, Mycobacterium avium subsp. paratuberculosis
accgcgucagcagcgcgac

SEQ ID NO: 2868901 - RNA, 21 nt, Mycobacterium avium subsp. paratuberculosis
accgcgucagcagcgcgacgc

SEQ ID NO: 2868902 - RNA, 13 nt, Mycobacterium avium subsp. paratuberculosis
accgcguccacga

SEQ ID NO: 2868903 - RNA, 22 nt, Mycobacterium avium subsp. paratuberculosis
accgcguccacgaccccggcgg

SEQ ID NO: 2868904 - RNA, 23 nt, Mycobacterium avium subsp. paratuberculosis
accgcguccacgaccccggcggc

SEQ ID NO: 2868905 - RNA, 16 nt, Mycobacterium avium subsp. paratuberculosis
accgcguccgaggcgg

SEQ ID NO: 2868906 - RNA, 18 nt, Mycobacterium avium subsp. paratuberculosis
accgcguccgaggcgguu

SEQ ID NO: 2868907 - RNA, 19 nt, Mycobacterium avium subsp. paratuberculosis
accgcguccgaggcgguuc

SEQ ID NO: 2868908 - RNA, 15 nt, Mycobacterium avium subsp. paratuberculosis
accgcguccgcgguu

SEQ ID NO: 2868909 - RNA, 13 nt, Mycobacterium avium subsp. paratuberculosis
accgcguccgcgu

SEQ ID NO: 2868910 - RNA, 14 nt, Mycobacterium avium subsp. paratuberculosis
accgcguccgcguc

SEQ ID NO: 2868911 - RNA, 18 nt, Mycobacterium avium subsp. paratuberculosis
accgcguccgcgucgucg

SEQ ID NO: 2868912 - RNA, 22 nt, Mycobacterium avium subsp. paratuberculosis
accgcguccgcgucgucgaggc

SEQ ID NO: 2868913 - RNA, 20 nt, Mycobacterium avium subsp. paratuberculosis
accgcguccugcaggcaggc

SEQ ID NO: 2868914 - RNA, 21 nt, Mycobacterium avium subsp. paratuberculosis
accgcguccugcaggcaggcc

SEQ ID NO: 2868915 - RNA, 22 nt, Mycobacterium avium subsp. paratuberculosis
accgcguccuucuccgccgggc

SEQ ID NO: 2868916 - RNA, 14 nt, Mycobacterium avium subsp. paratuberculosis
accgcgucgaccac

SEQ ID NO: 2868917 - RNA, 18 nt, Mycobacterium avium subsp. paratuberculosis
accgcgucgaccaccgcc

SEQ ID NO: 2868918 - RNA, 21 nt, Mycobacterium avium subsp. paratuberculosis
accgcgucgaccaccgccggc

SEQ ID NO: 2868919 - RNA, 16 nt, Mycobacterium avium subsp. paratuberculosis
accgcgucgacggcgu

SEQ ID NO: 2868920 - RNA, 20 nt, Mycobacterium avium subsp. paratuberculosis
accgcgucgaugcgggcccg

SEQ ID NO: 2868921 - RNA, 17 nt, Mycobacterium avium subsp. paratuberculosis
accgcgucgaugucguc

SEQ ID NO: 2868922 - RNA, 16 nt, Mycobacterium avium subsp. paratuberculosis
accgcgucgcagugcc

SEQ ID NO: 2868923 - RNA, 19 nt, Mycobacterium avium subsp. paratuberculosis
accgcgucgcagugccggu

SEQ ID NO: 2868924 - RNA, 13 nt, Mycobacterium avium subsp. paratuberculosis
accgcgucggagg

SEQ ID NO: 2868925 - RNA, 13 nt, Mycobacterium avium subsp. paratuberculosis
accgcgucggccc

SEQ ID NO: 2868926 - RNA, 14 nt, Mycobacterium avium subsp. paratuberculosis
accgcgucggccca

SEQ ID NO: 2868927 - RNA, 20 nt, Mycobacterium avium subsp. paratuberculosis
accgcgucggcgcuggccag

SEQ ID NO: 2868928 - RNA, 19 nt, Mycobacterium avium subsp. paratuberculosis
accgcgucuuggacgcccg

SEQ ID NO: 2868929 - RNA, 21 nt, Mycobacterium avium subsp. paratuberculosis
accgcgucuuggacgcccgcg

SEQ ID NO: 2868930 - RNA, 22 nt, Mycobacterium avium subsp. paratuberculosis
accgcgucuuggacgcccgcga

SEQ ID NO: 2868931 - RNA, 14 nt, Mycobacterium avium subsp. paratuberculosis
accgcguggcgcac

SEQ ID NO: 2868932 - RNA, 15 nt, Mycobacterium avium subsp. paratuberculosis
accgcguggcgcaca

SEQ ID NO: 2868933 - RNA, 17 nt, Mycobacterium avium subsp. paratuberculosis
accgcguggcgcacagc

SEQ ID NO: 2868934 - RNA, 17 nt, Mycobacterium avium subsp. paratuberculosis
accgcgugucggcacac

SEQ ID NO: 2868935 - RNA, 15 nt, Mycobacterium avium subsp. paratuberculosis
accgcgugugcccgc

SEQ ID NO: 2868936 - RNA, 16 nt, Mycobacterium avium subsp. paratuberculosis
accgcgugugcccgcc

SEQ ID NO: 2868937 - RNA, 21 nt, Mycobacterium avium subsp. paratuberculosis
accgcgugugcccgccucgca

SEQ ID NO: 2868938 - RNA, 22 nt, Mycobacterium avium subsp. paratuberculosis
accgcgugugcccgccucgcag

SEQ ID NO: 2868939 - RNA, 18 nt, Mycobacterium avium subsp. paratuberculosis
accgcguugaucagcgcc

SEQ ID NO: 2868940 - RNA, 20 nt, Mycobacterium avium subsp. paratuberculosis
accgcguugaucagcgccag

SEQ ID NO: 2868941 - RNA, 15 nt, Mycobacterium avium subsp. paratuberculosis
accgcguuggccgcc

SEQ ID NO: 2868942 - RNA, 17 nt, Mycobacterium avium subsp. paratuberculosis
accgcguuggccgccac

SEQ ID NO: 2868943 - RNA, 16 nt, Mycobacterium avium subsp. paratuberculosis
accgcguuggcgccga

SEQ ID NO: 2868944 - RNA, 23 nt, Mycobacterium avium subsp. paratuberculosis
accgcguuggcgccgacgucagg

SEQ ID NO: 2868945 - RNA, 23 nt, Mycobacterium avium subsp. paratuberculosis
accgcguuguccggggugggcac

SEQ ID NO: 2868946 - RNA, 16 nt, Mycobacterium avium subsp. paratuberculosis
accgcguugucggcga

SEQ ID NO: 2868947 - RNA, 19 nt, Mycobacterium avium subsp. paratuberculosis
accgcguugucggcgacgg

SEQ ID NO: 2868948 - RNA, 18 nt, Mycobacterium avium subsp. paratuberculosis
accgcuccccgagcacgu

SEQ ID NO: 2868949 - RNA, 23 nt, Mycobacterium avium subsp. paratuberculosis
accgcuccccgagcacgucgagc

SEQ ID NO: 2868950 - RNA, 19 nt, Mycobacterium avium subsp. paratuberculosis
accgcucgaacacccggcu

SEQ ID NO: 2868951 - RNA, 21 nt, Mycobacterium avium subsp. paratuberculosis
accgcucgaacacccggcuuc

SEQ ID NO: 2868952 - RNA, 20 nt, Mycobacterium avium subsp. paratuberculosis
accgcucgauggcgccgauc

SEQ ID NO: 2868953 - RNA, 20 nt, Mycobacterium avium subsp. paratuberculosis
accgcucggcgaucuggcgg

SEQ ID NO: 2868954 - RNA, 14 nt, Mycobacterium avium subsp. paratuberculosis
accgcucggcggcg

SEQ ID NO: 2868955 - RNA, 17 nt, Mycobacterium avium subsp. paratuberculosis
accgcucggcggcgccg

SEQ ID NO: 2868956 - RNA, 14 nt, Mycobacterium avium subsp. paratuberculosis
accgcugaccagga

SEQ ID NO: 2868957 - RNA, 22 nt, Mycobacterium avium subsp. paratuberculosis
accgcugagguagucccgcgcc

SEQ ID NO: 2868958 - RNA, 17 nt, Mycobacterium avium subsp. paratuberculosis
accgcugaugccgccga

SEQ ID NO: 2868959 - RNA, 18 nt, Mycobacterium avium subsp. paratuberculosis
accgcugaugccgccgaa

SEQ ID NO: 2868960 - RNA, 13 nt, Mycobacterium avium subsp. paratuberculosis
accgcugcaaccg

SEQ ID NO: 2868961 - RNA, 18 nt, Mycobacterium avium subsp. paratuberculosis
accgcugcaaccgguagc

SEQ ID NO: 2868962 - RNA, 13 nt, Mycobacterium avium subsp. paratuberculosis
accgcugcaugcc

SEQ ID NO: 2868963 - RNA, 21 nt, Mycobacterium avium subsp. paratuberculosis
accgcugcaugccgucgaucu

SEQ ID NO: 2868964 - RNA, 24 nt, Mycobacterium avium subsp. paratuberculosis
accgcugccacgguuucgccguac

SEQ ID NO: 2868965 - RNA, 14 nt, Mycobacterium avium subsp. paratuberculosis
accgcugcggcaca

SEQ ID NO: 2868966 - RNA, 15 nt, Mycobacterium avium subsp. paratuberculosis
accgcugcggcacac

SEQ ID NO: 2868967 - RNA, 19 nt, Mycobacterium avium subsp. paratuberculosis
accgcugcugcucggccgc

SEQ ID NO: 2868968 - RNA, 15 nt, Mycobacterium avium subsp. paratuberculosis
accgcugcugcugcc

SEQ ID NO: 2868969 - RNA, 17 nt, Mycobacterium avium subsp. paratuberculosis
accgcugcugcugcccg

SEQ ID NO: 2868970 - RNA, 19 nt, Mycobacterium avium subsp. paratuberculosis
accgcugcugcugcccgcc

SEQ ID NO: 2868971 - RNA, 20 nt, Mycobacterium avium subsp. paratuberculosis
accgcugcugcugcccgccc

SEQ ID NO: 2868972 - RNA, 22 nt, Mycobacterium avium subsp. paratuberculosis
accgcugcugcugcccgcccga

SEQ ID NO: 2868973 - RNA, 16 nt, Mycobacterium avium subsp. paratuberculosis
accgcugggcggcgcg

SEQ ID NO: 2868974 - RNA, 18 nt, Mycobacterium avium subsp. paratuberculosis
accgcugggcggcgcggc

SEQ ID NO: 2868975 - RNA, 19 nt, Mycobacterium avium subsp. paratuberculosis
accgcugggcggcgcggcg

SEQ ID NO: 2868976 - RNA, 14 nt, Mycobacterium avium subsp. paratuberculosis
accgcuguggacag

SEQ ID NO: 2868977 - RNA, 15 nt, Mycobacterium avium subsp. paratuberculosis
accgcuugacgccgc

SEQ ID NO: 2868978 - RNA, 18 nt, Mycobacterium avium subsp. paratuberculosis
accgcuugacgccgccga

SEQ ID NO: 2868979 - RNA, 14 nt, Mycobacterium avium subsp. paratuberculosis
accgcuugcccagc

SEQ ID NO: 2868980 - RNA, 16 nt, Mycobacterium avium subsp. paratuberculosis
accgcuugcccagccc

SEQ ID NO: 2868981 - RNA, 13 nt, Mycobacterium avium subsp. paratuberculosis
accgcuugcggcu

SEQ ID NO: 2868982 - RNA, 19 nt, Mycobacterium avium subsp. paratuberculosis
accgcuugcggcucaacga

SEQ ID NO: 2868983 - RNA, 12 nt, Mycobacterium avium subsp. paratuberculosis
accgcuuggccc

SEQ ID NO: 2868984 - RNA, 13 nt, Mycobacterium avium subsp. paratuberculosis
accgcuuggccca

SEQ ID NO: 2868985 - RNA, 14 nt, Mycobacterium avium subsp. paratuberculosis
accgcuuggcccac

SEQ ID NO: 2868986 - RNA, 16 nt, Mycobacterium avium subsp. paratuberculosis
accggaagaucagcag

SEQ ID NO: 2868987 - RNA, 16 nt, Mycobacterium avium subsp. paratuberculosis
accggaagcgcgcauc

SEQ ID NO: 2868988 - RNA, 15 nt, Mycobacterium avium subsp. paratuberculosis
accggaaggccaggu

SEQ ID NO: 2868989 - RNA, 19 nt, Mycobacterium avium subsp. paratuberculosis
accggaauggcagcagccg

SEQ ID NO: 2868990 - RNA, 22 nt, Mycobacterium avium subsp. paratuberculosis
accggaauggcagcagccggaa

SEQ ID NO: 2868991 - RNA, 21 nt, Mycobacterium avium subsp. paratuberculosis
accggaauugaagcccugcuc

SEQ ID NO: 2868992 - RNA, 16 nt, Mycobacterium avium subsp. paratuberculosis
accggacagcugggcg

SEQ ID NO: 2868993 - RNA, 14 nt, Mycobacterium avium subsp. paratuberculosis
accggaccgccgag

SEQ ID NO: 2868994 - RNA, 13 nt, Mycobacterium avium subsp. paratuberculosis
accggaccgccgc

SEQ ID NO: 2868995 - RNA, 14 nt, Mycobacterium avium subsp. paratuberculosis
accggaccgccgcg

SEQ ID NO: 2868996 - RNA, 18 nt, Mycobacterium avium subsp. paratuberculosis
accggaccgccgcggcgc

SEQ ID NO: 2868997 - RNA, 23 nt, Mycobacterium avium subsp. paratuberculosis
accggaccgccgcggcgcccggc

SEQ ID NO: 2868998 - RNA, 17 nt, Mycobacterium avium subsp. paratuberculosis
accggaccggccagcag

SEQ ID NO: 2868999 - RNA, 18 nt, Mycobacterium avium subsp. paratuberculosis
accggaccggccagcagc

SEQ ID NO: 2869000 - RNA, 23 nt, Mycobacterium avium subsp. paratuberculosis
accggacgcagcgaucggcggcu

SEQ ID NO: 2869001 - RNA, 15 nt, Mycobacterium avium subsp. paratuberculosis
accggagccuugguc

SEQ ID NO: 2869002 - RNA, 18 nt, Mycobacterium avium subsp. paratuberculosis
accggagccuuggucgcg

SEQ ID NO: 2869003 - RNA, 13 nt, Mycobacterium avium subsp. paratuberculosis
accggaggccgcg

SEQ ID NO: 2869004 - RNA, 16 nt, Mycobacterium avium subsp. paratuberculosis
accggaggccgcgggu

SEQ ID NO: 2869005 - RNA, 23 nt, Mycobacterium avium subsp. paratuberculosis
accggauccaccaauucgcgcug

SEQ ID NO: 2869006 - RNA, 18 nt, Mycobacterium avium subsp. paratuberculosis
accggaucggccagcagg

SEQ ID NO: 2869007 - RNA, 21 nt, Mycobacterium avium subsp. paratuberculosis
accggaucggcugcgggccag

SEQ ID NO: 2869008 - RNA, 23 nt, Mycobacterium avium subsp. paratuberculosis
accggaugaugcccuuggcggcc

SEQ ID NO: 2869009 - RNA, 16 nt, Mycobacterium avium subsp. paratuberculosis
accggaugcaccggca

SEQ ID NO: 2869010 - RNA, 18 nt, Mycobacterium avium subsp. paratuberculosis
accggaugcaccggcagc

SEQ ID NO: 2869011 - RNA, 21 nt, Mycobacterium avium subsp. paratuberculosis
accggaugcaccggcagccag

SEQ ID NO: 2869012 - RNA, 21 nt, Mycobacterium avium subsp. paratuberculosis
accggaugcacgugcaccgcg

SEQ ID NO: 2869013 - RNA, 21 nt, Mycobacterium avium subsp. paratuberculosis
accggaugcucaccggucagc

SEQ ID NO: 2869014 - RNA, 17 nt, Mycobacterium avium subsp. paratuberculosis
accggauggcgcccggc

SEQ ID NO: 2869015 - RNA, 20 nt, Mycobacterium avium subsp. paratuberculosis
accggauggcgcccggcagc

SEQ ID NO: 2869016 - RNA, 15 nt, Mycobacterium avium subsp. paratuberculosis
accggcaaccgccac

SEQ ID NO: 2869017 - RNA, 17 nt, Mycobacterium avium subsp. paratuberculosis
accggcaaccgccacga

SEQ ID NO: 2869018 - RNA, 13 nt, Mycobacterium avium subsp. paratuberculosis
accggcaccacga

SEQ ID NO: 2869019 - RNA, 17 nt, Mycobacterium avium subsp. paratuberculosis
accggcaccagcagcca

SEQ ID NO: 2869020 - RNA, 16 nt, Mycobacterium avium subsp. paratuberculosis
accggcaccagcaggc

SEQ ID NO: 2869021 - RNA, 17 nt, Mycobacterium avium subsp. paratuberculosis
accggcaccagcaggcc

SEQ ID NO: 2869022 - RNA, 23 nt, Mycobacterium avium subsp. paratuberculosis
accggcacccccaauugccgggc

SEQ ID NO: 2869023 - RNA, 12 nt, Mycobacterium avium subsp. paratuberculosis
accggcaccgcc

SEQ ID NO: 2869024 - RNA, 17 nt, Mycobacterium avium subsp. paratuberculosis
accggcaccgccagcca

SEQ ID NO: 2869025 - RNA, 23 nt, Mycobacterium avium subsp. paratuberculosis
accggcaccgccagccaccacau

SEQ ID NO: 2869026 - RNA, 13 nt, Mycobacterium avium subsp. paratuberculosis
accggcaccgccc

SEQ ID NO: 2869027 - RNA, 23 nt, Mycobacterium avium subsp. paratuberculosis
accggcaccgcccccgcggcggc

SEQ ID NO: 2869028 - RNA, 13 nt, Mycobacterium avium subsp. paratuberculosis
accggcaccgcgg

SEQ ID NO: 2869029 - RNA, 16 nt, Mycobacterium avium subsp. paratuberculosis
accggcaccgcggcga

SEQ ID NO: 2869030 - RNA, 20 nt, Mycobacterium avium subsp. paratuberculosis
accggcacgaucgucgccgc

SEQ ID NO: 2869031 - RNA, 13 nt, Mycobacterium avium subsp. paratuberculosis
accggcacggcac

SEQ ID NO: 2869032 - RNA, 19 nt, Mycobacterium avium subsp. paratuberculosis
accggcacggcaccgcgag

SEQ ID NO: 2869033 - RNA, 22 nt, Mycobacterium avium subsp. paratuberculosis
accggcacggugcacacgccga

SEQ ID NO: 2869034 - RNA, 13 nt, Mycobacterium avium subsp. paratuberculosis
accggcacgucga

SEQ ID NO: 2869035 - RNA, 15 nt, Mycobacterium avium subsp. paratuberculosis
accggcacgucggcc

SEQ ID NO: 2869036 - RNA, 17 nt, Mycobacterium avium subsp. paratuberculosis
accggcacgucggccac

SEQ ID NO: 2869037 - RNA, 15 nt, Mycobacterium avium subsp. paratuberculosis
accggcagcaaccgc

SEQ ID NO: 2869038 - RNA, 16 nt, Mycobacterium avium subsp. paratuberculosis
accggcagcaaccgcg

SEQ ID NO: 2869039 - RNA, 14 nt, Mycobacterium avium subsp. paratuberculosis
accggcagcaccgc

SEQ ID NO: 2869040 - RNA, 15 nt, Mycobacterium avium subsp. paratuberculosis
accggcagcaccgcc

SEQ ID NO: 2869041 - RNA, 17 nt, Mycobacterium avium subsp. paratuberculosis
accggcagcaccgccga

SEQ ID NO: 2869042 - RNA, 12 nt, Mycobacterium avium subsp. paratuberculosis
accggcagcagc

SEQ ID NO: 2869043 - RNA, 14 nt, Mycobacterium avium subsp. paratuberculosis
accggcagcagcgc

SEQ ID NO: 2869044 - RNA, 20 nt, Mycobacterium avium subsp. paratuberculosis
accggcagcaggugcaccac

SEQ ID NO: 2869045 - RNA, 21 nt, Mycobacterium avium subsp. paratuberculosis
accggcagcaggugcaccacc

SEQ ID NO: 2869046 - RNA, 14 nt, Mycobacterium avium subsp. paratuberculosis
accggcagccgcag

SEQ ID NO: 2869047 - RNA, 15 nt, Mycobacterium avium subsp. paratuberculosis
accggcagccgcagc

SEQ ID NO: 2869048 - RNA, 16 nt, Mycobacterium avium subsp. paratuberculosis
accggcagccgcagcg

SEQ ID NO: 2869049 - RNA, 17 nt, Mycobacterium avium subsp. paratuberculosis
accggcagccgcagcga

SEQ ID NO: 2869050 - RNA, 18 nt, Mycobacterium avium subsp. paratuberculosis
accggcagccgcagcgac

SEQ ID NO: 2869051 - RNA, 15 nt, Mycobacterium avium subsp. paratuberculosis
accggcagccgcgcc

SEQ ID NO: 2869052 - RNA, 16 nt, Mycobacterium avium subsp. paratuberculosis
accggcagccggcgua

SEQ ID NO: 2869053 - RNA, 13 nt, Mycobacterium avium subsp. paratuberculosis
accggcagcgcca

SEQ ID NO: 2869054 - RNA, 14 nt, Mycobacterium avium subsp. paratuberculosis
accggcagcgccac

SEQ ID NO: 2869055 - RNA, 23 nt, Mycobacterium avium subsp. paratuberculosis
accggcaggacgggggccggugc

SEQ ID NO: 2869056 - RNA, 15 nt, Mycobacterium avium subsp. paratuberculosis
accggcaucgguggc

SEQ ID NO: 2869057 - RNA, 21 nt, Mycobacterium avium subsp. paratuberculosis
accggcaucgguggcaccccg

SEQ ID NO: 2869058 - RNA, 22 nt, Mycobacterium avium subsp. paratuberculosis
accggcaucgguggcaccccgc

SEQ ID NO: 2869059 - RNA, 12 nt, Mycobacterium avium subsp. paratuberculosis
accggcauucgu

SEQ ID NO: 2869060 - RNA, 21 nt, Mycobacterium avium subsp. paratuberculosis
accggcauucguguggcgcac

SEQ ID NO: 2869061 - RNA, 18 nt, Mycobacterium avium subsp. paratuberculosis
accggccaccucgucggc

SEQ ID NO: 2869062 - RNA, 13 nt, Mycobacterium avium subsp. paratuberculosis
accggccagcacg

SEQ ID NO: 2869063 - RNA, 13 nt, Mycobacterium avium subsp. paratuberculosis
accggccagcagc

SEQ ID NO: 2869064 - RNA, 16 nt, Mycobacterium avium subsp. paratuberculosis
accggccagcagcagc

SEQ ID NO: 2869065 - RNA, 17 nt, Mycobacterium avium subsp. paratuberculosis
accggccagcagcagcc

SEQ ID NO: 2869066 - RNA, 20 nt, Mycobacterium avium subsp. paratuberculosis
accggccagcagcagcccgc

SEQ ID NO: 2869067 - RNA, 22 nt, Mycobacterium avium subsp. paratuberculosis
accggccagcagcagcccgccg

SEQ ID NO: 2869068 - RNA, 15 nt, Mycobacterium avium subsp. paratuberculosis
accggccagcagccg

SEQ ID NO: 2869069 - RNA, 16 nt, Mycobacterium avium subsp. paratuberculosis
accggccagcagccgc

SEQ ID NO: 2869070 - RNA, 18 nt, Mycobacterium avium subsp. paratuberculosis
accggccagcauggucuc

SEQ ID NO: 2869071 - RNA, 16 nt, Mycobacterium avium subsp. paratuberculosis
accggccagggccgcc

SEQ ID NO: 2869072 - RNA, 17 nt, Mycobacterium avium subsp. paratuberculosis
accggccagggccgccg

SEQ ID NO: 2869073 - RNA, 19 nt, Mycobacterium avium subsp. paratuberculosis
accggccagggccgccgca

SEQ ID NO: 2869074 - RNA, 13 nt, Mycobacterium avium subsp. paratuberculosis
accggccauccgc

SEQ ID NO: 2869075 - RNA, 15 nt, Mycobacterium avium subsp. paratuberculosis
accggcccagcagcg

SEQ ID NO: 2869076 - RNA, 16 nt, Mycobacterium avium subsp. paratuberculosis
accggcccagcagcgu

SEQ ID NO: 2869077 - RNA, 17 nt, Mycobacterium avium subsp. paratuberculosis
accggcccagcagcguc

SEQ ID NO: 2869078 - RNA, 21 nt, Mycobacterium avium subsp. paratuberculosis
accggcccagcagcgucacgu

SEQ ID NO: 2869079 - RNA, 14 nt, Mycobacterium avium subsp. paratuberculosis
accggcccagccgg

SEQ ID NO: 2869080 - RNA, 17 nt, Mycobacterium avium subsp. paratuberculosis
accggcccagccggcgg

SEQ ID NO: 2869081 - RNA, 18 nt, Mycobacterium avium subsp. paratuberculosis
accggcccagccggcggu

SEQ ID NO: 2869082 - RNA, 14 nt, Mycobacterium avium subsp. paratuberculosis
accggcccagcgcg

SEQ ID NO: 2869083 - RNA, 15 nt, Mycobacterium avium subsp. paratuberculosis
accggcccagcgcgg

SEQ ID NO: 2869084 - RNA, 17 nt, Mycobacterium avium subsp. paratuberculosis
accggcccagcgcggug

SEQ ID NO: 2869085 - RNA, 22 nt, Mycobacterium avium subsp. paratuberculosis
accggccccaacggcgugcagc

SEQ ID NO: 2869086 - RNA, 20 nt, Mycobacterium avium subsp. paratuberculosis
accggccccgagcgucacgc

SEQ ID NO: 2869087 - RNA, 20 nt, Mycobacterium avium subsp. paratuberculosis
accggcccgaacaccuccuc

SEQ ID NO: 2869088 - RNA, 14 nt, Mycobacterium avium subsp. paratuberculosis
accggcccggccgg

SEQ ID NO: 2869089 - RNA, 19 nt, Mycobacterium avium subsp. paratuberculosis
accggcccggccggcgcga

SEQ ID NO: 2869090 - RNA, 20 nt, Mycobacterium avium subsp. paratuberculosis
accggcccggccggcgcgac

SEQ ID NO: 2869091 - RNA, 21 nt, Mycobacterium avium subsp. paratuberculosis
accggcccggccggcgcgacc

SEQ ID NO: 2869092 - RNA, 14 nt, Mycobacterium avium subsp. paratuberculosis
accggcccggcggc

SEQ ID NO: 2869093 - RNA, 21 nt, Mycobacterium avium subsp. paratuberculosis
accggcccggcggccggccgc

SEQ ID NO: 2869094 - RNA, 17 nt, Mycobacterium avium subsp. paratuberculosis
accggcccggcgggcau

SEQ ID NO: 2869095 - RNA, 15 nt, Mycobacterium avium subsp. paratuberculosis
accggccgagccgau

SEQ ID NO: 2869096 - RNA, 17 nt, Mycobacterium avium subsp. paratuberculosis
accggccgauggcccag

SEQ ID NO: 2869097 - RNA, 23 nt, Mycobacterium avium subsp. paratuberculosis
accggccgauggcccaggccgcg

SEQ ID NO: 2869098 - RNA, 13 nt, Mycobacterium avium subsp. paratuberculosis
accggccgcccgg

SEQ ID NO: 2869099 - RNA, 21 nt, Mycobacterium avium subsp. paratuberculosis
accggccgcccggcgagcagc

SEQ ID NO: 2869100 - RNA, 12 nt, Mycobacterium avium subsp. paratuberculosis
accggccgcgcg

SEQ ID NO: 2869101 - RNA, 19 nt, Mycobacterium avium subsp. paratuberculosis
accggccgcgcguagauca

SEQ ID NO: 2869102 - RNA, 22 nt, Mycobacterium avium subsp. paratuberculosis
accggccgcgcguagaucaucu

SEQ ID NO: 2869103 - RNA, 13 nt, Mycobacterium avium subsp. paratuberculosis
accggccggcccc

SEQ ID NO: 2869104 - RNA, 19 nt, Mycobacterium avium subsp. paratuberculosis
accggccggccccggggga

SEQ ID NO: 2869105 - RNA, 17 nt, Mycobacterium avium subsp. paratuberculosis
accggccggccgccugg

SEQ ID NO: 2869106 - RNA, 12 nt, Mycobacterium avium subsp. paratuberculosis
accggccggcgc

SEQ ID NO: 2869107 - RNA, 13 nt, Mycobacterium avium subsp. paratuberculosis
accggccggcgcg

SEQ ID NO: 2869108 - RNA, 14 nt, Mycobacterium avium subsp. paratuberculosis
accggccggcgcgc

SEQ ID NO: 2869109 - RNA, 19 nt, Mycobacterium avium subsp. paratuberculosis
accggccggcgcgcacggc

SEQ ID NO: 2869110 - RNA, 15 nt, Mycobacterium avium subsp. paratuberculosis
accggccggcgcggc

SEQ ID NO: 2869111 - RNA, 16 nt, Mycobacterium avium subsp. paratuberculosis
accggccggcgcggcg

SEQ ID NO: 2869112 - RNA, 20 nt, Mycobacterium avium subsp. paratuberculosis
accggccggcgcggcggcga

SEQ ID NO: 2869113 - RNA, 21 nt, Mycobacterium avium subsp. paratuberculosis
accggccggcgcggcggcgac

SEQ ID NO: 2869114 - RNA, 23 nt, Mycobacterium avium subsp. paratuberculosis
accggccggcgcggcggcgacgu

SEQ ID NO: 2869115 - RNA, 16 nt, Mycobacterium avium subsp. paratuberculosis
accggccgggacgggu

SEQ ID NO: 2869116 - RNA, 17 nt, Mycobacterium avium subsp. paratuberculosis
accggccggggcgccac

SEQ ID NO: 2869117 - RNA, 22 nt, Mycobacterium avium subsp. paratuberculosis
accggccggggcgggcacgucg

SEQ ID NO: 2869118 - RNA, 14 nt, Mycobacterium avium subsp. paratuberculosis
accggccgguccgc

SEQ ID NO: 2869119 - RNA, 17 nt, Mycobacterium avium subsp. paratuberculosis
accggccgguccgccca

SEQ ID NO: 2869120 - RNA, 18 nt, Mycobacterium avium subsp. paratuberculosis
accggccgguccgcccag

SEQ ID NO: 2869121 - RNA, 23 nt, Mycobacterium avium subsp. paratuberculosis
accggccgguccgcccagacgcg

SEQ ID NO: 2869122 - RNA, 16 nt, Mycobacterium avium subsp. paratuberculosis
accggccgugcgcguc

SEQ ID NO: 2869123 - RNA, 19 nt, Mycobacterium avium subsp. paratuberculosis
accggccgugcgcgucgac

SEQ ID NO: 2869124 - RNA, 19 nt, Mycobacterium avium subsp. paratuberculosis
accggccugcagcgcgguc

SEQ ID NO: 2869125 - RNA, 14 nt, Mycobacterium avium subsp. paratuberculosis
accggcgaauccga

SEQ ID NO: 2869126 - RNA, 22 nt, Mycobacterium avium subsp. paratuberculosis
accggcgaauccgaguuggccg

SEQ ID NO: 2869127 - RNA, 14 nt, Mycobacterium avium subsp. paratuberculosis
accggcgacggcgg

SEQ ID NO: 2869128 - RNA, 19 nt, Mycobacterium avium subsp. paratuberculosis
accggcgacggcgguucga

SEQ ID NO: 2869129 - RNA, 17 nt, Mycobacterium avium subsp. paratuberculosis
accggcgaggugcgcca

SEQ ID NO: 2869130 - RNA, 18 nt, Mycobacterium avium subsp. paratuberculosis
accggcgaguccgcggag

SEQ ID NO: 2869131 - RNA, 14 nt, Mycobacterium avium subsp. paratuberculosis
accggcgaucguca

SEQ ID NO: 2869132 - RNA, 17 nt, Mycobacterium avium subsp. paratuberculosis
accggcgaugccagcgc

SEQ ID NO: 2869133 - RNA, 14 nt, Mycobacterium avium subsp. paratuberculosis
accggcgauguggc

SEQ ID NO: 2869134 - RNA, 17 nt, Mycobacterium avium subsp. paratuberculosis
accggcgauuucggccg

SEQ ID NO: 2869135 - RNA, 18 nt, Mycobacterium avium subsp. paratuberculosis
accggcgauuucggccgu

SEQ ID NO: 2869136 - RNA, 20 nt, Mycobacterium avium subsp. paratuberculosis
accggcgauuucggccguga

SEQ ID NO: 2869137 - RNA, 17 nt, Mycobacterium avium subsp. paratuberculosis
accggcgcagcgcgucg

SEQ ID NO: 2869138 - RNA, 18 nt, Mycobacterium avium subsp. paratuberculosis
accggcgcagcgcgucgc

SEQ ID NO: 2869139 - RNA, 16 nt, Mycobacterium avium subsp. paratuberculosis
accggcgccaggccgg

SEQ ID NO: 2869140 - RNA, 17 nt, Mycobacterium avium subsp. paratuberculosis
accggcgccaggccggc

SEQ ID NO: 2869141 - RNA, 19 nt, Mycobacterium avium subsp. paratuberculosis
accggcgccaggccggcga

SEQ ID NO: 2869142 - RNA, 21 nt, Mycobacterium avium subsp. paratuberculosis
accggcgccaggccggcgacg

SEQ ID NO: 2869143 - RNA, 13 nt, Mycobacterium avium subsp. paratuberculosis
accggcgccaggu

SEQ ID NO: 2869144 - RNA, 18 nt, Mycobacterium avium subsp. paratuberculosis
accggcgccccgggcagc

SEQ ID NO: 2869145 - RNA, 20 nt, Mycobacterium avium subsp. paratuberculosis
accggcgccccgggcagcga

SEQ ID NO: 2869146 - RNA, 21 nt, Mycobacterium avium subsp. paratuberculosis
accggcgccccgggcagcgaa

SEQ ID NO: 2869147 - RNA, 17 nt, Mycobacterium avium subsp. paratuberculosis
accggcgccgccaccac

SEQ ID NO: 2869148 - RNA, 12 nt, Mycobacterium avium subsp. paratuberculosis
accggcgccggc

SEQ ID NO: 2869149 - RNA, 15 nt, Mycobacterium avium subsp. paratuberculosis
accggcgccggccgc

SEQ ID NO: 2869150 - RNA, 18 nt, Mycobacterium avium subsp. paratuberculosis
accggcgccggccgccgg

SEQ ID NO: 2869151 - RNA, 19 nt, Mycobacterium avium subsp. paratuberculosis
accggcgccgggcagcccg

SEQ ID NO: 2869152 - RNA, 22 nt, Mycobacterium avium subsp. paratuberculosis
accggcgccgggcagcccgggu

SEQ ID NO: 2869153 - RNA, 21 nt, Mycobacterium avium subsp. paratuberculosis
accggcgccucgaugcgggug

SEQ ID NO: 2869154 - RNA, 13 nt, Mycobacterium avium subsp. paratuberculosis
accggcgccucgu

SEQ ID NO: 2869155 - RNA, 13 nt, Mycobacterium avium subsp. paratuberculosis
accggcgcgacgg

SEQ ID NO: 2869156 - RNA, 16 nt, Mycobacterium avium subsp. paratuberculosis
accggcgcgacggcgg

SEQ ID NO: 2869157 - RNA, 14 nt, Mycobacterium avium subsp. paratuberculosis
accggcgcgcagca

SEQ ID NO: 2869158 - RNA, 22 nt, Mycobacterium avium subsp. paratuberculosis
accggcgcgcagcaucucuuga

SEQ ID NO: 2869159 - RNA, 14 nt, Mycobacterium avium subsp. paratuberculosis
accggcgcgcccga

SEQ ID NO: 2869160 - RNA, 17 nt, Mycobacterium avium subsp. paratuberculosis
accggcgcgcccgaguc

SEQ ID NO: 2869161 - RNA, 13 nt, Mycobacterium avium subsp. paratuberculosis
accggcgcgccgc

SEQ ID NO: 2869162 - RNA, 15 nt, Mycobacterium avium subsp. paratuberculosis
accggcgcgccgcgu

SEQ ID NO: 2869163 - RNA, 14 nt, Mycobacterium avium subsp. paratuberculosis
accggcgcgccguc

SEQ ID NO: 2869164 - RNA, 15 nt, Mycobacterium avium subsp. paratuberculosis
accggcgcugcccgc

SEQ ID NO: 2869165 - RNA, 21 nt, Mycobacterium avium subsp. paratuberculosis
accggcggaaguagcccggag

SEQ ID NO: 2869166 - RNA, 21 nt, Mycobacterium avium subsp. paratuberculosis
accggcggauucucgcucugc

SEQ ID NO: 2869167 - RNA, 22 nt, Mycobacterium avium subsp. paratuberculosis
accggcggauucucgcucugcc

SEQ ID NO: 2869168 - RNA, 14 nt, Mycobacterium avium subsp. paratuberculosis
accggcggcagcga

SEQ ID NO: 2869169 - RNA, 13 nt, Mycobacterium avium subsp. paratuberculosis
accggcggccagc

SEQ ID NO: 2869170 - RNA, 15 nt, Mycobacterium avium subsp. paratuberculosis
accggcggccagcga

SEQ ID NO: 2869171 - RNA, 14 nt, Mycobacterium avium subsp. paratuberculosis
accggcggcgacgg

SEQ ID NO: 2869172 - RNA, 15 nt, Mycobacterium avium subsp. paratuberculosis
accggcggcgacggc

SEQ ID NO: 2869173 - RNA, 13 nt, Mycobacterium avium subsp. paratuberculosis
accggcggcgauc

SEQ ID NO: 2869174 - RNA, 14 nt, Mycobacterium avium subsp. paratuberculosis
accggcggcgaucg

SEQ ID NO: 2869175 - RNA, 16 nt, Mycobacterium avium subsp. paratuberculosis
accggcggcgaucggc

SEQ ID NO: 2869176 - RNA, 22 nt, Mycobacterium avium subsp. paratuberculosis
accggcggcgaucggcgcggcg

SEQ ID NO: 2869177 - RNA, 13 nt, Mycobacterium avium subsp. paratuberculosis
accggcggcggcc

SEQ ID NO: 2869178 - RNA, 14 nt, Mycobacterium avium subsp. paratuberculosis
accggcggcggccu

SEQ ID NO: 2869179 - RNA, 22 nt, Mycobacterium avium subsp. paratuberculosis
accggcggcggugagcgcgucg

SEQ ID NO: 2869180 - RNA, 14 nt, Mycobacterium avium subsp. paratuberculosis
accggcggcugggc

SEQ ID NO: 2869181 - RNA, 20 nt, Mycobacterium avium subsp. paratuberculosis
accggcggcugggcagccgc

SEQ ID NO: 2869182 - RNA, 21 nt, Mycobacterium avium subsp. paratuberculosis
accggcggcugggcagccgcg

SEQ ID NO: 2869183 - RNA, 15 nt, Mycobacterium avium subsp. paratuberculosis
accggcgggcggcgg

SEQ ID NO: 2869184 - RNA, 12 nt, Mycobacterium avium subsp. paratuberculosis
accggcggucac

SEQ ID NO: 2869185 - RNA, 15 nt, Mycobacterium avium subsp. paratuberculosis
accggcggugccggc

SEQ ID NO: 2869186 - RNA, 17 nt, Mycobacterium avium subsp. paratuberculosis
accggcggugccggcca

SEQ ID NO: 2869187 - RNA, 18 nt, Mycobacterium avium subsp. paratuberculosis
accggcggugccggccag

SEQ ID NO: 2869188 - RNA, 15 nt, Mycobacterium avium subsp. paratuberculosis
accggcggugcggac

SEQ ID NO: 2869189 - RNA, 20 nt, Mycobacterium avium subsp. paratuberculosis
accggcguacgacaucucga

SEQ ID NO: 2869190 - RNA, 16 nt, Mycobacterium avium subsp. paratuberculosis
accggcgucauggugc

SEQ ID NO: 2869191 - RNA, 22 nt, Mycobacterium avium subsp. paratuberculosis
accggcgucauggugcgcgggu

SEQ ID NO: 2869192 - RNA, 15 nt, Mycobacterium avium subsp. paratuberculosis
accggcgucgacagc

SEQ ID NO: 2869193 - RNA, 17 nt, Mycobacterium avium subsp. paratuberculosis
accggcgucgacagccg

SEQ ID NO: 2869194 - RNA, 18 nt, Mycobacterium avium subsp. paratuberculosis
accggcgucgacagccgg

SEQ ID NO: 2869195 - RNA, 19 nt, Mycobacterium avium subsp. paratuberculosis
accggcgucgacagccggu

SEQ ID NO: 2869196 - RNA, 21 nt, Mycobacterium avium subsp. paratuberculosis
accggcgucgacagccggucg

SEQ ID NO: 2869197 - RNA, 22 nt, Mycobacterium avium subsp. paratuberculosis
accggcguggugggcagaugcc

SEQ ID NO: 2869198 - RNA, 18 nt, Mycobacterium avium subsp. paratuberculosis
accggcguugcauuucgg

SEQ ID NO: 2869199 - RNA, 19 nt, Mycobacterium avium subsp. paratuberculosis
accggcuccuugcgccgca

SEQ ID NO: 2869200 - RNA, 14 nt, Mycobacterium avium subsp. paratuberculosis
accggcucgccggc

SEQ ID NO: 2869201 - RNA, 15 nt, Mycobacterium avium subsp. paratuberculosis
accggcucgccggcg

SEQ ID NO: 2869202 - RNA, 17 nt, Mycobacterium avium subsp. paratuberculosis
accggcucgccggcgcg

SEQ ID NO: 2869203 - RNA, 19 nt, Mycobacterium avium subsp. paratuberculosis
accggcucgccggcgcgca

SEQ ID NO: 2869204 - RNA, 20 nt, Mycobacterium avium subsp. paratuberculosis
accggcucgccggcgcgcac

SEQ ID NO: 2869205 - RNA, 14 nt, Mycobacterium avium subsp. paratuberculosis
accggcucgcgggg

SEQ ID NO: 2869206 - RNA, 15 nt, Mycobacterium avium subsp. paratuberculosis
accggcucgcggggu

SEQ ID NO: 2869207 - RNA, 13 nt, Mycobacterium avium subsp. paratuberculosis
accggcucgcuga

SEQ ID NO: 2869208 - RNA, 23 nt, Mycobacterium avium subsp. paratuberculosis
accggcucgggaacggucagccg

SEQ ID NO: 2869209 - RNA, 17 nt, Mycobacterium avium subsp. paratuberculosis
accggcugaccggcggu

SEQ ID NO: 2869210 - RNA, 13 nt, Mycobacterium avium subsp. paratuberculosis
accggcugcccga

SEQ ID NO: 2869211 - RNA, 14 nt, Mycobacterium avium subsp. paratuberculosis
accggcugcccgac

SEQ ID NO: 2869212 - RNA, 15 nt, Mycobacterium avium subsp. paratuberculosis
accggcugcccgacc

SEQ ID NO: 2869213 - RNA, 19 nt, Mycobacterium avium subsp. paratuberculosis
accggcugcccgacccgca

SEQ ID NO: 2869214 - RNA, 20 nt, Mycobacterium avium subsp. paratuberculosis
accggcugcccgacccgcac

SEQ ID NO: 2869215 - RNA, 22 nt, Mycobacterium avium subsp. paratuberculosis
accggcugcccgacccgcacca

SEQ ID NO: 2869216 - RNA, 19 nt, Mycobacterium avium subsp. paratuberculosis
accggcugcucgcgcugcc

SEQ ID NO: 2869217 - RNA, 15 nt, Mycobacterium avium subsp. paratuberculosis
accggcuggccgagc

SEQ ID NO: 2869218 - RNA, 20 nt, Mycobacterium avium subsp. paratuberculosis
accggcuggccgagcggcug

SEQ ID NO: 2869219 - RNA, 18 nt, Mycobacterium avium subsp. paratuberculosis
accggcuggugcagcagc

SEQ ID NO: 2869220 - RNA, 20 nt, Mycobacterium avium subsp. paratuberculosis
accggcuggugcagcagcug

SEQ ID NO: 2869221 - RNA, 19 nt, Mycobacterium avium subsp. paratuberculosis
accggcuucgggaucagcg

SEQ ID NO: 2869222 - RNA, 20 nt, Mycobacterium avium subsp. paratuberculosis
accggcuugccgaucgccgc

SEQ ID NO: 2869223 - RNA, 15 nt, Mycobacterium avium subsp. paratuberculosis
accggcuuggccacg

SEQ ID NO: 2869224 - RNA, 18 nt, Mycobacterium avium subsp. paratuberculosis
accgggaacagccaggcg

SEQ ID NO: 2869225 - RNA, 16 nt, Mycobacterium avium subsp. paratuberculosis
accgggaagccgagcu

SEQ ID NO: 2869226 - RNA, 18 nt, Mycobacterium avium subsp. paratuberculosis
accgggaaguagggcagc

SEQ ID NO: 2869227 - RNA, 17 nt, Mycobacterium avium subsp. paratuberculosis
accgggacaccgcuggc

SEQ ID NO: 2869228 - RNA, 16 nt, Mycobacterium avium subsp. paratuberculosis
accgggacagccgcgc

SEQ ID NO: 2869229 - RNA, 19 nt, Mycobacterium avium subsp. paratuberculosis
accgggacagccgcgccga

SEQ ID NO: 2869230 - RNA, 20 nt, Mycobacterium avium subsp. paratuberculosis
accgggacagccgcgccgac

SEQ ID NO: 2869231 - RNA, 16 nt, Mycobacterium avium subsp. paratuberculosis
accgggaccagcgcgg

SEQ ID NO: 2869232 - RNA, 17 nt, Mycobacterium avium subsp. paratuberculosis
accgggaccagcgcggu

SEQ ID NO: 2869233 - RNA, 13 nt, Mycobacterium avium subsp. paratuberculosis
accgggaccugcu

SEQ ID NO: 2869234 - RNA, 21 nt, Mycobacterium avium subsp. paratuberculosis
accgggaccugggucugcggc

SEQ ID NO: 2869235 - RNA, 19 nt, Mycobacterium avium subsp. paratuberculosis
accgggacgacggcgccgc

SEQ ID NO: 2869236 - RNA, 20 nt, Mycobacterium avium subsp. paratuberculosis
accgggacgggggugccgac

SEQ ID NO: 2869237 - RNA, 23 nt, Mycobacterium avium subsp. paratuberculosis
accgggacgggggugccgaccgc

SEQ ID NO: 2869238 - RNA, 19 nt, Mycobacterium avium subsp. paratuberculosis
accgggagaacucgacgau

SEQ ID NO: 2869239 - RNA, 18 nt, Mycobacterium avium subsp. paratuberculosis
accgggaucacccucggc

SEQ ID NO: 2869240 - RNA, 16 nt, Mycobacterium avium subsp. paratuberculosis
accgggauccggcgcg

SEQ ID NO: 2869241 - RNA, 20 nt, Mycobacterium avium subsp. paratuberculosis
accgggauccggcgcgccgc

SEQ ID NO: 2869242 - RNA, 17 nt, Mycobacterium avium subsp. paratuberculosis
accgggaucggcggcgg

SEQ ID NO: 2869243 - RNA, 19 nt, Mycobacterium avium subsp. paratuberculosis
accgggaucggcggcgggg

SEQ ID NO: 2869244 - RNA, 22 nt, Mycobacterium avium subsp. paratuberculosis
accgggaucggggugccgccgg

SEQ ID NO: 2869245 - RNA, 19 nt, Mycobacterium avium subsp. paratuberculosis
accgggaucguguggccgc

SEQ ID NO: 2869246 - RNA, 21 nt, Mycobacterium avium subsp. paratuberculosis
accgggaucguguggccgccc

SEQ ID NO: 2869247 - RNA, 20 nt, Mycobacterium avium subsp. paratuberculosis
accgggaugacaaccaucga

SEQ ID NO: 2869248 - RNA, 15 nt, Mycobacterium avium subsp. paratuberculosis
accgggauggugacc

SEQ ID NO: 2869249 - RNA, 18 nt, Mycobacterium avium subsp. paratuberculosis
accgggauggugaccagc

SEQ ID NO: 2869250 - RNA, 21 nt, Mycobacterium avium subsp. paratuberculosis
accgggauggugaccagcgcc

SEQ ID NO: 2869251 - RNA, 22 nt, Mycobacterium avium subsp. paratuberculosis
accgggauggugaccagcgccc

SEQ ID NO: 2869252 - RNA, 13 nt, Mycobacterium avium subsp. paratuberculosis
accgggcacccgg

SEQ ID NO: 2869253 - RNA, 16 nt, Mycobacterium avium subsp. paratuberculosis
accgggcacccggcgc

SEQ ID NO: 2869254 - RNA, 17 nt, Mycobacterium avium subsp. paratuberculosis
accgggcacccggcgcg

SEQ ID NO: 2869255 - RNA, 23 nt, Mycobacterium avium subsp. paratuberculosis
accgggcacccggcgcggccgcc

SEQ ID NO: 2869256 - RNA, 13 nt, Mycobacterium avium subsp. paratuberculosis
accgggcaccgac

SEQ ID NO: 2869257 - RNA, 14 nt, Mycobacterium avium subsp. paratuberculosis
accgggcagccgca

SEQ ID NO: 2869258 - RNA, 22 nt, Mycobacterium avium subsp. paratuberculosis
accgggcagccgcacaccgcgg

SEQ ID NO: 2869259 - RNA, 21 nt, Mycobacterium avium subsp. paratuberculosis
accgggcaguagaacggcccg

SEQ ID NO: 2869260 - RNA, 22 nt, Mycobacterium avium subsp. paratuberculosis
accgggccaacgguucggccgc

SEQ ID NO: 2869261 - RNA, 16 nt, Mycobacterium avium subsp. paratuberculosis
accgggccaggaugac

SEQ ID NO: 2869262 - RNA, 17 nt, Mycobacterium avium subsp. paratuberculosis
accgggccaggaugacc

SEQ ID NO: 2869263 - RNA, 18 nt, Mycobacterium avium subsp. paratuberculosis
accgggccaggaugaccg

SEQ ID NO: 2869264 - RNA, 23 nt, Mycobacterium avium subsp. paratuberculosis
accgggccaggaugaccgcccag

SEQ ID NO: 2869265 - RNA, 18 nt, Mycobacterium avium subsp. paratuberculosis
accgggcccagcucggug

SEQ ID NO: 2869266 - RNA, 17 nt, Mycobacterium avium subsp. paratuberculosis
accgggcccgcccgcag

SEQ ID NO: 2869267 - RNA, 21 nt, Mycobacterium avium subsp. paratuberculosis
accgggcccgcccgcagcggc

SEQ ID NO: 2869268 - RNA, 15 nt, Mycobacterium avium subsp. paratuberculosis
accgggcccggcgcc

SEQ ID NO: 2869269 - RNA, 21 nt, Mycobacterium avium subsp. paratuberculosis
accgggccgaaggcggcgccg

SEQ ID NO: 2869270 - RNA, 22 nt, Mycobacterium avium subsp. paratuberculosis
accgggccgaugaacaugcccu

SEQ ID NO: 2869271 - RNA, 12 nt, Mycobacterium avium subsp. paratuberculosis
accgggccgcac

SEQ ID NO: 2869272 - RNA, 18 nt, Mycobacterium avium subsp. paratuberculosis
accgggccgccaucaccg

SEQ ID NO: 2869273 - RNA, 12 nt, Mycobacterium avium subsp. paratuberculosis
accgggccgcug

SEQ ID NO: 2869274 - RNA, 14 nt, Mycobacterium avium subsp. paratuberculosis
accgggccgcuggc

SEQ ID NO: 2869275 - RNA, 23 nt, Mycobacterium avium subsp. paratuberculosis
accgggccgcuggccgccccgaa

SEQ ID NO: 2869276 - RNA, 17 nt, Mycobacterium avium subsp. paratuberculosis
accgggccgcuggugag

SEQ ID NO: 2869277 - RNA, 24 nt, Mycobacterium avium subsp. paratuberculosis
accgggccgcuggugaggucgcgc

SEQ ID NO: 2869278 - RNA, 16 nt, Mycobacterium avium subsp. paratuberculosis
accgggccugcgcgcc

SEQ ID NO: 2869279 - RNA, 17 nt, Mycobacterium avium subsp. paratuberculosis
accgggccugcgcgccg

SEQ ID NO: 2869280 - RNA, 19 nt, Mycobacterium avium subsp. paratuberculosis
accgggccugcgcgccgau

SEQ ID NO: 2869281 - RNA, 15 nt, Mycobacterium avium subsp. paratuberculosis
accgggcgcgcagau

SEQ ID NO: 2869282 - RNA, 16 nt, Mycobacterium avium subsp. paratuberculosis
accgggcgcgcagauc

SEQ ID NO: 2869283 - RNA, 21 nt, Mycobacterium avium subsp. paratuberculosis
accgggcgcgcagaucgucga

SEQ ID NO: 2869284 - RNA, 14 nt, Mycobacterium avium subsp. paratuberculosis
accgggcgggcugc

SEQ ID NO: 2869285 - RNA, 18 nt, Mycobacterium avium subsp. paratuberculosis
accgggcgggcugcgggc

SEQ ID NO: 2869286 - RNA, 16 nt, Mycobacterium avium subsp. paratuberculosis
accgggcggugaccac

SEQ ID NO: 2869287 - RNA, 20 nt, Mycobacterium avium subsp. paratuberculosis
accgggcggugaccacgccg

SEQ ID NO: 2869288 - RNA, 17 nt, Mycobacterium avium subsp. paratuberculosis
accgggcgucggcggug

SEQ ID NO: 2869289 - RNA, 14 nt, Mycobacterium avium subsp. paratuberculosis
accgggcgucgggg

SEQ ID NO: 2869290 - RNA, 14 nt, Mycobacterium avium subsp. paratuberculosis
accgggcuccagcg

SEQ ID NO: 2869291 - RNA, 16 nt, Mycobacterium avium subsp. paratuberculosis
accgggcugucgggca

SEQ ID NO: 2869292 - RNA, 20 nt, Mycobacterium avium subsp. paratuberculosis
accgggcugucgggcaggcc

SEQ ID NO: 2869293 - RNA, 15 nt, Mycobacterium avium subsp. paratuberculosis
accggggccagcacg

SEQ ID NO: 2869294 - RNA, 19 nt, Mycobacterium avium subsp. paratuberculosis
accggggccagcacgcccc

SEQ ID NO: 2869295 - RNA, 14 nt, Mycobacterium avium subsp. paratuberculosis
accggggccgcacc

SEQ ID NO: 2869296 - RNA, 15 nt, Mycobacterium avium subsp. paratuberculosis
accggggcgccccgc

SEQ ID NO: 2869297 - RNA, 19 nt, Mycobacterium avium subsp. paratuberculosis
accggggcgccccgcuggu

SEQ ID NO: 2869298 - RNA, 14 nt, Mycobacterium avium subsp. paratuberculosis
accggggugccgcc

SEQ ID NO: 2869299 - RNA, 19 nt, Mycobacterium avium subsp. paratuberculosis
accggguacaccggcucgc

SEQ ID NO: 2869300 - RNA, 21 nt, Mycobacterium avium subsp. paratuberculosis
accggguacaccggcucgcug

SEQ ID NO: 2869301 - RNA, 15 nt, Mycobacterium avium subsp. paratuberculosis
accggguagcccgcg

SEQ ID NO: 2869302 - RNA, 17 nt, Mycobacterium avium subsp. paratuberculosis
accgggucagcaccacc

SEQ ID NO: 2869303 - RNA, 22 nt, Mycobacterium avium subsp. paratuberculosis
accggguccgaggugaucgcga

SEQ ID NO: 2869304 - RNA, 16 nt, Mycobacterium avium subsp. paratuberculosis
accgggucgccaaggu

SEQ ID NO: 2869305 - RNA, 14 nt, Mycobacterium avium subsp. paratuberculosis
accgggucgccgau

SEQ ID NO: 2869306 - RNA, 13 nt, Mycobacterium avium subsp. paratuberculosis
accgggucguccg

SEQ ID NO: 2869307 - RNA, 16 nt, Mycobacterium avium subsp. paratuberculosis
accgggucguccgcga

SEQ ID NO: 2869308 - RNA, 13 nt, Mycobacterium avium subsp. paratuberculosis
accgggucgucgc

SEQ ID NO: 2869309 - RNA, 14 nt, Mycobacterium avium subsp. paratuberculosis
accgggucugccac

SEQ ID NO: 2869310 - RNA, 22 nt, Mycobacterium avium subsp. paratuberculosis
accgggucugccacgcccaccg

SEQ ID NO: 2869311 - RNA, 15 nt, Mycobacterium avium subsp. paratuberculosis
acgaccaggaugccc

SEQ ID NO: 2869312 - RNA, 17 nt, Mycobacterium avium subsp. paratuberculosis
acgaccaggaugcccag

SEQ ID NO: 2869313 - RNA, 19 nt, Mycobacterium avium subsp. paratuberculosis
acgaccaggaugcccagga

SEQ ID NO: 2869314 - RNA, 21 nt, Mycobacterium avium subsp. paratuberculosis
acgaccaggaugcccaggaug

SEQ ID NO: 2869315 - RNA, 13 nt, Mycobacterium avium subsp. paratuberculosis
acgaccaggucca

SEQ ID NO: 2869316 - RNA, 20 nt, Mycobacterium avium subsp. paratuberculosis
acgaccagguccaccccgcc

SEQ ID NO: 2869317 - RNA, 21 nt, Mycobacterium avium subsp. paratuberculosis
acgaccaguucgcccuggccg

SEQ ID NO: 2869318 - RNA, 12 nt, Mycobacterium avium subsp. paratuberculosis
acgaccaucagc

SEQ ID NO: 2869319 - RNA, 18 nt, Mycobacterium avium subsp. paratuberculosis
acgaccaucagcgcccgg

SEQ ID NO: 2869320 - RNA, 14 nt, Mycobacterium avium subsp. paratuberculosis
acgaccaugucggc

SEQ ID NO: 2869321 - RNA, 15 nt, Mycobacterium avium subsp. paratuberculosis
acgaccccgcccacg

SEQ ID NO: 2869322 - RNA, 14 nt, Mycobacterium avium subsp. paratuberculosis
acgaccccggcggc

SEQ ID NO: 2869323 - RNA, 18 nt, Mycobacterium avium subsp. paratuberculosis
acgaccccggcggcaccg

SEQ ID NO: 2869324 - RNA, 16 nt, Mycobacterium avium subsp. paratuberculosis
acgacccggccaccgc

SEQ ID NO: 2869325 - RNA, 17 nt, Mycobacterium avium subsp. paratuberculosis
acgacccggccaccgcc

SEQ ID NO: 2869326 - RNA, 15 nt, Mycobacterium avium subsp. paratuberculosis
acgacccgucggggu

SEQ ID NO: 2869327 - RNA, 20 nt, Mycobacterium avium subsp. paratuberculosis
acgaccgcaccgaccagcgg

SEQ ID NO: 2869328 - RNA, 15 nt, Mycobacterium avium subsp. paratuberculosis
acgaccgccagcagc

SEQ ID NO: 2869329 - RNA, 14 nt, Mycobacterium avium subsp. paratuberculosis
acgaccggcagcac

SEQ ID NO: 2869330 - RNA, 20 nt, Mycobacterium avium subsp. paratuberculosis
acgaccggcagcaccggccg

SEQ ID NO: 2869331 - RNA, 18 nt, Mycobacterium avium subsp. paratuberculosis
acgaccggcagccgcgcc

SEQ ID NO: 2869332 - RNA, 13 nt, Mycobacterium avium subsp. paratuberculosis
acgaccggguccg

SEQ ID NO: 2869333 - RNA, 22 nt, Mycobacterium avium subsp. paratuberculosis
acgaccggguccgaggugaucg

SEQ ID NO: 2869334 - RNA, 20 nt, Mycobacterium avium subsp. paratuberculosis
acgaccgggucugccacgcc

SEQ ID NO: 2869335 - RNA, 15 nt, Mycobacterium avium subsp. paratuberculosis
acgaccguagccggu

SEQ ID NO: 2869336 - RNA, 19 nt, Mycobacterium avium subsp. paratuberculosis
acgaccguagccggucggc

SEQ ID NO: 2869337 - RNA, 22 nt, Mycobacterium avium subsp. paratuberculosis
acgaccguagccggucggcccg

SEQ ID NO: 2869338 - RNA, 20 nt, Mycobacterium avium subsp. paratuberculosis
acgaccucccccgacgccga

SEQ ID NO: 2869339 - RNA, 21 nt, Mycobacterium avium subsp. paratuberculosis
acgaccucccccgacgccgac

SEQ ID NO: 2869340 - RNA, 18 nt, Mycobacterium avium subsp. paratuberculosis
acgaccucgcccgccgcg

SEQ ID NO: 2869341 - RNA, 20 nt, Mycobacterium avium subsp. paratuberculosis
acgaccucgcccgccgcgac

SEQ ID NO: 2869342 - RNA, 21 nt, Mycobacterium avium subsp. paratuberculosis
acgaccucgcccgccgcgacg

SEQ ID NO: 2869343 - RNA, 14 nt, Mycobacterium avium subsp. paratuberculosis
acgaccucgccgac

SEQ ID NO: 2869344 - RNA, 16 nt, Mycobacterium avium subsp. paratuberculosis
acgaccucgucgucga

SEQ ID NO: 2869345 - RNA, 12 nt, Mycobacterium avium subsp. paratuberculosis
acgaccuggcgg

SEQ ID NO: 2869346 - RNA, 17 nt, Mycobacterium avium subsp. paratuberculosis
acgaccuggcgggccag

SEQ ID NO: 2869347 - RNA, 17 nt, Mycobacterium avium subsp. paratuberculosis
acgaccugggcgccguc

SEQ ID NO: 2869348 - RNA, 20 nt, Mycobacterium avium subsp. paratuberculosis
acgaccuggucgccgccguc

SEQ ID NO: 2869349 - RNA, 19 nt, Mycobacterium avium subsp. paratuberculosis
acgaccugguugacaccac

SEQ ID NO: 2869350 - RNA, 12 nt, Mycobacterium avium subsp. paratuberculosis
acgaccuugucg

SEQ ID NO: 2869351 - RNA, 18 nt, Mycobacterium avium subsp. paratuberculosis
acgaccuugucgcgcacc

SEQ ID NO: 2869352 - RNA, 21 nt, Mycobacterium avium subsp. paratuberculosis
acgaccuugucgcgcacccgc

SEQ ID NO: 2869353 - RNA, 22 nt, Mycobacterium avium subsp. paratuberculosis
acgaccuugucgcgcacccgca

SEQ ID NO: 2869354 - RNA, 20 nt, Mycobacterium avium subsp. paratuberculosis
acgacgaaaaugaugccgac

SEQ ID NO: 2869355 - RNA, 21 nt, Mycobacterium avium subsp. paratuberculosis
acgacgaacaccaccggcaac

SEQ ID NO: 2869356 - RNA, 18 nt, Mycobacterium avium subsp. paratuberculosis
acgacgaacgcggugagc

SEQ ID NO: 2869357 - RNA, 15 nt, Mycobacterium avium subsp. paratuberculosis
acgacgaacggguag

SEQ ID NO: 2869358 - RNA, 18 nt, Mycobacterium avium subsp. paratuberculosis
acgacgaaucccgccucg

SEQ ID NO: 2869359 - RNA, 18 nt, Mycobacterium avium subsp. paratuberculosis
acgacgacaggucgagca

SEQ ID NO: 2869360 - RNA, 14 nt, Mycobacterium avium subsp. paratuberculosis
acgacgaccgcgac

SEQ ID NO: 2869361 - RNA, 16 nt, Mycobacterium avium subsp. paratuberculosis
acgacgaccgcguccg

SEQ ID NO: 2869362 - RNA, 17 nt, Mycobacterium avium subsp. paratuberculosis
acgacgaccgcguccga

SEQ ID NO: 2869363 - RNA, 23 nt, Mycobacterium avium subsp. paratuberculosis
acgacgaccucccccgacgccga

SEQ ID NO: 2869364 - RNA, 12 nt, Mycobacterium avium subsp. paratuberculosis
acgacgacgucg

SEQ ID NO: 2869365 - RNA, 15 nt, Mycobacterium avium subsp. paratuberculosis
acgacgacgucgacg

SEQ ID NO: 2869366 - RNA, 16 nt, Mycobacterium avium subsp. paratuberculosis
acgacgacgucgacga

SEQ ID NO: 2869367 - RNA, 15 nt, Mycobacterium avium subsp. paratuberculosis
acgacgagccgacgu

SEQ ID NO: 2869368 - RNA, 14 nt, Mycobacterium avium subsp. paratuberculosis
acgacgccaccgcg

SEQ ID NO: 2869369 - RNA, 22 nt, Mycobacterium avium subsp. paratuberculosis
acgacgccaguucgucggccgu

SEQ ID NO: 2869370 - RNA, 11 nt, Mycobacterium avium subsp. paratuberculosis
acgacgccgaa

SEQ ID NO: 2869371 - RNA, 12 nt, Mycobacterium avium subsp. paratuberculosis
acgacgccgaac

SEQ ID NO: 2869372 - RNA, 18 nt, Mycobacterium avium subsp. paratuberculosis
acgacgccgauccgcagc

SEQ ID NO: 2869373 - RNA, 16 nt, Mycobacterium avium subsp. paratuberculosis
acgacgccgccgaggg

SEQ ID NO: 2869374 - RNA, 23 nt, Mycobacterium avium subsp. paratuberculosis
acgacgccgucacggaucgccca

SEQ ID NO: 2869375 - RNA, 14 nt, Mycobacterium avium subsp. paratuberculosis
acgacgcgcucagc

SEQ ID NO: 2869376 - RNA, 13 nt, Mycobacterium avium subsp. paratuberculosis
acgacgcggcgcg

SEQ ID NO: 2869377 - RNA, 14 nt, Mycobacterium avium subsp. paratuberculosis
acgacgcggcgcgc

SEQ ID NO: 2869378 - RNA, 16 nt, Mycobacterium avium subsp. paratuberculosis
acgacgcggcgcgcga

SEQ ID NO: 2869379 - RNA, 23 nt, Mycobacterium avium subsp. paratuberculosis
acgacgcggucgucgucgucggu

SEQ ID NO: 2869380 - RNA, 17 nt, Mycobacterium avium subsp. paratuberculosis
acgacgcggucugcggu

SEQ ID NO: 2869381 - RNA, 22 nt, Mycobacterium avium subsp. paratuberculosis
acgacgcggucugcggugcgcc

SEQ ID NO: 2869382 - RNA, 24 nt, Mycobacterium avium subsp. paratuberculosis
acgacgcggucugcggugcgccca

SEQ ID NO: 2869383 - RNA, 19 nt, Mycobacterium avium subsp. paratuberculosis
acgacggccaccgcgacgc

SEQ ID NO: 2869384 - RNA, 12 nt, Mycobacterium avium subsp. paratuberculosis
acgacggccagc

SEQ ID NO: 2869385 - RNA, 13 nt, Mycobacterium avium subsp. paratuberculosis
acgacggcgccgc

SEQ ID NO: 2869386 - RNA, 14 nt, Mycobacterium avium subsp. paratuberculosis
acgacggcgccgcc

SEQ ID NO: 2869387 - RNA, 15 nt, Mycobacterium avium subsp. paratuberculosis
acgacggcgccgccc

SEQ ID NO: 2869388 - RNA, 16 nt, Mycobacterium avium subsp. paratuberculosis
acgacggcgccgcccg

SEQ ID NO: 2869389 - RNA, 19 nt, Mycobacterium avium subsp. paratuberculosis
acgacggcgccgcccgggc

SEQ ID NO: 2869390 - RNA, 20 nt, Mycobacterium avium subsp. paratuberculosis
acgacggcgccgcccgggcc

SEQ ID NO: 2869391 - RNA, 14 nt, Mycobacterium avium subsp. paratuberculosis
acgacggcgcuggc

SEQ ID NO: 2869392 - RNA, 23 nt, Mycobacterium avium subsp. paratuberculosis
acgacggcgcuggccgcggccag

SEQ ID NO: 2869393 - RNA, 11 nt, Mycobacterium avium subsp. paratuberculosis
acgacggcggg

SEQ ID NO: 2869394 - RNA, 17 nt, Mycobacterium avium subsp. paratuberculosis
acgacgggcagggugac

SEQ ID NO: 2869395 - RNA, 19 nt, Mycobacterium avium subsp. paratuberculosis
acgacgggcagggugaccg

SEQ ID NO: 2869396 - RNA, 23 nt, Mycobacterium avium subsp. paratuberculosis
acgacgggcagggugaccgaggc

SEQ ID NO: 2869397 - RNA, 14 nt, Mycobacterium avium subsp. paratuberculosis
acgacggucacggc

SEQ ID NO: 2869398 - RNA, 17 nt, Mycobacterium avium subsp. paratuberculosis
acgacggucacggccgc

SEQ ID NO: 2869399 - RNA, 22 nt, Mycobacterium avium subsp. paratuberculosis
acgacggucacggccgccagca

SEQ ID NO: 2869400 - RNA, 15 nt, Mycobacterium avium subsp. paratuberculosis
acgacggugcgcccg

SEQ ID NO: 2869401 - RNA, 17 nt, Mycobacterium avium subsp. paratuberculosis
acgacggugcgcccguc

SEQ ID NO: 2869402 - RNA, 13 nt, Mycobacterium avium subsp. paratuberculosis
acgacguccgggc

SEQ ID NO: 2869403 - RNA, 16 nt, Mycobacterium avium subsp. paratuberculosis
acgacguccgggccgc

SEQ ID NO: 2869404 - RNA, 11 nt, Mycobacterium avium subsp. paratuberculosis
acgacgucgac

SEQ ID NO: 2869405 - RNA, 16 nt, Mycobacterium avium subsp. paratuberculosis
acgacgucgaccgcgc

SEQ ID NO: 2869406 - RNA, 17 nt, Mycobacterium avium subsp. paratuberculosis
acgacgucgaccgcgcc

SEQ ID NO: 2869407 - RNA, 20 nt, Mycobacterium avium subsp. paratuberculosis
acgacgucgaccgcgccggg

SEQ ID NO: 2869408 - RNA, 17 nt, Mycobacterium avium subsp. paratuberculosis
acgacgucgacgacccg

SEQ ID NO: 2869409 - RNA, 13 nt, Mycobacterium avium subsp. paratuberculosis
acgacgucgacgu

SEQ ID NO: 2869410 - RNA, 15 nt, Mycobacterium avium subsp. paratuberculosis
acgacgucgcgcagg

SEQ ID NO: 2869411 - RNA, 19 nt, Mycobacterium avium subsp. paratuberculosis
acgacgucgucguccucgu

SEQ ID NO: 2869412 - RNA, 19 nt, Mycobacterium avium subsp. paratuberculosis
acgacgucugggccgccga

SEQ ID NO: 2869413 - RNA, 19 nt, Mycobacterium avium subsp. paratuberculosis
acgacgugauaguggucgu

SEQ ID NO: 2869414 - RNA, 22 nt, Mycobacterium avium subsp. paratuberculosis
acgacgugauaguggucgucgu

SEQ ID NO: 2869415 - RNA, 13 nt, Mycobacterium avium subsp. paratuberculosis
acgacgugcccuu

SEQ ID NO: 2869416 - RNA, 23 nt, Mycobacterium avium subsp. paratuberculosis
acgacgugguggaugaugccggc

SEQ ID NO: 2869417 - RNA, 21 nt, Mycobacterium avium subsp. paratuberculosis
acgacguguucaacgcgccga

SEQ ID NO: 2869418 - RNA, 17 nt, Mycobacterium avium subsp. paratuberculosis
acgacguugcgggccag

SEQ ID NO: 2869419 - RNA, 16 nt, Mycobacterium avium subsp. paratuberculosis
acgacguuggccagca

SEQ ID NO: 2869420 - RNA, 18 nt, Mycobacterium avium subsp. paratuberculosis
acgacguuggccagcacc

SEQ ID NO: 2869421 - RNA, 23 nt, Mycobacterium avium subsp. paratuberculosis
acgacguuggccagcaccgcggc

SEQ ID NO: 2869422 - RNA, 18 nt, Mycobacterium avium subsp. paratuberculosis
acgacucggccuccgcgc

SEQ ID NO: 2869423 - RNA, 22 nt, Mycobacterium avium subsp. paratuberculosis
acgacucggccuccgcgcgcgg

SEQ ID NO: 2869424 - RNA, 15 nt, Mycobacterium avium subsp. paratuberculosis
acgacucuuccagga

SEQ ID NO: 2869425 - RNA, 13 nt, Mycobacterium avium subsp. paratuberculosis
acgacugcgcggc

SEQ ID NO: 2869426 - RNA, 15 nt, Mycobacterium avium subsp. paratuberculosis
acgacugcgcggccg

SEQ ID NO: 2869427 - RNA, 18 nt, Mycobacterium avium subsp. paratuberculosis
acgacugcgcggccggcg

SEQ ID NO: 2869428 - RNA, 20 nt, Mycobacterium avium subsp. paratuberculosis
acgacugcgcggccggcgug

SEQ ID NO: 2869429 - RNA, 22 nt, Mycobacterium avium subsp. paratuberculosis
acgacugcgcggccggcgugua

SEQ ID NO: 2869430 - RNA, 15 nt, Mycobacterium avium subsp. paratuberculosis
acgacuggcggcggc

SEQ ID NO: 2869431 - RNA, 16 nt, Mycobacterium avium subsp. paratuberculosis
acgacuggcggcggcg

SEQ ID NO: 2869432 - RNA, 23 nt, Mycobacterium avium subsp. paratuberculosis
acgacugggugcgcgggcgcccg

SEQ ID NO: 2869433 - RNA, 17 nt, Mycobacterium avium subsp. paratuberculosis
acgacuucacaggccgc

SEQ ID NO: 2869434 - RNA, 14 nt, Mycobacterium avium subsp. paratuberculosis
acgacuucggccuc

SEQ ID NO: 2869435 - RNA, 15 nt, Mycobacterium avium subsp. paratuberculosis
acgacuucggccucg

SEQ ID NO: 2869436 - RNA, 17 nt, Mycobacterium avium subsp. paratuberculosis
acgagaaggcggcgucg

SEQ ID NO: 2869437 - RNA, 23 nt, Mycobacterium avium subsp. paratuberculosis
acgagagcggaucggcggcgacg

SEQ ID NO: 2869438 - RNA, 20 nt, Mycobacterium avium subsp. paratuberculosis
acgagaucgguuggcucgca

SEQ ID NO: 2869439 - RNA, 13 nt, Mycobacterium avium subsp. paratuberculosis
acgagaugcccca

SEQ ID NO: 2869440 - RNA, 20 nt, Mycobacterium avium subsp. paratuberculosis
acgagcagcaagagcaggcu

SEQ ID NO: 2869441 - RNA, 13 nt, Mycobacterium avium subsp. paratuberculosis
acgagcagccgau

SEQ ID NO: 2869442 - RNA, 17 nt, Mycobacterium avium subsp. paratuberculosis
acgagcagcgugcugac

SEQ ID NO: 2869443 - RNA, 22 nt, Mycobacterium avium subsp. paratuberculosis
acgagcagcgugcugacgucgu

SEQ ID NO: 2869444 - RNA, 17 nt, Mycobacterium avium subsp. paratuberculosis
acgagcccagccgucgc

SEQ ID NO: 2869445 - RNA, 16 nt, Mycobacterium avium subsp. paratuberculosis
acgagcccgccggcgg

SEQ ID NO: 2869446 - RNA, 13 nt, Mycobacterium avium subsp. paratuberculosis
acgagcccgcgcc

SEQ ID NO: 2869447 - RNA, 15 nt, Mycobacterium avium subsp. paratuberculosis
acgagcccgcgccca

SEQ ID NO: 2869448 - RNA, 12 nt, Mycobacterium avium subsp. paratuberculosis
acgagccgacgu

SEQ ID NO: 2869449 - RNA, 16 nt, Mycobacterium avium subsp. paratuberculosis
acgagccgccgcgggu

SEQ ID NO: 2869450 - RNA, 22 nt, Mycobacterium avium subsp. paratuberculosis
acgagcgcgccgagguggcccg

SEQ ID NO: 2869451 - RNA, 13 nt, Mycobacterium avium subsp. paratuberculosis
acgagcgggccga

SEQ ID NO: 2869452 - RNA, 16 nt, Mycobacterium avium subsp. paratuberculosis
acgagcucaccgccga

SEQ ID NO: 2869453 - RNA, 17 nt, Mycobacterium avium subsp. paratuberculosis
acgagcucaccgccgau

SEQ ID NO: 2869454 - RNA, 13 nt, Mycobacterium avium subsp. paratuberculosis
acgagcucgccgc

SEQ ID NO: 2869455 - RNA, 19 nt, Mycobacterium avium subsp. paratuberculosis
acgagcucgccgcugucgu

SEQ ID NO: 2869456 - RNA, 18 nt, Mycobacterium avium subsp. paratuberculosis
acgagcugacgaacgcgc

SEQ ID NO: 2869457 - RNA, 21 nt, Mycobacterium avium subsp. paratuberculosis
acgagcugacgaacgcgccgc

SEQ ID NO: 2869458 - RNA, 19 nt, Mycobacterium avium subsp. paratuberculosis
acgaggagggugucggcgg

SEQ ID NO: 2869459 - RNA, 20 nt, Mycobacterium avium subsp. paratuberculosis
acgaggagggugucggcggg

SEQ ID NO: 2869460 - RNA, 17 nt, Mycobacterium avium subsp. paratuberculosis
acgaggcacggcccgcu

SEQ ID NO: 2869461 - RNA, 19 nt, Mycobacterium avium subsp. paratuberculosis
acgaggcacggcccgcucg

SEQ ID NO: 2869462 - RNA, 17 nt, Mycobacterium avium subsp. paratuberculosis
acgaggccagggcccgc

SEQ ID NO: 2869463 - RNA, 18 nt, Mycobacterium avium subsp. paratuberculosis
acgaggccagggcccgca

SEQ ID NO: 2869464 - RNA, 20 nt, Mycobacterium avium subsp. paratuberculosis
acgaggccagggcccgcagc

SEQ ID NO: 2869465 - RNA, 22 nt, Mycobacterium avium subsp. paratuberculosis
acgaggccagggcccgcagccg

SEQ ID NO: 2869466 - RNA, 18 nt, Mycobacterium avium subsp. paratuberculosis
acgaggcccacgaaccgg

SEQ ID NO: 2869467 - RNA, 16 nt, Mycobacterium avium subsp. paratuberculosis
acgaggcccggacggc

SEQ ID NO: 2869468 - RNA, 13 nt, Mycobacterium avium subsp. paratuberculosis
acgaggccgacgu

SEQ ID NO: 2869469 - RNA, 16 nt, Mycobacterium avium subsp. paratuberculosis
acgaggccgcgccgug

SEQ ID NO: 2869470 - RNA, 21 nt, Mycobacterium avium subsp. paratuberculosis
acgaggccgcgccgugcgcca

SEQ ID NO: 2869471 - RNA, 22 nt, Mycobacterium avium subsp. paratuberculosis
acgaggccgcgccgugcgccag

SEQ ID NO: 2869472 - RNA, 18 nt, Mycobacterium avium subsp. paratuberculosis
acgaggccgggcuggcgc

SEQ ID NO: 2869473 - RNA, 17 nt, Mycobacterium avium subsp. paratuberculosis
acgaggcgugcagcccg

SEQ ID NO: 2869474 - RNA, 18 nt, Mycobacterium avium subsp. paratuberculosis
acgaggcgugcagcccgc

SEQ ID NO: 2869475 - RNA, 18 nt, Mycobacterium avium subsp. paratuberculosis
acgaggcugugggccagc

SEQ ID NO: 2869476 - RNA, 22 nt, Mycobacterium avium subsp. paratuberculosis
acgaggcugugggccagcagcg

SEQ ID NO: 2869477 - RNA, 20 nt, Mycobacterium avium subsp. paratuberculosis
acgaggggcagcagcgccca

SEQ ID NO: 2869478 - RNA, 14 nt, Mycobacterium avium subsp. paratuberculosis
acgaggugaccggc

SEQ ID NO: 2869479 - RNA, 15 nt, Mycobacterium avium subsp. paratuberculosis
acgaguaaccggugc

SEQ ID NO: 2869480 - RNA, 19 nt, Mycobacterium avium subsp. paratuberculosis
acgaguaggcggcuccgau

SEQ ID NO: 2869481 - RNA, 22 nt, Mycobacterium avium subsp. paratuberculosis
acgaguggucggccgcccacgu

SEQ ID NO: 2869482 - RNA, 21 nt, Mycobacterium avium subsp. paratuberculosis
acgauacgcuguggggcccac

SEQ ID NO: 2869483 - RNA, 15 nt, Mycobacterium avium subsp. paratuberculosis
acgaucaccaccacc

SEQ ID NO: 2869484 - RNA, 15 nt, Mycobacterium avium subsp. paratuberculosis
acgaucaccggcuug

SEQ ID NO: 2869485 - RNA, 21 nt, Mycobacterium avium subsp. paratuberculosis
acgaucagcacgucgcggccc

SEQ ID NO: 2869486 - RNA, 23 nt, Mycobacterium avium subsp. paratuberculosis
acgaucagcagaugcgugcggug

SEQ ID NO: 2869487 - RNA, 15 nt, Mycobacterium avium subsp. paratuberculosis
acgaucagcgcgucg

SEQ ID NO: 2869488 - RNA, 17 nt, Mycobacterium avium subsp. paratuberculosis
acgauccacagcgcgaa

SEQ ID NO: 2869489 - RNA, 13 nt, Mycobacterium avium subsp. paratuberculosis
acgaucccggcga

SEQ ID NO: 2869490 - RNA, 22 nt, Mycobacterium avium subsp. paratuberculosis
acgaucccggcgagcacgccgc

SEQ ID NO: 2869491 - RNA, 13 nt, Mycobacterium avium subsp. paratuberculosis
acgauccgcgcgg

SEQ ID NO: 2869492 - RNA, 14 nt, Mycobacterium avium subsp. paratuberculosis
acgauccgggccgg

SEQ ID NO: 2869493 - RNA, 20 nt, Mycobacterium avium subsp. paratuberculosis
acgauccgggccggucgguc

SEQ ID NO: 2869494 - RNA, 21 nt, Mycobacterium avium subsp. paratuberculosis
acgauccgggccggucgguca

SEQ ID NO: 2869495 - RNA, 14 nt, Mycobacterium avium subsp. paratuberculosis
acgaucgcgccggc

SEQ ID NO: 2869496 - RNA, 16 nt, Mycobacterium avium subsp. paratuberculosis
acgaucgcgccggccg

SEQ ID NO: 2869497 - RNA, 22 nt, Mycobacterium avium subsp. paratuberculosis
acgaucgcggugacgcgccggc

SEQ ID NO: 2869498 - RNA, 15 nt, Mycobacterium avium subsp. paratuberculosis
acgaucggcagcgcc

SEQ ID NO: 2869499 - RNA, 16 nt, Mycobacterium avium subsp. paratuberculosis
acgaucggcuccagcg

SEQ ID NO: 2869500 - RNA, 18 nt, Mycobacterium avium subsp. paratuberculosis
acgaucggcuccagcgcc

SEQ ID NO: 2869501 - RNA, 11 nt, Mycobacterium avium subsp. paratuberculosis
acgaucgggcg

SEQ ID NO: 2869502 - RNA, 20 nt, Mycobacterium avium subsp. paratuberculosis
acgaucgucaccgugccguc

SEQ ID NO: 2869503 - RNA, 16 nt, Mycobacterium avium subsp. paratuberculosis
acgaucgucgacguca

SEQ ID NO: 2869504 - RNA, 23 nt, Mycobacterium avium subsp. paratuberculosis
acgaucgucgacgucaacaccgu

SEQ ID NO: 2869505 - RNA, 20 nt, Mycobacterium avium subsp. paratuberculosis
acgaucucccaacgcagcgc

SEQ ID NO: 2869506 - RNA, 14 nt, Mycobacterium avium subsp. paratuberculosis
acgaucucgccguc

SEQ ID NO: 2869507 - RNA, 13 nt, Mycobacterium avium subsp. paratuberculosis
acgaucugcacac

SEQ ID NO: 2869508 - RNA, 13 nt, Mycobacterium avium subsp. paratuberculosis
acgaucugcaggc

SEQ ID NO: 2869509 - RNA, 16 nt, Mycobacterium avium subsp. paratuberculosis
acgaucugcaggccga

SEQ ID NO: 2869510 - RNA, 19 nt, Mycobacterium avium subsp. paratuberculosis
acgaucuugccgaacaggc

SEQ ID NO: 2869511 - RNA, 18 nt, Mycobacterium avium subsp. paratuberculosis
acgaugaaaccccagccg

SEQ ID NO: 2869512 - RNA, 22 nt, Mycobacterium avium subsp. paratuberculosis
acgaugaaaccccagccggccg

SEQ ID NO: 2869513 - RNA, 15 nt, Mycobacterium avium subsp. paratuberculosis
acgaugagggugaug

SEQ ID NO: 2869514 - RNA, 24 nt, Mycobacterium avium subsp. paratuberculosis
acgaugauccuggccuggucggcc

SEQ ID NO: 2869515 - RNA, 20 nt, Mycobacterium avium subsp. paratuberculosis
acgaugaugucgcccggcgg

SEQ ID NO: 2869516 - RNA, 23 nt, Mycobacterium avium subsp. paratuberculosis
acgaugaugucggccggcaguuc

SEQ ID NO: 2869517 - RNA, 17 nt, Mycobacterium avium subsp. paratuberculosis
acgaugcccagccccuc

SEQ ID NO: 2869518 - RNA, 18 nt, Mycobacterium avium subsp. paratuberculosis
acgaugcccagccccucg

SEQ ID NO: 2869519 - RNA, 23 nt, Mycobacterium avium subsp. paratuberculosis
acgaugcccggggugcuggcgua

SEQ ID NO: 2869520 - RNA, 18 nt, Mycobacterium avium subsp. paratuberculosis
acgaugcccuuggccagc

SEQ ID NO: 2869521 - RNA, 22 nt, Mycobacterium avium subsp. paratuberculosis
acgaugcccuuggccagcagug

SEQ ID NO: 2869522 - RNA, 23 nt, Mycobacterium avium subsp. paratuberculosis
acgaugcccuuggccagcagugc

SEQ ID NO: 2869523 - RNA, 14 nt, Mycobacterium avium subsp. paratuberculosis
acgaugccgcggcg

SEQ ID NO: 2869524 - RNA, 15 nt, Mycobacterium avium subsp. paratuberculosis
acgaugccggccggg

SEQ ID NO: 2869525 - RNA, 18 nt, Mycobacterium avium subsp. paratuberculosis
acgaugccggccgggacg

SEQ ID NO: 2869526 - RNA, 14 nt, Mycobacterium avium subsp. paratuberculosis
acgaugccggcguc

SEQ ID NO: 2869527 - RNA, 13 nt, Mycobacterium avium subsp. paratuberculosis
acgaugccgggca

SEQ ID NO: 2869528 - RNA, 21 nt, Mycobacterium avium subsp. paratuberculosis
acgaugcgcacccccggggcc

SEQ ID NO: 2869529 - RNA, 13 nt, Mycobacterium avium subsp. paratuberculosis
acgaugcgcugcu

SEQ ID NO: 2869530 - RNA, 12 nt, Mycobacterium avium subsp. paratuberculosis
acgaugcggccg

SEQ ID NO: 2869531 - RNA, 18 nt, Mycobacterium avium subsp. paratuberculosis
acgaugcggccguuggcc

SEQ ID NO: 2869532 - RNA, 13 nt, Mycobacterium avium subsp. paratuberculosis
acgaugcggggcc

SEQ ID NO: 2869533 - RNA, 16 nt, Mycobacterium avium subsp. paratuberculosis
acgaugcugucgcggg

SEQ ID NO: 2869534 - RNA, 23 nt, Mycobacterium avium subsp. paratuberculosis
acgauggccaggcccagcccggc

SEQ ID NO: 2869535 - RNA, 19 nt, Mycobacterium avium subsp. paratuberculosis
acgauggcccggaccgccg

SEQ ID NO: 2869536 - RNA, 20 nt, Mycobacterium avium subsp. paratuberculosis
acgauggcgaccgcgcaggc

SEQ ID NO: 2869537 - RNA, 15 nt, Mycobacterium avium subsp. paratuberculosis
acgauggcgcggcgc

SEQ ID NO: 2869538 - RNA, 18 nt, Mycobacterium avium subsp. paratuberculosis
acgauggcgcggcgcacc

SEQ ID NO: 2869539 - RNA, 22 nt, Mycobacterium avium subsp. paratuberculosis
acgauggcgcggcgcaccgccc

SEQ ID NO: 2869540 - RNA, 23 nt, Mycobacterium avium subsp. paratuberculosis
acgauggcgcggcgcaccgcccg

SEQ ID NO: 2869541 - RNA, 14 nt, Mycobacterium avium subsp. paratuberculosis
acgaugggccgccc

SEQ ID NO: 2869542 - RNA, 15 nt, Mycobacterium avium subsp. paratuberculosis
acgauguccgccggc

SEQ ID NO: 2869543 - RNA, 20 nt, Mycobacterium avium subsp. paratuberculosis
acgaugucgaaacccaggaa

SEQ ID NO: 2869544 - RNA, 22 nt, Mycobacterium avium subsp. paratuberculosis
acgaugucgacccgcggcgccg

SEQ ID NO: 2869545 - RNA, 19 nt, Mycobacterium avium subsp. paratuberculosis
acgaugucgaugacggcgg

SEQ ID NO: 2869546 - RNA, 21 nt, Mycobacterium avium subsp. paratuberculosis
acgaugucgucgccgguggcc

SEQ ID NO: 2869547 - RNA, 22 nt, Mycobacterium avium subsp. paratuberculosis
acgauguguaacaacucgccgg

SEQ ID NO: 2869548 - RNA, 20 nt, Mycobacterium avium subsp. paratuberculosis
acgauguugaugucgcgcgg

SEQ ID NO: 2869549 - RNA, 21 nt, Mycobacterium avium subsp. paratuberculosis
acgauguugaugucgcgcggc

SEQ ID NO: 2869550 - RNA, 22 nt, Mycobacterium avium subsp. paratuberculosis
acgauguugaugucgcgcggcu

SEQ ID NO: 2869551 - RNA, 22 nt, Mycobacterium avium subsp. paratuberculosis
acgauguuggcgacgacggcgg

SEQ ID NO: 2869552 - RNA, 20 nt, Mycobacterium avium subsp. paratuberculosis
acgauucuugaccaccuugg

SEQ ID NO: 2869553 - RNA, 15 nt, Mycobacterium avium subsp. paratuberculosis
acgauugucggggcc

SEQ ID NO: 2869554 - RNA, 22 nt, Mycobacterium avium subsp. paratuberculosis
acgauuuccgguuccucggcgu

SEQ ID NO: 2869555 - RNA, 17 nt, Mycobacterium avium subsp. paratuberculosis
acgauuugggcgguccg

SEQ ID NO: 2869556 - RNA, 19 nt, Mycobacterium avium subsp. paratuberculosis
acgcaaaacggugcggccu

SEQ ID NO: 2869557 - RNA, 21 nt, Mycobacterium avium subsp. paratuberculosis
acgcaaaacggugcggccucg

SEQ ID NO: 2869558 - RNA, 17 nt, Mycobacterium avium subsp. paratuberculosis
acgcaacagggccaccg

SEQ ID NO: 2869559 - RNA, 14 nt, Mycobacterium avium subsp. paratuberculosis
acgcaagaagucgg

SEQ ID NO: 2869560 - RNA, 17 nt, Mycobacterium avium subsp. paratuberculosis
acgcaagaagucggugu

SEQ ID NO: 2869561 - RNA, 13 nt, Mycobacterium avium subsp. paratuberculosis
acgcaaucgccca

SEQ ID NO: 2869562 - RNA, 16 nt, Mycobacterium avium subsp. paratuberculosis
acgcaaucgcccaguc

SEQ ID NO: 2869563 - RNA, 17 nt, Mycobacterium avium subsp. paratuberculosis
acgcaaucgcccagucc

SEQ ID NO: 2869564 - RNA, 18 nt, Mycobacterium avium subsp. paratuberculosis
acgcaaucgcccaguccc

SEQ ID NO: 2869565 - RNA, 21 nt, Mycobacterium avium subsp. paratuberculosis
acgcaaugcgucgcggcggcg

SEQ ID NO: 2869566 - RNA, 14 nt, Mycobacterium avium subsp. paratuberculosis
acgcacaccgcgcg

SEQ ID NO: 2869567 - RNA, 15 nt, Mycobacterium avium subsp. paratuberculosis
acgcacaccgcgcgc

SEQ ID NO: 2869568 - RNA, 19 nt, Mycobacterium avium subsp. paratuberculosis
acgcacaccgcgcgcaggc

SEQ ID NO: 2869569 - RNA, 15 nt, Mycobacterium avium subsp. paratuberculosis
acgcaccaccgcggu

SEQ ID NO: 2869570 - RNA, 16 nt, Mycobacterium avium subsp. paratuberculosis
acgcaccaccgcggug

SEQ ID NO: 2869571 - RNA, 13 nt, Mycobacterium avium subsp. paratuberculosis
acgcacccgacac

SEQ ID NO: 2869572 - RNA, 13 nt, Mycobacterium avium subsp. paratuberculosis
acgcaccucggcc

SEQ ID NO: 2869573 - RNA, 17 nt, Mycobacterium avium subsp. paratuberculosis
acgcaccucggccgggu

SEQ ID NO: 2869574 - RNA, 16 nt, Mycobacterium avium subsp. paratuberculosis
acgcacgaaaccgcgu

SEQ ID NO: 2869575 - RNA, 13 nt, Mycobacterium avium subsp. paratuberculosis
acgcacgccggcg

SEQ ID NO: 2869576 - RNA, 15 nt, Mycobacterium avium subsp. paratuberculosis
acgcacgccggcggg

SEQ ID NO: 2869577 - RNA, 24 nt, Mycobacterium avium subsp. paratuberculosis
acgcacgccggcggggguucgacg

SEQ ID NO: 2869578 - RNA, 19 nt, Mycobacterium avium subsp. paratuberculosis
acgcacggcgaacggccgc

SEQ ID NO: 2869579 - RNA, 22 nt, Mycobacterium avium subsp. paratuberculosis
acgcacggcgaacggccgcgau

SEQ ID NO: 2869580 - RNA, 13 nt, Mycobacterium avium subsp. paratuberculosis
acgcacgggcggc

SEQ ID NO: 2869581 - RNA, 14 nt, Mycobacterium avium subsp. paratuberculosis
acgcacgggcggcg

SEQ ID NO: 2869582 - RNA, 15 nt, Mycobacterium avium subsp. paratuberculosis
acgcacgggcggcgg

SEQ ID NO: 2869583 - RNA, 12 nt, Mycobacterium avium subsp. paratuberculosis
acgcacgucggc

SEQ ID NO: 2869584 - RNA, 17 nt, Mycobacterium avium subsp. paratuberculosis
acgcacucgguguggcc

SEQ ID NO: 2869585 - RNA, 21 nt, Mycobacterium avium subsp. paratuberculosis
acgcacucgguguggcccaac

SEQ ID NO: 2869586 - RNA, 13 nt, Mycobacterium avium subsp. paratuberculosis
acgcagccgucga

SEQ ID NO: 2869587 - RNA, 16 nt, Mycobacterium avium subsp. paratuberculosis
acgcagccgucgaucu

SEQ ID NO: 2869588 - RNA, 21 nt, Mycobacterium avium subsp. paratuberculosis
acgcagccgucgaucuugacg

SEQ ID NO: 2869589 - RNA, 12 nt, Mycobacterium avium subsp. paratuberculosis
acgcagcgaucg

SEQ ID NO: 2869590 - RNA, 20 nt, Mycobacterium avium subsp. paratuberculosis
acgcagcgcauccgacaccg

SEQ ID NO: 2869591 - RNA, 14 nt, Mycobacterium avium subsp. paratuberculosis
acgcagcggcguca

SEQ ID NO: 2869592 - RNA, 16 nt, Mycobacterium avium subsp. paratuberculosis
acgcagcggugcagcc

SEQ ID NO: 2869593 - RNA, 17 nt, Mycobacterium avium subsp. paratuberculosis
acgcagcggugcagccc

SEQ ID NO: 2869594 - RNA, 15 nt, Mycobacterium avium subsp. paratuberculosis
acgcaggcguggccc

SEQ ID NO: 2869595 - RNA, 19 nt, Mycobacterium avium subsp. paratuberculosis
acgcaggcguggcccagcc

SEQ ID NO: 2869596 - RNA, 19 nt, Mycobacterium avium subsp. paratuberculosis
acgcaggugcgccgcucgu

SEQ ID NO: 2869597 - RNA, 20 nt, Mycobacterium avium subsp. paratuberculosis
acgcaggugcgccgcucguc

SEQ ID NO: 2869598 - RNA, 18 nt, Mycobacterium avium subsp. paratuberculosis
acgcagguuucucgacca

SEQ ID NO: 2869599 - RNA, 15 nt, Mycobacterium avium subsp. paratuberculosis
acgcagugccgcacc

SEQ ID NO: 2869600 - RNA, 20 nt, Mycobacterium avium subsp. paratuberculosis
acgcagugccgcaccagcac

SEQ ID NO: 2869601 - RNA, 15 nt, Mycobacterium avium subsp. paratuberculosis
acgcaucaccacgcu

SEQ ID NO: 2869602 - RNA, 16 nt, Mycobacterium avium subsp. paratuberculosis
acgcaucagggccagc

SEQ ID NO: 2869603 - RNA, 18 nt, Mycobacterium avium subsp. paratuberculosis
acgcaucagggccagccg

SEQ ID NO: 2869604 - RNA, 13 nt, Mycobacterium avium subsp. paratuberculosis
acgcaucgccgag

SEQ ID NO: 2869605 - RNA, 19 nt, Mycobacterium avium subsp. paratuberculosis
acgcaucgccgagagcguc

SEQ ID NO: 2869606 - RNA, 13 nt, Mycobacterium avium subsp. paratuberculosis
acgcaucggcgcc

SEQ ID NO: 2869607 - RNA, 14 nt, Mycobacterium avium subsp. paratuberculosis
acgcaucggcgccg

SEQ ID NO: 2869608 - RNA, 14 nt, Mycobacterium avium subsp. paratuberculosis
acgccaacaacuac

SEQ ID NO: 2869609 - RNA, 20 nt, Mycobacterium avium subsp. paratuberculosis
acgccaacugguccugcggc

SEQ ID NO: 2869610 - RNA, 21 nt, Mycobacterium avium subsp. paratuberculosis
acgccaacugguccugcggcu

SEQ ID NO: 2869611 - RNA, 16 nt, Mycobacterium avium subsp. paratuberculosis
acgccacaaacagcgc

SEQ ID NO: 2869612 - RNA, 18 nt, Mycobacterium avium subsp. paratuberculosis
acgccacaaacagcgcgg

SEQ ID NO: 2869613 - RNA, 19 nt, Mycobacterium avium subsp. paratuberculosis
acgccacaaacagcgcggc

SEQ ID NO: 2869614 - RNA, 17 nt, Mycobacterium avium subsp. paratuberculosis
acgccaccaccuccucg

SEQ ID NO: 2869615 - RNA, 23 nt, Mycobacterium avium subsp. paratuberculosis
acgccaccaccuccucgcgggcg

SEQ ID NO: 2869616 - RNA, 19 nt, Mycobacterium avium subsp. paratuberculosis
acgccaccacggcgucgcu

SEQ ID NO: 2869617 - RNA, 21 nt, Mycobacterium avium subsp. paratuberculosis
acgccaccacggcgucgcuga

SEQ ID NO: 2869618 - RNA, 14 nt, Mycobacterium avium subsp. paratuberculosis
acgccaccaucgag

SEQ ID NO: 2869619 - RNA, 16 nt, Mycobacterium avium subsp. paratuberculosis
acgccaccuucaccgc

SEQ ID NO: 2869620 - RNA, 18 nt, Mycobacterium avium subsp. paratuberculosis
acgccaccuucaccgcgc

SEQ ID NO: 2869621 - RNA, 19 nt, Mycobacterium avium subsp. paratuberculosis
acgccaccuucaccgcgcc

SEQ ID NO: 2869622 - RNA, 21 nt, Mycobacterium avium subsp. paratuberculosis
acgccaccuucaccgcgccgg

SEQ ID NO: 2869623 - RNA, 13 nt, Mycobacterium avium subsp. paratuberculosis
acgccacggcggc

SEQ ID NO: 2869624 - RNA, 14 nt, Mycobacterium avium subsp. paratuberculosis
acgccacggcggcc

SEQ ID NO: 2869625 - RNA, 15 nt, Mycobacterium avium subsp. paratuberculosis
acgccacggcggccg

SEQ ID NO: 2869626 - RNA, 15 nt, Mycobacterium avium subsp. paratuberculosis
acgccacggggcugc

SEQ ID NO: 2869627 - RNA, 19 nt, Mycobacterium avium subsp. paratuberculosis
acgccacggggcugcgggc

SEQ ID NO: 2869628 - RNA, 20 nt, Mycobacterium avium subsp. paratuberculosis
acgccacggggcugcgggcc

SEQ ID NO: 2869629 - RNA, 12 nt, Mycobacterium avium subsp. paratuberculosis
acgccacguagc

SEQ ID NO: 2869630 - RNA, 15 nt, Mycobacterium avium subsp. paratuberculosis
acgccacguagcagc

SEQ ID NO: 2869631 - RNA, 16 nt, Mycobacterium avium subsp. paratuberculosis
acgccacguagcagca

SEQ ID NO: 2869632 - RNA, 22 nt, Mycobacterium avium subsp. paratuberculosis
acgccacgucguucaugaucgg

SEQ ID NO: 2869633 - RNA, 17 nt, Mycobacterium avium subsp. paratuberculosis
acgccagaugcgccgcg

SEQ ID NO: 2869634 - RNA, 20 nt, Mycobacterium avium subsp. paratuberculosis
acgccagaugcgccgcggau

SEQ ID NO: 2869635 - RNA, 23 nt, Mycobacterium avium subsp. paratuberculosis
acgccagcacguggccgggcucg

SEQ ID NO: 2869636 - RNA, 12 nt, Mycobacterium avium subsp. paratuberculosis
acgccagcagcc

SEQ ID NO: 2869637 - RNA, 15 nt, Mycobacterium avium subsp. paratuberculosis
acgccagcagccgca

SEQ ID NO: 2869638 - RNA, 18 nt, Mycobacterium avium subsp. paratuberculosis
acgccagcagccgcagca

SEQ ID NO: 2869639 - RNA, 23 nt, Mycobacterium avium subsp. paratuberculosis
acgccagcagcugcgggaccagc

SEQ ID NO: 2869640 - RNA, 14 nt, Mycobacterium avium subsp. paratuberculosis
acgccagccaggcg

SEQ ID NO: 2869641 - RNA, 14 nt, Mycobacterium avium subsp. paratuberculosis
acgccagccgggug

SEQ ID NO: 2869642 - RNA, 15 nt, Mycobacterium avium subsp. paratuberculosis
acgccagccgggugg

SEQ ID NO: 2869643 - RNA, 21 nt, Mycobacterium avium subsp. paratuberculosis
acgccagccggguggcccgcg

SEQ ID NO: 2869644 - RNA, 13 nt, Mycobacterium avium subsp. paratuberculosis
acgccagcgccgc

SEQ ID NO: 2869645 - RNA, 16 nt, Mycobacterium avium subsp. paratuberculosis
acgccagcgccgcaac

SEQ ID NO: 2869646 - RNA, 21 nt, Mycobacterium avium subsp. paratuberculosis
acgccagcgcgacccgcucga

SEQ ID NO: 2869647 - RNA, 15 nt, Mycobacterium avium subsp. paratuberculosis
acgccagcggcagcg

SEQ ID NO: 2869648 - RNA, 16 nt, Mycobacterium avium subsp. paratuberculosis
acgccagcggcagcgc

SEQ ID NO: 2869649 - RNA, 20 nt, Mycobacterium avium subsp. paratuberculosis
acgccagcgugacgcccggc

SEQ ID NO: 2869650 - RNA, 21 nt, Mycobacterium avium subsp. paratuberculosis
accgggugaacgaggccgcgc

SEQ ID NO: 2869651 - RNA, 22 nt, Mycobacterium avium subsp. paratuberculosis
accgggugaacgaggccgcgcc

SEQ ID NO: 2869652 - RNA, 16 nt, Mycobacterium avium subsp. paratuberculosis
accgggugaccggcgc

SEQ ID NO: 2869653 - RNA, 20 nt, Mycobacterium avium subsp. paratuberculosis
accgggugaccggcgcgcag

SEQ ID NO: 2869654 - RNA, 12 nt, Mycobacterium avium subsp. paratuberculosis
accgggugacga

SEQ ID NO: 2869655 - RNA, 18 nt, Mycobacterium avium subsp. paratuberculosis
accgggugaugucgccga

SEQ ID NO: 2869656 - RNA, 20 nt, Mycobacterium avium subsp. paratuberculosis
accgggugcguccagaccgg

SEQ ID NO: 2869657 - RNA, 22 nt, Mycobacterium avium subsp. paratuberculosis
accgggugcguccagaccggcc

SEQ ID NO: 2869658 - RNA, 18 nt, Mycobacterium avium subsp. paratuberculosis
accggguggccagcacca

SEQ ID NO: 2869659 - RNA, 15 nt, Mycobacterium avium subsp. paratuberculosis
accggguggccguga

SEQ ID NO: 2869660 - RNA, 16 nt, Mycobacterium avium subsp. paratuberculosis
accgggugggccgacc

SEQ ID NO: 2869661 - RNA, 17 nt, Mycobacterium avium subsp. paratuberculosis
accggguuggcgcgcac

SEQ ID NO: 2869662 - RNA, 19 nt, Mycobacterium avium subsp. paratuberculosis
accggguuggcgcgcacca

SEQ ID NO: 2869663 - RNA, 20 nt, Mycobacterium avium subsp. paratuberculosis
accggguuugaggcccacgu

SEQ ID NO: 2869664 - RNA, 20 nt, Mycobacterium avium subsp. paratuberculosis
accgguagaagaugcgccgg

SEQ ID NO: 2869665 - RNA, 22 nt, Mycobacterium avium subsp. paratuberculosis
accgguagaagaugcgccgggu

SEQ ID NO: 2869666 - RNA, 23 nt, Mycobacterium avium subsp. paratuberculosis
accgguagaagaugcgccggguc

SEQ ID NO: 2869667 - RNA, 18 nt, Mycobacterium avium subsp. paratuberculosis
accgguaggcgcaccgcc

SEQ ID NO: 2869668 - RNA, 19 nt, Mycobacterium avium subsp. paratuberculosis
accgguaggcgcaccgccg

SEQ ID NO: 2869669 - RNA, 22 nt, Mycobacterium avium subsp. paratuberculosis
accgguaggcgcaccgccgggc

SEQ ID NO: 2869670 - RNA, 18 nt, Mycobacterium avium subsp. paratuberculosis
accgguagucgucgaggu

SEQ ID NO: 2869671 - RNA, 23 nt, Mycobacterium avium subsp. paratuberculosis
accggucaacggcucggucaagc

SEQ ID NO: 2869672 - RNA, 23 nt, Mycobacterium avium subsp. paratuberculosis
accgguccagaaguaacccaccg

SEQ ID NO: 2869673 - RNA, 17 nt, Mycobacterium avium subsp. paratuberculosis
accgguccaguccggcc

SEQ ID NO: 2869674 - RNA, 21 nt, Mycobacterium avium subsp. paratuberculosis
accgguccaguccggccguga

SEQ ID NO: 2869675 - RNA, 16 nt, Mycobacterium avium subsp. paratuberculosis
accgguccgccgccgg

SEQ ID NO: 2869676 - RNA, 17 nt, Mycobacterium avium subsp. paratuberculosis
accgguccgccgccggc

SEQ ID NO: 2869677 - RNA, 15 nt, Mycobacterium avium subsp. paratuberculosis
accgguccgccgucg

SEQ ID NO: 2869678 - RNA, 16 nt, Mycobacterium avium subsp. paratuberculosis
accgguccgccgucgg

SEQ ID NO: 2869679 - RNA, 18 nt, Mycobacterium avium subsp. paratuberculosis
accgguccgccgucgggg

SEQ ID NO: 2869680 - RNA, 13 nt, Mycobacterium avium subsp. paratuberculosis
accgguccggccg

SEQ ID NO: 2869681 - RNA, 16 nt, Mycobacterium avium subsp. paratuberculosis
accgguccggccgugc

SEQ ID NO: 2869682 - RNA, 17 nt, Mycobacterium avium subsp. paratuberculosis
accgguccggccgugcc

SEQ ID NO: 2869683 - RNA, 18 nt, Mycobacterium avium subsp. paratuberculosis
accgguccggccgugccg

SEQ ID NO: 2869684 - RNA, 20 nt, Mycobacterium avium subsp. paratuberculosis
accgguccuccccgcuggcg

SEQ ID NO: 2869685 - RNA, 15 nt, Mycobacterium avium subsp. paratuberculosis
accggucgacgacga

SEQ ID NO: 2869686 - RNA, 22 nt, Mycobacterium avium subsp. paratuberculosis
accggucgcguugaaagccgcg

SEQ ID NO: 2869687 - RNA, 23 nt, Mycobacterium avium subsp. paratuberculosis
accggucggaaaagugggucagc

SEQ ID NO: 2869688 - RNA, 23 nt, Mycobacterium avium subsp. paratuberculosis
accggucggugcccagcaccgcc

SEQ ID NO: 2869689 - RNA, 19 nt, Mycobacterium avium subsp. paratuberculosis
accggucguagaccucuug

SEQ ID NO: 2869690 - RNA, 14 nt, Mycobacterium avium subsp. paratuberculosis
accggucguuggcc

SEQ ID NO: 2869691 - RNA, 21 nt, Mycobacterium avium subsp. paratuberculosis
accggucucgaccgcggcgcc

SEQ ID NO: 2869692 - RNA, 22 nt, Mycobacterium avium subsp. paratuberculosis
accggucucgaccgcggcgccg

SEQ ID NO: 2869693 - RNA, 15 nt, Mycobacterium avium subsp. paratuberculosis
accggugcaccgcgc

SEQ ID NO: 2869694 - RNA, 18 nt, Mycobacterium avium subsp. paratuberculosis
accggugcaccgcgcgca

SEQ ID NO: 2869695 - RNA, 15 nt, Mycobacterium avium subsp. paratuberculosis
accggugcacgagcg

SEQ ID NO: 2869696 - RNA, 13 nt, Mycobacterium avium subsp. paratuberculosis
accggugcgcccg

SEQ ID NO: 2869697 - RNA, 14 nt, Mycobacterium avium subsp. paratuberculosis
accggugcgcccgc

SEQ ID NO: 2869698 - RNA, 15 nt, Mycobacterium avium subsp. paratuberculosis
accggugcgcccgcg

SEQ ID NO: 2869699 - RNA, 16 nt, Mycobacterium avium subsp. paratuberculosis
accggugcgcccgcga

SEQ ID NO: 2869700 - RNA, 18 nt, Mycobacterium avium subsp. paratuberculosis
accggugcgcccgcgauc

SEQ ID NO: 2869701 - RNA, 18 nt, Mycobacterium avium subsp. paratuberculosis
accggugcggucccgguc

SEQ ID NO: 2869702 - RNA, 22 nt, Mycobacterium avium subsp. paratuberculosis
accggugcucuccugcuugacc

SEQ ID NO: 2869703 - RNA, 14 nt, Mycobacterium avium subsp. paratuberculosis
accgguggccgcgu

SEQ ID NO: 2869704 - RNA, 17 nt, Mycobacterium avium subsp. paratuberculosis
accgguggccgcgucga

SEQ ID NO: 2869705 - RNA, 19 nt, Mycobacterium avium subsp. paratuberculosis
accgguggccgcgucgacc

SEQ ID NO: 2869706 - RNA, 20 nt, Mycobacterium avium subsp. paratuberculosis
accgguggccgcgucgacca

SEQ ID NO: 2869707 - RNA, 18 nt, Mycobacterium avium subsp. paratuberculosis
accgguggugagacccug

SEQ ID NO: 2869708 - RNA, 16 nt, Mycobacterium avium subsp. paratuberculosis
accggugucacgcugg

SEQ ID NO: 2869709 - RNA, 17 nt, Mycobacterium avium subsp. paratuberculosis
accggugugccuggcuc

SEQ ID NO: 2869710 - RNA, 15 nt, Mycobacterium avium subsp. paratuberculosis
accgguuccgggcga

SEQ ID NO: 2869711 - RNA, 22 nt, Mycobacterium avium subsp. paratuberculosis
accgguuccgggcgaccccggc

SEQ ID NO: 2869712 - RNA, 23 nt, Mycobacterium avium subsp. paratuberculosis
accgguucggacacggcgccgug

SEQ ID NO: 2869713 - RNA, 24 nt, Mycobacterium avium subsp. paratuberculosis
accgguucggacacggcgccgugc

SEQ ID NO: 2869714 - RNA, 23 nt, Mycobacterium avium subsp. paratuberculosis
accgguucgucaacgccccgguc

SEQ ID NO: 2869715 - RNA, 22 nt, Mycobacterium avium subsp. paratuberculosis
accgguugcccgguuccgcgac

SEQ ID NO: 2869716 - RNA, 23 nt, Mycobacterium avium subsp. paratuberculosis
accgguugcccgguuccgcgaca

SEQ ID NO: 2869717 - RNA, 15 nt, Mycobacterium avium subsp. paratuberculosis
accgguugcgccgag

SEQ ID NO: 2869718 - RNA, 17 nt, Mycobacterium avium subsp. paratuberculosis
accgguugcgccgaggu

SEQ ID NO: 2869719 - RNA, 14 nt, Mycobacterium avium subsp. paratuberculosis
accgguugcggcga

SEQ ID NO: 2869720 - RNA, 17 nt, Mycobacterium avium subsp. paratuberculosis
accgguugcggcgaacg

SEQ ID NO: 2869721 - RNA, 15 nt, Mycobacterium avium subsp. paratuberculosis
accgguugcgggccg

SEQ ID NO: 2869722 - RNA, 16 nt, Mycobacterium avium subsp. paratuberculosis
accgguuugucggcgc

SEQ ID NO: 2869723 - RNA, 18 nt, Mycobacterium avium subsp. paratuberculosis
accguaccgaggaugacc

SEQ ID NO: 2869724 - RNA, 19 nt, Mycobacterium avium subsp. paratuberculosis
accguaccgaggaugaccg

SEQ ID NO: 2869725 - RNA, 23 nt, Mycobacterium avium subsp. paratuberculosis
accguaccgaggaugaccgcggc

SEQ ID NO: 2869726 - RNA, 14 nt, Mycobacterium avium subsp. paratuberculosis
accguacggcccga

SEQ ID NO: 2869727 - RNA, 13 nt, Mycobacterium avium subsp. paratuberculosis
accguagccgguc

SEQ ID NO: 2869728 - RNA, 17 nt, Mycobacterium avium subsp. paratuberculosis
accguagccggucggcc

SEQ ID NO: 2869729 - RNA, 18 nt, Mycobacterium avium subsp. paratuberculosis
accguagccggucggccc

SEQ ID NO: 2869730 - RNA, 19 nt, Mycobacterium avium subsp. paratuberculosis
accguagccggucggcccg

SEQ ID NO: 2869731 - RNA, 21 nt, Mycobacterium avium subsp. paratuberculosis
accgucacccccggcgcgacg

SEQ ID NO: 2869732 - RNA, 15 nt, Mycobacterium avium subsp. paratuberculosis
accgucaccguggcg

SEQ ID NO: 2869733 - RNA, 12 nt, Mycobacterium avium subsp. paratuberculosis
accgucaccuuc

SEQ ID NO: 2869734 - RNA, 13 nt, Mycobacterium avium subsp. paratuberculosis
accgucacgcugg

SEQ ID NO: 2869735 - RNA, 15 nt, Mycobacterium avium subsp. paratuberculosis
accgucacgcuggcg

SEQ ID NO: 2869736 - RNA, 17 nt, Mycobacterium avium subsp. paratuberculosis
accgucacgcuggcgug

SEQ ID NO: 2869737 - RNA, 15 nt, Mycobacterium avium subsp. paratuberculosis
accgucagcagggcc

SEQ ID NO: 2869738 - RNA, 17 nt, Mycobacterium avium subsp. paratuberculosis
accgucagcagggccuc

SEQ ID NO: 2869739 - RNA, 13 nt, Mycobacterium avium subsp. paratuberculosis
accgucagccagg

SEQ ID NO: 2869740 - RNA, 15 nt, Mycobacterium avium subsp. paratuberculosis
accgucagggugacg

SEQ ID NO: 2869741 - RNA, 22 nt, Mycobacterium avium subsp. paratuberculosis
accgucaggguggugcccccgc

SEQ ID NO: 2869742 - RNA, 21 nt, Mycobacterium avium subsp. paratuberculosis
accgucaguucguagaucacg

SEQ ID NO: 2869743 - RNA, 15 nt, Mycobacterium avium subsp. paratuberculosis
accgucaucgcggcg

SEQ ID NO: 2869744 - RNA, 16 nt, Mycobacterium avium subsp. paratuberculosis
accgucaucgcggcga

SEQ ID NO: 2869745 - RNA, 20 nt, Mycobacterium avium subsp. paratuberculosis
accgucaucgugugggcgcc

SEQ ID NO: 2869746 - RNA, 22 nt, Mycobacterium avium subsp. paratuberculosis
accgucaucgugugggcgcccg

SEQ ID NO: 2869747 - RNA, 23 nt, Mycobacterium avium subsp. paratuberculosis
accgucaucgugugggcgcccgc

SEQ ID NO: 2869748 - RNA, 16 nt, Mycobacterium avium subsp. paratuberculosis
accguccacagccggc

SEQ ID NO: 2869749 - RNA, 21 nt, Mycobacterium avium subsp. paratuberculosis
accguccacagccggcggcug

SEQ ID NO: 2869750 - RNA, 16 nt, Mycobacterium avium subsp. paratuberculosis
accguccagcucagcg

SEQ ID NO: 2869751 - RNA, 19 nt, Mycobacterium avium subsp. paratuberculosis
accguccagcucagcgcgc

SEQ ID NO: 2869752 - RNA, 20 nt, Mycobacterium avium subsp. paratuberculosis
accguccagcucagcgcgca

SEQ ID NO: 2869753 - RNA, 21 nt, Mycobacterium avium subsp. paratuberculosis
accguccagcucagcgcgcac

SEQ ID NO: 2869754 - RNA, 21 nt, Mycobacterium avium subsp. paratuberculosis
accgucccacacgggugugac

SEQ ID NO: 2869755 - RNA, 21 nt, Mycobacterium avium subsp. paratuberculosis
accgucccggugucgccgucg

SEQ ID NO: 2869756 - RNA, 13 nt, Mycobacterium avium subsp. paratuberculosis
accguccgaccgu

SEQ ID NO: 2869757 - RNA, 23 nt, Mycobacterium avium subsp. paratuberculosis
accguccgcagauagaucgacgc

SEQ ID NO: 2869758 - RNA, 15 nt, Mycobacterium avium subsp. paratuberculosis
accguccgcgcccac

SEQ ID NO: 2869759 - RNA, 12 nt, Mycobacterium avium subsp. paratuberculosis
accgucgaccaa

SEQ ID NO: 2869760 - RNA, 16 nt, Mycobacterium avium subsp. paratuberculosis
accgucgaccaacugc

SEQ ID NO: 2869761 - RNA, 14 nt, Mycobacterium avium subsp. paratuberculosis
accgucgacgacga

SEQ ID NO: 2869762 - RNA, 22 nt, Mycobacterium avium subsp. paratuberculosis
accgucgacgacgaaucccgcc

SEQ ID NO: 2869763 - RNA, 14 nt, Mycobacterium avium subsp. paratuberculosis
accgucgccacgau

SEQ ID NO: 2869764 - RNA, 13 nt, Mycobacterium avium subsp. paratuberculosis
accgucgcccgcc

SEQ ID NO: 2869765 - RNA, 15 nt, Mycobacterium avium subsp. paratuberculosis
accgucgcccgccca

SEQ ID NO: 2869766 - RNA, 16 nt, Mycobacterium avium subsp. paratuberculosis
accgucgccgaccagc

SEQ ID NO: 2869767 - RNA, 13 nt, Mycobacterium avium subsp. paratuberculosis
accgucgccggcg

SEQ ID NO: 2869768 - RNA, 14 nt, Mycobacterium avium subsp. paratuberculosis
accgucgccggcug

SEQ ID NO: 2869769 - RNA, 13 nt, Mycobacterium avium subsp. paratuberculosis
accgucgcgcagc

SEQ ID NO: 2869770 - RNA, 15 nt, Mycobacterium avium subsp. paratuberculosis
accgucgcgcagccc

SEQ ID NO: 2869771 - RNA, 18 nt, Mycobacterium avium subsp. paratuberculosis
accgucgcgcagcccgau

SEQ ID NO: 2869772 - RNA, 19 nt, Mycobacterium avium subsp. paratuberculosis
accgucgcggucagcucga

SEQ ID NO: 2869773 - RNA, 13 nt, Mycobacterium avium subsp. paratuberculosis
accgucggcccgc

SEQ ID NO: 2869774 - RNA, 14 nt, Mycobacterium avium subsp. paratuberculosis
accgucggcccgcc

SEQ ID NO: 2869775 - RNA, 23 nt, Mycobacterium avium subsp. paratuberculosis
accgucggcccgccaaaacgggg

SEQ ID NO: 2869776 - RNA, 15 nt, Mycobacterium avium subsp. paratuberculosis
accgucggcgaucgc

SEQ ID NO: 2869777 - RNA, 19 nt, Mycobacterium avium subsp. paratuberculosis
accgucggcgaucgccggg

SEQ ID NO: 2869778 - RNA, 23 nt, Mycobacterium avium subsp. paratuberculosis
accgucgggaauggggcccgguc

SEQ ID NO: 2869779 - RNA, 12 nt, Mycobacterium avium subsp. paratuberculosis
accgucgggacg

SEQ ID NO: 2869780 - RNA, 18 nt, Mycobacterium avium subsp. paratuberculosis
accgucgggacggccagc

SEQ ID NO: 2869781 - RNA, 20 nt, Mycobacterium avium subsp. paratuberculosis
accgucgggacggccagcag

SEQ ID NO: 2869782 - RNA, 14 nt, Mycobacterium avium subsp. paratuberculosis
accgucggugucga

SEQ ID NO: 2869783 - RNA, 21 nt, Mycobacterium avium subsp. paratuberculosis
accgucguccacgcccagcgc

SEQ ID NO: 2869784 - RNA, 18 nt, Mycobacterium avium subsp. paratuberculosis
accgucgucgcaccggca

SEQ ID NO: 2869785 - RNA, 16 nt, Mycobacterium avium subsp. paratuberculosis
accgucgugccagcgc

SEQ ID NO: 2869786 - RNA, 17 nt, Mycobacterium avium subsp. paratuberculosis
accgucgugccagcgca

SEQ ID NO: 2869787 - RNA, 15 nt, Mycobacterium avium subsp. paratuberculosis
accgucuccggcgcg

SEQ ID NO: 2869788 - RNA, 16 nt, Mycobacterium avium subsp. paratuberculosis
accgucuccggcgcgg

SEQ ID NO: 2869789 - RNA, 15 nt, Mycobacterium avium subsp. paratuberculosis
accgucugcgccguc

SEQ ID NO: 2869790 - RNA, 22 nt, Mycobacterium avium subsp. paratuberculosis
accgucugcgccgucaccggcu

SEQ ID NO: 2869791 - RNA, 18 nt, Mycobacterium avium subsp. paratuberculosis
accgucuucggggccgcc

SEQ ID NO: 2869792 - RNA, 20 nt, Mycobacterium avium subsp. paratuberculosis
accgucuucggggccgccgu

SEQ ID NO: 2869793 - RNA, 23 nt, Mycobacterium avium subsp. paratuberculosis
accgucuucggggccgccgucgg

SEQ ID NO: 2869794 - RNA, 21 nt, Mycobacterium avium subsp. paratuberculosis
accgucuucuucagccgcagc

SEQ ID NO: 2869795 - RNA, 19 nt, Mycobacterium avium subsp. paratuberculosis
accgucuuggucucgccga

SEQ ID NO: 2869796 - RNA, 21 nt, Mycobacterium avium subsp. paratuberculosis
accgugaagcuaguuucacgc

SEQ ID NO: 2869797 - RNA, 21 nt, Mycobacterium avium subsp. paratuberculosis
accgugacugggugggacgga

SEQ ID NO: 2869798 - RNA, 13 nt, Mycobacterium avium subsp. paratuberculosis
accgugaggcccg

SEQ ID NO: 2869799 - RNA, 15 nt, Mycobacterium avium subsp. paratuberculosis
accgugaggcccggc

SEQ ID NO: 2869800 - RNA, 16 nt, Mycobacterium avium subsp. paratuberculosis
accgugaggcccggcg

SEQ ID NO: 2869801 - RNA, 17 nt, Mycobacterium avium subsp. paratuberculosis
accgugaggcccggcgu

SEQ ID NO: 2869802 - RNA, 18 nt, Mycobacterium avium subsp. paratuberculosis
accgugaggcccggcgug

SEQ ID NO: 2869803 - RNA, 17 nt, Mycobacterium avium subsp. paratuberculosis
accgugaguucgcugac

SEQ ID NO: 2869804 - RNA, 16 nt, Mycobacterium avium subsp. paratuberculosis
accgugaucgccacca

SEQ ID NO: 2869805 - RNA, 18 nt, Mycobacterium avium subsp. paratuberculosis
accgugaucgccaccacc

SEQ ID NO: 2869806 - RNA, 19 nt, Mycobacterium avium subsp. paratuberculosis
accgugcacgaucgcggug

SEQ ID NO: 2869807 - RNA, 13 nt, Mycobacterium avium subsp. paratuberculosis
accgugcccacca

SEQ ID NO: 2869808 - RNA, 21 nt, Mycobacterium avium subsp. paratuberculosis
accgugcccaccagccggccg

SEQ ID NO: 2869809 - RNA, 12 nt, Mycobacterium avium subsp. paratuberculosis
accgugcccgag

SEQ ID NO: 2869810 - RNA, 17 nt, Mycobacterium avium subsp. paratuberculosis
accgugcccgagccgau

SEQ ID NO: 2869811 - RNA, 13 nt, Mycobacterium avium subsp. paratuberculosis
accgugccgcccg

SEQ ID NO: 2869812 - RNA, 15 nt, Mycobacterium avium subsp. paratuberculosis
accgugccgcccguc

SEQ ID NO: 2869813 - RNA, 14 nt, Mycobacterium avium subsp. paratuberculosis
accgugccgcgcgg

SEQ ID NO: 2869814 - RNA, 15 nt, Mycobacterium avium subsp. paratuberculosis
accgugccgucacgc

SEQ ID NO: 2869815 - RNA, 13 nt, Mycobacterium avium subsp. paratuberculosis
accgugccgucgc

SEQ ID NO: 2869816 - RNA, 16 nt, Mycobacterium avium subsp. paratuberculosis
accgugccgucggcgu

SEQ ID NO: 2869817 - RNA, 17 nt, Mycobacterium avium subsp. paratuberculosis
accgugccgucggcguc

SEQ ID NO: 2869818 - RNA, 18 nt, Mycobacterium avium subsp. paratuberculosis
accgugccuuacgccggg

SEQ ID NO: 2869819 - RNA, 18 nt, Mycobacterium avium subsp. paratuberculosis
accgugcgacuugguggc

SEQ ID NO: 2869820 - RNA, 19 nt, Mycobacterium avium subsp. paratuberculosis
accgugcgacuugguggcc

SEQ ID NO: 2869821 - RNA, 14 nt, Mycobacterium avium subsp. paratuberculosis
accgugcgcgcgca

SEQ ID NO: 2869822 - RNA, 16 nt, Mycobacterium avium subsp. paratuberculosis
accgugcgcgcgcacc

SEQ ID NO: 2869823 - RNA, 17 nt, Mycobacterium avium subsp. paratuberculosis
accguggaagucgccgu

SEQ ID NO: 2869824 - RNA, 20 nt, Mycobacterium avium subsp. paratuberculosis
accguggaagucgccguccg

SEQ ID NO: 2869825 - RNA, 16 nt, Mycobacterium avium subsp. paratuberculosis
accguggagacguccg

SEQ ID NO: 2869826 - RNA, 15 nt, Mycobacterium avium subsp. paratuberculosis
accguggcaggcgau

SEQ ID NO: 2869827 - RNA, 15 nt, Mycobacterium avium subsp. paratuberculosis
accguggccccacgg

SEQ ID NO: 2869828 - RNA, 20 nt, Mycobacterium avium subsp. paratuberculosis
accguggccccagccaccgu

SEQ ID NO: 2869829 - RNA, 19 nt, Mycobacterium avium subsp. paratuberculosis
accguggcgggggagccgu

SEQ ID NO: 2869830 - RNA, 15 nt, Mycobacterium avium subsp. paratuberculosis
accgugggcggcgcg

SEQ ID NO: 2869831 - RNA, 23 nt, Mycobacterium avium subsp. paratuberculosis
accgugggcggcgcgaucgucga

SEQ ID NO: 2869832 - RNA, 17 nt, Mycobacterium avium subsp. paratuberculosis
accguggugacccggac

SEQ ID NO: 2869833 - RNA, 20 nt, Mycobacterium avium subsp. paratuberculosis
accguggugacccggaccgg

SEQ ID NO: 2869834 - RNA, 16 nt, Mycobacterium avium subsp. paratuberculosis
accgugguggcggcga

SEQ ID NO: 2869835 - RNA, 13 nt, Mycobacterium avium subsp. paratuberculosis
accguggugucgg

SEQ ID NO: 2869836 - RNA, 23 nt, Mycobacterium avium subsp. paratuberculosis
accguggugucggagaucggcga

SEQ ID NO: 2869837 - RNA, 23 nt, Mycobacterium avium subsp. paratuberculosis
accguggugugcccgcgggccag

SEQ ID NO: 2869838 - RNA, 15 nt, Mycobacterium avium subsp. paratuberculosis
accguguagccgacc

SEQ ID NO: 2869839 - RNA, 23 nt, Mycobacterium avium subsp. paratuberculosis
accguguagccgaccgacccggc

SEQ ID NO: 2869840 - RNA, 17 nt, Mycobacterium avium subsp. paratuberculosis
accguguugaucucguc

SEQ ID NO: 2869841 - RNA, 14 nt, Mycobacterium avium subsp. paratuberculosis
accguguuggugac

SEQ ID NO: 2869842 - RNA, 23 nt, Mycobacterium avium subsp. paratuberculosis
accguguuugcugcaugcgcugc

SEQ ID NO: 2869843 - RNA, 15 nt, Mycobacterium avium subsp. paratuberculosis
accguucaccucuuc

SEQ ID NO: 2869844 - RNA, 16 nt, Mycobacterium avium subsp. paratuberculosis
accguucaccucuucg

SEQ ID NO: 2869845 - RNA, 19 nt, Mycobacterium avium subsp. paratuberculosis
accguucauuaucccgcac

SEQ ID NO: 2869846 - RNA, 22 nt, Mycobacterium avium subsp. paratuberculosis
accguucauuaucccgcaccgc

SEQ ID NO: 2869847 - RNA, 22 nt, Mycobacterium avium subsp. paratuberculosis
accguucccaccggcuucuccu

SEQ ID NO: 2869848 - RNA, 21 nt, Mycobacterium avium subsp. paratuberculosis
accguucuccgaggcguccuc

SEQ ID NO: 2869849 - RNA, 14 nt, Mycobacterium avium subsp. paratuberculosis
accguugacgaccu

SEQ ID NO: 2869850 - RNA, 18 nt, Mycobacterium avium subsp. paratuberculosis
accguugacgaccuuguc

SEQ ID NO: 2869851 - RNA, 15 nt, Mycobacterium avium subsp. paratuberculosis
accguugaggcgagc

SEQ ID NO: 2869852 - RNA, 15 nt, Mycobacterium avium subsp. paratuberculosis
accguugcagaacaa

SEQ ID NO: 2869853 - RNA, 14 nt, Mycobacterium avium subsp. paratuberculosis
accguuggccugcg

SEQ ID NO: 2869854 - RNA, 19 nt, Mycobacterium avium subsp. paratuberculosis
accguuggccugcgcgacc

SEQ ID NO: 2869855 - RNA, 21 nt, Mycobacterium avium subsp. paratuberculosis
accguuggccugcgcgaccuc

SEQ ID NO: 2869856 - RNA, 20 nt, Mycobacterium avium subsp. paratuberculosis
accguugucucggcgccguc

SEQ ID NO: 2869857 - RNA, 22 nt, Mycobacterium avium subsp. paratuberculosis
accguugucucggcgccgucgc

SEQ ID NO: 2869858 - RNA, 16 nt, Mycobacterium avium subsp. paratuberculosis
accguugugacccgcu

SEQ ID NO: 2869859 - RNA, 16 nt, Mycobacterium avium subsp. paratuberculosis
accguuuucggcgcgc

SEQ ID NO: 2869860 - RNA, 18 nt, Mycobacterium avium subsp. paratuberculosis
accguuuucggcgcgcag

SEQ ID NO: 2869861 - RNA, 15 nt, Mycobacterium avium subsp. paratuberculosis
accuaggcgucgucg

SEQ ID NO: 2869862 - RNA, 17 nt, Mycobacterium avium subsp. paratuberculosis
accuaggcgucgucggc

SEQ ID NO: 2869863 - RNA, 18 nt, Mycobacterium avium subsp. paratuberculosis
accuaggcgucgucggcc

SEQ ID NO: 2869864 - RNA, 16 nt, Mycobacterium avium subsp. paratuberculosis
accuagggcccacgcu

SEQ ID NO: 2869865 - RNA, 19 nt, Mycobacterium avium subsp. paratuberculosis
accuagggcccacgcucga

SEQ ID NO: 2869866 - RNA, 20 nt, Mycobacterium avium subsp. paratuberculosis
accuagggcccacgcucgac

SEQ ID NO: 2869867 - RNA, 19 nt, Mycobacterium avium subsp. paratuberculosis
accucacacugaaagccga

SEQ ID NO: 2869868 - RNA, 21 nt, Mycobacterium avium subsp. paratuberculosis
accucaccccgcuugcgcagc

SEQ ID NO: 2869869 - RNA, 16 nt, Mycobacterium avium subsp. paratuberculosis
accucacggucggcgu

SEQ ID NO: 2869870 - RNA, 16 nt, Mycobacterium avium subsp. paratuberculosis
accucaucgcccagcc

SEQ ID NO: 2869871 - RNA, 13 nt, Mycobacterium avium subsp. paratuberculosis
accuccaaugcgc

SEQ ID NO: 2869872 - RNA, 17 nt, Mycobacterium avium subsp. paratuberculosis
accuccacgagccgguc

SEQ ID NO: 2869873 - RNA, 17 nt, Mycobacterium avium subsp. paratuberculosis
accuccagauagaggaa

SEQ ID NO: 2869874 - RNA, 20 nt, Mycobacterium avium subsp. paratuberculosis
accuccagauagaggaacag

SEQ ID NO: 2869875 - RNA, 18 nt, Mycobacterium avium subsp. paratuberculosis
accucccccgacgccgac

SEQ ID NO: 2869876 - RNA, 15 nt, Mycobacterium avium subsp. paratuberculosis
accuccccgcggugc

SEQ ID NO: 2869877 - RNA, 12 nt, Mycobacterium avium subsp. paratuberculosis
accucccggcgc

SEQ ID NO: 2869878 - RNA, 18 nt, Mycobacterium avium subsp. paratuberculosis
accucccggcgccacgcc

SEQ ID NO: 2869879 - RNA, 22 nt, Mycobacterium avium subsp. paratuberculosis
accuccgacagcccccgcagcc

SEQ ID NO: 2869880 - RNA, 17 nt, Mycobacterium avium subsp. paratuberculosis
accuccgacaucaggcc

SEQ ID NO: 2869881 - RNA, 18 nt, Mycobacterium avium subsp. paratuberculosis
accuccggcagcgaaacc

SEQ ID NO: 2869882 - RNA, 20 nt, Mycobacterium avium subsp. paratuberculosis
accuccgugccgauggccac

SEQ ID NO: 2869883 - RNA, 12 nt, Mycobacterium avium subsp. paratuberculosis
accuccuccggu

SEQ ID NO: 2869884 - RNA, 19 nt, Mycobacterium avium subsp. paratuberculosis
accuccuccgguccgggcu

SEQ ID NO: 2869885 - RNA, 13 nt, Mycobacterium avium subsp. paratuberculosis
accuccucgcggg

SEQ ID NO: 2869886 - RNA, 22 nt, Mycobacterium avium subsp. paratuberculosis
accuccucgguguacagcgcca

SEQ ID NO: 2869887 - RNA, 21 nt, Mycobacterium avium subsp. paratuberculosis
accuccugcaaggcccccgcc

SEQ ID NO: 2869888 - RNA, 14 nt, Mycobacterium avium subsp. paratuberculosis
accuccugcacccg

SEQ ID NO: 2869889 - RNA, 22 nt, Mycobacterium avium subsp. paratuberculosis
accuccugcuggcguucgccga

SEQ ID NO: 2869890 - RNA, 21 nt, Mycobacterium avium subsp. paratuberculosis
accuccugggugagcggcgcg

SEQ ID NO: 2869891 - RNA, 18 nt, Mycobacterium avium subsp. paratuberculosis
accuccuugcccagcgcg

SEQ ID NO: 2869892 - RNA, 21 nt, Mycobacterium avium subsp. paratuberculosis
accuccuugcccagcgcggua

SEQ ID NO: 2869893 - RNA, 17 nt, Mycobacterium avium subsp. paratuberculosis
accuccuuggccaggcg

SEQ ID NO: 2869894 - RNA, 23 nt, Mycobacterium avium subsp. paratuberculosis
accuccuuggccaggcgggccac

SEQ ID NO: 2869895 - RNA, 16 nt, Mycobacterium avium subsp. paratuberculosis
accucgaaacccagcu

SEQ ID NO: 2869896 - RNA, 18 nt, Mycobacterium avium subsp. paratuberculosis
accucgaacuugaccggg

SEQ ID NO: 2869897 - RNA, 22 nt, Mycobacterium avium subsp. paratuberculosis
accucgaacuugaccgggcucc

SEQ ID NO: 2869898 - RNA, 23 nt, Mycobacterium avium subsp. paratuberculosis
accucgaagaagagggcgugacg

SEQ ID NO: 2869899 - RNA, 22 nt, Mycobacterium avium subsp. paratuberculosis
accucgaagcagccuucuuggc

SEQ ID NO: 2869900 - RNA, 14 nt, Mycobacterium avium subsp. paratuberculosis
accucgaagccgac

SEQ ID NO: 2869901 - RNA, 18 nt, Mycobacterium avium subsp. paratuberculosis
accucgaagccgacgucc

SEQ ID NO: 2869902 - RNA, 16 nt, Mycobacterium avium subsp. paratuberculosis
accucgaagccgaucg

SEQ ID NO: 2869903 - RNA, 22 nt, Mycobacterium avium subsp. paratuberculosis
accucgaagccgaucgcggcga

SEQ ID NO: 2869904 - RNA, 14 nt, Mycobacterium avium subsp. paratuberculosis
accucgaagggcgc

SEQ ID NO: 2869905 - RNA, 17 nt, Mycobacterium avium subsp. paratuberculosis
accucgaagggcgccag

SEQ ID NO: 2869906 - RNA, 18 nt, Mycobacterium avium subsp. paratuberculosis
accucgaagggcgccagc

SEQ ID NO: 2869907 - RNA, 20 nt, Mycobacterium avium subsp. paratuberculosis
accucgaagggcgccagccg

SEQ ID NO: 2869908 - RNA, 21 nt, Mycobacterium avium subsp. paratuberculosis
accucgaagggcgccagccgu

SEQ ID NO: 2869909 - RNA, 20 nt, Mycobacterium avium subsp. paratuberculosis
accucgacacgggccgcgcc

SEQ ID NO: 2869910 - RNA, 23 nt, Mycobacterium avium subsp. paratuberculosis
accucgacacgggccgcgccgag

SEQ ID NO: 2869911 - RNA, 19 nt, Mycobacterium avium subsp. paratuberculosis
accucgaccgugaggcccg

SEQ ID NO: 2869912 - RNA, 21 nt, Mycobacterium avium subsp. paratuberculosis
accucgaccgugaggcccggc

SEQ ID NO: 2869913 - RNA, 23 nt, Mycobacterium avium subsp. paratuberculosis
accucgaccgugaggcccggcgu

SEQ ID NO: 2869914 - RNA, 16 nt, Mycobacterium avium subsp. paratuberculosis
accucgagcaaccgca

SEQ ID NO: 2869915 - RNA, 15 nt, Mycobacterium avium subsp. paratuberculosis
accucgagcaccggc

SEQ ID NO: 2869916 - RNA, 18 nt, Mycobacterium avium subsp. paratuberculosis
accucgagcaccggcggc

SEQ ID NO: 2869917 - RNA, 14 nt, Mycobacterium avium subsp. paratuberculosis
accucgagcacgcc

SEQ ID NO: 2869918 - RNA, 15 nt, Mycobacterium avium subsp. paratuberculosis
accucgagcacgccc

SEQ ID NO: 2869919 - RNA, 14 nt, Mycobacterium avium subsp. paratuberculosis
accucgagcagcgc

SEQ ID NO: 2869920 - RNA, 16 nt, Mycobacterium avium subsp. paratuberculosis
accucgagcagcgcgc

SEQ ID NO: 2869921 - RNA, 16 nt, Mycobacterium avium subsp. paratuberculosis
accucgagcgucacgc

SEQ ID NO: 2869922 - RNA, 19 nt, Mycobacterium avium subsp. paratuberculosis
accucgagcgucacgcugg

SEQ ID NO: 2869923 - RNA, 16 nt, Mycobacterium avium subsp. paratuberculosis
accucgagcucaccga

SEQ ID NO: 2869924 - RNA, 17 nt, Mycobacterium avium subsp. paratuberculosis
accucgagcucaccgac

SEQ ID NO: 2869925 - RNA, 20 nt, Mycobacterium avium subsp. paratuberculosis
accucgaggaacuugcgccg

SEQ ID NO: 2869926 - RNA, 23 nt, Mycobacterium avium subsp. paratuberculosis
accucgaggaacuugcgccgggu

SEQ ID NO: 2869927 - RNA, 16 nt, Mycobacterium avium subsp. paratuberculosis
accucgaggccgaggu

SEQ ID NO: 2869928 - RNA, 18 nt, Mycobacterium avium subsp. paratuberculosis
accucgaggccgaggucg

SEQ ID NO: 2869929 - RNA, 21 nt, Mycobacterium avium subsp. paratuberculosis
accucgaggccgaggucgguc

SEQ ID NO: 2869930 - RNA, 18 nt, Mycobacterium avium subsp. paratuberculosis
accucgaguacucggugu

SEQ ID NO: 2869931 - RNA, 19 nt, Mycobacterium avium subsp. paratuberculosis
accucgaugccgugccggu

SEQ ID NO: 2869932 - RNA, 13 nt, Mycobacterium avium subsp. paratuberculosis
accucgauggcga

SEQ ID NO: 2869933 - RNA, 17 nt, Mycobacterium avium subsp. paratuberculosis
accucgauggguucuuc

SEQ ID NO: 2869934 - RNA, 14 nt, Mycobacterium avium subsp. paratuberculosis
accucgcacagcuu

SEQ ID NO: 2869935 - RNA, 16 nt, Mycobacterium avium subsp. paratuberculosis
accucgcccgccgcga

SEQ ID NO: 2869936 - RNA, 19 nt, Mycobacterium avium subsp. paratuberculosis
accucgcccgccgcgacgg

SEQ ID NO: 2869937 - RNA, 12 nt, Mycobacterium avium subsp. paratuberculosis
accucgcccggc

SEQ ID NO: 2869938 - RNA, 14 nt, Mycobacterium avium subsp. paratuberculosis
accucgcccggcuc

SEQ ID NO: 2869939 - RNA, 13 nt, Mycobacterium avium subsp. paratuberculosis
accucgccgacgg

SEQ ID NO: 2869940 - RNA, 17 nt, Mycobacterium avium subsp. paratuberculosis
accucgccgacgguguc

SEQ ID NO: 2869941 - RNA, 21 nt, Mycobacterium avium subsp. paratuberculosis
accucgccgacgucccagcac

SEQ ID NO: 2869942 - RNA, 17 nt, Mycobacterium avium subsp. paratuberculosis
accucgccgagcagccg

SEQ ID NO: 2869943 - RNA, 15 nt, Mycobacterium avium subsp. paratuberculosis
accucgccggccgcc

SEQ ID NO: 2869944 - RNA, 18 nt, Mycobacterium avium subsp. paratuberculosis
accucgccggccgccgug

SEQ ID NO: 2869945 - RNA, 14 nt, Mycobacterium avium subsp. paratuberculosis
accucgccggccgg

SEQ ID NO: 2869946 - RNA, 16 nt, Mycobacterium avium subsp. paratuberculosis
accucgccggccgggc

SEQ ID NO: 2869947 - RNA, 18 nt, Mycobacterium avium subsp. paratuberculosis
accucgccggccgggcgg

SEQ ID NO: 2869948 - RNA, 15 nt, Mycobacterium avium subsp. paratuberculosis
accucgccuccagca

SEQ ID NO: 2869949 - RNA, 21 nt, Mycobacterium avium subsp. paratuberculosis
accucgccuccagcagggaca

SEQ ID NO: 2869950 - RNA, 15 nt, Mycobacterium avium subsp. paratuberculosis
accucgcgcaccggc

SEQ ID NO: 2869951 - RNA, 13 nt, Mycobacterium avium subsp. paratuberculosis
accucgcgcagca

SEQ ID NO: 2869952 - RNA, 14 nt, Mycobacterium avium subsp. paratuberculosis
accucgcgcagcac

SEQ ID NO: 2869953 - RNA, 13 nt, Mycobacterium avium subsp. paratuberculosis
accucgcgcagcc

SEQ ID NO: 2869954 - RNA, 14 nt, Mycobacterium avium subsp. paratuberculosis
accucgcgcagccc

SEQ ID NO: 2869955 - RNA, 16 nt, Mycobacterium avium subsp. paratuberculosis
accucgcgcagccccc

SEQ ID NO: 2869956 - RNA, 12 nt, Mycobacterium avium subsp. paratuberculosis
accucgcgcccg

SEQ ID NO: 2869957 - RNA, 15 nt, Mycobacterium avium subsp. paratuberculosis
accucgcgcccggcg

SEQ ID NO: 2869958 - RNA, 16 nt, Mycobacterium avium subsp. paratuberculosis
accucgcgcccggcgc

SEQ ID NO: 2869959 - RNA, 17 nt, Mycobacterium avium subsp. paratuberculosis
accucgcgcccggcgcc

SEQ ID NO: 2869960 - RNA, 20 nt, Mycobacterium avium subsp. paratuberculosis
accucgcgcccggcgccggc

SEQ ID NO: 2869961 - RNA, 20 nt, Mycobacterium avium subsp. paratuberculosis
accucgcgccgcgaucucgg

SEQ ID NO: 2869962 - RNA, 23 nt, Mycobacterium avium subsp. paratuberculosis
accucgcgccgcgaucucggcgg

SEQ ID NO: 2869963 - RNA, 15 nt, Mycobacterium avium subsp. paratuberculosis
accucgcgcgcgagc

SEQ ID NO: 2869964 - RNA, 16 nt, Mycobacterium avium subsp. paratuberculosis
accucgcgcggggcgg

SEQ ID NO: 2869965 - RNA, 19 nt, Mycobacterium avium subsp. paratuberculosis
accucgcgcggggcggccg

SEQ ID NO: 2869966 - RNA, 20 nt, Mycobacterium avium subsp. paratuberculosis
accucgcgcgucacgcuggc

SEQ ID NO: 2869967 - RNA, 23 nt, Mycobacterium avium subsp. paratuberculosis
accucgcgcgucacgcuggcgug

SEQ ID NO: 2869968 - RNA, 14 nt, Mycobacterium avium subsp. paratuberculosis
accucgcggcggcg

SEQ ID NO: 2869969 - RNA, 15 nt, Mycobacterium avium subsp. paratuberculosis
accucgcggcggcgu

SEQ ID NO: 2869970 - RNA, 19 nt, Mycobacterium avium subsp. paratuberculosis
accucgcggcggcgucggc

SEQ ID NO: 2869971 - RNA, 21 nt, Mycobacterium avium subsp. paratuberculosis
accucgcggcggcgucggcgu

SEQ ID NO: 2869972 - RNA, 15 nt, Mycobacterium avium subsp. paratuberculosis
accucgcuacgcgag

SEQ ID NO: 2869973 - RNA, 16 nt, Mycobacterium avium subsp. paratuberculosis
accucgcuacgcgagc

SEQ ID NO: 2869974 - RNA, 18 nt, Mycobacterium avium subsp. paratuberculosis
accucgcuacgcgagcug

SEQ ID NO: 2869975 - RNA, 19 nt, Mycobacterium avium subsp. paratuberculosis
accucgcuacgcgagcugc

SEQ ID NO: 2869976 - RNA, 21 nt, Mycobacterium avium subsp. paratuberculosis
accucgcugcgcgaggagauu

SEQ ID NO: 2869977 - RNA, 20 nt, Mycobacterium avium subsp. paratuberculosis
accucggagaugauggccgc

SEQ ID NO: 2869978 - RNA, 15 nt, Mycobacterium avium subsp. paratuberculosis
accucggaucgucug

SEQ ID NO: 2869979 - RNA, 16 nt, Mycobacterium avium subsp. paratuberculosis
accucggccaccaccu

SEQ ID NO: 2869980 - RNA, 11 nt, Mycobacterium avium subsp. paratuberculosis
accucggccag

SEQ ID NO: 2869981 - RNA, 15 nt, Mycobacterium avium subsp. paratuberculosis
accucggccagcgcc

SEQ ID NO: 2869982 - RNA, 21 nt, Mycobacterium avium subsp. paratuberculosis
accucggccagcgccgcgcgc

SEQ ID NO: 2869983 - RNA, 22 nt, Mycobacterium avium subsp. paratuberculosis
accucggccagcgccgcgcgcg

SEQ ID NO: 2869984 - RNA, 14 nt, Mycobacterium avium subsp. paratuberculosis
accucggccggguc

SEQ ID NO: 2869985 - RNA, 23 nt, Mycobacterium avium subsp. paratuberculosis
accucggccuugaccacggugcg

SEQ ID NO: 2869986 - RNA, 19 nt, Mycobacterium avium subsp. paratuberculosis
accucggcgaccagcgacg

SEQ ID NO: 2869987 - RNA, 20 nt, Mycobacterium avium subsp. paratuberculosis
accucggcgaucugcuccuc

SEQ ID NO: 2869988 - RNA, 15 nt, Mycobacterium avium subsp. paratuberculosis
accucggcggcaccg

SEQ ID NO: 2869989 - RNA, 17 nt, Mycobacterium avium subsp. paratuberculosis
accucggcggcaccgcc

SEQ ID NO: 2869990 - RNA, 18 nt, Mycobacterium avium subsp. paratuberculosis
accucggcggcaccgccc

SEQ ID NO: 2869991 - RNA, 12 nt, Mycobacterium avium subsp. paratuberculosis
accucggcggcg

SEQ ID NO: 2869992 - RNA, 13 nt, Mycobacterium avium subsp. paratuberculosis
accucggcggcgg

SEQ ID NO: 2869993 - RNA, 16 nt, Mycobacterium avium subsp. paratuberculosis
accucggcggcggcgc

SEQ ID NO: 2869994 - RNA, 17 nt, Mycobacterium avium subsp. paratuberculosis
accucggcggcggcgcg

SEQ ID NO: 2869995 - RNA, 18 nt, Mycobacterium avium subsp. paratuberculosis
accucggcggcggcgcgc

SEQ ID NO: 2869996 - RNA, 19 nt, Mycobacterium avium subsp. paratuberculosis
accucggcggcggcgcgcc

SEQ ID NO: 2869997 - RNA, 23 nt, Mycobacterium avium subsp. paratuberculosis
accucggcggcggcgcgccggcc

SEQ ID NO: 2869998 - RNA, 14 nt, Mycobacterium avium subsp. paratuberculosis
accucggcgucggc

SEQ ID NO: 2869999 - RNA, 16 nt, Mycobacterium avium subsp. paratuberculosis
accucggcgucggcgc

SEQ ID NO: 2870000 - RNA, 17 nt, Mycobacterium avium subsp. paratuberculosis
accucggcgucggcgcg

SEQ ID NO: 2870001 - RNA, 19 nt, Mycobacterium avium subsp. paratuberculosis
accucggcgucggcgcgug

SEQ ID NO: 2870002 - RNA, 20 nt, Mycobacterium avium subsp. paratuberculosis
accucgggcauuggcagcuc

SEQ ID NO: 2870003 - RNA, 21 nt, Mycobacterium avium subsp. paratuberculosis
accucgggcauuggcagcucg

SEQ ID NO: 2870004 - RNA, 18 nt, Mycobacterium avium subsp. paratuberculosis
accucggggucggccgga

SEQ ID NO: 2870005 - RNA, 19 nt, Mycobacterium avium subsp. paratuberculosis
accucggguguaggcccga

SEQ ID NO: 2870006 - RNA, 14 nt, Mycobacterium avium subsp. paratuberculosis
accucggucgggga

SEQ ID NO: 2870007 - RNA, 17 nt, Mycobacterium avium subsp. paratuberculosis
accucggugaugguccc

SEQ ID NO: 2870008 - RNA, 17 nt, Mycobacterium avium subsp. paratuberculosis
accucgguggacgccgc

SEQ ID NO: 2870009 - RNA, 17 nt, Mycobacterium avium subsp. paratuberculosis
accucggugucgagguc

SEQ ID NO: 2870010 - RNA, 16 nt, Mycobacterium avium subsp. paratuberculosis
accucgucgacggcgg

SEQ ID NO: 2870011 - RNA, 13 nt, Mycobacterium avium subsp. paratuberculosis
accucgucgaucu

SEQ ID NO: 2870012 - RNA, 22 nt, Mycobacterium avium subsp. paratuberculosis
accucgucgaucuucgcggcgu

SEQ ID NO: 2870013 - RNA, 23 nt, Mycobacterium avium subsp. paratuberculosis
accucgucgaucuucgcggcgua

SEQ ID NO: 2870014 - RNA, 16 nt, Mycobacterium avium subsp. paratuberculosis
accucgucgccgucgg

SEQ ID NO: 2870015 - RNA, 21 nt, Mycobacterium avium subsp. paratuberculosis
accucgucggcggcgacggcg

SEQ ID NO: 2870016 - RNA, 14 nt, Mycobacterium avium subsp. paratuberculosis
accucgucgggcgc

SEQ ID NO: 2870017 - RNA, 18 nt, Mycobacterium avium subsp. paratuberculosis
accucgucgggcgccagc

SEQ ID NO: 2870018 - RNA, 18 nt, Mycobacterium avium subsp. paratuberculosis
accucgugcacaugcccg

SEQ ID NO: 2870019 - RNA, 14 nt, Mycobacterium avium subsp. paratuberculosis
accucugcgcgagc

SEQ ID NO: 2870020 - RNA, 23 nt, Mycobacterium avium subsp. paratuberculosis
accucuucgcgguccaucuccag

SEQ ID NO: 2870021 - RNA, 15 nt, Mycobacterium avium subsp. paratuberculosis
accucuucggcgccg

SEQ ID NO: 2870022 - RNA, 17 nt, Mycobacterium avium subsp. paratuberculosis
accucuucggcgccggc

SEQ ID NO: 2870023 - RNA, 18 nt, Mycobacterium avium subsp. paratuberculosis
accucuucgggcagcgcg

SEQ ID NO: 2870024 - RNA, 20 nt, Mycobacterium avium subsp. paratuberculosis
accucuucgggcagcgcgug

SEQ ID NO: 2870025 - RNA, 14 nt, Mycobacterium avium subsp. paratuberculosis
accucuucgugcac

SEQ ID NO: 2870026 - RNA, 14 nt, Mycobacterium avium subsp. paratuberculosis
accucuugcggcgc

SEQ ID NO: 2870027 - RNA, 15 nt, Mycobacterium avium subsp. paratuberculosis
accucuugcggcgca

SEQ ID NO: 2870028 - RNA, 23 nt, Mycobacterium avium subsp. paratuberculosis
accucuugggacuggauggcgau

SEQ ID NO: 2870029 - RNA, 17 nt, Mycobacterium avium subsp. paratuberculosis
accugaacggccgcgca

SEQ ID NO: 2870030 - RNA, 18 nt, Mycobacterium avium subsp. paratuberculosis
accugaacggccgcgcag

SEQ ID NO: 2870031 - RNA, 18 nt, Mycobacterium avium subsp. paratuberculosis
accugaccagcggcgcgc

SEQ ID NO: 2870032 - RNA, 20 nt, Mycobacterium avium subsp. paratuberculosis
accugaccagcggcgcgccg

SEQ ID NO: 2870033 - RNA, 12 nt, Mycobacterium avium subsp. paratuberculosis
accugaccgcgg

SEQ ID NO: 2870034 - RNA, 17 nt, Mycobacterium avium subsp. paratuberculosis
accugaccgucggccag

SEQ ID NO: 2870035 - RNA, 20 nt, Mycobacterium avium subsp. paratuberculosis
accugacgcucggucgccac

SEQ ID NO: 2870036 - RNA, 19 nt, Mycobacterium avium subsp. paratuberculosis
accugagucugggucacgc

SEQ ID NO: 2870037 - RNA, 19 nt, Mycobacterium avium subsp. paratuberculosis
accugauaggggucggcga

SEQ ID NO: 2870038 - RNA, 13 nt, Mycobacterium avium subsp. paratuberculosis
accugaucgaugc

SEQ ID NO: 2870039 - RNA, 15 nt, Mycobacterium avium subsp. paratuberculosis
accugaucgcggcga

SEQ ID NO: 2870040 - RNA, 20 nt, Mycobacterium avium subsp. paratuberculosis
accugaucgcggcgagcagc

SEQ ID NO: 2870041 - RNA, 13 nt, Mycobacterium avium subsp. paratuberculosis
accugaucuucga

SEQ ID NO: 2870042 - RNA, 16 nt, Mycobacterium avium subsp. paratuberculosis
accugauuucaucgcg

SEQ ID NO: 2870043 - RNA, 19 nt, Mycobacterium avium subsp. paratuberculosis
accugauuucaucgcggcg

SEQ ID NO: 2870044 - RNA, 21 nt, Mycobacterium avium subsp. paratuberculosis
accugcacgcuguccgcguga

SEQ ID NO: 2870045 - RNA, 22 nt, Mycobacterium avium subsp. paratuberculosis
accugcagccggucggaggccu

SEQ ID NO: 2870046 - RNA, 17 nt, Mycobacterium avium subsp. paratuberculosis
accugcagcgccuuggg

SEQ ID NO: 2870047 - RNA, 18 nt, Mycobacterium avium subsp. paratuberculosis
accugcaguucgaucacc

SEQ ID NO: 2870048 - RNA, 13 nt, Mycobacterium avium subsp. paratuberculosis
accugcaucucga

SEQ ID NO: 2870049 - RNA, 20 nt, Mycobacterium avium subsp. paratuberculosis
accugcaucucgacccgggc

SEQ ID NO: 2870050 - RNA, 20 nt, Mycobacterium avium subsp. paratuberculosis
accugccccacacgcucggc

SEQ ID NO: 2870051 - RNA, 16 nt, Mycobacterium avium subsp. paratuberculosis
accugcccgggcccga

SEQ ID NO: 2870052 - RNA, 20 nt, Mycobacterium avium subsp. paratuberculosis
accugccgcaacgggccgca

SEQ ID NO: 2870053 - RNA, 12 nt, Mycobacterium avium subsp. paratuberculosis
accugccgcaca

SEQ ID NO: 2870054 - RNA, 19 nt, Mycobacterium avium subsp. paratuberculosis
accugccgcacaccgucuc

SEQ ID NO: 2870055 - RNA, 14 nt, Mycobacterium avium subsp. paratuberculosis
accugccggcgauc

SEQ ID NO: 2870056 - RNA, 12 nt, Mycobacterium avium subsp. paratuberculosis
accugccgucga

SEQ ID NO: 2870057 - RNA, 13 nt, Mycobacterium avium subsp. paratuberculosis
accugcgcgacgc

SEQ ID NO: 2870058 - RNA, 15 nt, Mycobacterium avium subsp. paratuberculosis
accugcgcgacgcug

SEQ ID NO: 2870059 - RNA, 14 nt, Mycobacterium avium subsp. paratuberculosis
accugcgcgacggc

SEQ ID NO: 2870060 - RNA, 16 nt, Mycobacterium avium subsp. paratuberculosis
accugcgcgacggcgc

SEQ ID NO: 2870061 - RNA, 17 nt, Mycobacterium avium subsp. paratuberculosis
accugcggcaccucggc

SEQ ID NO: 2870062 - RNA, 14 nt, Mycobacterium avium subsp. paratuberculosis
accugcggccccug

SEQ ID NO: 2870063 - RNA, 14 nt, Mycobacterium avium subsp. paratuberculosis
accugcggcccguc

SEQ ID NO: 2870064 - RNA, 19 nt, Mycobacterium avium subsp. paratuberculosis
accugcggcccgucgccgu

SEQ ID NO: 2870065 - RNA, 22 nt, Mycobacterium avium subsp. paratuberculosis
accugcggcggcagucgcagca

SEQ ID NO: 2870066 - RNA, 18 nt, Mycobacterium avium subsp. paratuberculosis
accugcgggcccaccgcg

SEQ ID NO: 2870067 - RNA, 19 nt, Mycobacterium avium subsp. paratuberculosis
accugcgggcccaccgcgc

SEQ ID NO: 2870068 - RNA, 22 nt, Mycobacterium avium subsp. paratuberculosis
accugcgggcccaccgcgcgcu

SEQ ID NO: 2870069 - RNA, 14 nt, Mycobacterium avium subsp. paratuberculosis
accugcggugccaa

SEQ ID NO: 2870070 - RNA, 14 nt, Mycobacterium avium subsp. paratuberculosis
accugcgugccuug

SEQ ID NO: 2870071 - RNA, 19 nt, Mycobacterium avium subsp. paratuberculosis
accugcucaccgagcuggg

SEQ ID NO: 2870072 - RNA, 21 nt, Mycobacterium avium subsp. paratuberculosis
accugcucaccgagcugggcc

SEQ ID NO: 2870073 - RNA, 17 nt, Mycobacterium avium subsp. paratuberculosis
accugcucgaugcgcgc

SEQ ID NO: 2870074 - RNA, 23 nt, Mycobacterium avium subsp. paratuberculosis
accugcucgaugcgcgccagcag

SEQ ID NO: 2870075 - RNA, 18 nt, Mycobacterium avium subsp. paratuberculosis
accugcucgucggugacg

SEQ ID NO: 2870076 - RNA, 19 nt, Mycobacterium avium subsp. paratuberculosis
accugcucgucggugacgg

SEQ ID NO: 2870077 - RNA, 15 nt, Mycobacterium avium subsp. paratuberculosis
accugcugcucgucg

SEQ ID NO: 2870078 - RNA, 23 nt, Mycobacterium avium subsp. paratuberculosis
accugcugcucgucgcgggcgcc

SEQ ID NO: 2870079 - RNA, 17 nt, Mycobacterium avium subsp. paratuberculosis
accugcugggcgggcag

SEQ ID NO: 2870080 - RNA, 18 nt, Mycobacterium avium subsp. paratuberculosis
accugcugggcgggcagc

SEQ ID NO: 2870081 - RNA, 22 nt, Mycobacterium avium subsp. paratuberculosis
accugcugggcgggcagccgcu

SEQ ID NO: 2870082 - RNA, 17 nt, Mycobacterium avium subsp. paratuberculosis
accugcuugagcccguc

SEQ ID NO: 2870083 - RNA, 18 nt, Mycobacterium avium subsp. paratuberculosis
accugcuugagcccgucg

SEQ ID NO: 2870084 - RNA, 22 nt, Mycobacterium avium subsp. paratuberculosis
accugcuugagcccgucgacgu

SEQ ID NO: 2870085 - RNA, 16 nt, Mycobacterium avium subsp. paratuberculosis
accugcuuggcggccu

SEQ ID NO: 2870086 - RNA, 20 nt, Mycobacterium avium subsp. paratuberculosis
accugcuuggucuccggccc

SEQ ID NO: 2870087 - RNA, 23 nt, Mycobacterium avium subsp. paratuberculosis
accugcuuguugagggugacggu

SEQ ID NO: 2870088 - RNA, 18 nt, Mycobacterium avium subsp. paratuberculosis
accuggaagcgcaucgcc

SEQ ID NO: 2870089 - RNA, 19 nt, Mycobacterium avium subsp. paratuberculosis
accuggaagcgcaucgccg

SEQ ID NO: 2870090 - RNA, 22 nt, Mycobacterium avium subsp. paratuberculosis
accuggaagcgcaucgccggcg

SEQ ID NO: 2870091 - RNA, 14 nt, Mycobacterium avium subsp. paratuberculosis
accuggacgccgca

SEQ ID NO: 2870092 - RNA, 14 nt, Mycobacterium avium subsp. paratuberculosis
accuggagcggguc

SEQ ID NO: 2870093 - RNA, 16 nt, Mycobacterium avium subsp. paratuberculosis
accuggaggccaacga

SEQ ID NO: 2870094 - RNA, 19 nt, Mycobacterium avium subsp. paratuberculosis
accuggcagcauccgccga

SEQ ID NO: 2870095 - RNA, 15 nt, Mycobacterium avium subsp. paratuberculosis
accuggccaccagca

SEQ ID NO: 2870096 - RNA, 17 nt, Mycobacterium avium subsp. paratuberculosis
accuggccaccagcagc

SEQ ID NO: 2870097 - RNA, 18 nt, Mycobacterium avium subsp. paratuberculosis
accuggccaccagcagca

SEQ ID NO: 2870098 - RNA, 12 nt, Mycobacterium avium subsp. paratuberculosis
accuggccggcc

SEQ ID NO: 2870099 - RNA, 14 nt, Mycobacterium avium subsp. paratuberculosis
accuggccggccau

SEQ ID NO: 2870100 - RNA, 15 nt, Mycobacterium avium subsp. paratuberculosis
accuggccggccauc

SEQ ID NO: 2870101 - RNA, 22 nt, Mycobacterium avium subsp. paratuberculosis
accuggccggccaucuucaguu

SEQ ID NO: 2870102 - RNA, 14 nt, Mycobacterium avium subsp. paratuberculosis
accuggccggccuc

SEQ ID NO: 2870103 - RNA, 15 nt, Mycobacterium avium subsp. paratuberculosis
accuggccggccucg

SEQ ID NO: 2870104 - RNA, 20 nt, Mycobacterium avium subsp. paratuberculosis
accuggccgguauuggccac

SEQ ID NO: 2870105 - RNA, 16 nt, Mycobacterium avium subsp. paratuberculosis
accuggccguucaggu

SEQ ID NO: 2870106 - RNA, 14 nt, Mycobacterium avium subsp. paratuberculosis
accuggcgcagcac

SEQ ID NO: 2870107 - RNA, 14 nt, Mycobacterium avium subsp. paratuberculosis
accuggcgggccag

SEQ ID NO: 2870108 - RNA, 19 nt, Mycobacterium avium subsp. paratuberculosis
accuggcgggccagcuugu

SEQ ID NO: 2870109 - RNA, 16 nt, Mycobacterium avium subsp. paratuberculosis
accuggcugacggcgu

SEQ ID NO: 2870110 - RNA, 18 nt, Mycobacterium avium subsp. paratuberculosis
accuggcugccugguugg

SEQ ID NO: 2870111 - RNA, 20 nt, Mycobacterium avium subsp. paratuberculosis
accugggaugucuagccgcc

SEQ ID NO: 2870112 - RNA, 13 nt, Mycobacterium avium subsp. paratuberculosis
accugggcgccgu

SEQ ID NO: 2870113 - RNA, 14 nt, Mycobacterium avium subsp. paratuberculosis
accugggcgccguc

SEQ ID NO: 2870114 - RNA, 20 nt, Mycobacterium avium subsp. paratuberculosis
accugggcgccgucgccgac

SEQ ID NO: 2870115 - RNA, 15 nt, Mycobacterium avium subsp. paratuberculosis
accugggcggcggcg

SEQ ID NO: 2870116 - RNA, 14 nt, Mycobacterium avium subsp. paratuberculosis
accugggcggggcu

SEQ ID NO: 2870117 - RNA, 17 nt, Mycobacterium avium subsp. paratuberculosis
accugggcgucgucggc

SEQ ID NO: 2870118 - RNA, 18 nt, Mycobacterium avium subsp. paratuberculosis
accugggcgucgucggcc

SEQ ID NO: 2870119 - RNA, 18 nt, Mycobacterium avium subsp. paratuberculosis
accugggucaucaccuug

SEQ ID NO: 2870120 - RNA, 15 nt, Mycobacterium avium subsp. paratuberculosis
accugggugcgccac

SEQ ID NO: 2870121 - RNA, 16 nt, Mycobacterium avium subsp. paratuberculosis
accugguccaccgcgg

SEQ ID NO: 2870122 - RNA, 17 nt, Mycobacterium avium subsp. paratuberculosis
accugguccaccgcggc

SEQ ID NO: 2870123 - RNA, 20 nt, Mycobacterium avium subsp. paratuberculosis
accugguccaccgcggcggc

SEQ ID NO: 2870124 - RNA, 16 nt, Mycobacterium avium subsp. paratuberculosis
accuggucgccgaacg

SEQ ID NO: 2870125 - RNA, 17 nt, Mycobacterium avium subsp. paratuberculosis
accuggucgccgaacgu

SEQ ID NO: 2870126 - RNA, 16 nt, Mycobacterium avium subsp. paratuberculosis
accuggucgccgccgu

SEQ ID NO: 2870127 - RNA, 20 nt, Mycobacterium avium subsp. paratuberculosis
accuggucgggguggaucgc

SEQ ID NO: 2870128 - RNA, 23 nt, Mycobacterium avium subsp. paratuberculosis
accuggucgggguggaucgccca

SEQ ID NO: 2870129 - RNA, 12 nt, Mycobacterium avium subsp. paratuberculosis
accuggucgguc

SEQ ID NO: 2870130 - RNA, 15 nt, Mycobacterium avium subsp. paratuberculosis
accuggucggucagc

SEQ ID NO: 2870131 - RNA, 14 nt, Mycobacterium avium subsp. paratuberculosis
accuggugcucgcg

SEQ ID NO: 2870132 - RNA, 18 nt, Mycobacterium avium subsp. paratuberculosis
accuggugcucgcgcucg

SEQ ID NO: 2870133 - RNA, 17 nt, Mycobacterium avium subsp. paratuberculosis
accugguucucccgucg

SEQ ID NO: 2870134 - RNA, 21 nt, Mycobacterium avium subsp. paratuberculosis
accugguucucccgucgcgac

SEQ ID NO: 2870135 - RNA, 22 nt, Mycobacterium avium subsp. paratuberculosis
accugguugaacggcaccccgc

SEQ ID NO: 2870136 - RNA, 18 nt, Mycobacterium avium subsp. paratuberculosis
accugguugccgcccucg

SEQ ID NO: 2870137 - RNA, 23 nt, Mycobacterium avium subsp. paratuberculosis
accugguugccgcccucggccgu

SEQ ID NO: 2870138 - RNA, 18 nt, Mycobacterium avium subsp. paratuberculosis
accugguuggcccgcacc

SEQ ID NO: 2870139 - RNA, 22 nt, Mycobacterium avium subsp. paratuberculosis
accugguuggcccgcaccaccc

SEQ ID NO: 2870140 - RNA, 17 nt, Mycobacterium avium subsp. paratuberculosis
accugguuggcgacagg

SEQ ID NO: 2870141 - RNA, 17 nt, Mycobacterium avium subsp. paratuberculosis
accuguacgugucccug

SEQ ID NO: 2870142 - RNA, 23 nt, Mycobacterium avium subsp. paratuberculosis
accuguacgugucccugcggcug

SEQ ID NO: 2870143 - RNA, 17 nt, Mycobacterium avium subsp. paratuberculosis
accugugccauagacca

SEQ ID NO: 2870144 - RNA, 14 nt, Mycobacterium avium subsp. paratuberculosis
accugugcgcccca

SEQ ID NO: 2870145 - RNA, 18 nt, Mycobacterium avium subsp. paratuberculosis
accuguuuggccagccag

SEQ ID NO: 2870146 - RNA, 17 nt, Mycobacterium avium subsp. paratuberculosis
accuucaccgaccagcu

SEQ ID NO: 2870147 - RNA, 17 nt, Mycobacterium avium subsp. paratuberculosis
accuucaccgcgccggu

SEQ ID NO: 2870148 - RNA, 20 nt, Mycobacterium avium subsp. paratuberculosis
accuucccaaccccgggcgg

SEQ ID NO: 2870149 - RNA, 16 nt, Mycobacterium avium subsp. paratuberculosis
accuucgagccgccgc

SEQ ID NO: 2870150 - RNA, 17 nt, Mycobacterium avium subsp. paratuberculosis
accuucgagccgccgcc

SEQ ID NO: 2870151 - RNA, 20 nt, Mycobacterium avium subsp. paratuberculosis
accuucucccgcggcagccg

SEQ ID NO: 2870152 - RNA, 17 nt, Mycobacterium avium subsp. paratuberculosis
accuucugcgcgccguc

SEQ ID NO: 2870153 - RNA, 12 nt, Mycobacterium avium subsp. paratuberculosis
accuucuugucc

SEQ ID NO: 2870154 - RNA, 12 nt, Mycobacterium avium subsp. paratuberculosis
accuugaccacc

SEQ ID NO: 2870155 - RNA, 14 nt, Mycobacterium avium subsp. paratuberculosis
accuugaccaccga

SEQ ID NO: 2870156 - RNA, 22 nt, Mycobacterium avium subsp. paratuberculosis
accuugaccaccgagccgggca

SEQ ID NO: 2870157 - RNA, 11 nt, Mycobacterium avium subsp. paratuberculosis
accuugaccag

SEQ ID NO: 2870158 - RNA, 21 nt, Mycobacterium avium subsp. paratuberculosis
accuugacccaggcccgggau

SEQ ID NO: 2870159 - RNA, 16 nt, Mycobacterium avium subsp. paratuberculosis
accuugaucucgucgc

SEQ ID NO: 2870160 - RNA, 23 nt, Mycobacterium avium subsp. paratuberculosis
accuugcagcccgcguccagcag

SEQ ID NO: 2870161 - RNA, 16 nt, Mycobacterium avium subsp. paratuberculosis
accuugcccgucgcgu

SEQ ID NO: 2870162 - RNA, 17 nt, Mycobacterium avium subsp. paratuberculosis
accuugcccgucgcguc

SEQ ID NO: 2870163 - RNA, 18 nt, Mycobacterium avium subsp. paratuberculosis
accuugcgcagccggcag

SEQ ID NO: 2870164 - RNA, 20 nt, Mycobacterium avium subsp. paratuberculosis
accuugcgcgggucgccggg

SEQ ID NO: 2870165 - RNA, 14 nt, Mycobacterium avium subsp. paratuberculosis
accuugcggccggc

SEQ ID NO: 2870166 - RNA, 18 nt, Mycobacterium avium subsp. paratuberculosis
accuugcggccggcggcg

SEQ ID NO: 2870167 - RNA, 21 nt, Mycobacterium avium subsp. paratuberculosis
accuuggccggugcgccgacc

SEQ ID NO: 2870168 - RNA, 22 nt, Mycobacterium avium subsp. paratuberculosis
accuuggccggugcgccgaccg

SEQ ID NO: 2870169 - RNA, 16 nt, Mycobacterium avium subsp. paratuberculosis
accuuggcgucgauca

SEQ ID NO: 2870170 - RNA, 16 nt, Mycobacterium avium subsp. paratuberculosis
accuugggcauccgcu

SEQ ID NO: 2870171 - RNA, 19 nt, Mycobacterium avium subsp. paratuberculosis
accuuggggucaccguccu

SEQ ID NO: 2870172 - RNA, 20 nt, Mycobacterium avium subsp. paratuberculosis
accuuggucagcucccggca

SEQ ID NO: 2870173 - RNA, 21 nt, Mycobacterium avium subsp. paratuberculosis
accuuggucagcucccggcag

SEQ ID NO: 2870174 - RNA, 20 nt, Mycobacterium avium subsp. paratuberculosis
accuugguggccgcggccgc

SEQ ID NO: 2870175 - RNA, 14 nt, Mycobacterium avium subsp. paratuberculosis
accuugucggcguc

SEQ ID NO: 2870176 - RNA, 18 nt, Mycobacterium avium subsp. paratuberculosis
acgaaauaaccgcgcggc

SEQ ID NO: 2870177 - RNA, 13 nt, Mycobacterium avium subsp. paratuberculosis
acgaacaccacgu

SEQ ID NO: 2870178 - RNA, 15 nt, Mycobacterium avium subsp. paratuberculosis
acgaacaccggcgcg

SEQ ID NO: 2870179 - RNA, 14 nt, Mycobacterium avium subsp. paratuberculosis
acgaacaccggcgg

SEQ ID NO: 2870180 - RNA, 14 nt, Mycobacterium avium subsp. paratuberculosis
acgaacagcaccgc

SEQ ID NO: 2870181 - RNA, 16 nt, Mycobacterium avium subsp. paratuberculosis
acgaacaugcugccgc

SEQ ID NO: 2870182 - RNA, 13 nt, Mycobacterium avium subsp. paratuberculosis
acgaaccaggcgc

SEQ ID NO: 2870183 - RNA, 16 nt, Mycobacterium avium subsp. paratuberculosis
acgaaccauucguggc

SEQ ID NO: 2870184 - RNA, 18 nt, Mycobacterium avium subsp. paratuberculosis
acgaacccgccgcggccg

SEQ ID NO: 2870185 - RNA, 13 nt, Mycobacterium avium subsp. paratuberculosis
acgaacccggcgg

SEQ ID NO: 2870186 - RNA, 17 nt, Mycobacterium avium subsp. paratuberculosis
acgaacccggcggcccc

SEQ ID NO: 2870187 - RNA, 15 nt, Mycobacterium avium subsp. paratuberculosis
acgaaccgccacacg

SEQ ID NO: 2870188 - RNA, 23 nt, Mycobacterium avium subsp. paratuberculosis
acgaaccgcucgaacacccggcu

SEQ ID NO: 2870189 - RNA, 20 nt, Mycobacterium avium subsp. paratuberculosis
acgaaccgguugcgggccga

SEQ ID NO: 2870190 - RNA, 14 nt, Mycobacterium avium subsp. paratuberculosis
acgaacgacgcggc

SEQ ID NO: 2870191 - RNA, 15 nt, Mycobacterium avium subsp. paratuberculosis
acgaacgccaccacg

SEQ ID NO: 2870192 - RNA, 14 nt, Mycobacterium avium subsp. paratuberculosis
acgaacgcgccgcc

SEQ ID NO: 2870193 - RNA, 20 nt, Mycobacterium avium subsp. paratuberculosis
acgaacgcgccgccgagcaa

SEQ ID NO: 2870194 - RNA, 17 nt, Mycobacterium avium subsp. paratuberculosis
acgaacgcggccgccag

SEQ ID NO: 2870195 - RNA, 14 nt, Mycobacterium avium subsp. paratuberculosis
acgaacgcggcgcc

SEQ ID NO: 2870196 - RNA, 18 nt, Mycobacterium avium subsp. paratuberculosis
acgaacgcuuccagcacc

SEQ ID NO: 2870197 - RNA, 22 nt, Mycobacterium avium subsp. paratuberculosis
acgaacggcacguugcccagga

SEQ ID NO: 2870198 - RNA, 21 nt, Mycobacterium avium subsp. paratuberculosis
acgaacggcgcgaaccgggcc

SEQ ID NO: 2870199 - RNA, 23 nt, Mycobacterium avium subsp. paratuberculosis
acgaacggcgcgaaccgggccag

SEQ ID NO: 2870200 - RNA, 15 nt, Mycobacterium avium subsp. paratuberculosis
acgaacgucaggccg

SEQ ID NO: 2870201 - RNA, 17 nt, Mycobacterium avium subsp. paratuberculosis
acgaacuccgagccggu

SEQ ID NO: 2870202 - RNA, 15 nt, Mycobacterium avium subsp. paratuberculosis
acgaacuccgcgcgc

SEQ ID NO: 2870203 - RNA, 21 nt, Mycobacterium avium subsp. paratuberculosis
acgaacuccgcgcgcggcacg

SEQ ID NO: 2870204 - RNA, 17 nt, Mycobacterium avium subsp. paratuberculosis
acgaagaucccgcuggc

SEQ ID NO: 2870205 - RNA, 18 nt, Mycobacterium avium subsp. paratuberculosis
acgaagaugcgcccgguc

SEQ ID NO: 2870206 - RNA, 22 nt, Mycobacterium avium subsp. paratuberculosis
acgaagauggcgugccacagca

SEQ ID NO: 2870207 - RNA, 12 nt, Mycobacterium avium subsp. paratuberculosis
acgaagcagcuc

SEQ ID NO: 2870208 - RNA, 15 nt, Mycobacterium avium subsp. paratuberculosis
acgaagcagcucgcg

SEQ ID NO: 2870209 - RNA, 11 nt, Mycobacterium avium subsp. paratuberculosis
acgaagccgaa

SEQ ID NO: 2870210 - RNA, 14 nt, Mycobacterium avium subsp. paratuberculosis
acgaagcgggcggc

SEQ ID NO: 2870211 - RNA, 15 nt, Mycobacterium avium subsp. paratuberculosis
acgaagcgggcggcg

SEQ ID NO: 2870212 - RNA, 17 nt, Mycobacterium avium subsp. paratuberculosis
acgaagcgggcggcgaa

SEQ ID NO: 2870213 - RNA, 15 nt, Mycobacterium avium subsp. paratuberculosis
acgaagggcgccagc

SEQ ID NO: 2870214 - RNA, 16 nt, Mycobacterium avium subsp. paratuberculosis
acgaaggugcgcacga

SEQ ID NO: 2870215 - RNA, 17 nt, Mycobacterium avium subsp. paratuberculosis
acgaaguccgagccggc

SEQ ID NO: 2870216 - RNA, 12 nt, Mycobacterium avium subsp. paratuberculosis
acgaagucgacg

SEQ ID NO: 2870217 - RNA, 16 nt, Mycobacterium avium subsp. paratuberculosis
acgaagugcccggcgc

SEQ ID NO: 2870218 - RNA, 17 nt, Mycobacterium avium subsp. paratuberculosis
acgaaguugaucgcggc

SEQ ID NO: 2870219 - RNA, 18 nt, Mycobacterium avium subsp. paratuberculosis
acgaaguugaucgcggcg

SEQ ID NO: 2870220 - RNA, 23 nt, Mycobacterium avium subsp. paratuberculosis
acgaaguugaucgcggcggacag

SEQ ID NO: 2870221 - RNA, 23 nt, Mycobacterium avium subsp. paratuberculosis
acgaaguugguguccacccgcgc

SEQ ID NO: 2870222 - RNA, 23 nt, Mycobacterium avium subsp. paratuberculosis
acgaauacccuucggccggcagc

SEQ ID NO: 2870223 - RNA, 21 nt, Mycobacterium avium subsp. paratuberculosis
acgaaucccgccucggugagc

SEQ ID NO: 2870224 - RNA, 16 nt, Mycobacterium avium subsp. paratuberculosis
acgaauucggagacca

SEQ ID NO: 2870225 - RNA, 21 nt, Mycobacterium avium subsp. paratuberculosis
acgaauucggagaccaggucg

SEQ ID NO: 2870226 - RNA, 14 nt, Mycobacterium avium subsp. paratuberculosis
acgaauucgguggc

SEQ ID NO: 2870227 - RNA, 12 nt, Mycobacterium avium subsp. paratuberculosis
acgacaacagug

SEQ ID NO: 2870228 - RNA, 13 nt, Mycobacterium avium subsp. paratuberculosis
acgacaacagugc

SEQ ID NO: 2870229 - RNA, 14 nt, Mycobacterium avium subsp. paratuberculosis
acgacaccaccgug

SEQ ID NO: 2870230 - RNA, 20 nt, Mycobacterium avium subsp. paratuberculosis
acgacacccuucaucagcac

SEQ ID NO: 2870231 - RNA, 16 nt, Mycobacterium avium subsp. paratuberculosis
acgacacgauggguca

SEQ ID NO: 2870232 - RNA, 22 nt, Mycobacterium avium subsp. paratuberculosis
acgacacguggaccgagcgcgc

SEQ ID NO: 2870233 - RNA, 21 nt, Mycobacterium avium subsp. paratuberculosis
acgacagcacccaggugcugc

SEQ ID NO: 2870234 - RNA, 22 nt, Mycobacterium avium subsp. paratuberculosis
acgacagcaggaucuccggccg

SEQ ID NO: 2870235 - RNA, 18 nt, Mycobacterium avium subsp. paratuberculosis
acgacagcgacgggccgg

SEQ ID NO: 2870236 - RNA, 16 nt, Mycobacterium avium subsp. paratuberculosis
acgacaucaccaccgc

SEQ ID NO: 2870237 - RNA, 15 nt, Mycobacterium avium subsp. paratuberculosis
acgacaucucgacgg

SEQ ID NO: 2870238 - RNA, 18 nt, Mycobacterium avium subsp. paratuberculosis
acgacaucucgacgguga

SEQ ID NO: 2870239 - RNA, 23 nt, Mycobacterium avium subsp. paratuberculosis
acgacaucucgacggugaccggc

SEQ ID NO: 2870240 - RNA, 13 nt, Mycobacterium avium subsp. paratuberculosis
acgaccagcggca

SEQ ID NO: 2870241 - RNA, 15 nt, Mycobacterium avium subsp. paratuberculosis
acgaccagcggcagc

SEQ ID NO: 2870242 - RNA, 21 nt, Mycobacterium avium subsp. paratuberculosis
acgaccaggaaguacaccacc

SEQ ID NO: 2870243 - RNA, 19 nt, Mycobacterium avium subsp. paratuberculosis
acgcuguuggaaccggcca

SEQ ID NO: 2870244 - RNA, 14 nt, Mycobacterium avium subsp. paratuberculosis
acgcuuccagcacc

SEQ ID NO: 2870245 - RNA, 22 nt, Mycobacterium avium subsp. paratuberculosis
acgcuuccagcaccacccgguc

SEQ ID NO: 2870246 - RNA, 17 nt, Mycobacterium avium subsp. paratuberculosis
acgcuuccgugcuugcc

SEQ ID NO: 2870247 - RNA, 18 nt, Mycobacterium avium subsp. paratuberculosis
acgcuuccgugcuugccc

SEQ ID NO: 2870248 - RNA, 22 nt, Mycobacterium avium subsp. paratuberculosis
acgcuuccgugcuugcccgacg

SEQ ID NO: 2870249 - RNA, 21 nt, Mycobacterium avium subsp. paratuberculosis
acgcuugggguuuggcgacgu

SEQ ID NO: 2870250 - RNA, 18 nt, Mycobacterium avium subsp. paratuberculosis
acgcuuucgggucgacga

SEQ ID NO: 2870251 - RNA, 21 nt, Mycobacterium avium subsp. paratuberculosis
acgcuuuuucgcgaacuucag

SEQ ID NO: 2870252 - RNA, 19 nt, Mycobacterium avium subsp. paratuberculosis
acggaaaccgcugcggcac

SEQ ID NO: 2870253 - RNA, 20 nt, Mycobacterium avium subsp. paratuberculosis
acggaagcgguugagccaca

SEQ ID NO: 2870254 - RNA, 19 nt, Mycobacterium avium subsp. paratuberculosis
acggaauucgggugcggcg

SEQ ID NO: 2870255 - RNA, 18 nt, Mycobacterium avium subsp. paratuberculosis
acggacacccgcgcggug

SEQ ID NO: 2870256 - RNA, 20 nt, Mycobacterium avium subsp. paratuberculosis
acggacacccgcgcggugcc

SEQ ID NO: 2870257 - RNA, 19 nt, Mycobacterium avium subsp. paratuberculosis
acggacagcucaccgggcu

SEQ ID NO: 2870258 - RNA, 20 nt, Mycobacterium avium subsp. paratuberculosis
acggacgcauccacggccgg

SEQ ID NO: 2870259 - RNA, 21 nt, Mycobacterium avium subsp. paratuberculosis
acggagacgacgacgaacgcg

SEQ ID NO: 2870260 - RNA, 17 nt, Mycobacterium avium subsp. paratuberculosis
acggagccgagcaccag

SEQ ID NO: 2870261 - RNA, 18 nt, Mycobacterium avium subsp. paratuberculosis
acggagccgagcaccagg

SEQ ID NO: 2870262 - RNA, 14 nt, Mycobacterium avium subsp. paratuberculosis
acggagcgcccggc

SEQ ID NO: 2870263 - RNA, 18 nt, Mycobacterium avium subsp. paratuberculosis
acggagcggccuaacgag

SEQ ID NO: 2870264 - RNA, 14 nt, Mycobacterium avium subsp. paratuberculosis
acggagucgucggc

SEQ ID NO: 2870265 - RNA, 15 nt, Mycobacterium avium subsp. paratuberculosis
acggagucgucggcg

SEQ ID NO: 2870266 - RNA, 16 nt, Mycobacterium avium subsp. paratuberculosis
acggagucgucggcgc

SEQ ID NO: 2870267 - RNA, 16 nt, Mycobacterium avium subsp. paratuberculosis
acggaguuggaucgcc

SEQ ID NO: 2870268 - RNA, 18 nt, Mycobacterium avium subsp. paratuberculosis
acggaguuggaucgccgc

SEQ ID NO: 2870269 - RNA, 15 nt, Mycobacterium avium subsp. paratuberculosis
acggauccgggcgcc

SEQ ID NO: 2870270 - RNA, 19 nt, Mycobacterium avium subsp. paratuberculosis
acggaucgagcgcaccgcc

SEQ ID NO: 2870271 - RNA, 19 nt, Mycobacterium avium subsp. paratuberculosis
acggaucgagucccgcgcg

SEQ ID NO: 2870272 - RNA, 12 nt, Mycobacterium avium subsp. paratuberculosis
acggaucgccgg

SEQ ID NO: 2870273 - RNA, 16 nt, Mycobacterium avium subsp. paratuberculosis
acggaucgccggacag

SEQ ID NO: 2870274 - RNA, 15 nt, Mycobacterium avium subsp. paratuberculosis
acggaucggccgcgu

SEQ ID NO: 2870275 - RNA, 16 nt, Mycobacterium avium subsp. paratuberculosis
acggaucggccgcguc

SEQ ID NO: 2870276 - RNA, 18 nt, Mycobacterium avium subsp. paratuberculosis
acggaucggccgcgucgg

SEQ ID NO: 2870277 - RNA, 21 nt, Mycobacterium avium subsp. paratuberculosis
acggaucggccgcgucgggca

SEQ ID NO: 2870278 - RNA, 21 nt, Mycobacterium avium subsp. paratuberculosis
acggaugccccuugacgguga

SEQ ID NO: 2870279 - RNA, 16 nt, Mycobacterium avium subsp. paratuberculosis
acggauguggucggcc

SEQ ID NO: 2870280 - RNA, 18 nt, Mycobacterium avium subsp. paratuberculosis
acggauguggucggccac

SEQ ID NO: 2870281 - RNA, 19 nt, Mycobacterium avium subsp. paratuberculosis
acggauguggucggccacg

SEQ ID NO: 2870282 - RNA, 17 nt, Mycobacterium avium subsp. paratuberculosis
acggauucagcgucgcc

SEQ ID NO: 2870283 - RNA, 16 nt, Mycobacterium avium subsp. paratuberculosis
acggauugcggacgcc

SEQ ID NO: 2870284 - RNA, 21 nt, Mycobacterium avium subsp. paratuberculosis
acggauugcggacgccucgcc

SEQ ID NO: 2870285 - RNA, 19 nt, Mycobacterium avium subsp. paratuberculosis
acggcaaccugggcggcgg

SEQ ID NO: 2870286 - RNA, 20 nt, Mycobacterium avium subsp. paratuberculosis
acggcaaccugggcggcggc

SEQ ID NO: 2870287 - RNA, 15 nt, Mycobacterium avium subsp. paratuberculosis
acggcaacggcggcg

SEQ ID NO: 2870288 - RNA, 16 nt, Mycobacterium avium subsp. paratuberculosis
acggcaacggcggcgg

SEQ ID NO: 2870289 - RNA, 20 nt, Mycobacterium avium subsp. paratuberculosis
acggcaauacggggcauccc

SEQ ID NO: 2870290 - RNA, 14 nt, Mycobacterium avium subsp. paratuberculosis
acggcaauccggcc

SEQ ID NO: 2870291 - RNA, 15 nt, Mycobacterium avium subsp. paratuberculosis
acggcaauccggccc

SEQ ID NO: 2870292 - RNA, 16 nt, Mycobacterium avium subsp. paratuberculosis
acggcaauccggcccc

SEQ ID NO: 2870293 - RNA, 16 nt, Mycobacterium avium subsp. paratuberculosis
acggcaaugguugcgg

SEQ ID NO: 2870294 - RNA, 18 nt, Mycobacterium avium subsp. paratuberculosis
acggcaaugguugcggcg

SEQ ID NO: 2870295 - RNA, 19 nt, Mycobacterium avium subsp. paratuberculosis
acggcaaugguugcggcgg

SEQ ID NO: 2870296 - RNA, 20 nt, Mycobacterium avium subsp. paratuberculosis
acggcaaugguugcggcggg

SEQ ID NO: 2870297 - RNA, 22 nt, Mycobacterium avium subsp. paratuberculosis
acggcaaugguugcggcgggcc

SEQ ID NO: 2870298 - RNA, 15 nt, Mycobacterium avium subsp. paratuberculosis
acggcaccaccacgg

SEQ ID NO: 2870299 - RNA, 15 nt, Mycobacterium avium subsp. paratuberculosis
acggcaccagcggau

SEQ ID NO: 2870300 - RNA, 18 nt, Mycobacterium avium subsp. paratuberculosis
acggcaccagcggaucgg

SEQ ID NO: 2870301 - RNA, 23 nt, Mycobacterium avium subsp. paratuberculosis
acggcaccagcggaucggcgguc

SEQ ID NO: 2870302 - RNA, 16 nt, Mycobacterium avium subsp. paratuberculosis
acggcaccccgcgguc

SEQ ID NO: 2870303 - RNA, 18 nt, Mycobacterium avium subsp. paratuberculosis
acggcaccccgcggucgg

SEQ ID NO: 2870304 - RNA, 20 nt, Mycobacterium avium subsp. paratuberculosis
acggcaccccgcggucggcg

SEQ ID NO: 2870305 - RNA, 22 nt, Mycobacterium avium subsp. paratuberculosis
acggcaccccgcggucggcggc

SEQ ID NO: 2870306 - RNA, 13 nt, Mycobacterium avium subsp. paratuberculosis
acggcacccggcc

SEQ ID NO: 2870307 - RNA, 21 nt, Mycobacterium avium subsp. paratuberculosis
acggcaccgacagggccagcg

SEQ ID NO: 2870308 - RNA, 22 nt, Mycobacterium avium subsp. paratuberculosis
acggcaccgacagggccagcgc

SEQ ID NO: 2870309 - RNA, 17 nt, Mycobacterium avium subsp. paratuberculosis
acggcaccgacggagcc

SEQ ID NO: 2870310 - RNA, 22 nt, Mycobacterium avium subsp. paratuberculosis
acggcaccgacggagccgagca

SEQ ID NO: 2870311 - RNA, 18 nt, Mycobacterium avium subsp. paratuberculosis
acggcaccgccgcgcggc

SEQ ID NO: 2870312 - RNA, 14 nt, Mycobacterium avium subsp. paratuberculosis
acggcaccgcgagc

SEQ ID NO: 2870313 - RNA, 15 nt, Mycobacterium avium subsp. paratuberculosis
acggcaccucgauca

SEQ ID NO: 2870314 - RNA, 16 nt, Mycobacterium avium subsp. paratuberculosis
acggcaccucgaucac

SEQ ID NO: 2870315 - RNA, 18 nt, Mycobacterium avium subsp. paratuberculosis
acggcagcaacugaccga

SEQ ID NO: 2870316 - RNA, 14 nt, Mycobacterium avium subsp. paratuberculosis
acggcagcaccgcc

SEQ ID NO: 2870317 - RNA, 16 nt, Mycobacterium avium subsp. paratuberculosis
acggcagcaccgccga

SEQ ID NO: 2870318 - RNA, 22 nt, Mycobacterium avium subsp. paratuberculosis
acggcagcaccucgcgcagcac

SEQ ID NO: 2870319 - RNA, 14 nt, Mycobacterium avium subsp. paratuberculosis
acggcagcccgacg

SEQ ID NO: 2870320 - RNA, 15 nt, Mycobacterium avium subsp. paratuberculosis
acggcagcccgacgu

SEQ ID NO: 2870321 - RNA, 19 nt, Mycobacterium avium subsp. paratuberculosis
acggcagcgcuaaccgcgg

SEQ ID NO: 2870322 - RNA, 21 nt, Mycobacterium avium subsp. paratuberculosis
acggcagcgcuaaccgcgggc

SEQ ID NO: 2870323 - RNA, 12 nt, Mycobacterium avium subsp. paratuberculosis
acggcagcggca

SEQ ID NO: 2870324 - RNA, 17 nt, Mycobacterium avium subsp. paratuberculosis
acggcagcucgucgacg

SEQ ID NO: 2870325 - RNA, 13 nt, Mycobacterium avium subsp. paratuberculosis
acggcaggcggcc

SEQ ID NO: 2870326 - RNA, 15 nt, Mycobacterium avium subsp. paratuberculosis
acggcaggcggcccg

SEQ ID NO: 2870327 - RNA, 20 nt, Mycobacterium avium subsp. paratuberculosis
acggcaggcggcccgcucga

SEQ ID NO: 2870328 - RNA, 20 nt, Mycobacterium avium subsp. paratuberculosis
acgcucggcgcgucguccga

SEQ ID NO: 2870329 - RNA, 22 nt, Mycobacterium avium subsp. paratuberculosis
acgcucggcgcgucguccgaca

SEQ ID NO: 2870330 - RNA, 13 nt, Mycobacterium avium subsp. paratuberculosis
acgcucggcggcg

SEQ ID NO: 2870331 - RNA, 15 nt, Mycobacterium avium subsp. paratuberculosis
acgcucggcggcgcg

SEQ ID NO: 2870332 - RNA, 22 nt, Mycobacterium avium subsp. paratuberculosis
acgcucggcggcgcgcaggcgc

SEQ ID NO: 2870333 - RNA, 13 nt, Mycobacterium avium subsp. paratuberculosis
acgcucggcgggu

SEQ ID NO: 2870334 - RNA, 15 nt, Mycobacterium avium subsp. paratuberculosis
acgcucgggccggcg

SEQ ID NO: 2870335 - RNA, 17 nt, Mycobacterium avium subsp. paratuberculosis
acgcucgggccggcgcc

SEQ ID NO: 2870336 - RNA, 18 nt, Mycobacterium avium subsp. paratuberculosis
acgcucgggccggcgccg

SEQ ID NO: 2870337 - RNA, 20 nt, Mycobacterium avium subsp. paratuberculosis
acgcucgggcuucggcguca

SEQ ID NO: 2870338 - RNA, 23 nt, Mycobacterium avium subsp. paratuberculosis
acgcucggucgccacggccggca

SEQ ID NO: 2870339 - RNA, 13 nt, Mycobacterium avium subsp. paratuberculosis
acgcucucgccgg

SEQ ID NO: 2870340 - RNA, 14 nt, Mycobacterium avium subsp. paratuberculosis
acgcucucgccggu

SEQ ID NO: 2870341 - RNA, 17 nt, Mycobacterium avium subsp. paratuberculosis
acgcucucgccggucag

SEQ ID NO: 2870342 - RNA, 17 nt, Mycobacterium avium subsp. paratuberculosis
acgcucuucagcgcgac

SEQ ID NO: 2870343 - RNA, 21 nt, Mycobacterium avium subsp. paratuberculosis
acgcucuucagcgcgacagcc

SEQ ID NO: 2870344 - RNA, 19 nt, Mycobacterium avium subsp. paratuberculosis
acgcugaacagcccgagca

SEQ ID NO: 2870345 - RNA, 18 nt, Mycobacterium avium subsp. paratuberculosis
acgcugaacggugccguc

SEQ ID NO: 2870346 - RNA, 19 nt, Mycobacterium avium subsp. paratuberculosis
acgcugaacggugccguca

SEQ ID NO: 2870347 - RNA, 21 nt, Mycobacterium avium subsp. paratuberculosis
acgcugaacggugccgucacg

SEQ ID NO: 2870348 - RNA, 23 nt, Mycobacterium avium subsp. paratuberculosis
acgcugaagaucgaaaugaccgc

SEQ ID NO: 2870349 - RNA, 13 nt, Mycobacterium avium subsp. paratuberculosis
acgcugaagccca

SEQ ID NO: 2870350 - RNA, 24 nt, Mycobacterium avium subsp. paratuberculosis
acgcugaagcccaccgccguuccg

SEQ ID NO: 2870351 - RNA, 18 nt, Mycobacterium avium subsp. paratuberculosis
acgcugaccugugcgccc

SEQ ID NO: 2870352 - RNA, 20 nt, Mycobacterium avium subsp. paratuberculosis
acgcugaccugugcgcccca

SEQ ID NO: 2870353 - RNA, 22 nt, Mycobacterium avium subsp. paratuberculosis
acgcugaccugugcgccccacg

SEQ ID NO: 2870354 - RNA, 16 nt, Mycobacterium avium subsp. paratuberculosis
acgcugacgaugcggc

SEQ ID NO: 2870355 - RNA, 20 nt, Mycobacterium avium subsp. paratuberculosis
acgcugacgaugcggccggc

SEQ ID NO: 2870356 - RNA, 22 nt, Mycobacterium avium subsp. paratuberculosis
acgcugacgaugcggccggcgg

SEQ ID NO: 2870357 - RNA, 23 nt, Mycobacterium avium subsp. paratuberculosis
acgcugagcacccgcccggacgc

SEQ ID NO: 2870358 - RNA, 14 nt, Mycobacterium avium subsp. paratuberculosis
acgcugagccgcuc

SEQ ID NO: 2870359 - RNA, 17 nt, Mycobacterium avium subsp. paratuberculosis
acgcugagccgcucguc

SEQ ID NO: 2870360 - RNA, 19 nt, Mycobacterium avium subsp. paratuberculosis
acgcugagccgcucgucga

SEQ ID NO: 2870361 - RNA, 22 nt, Mycobacterium avium subsp. paratuberculosis
acgcugagccgcucgucgaguc

SEQ ID NO: 2870362 - RNA, 12 nt, Mycobacterium avium subsp. paratuberculosis
acgcugagcgcc

SEQ ID NO: 2870363 - RNA, 23 nt, Mycobacterium avium subsp. paratuberculosis
acgcugagucuacuuggccagcu

SEQ ID NO: 2870364 - RNA, 16 nt, Mycobacterium avium subsp. paratuberculosis
acgcugaucaccacgg

SEQ ID NO: 2870365 - RNA, 18 nt, Mycobacterium avium subsp. paratuberculosis
acgcugaucaccacgguc

SEQ ID NO: 2870366 - RNA, 16 nt, Mycobacterium avium subsp. paratuberculosis
acgcugcagguggccc

SEQ ID NO: 2870367 - RNA, 18 nt, Mycobacterium avium subsp. paratuberculosis
acgcugcagguggcccac

SEQ ID NO: 2870368 - RNA, 13 nt, Mycobacterium avium subsp. paratuberculosis
acgcugccaggcg

SEQ ID NO: 2870369 - RNA, 15 nt, Mycobacterium avium subsp. paratuberculosis
acgcugcccaaccgu

SEQ ID NO: 2870370 - RNA, 17 nt, Mycobacterium avium subsp. paratuberculosis
acgcugccgcgccgcca

SEQ ID NO: 2870371 - RNA, 18 nt, Mycobacterium avium subsp. paratuberculosis
acgcugccgcgccgccac

SEQ ID NO: 2870372 - RNA, 19 nt, Mycobacterium avium subsp. paratuberculosis
acgcugccgcuggcgucga

SEQ ID NO: 2870373 - RNA, 20 nt, Mycobacterium avium subsp. paratuberculosis
acgcugccgcuggcgucgau

SEQ ID NO: 2870374 - RNA, 15 nt, Mycobacterium avium subsp. paratuberculosis
acgcugccggggcgc

SEQ ID NO: 2870375 - RNA, 15 nt, Mycobacterium avium subsp. paratuberculosis
acgcugcgcacccgg

SEQ ID NO: 2870376 - RNA, 13 nt, Mycobacterium avium subsp. paratuberculosis
acgcugcgccagc

SEQ ID NO: 2870377 - RNA, 19 nt, Mycobacterium avium subsp. paratuberculosis
acgcugcgccagccgucgc

SEQ ID NO: 2870378 - RNA, 22 nt, Mycobacterium avium subsp. paratuberculosis
acgcugcgccagccgucgccgc

SEQ ID NO: 2870379 - RNA, 15 nt, Mycobacterium avium subsp. paratuberculosis
acgcugcgcgccgau

SEQ ID NO: 2870380 - RNA, 18 nt, Mycobacterium avium subsp. paratuberculosis
acgcugcgcgccgauccg

SEQ ID NO: 2870381 - RNA, 22 nt, Mycobacterium avium subsp. paratuberculosis
acgcugcgcgccgauccggcuc

SEQ ID NO: 2870382 - RNA, 19 nt, Mycobacterium avium subsp. paratuberculosis
acgcugcggaugucggugu

SEQ ID NO: 2870383 - RNA, 16 nt, Mycobacterium avium subsp. paratuberculosis
acgcugcggcgccggg

SEQ ID NO: 2870384 - RNA, 17 nt, Mycobacterium avium subsp. paratuberculosis
acgcugcggcgccgggc

SEQ ID NO: 2870385 - RNA, 13 nt, Mycobacterium avium subsp. paratuberculosis
acgcuggccgaga

SEQ ID NO: 2870386 - RNA, 19 nt, Mycobacterium avium subsp. paratuberculosis
acgcuggccgagagccggu

SEQ ID NO: 2870387 - RNA, 16 nt, Mycobacterium avium subsp. paratuberculosis
acgcuggccggcagcg

SEQ ID NO: 2870388 - RNA, 20 nt, Mycobacterium avium subsp. paratuberculosis
acgcuggcgugacacucggu

SEQ ID NO: 2870389 - RNA, 17 nt, Mycobacterium avium subsp. paratuberculosis
acgcuggcgugacaguc

SEQ ID NO: 2870390 - RNA, 20 nt, Mycobacterium avium subsp. paratuberculosis
acgcuggcgugacgcucgag

SEQ ID NO: 2870391 - RNA, 19 nt, Mycobacterium avium subsp. paratuberculosis
acgcuggcgugacgcucgc

SEQ ID NO: 2870392 - RNA, 22 nt, Mycobacterium avium subsp. paratuberculosis
acgcuggcgugacgcucggcgg

SEQ ID NO: 2870393 - RNA, 23 nt, Mycobacterium avium subsp. paratuberculosis
acgcuggcgugacgcucggcggc

SEQ ID NO: 2870394 - RNA, 20 nt, Mycobacterium avium subsp. paratuberculosis
acgcuggcgugacgcucggg

SEQ ID NO: 2870395 - RNA, 21 nt, Mycobacterium avium subsp. paratuberculosis
acgcuggcgugacgcucgggg

SEQ ID NO: 2870396 - RNA, 22 nt, Mycobacterium avium subsp. paratuberculosis
acgcuggcgugacguucgucag

SEQ ID NO: 2870397 - RNA, 18 nt, Mycobacterium avium subsp. paratuberculosis
acgcuggcguggcacccg

SEQ ID NO: 2870398 - RNA, 19 nt, Mycobacterium avium subsp. paratuberculosis
acgcuggcguggcgccggc

SEQ ID NO: 2870399 - RNA, 20 nt, Mycobacterium avium subsp. paratuberculosis
acgcuggcguggcgccggcg

SEQ ID NO: 2870400 - RNA, 21 nt, Mycobacterium avium subsp. paratuberculosis
acgcuggcguggcgccggcgc

SEQ ID NO: 2870401 - RNA, 17 nt, Mycobacterium avium subsp. paratuberculosis
acgcuggcguggcucgg

SEQ ID NO: 2870402 - RNA, 14 nt, Mycobacterium avium subsp. paratuberculosis
acgcugggcggcga

SEQ ID NO: 2870403 - RNA, 16 nt, Mycobacterium avium subsp. paratuberculosis
acgcugggcggcgaca

SEQ ID NO: 2870404 - RNA, 18 nt, Mycobacterium avium subsp. paratuberculosis
acgcugggcuccgaccgu

SEQ ID NO: 2870405 - RNA, 19 nt, Mycobacterium avium subsp. paratuberculosis
acgcuggucgaacgccacc

SEQ ID NO: 2870406 - RNA, 20 nt, Mycobacterium avium subsp. paratuberculosis
acgcuggugacgugcaccug

SEQ ID NO: 2870407 - RNA, 20 nt, Mycobacterium avium subsp. paratuberculosis
acgcuguccgcgugaaugcc

SEQ ID NO: 2870408 - RNA, 14 nt, Mycobacterium avium subsp. paratuberculosis
acgcugugcgccuu

SEQ ID NO: 2870409 - RNA, 21 nt, Mycobacterium avium subsp. paratuberculosis
acgcugugcgccuugccgucg

SEQ ID NO: 2870410 - RNA, 16 nt, Mycobacterium avium subsp. paratuberculosis
acgcugugcucgacga

SEQ ID NO: 2870411 - RNA, 17 nt, Mycobacterium avium subsp. paratuberculosis
acgcuguuggaaccggc

SEQ ID NO: 2870412 - RNA, 19 nt, Mycobacterium avium subsp. paratuberculosis
acgccagcgugacgcucgg

SEQ ID NO: 2870413 - RNA, 20 nt, Mycobacterium avium subsp. paratuberculosis
acgccagcgugacgcucggg

SEQ ID NO: 2870414 - RNA, 21 nt, Mycobacterium avium subsp. paratuberculosis
acgccagcgugacgcucgggc

SEQ ID NO: 2870415 - RNA, 22 nt, Mycobacterium avium subsp. paratuberculosis
acgccagcgugacgcucgggcu

SEQ ID NO: 2870416 - RNA, 12 nt, Mycobacterium avium subsp. paratuberculosis
acgccagcugcc

SEQ ID NO: 2870417 - RNA, 22 nt, Mycobacterium avium subsp. paratuberculosis
acgccagcugccgcgacucggu

SEQ ID NO: 2870418 - RNA, 23 nt, Mycobacterium avium subsp. paratuberculosis
acgccagcugcggaucgggcgug

SEQ ID NO: 2870419 - RNA, 14 nt, Mycobacterium avium subsp. paratuberculosis
acgccaguguggcc

SEQ ID NO: 2870420 - RNA, 19 nt, Mycobacterium avium subsp. paratuberculosis
acgccaguguggccgcggc

SEQ ID NO: 2870421 - RNA, 16 nt, Mycobacterium avium subsp. paratuberculosis
acgccaguucgucggc

SEQ ID NO: 2870422 - RNA, 21 nt, Mycobacterium avium subsp. paratuberculosis
acgccaguucgucggccgucg

SEQ ID NO: 2870423 - RNA, 17 nt, Mycobacterium avium subsp. paratuberculosis
acgccaucaccagcgcg

SEQ ID NO: 2870424 - RNA, 15 nt, Mycobacterium avium subsp. paratuberculosis
acgccaucagcacca

SEQ ID NO: 2870425 - RNA, 13 nt, Mycobacterium avium subsp. paratuberculosis
acgccaucgccuc

SEQ ID NO: 2870426 - RNA, 16 nt, Mycobacterium avium subsp. paratuberculosis
acgccaucgccucggc

SEQ ID NO: 2870427 - RNA, 19 nt, Mycobacterium avium subsp. paratuberculosis
acgccaucgccucggccac

SEQ ID NO: 2870428 - RNA, 22 nt, Mycobacterium avium subsp. paratuberculosis
acgccaucgccucggccaccag

SEQ ID NO: 2870429 - RNA, 23 nt, Mycobacterium avium subsp. paratuberculosis
acgccaucgccucggccaccaga

SEQ ID NO: 2870430 - RNA, 14 nt, Mycobacterium avium subsp. paratuberculosis
acgccaugucgaug

SEQ ID NO: 2870431 - RNA, 15 nt, Mycobacterium avium subsp. paratuberculosis
acgccaugugccggc

SEQ ID NO: 2870432 - RNA, 18 nt, Mycobacterium avium subsp. paratuberculosis
acgccaugugccggcgcu

SEQ ID NO: 2870433 - RNA, 18 nt, Mycobacterium avium subsp. paratuberculosis
acgcccaacuacccgccg

SEQ ID NO: 2870434 - RNA, 15 nt, Mycobacterium avium subsp. paratuberculosis
acgcccacagcgcca

SEQ ID NO: 2870435 - RNA, 17 nt, Mycobacterium avium subsp. paratuberculosis
acgcccaccacaucggu

SEQ ID NO: 2870436 - RNA, 12 nt, Mycobacterium avium subsp. paratuberculosis
acgcccaccggu

SEQ ID NO: 2870437 - RNA, 23 nt, Mycobacterium avium subsp. paratuberculosis
acgcccaccugguuggcccgcac

SEQ ID NO: 2870438 - RNA, 14 nt, Mycobacterium avium subsp. paratuberculosis
acgcccacgccgag

SEQ ID NO: 2870439 - RNA, 15 nt, Mycobacterium avium subsp. paratuberculosis
acgcccacgccgagg

SEQ ID NO: 2870440 - RNA, 23 nt, Mycobacterium avium subsp. paratuberculosis
acgcccagaacgacgcgcucagc

SEQ ID NO: 2870441 - RNA, 17 nt, Mycobacterium avium subsp. paratuberculosis
acgcccagaccguggag

SEQ ID NO: 2870442 - RNA, 20 nt, Mycobacterium avium subsp. paratuberculosis
acgcccagaucgacgccgac

SEQ ID NO: 2870443 - RNA, 14 nt, Mycobacterium avium subsp. paratuberculosis
acgcccagcaccga

SEQ ID NO: 2870444 - RNA, 14 nt, Mycobacterium avium subsp. paratuberculosis
acgcccagcgccgc

SEQ ID NO: 2870445 - RNA, 16 nt, Mycobacterium avium subsp. paratuberculosis
acgcccagcgccgcgu

SEQ ID NO: 2870446 - RNA, 18 nt, Mycobacterium avium subsp. paratuberculosis
acgcccagcgcggcgaac

SEQ ID NO: 2870447 - RNA, 23 nt, Mycobacterium avium subsp. paratuberculosis
acgcccaggcucaggaucagcag

SEQ ID NO: 2870448 - RNA, 13 nt, Mycobacterium avium subsp. paratuberculosis
acgccccaggcgc

SEQ ID NO: 2870449 - RNA, 14 nt, Mycobacterium avium subsp. paratuberculosis
acgccccaggcgcc

SEQ ID NO: 2870450 - RNA, 19 nt, Mycobacterium avium subsp. paratuberculosis
acgccccaguuggcgucgu

SEQ ID NO: 2870451 - RNA, 18 nt, Mycobacterium avium subsp. paratuberculosis
acgccccauugccgcgcc

SEQ ID NO: 2870452 - RNA, 20 nt, Mycobacterium avium subsp. paratuberculosis
acgccccauugccgcgccgg

SEQ ID NO: 2870453 - RNA, 22 nt, Mycobacterium avium subsp. paratuberculosis
acgccccauugccgcgccgggg

SEQ ID NO: 2870454 - RNA, 19 nt, Mycobacterium avium subsp. paratuberculosis
acgcccccgcuggcccggc

SEQ ID NO: 2870455 - RNA, 14 nt, Mycobacterium avium subsp. paratuberculosis
acgccccggcgccg

SEQ ID NO: 2870456 - RNA, 18 nt, Mycobacterium avium subsp. paratuberculosis
acgccccggcgccgucgu

SEQ ID NO: 2870457 - RNA, 15 nt, Mycobacterium avium subsp. paratuberculosis
acgccccggcggguc

SEQ ID NO: 2870458 - RNA, 12 nt, Mycobacterium avium subsp. paratuberculosis
acgcccgacgac

SEQ ID NO: 2870459 - RNA, 17 nt, Mycobacterium avium subsp. paratuberculosis
acgcccgaucccgggcc

SEQ ID NO: 2870460 - RNA, 22 nt, Mycobacterium avium subsp. paratuberculosis
acgcccgaucccgggccguuca

SEQ ID NO: 2870461 - RNA, 22 nt, Mycobacterium avium subsp. paratuberculosis
acgcccgaucugggaucggugc

SEQ ID NO: 2870462 - RNA, 12 nt, Mycobacterium avium subsp. paratuberculosis
acgcccgcacca

SEQ ID NO: 2870463 - RNA, 16 nt, Mycobacterium avium subsp. paratuberculosis
acgcccgcaccacgac

SEQ ID NO: 2870464 - RNA, 16 nt, Mycobacterium avium subsp. paratuberculosis
acgcccgcagcgcauc

SEQ ID NO: 2870465 - RNA, 20 nt, Mycobacterium avium subsp. paratuberculosis
acgcccgcgaucggcgccac

SEQ ID NO: 2870466 - RNA, 22 nt, Mycobacterium avium subsp. paratuberculosis
acgcccgcgaucggcgccacga

SEQ ID NO: 2870467 - RNA, 16 nt, Mycobacterium avium subsp. paratuberculosis
acgcccggacccgcuc

SEQ ID NO: 2870468 - RNA, 18 nt, Mycobacterium avium subsp. paratuberculosis
acgcccggacccgcucgc

SEQ ID NO: 2870469 - RNA, 13 nt, Mycobacterium avium subsp. paratuberculosis
acgcccggccacc

SEQ ID NO: 2870470 - RNA, 12 nt, Mycobacterium avium subsp. paratuberculosis
acgcccggcgcc

SEQ ID NO: 2870471 - RNA, 14 nt, Mycobacterium avium subsp. paratuberculosis
acgcccggcgccgg

SEQ ID NO: 2870472 - RNA, 15 nt, Mycobacterium avium subsp. paratuberculosis
acgcccggcgccggc

SEQ ID NO: 2870473 - RNA, 18 nt, Mycobacterium avium subsp. paratuberculosis
acgcccggcgccggcggc

SEQ ID NO: 2870474 - RNA, 22 nt, Mycobacterium avium subsp. paratuberculosis
acgcccggcgccggcggccacg

SEQ ID NO: 2870475 - RNA, 15 nt, Mycobacterium avium subsp. paratuberculosis
acgcccggcuucgcc

SEQ ID NO: 2870476 - RNA, 17 nt, Mycobacterium avium subsp. paratuberculosis
acgcccggcuucgccgc

SEQ ID NO: 2870477 - RNA, 19 nt, Mycobacterium avium subsp. paratuberculosis
acgcccggcuucgccgccg

SEQ ID NO: 2870478 - RNA, 15 nt, Mycobacterium avium subsp. paratuberculosis
acgcccggucgauga

SEQ ID NO: 2870479 - RNA, 22 nt, Mycobacterium avium subsp. paratuberculosis
acgcccguagcggugggcgcgu

SEQ ID NO: 2870480 - RNA, 16 nt, Mycobacterium avium subsp. paratuberculosis
acgcccgucccgccga

SEQ ID NO: 2870481 - RNA, 16 nt, Mycobacterium avium subsp. paratuberculosis
acgcccguucgagcgc

SEQ ID NO: 2870482 - RNA, 17 nt, Mycobacterium avium subsp. paratuberculosis
acgcccuccuggcgggu

SEQ ID NO: 2870483 - RNA, 20 nt, Mycobacterium avium subsp. paratuberculosis
acgcccucgucuuccgcggc

SEQ ID NO: 2870484 - RNA, 15 nt, Mycobacterium avium subsp. paratuberculosis
acgcccugccacagc

SEQ ID NO: 2870485 - RNA, 17 nt, Mycobacterium avium subsp. paratuberculosis
acgcccugccacagcga

SEQ ID NO: 2870486 - RNA, 17 nt, Mycobacterium avium subsp. paratuberculosis
acgcccuggccgccggc

SEQ ID NO: 2870487 - RNA, 13 nt, Mycobacterium avium subsp. paratuberculosis
acgcccuuggcgc

SEQ ID NO: 2870488 - RNA, 15 nt, Mycobacterium avium subsp. paratuberculosis
acgcccuuggcgccc

SEQ ID NO: 2870489 - RNA, 17 nt, Mycobacterium avium subsp. paratuberculosis
acgcccuuggcgcccag

SEQ ID NO: 2870490 - RNA, 18 nt, Mycobacterium avium subsp. paratuberculosis
acgcccuuguccucgagc

SEQ ID NO: 2870491 - RNA, 15 nt, Mycobacterium avium subsp. paratuberculosis
acgccgaacugccgg

SEQ ID NO: 2870492 - RNA, 18 nt, Mycobacterium avium subsp. paratuberculosis
acgccgaagaucagcgcg

SEQ ID NO: 2870493 - RNA, 19 nt, Mycobacterium avium subsp. paratuberculosis
acgccgaagaucagcgcgu

SEQ ID NO: 2870494 - RNA, 15 nt, Mycobacterium avium subsp. paratuberculosis
acgccgacaccagcg

SEQ ID NO: 2870495 - RNA, 18 nt, Mycobacterium avium subsp. paratuberculosis
acgccgacaccagcgcgc

SEQ ID NO: 2870496 - RNA, 19 nt, Mycobacterium avium subsp. paratuberculosis
acgccgacaccagcgcgca

SEQ ID NO: 2870497 - RNA, 17 nt, Mycobacterium avium subsp. paratuberculosis
acgccgacaccgucgcc

SEQ ID NO: 2870498 - RNA, 19 nt, Mycobacterium avium subsp. paratuberculosis
acgccgacaccgucgccgu

SEQ ID NO: 2870499 - RNA, 21 nt, Mycobacterium avium subsp. paratuberculosis
acgccgacaccgucgccguga

SEQ ID NO: 2870500 - RNA, 17 nt, Mycobacterium avium subsp. paratuberculosis
acgccgacaucgcggcg

SEQ ID NO: 2870501 - RNA, 18 nt, Mycobacterium avium subsp. paratuberculosis
acgccgacaucgcggcga

SEQ ID NO: 2870502 - RNA, 19 nt, Mycobacterium avium subsp. paratuberculosis
acgccgacaucgcggcgau

SEQ ID NO: 2870503 - RNA, 21 nt, Mycobacterium avium subsp. paratuberculosis
acgccgacaucucccggucga

SEQ ID NO: 2870504 - RNA, 20 nt, Mycobacterium avium subsp. paratuberculosis
acgccgaccacccccagccc

SEQ ID NO: 2870505 - RNA, 21 nt, Mycobacterium avium subsp. paratuberculosis
acgccgaccacccccagcccg

SEQ ID NO: 2870506 - RNA, 13 nt, Mycobacterium avium subsp. paratuberculosis
acgccgaccaggu

SEQ ID NO: 2870507 - RNA, 14 nt, Mycobacterium avium subsp. paratuberculosis
acgccgaccgcggu

SEQ ID NO: 2870508 - RNA, 22 nt, Mycobacterium avium subsp. paratuberculosis
acgccgaccgcggucgcggcgc

SEQ ID NO: 2870509 - RNA, 23 nt, Mycobacterium avium subsp. paratuberculosis
acgccgaccgcggucgcggcgcc

SEQ ID NO: 2870510 - RNA, 20 nt, Mycobacterium avium subsp. paratuberculosis
acgccgacgauccgcgccgc

SEQ ID NO: 2870511 - RNA, 22 nt, Mycobacterium avium subsp. paratuberculosis
acgccgacgauccgcgccgcga

SEQ ID NO: 2870512 - RNA, 22 nt, Mycobacterium avium subsp. paratuberculosis
acgccgacgcauguccgccguc

SEQ ID NO: 2870513 - RNA, 12 nt, Mycobacterium avium subsp. paratuberculosis
acgccgacgccc

SEQ ID NO: 2870514 - RNA, 15 nt, Mycobacterium avium subsp. paratuberculosis
acgccgacgcccagc

SEQ ID NO: 2870515 - RNA, 18 nt, Mycobacterium avium subsp. paratuberculosis
acgccgacguaggacagc

SEQ ID NO: 2870516 - RNA, 20 nt, Mycobacterium avium subsp. paratuberculosis
acgccgacgucaggguggcc

SEQ ID NO: 2870517 - RNA, 22 nt, Mycobacterium avium subsp. paratuberculosis
acgccgacgucaggguggccuc

SEQ ID NO: 2870518 - RNA, 18 nt, Mycobacterium avium subsp. paratuberculosis
acgccgacuagcgcggcg

SEQ ID NO: 2870519 - RNA, 22 nt, Mycobacterium avium subsp. paratuberculosis
acgccgacuagcgcggcggccu

SEQ ID NO: 2870520 - RNA, 23 nt, Mycobacterium avium subsp. paratuberculosis
acgccgacuagcgcggcggccuc

SEQ ID NO: 2870521 - RNA, 17 nt, Mycobacterium avium subsp. paratuberculosis
acgccgagcaccuggcc

SEQ ID NO: 2870522 - RNA, 15 nt, Mycobacterium avium subsp. paratuberculosis
acgccgagcagcacc

SEQ ID NO: 2870523 - RNA, 19 nt, Mycobacterium avium subsp. paratuberculosis
acgccgagcagcaccggca

SEQ ID NO: 2870524 - RNA, 22 nt, Mycobacterium avium subsp. paratuberculosis
acgccgagcagcaccggcaugu

SEQ ID NO: 2870525 - RNA, 23 nt, Mycobacterium avium subsp. paratuberculosis
acgccgagcagcucagccgccug

SEQ ID NO: 2870526 - RNA, 18 nt, Mycobacterium avium subsp. paratuberculosis
acgccgaggaggccgcgg

SEQ ID NO: 2870527 - RNA, 20 nt, Mycobacterium avium subsp. paratuberculosis
acgccgaggaggccgcggcg

SEQ ID NO: 2870528 - RNA, 21 nt, Mycobacterium avium subsp. paratuberculosis
acgccgaggaggccgcggcga

SEQ ID NO: 2870529 - RNA, 14 nt, Mycobacterium avium subsp. paratuberculosis
acgccgaggcgggu

SEQ ID NO: 2870530 - RNA, 15 nt, Mycobacterium avium subsp. paratuberculosis
acgccgagggcggcg

SEQ ID NO: 2870531 - RNA, 16 nt, Mycobacterium avium subsp. paratuberculosis
acgccgagggcggcgg

SEQ ID NO: 2870532 - RNA, 17 nt, Mycobacterium avium subsp. paratuberculosis
acgccgagggcggcggc

SEQ ID NO: 2870533 - RNA, 17 nt, Mycobacterium avium subsp. paratuberculosis
acgccgagggugccggc

SEQ ID NO: 2870534 - RNA, 22 nt, Mycobacterium avium subsp. paratuberculosis
acgccgagggugccggccaccg

SEQ ID NO: 2870535 - RNA, 22 nt, Mycobacterium avium subsp. paratuberculosis
acgccgaguaacucggccuucg

SEQ ID NO: 2870536 - RNA, 24 nt, Mycobacterium avium subsp. paratuberculosis
acgccgaguaacucggccuucgcc

SEQ ID NO: 2870537 - RNA, 14 nt, Mycobacterium avium subsp. paratuberculosis
acgccgaucaccgc

SEQ ID NO: 2870538 - RNA, 16 nt, Mycobacterium avium subsp. paratuberculosis
acgccgaucaccggca

SEQ ID NO: 2870539 - RNA, 17 nt, Mycobacterium avium subsp. paratuberculosis
acgccgaucaccggcac

SEQ ID NO: 2870540 - RNA, 19 nt, Mycobacterium avium subsp. paratuberculosis
acgccgaucaccggcacgu

SEQ ID NO: 2870541 - RNA, 18 nt, Mycobacterium avium subsp. paratuberculosis
acgccgauccgcagccgc

SEQ ID NO: 2870542 - RNA, 20 nt, Mycobacterium avium subsp. paratuberculosis
acgccgauccgcagccgcug

SEQ ID NO: 2870543 - RNA, 23 nt, Mycobacterium avium subsp. paratuberculosis
acgccgauccgcagccgcugccg

SEQ ID NO: 2870544 - RNA, 16 nt, Mycobacterium avium subsp. paratuberculosis
acgccgauccgcugcg

SEQ ID NO: 2870545 - RNA, 16 nt, Mycobacterium avium subsp. paratuberculosis
acgccgaucgggaugu

SEQ ID NO: 2870546 - RNA, 15 nt, Mycobacterium avium subsp. paratuberculosis
acgccgaugaucugg

SEQ ID NO: 2870547 - RNA, 13 nt, Mycobacterium avium subsp. paratuberculosis
acgccgaugcggu

SEQ ID NO: 2870548 - RNA, 19 nt, Mycobacterium avium subsp. paratuberculosis
acgccgauggccugguggc

SEQ ID NO: 2870549 - RNA, 15 nt, Mycobacterium avium subsp. paratuberculosis
acgccgauggugacc

SEQ ID NO: 2870550 - RNA, 16 nt, Mycobacterium avium subsp. paratuberculosis
acgccgaugugcucgg

SEQ ID NO: 2870551 - RNA, 17 nt, Mycobacterium avium subsp. paratuberculosis
acgccgaugugcucggu

SEQ ID NO: 2870552 - RNA, 21 nt, Mycobacterium avium subsp. paratuberculosis
acgccgauguuuugggugcuu

SEQ ID NO: 2870553 - RNA, 20 nt, Mycobacterium avium subsp. paratuberculosis
acgccgcacgcgaccgcguc

SEQ ID NO: 2870554 - RNA, 23 nt, Mycobacterium avium subsp. paratuberculosis
acgccgcacgcgaccgcgucgac

SEQ ID NO: 2870555 - RNA, 21 nt, Mycobacterium avium subsp. paratuberculosis
acgccgcagcgcagcgucggc

SEQ ID NO: 2870556 - RNA, 23 nt, Mycobacterium avium subsp. paratuberculosis
acgccgcauacaccuugucggcg

SEQ ID NO: 2870557 - RNA, 14 nt, Mycobacterium avium subsp. paratuberculosis
acgccgcccaggcc

SEQ ID NO: 2870558 - RNA, 22 nt, Mycobacterium avium subsp. paratuberculosis
acgccgcccaggccccggccga

SEQ ID NO: 2870559 - RNA, 18 nt, Mycobacterium avium subsp. paratuberculosis
acgccgcccccgccgcga

SEQ ID NO: 2870560 - RNA, 19 nt, Mycobacterium avium subsp. paratuberculosis
acgccgcccccgccgcgag

SEQ ID NO: 2870561 - RNA, 20 nt, Mycobacterium avium subsp. paratuberculosis
acgccgcccccgccgcgagc

SEQ ID NO: 2870562 - RNA, 21 nt, Mycobacterium avium subsp. paratuberculosis
acgccgcccccgccgcgagca

SEQ ID NO: 2870563 - RNA, 20 nt, Mycobacterium avium subsp. paratuberculosis
acgccgcccucucacggcgg

SEQ ID NO: 2870564 - RNA, 15 nt, Mycobacterium avium subsp. paratuberculosis
acgccgccgaacccc

SEQ ID NO: 2870565 - RNA, 21 nt, Mycobacterium avium subsp. paratuberculosis
acgccgccgaaccccagcucc

SEQ ID NO: 2870566 - RNA, 22 nt, Mycobacterium avium subsp. paratuberculosis
acgccgccgacagcaccucgcc

SEQ ID NO: 2870567 - RNA, 13 nt, Mycobacterium avium subsp. paratuberculosis
acgccgccgaggg

SEQ ID NO: 2870568 - RNA, 16 nt, Mycobacterium avium subsp. paratuberculosis
acgccgccgccgagcu

SEQ ID NO: 2870569 - RNA, 22 nt, Mycobacterium avium subsp. paratuberculosis
acgccgccgcgaacucaggcgc

SEQ ID NO: 2870570 - RNA, 21 nt, Mycobacterium avium subsp. paratuberculosis
acgccgccgcgucgucaucgu

SEQ ID NO: 2870571 - RNA, 12 nt, Mycobacterium avium subsp. paratuberculosis
acgccgccggga

SEQ ID NO: 2870572 - RNA, 13 nt, Mycobacterium avium subsp. paratuberculosis
acgccgccgucgu

SEQ ID NO: 2870573 - RNA, 21 nt, Mycobacterium avium subsp. paratuberculosis
acgccgccuugacgccgggca

SEQ ID NO: 2870574 - RNA, 14 nt, Mycobacterium avium subsp. paratuberculosis
acgccgcgacgaug

SEQ ID NO: 2870575 - RNA, 13 nt, Mycobacterium avium subsp. paratuberculosis
acgccgcgcaccc

SEQ ID NO: 2870576 - RNA, 13 nt, Mycobacterium avium subsp. paratuberculosis
acgccgcgcagcg

SEQ ID NO: 2870577 - RNA, 14 nt, Mycobacterium avium subsp. paratuberculosis
acgccgcgcagcgg

SEQ ID NO: 2870578 - RNA, 18 nt, Mycobacterium avium subsp. paratuberculosis
acgccgcgcagcggggcg

SEQ ID NO: 2870579 - RNA, 14 nt, Mycobacterium avium subsp. paratuberculosis
acgccgcgcccguc

SEQ ID NO: 2870580 - RNA, 16 nt, Mycobacterium avium subsp. paratuberculosis
acgccgcgcccgucga

SEQ ID NO: 2870581 - RNA, 15 nt, Mycobacterium avium subsp. paratuberculosis
acgccgcgcuugacg

SEQ ID NO: 2870582 - RNA, 22 nt, Mycobacterium avium subsp. paratuberculosis
acgccgcgcuugacggccgggc

SEQ ID NO: 2870583 - RNA, 19 nt, Mycobacterium avium subsp. paratuberculosis
acgccgcggaaggccagcu

SEQ ID NO: 2870584 - RNA, 20 nt, Mycobacterium avium subsp. paratuberculosis
acgccgcggaaggccagcuc

SEQ ID NO: 2870585 - RNA, 21 nt, Mycobacterium avium subsp. paratuberculosis
acgccgcggaaggccagcucc

SEQ ID NO: 2870586 - RNA, 13 nt, Mycobacterium avium subsp. paratuberculosis
acgccgcggucgc

SEQ ID NO: 2870587 - RNA, 14 nt, Mycobacterium avium subsp. paratuberculosis
acgccgcggucgcu

SEQ ID NO: 2870588 - RNA, 16 nt, Mycobacterium avium subsp. paratuberculosis
acgccgcggucgcuga

SEQ ID NO: 2870589 - RNA, 18 nt, Mycobacterium avium subsp. paratuberculosis
acgccgcgguggccggga

SEQ ID NO: 2870590 - RNA, 21 nt, Mycobacterium avium subsp. paratuberculosis
acgccgcgguggccgggaugc

SEQ ID NO: 2870591 - RNA, 14 nt, Mycobacterium avium subsp. paratuberculosis
acgccgcguccucg

SEQ ID NO: 2870592 - RNA, 16 nt, Mycobacterium avium subsp. paratuberculosis
acgccgcucggccagc

SEQ ID NO: 2870593 - RNA, 18 nt, Mycobacterium avium subsp. paratuberculosis
acgccgcucggccagcgc

SEQ ID NO: 2870594 - RNA, 19 nt, Mycobacterium avium subsp. paratuberculosis
acgccgcucggccagcgca

SEQ ID NO: 2870595 - RNA, 23 nt, Mycobacterium avium subsp. paratuberculosis
acgccgcucggccagcgcagcga

SEQ ID NO: 2870596 - RNA, 13 nt, Mycobacterium avium subsp. paratuberculosis
acgccgcugccgg

SEQ ID NO: 2870597 - RNA, 13 nt, Mycobacterium avium subsp. paratuberculosis
acgccgcugggcg

SEQ ID NO: 2870598 - RNA, 21 nt, Mycobacterium avium subsp. paratuberculosis
acgccgcugggcguggugcgg

SEQ ID NO: 2870599 - RNA, 21 nt, Mycobacterium avium subsp. paratuberculosis
acgccggaaucgauuggugcg

SEQ ID NO: 2870600 - RNA, 22 nt, Mycobacterium avium subsp. paratuberculosis
acgccggaaucgauuggugcgc

SEQ ID NO: 2870601 - RNA, 23 nt, Mycobacterium avium subsp. paratuberculosis
acgccggaaucgauuggugcgca

SEQ ID NO: 2870602 - RNA, 23 nt, Mycobacterium avium subsp. paratuberculosis
acgccggacagcuggcggucgcu

SEQ ID NO: 2870603 - RNA, 18 nt, Mycobacterium avium subsp. paratuberculosis
acgccggaccccacagcg

SEQ ID NO: 2870604 - RNA, 20 nt, Mycobacterium avium subsp. paratuberculosis
acgccggaccccacagcgcg

SEQ ID NO: 2870605 - RNA, 23 nt, Mycobacterium avium subsp. paratuberculosis
acgccggauuggcgucgguggcg

SEQ ID NO: 2870606 - RNA, 17 nt, Mycobacterium avium subsp. paratuberculosis
acgccggcagccgcucg

SEQ ID NO: 2870607 - RNA, 16 nt, Mycobacterium avium subsp. paratuberculosis
acgccggcaucagcga

SEQ ID NO: 2870608 - RNA, 23 nt, Mycobacterium avium subsp. paratuberculosis
acgccggcaucagcgagacgacc

SEQ ID NO: 2870609 - RNA, 16 nt, Mycobacterium avium subsp. paratuberculosis
acgccggccaccaaca

SEQ ID NO: 2870610 - RNA, 16 nt, Mycobacterium avium subsp. paratuberculosis
acgccggccccggcga

SEQ ID NO: 2870611 - RNA, 12 nt, Mycobacterium avium subsp. paratuberculosis
acgccggccggc

SEQ ID NO: 2870612 - RNA, 15 nt, Mycobacterium avium subsp. paratuberculosis
acgccggccggcgug

SEQ ID NO: 2870613 - RNA, 19 nt, Mycobacterium avium subsp. paratuberculosis
acgccggccucucgucgac

SEQ ID NO: 2870614 - RNA, 21 nt, Mycobacterium avium subsp. paratuberculosis
acgccggccucucgucgacga

SEQ ID NO: 2870615 - RNA, 15 nt, Mycobacterium avium subsp. paratuberculosis
acgccggcgaggcgg

SEQ ID NO: 2870616 - RNA, 12 nt, Mycobacterium avium subsp. paratuberculosis
acgccggcggcc

SEQ ID NO: 2870617 - RNA, 14 nt, Mycobacterium avium subsp. paratuberculosis
acgccggcggccac

SEQ ID NO: 2870618 - RNA, 16 nt, Mycobacterium avium subsp. paratuberculosis
acgccggcgugcacag

SEQ ID NO: 2870619 - RNA, 20 nt, Mycobacterium avium subsp. paratuberculosis
acgccggcgugcacaggccg

SEQ ID NO: 2870620 - RNA, 21 nt, Mycobacterium avium subsp. paratuberculosis
acgccggcgugcacaggccgc

SEQ ID NO: 2870621 - RNA, 23 nt, Mycobacterium avium subsp. paratuberculosis
acgccggcgugcacaggccgccg

SEQ ID NO: 2870622 - RNA, 13 nt, Mycobacterium avium subsp. paratuberculosis
acgccggcucggu

SEQ ID NO: 2870623 - RNA, 15 nt, Mycobacterium avium subsp. paratuberculosis
acgccggcucggucu

SEQ ID NO: 2870624 - RNA, 20 nt, Mycobacterium avium subsp. paratuberculosis
acgccggcuugccccggucc

SEQ ID NO: 2870625 - RNA, 18 nt, Mycobacterium avium subsp. paratuberculosis
acgccgggcacucccuug

SEQ ID NO: 2870626 - RNA, 18 nt, Mycobacterium avium subsp. paratuberculosis
acgccgggcagcgcgcga

SEQ ID NO: 2870627 - RNA, 14 nt, Mycobacterium avium subsp. paratuberculosis
acgccgggccgccg

SEQ ID NO: 2870628 - RNA, 20 nt, Mycobacterium avium subsp. paratuberculosis
acgccgggccgccgcggcca

SEQ ID NO: 2870629 - RNA, 14 nt, Mycobacterium avium subsp. paratuberculosis
acgccgggcucgcc

SEQ ID NO: 2870630 - RNA, 19 nt, Mycobacterium avium subsp. paratuberculosis
acgccgggguagaggccgc

SEQ ID NO: 2870631 - RNA, 22 nt, Mycobacterium avium subsp. paratuberculosis
acgccgggguagaggccgcgga

SEQ ID NO: 2870632 - RNA, 23 nt, Mycobacterium avium subsp. paratuberculosis
acgccgggguagaggccgcggau

SEQ ID NO: 2870633 - RNA, 17 nt, Mycobacterium avium subsp. paratuberculosis
acgccggggucgacagc

SEQ ID NO: 2870634 - RNA, 16 nt, Mycobacterium avium subsp. paratuberculosis
acgccggguccacgaa

SEQ ID NO: 2870635 - RNA, 12 nt, Mycobacterium avium subsp. paratuberculosis
acgccggguccc

SEQ ID NO: 2870636 - RNA, 15 nt, Mycobacterium avium subsp. paratuberculosis
acgccgggucgacgc

SEQ ID NO: 2870637 - RNA, 18 nt, Mycobacterium avium subsp. paratuberculosis
acgccgggucgacgccga

SEQ ID NO: 2870638 - RNA, 20 nt, Mycobacterium avium subsp. paratuberculosis
acgccgggucgacgccgagu

SEQ ID NO: 2870639 - RNA, 18 nt, Mycobacterium avium subsp. paratuberculosis
acgccggguugggcggcg

SEQ ID NO: 2870640 - RNA, 19 nt, Mycobacterium avium subsp. paratuberculosis
acgccggguugggcggcgg

SEQ ID NO: 2870641 - RNA, 20 nt, Mycobacterium avium subsp. paratuberculosis
acgccggguugggcggcggc

SEQ ID NO: 2870642 - RNA, 18 nt, Mycobacterium avium subsp. paratuberculosis
acgccgguagccgcucgc

SEQ ID NO: 2870643 - RNA, 21 nt, Mycobacterium avium subsp. paratuberculosis
acgccgguagccgcucgccca

SEQ ID NO: 2870644 - RNA, 16 nt, Mycobacterium avium subsp. paratuberculosis
acgccggucagcacca

SEQ ID NO: 2870645 - RNA, 19 nt, Mycobacterium avium subsp. paratuberculosis
acgccggugaaaccggcgc

SEQ ID NO: 2870646 - RNA, 20 nt, Mycobacterium avium subsp. paratuberculosis
acgccggugaaaccggcgcc

SEQ ID NO: 2870647 - RNA, 21 nt, Mycobacterium avium subsp. paratuberculosis
acgccggugaaaccggcgccg

SEQ ID NO: 2870648 - RNA, 22 nt, Mycobacterium avium subsp. paratuberculosis
acgccggugaaaccggcgccga

SEQ ID NO: 2870649 - RNA, 16 nt, Mycobacterium avium subsp. paratuberculosis
acgccggugagcacga

SEQ ID NO: 2870650 - RNA, 19 nt, Mycobacterium avium subsp. paratuberculosis
acgccguagaucacgccgg

SEQ ID NO: 2870651 - RNA, 17 nt, Mycobacterium avium subsp. paratuberculosis
acgccguauucgccgac

SEQ ID NO: 2870652 - RNA, 21 nt, Mycobacterium avium subsp. paratuberculosis
acgccgucacggaucgcccac

SEQ ID NO: 2870653 - RNA, 17 nt, Mycobacterium avium subsp. paratuberculosis
acgccguccgacgugcu

SEQ ID NO: 2870654 - RNA, 20 nt, Mycobacterium avium subsp. paratuberculosis
acgccguccuuggccgccag

SEQ ID NO: 2870655 - RNA, 21 nt, Mycobacterium avium subsp. paratuberculosis
acgccguccuuggccgccagc

SEQ ID NO: 2870656 - RNA, 16 nt, Mycobacterium avium subsp. paratuberculosis
acgccgucgacgaucu

SEQ ID NO: 2870657 - RNA, 22 nt, Mycobacterium avium subsp. paratuberculosis
acgccgucgacgaucugcacac

SEQ ID NO: 2870658 - RNA, 13 nt, Mycobacterium avium subsp. paratuberculosis
acgccgucgagcc

SEQ ID NO: 2870659 - RNA, 19 nt, Mycobacterium avium subsp. paratuberculosis
acgccgucgaugacgcgcu

SEQ ID NO: 2870660 - RNA, 14 nt, Mycobacterium avium subsp. paratuberculosis
acgccgucggggua

SEQ ID NO: 2870661 - RNA, 17 nt, Mycobacterium avium subsp. paratuberculosis
acgccgucgugcucggc

SEQ ID NO: 2870662 - RNA, 19 nt, Mycobacterium avium subsp. paratuberculosis
acgccgucgugcucggcga

SEQ ID NO: 2870663 - RNA, 19 nt, Mycobacterium avium subsp. paratuberculosis
acgccgugcagaacagcac

SEQ ID NO: 2870664 - RNA, 21 nt, Mycobacterium avium subsp. paratuberculosis
acgccgugcagaacagcacga

SEQ ID NO: 2870665 - RNA, 14 nt, Mycobacterium avium subsp. paratuberculosis
acgccgugcaggag

SEQ ID NO: 2870666 - RNA, 17 nt, Mycobacterium avium subsp. paratuberculosis
acgccgugcccggcgcc

SEQ ID NO: 2870667 - RNA, 14 nt, Mycobacterium avium subsp. paratuberculosis
acgccgugcugccg

SEQ ID NO: 2870668 - RNA, 14 nt, Mycobacterium avium subsp. paratuberculosis
acgccguggaucgg

SEQ ID NO: 2870669 - RNA, 14 nt, Mycobacterium avium subsp. paratuberculosis
acgccguggcccgc

SEQ ID NO: 2870670 - RNA, 15 nt, Mycobacterium avium subsp. paratuberculosis
acgccguggcccgcc

SEQ ID NO: 2870671 - RNA, 14 nt, Mycobacterium avium subsp. paratuberculosis
acgccguggcggcg

SEQ ID NO: 2870672 - RNA, 20 nt, Mycobacterium avium subsp. paratuberculosis
acgccguggcggcgggccag

SEQ ID NO: 2870673 - RNA, 21 nt, Mycobacterium avium subsp. paratuberculosis
acgccguggcggcgggccagc

SEQ ID NO: 2870674 - RNA, 23 nt, Mycobacterium avium subsp. paratuberculosis
acgccguggcggcgggccagcuc

SEQ ID NO: 2870675 - RNA, 22 nt, Mycobacterium avium subsp. paratuberculosis
acgccgugguccagccggucgc

SEQ ID NO: 2870676 - RNA, 14 nt, Mycobacterium avium subsp. paratuberculosis
acgccguguugacg

SEQ ID NO: 2870677 - RNA, 15 nt, Mycobacterium avium subsp. paratuberculosis
acgccguguugacgu

SEQ ID NO: 2870678 - RNA, 22 nt, Mycobacterium avium subsp. paratuberculosis
acgccguugcggugcucgucga

SEQ ID NO: 2870679 - RNA, 13 nt, Mycobacterium avium subsp. paratuberculosis
acgccucacccca

SEQ ID NO: 2870680 - RNA, 18 nt, Mycobacterium avium subsp. paratuberculosis
acgccucaccccagcgcg

SEQ ID NO: 2870681 - RNA, 20 nt, Mycobacterium avium subsp. paratuberculosis
acgccucaccccagcgcgac

SEQ ID NO: 2870682 - RNA, 13 nt, Mycobacterium avium subsp. paratuberculosis
acgccucaggcga

SEQ ID NO: 2870683 - RNA, 17 nt, Mycobacterium avium subsp. paratuberculosis
acgccucaggcgagcac

SEQ ID NO: 2870684 - RNA, 11 nt, Mycobacterium avium subsp. paratuberculosis
acgccuccaca

SEQ ID NO: 2870685 - RNA, 14 nt, Mycobacterium avium subsp. paratuberculosis
acgccucccccacc

SEQ ID NO: 2870686 - RNA, 20 nt, Mycobacterium avium subsp. paratuberculosis
acgccuccgaauccagcgcg

SEQ ID NO: 2870687 - RNA, 21 nt, Mycobacterium avium subsp. paratuberculosis
acgccuccgaauccagcgcgc

SEQ ID NO: 2870688 - RNA, 13 nt, Mycobacterium avium subsp. paratuberculosis
acgccuccgccgc

SEQ ID NO: 2870689 - RNA, 23 nt, Mycobacterium avium subsp. paratuberculosis
acgccuccgccgccccgucgguc

SEQ ID NO: 2870690 - RNA, 23 nt, Mycobacterium avium subsp. paratuberculosis
acgccuccggcaguacgcgccgg

SEQ ID NO: 2870691 - RNA, 17 nt, Mycobacterium avium subsp. paratuberculosis
acgccucgagcgcccgg

SEQ ID NO: 2870692 - RNA, 14 nt, Mycobacterium avium subsp. paratuberculosis
acgccucgcgcagc

SEQ ID NO: 2870693 - RNA, 16 nt, Mycobacterium avium subsp. paratuberculosis
acgccucgggccggca

SEQ ID NO: 2870694 - RNA, 17 nt, Mycobacterium avium subsp. paratuberculosis
acgccucgggccggcag

SEQ ID NO: 2870695 - RNA, 18 nt, Mycobacterium avium subsp. paratuberculosis
acgccucgggccggcagc

SEQ ID NO: 2870696 - RNA, 20 nt, Mycobacterium avium subsp. paratuberculosis
acgccucggugcggaacacc

SEQ ID NO: 2870697 - RNA, 12 nt, Mycobacterium avium subsp. paratuberculosis
acgccucgucga

SEQ ID NO: 2870698 - RNA, 13 nt, Mycobacterium avium subsp. paratuberculosis
acgccucgucgac

SEQ ID NO: 2870699 - RNA, 17 nt, Mycobacterium avium subsp. paratuberculosis
acgccucgucgaccgcg

SEQ ID NO: 2870700 - RNA, 19 nt, Mycobacterium avium subsp. paratuberculosis
acgccucgucgaccgcggc

SEQ ID NO: 2870701 - RNA, 22 nt, Mycobacterium avium subsp. paratuberculosis
acgccucgucgaccgcggccug

SEQ ID NO: 2870702 - RNA, 15 nt, Mycobacterium avium subsp. paratuberculosis
acgccucgucgagca

SEQ ID NO: 2870703 - RNA, 17 nt, Mycobacterium avium subsp. paratuberculosis
acgccucgucgagcagc

SEQ ID NO: 2870704 - RNA, 19 nt, Mycobacterium avium subsp. paratuberculosis
acgccucgucgagcagcgc

SEQ ID NO: 2870705 - RNA, 21 nt, Mycobacterium avium subsp. paratuberculosis
acgccucgucgagcagcgccc

SEQ ID NO: 2870706 - RNA, 14 nt, Mycobacterium avium subsp. paratuberculosis
acgccucguuggcc

SEQ ID NO: 2870707 - RNA, 15 nt, Mycobacterium avium subsp. paratuberculosis
acgccucguuggcca

SEQ ID NO: 2870708 - RNA, 18 nt, Mycobacterium avium subsp. paratuberculosis
acgccucguuggccagcu

SEQ ID NO: 2870709 - RNA, 19 nt, Mycobacterium avium subsp. paratuberculosis
acgccucguuggccagcuc

SEQ ID NO: 2870710 - RNA, 21 nt, Mycobacterium avium subsp. paratuberculosis
acgccucguuggccagcucgg

SEQ ID NO: 2870711 - RNA, 16 nt, Mycobacterium avium subsp. paratuberculosis
acgccugccggcgccg

SEQ ID NO: 2870712 - RNA, 17 nt, Mycobacterium avium subsp. paratuberculosis
acgccugccggcgccgg

SEQ ID NO: 2870713 - RNA, 14 nt, Mycobacterium avium subsp. paratuberculosis
acgccugcgccgcc

SEQ ID NO: 2870714 - RNA, 15 nt, Mycobacterium avium subsp. paratuberculosis
acgccugcgccgccg

SEQ ID NO: 2870715 - RNA, 16 nt, Mycobacterium avium subsp. paratuberculosis
acgccugcgccgccgu

SEQ ID NO: 2870716 - RNA, 14 nt, Mycobacterium avium subsp. paratuberculosis
acgccugcggccca

SEQ ID NO: 2870717 - RNA, 16 nt, Mycobacterium avium subsp. paratuberculosis
acgccugcggcccagc

SEQ ID NO: 2870718 - RNA, 21 nt, Mycobacterium avium subsp. paratuberculosis
acgccuggcggaaggccgcgc

SEQ ID NO: 2870719 - RNA, 20 nt, Mycobacterium avium subsp. paratuberculosis
acgccuugcacacggccuug

SEQ ID NO: 2870720 - RNA, 17 nt, Mycobacterium avium subsp. paratuberculosis
acgccuugcgguuggcc

SEQ ID NO: 2870721 - RNA, 20 nt, Mycobacterium avium subsp. paratuberculosis
acgccuugcgguuggccgga

SEQ ID NO: 2870722 - RNA, 15 nt, Mycobacterium avium subsp. paratuberculosis
acgccuuggugccgu

SEQ ID NO: 2870723 - RNA, 15 nt, Mycobacterium avium subsp. paratuberculosis
acgcgaaagcacccg

SEQ ID NO: 2870724 - RNA, 17 nt, Mycobacterium avium subsp. paratuberculosis
acgcgaaagcacccgac

SEQ ID NO: 2870725 - RNA, 14 nt, Mycobacterium avium subsp. paratuberculosis
acgcgaacccacac

SEQ ID NO: 2870726 - RNA, 16 nt, Mycobacterium avium subsp. paratuberculosis
acgcgaacgcgccccg

SEQ ID NO: 2870727 - RNA, 17 nt, Mycobacterium avium subsp. paratuberculosis
acgcgaagucgccgccc

SEQ ID NO: 2870728 - RNA, 20 nt, Mycobacterium avium subsp. paratuberculosis
acgcgaagucgccgcccggg

SEQ ID NO: 2870729 - RNA, 21 nt, Mycobacterium avium subsp. paratuberculosis
acgcgaagucgccgcccgggc

SEQ ID NO: 2870730 - RNA, 22 nt, Mycobacterium avium subsp. paratuberculosis
acgcgaagucgccgcccgggcc

SEQ ID NO: 2870731 - RNA, 17 nt, Mycobacterium avium subsp. paratuberculosis
acgcgaaugucgaccac

SEQ ID NO: 2870732 - RNA, 22 nt, Mycobacterium avium subsp. paratuberculosis
acgcgaaugucgaccaccgggu

SEQ ID NO: 2870733 - RNA, 19 nt, Mycobacterium avium subsp. paratuberculosis
acgcgaccaggcccagcgg

SEQ ID NO: 2870734 - RNA, 14 nt, Mycobacterium avium subsp. paratuberculosis
acgcgaccgagguc

SEQ ID NO: 2870735 - RNA, 15 nt, Mycobacterium avium subsp. paratuberculosis
acgcgaccgcgcggc

SEQ ID NO: 2870736 - RNA, 16 nt, Mycobacterium avium subsp. paratuberculosis
acgcgaccgcgcggcg

SEQ ID NO: 2870737 - RNA, 14 nt, Mycobacterium avium subsp. paratuberculosis
acgcgaccggccau

SEQ ID NO: 2870738 - RNA, 15 nt, Mycobacterium avium subsp. paratuberculosis
acgcgaccggccauc

SEQ ID NO: 2870739 - RNA, 13 nt, Mycobacterium avium subsp. paratuberculosis
acgcgaccggccc

SEQ ID NO: 2870740 - RNA, 14 nt, Mycobacterium avium subsp. paratuberculosis
acgcgaccggcccg

SEQ ID NO: 2870741 - RNA, 15 nt, Mycobacterium avium subsp. paratuberculosis
acgcgaccggcccga

SEQ ID NO: 2870742 - RNA, 16 nt, Mycobacterium avium subsp. paratuberculosis
acgcgaccgucgggac

SEQ ID NO: 2870743 - RNA, 14 nt, Mycobacterium avium subsp. paratuberculosis
acgcgacgaaccgc

SEQ ID NO: 2870744 - RNA, 17 nt, Mycobacterium avium subsp. paratuberculosis
acgcgacgaagccggug

SEQ ID NO: 2870745 - RNA, 18 nt, Mycobacterium avium subsp. paratuberculosis
acgcgacgaagccggugc

SEQ ID NO: 2870746 - RNA, 15 nt, Mycobacterium avium subsp. paratuberculosis
acgcgacgcgcucgg

SEQ ID NO: 2870747 - RNA, 18 nt, Mycobacterium avium subsp. paratuberculosis
acgcgacgcgcucggcga

SEQ ID NO: 2870748 - RNA, 14 nt, Mycobacterium avium subsp. paratuberculosis
acgcgacggcccgg

SEQ ID NO: 2870749 - RNA, 16 nt, Mycobacterium avium subsp. paratuberculosis
acgcgacggcccgguc

SEQ ID NO: 2870750 - RNA, 20 nt, Mycobacterium avium subsp. paratuberculosis
acgcgacggcccgguccagu

SEQ ID NO: 2870751 - RNA, 19 nt, Mycobacterium avium subsp. paratuberculosis
acgcgacggucgugcuggg

SEQ ID NO: 2870752 - RNA, 21 nt, Mycobacterium avium subsp. paratuberculosis
acgcgacggucgugcugggcc

SEQ ID NO: 2870753 - RNA, 12 nt, Mycobacterium avium subsp. paratuberculosis
acgcgacggugg

SEQ ID NO: 2870754 - RNA, 14 nt, Mycobacterium avium subsp. paratuberculosis
acgcgacgguggcg

SEQ ID NO: 2870755 - RNA, 15 nt, Mycobacterium avium subsp. paratuberculosis
acgcgagaagcgcgc

SEQ ID NO: 2870756 - RNA, 18 nt, Mycobacterium avium subsp. paratuberculosis
acgcgagacgagccgccg

SEQ ID NO: 2870757 - RNA, 16 nt, Mycobacterium avium subsp. paratuberculosis
acgcgagcggacgggc

SEQ ID NO: 2870758 - RNA, 22 nt, Mycobacterium avium subsp. paratuberculosis
acgcgagcugcuucgucgccgg

SEQ ID NO: 2870759 - RNA, 23 nt, Mycobacterium avium subsp. paratuberculosis
acgcgagcugcuucgucgccggg

SEQ ID NO: 2870760 - RNA, 24 nt, Mycobacterium avium subsp. paratuberculosis
acgcgauagaccucacggucggcg

SEQ ID NO: 2870761 - RNA, 19 nt, Mycobacterium avium subsp. paratuberculosis
acgcgaucagguccggaau

SEQ ID NO: 2870762 - RNA, 23 nt, Mycobacterium avium subsp. paratuberculosis
acgcgaugaucagcucgcgcauc

SEQ ID NO: 2870763 - RNA, 17 nt, Mycobacterium avium subsp. paratuberculosis
acgcgauggcggcgcgc

SEQ ID NO: 2870764 - RNA, 19 nt, Mycobacterium avium subsp. paratuberculosis
acgcgauggcggcgcgcuc

SEQ ID NO: 2870765 - RNA, 21 nt, Mycobacterium avium subsp. paratuberculosis
acgcgauggcggcgcgcucgu

SEQ ID NO: 2870766 - RNA, 22 nt, Mycobacterium avium subsp. paratuberculosis
acgcgauggcggcgcgcucguc

SEQ ID NO: 2870767 - RNA, 19 nt, Mycobacterium avium subsp. paratuberculosis
acgcgauucucgcugcggc

SEQ ID NO: 2870768 - RNA, 22 nt, Mycobacterium avium subsp. paratuberculosis
acgcgauucucgcugcggcgca

SEQ ID NO: 2870769 - RNA, 15 nt, Mycobacterium avium subsp. paratuberculosis
acgcgcaauccugcc

SEQ ID NO: 2870770 - RNA, 17 nt, Mycobacterium avium subsp. paratuberculosis
acgcgcaauccugcccg

SEQ ID NO: 2870771 - RNA, 19 nt, Mycobacterium avium subsp. paratuberculosis
acgcgcaauccugcccggu

SEQ ID NO: 2870772 - RNA, 20 nt, Mycobacterium avium subsp. paratuberculosis
acgcgcaauccugcccgguc

SEQ ID NO: 2870773 - RNA, 17 nt, Mycobacterium avium subsp. paratuberculosis
acgcgcacaacagccau

SEQ ID NO: 2870774 - RNA, 17 nt, Mycobacterium avium subsp. paratuberculosis
acgcgcacacggccucg

SEQ ID NO: 2870775 - RNA, 18 nt, Mycobacterium avium subsp. paratuberculosis
acgcgcacacggccucgc

SEQ ID NO: 2870776 - RNA, 17 nt, Mycobacterium avium subsp. paratuberculosis
acgcgcaccagggccgc

SEQ ID NO: 2870777 - RNA, 18 nt, Mycobacterium avium subsp. paratuberculosis
acgcgcacccgggaccgg

SEQ ID NO: 2870778 - RNA, 12 nt, Mycobacterium avium subsp. paratuberculosis
acgcgcaccgcc

SEQ ID NO: 2870779 - RNA, 15 nt, Mycobacterium avium subsp. paratuberculosis
acgcgcaccgccacc

SEQ ID NO: 2870780 - RNA, 17 nt, Mycobacterium avium subsp. paratuberculosis
acgcgcaccgccaccgc

SEQ ID NO: 2870781 - RNA, 18 nt, Mycobacterium avium subsp. paratuberculosis
acgcgcaccgccaccgcc

SEQ ID NO: 2870782 - RNA, 22 nt, Mycobacterium avium subsp. paratuberculosis
acgcgcaccgccaccgcccgcu

SEQ ID NO: 2870783 - RNA, 12 nt, Mycobacterium avium subsp. paratuberculosis
acgcgccacgcc

SEQ ID NO: 2870784 - RNA, 17 nt, Mycobacterium avium subsp. paratuberculosis
acgcgccacgccccggc

SEQ ID NO: 2870785 - RNA, 22 nt, Mycobacterium avium subsp. paratuberculosis
acgcgccacgccccggcgccgu

SEQ ID NO: 2870786 - RNA, 15 nt, Mycobacterium avium subsp. paratuberculosis
acgcgccccgccggg

SEQ ID NO: 2870787 - RNA, 15 nt, Mycobacterium avium subsp. paratuberculosis
acgcgcccggcgacg

SEQ ID NO: 2870788 - RNA, 20 nt, Mycobacterium avium subsp. paratuberculosis
acgcgcccggcgacgcggcg

SEQ ID NO: 2870789 - RNA, 14 nt, Mycobacterium avium subsp. paratuberculosis
acgcgcccggcggg

SEQ ID NO: 2870790 - RNA, 17 nt, Mycobacterium avium subsp. paratuberculosis
acgcgccgaacaacggc

SEQ ID NO: 2870791 - RNA, 19 nt, Mycobacterium avium subsp. paratuberculosis
acgcgccgaugccgaacgu

SEQ ID NO: 2870792 - RNA, 22 nt, Mycobacterium avium subsp. paratuberculosis
acgcgccgaugccgaacgucac

SEQ ID NO: 2870793 - RNA, 19 nt, Mycobacterium avium subsp. paratuberculosis
acgcgccgcacugcacggc

SEQ ID NO: 2870794 - RNA, 12 nt, Mycobacterium avium subsp. paratuberculosis
acgcgccgccca

SEQ ID NO: 2870795 - RNA, 14 nt, Mycobacterium avium subsp. paratuberculosis
acgcgccgcccacc

SEQ ID NO: 2870796 - RNA, 13 nt, Mycobacterium avium subsp. paratuberculosis
acgcgccgccgag

SEQ ID NO: 2870797 - RNA, 11 nt, Mycobacterium avium subsp. paratuberculosis
acgcgccggcc

SEQ ID NO: 2870798 - RNA, 15 nt, Mycobacterium avium subsp. paratuberculosis
acgcgccggccagcc

SEQ ID NO: 2870799 - RNA, 18 nt, Mycobacterium avium subsp. paratuberculosis
acgcgccggccagccggc

SEQ ID NO: 2870800 - RNA, 19 nt, Mycobacterium avium subsp. paratuberculosis
acgcgccggccagccggcu

SEQ ID NO: 2870801 - RNA, 20 nt, Mycobacterium avium subsp. paratuberculosis
acgcgccggccagccggcuc

SEQ ID NO: 2870802 - RNA, 13 nt, Mycobacterium avium subsp. paratuberculosis
acgcgccggcgcg

SEQ ID NO: 2870803 - RNA, 14 nt, Mycobacterium avium subsp. paratuberculosis
acgcgccggcgguc

SEQ ID NO: 2870804 - RNA, 16 nt, Mycobacterium avium subsp. paratuberculosis
acgcgccggcggucga

SEQ ID NO: 2870805 - RNA, 17 nt, Mycobacterium avium subsp. paratuberculosis
acgcgccgggcaacagc

SEQ ID NO: 2870806 - RNA, 19 nt, Mycobacterium avium subsp. paratuberculosis
acgcgccgggcaacagcgc

SEQ ID NO: 2870807 - RNA, 21 nt, Mycobacterium avium subsp. paratuberculosis
acgcgccgggcaacagcgcgc

SEQ ID NO: 2870808 - RNA, 12 nt, Mycobacterium avium subsp. paratuberculosis
acgcgccgguga

SEQ ID NO: 2870809 - RNA, 14 nt, Mycobacterium avium subsp. paratuberculosis
acgcgccggugacc

SEQ ID NO: 2870810 - RNA, 18 nt, Mycobacterium avium subsp. paratuberculosis
acgcgccgucgucggaca

SEQ ID NO: 2870811 - RNA, 20 nt, Mycobacterium avium subsp. paratuberculosis
acgcgcgcaguugcgcggcg

SEQ ID NO: 2870812 - RNA, 13 nt, Mycobacterium avium subsp. paratuberculosis
acgcgcgccccgg

SEQ ID NO: 2870813 - RNA, 15 nt, Mycobacterium avium subsp. paratuberculosis
acgcgcgccccgguc

SEQ ID NO: 2870814 - RNA, 13 nt, Mycobacterium avium subsp. paratuberculosis
acgcgcgcccggc

SEQ ID NO: 2870815 - RNA, 13 nt, Mycobacterium avium subsp. paratuberculosis
acgcgcgcgacgg

SEQ ID NO: 2870816 - RNA, 15 nt, Mycobacterium avium subsp. paratuberculosis
acgcgcgcgacggcg

SEQ ID NO: 2870817 - RNA, 20 nt, Mycobacterium avium subsp. paratuberculosis
acgcgcgcgacggcgcguga

SEQ ID NO: 2870818 - RNA, 13 nt, Mycobacterium avium subsp. paratuberculosis
acgcgcgcggcgu

SEQ ID NO: 2870819 - RNA, 19 nt, Mycobacterium avium subsp. paratuberculosis
acgcgcggaugcccaggcc

SEQ ID NO: 2870820 - RNA, 22 nt, Mycobacterium avium subsp. paratuberculosis
acgcgcggaugcccaggccggc

SEQ ID NO: 2870821 - RNA, 15 nt, Mycobacterium avium subsp. paratuberculosis
acgcgcgggucgucg

SEQ ID NO: 2870822 - RNA, 20 nt, Mycobacterium avium subsp. paratuberculosis
acgcgcgggucgucggccug

SEQ ID NO: 2870823 - RNA, 21 nt, Mycobacterium avium subsp. paratuberculosis
acgcgcgggucgucggccugu

SEQ ID NO: 2870824 - RNA, 13 nt, Mycobacterium avium subsp. paratuberculosis
acgcgcgggugcg

SEQ ID NO: 2870825 - RNA, 14 nt, Mycobacterium avium subsp. paratuberculosis
acgcgcgggugcgg

SEQ ID NO: 2870826 - RNA, 17 nt, Mycobacterium avium subsp. paratuberculosis
acgcgcgggugcgggcg

SEQ ID NO: 2870827 - RNA, 19 nt, Mycobacterium avium subsp. paratuberculosis
acgcgcggucgucgcccgu

SEQ ID NO: 2870828 - RNA, 14 nt, Mycobacterium avium subsp. paratuberculosis
acgcgcgugacggc

SEQ ID NO: 2870829 - RNA, 18 nt, Mycobacterium avium subsp. paratuberculosis
acgcgcgugacggcgggg

SEQ ID NO: 2870830 - RNA, 17 nt, Mycobacterium avium subsp. paratuberculosis
acgcgcucagcgcggcc

SEQ ID NO: 2870831 - RNA, 19 nt, Mycobacterium avium subsp. paratuberculosis
acgcgcucagcgcggccac

SEQ ID NO: 2870832 - RNA, 20 nt, Mycobacterium avium subsp. paratuberculosis
acgcgcucggcgaccgccgg

SEQ ID NO: 2870833 - RNA, 14 nt, Mycobacterium avium subsp. paratuberculosis
acgcgcugaucacc

SEQ ID NO: 2870834 - RNA, 13 nt, Mycobacterium avium subsp. paratuberculosis
acgcgcugccgac

SEQ ID NO: 2870835 - RNA, 17 nt, Mycobacterium avium subsp. paratuberculosis
acgcgcugcgcgccgcc

SEQ ID NO: 2870836 - RNA, 21 nt, Mycobacterium avium subsp. paratuberculosis
acgcgcugcgcgccgcccucg

SEQ ID NO: 2870837 - RNA, 21 nt, Mycobacterium avium subsp. paratuberculosis
acgcgcugucgcccucgaucg

SEQ ID NO: 2870838 - RNA, 17 nt, Mycobacterium avium subsp. paratuberculosis
acgcggacagcucgccg

SEQ ID NO: 2870839 - RNA, 18 nt, Mycobacterium avium subsp. paratuberculosis
acgcggacagcucgccgg

SEQ ID NO: 2870840 - RNA, 23 nt, Mycobacterium avium subsp. paratuberculosis
acgcggacagcucgccggccgcg

SEQ ID NO: 2870841 - RNA, 22 nt, Mycobacterium avium subsp. paratuberculosis
acgcggaccuuggugucggcga

SEQ ID NO: 2870842 - RNA, 18 nt, Mycobacterium avium subsp. paratuberculosis
acgcggauagcccagcgu

SEQ ID NO: 2870843 - RNA, 17 nt, Mycobacterium avium subsp. paratuberculosis
acgcggaucgcgcugac

SEQ ID NO: 2870844 - RNA, 18 nt, Mycobacterium avium subsp. paratuberculosis
acgcggaucgguggacgc

SEQ ID NO: 2870845 - RNA, 16 nt, Mycobacterium avium subsp. paratuberculosis
acgcggcaggcgcccc

SEQ ID NO: 2870846 - RNA, 18 nt, Mycobacterium avium subsp. paratuberculosis
acgcggcaggcgccccag

SEQ ID NO: 2870847 - RNA, 19 nt, Mycobacterium avium subsp. paratuberculosis
acgcggcaugaccggccag

SEQ ID NO: 2870848 - RNA, 20 nt, Mycobacterium avium subsp. paratuberculosis
acgcggcaugaccggccagc

SEQ ID NO: 2870849 - RNA, 16 nt, Mycobacterium avium subsp. paratuberculosis
acgcggccaccaccgc

SEQ ID NO: 2870850 - RNA, 13 nt, Mycobacterium avium subsp. paratuberculosis
acgcggccgagcc

SEQ ID NO: 2870851 - RNA, 13 nt, Mycobacterium avium subsp. paratuberculosis
acgcggccgccag

SEQ ID NO: 2870852 - RNA, 16 nt, Mycobacterium avium subsp. paratuberculosis
acgcggccgccagcgc

SEQ ID NO: 2870853 - RNA, 17 nt, Mycobacterium avium subsp. paratuberculosis
acgcggccgccagcgca

SEQ ID NO: 2870854 - RNA, 19 nt, Mycobacterium avium subsp. paratuberculosis
acgcggccgccaucgaucg

SEQ ID NO: 2870855 - RNA, 13 nt, Mycobacterium avium subsp. paratuberculosis
acgcggccgcgcc

SEQ ID NO: 2870856 - RNA, 14 nt, Mycobacterium avium subsp. paratuberculosis
acgcggccgcgccg

SEQ ID NO: 2870857 - RNA, 16 nt, Mycobacterium avium subsp. paratuberculosis
acgcggccgcgccggc

SEQ ID NO: 2870858 - RNA, 17 nt, Mycobacterium avium subsp. paratuberculosis
acgcggccucaccgcgg

SEQ ID NO: 2870859 - RNA, 22 nt, Mycobacterium avium subsp. paratuberculosis
acgcggccucaccgcgggccag

SEQ ID NO: 2870860 - RNA, 18 nt, Mycobacterium avium subsp. paratuberculosis
acgcggcgaagcaggcca

SEQ ID NO: 2870861 - RNA, 16 nt, Mycobacterium avium subsp. paratuberculosis
acgcggcgaccaccac

SEQ ID NO: 2870862 - RNA, 17 nt, Mycobacterium avium subsp. paratuberculosis
acgcggcgaccaccacc

SEQ ID NO: 2870863 - RNA, 18 nt, Mycobacterium avium subsp. paratuberculosis
acgcggcgaccaccaccg

SEQ ID NO: 2870864 - RNA, 20 nt, Mycobacterium avium subsp. paratuberculosis
acgcggcgaccaccaccgcc

SEQ ID NO: 2870865 - RNA, 12 nt, Mycobacterium avium subsp. paratuberculosis
acgcggcgccga

SEQ ID NO: 2870866 - RNA, 13 nt, Mycobacterium avium subsp. paratuberculosis
acgcggcgccgac

SEQ ID NO: 2870867 - RNA, 15 nt, Mycobacterium avium subsp. paratuberculosis
acgcggcgccgacgu

SEQ ID NO: 2870868 - RNA, 15 nt, Mycobacterium avium subsp. paratuberculosis
acgcggcgccguccu

SEQ ID NO: 2870869 - RNA, 12 nt, Mycobacterium avium subsp. paratuberculosis
acgcggcgcgac

SEQ ID NO: 2870870 - RNA, 13 nt, Mycobacterium avium subsp. paratuberculosis
acgcggcgcgaca

SEQ ID NO: 2870871 - RNA, 16 nt, Mycobacterium avium subsp. paratuberculosis
acgcggcgcgacaccg

SEQ ID NO: 2870872 - RNA, 20 nt, Mycobacterium avium subsp. paratuberculosis
acgcggcgcgacaccgcggc

SEQ ID NO: 2870873 - RNA, 22 nt, Mycobacterium avium subsp. paratuberculosis
acgcggcgcgacaccgcggcga

SEQ ID NO: 2870874 - RNA, 14 nt, Mycobacterium avium subsp. paratuberculosis
acgcggcgcgcauc

SEQ ID NO: 2870875 - RNA, 15 nt, Mycobacterium avium subsp. paratuberculosis
acgcggcgcgcgaug

SEQ ID NO: 2870876 - RNA, 16 nt, Mycobacterium avium subsp. paratuberculosis
acgcggcgcgcgaugg

SEQ ID NO: 2870877 - RNA, 20 nt, Mycobacterium avium subsp. paratuberculosis
acgcggcggaggccugcgcg

SEQ ID NO: 2870878 - RNA, 22 nt, Mycobacterium avium subsp. paratuberculosis
acgcggcggaggccugcgcggc

SEQ ID NO: 2870879 - RNA, 14 nt, Mycobacterium avium subsp. paratuberculosis
acgcggcggccgac

SEQ ID NO: 2870880 - RNA, 13 nt, Mycobacterium avium subsp. paratuberculosis
acgcggcggccug

SEQ ID NO: 2870881 - RNA, 14 nt, Mycobacterium avium subsp. paratuberculosis
acgcggcggccugc

SEQ ID NO: 2870882 - RNA, 20 nt, Mycobacterium avium subsp. paratuberculosis
acgcggcggccugcgcgucg

SEQ ID NO: 2870883 - RNA, 22 nt, Mycobacterium avium subsp. paratuberculosis
acgcggcggccugcgcgucguc

SEQ ID NO: 2870884 - RNA, 21 nt, Mycobacterium avium subsp. paratuberculosis
acgcggcggccuggccgucgc

SEQ ID NO: 2870885 - RNA, 14 nt, Mycobacterium avium subsp. paratuberculosis
acgcggcggcggug

SEQ ID NO: 2870886 - RNA, 13 nt, Mycobacterium avium subsp. paratuberculosis
acgcggcgggaaa

SEQ ID NO: 2870887 - RNA, 14 nt, Mycobacterium avium subsp. paratuberculosis
acgcggcgggaaac

SEQ ID NO: 2870888 - RNA, 22 nt, Mycobacterium avium subsp. paratuberculosis
acgcggcgggaacgguugacgc

SEQ ID NO: 2870889 - RNA, 20 nt, Mycobacterium avium subsp. paratuberculosis
acgcggcguugccgccggcg

SEQ ID NO: 2870890 - RNA, 22 nt, Mycobacterium avium subsp. paratuberculosis
acgcggcguugccgccggcgcg

SEQ ID NO: 2870891 - RNA, 15 nt, Mycobacterium avium subsp. paratuberculosis
acgcggcucgcgcgg

SEQ ID NO: 2870892 - RNA, 16 nt, Mycobacterium avium subsp. paratuberculosis
acgcggcucgcgcggu

SEQ ID NO: 2870893 - RNA, 13 nt, Mycobacterium avium subsp. paratuberculosis
acgcggcugauca

SEQ ID NO: 2870894 - RNA, 21 nt, Mycobacterium avium subsp. paratuberculosis
acgcggcugaucagccggcga

SEQ ID NO: 2870895 - RNA, 24 nt, Mycobacterium avium subsp. paratuberculosis
acgcggcugaucagccggcgagcg

SEQ ID NO: 2870896 - RNA, 17 nt, Mycobacterium avium subsp. paratuberculosis
acgcggcuggcccggcg

SEQ ID NO: 2870897 - RNA, 18 nt, Mycobacterium avium subsp. paratuberculosis
acgcggcuggcccggcgc

SEQ ID NO: 2870898 - RNA, 21 nt, Mycobacterium avium subsp. paratuberculosis
acgcggcuggcccggcgcggc

SEQ ID NO: 2870899 - RNA, 16 nt, Mycobacterium avium subsp. paratuberculosis
acgcggcuggcgggug

SEQ ID NO: 2870900 - RNA, 23 nt, Mycobacterium avium subsp. paratuberculosis
acgcggcuggcgggugguuggcc

SEQ ID NO: 2870901 - RNA, 18 nt, Mycobacterium avium subsp. paratuberculosis
acgcgggauugccgagca

SEQ ID NO: 2870902 - RNA, 19 nt, Mycobacterium avium subsp. paratuberculosis
acgcgggauugccgagcac

SEQ ID NO: 2870903 - RNA, 20 nt, Mycobacterium avium subsp. paratuberculosis
acgcgggauugccgagcacc

SEQ ID NO: 2870904 - RNA, 13 nt, Mycobacterium avium subsp. paratuberculosis
acgcgggccggca

SEQ ID NO: 2870905 - RNA, 13 nt, Mycobacterium avium subsp. paratuberculosis
acgcgggcgacgu

SEQ ID NO: 2870906 - RNA, 17 nt, Mycobacterium avium subsp. paratuberculosis
acgcgggcgacgucaac

SEQ ID NO: 2870907 - RNA, 13 nt, Mycobacterium avium subsp. paratuberculosis
acgcgggcgccca

SEQ ID NO: 2870908 - RNA, 14 nt, Mycobacterium avium subsp. paratuberculosis
acgcggggcggcgg

SEQ ID NO: 2870909 - RNA, 19 nt, Mycobacterium avium subsp. paratuberculosis
acgcggggcggcggcgccg

SEQ ID NO: 2870910 - RNA, 18 nt, Mycobacterium avium subsp. paratuberculosis
acgcgguaccgaugacca

SEQ ID NO: 2870911 - RNA, 22 nt, Mycobacterium avium subsp. paratuberculosis
acgcgguaccgaugaccaccgc

SEQ ID NO: 2870912 - RNA, 23 nt, Mycobacterium avium subsp. paratuberculosis
acgcggucgucgucgucggugau

SEQ ID NO: 2870913 - RNA, 17 nt, Mycobacterium avium subsp. paratuberculosis
acgcggucugcggugcg

SEQ ID NO: 2870914 - RNA, 22 nt, Mycobacterium avium subsp. paratuberculosis
acgcggucugcggugcgcccag

SEQ ID NO: 2870915 - RNA, 16 nt, Mycobacterium avium subsp. paratuberculosis
acgcggugaccgcggc

SEQ ID NO: 2870916 - RNA, 13 nt, Mycobacterium avium subsp. paratuberculosis
acgcggugacggu

SEQ ID NO: 2870917 - RNA, 15 nt, Mycobacterium avium subsp. paratuberculosis
acgcggugacgguga

SEQ ID NO: 2870918 - RNA, 16 nt, Mycobacterium avium subsp. paratuberculosis
acgcggugagcgcgcc

SEQ ID NO: 2870919 - RNA, 17 nt, Mycobacterium avium subsp. paratuberculosis
acgcggugagcgcgccg

SEQ ID NO: 2870920 - RNA, 21 nt, Mycobacterium avium subsp. paratuberculosis
acgcggugggcaccagcagcg

SEQ ID NO: 2870921 - RNA, 22 nt, Mycobacterium avium subsp. paratuberculosis
acgcggugggcaccagcagcgc

SEQ ID NO: 2870922 - RNA, 14 nt, Mycobacterium avium subsp. paratuberculosis
acgcgguggugcuc

SEQ ID NO: 2870923 - RNA, 19 nt, Mycobacterium avium subsp. paratuberculosis
acgcgguggugcucgcccc

SEQ ID NO: 2870924 - RNA, 21 nt, Mycobacterium avium subsp. paratuberculosis
acgcgguguuggcggcgucgu

SEQ ID NO: 2870925 - RNA, 16 nt, Mycobacterium avium subsp. paratuberculosis
acgcguagaaccagug

SEQ ID NO: 2870926 - RNA, 18 nt, Mycobacterium avium subsp. paratuberculosis
acgcguagaaccagugcg

SEQ ID NO: 2870927 - RNA, 14 nt, Mycobacterium avium subsp. paratuberculosis
acgcguagccgacc

SEQ ID NO: 2870928 - RNA, 15 nt, Mycobacterium avium subsp. paratuberculosis
acgcguagccgacca

SEQ ID NO: 2870929 - RNA, 23 nt, Mycobacterium avium subsp. paratuberculosis
acgcgucaccggaauugaagccc

SEQ ID NO: 2870930 - RNA, 17 nt, Mycobacterium avium subsp. paratuberculosis
acgcguccgacggcugg

SEQ ID NO: 2870931 - RNA, 21 nt, Mycobacterium avium subsp. paratuberculosis
acgcguccguagugcucggcg

SEQ ID NO: 2870932 - RNA, 13 nt, Mycobacterium avium subsp. paratuberculosis
acgcgucgaacac

SEQ ID NO: 2870933 - RNA, 16 nt, Mycobacterium avium subsp. paratuberculosis
acgcgucgaacagccg

SEQ ID NO: 2870934 - RNA, 20 nt, Mycobacterium avium subsp. paratuberculosis
acgcgucgaacagccgggcc

SEQ ID NO: 2870935 - RNA, 16 nt, Mycobacterium avium subsp. paratuberculosis
acgcgucgaccgccgc

SEQ ID NO: 2870936 - RNA, 19 nt, Mycobacterium avium subsp. paratuberculosis
acgcgucgcccacgccggu

SEQ ID NO: 2870937 - RNA, 12 nt, Mycobacterium avium subsp. paratuberculosis
acgcgucgccgu

SEQ ID NO: 2870938 - RNA, 15 nt, Mycobacterium avium subsp. paratuberculosis
acgcgucgcgccagc

SEQ ID NO: 2870939 - RNA, 17 nt, Mycobacterium avium subsp. paratuberculosis
acgcgucgcgccagcgg

SEQ ID NO: 2870940 - RNA, 18 nt, Mycobacterium avium subsp. paratuberculosis
acgcgucgcgccagcggu

SEQ ID NO: 2870941 - RNA, 14 nt, Mycobacterium avium subsp. paratuberculosis
acgcgucgcggcgg

SEQ ID NO: 2870942 - RNA, 16 nt, Mycobacterium avium subsp. paratuberculosis
acgcgucggcgccgga

SEQ ID NO: 2870943 - RNA, 17 nt, Mycobacterium avium subsp. paratuberculosis
acgcgucggcgccggau

SEQ ID NO: 2870944 - RNA, 18 nt, Mycobacterium avium subsp. paratuberculosis
acgcgucggucagcggcg

SEQ ID NO: 2870945 - RNA, 19 nt, Mycobacterium avium subsp. paratuberculosis
acgcgucggucagcggcgu

SEQ ID NO: 2870946 - RNA, 20 nt, Mycobacterium avium subsp. paratuberculosis
acgcgucggucagcggcguc

SEQ ID NO: 2870947 - RNA, 18 nt, Mycobacterium avium subsp. paratuberculosis
acgcgucguugucgucgc

SEQ ID NO: 2870948 - RNA, 15 nt, Mycobacterium avium subsp. paratuberculosis
acgcgugcgucaucg

SEQ ID NO: 2870949 - RNA, 23 nt, Mycobacterium avium subsp. paratuberculosis
acgcgugcgucaucgcgcugggg

SEQ ID NO: 2870950 - RNA, 21 nt, Mycobacterium avium subsp. paratuberculosis
acgcguuacacccauucacgc

SEQ ID NO: 2870951 - RNA, 14 nt, Mycobacterium avium subsp. paratuberculosis
acgcguucgucggc

SEQ ID NO: 2870952 - RNA, 16 nt, Mycobacterium avium subsp. paratuberculosis
acgcguucgucggcgc

SEQ ID NO: 2870953 - RNA, 21 nt, Mycobacterium avium subsp. paratuberculosis
acgcguucgucggcgcgucgu

SEQ ID NO: 2870954 - RNA, 17 nt, Mycobacterium avium subsp. paratuberculosis
acgcguugaccagaccg

SEQ ID NO: 2870955 - RNA, 21 nt, Mycobacterium avium subsp. paratuberculosis
acgcguugaccagaccgaaga

SEQ ID NO: 2870956 - RNA, 15 nt, Mycobacterium avium subsp. paratuberculosis
acgcguugcagcgcc

SEQ ID NO: 2870957 - RNA, 17 nt, Mycobacterium avium subsp. paratuberculosis
acgcguugcagcgccgc

SEQ ID NO: 2870958 - RNA, 21 nt, Mycobacterium avium subsp. paratuberculosis
acgcguugcagcgccgcggcg

SEQ ID NO: 2870959 - RNA, 17 nt, Mycobacterium avium subsp. paratuberculosis
acgcguuguugcucggc

SEQ ID NO: 2870960 - RNA, 21 nt, Mycobacterium avium subsp. paratuberculosis
acgcguuguugcucggcggcc

SEQ ID NO: 2870961 - RNA, 22 nt, Mycobacterium avium subsp. paratuberculosis
acgcguuguugcucggcggccc

SEQ ID NO: 2870962 - RNA, 17 nt, Mycobacterium avium subsp. paratuberculosis
acgcuagcgugacaguc

SEQ ID NO: 2870963 - RNA, 24 nt, Mycobacterium avium subsp. paratuberculosis
acgcuagcgugacgcucgcguggc

SEQ ID NO: 2870964 - RNA, 22 nt, Mycobacterium avium subsp. paratuberculosis
acgcuauuggccgagccgggcg

SEQ ID NO: 2870965 - RNA, 19 nt, Mycobacterium avium subsp. paratuberculosis
acgcucacccggcccaccg

SEQ ID NO: 2870966 - RNA, 15 nt, Mycobacterium avium subsp. paratuberculosis
acgcucacgcucggc

SEQ ID NO: 2870967 - RNA, 16 nt, Mycobacterium avium subsp. paratuberculosis
acgcucacgcucggcc

SEQ ID NO: 2870968 - RNA, 20 nt, Mycobacterium avium subsp. paratuberculosis
acgcucaggcguccagccag

SEQ ID NO: 2870969 - RNA, 24 nt, Mycobacterium avium subsp. paratuberculosis
acgcucaugcccgccacggccagc

SEQ ID NO: 2870970 - RNA, 22 nt, Mycobacterium avium subsp. paratuberculosis
acgcucccgguagagcggcacc

SEQ ID NO: 2870971 - RNA, 19 nt, Mycobacterium avium subsp. paratuberculosis
acgcucgacggccggcguc

SEQ ID NO: 2870972 - RNA, 21 nt, Mycobacterium avium subsp. paratuberculosis
acgcucgaggccccgcgugac

SEQ ID NO: 2870973 - RNA, 22 nt, Mycobacterium avium subsp. paratuberculosis
acgcucgcaggcgagccgacag

SEQ ID NO: 2870974 - RNA, 16 nt, Mycobacterium avium subsp. paratuberculosis
acgcucgccaccccgc

SEQ ID NO: 2870975 - RNA, 17 nt, Mycobacterium avium subsp. paratuberculosis
acgcucgccagaccggu

SEQ ID NO: 2870976 - RNA, 16 nt, Mycobacterium avium subsp. paratuberculosis
acgcucgccggcggcc

SEQ ID NO: 2870977 - RNA, 17 nt, Mycobacterium avium subsp. paratuberculosis
acgcucgccggcggccg

SEQ ID NO: 2870978 - RNA, 19 nt, Mycobacterium avium subsp. paratuberculosis
acgcucgcgugcgaacgug

SEQ ID NO: 2870979 - RNA, 23 nt, Mycobacterium avium subsp. paratuberculosis
acgcucgcgugcgaacgugaaac

SEQ ID NO: 2870980 - RNA, 22 nt, Mycobacterium avium subsp. paratuberculosis
acgcucgcguggccugggcgac

SEQ ID NO: 2870981 - RNA, 14 nt, Mycobacterium avium subsp. paratuberculosis
acgcucggcaggcg

SEQ ID NO: 2870982 - RNA, 17 nt, Mycobacterium avium subsp. paratuberculosis
acgcucggcaggcgggg

SEQ ID NO: 2870983 - RNA, 22 nt, Mycobacterium avium subsp. paratuberculosis
acgcucggccagggugacgguc

SEQ ID NO: 2870984 - RNA, 20 nt, Mycobacterium avium subsp. paratuberculosis
acgcucggccguggccguca

SEQ ID NO: 2870985 - RNA, 21 nt, Mycobacterium avium subsp. paratuberculosis
acgcucggccguggccgucac

SEQ ID NO: 2870986 - RNA, 13 nt, Mycobacterium avium subsp. paratuberculosis
acgcucggccuca

SEQ ID NO: 2870987 - RNA, 12 nt, Mycobacterium avium subsp. paratuberculosis
acgcucggcgag

SEQ ID NO: 2870988 - RNA, 13 nt, Mycobacterium avium subsp. paratuberculosis
acgcucggcgaug

SEQ ID NO: 2870989 - RNA, 14 nt, Mycobacterium avium subsp. paratuberculosis
acgcucggcgccga

SEQ ID NO: 2870990 - RNA, 16 nt, Mycobacterium avium subsp. paratuberculosis
acgcucggcgccgagc

SEQ ID NO: 2870991 - RNA, 17 nt, Mycobacterium avium subsp. paratuberculosis
acgcucggcgccgagcg

SEQ ID NO: 2870992 - RNA, 20 nt, Mycobacterium avium subsp. paratuberculosis
acgcucggcgccgagcguga

SEQ ID NO: 2870993 - RNA, 16 nt, Mycobacterium avium subsp. paratuberculosis
acgcucggcgccgcgg

SEQ ID NO: 2870994 - RNA, 23 nt, Mycobacterium avium subsp. paratuberculosis
acgcucggcgccgcggggcgagu

SEQ ID NO: 2870995 - RNA, 15 nt, Mycobacterium avium subsp. paratuberculosis
acgcucggcgccggc

SEQ ID NO: 2870996 - RNA, 18 nt, Mycobacterium avium subsp. paratuberculosis
acgcucggcgccggccgu

SEQ ID NO: 2870997 - RNA, 20 nt, Mycobacterium avium subsp. paratuberculosis
acgcucggcgccggccguca

SEQ ID NO: 2870998 - RNA, 21 nt, Mycobacterium avium subsp. paratuberculosis
acgcucggcgccggccgucac

SEQ ID NO: 2870999 - RNA, 14 nt, Mycobacterium avium subsp. paratuberculosis
acgcucggcgcgac

SEQ ID NO: 2871000 - RNA, 17 nt, Mycobacterium avium subsp. paratuberculosis
acgcucggcgcgacguu

SEQ ID NO: 2871001 - RNA, 22 nt, Mycobacterium avium subsp. paratuberculosis
acgcucggcgcgcggggccggc

SEQ ID NO: 2871002 - RNA, 15 nt, Mycobacterium avium subsp. paratuberculosis
acgcucggcgcgucg

SEQ ID NO: 2871003 - RNA, 17 nt, Mycobacterium avium subsp. paratuberculosis
acgcucggcgcgucguc

SEQ ID NO: 2871004 - RNA, 19 nt, Mycobacterium avium subsp. paratuberculosis
aggaacaccgagccggcgg

SEQ ID NO: 2871005 - RNA, 22 nt, Mycobacterium avium subsp. paratuberculosis
aggaacaccgagccggcggcgu

SEQ ID NO: 2871006 - RNA, 14 nt, Mycobacterium avium subsp. paratuberculosis
aggaacacggcucg

SEQ ID NO: 2871007 - RNA, 14 nt, Mycobacterium avium subsp. paratuberculosis
aggaacacgggaua

SEQ ID NO: 2871008 - RNA, 16 nt, Mycobacterium avium subsp. paratuberculosis
aggaacagacacagca

SEQ ID NO: 2871009 - RNA, 22 nt, Mycobacterium avium subsp. paratuberculosis
aggaaccacaccccggccacca

SEQ ID NO: 2871010 - RNA, 18 nt, Mycobacterium avium subsp. paratuberculosis
aggaacccgaccgcgaug

SEQ ID NO: 2871011 - RNA, 18 nt, Mycobacterium avium subsp. paratuberculosis
aggaaccggcagccggcg

SEQ ID NO: 2871012 - RNA, 12 nt, Mycobacterium avium subsp. paratuberculosis
aggaaccgugcg

SEQ ID NO: 2871013 - RNA, 15 nt, Mycobacterium avium subsp. paratuberculosis
aggaaccuggucggg

SEQ ID NO: 2871014 - RNA, 18 nt, Mycobacterium avium subsp. paratuberculosis
aggaacgccuuggugccg

SEQ ID NO: 2871015 - RNA, 20 nt, Mycobacterium avium subsp. paratuberculosis
aggaacgcggacagcucgcc

SEQ ID NO: 2871016 - RNA, 22 nt, Mycobacterium avium subsp. paratuberculosis
aggaacgguuuuucccagcggc

SEQ ID NO: 2871017 - RNA, 16 nt, Mycobacterium avium subsp. paratuberculosis
aggaacucagcgccca

SEQ ID NO: 2871018 - RNA, 20 nt, Mycobacterium avium subsp. paratuberculosis
aggaacuggucgaacagcgc

SEQ ID NO: 2871019 - RNA, 17 nt, Mycobacterium avium subsp. paratuberculosis
aggaagacguaggcggc

SEQ ID NO: 2871020 - RNA, 20 nt, Mycobacterium avium subsp. paratuberculosis
aggaagacgucgaacccgaa

SEQ ID NO: 2871021 - RNA, 23 nt, Mycobacterium avium subsp. paratuberculosis
aggaagaugccgaucaggcugga

SEQ ID NO: 2871022 - RNA, 17 nt, Mycobacterium avium subsp. paratuberculosis
aggaagccaugccgggg

SEQ ID NO: 2871023 - RNA, 22 nt, Mycobacterium avium subsp. paratuberculosis
aggaagccggcgacgaccgcac

SEQ ID NO: 2871024 - RNA, 22 nt, Mycobacterium avium subsp. paratuberculosis
aggaagcgaauccgggugucga

SEQ ID NO: 2871025 - RNA, 21 nt, Mycobacterium avium subsp. paratuberculosis
aggaaguacaccaccgcggcg

SEQ ID NO: 2871026 - RNA, 15 nt, Mycobacterium avium subsp. paratuberculosis
aggaaguccggcgcg

SEQ ID NO: 2871027 - RNA, 16 nt, Mycobacterium avium subsp. paratuberculosis
aggaaguccggcgcgc

SEQ ID NO: 2871028 - RNA, 17 nt, Mycobacterium avium subsp. paratuberculosis
aggaaguccggcgcgcc

SEQ ID NO: 2871029 - RNA, 24 nt, Mycobacterium avium subsp. paratuberculosis
aggaauccgguccacucgucggcg

SEQ ID NO: 2871030 - RNA, 13 nt, Mycobacterium avium subsp. paratuberculosis
aggaaucgcggca

SEQ ID NO: 2871031 - RNA, 18 nt, Mycobacterium avium subsp. paratuberculosis
aggaauucgccgacgcgc

SEQ ID NO: 2871032 - RNA, 19 nt, Mycobacterium avium subsp. paratuberculosis
aggaauuugcggcccggcu

SEQ ID NO: 2871033 - RNA, 17 nt, Mycobacterium avium subsp. paratuberculosis
aggacaccacgaucagc

SEQ ID NO: 2871034 - RNA, 18 nt, Mycobacterium avium subsp. paratuberculosis
aggacacguuggccagau

SEQ ID NO: 2871035 - RNA, 12 nt, Mycobacterium avium subsp. paratuberculosis
aggacagcacca

SEQ ID NO: 2871036 - RNA, 14 nt, Mycobacterium avium subsp. paratuberculosis
aggacagcaccaca

SEQ ID NO: 2871037 - RNA, 16 nt, Mycobacterium avium subsp. paratuberculosis
aggacagcaccgccau

SEQ ID NO: 2871038 - RNA, 14 nt, Mycobacterium avium subsp. paratuberculosis
aggacagcugacga

SEQ ID NO: 2871039 - RNA, 19 nt, Mycobacterium avium subsp. paratuberculosis
aggacaggaacgggccggc

SEQ ID NO: 2871040 - RNA, 13 nt, Mycobacterium avium subsp. paratuberculosis
aggacaggucgcg

SEQ ID NO: 2871041 - RNA, 14 nt, Mycobacterium avium subsp. paratuberculosis
aggaccacccacuc

SEQ ID NO: 2871042 - RNA, 19 nt, Mycobacterium avium subsp. paratuberculosis
aggaccacccacucccagc

SEQ ID NO: 2871043 - RNA, 14 nt, Mycobacterium avium subsp. paratuberculosis
aggaccagguugga

SEQ ID NO: 2871044 - RNA, 16 nt, Mycobacterium avium subsp. paratuberculosis
aggaccccggcugcug

SEQ ID NO: 2871045 - RNA, 21 nt, Mycobacterium avium subsp. paratuberculosis
aggacccguacuucucgaaga

SEQ ID NO: 2871046 - RNA, 21 nt, Mycobacterium avium subsp. paratuberculosis
aggaccgagccgcgcgccgag

SEQ ID NO: 2871047 - RNA, 16 nt, Mycobacterium avium subsp. paratuberculosis
aggaccgcgcgccggc

SEQ ID NO: 2871048 - RNA, 24 nt, Mycobacterium avium subsp. paratuberculosis
aggaccggaugaaggacuggccca

SEQ ID NO: 2871049 - RNA, 16 nt, Mycobacterium avium subsp. paratuberculosis
aggaccgggacgacgg

SEQ ID NO: 2871050 - RNA, 20 nt, Mycobacterium avium subsp. paratuberculosis
aggacgaacgcuggcggcgu

SEQ ID NO: 2871051 - RNA, 14 nt, Mycobacterium avium subsp. paratuberculosis
aggacgaggcccgc

SEQ ID NO: 2871052 - RNA, 14 nt, Mycobacterium avium subsp. paratuberculosis
aggacgaggcgggu

SEQ ID NO: 2871053 - RNA, 13 nt, Mycobacterium avium subsp. paratuberculosis
aggacgcccggcg

SEQ ID NO: 2871054 - RNA, 14 nt, Mycobacterium avium subsp. paratuberculosis
aggacgcccggcga

SEQ ID NO: 2871055 - RNA, 16 nt, Mycobacterium avium subsp. paratuberculosis
aggacgcccggcgagu

SEQ ID NO: 2871056 - RNA, 19 nt, Mycobacterium avium subsp. paratuberculosis
aggacgcgcccggcgacgc

SEQ ID NO: 2871057 - RNA, 17 nt, Mycobacterium avium subsp. paratuberculosis
aggacgcgggccugggc

SEQ ID NO: 2871058 - RNA, 15 nt, Mycobacterium avium subsp. paratuberculosis
aggacgggcgugaca

SEQ ID NO: 2871059 - RNA, 16 nt, Mycobacterium avium subsp. paratuberculosis
aggacgggcgugacag

SEQ ID NO: 2871060 - RNA, 21 nt, Mycobacterium avium subsp. paratuberculosis
aggacgguggccgucucgucg

SEQ ID NO: 2871061 - RNA, 18 nt, Mycobacterium avium subsp. paratuberculosis
aggacgguuucugccggc

SEQ ID NO: 2871062 - RNA, 20 nt, Mycobacterium avium subsp. paratuberculosis
aggacgguuucugccggccg

SEQ ID NO: 2871063 - RNA, 15 nt, Mycobacterium avium subsp. paratuberculosis
aggacgucggccggc

SEQ ID NO: 2871064 - RNA, 20 nt, Mycobacterium avium subsp. paratuberculosis
aggacgucggccggcugcag

SEQ ID NO: 2871065 - RNA, 21 nt, Mycobacterium avium subsp. paratuberculosis
aggacgucggccggcugcagc

SEQ ID NO: 2871066 - RNA, 13 nt, Mycobacterium avium subsp. paratuberculosis
aggacgucgucga

SEQ ID NO: 2871067 - RNA, 16 nt, Mycobacterium avium subsp. paratuberculosis
aggacgucgucgacgu

SEQ ID NO: 2871068 - RNA, 19 nt, Mycobacterium avium subsp. paratuberculosis
aggacgucgucgacgucca

SEQ ID NO: 2871069 - RNA, 18 nt, Mycobacterium avium subsp. paratuberculosis
aggacguugaggcggcgg

SEQ ID NO: 2871070 - RNA, 18 nt, Mycobacterium avium subsp. paratuberculosis
aggacucaaucggucagg

SEQ ID NO: 2871071 - RNA, 21 nt, Mycobacterium avium subsp. paratuberculosis
aggacuggcccacgcagccgu

SEQ ID NO: 2871072 - RNA, 22 nt, Mycobacterium avium subsp. paratuberculosis
aggagaacgucaggcccagcga

SEQ ID NO: 2871073 - RNA, 15 nt, Mycobacterium avium subsp. paratuberculosis
aggagaaggccgcgc

SEQ ID NO: 2871074 - RNA, 15 nt, Mycobacterium avium subsp. paratuberculosis
aggagacgucggccg

SEQ ID NO: 2871075 - RNA, 19 nt, Mycobacterium avium subsp. paratuberculosis
aggagcaccugcgcgacgc

SEQ ID NO: 2871076 - RNA, 21 nt, Mycobacterium avium subsp. paratuberculosis
aggagcugccggcgaccagcc

SEQ ID NO: 2871077 - RNA, 22 nt, Mycobacterium avium subsp. paratuberculosis
aggaggacaagucaugccgcgc

SEQ ID NO: 2871078 - RNA, 16 nt, Mycobacterium avium subsp. paratuberculosis
aggaggccgcggcgac

SEQ ID NO: 2871079 - RNA, 15 nt, Mycobacterium avium subsp. paratuberculosis
aggaggggcgcggca

SEQ ID NO: 2871080 - RNA, 18 nt, Mycobacterium avium subsp. paratuberculosis
aggaggguuuucggggcg

SEQ ID NO: 2871081 - RNA, 13 nt, Mycobacterium avium subsp. paratuberculosis
aggagguggucga

SEQ ID NO: 2871082 - RNA, 15 nt, Mycobacterium avium subsp. paratuberculosis
aggagguuuugcgug

SEQ ID NO: 2871083 - RNA, 22 nt, Mycobacterium avium subsp. paratuberculosis
aggagucgggcaaucggaccca

SEQ ID NO: 2871084 - RNA, 22 nt, Mycobacterium avium subsp. paratuberculosis
aggaguuuuucgggguggugga

SEQ ID NO: 2871085 - RNA, 12 nt, Mycobacterium avium subsp. paratuberculosis
aggaucaccggg

SEQ ID NO: 2871086 - RNA, 14 nt, Mycobacterium avium subsp. paratuberculosis
aggaucaccgggac

SEQ ID NO: 2871087 - RNA, 20 nt, Mycobacterium avium subsp. paratuberculosis
aggaucaccgggacgggggu

SEQ ID NO: 2871088 - RNA, 12 nt, Mycobacterium avium subsp. paratuberculosis
aggaucacgcgg

SEQ ID NO: 2871089 - RNA, 23 nt, Mycobacterium avium subsp. paratuberculosis
aggauccgaugacgcugccgcgc

SEQ ID NO: 2871090 - RNA, 24 nt, Mycobacterium avium subsp. paratuberculosis
aggauccgcucgacgaguuccucg

SEQ ID NO: 2871091 - RNA, 15 nt, Mycobacterium avium subsp. paratuberculosis
aggaucgcaggaugg

SEQ ID NO: 2871092 - RNA, 19 nt, Mycobacterium avium subsp. paratuberculosis
aggaucgcaggauggccug

SEQ ID NO: 2871093 - RNA, 22 nt, Mycobacterium avium subsp. paratuberculosis
aggaucgccugauacgacgucc

SEQ ID NO: 2871094 - RNA, 12 nt, Mycobacterium avium subsp. paratuberculosis
aggaucgcggcc

SEQ ID NO: 2871095 - RNA, 21 nt, Mycobacterium avium subsp. paratuberculosis
aggaucgcggccacgcccugg

SEQ ID NO: 2871096 - RNA, 19 nt, Mycobacterium avium subsp. paratuberculosis
aggaucgcggugaccgccg

SEQ ID NO: 2871097 - RNA, 21 nt, Mycobacterium avium subsp. paratuberculosis
aggaucucccggguggccucc

SEQ ID NO: 2871098 - RNA, 13 nt, Mycobacterium avium subsp. paratuberculosis
aggaucucgcggg

SEQ ID NO: 2871099 - RNA, 17 nt, Mycobacterium avium subsp. paratuberculosis
aggaucucgcgggcccg

SEQ ID NO: 2871100 - RNA, 20 nt, Mycobacterium avium subsp. paratuberculosis
aggaucugcacgucggcggc

SEQ ID NO: 2871101 - RNA, 21 nt, Mycobacterium avium subsp. paratuberculosis
aggaucugcagcacgcccaga

SEQ ID NO: 2871102 - RNA, 19 nt, Mycobacterium avium subsp. paratuberculosis
aggaucugcucggcgucgc

SEQ ID NO: 2871103 - RNA, 18 nt, Mycobacterium avium subsp. paratuberculosis
aggaucugggcggcggga

SEQ ID NO: 2871104 - RNA, 17 nt, Mycobacterium avium subsp. paratuberculosis
aggaucuggugcgcgcg

SEQ ID NO: 2871105 - RNA, 22 nt, Mycobacterium avium subsp. paratuberculosis
aggaucuucggcuuucucgcca

SEQ ID NO: 2871106 - RNA, 13 nt, Mycobacterium avium subsp. paratuberculosis
aggaugaacaccc

SEQ ID NO: 2871107 - RNA, 17 nt, Mycobacterium avium subsp. paratuberculosis
aggaugaacacccgggu

SEQ ID NO: 2871108 - RNA, 14 nt, Mycobacterium avium subsp. paratuberculosis
aggaugaaccggga

SEQ ID NO: 2871109 - RNA, 18 nt, Mycobacterium avium subsp. paratuberculosis
aggaugaccgcccaggac

SEQ ID NO: 2871110 - RNA, 16 nt, Mycobacterium avium subsp. paratuberculosis
aggaugaccgcggcga

SEQ ID NO: 2871111 - RNA, 20 nt, Mycobacterium avium subsp. paratuberculosis
aggaugaccgcgucggcgcc

SEQ ID NO: 2871112 - RNA, 15 nt, Mycobacterium avium subsp. paratuberculosis
aggaugcagccggcc

SEQ ID NO: 2871113 - RNA, 20 nt, Mycobacterium avium subsp. paratuberculosis
aggaugcccaacagcucgcg

SEQ ID NO: 2871114 - RNA, 18 nt, Mycobacterium avium subsp. paratuberculosis
aggaugcccagcaccacu

SEQ ID NO: 2871115 - RNA, 17 nt, Mycobacterium avium subsp. paratuberculosis
aggaugcccaggaugau

SEQ ID NO: 2871116 - RNA, 18 nt, Mycobacterium avium subsp. paratuberculosis
aggaugccgcccaccacc

SEQ ID NO: 2871117 - RNA, 21 nt, Mycobacterium avium subsp. paratuberculosis
aggaugccgcccaccaccggc

SEQ ID NO: 2871118 - RNA, 22 nt, Mycobacterium avium subsp. paratuberculosis
aggaugccgcccaccaccggcu

SEQ ID NO: 2871119 - RNA, 19 nt, Mycobacterium avium subsp. paratuberculosis
aggauggggucgcgggcgc

SEQ ID NO: 2871120 - RNA, 12 nt, Mycobacterium avium subsp. paratuberculosis
aggauggugaaa

SEQ ID NO: 2871121 - RNA, 19 nt, Mycobacterium avium subsp. paratuberculosis
aggaugguggugcaggcga

SEQ ID NO: 2871122 - RNA, 13 nt, Mycobacterium avium subsp. paratuberculosis
aggaugucgacga

SEQ ID NO: 2871123 - RNA, 20 nt, Mycobacterium avium subsp. paratuberculosis
aggaugucggacucgcgccg

SEQ ID NO: 2871124 - RNA, 19 nt, Mycobacterium avium subsp. paratuberculosis
aggauuccgucggcggccg

SEQ ID NO: 2871125 - RNA, 22 nt, Mycobacterium avium subsp. paratuberculosis
aggauucucagcagcgggccga

SEQ ID NO: 2871126 - RNA, 14 nt, Mycobacterium avium subsp. paratuberculosis
aggcaagggcgauc

SEQ ID NO: 2871127 - RNA, 13 nt, Mycobacterium avium subsp. paratuberculosis
aggcaagucgucg

SEQ ID NO: 2871128 - RNA, 18 nt, Mycobacterium avium subsp. paratuberculosis
aggcaaucaggcggucga

SEQ ID NO: 2871129 - RNA, 14 nt, Mycobacterium avium subsp. paratuberculosis
aggcacacgaacac

SEQ ID NO: 2871130 - RNA, 20 nt, Mycobacterium avium subsp. paratuberculosis
aggcacacgaacaccggcgg

SEQ ID NO: 2871131 - RNA, 11 nt, Mycobacterium avium subsp. paratuberculosis
aggcacagcag

SEQ ID NO: 2871132 - RNA, 13 nt, Mycobacterium avium subsp. paratuberculosis
aggcacagcagca

SEQ ID NO: 2871133 - RNA, 23 nt, Mycobacterium avium subsp. paratuberculosis
aggcacccaggaaaaccagcgac

SEQ ID NO: 2871134 - RNA, 18 nt, Mycobacterium avium subsp. paratuberculosis
aggcacccgcugcaccag

SEQ ID NO: 2871135 - RNA, 22 nt, Mycobacterium avium subsp. paratuberculosis
aggcacccgcugcaccagcccg

SEQ ID NO: 2871136 - RNA, 17 nt, Mycobacterium avium subsp. paratuberculosis
aggcaccgaacgccagc

SEQ ID NO: 2871137 - RNA, 23 nt, Mycobacterium avium subsp. paratuberculosis
aggcaccgaacgccagcagcugc

SEQ ID NO: 2871138 - RNA, 21 nt, Mycobacterium avium subsp. paratuberculosis
aggcacucgaucagcaccgcc

SEQ ID NO: 2871139 - RNA, 15 nt, Mycobacterium avium subsp. paratuberculosis
aggcacuggcgcugc

SEQ ID NO: 2871140 - RNA, 22 nt, Mycobacterium avium subsp. paratuberculosis
aggcagaagcuccacgccgccg

SEQ ID NO: 2871141 - RNA, 20 nt, Mycobacterium avium subsp. paratuberculosis
aggcagacccccagcagcgg

SEQ ID NO: 2871142 - RNA, 11 nt, Mycobacterium avium subsp. paratuberculosis
aggcagcagca

SEQ ID NO: 2871143 - RNA, 14 nt, Mycobacterium avium subsp. paratuberculosis
aggcagcccggcug

SEQ ID NO: 2871144 - RNA, 16 nt, Mycobacterium avium subsp. paratuberculosis
aggcagcccggcugcg

SEQ ID NO: 2871145 - RNA, 19 nt, Mycobacterium avium subsp. paratuberculosis
aggcagcgaaucggggucg

SEQ ID NO: 2871146 - RNA, 13 nt, Mycobacterium avium subsp. paratuberculosis
aggcagcgcacga

SEQ ID NO: 2871147 - RNA, 21 nt, Mycobacterium avium subsp. paratuberculosis
aggcagcgcacgaugugaugg

SEQ ID NO: 2871148 - RNA, 16 nt, Mycobacterium avium subsp. paratuberculosis
aggcagcgcgacuggg

SEQ ID NO: 2871149 - RNA, 20 nt, Mycobacterium avium subsp. paratuberculosis
aggcagcgcggauuccagcg

SEQ ID NO: 2871150 - RNA, 13 nt, Mycobacterium avium subsp. paratuberculosis
aggcaggccggca

SEQ ID NO: 2871151 - RNA, 18 nt, Mycobacterium avium subsp. paratuberculosis
aggcaggccggcagccgg

SEQ ID NO: 2871152 - RNA, 19 nt, Mycobacterium avium subsp. paratuberculosis
aggcaggccggcagccggc

SEQ ID NO: 2871153 - RNA, 21 nt, Mycobacterium avium subsp. paratuberculosis
aggcaggccggcagccggcgc

SEQ ID NO: 2871154 - RNA, 22 nt, Mycobacterium avium subsp. paratuberculosis
aggcaggccggcagccggcgcg

SEQ ID NO: 2871155 - RNA, 16 nt, Mycobacterium avium subsp. paratuberculosis
aggcaggcggccaggg

SEQ ID NO: 2871156 - RNA, 21 nt, Mycobacterium avium subsp. paratuberculosis
aggcaggcggccagggcggcg

SEQ ID NO: 2871157 - RNA, 19 nt, Mycobacterium avium subsp. paratuberculosis
aggcaguuccaugucgacg

SEQ ID NO: 2871158 - RNA, 23 nt, Mycobacterium avium subsp. paratuberculosis
aggcaguucgaugccgggcaugg

SEQ ID NO: 2871159 - RNA, 13 nt, Mycobacterium avium subsp. paratuberculosis
aggcauccugcug

SEQ ID NO: 2871160 - RNA, 16 nt, Mycobacterium avium subsp. paratuberculosis
aggcauccugcuggcc

SEQ ID NO: 2871161 - RNA, 21 nt, Mycobacterium avium subsp. paratuberculosis
aggcauccugcuggccgggcu

SEQ ID NO: 2871162 - RNA, 17 nt, Mycobacterium avium subsp. paratuberculosis
aggcaugggaucagcag

SEQ ID NO: 2871163 - RNA, 16 nt, Mycobacterium avium subsp. paratuberculosis
aggcaugggcgugccg

SEQ ID NO: 2871164 - RNA, 22 nt, Mycobacterium avium subsp. paratuberculosis
aggcauuagcgcguguccagaa

SEQ ID NO: 2871165 - RNA, 14 nt, Mycobacterium avium subsp. paratuberculosis
aggcauuccaccgc

SEQ ID NO: 2871166 - RNA, 21 nt, Mycobacterium avium subsp. paratuberculosis
aggcauuccaccgcgcggcgc

SEQ ID NO: 2871167 - RNA, 14 nt, Mycobacterium avium subsp. paratuberculosis
aggcauuccagugc

SEQ ID NO: 2871168 - RNA, 20 nt, Mycobacterium avium subsp. paratuberculosis
aggcauuuccagguccggga

SEQ ID NO: 2871169 - RNA, 12 nt, Mycobacterium avium subsp. paratuberculosis
aggccaacagca

SEQ ID NO: 2871170 - RNA, 15 nt, Mycobacterium avium subsp. paratuberculosis
aggccaacagcagca

SEQ ID NO: 2871171 - RNA, 19 nt, Mycobacterium avium subsp. paratuberculosis
aggccaacgagcgcgccga

SEQ ID NO: 2871172 - RNA, 14 nt, Mycobacterium avium subsp. paratuberculosis
aggccaaggccagc

SEQ ID NO: 2871173 - RNA, 18 nt, Mycobacterium avium subsp. paratuberculosis
aggccacaugggccacgg

SEQ ID NO: 2871174 - RNA, 19 nt, Mycobacterium avium subsp. paratuberculosis
aggccacaugggccacggc

SEQ ID NO: 2871175 - RNA, 20 nt, Mycobacterium avium subsp. paratuberculosis
aggccacaugggccacggcg

SEQ ID NO: 2871176 - RNA, 23 nt, Mycobacterium avium subsp. paratuberculosis
aggccacaugggccacggcgcga

SEQ ID NO: 2871177 - RNA, 16 nt, Mycobacterium avium subsp. paratuberculosis
aggccacccgggcgcc

SEQ ID NO: 2871178 - RNA, 20 nt, Mycobacterium avium subsp. paratuberculosis
aggccacccgggcgccggcg

SEQ ID NO: 2871179 - RNA, 23 nt, Mycobacterium avium subsp. paratuberculosis
aggccacccgggcgccggcgaug

SEQ ID NO: 2871180 - RNA, 13 nt, Mycobacterium avium subsp. paratuberculosis
aggccaccgcgcc

SEQ ID NO: 2871181 - RNA, 23 nt, Mycobacterium avium subsp. paratuberculosis
aggccagcaaccggaauggcagc

SEQ ID NO: 2871182 - RNA, 12 nt, Mycobacterium avium subsp. paratuberculosis
aggccagcaccc

SEQ ID NO: 2871183 - RNA, 23 nt, Mycobacterium avium subsp. paratuberculosis
aggccagcacccggucggugagc

SEQ ID NO: 2871184 - RNA, 12 nt, Mycobacterium avium subsp. paratuberculosis
aggccagcaccu

SEQ ID NO: 2871185 - RNA, 21 nt, Mycobacterium avium subsp. paratuberculosis
aggccagcaccuucagcgggc

SEQ ID NO: 2871186 - RNA, 14 nt, Mycobacterium avium subsp. paratuberculosis
aggccagcacgcag

SEQ ID NO: 2871187 - RNA, 20 nt, Mycobacterium avium subsp. paratuberculosis
aggccagcacgccggucagc

SEQ ID NO: 2871188 - RNA, 19 nt, Mycobacterium avium subsp. paratuberculosis
aggccagcagauacuccuc

SEQ ID NO: 2871189 - RNA, 13 nt, Mycobacterium avium subsp. paratuberculosis
aggccagcagcgc

SEQ ID NO: 2871190 - RNA, 18 nt, Mycobacterium avium subsp. paratuberculosis
aggccagcagcgcggcga

SEQ ID NO: 2871191 - RNA, 16 nt, Mycobacterium avium subsp. paratuberculosis
aggccagcccggcgug

SEQ ID NO: 2871192 - RNA, 21 nt, Mycobacterium avium subsp. paratuberculosis
aggccagcccggcgugcagga

SEQ ID NO: 2871193 - RNA, 17 nt, Mycobacterium avium subsp. paratuberculosis
aggccagcgcgugaucg

SEQ ID NO: 2871194 - RNA, 19 nt, Mycobacterium avium subsp. paratuberculosis
aggccagcucgaccgcggc

SEQ ID NO: 2871195 - RNA, 20 nt, Mycobacterium avium subsp. paratuberculosis
aggccagcucgaccgcggcg

SEQ ID NO: 2871196 - RNA, 21 nt, Mycobacterium avium subsp. paratuberculosis
aggccagcucgaccgcggcga

SEQ ID NO: 2871197 - RNA, 19 nt, Mycobacterium avium subsp. paratuberculosis
aggccagcugcaccggggc

SEQ ID NO: 2871198 - RNA, 20 nt, Mycobacterium avium subsp. paratuberculosis
aggccagcugcaccggggcc

SEQ ID NO: 2871199 - RNA, 21 nt, Mycobacterium avium subsp. paratuberculosis
aggccagcugcaccggggccg

SEQ ID NO: 2871200 - RNA, 22 nt, Mycobacterium avium subsp. paratuberculosis
aggccagcugcaccggggccgg

SEQ ID NO: 2871201 - RNA, 23 nt, Mycobacterium avium subsp. paratuberculosis
aggccagcugcaccggggccggc

SEQ ID NO: 2871202 - RNA, 13 nt, Mycobacterium avium subsp. paratuberculosis
aggccaggaccgg

SEQ ID NO: 2871203 - RNA, 23 nt, Mycobacterium avium subsp. paratuberculosis
aggccaggaccgggacgacggcg

SEQ ID NO: 2871204 - RNA, 10 nt, Mycobacterium avium subsp. paratuberculosis
aggccaggcg

SEQ ID NO: 2871205 - RNA, 18 nt, Mycobacterium avium subsp. paratuberculosis
aggccagggcccgcagcc

SEQ ID NO: 2871206 - RNA, 19 nt, Mycobacterium avium subsp. paratuberculosis
aggccaggugcacgccgag

SEQ ID NO: 2871207 - RNA, 20 nt, Mycobacterium avium subsp. paratuberculosis
aggccaggugcacgccgagc

SEQ ID NO: 2871208 - RNA, 15 nt, Mycobacterium avium subsp. paratuberculosis
aggccaucagcccgg

SEQ ID NO: 2871209 - RNA, 18 nt, Mycobacterium avium subsp. paratuberculosis
aggccaucagcccggcgu

SEQ ID NO: 2871210 - RNA, 17 nt, Mycobacterium avium subsp. paratuberculosis
aggccauggcgcaccgc

SEQ ID NO: 2871211 - RNA, 22 nt, Mycobacterium avium subsp. paratuberculosis
aggcccaacgugaugagcgcgu

SEQ ID NO: 2871212 - RNA, 21 nt, Mycobacterium avium subsp. paratuberculosis
aggcccaccaccacgaggacc

SEQ ID NO: 2871213 - RNA, 17 nt, Mycobacterium avium subsp. paratuberculosis
aggcccacguugagcac

SEQ ID NO: 2871214 - RNA, 18 nt, Mycobacterium avium subsp. paratuberculosis
aggcccacguugagcacg

SEQ ID NO: 2871215 - RNA, 18 nt, Mycobacterium avium subsp. paratuberculosis
aggcccagcagcaccgcg

SEQ ID NO: 2871216 - RNA, 15 nt, Mycobacterium avium subsp. paratuberculosis
aggcccagcagcgca

SEQ ID NO: 2871217 - RNA, 18 nt, Mycobacterium avium subsp. paratuberculosis
aggcccagcccgccgcgu

SEQ ID NO: 2871218 - RNA, 18 nt, Mycobacterium avium subsp. paratuberculosis
aggcccagcccggcccca

SEQ ID NO: 2871219 - RNA, 19 nt, Mycobacterium avium subsp. paratuberculosis
aggcccagcgaggcggcca

SEQ ID NO: 2871220 - RNA, 20 nt, Mycobacterium avium subsp. paratuberculosis
aggcccagcgaggcggccag

SEQ ID NO: 2871221 - RNA, 20 nt, Mycobacterium avium subsp. paratuberculosis
aggcccagcucguugccggc

SEQ ID NO: 2871222 - RNA, 13 nt, Mycobacterium avium subsp. paratuberculosis
aggcccaggcgac

SEQ ID NO: 2871223 - RNA, 15 nt, Mycobacterium avium subsp. paratuberculosis
aggcccaguagcgga

SEQ ID NO: 2871224 - RNA, 18 nt, Mycobacterium avium subsp. paratuberculosis
aggcccaguccugcagcu

SEQ ID NO: 2871225 - RNA, 12 nt, Mycobacterium avium subsp. paratuberculosis
aggcccccggcu

SEQ ID NO: 2871226 - RNA, 21 nt, Mycobacterium avium subsp. paratuberculosis
aggccccgccagauagggcag

SEQ ID NO: 2871227 - RNA, 15 nt, Mycobacterium avium subsp. paratuberculosis
aggccccgcgugacg

SEQ ID NO: 2871228 - RNA, 12 nt, Mycobacterium avium subsp. paratuberculosis
aggccccggcgc

SEQ ID NO: 2871229 - RNA, 19 nt, Mycobacterium avium subsp. paratuberculosis
aggcccgcaagaugugggc

SEQ ID NO: 2871230 - RNA, 14 nt, Mycobacterium avium subsp. paratuberculosis
aggcccgcgccgac

SEQ ID NO: 2871231 - RNA, 18 nt, Mycobacterium avium subsp. paratuberculosis
aggcccggacggccaccu

SEQ ID NO: 2871232 - RNA, 15 nt, Mycobacterium avium subsp. paratuberculosis
aggcccggcaccggu

SEQ ID NO: 2871233 - RNA, 15 nt, Mycobacterium avium subsp. paratuberculosis
aggcccggcagccgg

SEQ ID NO: 2871234 - RNA, 21 nt, Mycobacterium avium subsp. paratuberculosis
aggcccggcgugggccgcagc

SEQ ID NO: 2871235 - RNA, 18 nt, Mycobacterium avium subsp. paratuberculosis
aggcccgggaucgggcgu

SEQ ID NO: 2871236 - RNA, 12 nt, Mycobacterium avium subsp. paratuberculosis
aggcccgggcgg

SEQ ID NO: 2871237 - RNA, 14 nt, Mycobacterium avium subsp. paratuberculosis
aggcccgggcggcg

SEQ ID NO: 2871238 - RNA, 22 nt, Mycobacterium avium subsp. paratuberculosis
aggcccgguagauauggcccuc

SEQ ID NO: 2871239 - RNA, 23 nt, Mycobacterium avium subsp. paratuberculosis
aggcccgguugagugcgccgugc

SEQ ID NO: 2871240 - RNA, 15 nt, Mycobacterium avium subsp. paratuberculosis
aggcccucgccgcgg

SEQ ID NO: 2871241 - RNA, 17 nt, Mycobacterium avium subsp. paratuberculosis
aggcccucgccgcgguc

SEQ ID NO: 2871242 - RNA, 13 nt, Mycobacterium avium subsp. paratuberculosis
aggcccucggcca

SEQ ID NO: 2871243 - RNA, 14 nt, Mycobacterium avium subsp. paratuberculosis
aggcccucggccag

SEQ ID NO: 2871244 - RNA, 15 nt, Mycobacterium avium subsp. paratuberculosis
aggcccucggccagc

SEQ ID NO: 2871245 - RNA, 15 nt, Mycobacterium avium subsp. paratuberculosis
aggcccugcugcagc

SEQ ID NO: 2871246 - RNA, 17 nt, Mycobacterium avium subsp. paratuberculosis
aggccgaacaccgucau

SEQ ID NO: 2871247 - RNA, 16 nt, Mycobacterium avium subsp. paratuberculosis
aggccgaacagcagcg

SEQ ID NO: 2871248 - RNA, 21 nt, Mycobacterium avium subsp. paratuberculosis
aggccgaaccgcagccggauc

SEQ ID NO: 2871249 - RNA, 22 nt, Mycobacterium avium subsp. paratuberculosis
aggccgaaccgcagccggauca

SEQ ID NO: 2871250 - RNA, 22 nt, Mycobacterium avium subsp. paratuberculosis
aggccgacagguagcaggcgcg

SEQ ID NO: 2871251 - RNA, 18 nt, Mycobacterium avium subsp. paratuberculosis
aggccgacgccggccacc

SEQ ID NO: 2871252 - RNA, 14 nt, Mycobacterium avium subsp. paratuberculosis
aggccgacgcuggc

SEQ ID NO: 2871253 - RNA, 13 nt, Mycobacterium avium subsp. paratuberculosis
aggccgagcgcaa

SEQ ID NO: 2871254 - RNA, 22 nt, Mycobacterium avium subsp. paratuberculosis
aggccgagcgcaagggccgaca

SEQ ID NO: 2871255 - RNA, 13 nt, Mycobacterium avium subsp. paratuberculosis
aggccgagcgcgc

SEQ ID NO: 2871256 - RNA, 16 nt, Mycobacterium avium subsp. paratuberculosis
aggccgagcgcgcugg

SEQ ID NO: 2871257 - RNA, 17 nt, Mycobacterium avium subsp. paratuberculosis
aggccgagcgcgcugga

SEQ ID NO: 2871258 - RNA, 16 nt, Mycobacterium avium subsp. paratuberculosis
aggccgaggcgaguga

SEQ ID NO: 2871259 - RNA, 15 nt, Mycobacterium avium subsp. paratuberculosis
aggccgaggcugacg

SEQ ID NO: 2871260 - RNA, 16 nt, Mycobacterium avium subsp. paratuberculosis
aggccgaggcugacga

SEQ ID NO: 2871261 - RNA, 15 nt, Mycobacterium avium subsp. paratuberculosis
aggccgaggcugucg

SEQ ID NO: 2871262 - RNA, 17 nt, Mycobacterium avium subsp. paratuberculosis
aggccgaggucggucgc

SEQ ID NO: 2871263 - RNA, 20 nt, Mycobacterium avium subsp. paratuberculosis
aggccgaugaugaugccgcc

SEQ ID NO: 2871264 - RNA, 22 nt, Mycobacterium avium subsp. paratuberculosis
aggccgaugaugaugccgccca

SEQ ID NO: 2871265 - RNA, 13 nt, Mycobacterium avium subsp. paratuberculosis
aggccgccccggc

SEQ ID NO: 2871266 - RNA, 14 nt, Mycobacterium avium subsp. paratuberculosis
aggccgccccggcc

SEQ ID NO: 2871267 - RNA, 16 nt, Mycobacterium avium subsp. paratuberculosis
aggccgccccggccgc

SEQ ID NO: 2871268 - RNA, 23 nt, Mycobacterium avium subsp. paratuberculosis
aggccgcccgacccguccagcag

SEQ ID NO: 2871269 - RNA, 13 nt, Mycobacterium avium subsp. paratuberculosis
aggccgccgcauu

SEQ ID NO: 2871270 - RNA, 23 nt, Mycobacterium avium subsp. paratuberculosis
aggccgccgcauuccucggccag

SEQ ID NO: 2871271 - RNA, 22 nt, Mycobacterium avium subsp. paratuberculosis
aggccgccgccaccgucgccgg

SEQ ID NO: 2871272 - RNA, 12 nt, Mycobacterium avium subsp. paratuberculosis
aggccgccgcga

SEQ ID NO: 2871273 - RNA, 22 nt, Mycobacterium avium subsp. paratuberculosis
aggccgccgcgaccgucagcag

SEQ ID NO: 2871274 - RNA, 10 nt, Mycobacterium avium subsp. paratuberculosis
aggccgccgg

SEQ ID NO: 2871275 - RNA, 18 nt, Mycobacterium avium subsp. paratuberculosis
aggccgccgggccgccga

SEQ ID NO: 2871276 - RNA, 12 nt, Mycobacterium avium subsp. paratuberculosis
aggccgccucgu

SEQ ID NO: 2871277 - RNA, 13 nt, Mycobacterium avium subsp. paratuberculosis
aggccgcgagcac

SEQ ID NO: 2871278 - RNA, 15 nt, Mycobacterium avium subsp. paratuberculosis
aggccgcgagcacga

SEQ ID NO: 2871279 - RNA, 20 nt, Mycobacterium avium subsp. paratuberculosis
aggccgcgagcacgacgucg

SEQ ID NO: 2871280 - RNA, 21 nt, Mycobacterium avium subsp. paratuberculosis
aggccgcgagcacgacgucga

SEQ ID NO: 2871281 - RNA, 22 nt, Mycobacterium avium subsp. paratuberculosis
aggccgcgagcacgacgucgac

SEQ ID NO: 2871282 - RNA, 12 nt, Mycobacterium avium subsp. paratuberculosis
aggccgcgccga

SEQ ID NO: 2871283 - RNA, 14 nt, Mycobacterium avium subsp. paratuberculosis
aggccgcgccgggc

SEQ ID NO: 2871284 - RNA, 16 nt, Mycobacterium avium subsp. paratuberculosis
aggccgcgccgggcga

SEQ ID NO: 2871285 - RNA, 14 nt, Mycobacterium avium subsp. paratuberculosis
aggccgcgccgugc

SEQ ID NO: 2871286 - RNA, 15 nt, Mycobacterium avium subsp. paratuberculosis
aggccgcgccgugcg

SEQ ID NO: 2871287 - RNA, 20 nt, Mycobacterium avium subsp. paratuberculosis
aggccgcgcgggcggcgucg

SEQ ID NO: 2871288 - RNA, 13 nt, Mycobacterium avium subsp. paratuberculosis
aggccgcgcggug

SEQ ID NO: 2871289 - RNA, 12 nt, Mycobacterium avium subsp. paratuberculosis
aggccgcgcugg

SEQ ID NO: 2871290 - RNA, 13 nt, Mycobacterium avium subsp. paratuberculosis
aggccgcgcuggc

SEQ ID NO: 2871291 - RNA, 15 nt, Mycobacterium avium subsp. paratuberculosis
aggccgcgcuggcca

SEQ ID NO: 2871292 - RNA, 16 nt, Mycobacterium avium subsp. paratuberculosis
aggccgcgcuggccag

SEQ ID NO: 2871293 - RNA, 22 nt, Mycobacterium avium subsp. paratuberculosis
aggccgcgcuggcgcaggcgcu

SEQ ID NO: 2871294 - RNA, 15 nt, Mycobacterium avium subsp. paratuberculosis
aggccgcgcugucca

SEQ ID NO: 2871295 - RNA, 13 nt, Mycobacterium avium subsp. paratuberculosis
aggccgcggcgac

SEQ ID NO: 2871296 - RNA, 19 nt, Mycobacterium avium subsp. paratuberculosis
aggccgcgggcguucauca

SEQ ID NO: 2871297 - RNA, 22 nt, Mycobacterium avium subsp. paratuberculosis
aggccgcgggcguucaucaccu

SEQ ID NO: 2871298 - RNA, 14 nt, Mycobacterium avium subsp. paratuberculosis
aggccgcggucgcc

SEQ ID NO: 2871299 - RNA, 22 nt, Mycobacterium avium subsp. paratuberculosis
aggccgcggucgccccggccgc

SEQ ID NO: 2871300 - RNA, 23 nt, Mycobacterium avium subsp. paratuberculosis
aggccgcggucgccccggccgcg

SEQ ID NO: 2871301 - RNA, 19 nt, Mycobacterium avium subsp. paratuberculosis
aggccgcguagcucgccgc

SEQ ID NO: 2871302 - RNA, 20 nt, Mycobacterium avium subsp. paratuberculosis
aggccgcguagcucgccgcg

SEQ ID NO: 2871303 - RNA, 17 nt, Mycobacterium avium subsp. paratuberculosis
aggccgcugacaagcgc

SEQ ID NO: 2871304 - RNA, 17 nt, Mycobacterium avium subsp. paratuberculosis
aggccgcugcccggcgc

SEQ ID NO: 2871305 - RNA, 18 nt, Mycobacterium avium subsp. paratuberculosis
aggccgcugcccggcgcu

SEQ ID NO: 2871306 - RNA, 23 nt, Mycobacterium avium subsp. paratuberculosis
aggccggaccguucgguccggaa

SEQ ID NO: 2871307 - RNA, 13 nt, Mycobacterium avium subsp. paratuberculosis
aggccggccacca

SEQ ID NO: 2871308 - RNA, 15 nt, Mycobacterium avium subsp. paratuberculosis
aggccggccaccagg

SEQ ID NO: 2871309 - RNA, 14 nt, Mycobacterium avium subsp. paratuberculosis
aggccggccagcgg

SEQ ID NO: 2871310 - RNA, 19 nt, Mycobacterium avium subsp. paratuberculosis
aggccggccagcgggucgu

SEQ ID NO: 2871311 - RNA, 22 nt, Mycobacterium avium subsp. paratuberculosis
aggccggccuugcucgccgcgu

SEQ ID NO: 2871312 - RNA, 14 nt, Mycobacterium avium subsp. paratuberculosis
aggccggcgacgcc

SEQ ID NO: 2871313 - RNA, 22 nt, Mycobacterium avium subsp. paratuberculosis
aggccggcgacgccggcgaggc

SEQ ID NO: 2871314 - RNA, 21 nt, Mycobacterium avium subsp. paratuberculosis
aggccggcgagcucgcggccg

SEQ ID NO: 2871315 - RNA, 22 nt, Mycobacterium avium subsp. paratuberculosis
aggccggcgagcucgcggccgu

SEQ ID NO: 2871316 - RNA, 15 nt, Mycobacterium avium subsp. paratuberculosis
aggccggcgccgcgg

SEQ ID NO: 2871317 - RNA, 17 nt, Mycobacterium avium subsp. paratuberculosis
aggccggcgccgcgggu

SEQ ID NO: 2871318 - RNA, 22 nt, Mycobacterium avium subsp. paratuberculosis
aggccggcgccgggaaaguugu

SEQ ID NO: 2871319 - RNA, 12 nt, Mycobacterium avium subsp. paratuberculosis
aggccggcggug

SEQ ID NO: 2871320 - RNA, 17 nt, Mycobacterium avium subsp. paratuberculosis
aggccggcgguggugcc

SEQ ID NO: 2871321 - RNA, 17 nt, Mycobacterium avium subsp. paratuberculosis
aggccgggauagagcac

SEQ ID NO: 2871322 - RNA, 21 nt, Mycobacterium avium subsp. paratuberculosis
aggccgggauagagcaccgcg

SEQ ID NO: 2871323 - RNA, 22 nt, Mycobacterium avium subsp. paratuberculosis
aggccgggauagagcaccgcgc

SEQ ID NO: 2871324 - RNA, 21 nt, Mycobacterium avium subsp. paratuberculosis
aggccgggcagugcgcggcgu

SEQ ID NO: 2871325 - RNA, 14 nt, Mycobacterium avium subsp. paratuberculosis
aggccgggcuggcg

SEQ ID NO: 2871326 - RNA, 20 nt, Mycobacterium avium subsp. paratuberculosis
aggccgggcuggcgcuggau

SEQ ID NO: 2871327 - RNA, 16 nt, Mycobacterium avium subsp. paratuberculosis
aggccgggcugguccg

SEQ ID NO: 2871328 - RNA, 21 nt, Mycobacterium avium subsp. paratuberculosis
aggccgggcugguccggaacc

SEQ ID NO: 2871329 - RNA, 14 nt, Mycobacterium avium subsp. paratuberculosis
aggccgggguguag

SEQ ID NO: 2871330 - RNA, 23 nt, Mycobacterium avium subsp. paratuberculosis
aggccggucacccaggccgagua

SEQ ID NO: 2871331 - RNA, 17 nt, Mycobacterium avium subsp. paratuberculosis
aggccggucagcgacga

SEQ ID NO: 2871332 - RNA, 17 nt, Mycobacterium avium subsp. paratuberculosis
aggccggugcuguccac

SEQ ID NO: 2871333 - RNA, 14 nt, Mycobacterium avium subsp. paratuberculosis
aggccguagagcac

SEQ ID NO: 2871334 - RNA, 16 nt, Mycobacterium avium subsp. paratuberculosis
aggccguagagcacga

SEQ ID NO: 2871335 - RNA, 13 nt, Mycobacterium avium subsp. paratuberculosis
aggccguccacca

SEQ ID NO: 2871336 - RNA, 15 nt, Mycobacterium avium subsp. paratuberculosis
aggccguccaccaga

SEQ ID NO: 2871337 - RNA, 14 nt, Mycobacterium avium subsp. paratuberculosis
aggccguccagcag

SEQ ID NO: 2871338 - RNA, 15 nt, Mycobacterium avium subsp. paratuberculosis
aggccguccagcagc

SEQ ID NO: 2871339 - RNA, 16 nt, Mycobacterium avium subsp. paratuberculosis
aggccguccagcagca

SEQ ID NO: 2871340 - RNA, 16 nt, Mycobacterium avium subsp. paratuberculosis
aggccgucgaggcgcu

SEQ ID NO: 2871341 - RNA, 20 nt, Mycobacterium avium subsp. paratuberculosis
aggccgucgaggcgcugcag

SEQ ID NO: 2871342 - RNA, 13 nt, Mycobacterium avium subsp. paratuberculosis
aggccgucgccgg

SEQ ID NO: 2871343 - RNA, 14 nt, Mycobacterium avium subsp. paratuberculosis
aggccgucggcgcg

SEQ ID NO: 2871344 - RNA, 17 nt, Mycobacterium avium subsp. paratuberculosis
aggccgucggcgcggcc

SEQ ID NO: 2871345 - RNA, 18 nt, Mycobacterium avium subsp. paratuberculosis
aggccgucggcgcggccg

SEQ ID NO: 2871346 - RNA, 18 nt, Mycobacterium avium subsp. paratuberculosis
aggccgucggggaugccg

SEQ ID NO: 2871347 - RNA, 20 nt, Mycobacterium avium subsp. paratuberculosis
aggccgucucgagccggcgc

SEQ ID NO: 2871348 - RNA, 21 nt, Mycobacterium avium subsp. paratuberculosis
aggccgucucgagccggcgca

SEQ ID NO: 2871349 - RNA, 15 nt, Mycobacterium avium subsp. paratuberculosis
aggccgugaucggcc

SEQ ID NO: 2871350 - RNA, 20 nt, Mycobacterium avium subsp. paratuberculosis
aggccgugaucggccagcca

SEQ ID NO: 2871351 - RNA, 15 nt, Mycobacterium avium subsp. paratuberculosis
aggccgugguuggcg

SEQ ID NO: 2871352 - RNA, 18 nt, Mycobacterium avium subsp. paratuberculosis
aggccguuguggccaccc

SEQ ID NO: 2871353 - RNA, 16 nt, Mycobacterium avium subsp. paratuberculosis
aggccucccacagcgg

SEQ ID NO: 2871354 - RNA, 21 nt, Mycobacterium avium subsp. paratuberculosis
aggccucguggaacaccgcgc

SEQ ID NO: 2871355 - RNA, 16 nt, Mycobacterium avium subsp. paratuberculosis
aggccugcgccuuggc

SEQ ID NO: 2871356 - RNA, 22 nt, Mycobacterium avium subsp. paratuberculosis
aggccugcgccuuggccucggu

SEQ ID NO: 2871357 - RNA, 14 nt, Mycobacterium avium subsp. paratuberculosis
aggccugcgcggcc

SEQ ID NO: 2871358 - RNA, 15 nt, Mycobacterium avium subsp. paratuberculosis
aggccugcgcggccg

SEQ ID NO: 2871359 - RNA, 22 nt, Mycobacterium avium subsp. paratuberculosis
aggccugcgcggccgcgucggc

SEQ ID NO: 2871360 - RNA, 15 nt, Mycobacterium avium subsp. paratuberculosis
aggccuggaaccggg

SEQ ID NO: 2871361 - RNA, 18 nt, Mycobacterium avium subsp. paratuberculosis
aggccuggaugccgcccu

SEQ ID NO: 2871362 - RNA, 20 nt, Mycobacterium avium subsp. paratuberculosis
aggccuuccgcaacaucguc

SEQ ID NO: 2871363 - RNA, 13 nt, Mycobacterium avium subsp. paratuberculosis
aggccuuggugau

SEQ ID NO: 2871364 - RNA, 23 nt, Mycobacterium avium subsp. paratuberculosis
aggccuuggugaugggcagcgcc

SEQ ID NO: 2871365 - RNA, 17 nt, Mycobacterium avium subsp. paratuberculosis
aggcgaaauaacccacc

SEQ ID NO: 2871366 - RNA, 19 nt, Mycobacterium avium subsp. paratuberculosis
aggcgaacaccagcccggc

SEQ ID NO: 2871367 - RNA, 22 nt, Mycobacterium avium subsp. paratuberculosis
aggcgaacaccucggugaucuc

SEQ ID NO: 2871368 - RNA, 17 nt, Mycobacterium avium subsp. paratuberculosis
aggcgaacauggcggcc

SEQ ID NO: 2871369 - RNA, 22 nt, Mycobacterium avium subsp. paratuberculosis
aggcgaacauggcggccagccg

SEQ ID NO: 2871370 - RNA, 14 nt, Mycobacterium avium subsp. paratuberculosis
aggcgaaucggcgc

SEQ ID NO: 2871371 - RNA, 19 nt, Mycobacterium avium subsp. paratuberculosis
aggcgaaucggcgcacagc

SEQ ID NO: 2871372 - RNA, 13 nt, Mycobacterium avium subsp. paratuberculosis
aggcgaaugcggc

SEQ ID NO: 2871373 - RNA, 17 nt, Mycobacterium avium subsp. paratuberculosis
aggcgaaugcggccaug

SEQ ID NO: 2871374 - RNA, 18 nt, Mycobacterium avium subsp. paratuberculosis
aggcgaaugcggccaugu

SEQ ID NO: 2871375 - RNA, 15 nt, Mycobacterium avium subsp. paratuberculosis
aggcgaccaugccca

SEQ ID NO: 2871376 - RNA, 16 nt, Mycobacterium avium subsp. paratuberculosis
aggcgaccaugcccag

SEQ ID NO: 2871377 - RNA, 17 nt, Mycobacterium avium subsp. paratuberculosis
aggcgaccaugcccagc

SEQ ID NO: 2871378 - RNA, 18 nt, Mycobacterium avium subsp. paratuberculosis
aggcgaccaugcccagca

SEQ ID NO: 2871379 - RNA, 20 nt, Mycobacterium avium subsp. paratuberculosis
aggcgaccaugcccagcagu

SEQ ID NO: 2871380 - RNA, 13 nt, Mycobacterium avium subsp. paratuberculosis
aggcgacccccgg

SEQ ID NO: 2871381 - RNA, 15 nt, Mycobacterium avium subsp. paratuberculosis
aggcgaccggcccca

SEQ ID NO: 2871382 - RNA, 17 nt, Mycobacterium avium subsp. paratuberculosis
aggcgaccggccccaac

SEQ ID NO: 2871383 - RNA, 13 nt, Mycobacterium avium subsp. paratuberculosis
aggcgaccucgua

SEQ ID NO: 2871384 - RNA, 18 nt, Mycobacterium avium subsp. paratuberculosis
aggcgacgaaaaugccca

SEQ ID NO: 2871385 - RNA, 22 nt, Mycobacterium avium subsp. paratuberculosis
aggcgacgaaaaugcccagugu

SEQ ID NO: 2871386 - RNA, 15 nt, Mycobacterium avium subsp. paratuberculosis
aggcgacgucggucg

SEQ ID NO: 2871387 - RNA, 21 nt, Mycobacterium avium subsp. paratuberculosis
aggcgacgucggucggcagga

SEQ ID NO: 2871388 - RNA, 13 nt, Mycobacterium avium subsp. paratuberculosis
aggcgagcacccg

SEQ ID NO: 2871389 - RNA, 15 nt, Mycobacterium avium subsp. paratuberculosis
aggcgagcacggcac

SEQ ID NO: 2871390 - RNA, 18 nt, Mycobacterium avium subsp. paratuberculosis
aggcgagcacggcacgcc

SEQ ID NO: 2871391 - RNA, 19 nt, Mycobacterium avium subsp. paratuberculosis
aggcgagugaggacgaggc

SEQ ID NO: 2871392 - RNA, 15 nt, Mycobacterium avium subsp. paratuberculosis
aggcgaucagcgcgc

SEQ ID NO: 2871393 - RNA, 22 nt, Mycobacterium avium subsp. paratuberculosis
aggcgaucagcgcgcacagcgc

SEQ ID NO: 2871394 - RNA, 18 nt, Mycobacterium avium subsp. paratuberculosis
aggcgaucaucgccccgg

SEQ ID NO: 2871395 - RNA, 17 nt, Mycobacterium avium subsp. paratuberculosis
aggcgaucgggaacagc

SEQ ID NO: 2871396 - RNA, 21 nt, Mycobacterium avium subsp. paratuberculosis
aggcgaucgggaacagcccgc

SEQ ID NO: 2871397 - RNA, 16 nt, Mycobacterium avium subsp. paratuberculosis
aggcgaugaagccggc

SEQ ID NO: 2871398 - RNA, 14 nt, Mycobacterium avium subsp. paratuberculosis
aggcgaugccgccg

SEQ ID NO: 2871399 - RNA, 23 nt, Mycobacterium avium subsp. paratuberculosis
aggcgaugccgccgacgaugucg

SEQ ID NO: 2871400 - RNA, 14 nt, Mycobacterium avium subsp. paratuberculosis
aggcgauggcgucg

SEQ ID NO: 2871401 - RNA, 17 nt, Mycobacterium avium subsp. paratuberculosis
aggcgauggcgucggcc

SEQ ID NO: 2871402 - RNA, 22 nt, Mycobacterium avium subsp. paratuberculosis
aggcgauggcgucggccagcgg

SEQ ID NO: 2871403 - RNA, 13 nt, Mycobacterium avium subsp. paratuberculosis
aggcgauggugcc

SEQ ID NO: 2871404 - RNA, 18 nt, Mycobacterium avium subsp. paratuberculosis
aggcgauggugcccucgu

SEQ ID NO: 2871405 - RNA, 16 nt, Mycobacterium avium subsp. paratuberculosis
aggcgauggugccggc

SEQ ID NO: 2871406 - RNA, 17 nt, Mycobacterium avium subsp. paratuberculosis
aggcgauggugccggcc

SEQ ID NO: 2871407 - RNA, 14 nt, Mycobacterium avium subsp. paratuberculosis
aggcgcaacaccgg

SEQ ID NO: 2871408 - RNA, 20 nt, Mycobacterium avium subsp. paratuberculosis
aggcgcaacagcaccucguc

SEQ ID NO: 2871409 - RNA, 17 nt, Mycobacterium avium subsp. paratuberculosis
aggcgcacaacgaggcc

SEQ ID NO: 2871410 - RNA, 15 nt, Mycobacterium avium subsp. paratuberculosis
aggcgcaccaccagc

SEQ ID NO: 2871411 - RNA, 20 nt, Mycobacterium avium subsp. paratuberculosis
aggcgcaccaccagcucguc

SEQ ID NO: 2871412 - RNA, 14 nt, Mycobacterium avium subsp. paratuberculosis
aggcgcaccagcug

SEQ ID NO: 2871413 - RNA, 13 nt, Mycobacterium avium subsp. paratuberculosis
aggcgcaccgcca

SEQ ID NO: 2871414 - RNA, 17 nt, Mycobacterium avium subsp. paratuberculosis
aggcgcaccgccaccgc

SEQ ID NO: 2871415 - RNA, 18 nt, Mycobacterium avium subsp. paratuberculosis
aggcgcaccgccaccgcg

SEQ ID NO: 2871416 - RNA, 17 nt, Mycobacterium avium subsp. paratuberculosis
aggcgcaccgccgggca

SEQ ID NO: 2871417 - RNA, 21 nt, Mycobacterium avium subsp. paratuberculosis
aggcgcagaagcuaacgccag

SEQ ID NO: 2871418 - RNA, 22 nt, Mycobacterium avium subsp. paratuberculosis
aggcgcagaagcuaacgccagc

SEQ ID NO: 2871419 - RNA, 14 nt, Mycobacterium avium subsp. paratuberculosis
aggcgcagccagcg

SEQ ID NO: 2871420 - RNA, 14 nt, Mycobacterium avium subsp. paratuberculosis
aggcgcagcccgag

SEQ ID NO: 2871421 - RNA, 20 nt, Mycobacterium avium subsp. paratuberculosis
aggcgcagcccgagcggcau

SEQ ID NO: 2871422 - RNA, 17 nt, Mycobacterium avium subsp. paratuberculosis
aggcgcaguagccgacg

SEQ ID NO: 2871423 - RNA, 18 nt, Mycobacterium avium subsp. paratuberculosis
aggcgcaguagccgacgu

SEQ ID NO: 2871424 - RNA, 19 nt, Mycobacterium avium subsp. paratuberculosis
aggcgcaguagccgacgug

SEQ ID NO: 2871425 - RNA, 24 nt, Mycobacterium avium subsp. paratuberculosis
aggcgccacaacuggucgugcucg

SEQ ID NO: 2871426 - RNA, 15 nt, Mycobacterium avium subsp. paratuberculosis
aggcgccacagcagc

SEQ ID NO: 2871427 - RNA, 16 nt, Mycobacterium avium subsp. paratuberculosis
aggcgccacagcagca

SEQ ID NO: 2871428 - RNA, 19 nt, Mycobacterium avium subsp. paratuberculosis
aggcgccauugucggaucg

SEQ ID NO: 2871429 - RNA, 17 nt, Mycobacterium avium subsp. paratuberculosis
aggcgcccagcacccgg

SEQ ID NO: 2871430 - RNA, 18 nt, Mycobacterium avium subsp. paratuberculosis
aggcgcccugcacgaaca

SEQ ID NO: 2871431 - RNA, 14 nt, Mycobacterium avium subsp. paratuberculosis
aggcgccgaugccc

SEQ ID NO: 2871432 - RNA, 21 nt, Mycobacterium avium subsp. paratuberculosis
aggcgccgaugcccgccccgg

SEQ ID NO: 2871433 - RNA, 12 nt, Mycobacterium avium subsp. paratuberculosis
aggcgccgccgc

SEQ ID NO: 2871434 - RNA, 21 nt, Mycobacterium avium subsp. paratuberculosis
aggcgccgccgcgcaggccgc

SEQ ID NO: 2871435 - RNA, 17 nt, Mycobacterium avium subsp. paratuberculosis
aggcgccggccagcacg

SEQ ID NO: 2871436 - RNA, 22 nt, Mycobacterium avium subsp. paratuberculosis
aggcgccggguuguagcaggcg

SEQ ID NO: 2871437 - RNA, 20 nt, Mycobacterium avium subsp. paratuberculosis
aggcgccguauuggcaggcg

SEQ ID NO: 2871438 - RNA, 21 nt, Mycobacterium avium subsp. paratuberculosis
aggcgccguauuggcaggcga

SEQ ID NO: 2871439 - RNA, 14 nt, Mycobacterium avium subsp. paratuberculosis
aggcgccgucgaug

SEQ ID NO: 2871440 - RNA, 18 nt, Mycobacterium avium subsp. paratuberculosis
aggcgccgucgguggggg

SEQ ID NO: 2871441 - RNA, 14 nt, Mycobacterium avium subsp. paratuberculosis
aggcgcgaaagcgc

SEQ ID NO: 2871442 - RNA, 16 nt, Mycobacterium avium subsp. paratuberculosis
aggcgcgaaagcgcga

SEQ ID NO: 2871443 - RNA, 18 nt, Mycobacterium avium subsp. paratuberculosis
aggcgcgcagcaggcgcc

SEQ ID NO: 2871444 - RNA, 14 nt, Mycobacterium avium subsp. paratuberculosis
aggcgcgcagggcg

SEQ ID NO: 2871445 - RNA, 21 nt, Mycobacterium avium subsp. paratuberculosis
aggcgcgcgcuggugcgggcc

SEQ ID NO: 2871446 - RNA, 12 nt, Mycobacterium avium subsp. paratuberculosis
aggcgcgcggcc

SEQ ID NO: 2871447 - RNA, 19 nt, Mycobacterium avium subsp. paratuberculosis
aggcgcgcggccagccccg

SEQ ID NO: 2871448 - RNA, 21 nt, Mycobacterium avium subsp. paratuberculosis
aggcgcgcggccagccccggg

SEQ ID NO: 2871449 - RNA, 20 nt, Mycobacterium avium subsp. paratuberculosis
aggcgcgcuaacggcgcggc

SEQ ID NO: 2871450 - RNA, 13 nt, Mycobacterium avium subsp. paratuberculosis
aggcgcggcgcga

SEQ ID NO: 2871451 - RNA, 17 nt, Mycobacterium avium subsp. paratuberculosis
aggcgcggcgcgaggcg

SEQ ID NO: 2871452 - RNA, 14 nt, Mycobacterium avium subsp. paratuberculosis
aggcgcgggcgucc

SEQ ID NO: 2871453 - RNA, 13 nt, Mycobacterium avium subsp. paratuberculosis
aggcgcucgucga

SEQ ID NO: 2871454 - RNA, 13 nt, Mycobacterium avium subsp. paratuberculosis
aggcgcugggugc

SEQ ID NO: 2871455 - RNA, 18 nt, Mycobacterium avium subsp. paratuberculosis
aggcgcugggugcgggcu

SEQ ID NO: 2871456 - RNA, 19 nt, Mycobacterium avium subsp. paratuberculosis
aggcgcugggugcgggcug

SEQ ID NO: 2871457 - RNA, 17 nt, Mycobacterium avium subsp. paratuberculosis
aggcggaccugggugcg

SEQ ID NO: 2871458 - RNA, 15 nt, Mycobacterium avium subsp. paratuberculosis
aggcggacggcgacc

SEQ ID NO: 2871459 - RNA, 13 nt, Mycobacterium avium subsp. paratuberculosis
aggcggccaccgc

SEQ ID NO: 2871460 - RNA, 14 nt, Mycobacterium avium subsp. paratuberculosis
aggcggccaccgcg

SEQ ID NO: 2871461 - RNA, 16 nt, Mycobacterium avium subsp. paratuberculosis
aggcggccaccgcggc

SEQ ID NO: 2871462 - RNA, 20 nt, Mycobacterium avium subsp. paratuberculosis
aggcggccaccgcggccagc

SEQ ID NO: 2871463 - RNA, 12 nt, Mycobacterium avium subsp. paratuberculosis
aggcggccagca

SEQ ID NO: 2871464 - RNA, 14 nt, Mycobacterium avium subsp. paratuberculosis
aggcggccagcacc

SEQ ID NO: 2871465 - RNA, 17 nt, Mycobacterium avium subsp. paratuberculosis
aggcggccagcaccagu

SEQ ID NO: 2871466 - RNA, 14 nt, Mycobacterium avium subsp. paratuberculosis
aggcggccagcagc

SEQ ID NO: 2871467 - RNA, 15 nt, Mycobacterium avium subsp. paratuberculosis
aggcggccagcagca

SEQ ID NO: 2871468 - RNA, 15 nt, Mycobacterium avium subsp. paratuberculosis
aggcggccagcgccc

SEQ ID NO: 2871469 - RNA, 17 nt, Mycobacterium avium subsp. paratuberculosis
aggcggccagcgcccgc

SEQ ID NO: 2871470 - RNA, 22 nt, Mycobacterium avium subsp. paratuberculosis
aggcggccagcgcccgcgggug

SEQ ID NO: 2871471 - RNA, 19 nt, Mycobacterium avium subsp. paratuberculosis
aggcggccagggcggcgcc

SEQ ID NO: 2871472 - RNA, 22 nt, Mycobacterium avium subsp. paratuberculosis
aggcggccagggcggcgccggc

SEQ ID NO: 2871473 - RNA, 21 nt, Mycobacterium avium subsp. paratuberculosis
aggcggccauauagggguggg

SEQ ID NO: 2871474 - RNA, 12 nt, Mycobacterium avium subsp. paratuberculosis
aggcggccggcc

SEQ ID NO: 2871475 - RNA, 16 nt, Mycobacterium avium subsp. paratuberculosis
aggcggccggcccggc

SEQ ID NO: 2871476 - RNA, 12 nt, Mycobacterium avium subsp. paratuberculosis
aggcggccggga

SEQ ID NO: 2871477 - RNA, 12 nt, Mycobacterium avium subsp. paratuberculosis
aggcggccgggc

SEQ ID NO: 2871478 - RNA, 16 nt, Mycobacterium avium subsp. paratuberculosis
aggcggcgaccgcgac

SEQ ID NO: 2871479 - RNA, 23 nt, Mycobacterium avium subsp. paratuberculosis
aggcggcgacgaacgccggcauc

SEQ ID NO: 2871480 - RNA, 13 nt, Mycobacterium avium subsp. paratuberculosis
aggcggcgacggc

SEQ ID NO: 2871481 - RNA, 19 nt, Mycobacterium avium subsp. paratuberculosis
aggcggcgacggccguccg

SEQ ID NO: 2871482 - RNA, 19 nt, Mycobacterium avium subsp. paratuberculosis
aggcggcgacggcgucggc

SEQ ID NO: 2871483 - RNA, 22 nt, Mycobacterium avium subsp. paratuberculosis
aggcggcgagauuggccucggc

SEQ ID NO: 2871484 - RNA, 18 nt, Mycobacterium avium subsp. paratuberculosis
aggcggcgagcugaucgg

SEQ ID NO: 2871485 - RNA, 21 nt, Mycobacterium avium subsp. paratuberculosis
aggcggcgcagccagcgccgc

SEQ ID NO: 2871486 - RNA, 14 nt, Mycobacterium avium subsp. paratuberculosis
aggcggcgccggcc

SEQ ID NO: 2871487 - RNA, 19 nt, Mycobacterium avium subsp. paratuberculosis
aggcggcgccggccgggcu

SEQ ID NO: 2871488 - RNA, 15 nt, Mycobacterium avium subsp. paratuberculosis
aggcggcgccgucga

SEQ ID NO: 2871489 - RNA, 18 nt, Mycobacterium avium subsp. paratuberculosis
aggcggcgccgucgacca

SEQ ID NO: 2871490 - RNA, 22 nt, Mycobacterium avium subsp. paratuberculosis
aggcggcgccgucgaccagcuu

SEQ ID NO: 2871491 - RNA, 16 nt, Mycobacterium avium subsp. paratuberculosis
aggcggcggcgggcca

SEQ ID NO: 2871492 - RNA, 19 nt, Mycobacterium avium subsp. paratuberculosis
aggcggcggcgggccaggg

SEQ ID NO: 2871493 - RNA, 15 nt, Mycobacterium avium subsp. paratuberculosis
aggcggcgucgagca

SEQ ID NO: 2871494 - RNA, 23 nt, Mycobacterium avium subsp. paratuberculosis
aggcggcgugccagggcagcgcg

SEQ ID NO: 2871495 - RNA, 15 nt, Mycobacterium avium subsp. paratuberculosis
aggcgggcacacgcg

SEQ ID NO: 2871496 - RNA, 22 nt, Mycobacterium avium subsp. paratuberculosis
aggcgggccagcucgaacaccg

SEQ ID NO: 2871497 - RNA, 22 nt, Mycobacterium avium subsp. paratuberculosis
aggcgggcgaucucgauguaga

SEQ ID NO: 2871498 - RNA, 17 nt, Mycobacterium avium subsp. paratuberculosis
aggcggguaggcgucgc

SEQ ID NO: 2871499 - RNA, 13 nt, Mycobacterium avium subsp. paratuberculosis
aggcgggugagga

SEQ ID NO: 2871500 - RNA, 21 nt, Mycobacterium avium subsp. paratuberculosis
aggcggguguauucgcccacc

SEQ ID NO: 2871501 - RNA, 13 nt, Mycobacterium avium subsp. paratuberculosis
aggcggucgaacg

SEQ ID NO: 2871502 - RNA, 23 nt, Mycobacterium avium subsp. paratuberculosis
aggcggucgugucagggaugccc

SEQ ID NO: 2871503 - RNA, 15 nt, Mycobacterium avium subsp. paratuberculosis
aggcggugguggggu

SEQ ID NO: 2871504 - RNA, 17 nt, Mycobacterium avium subsp. paratuberculosis
aggcgguuccgguggcg

SEQ ID NO: 2871505 - RNA, 14 nt, Mycobacterium avium subsp. paratuberculosis
aggcguacaccagg

SEQ ID NO: 2871506 - RNA, 23 nt, Mycobacterium avium subsp. paratuberculosis
aggcguacaccagggugccgccg

SEQ ID NO: 2871507 - RNA, 17 nt, Mycobacterium avium subsp. paratuberculosis
aggcguagugcgcccag

SEQ ID NO: 2871508 - RNA, 12 nt, Mycobacterium avium subsp. paratuberculosis
aggcgucagggg

SEQ ID NO: 2871509 - RNA, 20 nt, Mycobacterium avium subsp. paratuberculosis
aggcgucaucguggacagga

SEQ ID NO: 2871510 - RNA, 21 nt, Mycobacterium avium subsp. paratuberculosis
aggcgucaucguggacaggag

SEQ ID NO: 2871511 - RNA, 13 nt, Mycobacterium avium subsp. paratuberculosis
aggcguccagcac

SEQ ID NO: 2871512 - RNA, 15 nt, Mycobacterium avium subsp. paratuberculosis
aggcguccagccagc

SEQ ID NO: 2871513 - RNA, 17 nt, Mycobacterium avium subsp. paratuberculosis
agcgggcggccccgggc

SEQ ID NO: 2871514 - RNA, 21 nt, Mycobacterium avium subsp. paratuberculosis
agcgggcggcgaacaccagca

SEQ ID NO: 2871515 - RNA, 14 nt, Mycobacterium avium subsp. paratuberculosis
agcgggcggcggug

SEQ ID NO: 2871516 - RNA, 20 nt, Mycobacterium avium subsp. paratuberculosis
agcgggcuaggcucggcagc

SEQ ID NO: 2871517 - RNA, 17 nt, Mycobacterium avium subsp. paratuberculosis
agcgggcugugccggcg

SEQ ID NO: 2871518 - RNA, 22 nt, Mycobacterium avium subsp. paratuberculosis
agcggggaggcccagcccgccg

SEQ ID NO: 2871519 - RNA, 23 nt, Mycobacterium avium subsp. paratuberculosis
agcggggcgaacccggcgcccgg

SEQ ID NO: 2871520 - RNA, 16 nt, Mycobacterium avium subsp. paratuberculosis
agcggggcgcgcaggc

SEQ ID NO: 2871521 - RNA, 23 nt, Mycobacterium avium subsp. paratuberculosis
agcggggcgcgcaggcgcaccac

SEQ ID NO: 2871522 - RNA, 14 nt, Mycobacterium avium subsp. paratuberculosis
agcggggugagcac

SEQ ID NO: 2871523 - RNA, 15 nt, Mycobacterium avium subsp. paratuberculosis
agcggggugcccacc

SEQ ID NO: 2871524 - RNA, 13 nt, Mycobacterium avium subsp. paratuberculosis
agcggggugugcu

SEQ ID NO: 2871525 - RNA, 17 nt, Mycobacterium avium subsp. paratuberculosis
agcggggugugcucggc

SEQ ID NO: 2871526 - RNA, 20 nt, Mycobacterium avium subsp. paratuberculosis
agcggggugugcucggcggc

SEQ ID NO: 2871527 - RNA, 21 nt, Mycobacterium avium subsp. paratuberculosis
agcggggugugcucggcggcg

SEQ ID NO: 2871528 - RNA, 20 nt, Mycobacterium avium subsp. paratuberculosis
agcgggguguucaccgcgcc

SEQ ID NO: 2871529 - RNA, 21 nt, Mycobacterium avium subsp. paratuberculosis
agcgggguguucaccgcgccg

SEQ ID NO: 2871530 - RNA, 23 nt, Mycobacterium avium subsp. paratuberculosis
agcgggguguucaccgcgccggg

SEQ ID NO: 2871531 - RNA, 22 nt, Mycobacterium avium subsp. paratuberculosis
agcgggguuuuugauugcgcgg

SEQ ID NO: 2871532 - RNA, 16 nt, Mycobacterium avium subsp. paratuberculosis
agcgggucagcuccac

SEQ ID NO: 2871533 - RNA, 16 nt, Mycobacterium avium subsp. paratuberculosis
agcggguccagccgcc

SEQ ID NO: 2871534 - RNA, 17 nt, Mycobacterium avium subsp. paratuberculosis
agcggguccgccccgag

SEQ ID NO: 2871535 - RNA, 15 nt, Mycobacterium avium subsp. paratuberculosis
agcgggucggccggc

SEQ ID NO: 2871536 - RNA, 16 nt, Mycobacterium avium subsp. paratuberculosis
agcgggucgucgggcc

SEQ ID NO: 2871537 - RNA, 21 nt, Mycobacterium avium subsp. paratuberculosis
agcgggucgucgggccgggga

SEQ ID NO: 2871538 - RNA, 18 nt, Mycobacterium avium subsp. paratuberculosis
agcgggucgugcaucggc

SEQ ID NO: 2871539 - RNA, 17 nt, Mycobacterium avium subsp. paratuberculosis
agcgggugaaucgacac

SEQ ID NO: 2871540 - RNA, 19 nt, Mycobacterium avium subsp. paratuberculosis
agcgggugaaucgacaccg

SEQ ID NO: 2871541 - RNA, 24 nt, Mycobacterium avium subsp. paratuberculosis
agcgggugaaucgacaccgcacgg

SEQ ID NO: 2871542 - RNA, 18 nt, Mycobacterium avium subsp. paratuberculosis
agcgggugauggccgccg

SEQ ID NO: 2871543 - RNA, 19 nt, Mycobacterium avium subsp. paratuberculosis
agcgggugauggccgccgc

SEQ ID NO: 2871544 - RNA, 21 nt, Mycobacterium avium subsp. paratuberculosis
agcggguucuucagggcggug

SEQ ID NO: 2871545 - RNA, 22 nt, Mycobacterium avium subsp. paratuberculosis
agcggguugcgguccccggaga

SEQ ID NO: 2871546 - RNA, 20 nt, Mycobacterium avium subsp. paratuberculosis
agcggguuguucuccagcgg

SEQ ID NO: 2871547 - RNA, 18 nt, Mycobacterium avium subsp. paratuberculosis
agcggucacggacaggug

SEQ ID NO: 2871548 - RNA, 18 nt, Mycobacterium avium subsp. paratuberculosis
agcgguccagcgugaacg

SEQ ID NO: 2871549 - RNA, 19 nt, Mycobacterium avium subsp. paratuberculosis
agcgguccauccagcgccg

SEQ ID NO: 2871550 - RNA, 20 nt, Mycobacterium avium subsp. paratuberculosis
agcgguccauccagcgccgc

SEQ ID NO: 2871551 - RNA, 21 nt, Mycobacterium avium subsp. paratuberculosis
agcgguccucgaaccgcuugc

SEQ ID NO: 2871552 - RNA, 14 nt, Mycobacterium avium subsp. paratuberculosis
agcggucgccccag

SEQ ID NO: 2871553 - RNA, 22 nt, Mycobacterium avium subsp. paratuberculosis
agcggucgccccagaacugguc

SEQ ID NO: 2871554 - RNA, 14 nt, Mycobacterium avium subsp. paratuberculosis
agcggucgcggaac

SEQ ID NO: 2871555 - RNA, 17 nt, Mycobacterium avium subsp. paratuberculosis
agcggucgcggaaccgg

SEQ ID NO: 2871556 - RNA, 19 nt, Mycobacterium avium subsp. paratuberculosis
agcggucgcggaaccggcc

SEQ ID NO: 2871557 - RNA, 20 nt, Mycobacterium avium subsp. paratuberculosis
agcggucgcggaaccggccg

SEQ ID NO: 2871558 - RNA, 23 nt, Mycobacterium avium subsp. paratuberculosis
agcggucgcggaaccggccgggg

SEQ ID NO: 2871559 - RNA, 16 nt, Mycobacterium avium subsp. paratuberculosis
agcggucggcggcuga

SEQ ID NO: 2871560 - RNA, 14 nt, Mycobacterium avium subsp. paratuberculosis
agcggucggcgguu

SEQ ID NO: 2871561 - RNA, 20 nt, Mycobacterium avium subsp. paratuberculosis
agcggucgggaucggugaag

SEQ ID NO: 2871562 - RNA, 15 nt, Mycobacterium avium subsp. paratuberculosis
agcggucgugcggga

SEQ ID NO: 2871563 - RNA, 17 nt, Mycobacterium avium subsp. paratuberculosis
agcggugaaacgccugc

SEQ ID NO: 2871564 - RNA, 14 nt, Mycobacterium avium subsp. paratuberculosis
agcggugacaucgc

SEQ ID NO: 2871565 - RNA, 16 nt, Mycobacterium avium subsp. paratuberculosis
agcggugacaucgcca

SEQ ID NO: 2871566 - RNA, 21 nt, Mycobacterium avium subsp. paratuberculosis
agcggugacaucgccaccugg

SEQ ID NO: 2871567 - RNA, 17 nt, Mycobacterium avium subsp. paratuberculosis
agcggugaccucgagca

SEQ ID NO: 2871568 - RNA, 23 nt, Mycobacterium avium subsp. paratuberculosis
agcggugaucgcgucaaccaccg

SEQ ID NO: 2871569 - RNA, 16 nt, Mycobacterium avium subsp. paratuberculosis
agcggugcaccaccgu

SEQ ID NO: 2871570 - RNA, 16 nt, Mycobacterium avium subsp. paratuberculosis
agcggugcagccccgc

SEQ ID NO: 2871571 - RNA, 18 nt, Mycobacterium avium subsp. paratuberculosis
agcggugcagccccgcac

SEQ ID NO: 2871572 - RNA, 14 nt, Mycobacterium avium subsp. paratuberculosis
agcggugccgcccg

SEQ ID NO: 2871573 - RNA, 14 nt, Mycobacterium avium subsp. paratuberculosis
agcgguggccacgc

SEQ ID NO: 2871574 - RNA, 20 nt, Mycobacterium avium subsp. paratuberculosis
agcggugucaccgacgccag

SEQ ID NO: 2871575 - RNA, 21 nt, Mycobacterium avium subsp. paratuberculosis
agcggugucaccgacgccagc

SEQ ID NO: 2871576 - RNA, 23 nt, Mycobacterium avium subsp. paratuberculosis
agcgguuccagaccggcggcgau

SEQ ID NO: 2871577 - RNA, 21 nt, Mycobacterium avium subsp. paratuberculosis
agcgguucgaucucgucgggu

SEQ ID NO: 2871578 - RNA, 22 nt, Mycobacterium avium subsp. paratuberculosis
agcgguucggcgacgcuggugg

SEQ ID NO: 2871579 - RNA, 17 nt, Mycobacterium avium subsp. paratuberculosis
agcgguuggcgacgcug

SEQ ID NO: 2871580 - RNA, 17 nt, Mycobacterium avium subsp. paratuberculosis
agcgguuuggauggccc

SEQ ID NO: 2871581 - RNA, 12 nt, Mycobacterium avium subsp. paratuberculosis
agcguacccagg

SEQ ID NO: 2871582 - RNA, 20 nt, Mycobacterium avium subsp. paratuberculosis
agcguacccaggucggcgug

SEQ ID NO: 2871583 - RNA, 21 nt, Mycobacterium avium subsp. paratuberculosis
agcguauccggccagccgggg

SEQ ID NO: 2871584 - RNA, 15 nt, Mycobacterium avium subsp. paratuberculosis
agcguaugccggugg

SEQ ID NO: 2871585 - RNA, 17 nt, Mycobacterium avium subsp. paratuberculosis
agcguaugccgguggcg

SEQ ID NO: 2871586 - RNA, 21 nt, Mycobacterium avium subsp. paratuberculosis
agcguaugccgguggcguccu

SEQ ID NO: 2871587 - RNA, 19 nt, Mycobacterium avium subsp. paratuberculosis
agcgucaacucgucggcga

SEQ ID NO: 2871588 - RNA, 16 nt, Mycobacterium avium subsp. paratuberculosis
agcgucaccaaugcgc

SEQ ID NO: 2871589 - RNA, 19 nt, Mycobacterium avium subsp. paratuberculosis
agcgucaccaaugcgccgg

SEQ ID NO: 2871590 - RNA, 20 nt, Mycobacterium avium subsp. paratuberculosis
agcgucaccaaugcgccggc

SEQ ID NO: 2871591 - RNA, 22 nt, Mycobacterium avium subsp. paratuberculosis
agcgucaccaaugcgccggcgg

SEQ ID NO: 2871592 - RNA, 24 nt, Mycobacterium avium subsp. paratuberculosis
agcgucaccaaugcgccggcggcc

SEQ ID NO: 2871593 - RNA, 14 nt, Mycobacterium avium subsp. paratuberculosis
agcgucaccuucac

SEQ ID NO: 2871594 - RNA, 20 nt, Mycobacterium avium subsp. paratuberculosis
agcgucaccuucaccacggc

SEQ ID NO: 2871595 - RNA, 14 nt, Mycobacterium avium subsp. paratuberculosis
agcgucacgccagc

SEQ ID NO: 2871596 - RNA, 15 nt, Mycobacterium avium subsp. paratuberculosis
agcgucacgccagcg

SEQ ID NO: 2871597 - RNA, 17 nt, Mycobacterium avium subsp. paratuberculosis
agcgucacgccagcgug

SEQ ID NO: 2871598 - RNA, 18 nt, Mycobacterium avium subsp. paratuberculosis
agcgucacgccagcguga

SEQ ID NO: 2871599 - RNA, 20 nt, Mycobacterium avium subsp. paratuberculosis
agcgucacgccagcgugacg

SEQ ID NO: 2871600 - RNA, 21 nt, Mycobacterium avium subsp. paratuberculosis
agcgucacgccagcgugacgc

SEQ ID NO: 2871601 - RNA, 22 nt, Mycobacterium avium subsp. paratuberculosis
agcgucacgccaguguggccgc

SEQ ID NO: 2871602 - RNA, 13 nt, Mycobacterium avium subsp. paratuberculosis
agcgucacgccgc

SEQ ID NO: 2871603 - RNA, 15 nt, Mycobacterium avium subsp. paratuberculosis
agcgucacgccgcgc

SEQ ID NO: 2871604 - RNA, 21 nt, Mycobacterium avium subsp. paratuberculosis
agcgucacgcuagcgugacag

SEQ ID NO: 2871605 - RNA, 12 nt, Mycobacterium avium subsp. paratuberculosis
agcgucacgcug

SEQ ID NO: 2871606 - RNA, 13 nt, Mycobacterium avium subsp. paratuberculosis
agcgucacgcugg

SEQ ID NO: 2871607 - RNA, 18 nt, Mycobacterium avium subsp. paratuberculosis
agcgucacgcuggcguga

SEQ ID NO: 2871608 - RNA, 20 nt, Mycobacterium avium subsp. paratuberculosis
agcgucacgcuggcguggcg

SEQ ID NO: 2871609 - RNA, 22 nt, Mycobacterium avium subsp. paratuberculosis
agcgucacgcuggcguggcucg

SEQ ID NO: 2871610 - RNA, 15 nt, Mycobacterium avium subsp. paratuberculosis
agcgucacgucgacg

SEQ ID NO: 2871611 - RNA, 16 nt, Mycobacterium avium subsp. paratuberculosis
agcgucacgucgacgg

SEQ ID NO: 2871612 - RNA, 14 nt, Mycobacterium avium subsp. paratuberculosis
agcgucagcaccgc

SEQ ID NO: 2871613 - RNA, 16 nt, Mycobacterium avium subsp. paratuberculosis
agcgucagcaccgcga

SEQ ID NO: 2871614 - RNA, 14 nt, Mycobacterium avium subsp. paratuberculosis
agcgucagcaucgc

SEQ ID NO: 2871615 - RNA, 22 nt, Mycobacterium avium subsp. paratuberculosis
agcgucagggcgacuccggcgc

SEQ ID NO: 2871616 - RNA, 20 nt, Mycobacterium avium subsp. paratuberculosis
agcgucaucacgugcuggcg

SEQ ID NO: 2871617 - RNA, 18 nt, Mycobacterium avium subsp. paratuberculosis
agcgucauuccgccgcgc

SEQ ID NO: 2871618 - RNA, 19 nt, Mycobacterium avium subsp. paratuberculosis
agcgucauuccgccgcgcc

SEQ ID NO: 2871619 - RNA, 19 nt, Mycobacterium avium subsp. paratuberculosis
agcguccggagaaccgcuc

SEQ ID NO: 2871620 - RNA, 23 nt, Mycobacterium avium subsp. paratuberculosis
agcguccgggcguagugcagcug

SEQ ID NO: 2871621 - RNA, 15 nt, Mycobacterium avium subsp. paratuberculosis
agcgucgacgcggug

SEQ ID NO: 2871622 - RNA, 14 nt, Mycobacterium avium subsp. paratuberculosis
agcgucgacugcac

SEQ ID NO: 2871623 - RNA, 18 nt, Mycobacterium avium subsp. paratuberculosis
agcgucgacugcaccgac

SEQ ID NO: 2871624 - RNA, 20 nt, Mycobacterium avium subsp. paratuberculosis
agcgucgacugcaccgacuc

SEQ ID NO: 2871625 - RNA, 21 nt, Mycobacterium avium subsp. paratuberculosis
agcgucgaugugggccgcagc

SEQ ID NO: 2871626 - RNA, 19 nt, Mycobacterium avium subsp. paratuberculosis
agcgucgccaauccggcgg

SEQ ID NO: 2871627 - RNA, 20 nt, Mycobacterium avium subsp. paratuberculosis
agcgucgccaauccggcggg

SEQ ID NO: 2871628 - RNA, 13 nt, Mycobacterium avium subsp. paratuberculosis
agcgucgccacca

SEQ ID NO: 2871629 - RNA, 16 nt, Mycobacterium avium subsp. paratuberculosis
agcgucgccaccaccu

SEQ ID NO: 2871630 - RNA, 15 nt, Mycobacterium avium subsp. paratuberculosis
agcgucgccagccgc

SEQ ID NO: 2871631 - RNA, 17 nt, Mycobacterium avium subsp. paratuberculosis
agcgucgccagccgccg

SEQ ID NO: 2871632 - RNA, 20 nt, Mycobacterium avium subsp. paratuberculosis
agcgucgccagccgccggcu

SEQ ID NO: 2871633 - RNA, 21 nt, Mycobacterium avium subsp. paratuberculosis
agcgucgccagccgccggcuc

SEQ ID NO: 2871634 - RNA, 17 nt, Mycobacterium avium subsp. paratuberculosis
agcgucgccaugccguc

SEQ ID NO: 2871635 - RNA, 21 nt, Mycobacterium avium subsp. paratuberculosis
agcgucgccaugccgucgcgc

SEQ ID NO: 2871636 - RNA, 17 nt, Mycobacterium avium subsp. paratuberculosis
agcgucgccgccccgag

SEQ ID NO: 2871637 - RNA, 13 nt, Mycobacterium avium subsp. paratuberculosis
agcgucgcgauca

SEQ ID NO: 2871638 - RNA, 20 nt, Mycobacterium avium subsp. paratuberculosis
agcgucgcgccgccacccca

SEQ ID NO: 2871639 - RNA, 13 nt, Mycobacterium avium subsp. paratuberculosis
agcgucgcggccg

SEQ ID NO: 2871640 - RNA, 16 nt, Mycobacterium avium subsp. paratuberculosis
agcgucggcgugcccg

SEQ ID NO: 2871641 - RNA, 18 nt, Mycobacterium avium subsp. paratuberculosis
agcgucggcgugcccgcc

SEQ ID NO: 2871642 - RNA, 20 nt, Mycobacterium avium subsp. paratuberculosis
agcgucggcgugcccgccga

SEQ ID NO: 2871643 - RNA, 18 nt, Mycobacterium avium subsp. paratuberculosis
agcgucggcuagcggcug

SEQ ID NO: 2871644 - RNA, 14 nt, Mycobacterium avium subsp. paratuberculosis
agcgucgggggcgu

SEQ ID NO: 2871645 - RNA, 20 nt, Mycobacterium avium subsp. paratuberculosis
agcgucggguacaccgagcc

SEQ ID NO: 2871646 - RNA, 18 nt, Mycobacterium avium subsp. paratuberculosis
agcgucgucaggccguga

SEQ ID NO: 2871647 - RNA, 20 nt, Mycobacterium avium subsp. paratuberculosis
agcgucucgaccgcgguggc

SEQ ID NO: 2871648 - RNA, 20 nt, Mycobacterium avium subsp. paratuberculosis
agcgucucgacggcgccgac

SEQ ID NO: 2871649 - RNA, 18 nt, Mycobacterium avium subsp. paratuberculosis
agcgucucgaucgacgac

SEQ ID NO: 2871650 - RNA, 13 nt, Mycobacterium avium subsp. paratuberculosis
agcgucucgccgg

SEQ ID NO: 2871651 - RNA, 21 nt, Mycobacterium avium subsp. paratuberculosis
agcgucucgccggggaacacc

SEQ ID NO: 2871652 - RNA, 15 nt, Mycobacterium avium subsp. paratuberculosis
agcgucucggcggcc

SEQ ID NO: 2871653 - RNA, 19 nt, Mycobacterium avium subsp. paratuberculosis
agcgucucggcggccgagc

SEQ ID NO: 2871654 - RNA, 13 nt, Mycobacterium avium subsp. paratuberculosis
agcgucugcgccc

SEQ ID NO: 2871655 - RNA, 15 nt, Mycobacterium avium subsp. paratuberculosis
agcgucugcgccccg

SEQ ID NO: 2871656 - RNA, 21 nt, Mycobacterium avium subsp. paratuberculosis
agcgucuggcagccggccggc

SEQ ID NO: 2871657 - RNA, 18 nt, Mycobacterium avium subsp. paratuberculosis
agcgucuucuucucgccg

SEQ ID NO: 2871658 - RNA, 22 nt, Mycobacterium avium subsp. paratuberculosis
agcgucuucuucucgccguccc

SEQ ID NO: 2871659 - RNA, 19 nt, Mycobacterium avium subsp. paratuberculosis
agcgucuuggacgcccggu

SEQ ID NO: 2871660 - RNA, 20 nt, Mycobacterium avium subsp. paratuberculosis
agcgucuuggacgcccgguc

SEQ ID NO: 2871661 - RNA, 20 nt, Mycobacterium avium subsp. paratuberculosis
agcgugaaacuagcuucacg

SEQ ID NO: 2871662 - RNA, 21 nt, Mycobacterium avium subsp. paratuberculosis
agcgugaaacuagcuucacgc

SEQ ID NO: 2871663 - RNA, 19 nt, Mycobacterium avium subsp. paratuberculosis
agcgugaacaccgcguugg

SEQ ID NO: 2871664 - RNA, 12 nt, Mycobacterium avium subsp. paratuberculosis
agcgugaagcua

SEQ ID NO: 2871665 - RNA, 20 nt, Mycobacterium avium subsp. paratuberculosis
agcgugaagcuagcuucacg

SEQ ID NO: 2871666 - RNA, 20 nt, Mycobacterium avium subsp. paratuberculosis
agcgugacagucgaccucgc

SEQ ID NO: 2871667 - RNA, 13 nt, Mycobacterium avium subsp. paratuberculosis
agcgugacccugc

SEQ ID NO: 2871668 - RNA, 14 nt, Mycobacterium avium subsp. paratuberculosis
agcgugacgccggg

SEQ ID NO: 2871669 - RNA, 15 nt, Mycobacterium avium subsp. paratuberculosis
agcgugacgucgacg

SEQ ID NO: 2871670 - RNA, 16 nt, Mycobacterium avium subsp. paratuberculosis
agcgugacgucgacgu

SEQ ID NO: 2871671 - RNA, 14 nt, Mycobacterium avium subsp. paratuberculosis
agcgugcacacccg

SEQ ID NO: 2871672 - RNA, 16 nt, Mycobacterium avium subsp. paratuberculosis
agcgugcccgcgccca

SEQ ID NO: 2871673 - RNA, 20 nt, Mycobacterium avium subsp. paratuberculosis
agcgugcccgcgcccaccug

SEQ ID NO: 2871674 - RNA, 22 nt, Mycobacterium avium subsp. paratuberculosis
agcgugcccgcgcccaccugga

SEQ ID NO: 2871675 - RNA, 12 nt, Mycobacterium avium subsp. paratuberculosis
agcgugccgccg

SEQ ID NO: 2871676 - RNA, 13 nt, Mycobacterium avium subsp. paratuberculosis
agcgugccgucca

SEQ ID NO: 2871677 - RNA, 14 nt, Mycobacterium avium subsp. paratuberculosis
agcgugcgcccgac

SEQ ID NO: 2871678 - RNA, 17 nt, Mycobacterium avium subsp. paratuberculosis
agcgugcgcggcuggcc

SEQ ID NO: 2871679 - RNA, 16 nt, Mycobacterium avium subsp. paratuberculosis
agcgugcucaugucgg

SEQ ID NO: 2871680 - RNA, 17 nt, Mycobacterium avium subsp. paratuberculosis
agcgugcugacgucguc

SEQ ID NO: 2871681 - RNA, 18 nt, Mycobacterium avium subsp. paratuberculosis
agcgugcugacgucgucg

SEQ ID NO: 2871682 - RNA, 23 nt, Mycobacterium avium subsp. paratuberculosis
agcgugcugacgucgucgcccac

SEQ ID NO: 2871683 - RNA, 20 nt, Mycobacterium avium subsp. paratuberculosis
agcgugcugccggacacccc

SEQ ID NO: 2871684 - RNA, 16 nt, Mycobacterium avium subsp. paratuberculosis
agcguggacaccgcac

SEQ ID NO: 2871685 - RNA, 13 nt, Mycobacterium avium subsp. paratuberculosis
agcguggccggca

SEQ ID NO: 2871686 - RNA, 18 nt, Mycobacterium avium subsp. paratuberculosis
agcguggccggcagguug

SEQ ID NO: 2871687 - RNA, 23 nt, Mycobacterium avium subsp. paratuberculosis
agcguggcgcgccccggcccguc

SEQ ID NO: 2871688 - RNA, 18 nt, Mycobacterium avium subsp. paratuberculosis
agcguggcgucggcgcgc

SEQ ID NO: 2871689 - RNA, 13 nt, Mycobacterium avium subsp. paratuberculosis
agcgugggcaccg

SEQ ID NO: 2871690 - RNA, 15 nt, Mycobacterium avium subsp. paratuberculosis
agcgugggcaccggc

SEQ ID NO: 2871691 - RNA, 17 nt, Mycobacterium avium subsp. paratuberculosis
agcgugggcaccggcac

SEQ ID NO: 2871692 - RNA, 19 nt, Mycobacterium avium subsp. paratuberculosis
agcgugggcaccggcaccg

SEQ ID NO: 2871693 - RNA, 20 nt, Mycobacterium avium subsp. paratuberculosis
agcgugggcaccggcaccgc

SEQ ID NO: 2871694 - RNA, 21 nt, Mycobacterium avium subsp. paratuberculosis
agcgugggcaccggcaccgcc

SEQ ID NO: 2871695 - RNA, 22 nt, Mycobacterium avium subsp. paratuberculosis
agcgugggcaccggcaccgccc

SEQ ID NO: 2871696 - RNA, 19 nt, Mycobacterium avium subsp. paratuberculosis
agcgugggggccauguacg

SEQ ID NO: 2871697 - RNA, 14 nt, Mycobacterium avium subsp. paratuberculosis
agcguggucacccg

SEQ ID NO: 2871698 - RNA, 15 nt, Mycobacterium avium subsp. paratuberculosis
agcguggucagcguc

SEQ ID NO: 2871699 - RNA, 17 nt, Mycobacterium avium subsp. paratuberculosis
agcguggucuccuggcc

SEQ ID NO: 2871700 - RNA, 20 nt, Mycobacterium avium subsp. paratuberculosis
agcguggucuccuggccgcc

SEQ ID NO: 2871701 - RNA, 22 nt, Mycobacterium avium subsp. paratuberculosis
agcguggucucguugugcaccg

SEQ ID NO: 2871702 - RNA, 15 nt, Mycobacterium avium subsp. paratuberculosis
agcguguagacggug

SEQ ID NO: 2871703 - RNA, 13 nt, Mycobacterium avium subsp. paratuberculosis
agcgugucgccgg

SEQ ID NO: 2871704 - RNA, 17 nt, Mycobacterium avium subsp. paratuberculosis
agcgugucgccggggcg

SEQ ID NO: 2871705 - RNA, 23 nt, Mycobacterium avium subsp. paratuberculosis
agcgugucgcgcaaugccaucgu

SEQ ID NO: 2871706 - RNA, 15 nt, Mycobacterium avium subsp. paratuberculosis
agcgugucggcgauc

SEQ ID NO: 2871707 - RNA, 14 nt, Mycobacterium avium subsp. paratuberculosis
agcgugucgggguc

SEQ ID NO: 2871708 - RNA, 16 nt, Mycobacterium avium subsp. paratuberculosis
agcgugugcaccugag

SEQ ID NO: 2871709 - RNA, 15 nt, Mycobacterium avium subsp. paratuberculosis
agcgugugcguggug

SEQ ID NO: 2871710 - RNA, 22 nt, Mycobacterium avium subsp. paratuberculosis
agcguguggcgugugggcucgc

SEQ ID NO: 2871711 - RNA, 20 nt, Mycobacterium avium subsp. paratuberculosis
agcguguugagcucgcggcg

SEQ ID NO: 2871712 - RNA, 19 nt, Mycobacterium avium subsp. paratuberculosis
agcguguuggacgcccgcu

SEQ ID NO: 2871713 - RNA, 17 nt, Mycobacterium avium subsp. paratuberculosis
agcguucacgucgauca

SEQ ID NO: 2871714 - RNA, 23 nt, Mycobacterium avium subsp. paratuberculosis
agcguuccagguucagcccggcg

SEQ ID NO: 2871715 - RNA, 18 nt, Mycobacterium avium subsp. paratuberculosis
agcguuccggcggccggc

SEQ ID NO: 2871716 - RNA, 19 nt, Mycobacterium avium subsp. paratuberculosis
agcguuccggcggccggcg

SEQ ID NO: 2871717 - RNA, 22 nt, Mycobacterium avium subsp. paratuberculosis
agcguuccuuacgccgacguca

SEQ ID NO: 2871718 - RNA, 14 nt, Mycobacterium avium subsp. paratuberculosis
agcguugccgcgcg

SEQ ID NO: 2871719 - RNA, 19 nt, Mycobacterium avium subsp. paratuberculosis
agcguugccgcgcgcccgc

SEQ ID NO: 2871720 - RNA, 14 nt, Mycobacterium avium subsp. paratuberculosis
agcguugccggccg

SEQ ID NO: 2871721 - RNA, 21 nt, Mycobacterium avium subsp. paratuberculosis
agcguugccggccgaagugcu

SEQ ID NO: 2871722 - RNA, 16 nt, Mycobacterium avium subsp. paratuberculosis
agcguugcgccagcag

SEQ ID NO: 2871723 - RNA, 23 nt, Mycobacterium avium subsp. paratuberculosis
agcguugcgcguucaagccgccg

SEQ ID NO: 2871724 - RNA, 19 nt, Mycobacterium avium subsp. paratuberculosis
agcguuugagcaccucuuc

SEQ ID NO: 2871725 - RNA, 17 nt, Mycobacterium avium subsp. paratuberculosis
agcguuuggccugcggc

SEQ ID NO: 2871726 - RNA, 22 nt, Mycobacterium avium subsp. paratuberculosis
agcuaaaccccacggccgcaac

SEQ ID NO: 2871727 - RNA, 17 nt, Mycobacterium avium subsp. paratuberculosis
agcuagcccagaacugc

SEQ ID NO: 2871728 - RNA, 17 nt, Mycobacterium avium subsp. paratuberculosis
agcuagcuucacgcucg

SEQ ID NO: 2871729 - RNA, 19 nt, Mycobacterium avium subsp. paratuberculosis
agcuagcuucacgcucggc

SEQ ID NO: 2871730 - RNA, 15 nt, Mycobacterium avium subsp. paratuberculosis
agcuaggcggccggg

SEQ ID NO: 2871731 - RNA, 16 nt, Mycobacterium avium subsp. paratuberculosis
agcuaggcggccgggc

SEQ ID NO: 2871732 - RNA, 19 nt, Mycobacterium avium subsp. paratuberculosis
agcuaguuucacgcucggc

SEQ ID NO: 2871733 - RNA, 22 nt, Mycobacterium avium subsp. paratuberculosis
agcuaguuucacgcucggcggg

SEQ ID NO: 2871734 - RNA, 23 nt, Mycobacterium avium subsp. paratuberculosis
agcuaguuucacguucgcggucg

SEQ ID NO: 2871735 - RNA, 23 nt, Mycobacterium avium subsp. paratuberculosis
agcucaccgacaagggccgggcg

SEQ ID NO: 2871736 - RNA, 14 nt, Mycobacterium avium subsp. paratuberculosis
agcucaccgccgau

SEQ ID NO: 2871737 - RNA, 13 nt, Mycobacterium avium subsp. paratuberculosis
agcucaccgggcu

SEQ ID NO: 2871738 - RNA, 14 nt, Mycobacterium avium subsp. paratuberculosis
agcucaccugcgug

SEQ ID NO: 2871739 - RNA, 13 nt, Mycobacterium avium subsp. paratuberculosis
agcucagccacgc

SEQ ID NO: 2871740 - RNA, 18 nt, Mycobacterium avium subsp. paratuberculosis
agcucagccacgccggca

SEQ ID NO: 2871741 - RNA, 19 nt, Mycobacterium avium subsp. paratuberculosis
agcucagccacgccggcac

SEQ ID NO: 2871742 - RNA, 14 nt, Mycobacterium avium subsp. paratuberculosis
agcucagcgcgcac

SEQ ID NO: 2871743 - RNA, 17 nt, Mycobacterium avium subsp. paratuberculosis
agcucagcugcugcgcg

SEQ ID NO: 2871744 - RNA, 21 nt, Mycobacterium avium subsp. paratuberculosis
agcucagcugcugcgcggcgg

SEQ ID NO: 2871745 - RNA, 18 nt, Mycobacterium avium subsp. paratuberculosis
agcucaggaacggccgga

SEQ ID NO: 2871746 - RNA, 15 nt, Mycobacterium avium subsp. paratuberculosis
agcucaggccggccu

SEQ ID NO: 2871747 - RNA, 17 nt, Mycobacterium avium subsp. paratuberculosis
agcucaggccggccuug

SEQ ID NO: 2871748 - RNA, 19 nt, Mycobacterium avium subsp. paratuberculosis
agcucaggccggccuugcu

SEQ ID NO: 2871749 - RNA, 13 nt, Mycobacterium avium subsp. paratuberculosis
agcucaggugcga

SEQ ID NO: 2871750 - RNA, 17 nt, Mycobacterium avium subsp. paratuberculosis
agcucauacagcggcgc

SEQ ID NO: 2871751 - RNA, 23 nt, Mycobacterium avium subsp. paratuberculosis
agcucauacagcggcgcgcgccg

SEQ ID NO: 2871752 - RNA, 19 nt, Mycobacterium avium subsp. paratuberculosis
agcucaucaccggcgcgcc

SEQ ID NO: 2871753 - RNA, 21 nt, Mycobacterium avium subsp. paratuberculosis
agcucaucaccggcgcgccgu

SEQ ID NO: 2871754 - RNA, 23 nt, Mycobacterium avium subsp. paratuberculosis
agcucaucaccggcgcgccgucc

SEQ ID NO: 2871755 - RNA, 20 nt, Mycobacterium avium subsp. paratuberculosis
agcucaugguguuccaccag

SEQ ID NO: 2871756 - RNA, 16 nt, Mycobacterium avium subsp. paratuberculosis
agcucauguggggggu

SEQ ID NO: 2871757 - RNA, 16 nt, Mycobacterium avium subsp. paratuberculosis
agcuccaaugcggccg

SEQ ID NO: 2871758 - RNA, 18 nt, Mycobacterium avium subsp. paratuberculosis
agcuccaccugcggcacc

SEQ ID NO: 2871759 - RNA, 12 nt, Mycobacterium avium subsp. paratuberculosis
agcuccacgccg

SEQ ID NO: 2871760 - RNA, 14 nt, Mycobacterium avium subsp. paratuberculosis
agcuccacgccgcc

SEQ ID NO: 2871761 - RNA, 16 nt, Mycobacterium avium subsp. paratuberculosis
agcuccacgccgccgg

SEQ ID NO: 2871762 - RNA, 21 nt, Mycobacterium avium subsp. paratuberculosis
agcuccacgccgccgggaaca

SEQ ID NO: 2871763 - RNA, 23 nt, Mycobacterium avium subsp. paratuberculosis
agcuccacgccgccgggaacagc

SEQ ID NO: 2871764 - RNA, 12 nt, Mycobacterium avium subsp. paratuberculosis
agcuccagcagc

SEQ ID NO: 2871765 - RNA, 13 nt, Mycobacterium avium subsp. paratuberculosis
agcuccagcagcc

SEQ ID NO: 2871766 - RNA, 19 nt, Mycobacterium avium subsp. paratuberculosis
agcuccagcagcccgggcu

SEQ ID NO: 2871767 - RNA, 18 nt, Mycobacterium avium subsp. paratuberculosis
agcuccagcgaguuggcc

SEQ ID NO: 2871768 - RNA, 19 nt, Mycobacterium avium subsp. paratuberculosis
agcuccagcgaguuggcca

SEQ ID NO: 2871769 - RNA, 17 nt, Mycobacterium avium subsp. paratuberculosis
agcucccgagcaucgcc

SEQ ID NO: 2871770 - RNA, 22 nt, Mycobacterium avium subsp. paratuberculosis
agcucccggcagaucgcggccc

SEQ ID NO: 2871771 - RNA, 13 nt, Mycobacterium avium subsp. paratuberculosis
agcucccgggcgg

SEQ ID NO: 2871772 - RNA, 15 nt, Mycobacterium avium subsp. paratuberculosis
agcucccgggcggcg

SEQ ID NO: 2871773 - RNA, 16 nt, Mycobacterium avium subsp. paratuberculosis
agcucccgggcggcgc

SEQ ID NO: 2871774 - RNA, 16 nt, Mycobacterium avium subsp. paratuberculosis
agcuccgccacccugc

SEQ ID NO: 2871775 - RNA, 16 nt, Mycobacterium avium subsp. paratuberculosis
agcuccgccgacacca

SEQ ID NO: 2871776 - RNA, 16 nt, Mycobacterium avium subsp. paratuberculosis
agcuccgcggccagcu

SEQ ID NO: 2871777 - RNA, 22 nt, Mycobacterium avium subsp. paratuberculosis
agcuccggguaggacaccguca

SEQ ID NO: 2871778 - RNA, 13 nt, Mycobacterium avium subsp. paratuberculosis
agcuccguccacc

SEQ ID NO: 2871779 - RNA, 20 nt, Mycobacterium avium subsp. paratuberculosis
agcuccuccggguccccgcc

SEQ ID NO: 2871780 - RNA, 19 nt, Mycobacterium avium subsp. paratuberculosis
agcuccucgauggucgucg

SEQ ID NO: 2871781 - RNA, 23 nt, Mycobacterium avium subsp. paratuberculosis
agcuccucgcggaacugcuccca

SEQ ID NO: 2871782 - RNA, 18 nt, Mycobacterium avium subsp. paratuberculosis
agcuccucggccagcacc

SEQ ID NO: 2871783 - RNA, 17 nt, Mycobacterium avium subsp. paratuberculosis
agcuccuugagccgccg

SEQ ID NO: 2871784 - RNA, 18 nt, Mycobacterium avium subsp. paratuberculosis
agcuccuugagccgccgc

SEQ ID NO: 2871785 - RNA, 20 nt, Mycobacterium avium subsp. paratuberculosis
agcuccuugagccgccgcgg

SEQ ID NO: 2871786 - RNA, 22 nt, Mycobacterium avium subsp. paratuberculosis
agcuccuugagccgccgcggca

SEQ ID NO: 2871787 - RNA, 15 nt, Mycobacterium avium subsp. paratuberculosis
agcucgaaccuggag

SEQ ID NO: 2871788 - RNA, 23 nt, Mycobacterium avium subsp. paratuberculosis
agcucgaaggugaccaucggguc

SEQ ID NO: 2871789 - RNA, 21 nt, Mycobacterium avium subsp. paratuberculosis
agcucgaaggugcccgcaucg

SEQ ID NO: 2871790 - RNA, 17 nt, Mycobacterium avium subsp. paratuberculosis
agcucgacaucggccgc

SEQ ID NO: 2871791 - RNA, 16 nt, Mycobacterium avium subsp. paratuberculosis
agcucgaccgcggcga

SEQ ID NO: 2871792 - RNA, 17 nt, Mycobacterium avium subsp. paratuberculosis
agcucgaccgcggcgau

SEQ ID NO: 2871793 - RNA, 18 nt, Mycobacterium avium subsp. paratuberculosis
agcucgaccgcggcgaug

SEQ ID NO: 2871794 - RNA, 12 nt, Mycobacterium avium subsp. paratuberculosis
agcucgacgacu

SEQ ID NO: 2871795 - RNA, 12 nt, Mycobacterium avium subsp. paratuberculosis
agcucgacgaug

SEQ ID NO: 2871796 - RNA, 13 nt, Mycobacterium avium subsp. paratuberculosis
agcucgaucaccc

SEQ ID NO: 2871797 - RNA, 16 nt, Mycobacterium avium subsp. paratuberculosis
agcucgaucgccgcgc

SEQ ID NO: 2871798 - RNA, 17 nt, Mycobacterium avium subsp. paratuberculosis
agcucgaucgccgcgcc

SEQ ID NO: 2871799 - RNA, 22 nt, Mycobacterium avium subsp. paratuberculosis
agcucgaugccguucgcgccgu

SEQ ID NO: 2871800 - RNA, 15 nt, Mycobacterium avium subsp. paratuberculosis
agcucgcccagcacc

SEQ ID NO: 2871801 - RNA, 14 nt, Mycobacterium avium subsp. paratuberculosis
agcucgccgagcgu

SEQ ID NO: 2871802 - RNA, 21 nt, Mycobacterium avium subsp. paratuberculosis
agcucgccgauguggcgggcg

SEQ ID NO: 2871803 - RNA, 14 nt, Mycobacterium avium subsp. paratuberculosis
agcucgccgccgac

SEQ ID NO: 2871804 - RNA, 14 nt, Mycobacterium avium subsp. paratuberculosis
agcucgccgcggcc

SEQ ID NO: 2871805 - RNA, 15 nt, Mycobacterium avium subsp. paratuberculosis
agcucgccgcggcca

SEQ ID NO: 2871806 - RNA, 18 nt, Mycobacterium avium subsp. paratuberculosis
agcucgccgcggccacgc

SEQ ID NO: 2871807 - RNA, 13 nt, Mycobacterium avium subsp. paratuberculosis
agcucgccggccg

SEQ ID NO: 2871808 - RNA, 19 nt, Mycobacterium avium subsp. paratuberculosis
agcucgccggccgcgggcg

SEQ ID NO: 2871809 - RNA, 15 nt, Mycobacterium avium subsp. paratuberculosis
agcucgccgguggcg

SEQ ID NO: 2871810 - RNA, 20 nt, Mycobacterium avium subsp. paratuberculosis
agcucgcgaacuacuucguc

SEQ ID NO: 2871811 - RNA, 18 nt, Mycobacterium avium subsp. paratuberculosis
agcucgcgaagcgcgaug

SEQ ID NO: 2871812 - RNA, 19 nt, Mycobacterium avium subsp. paratuberculosis
agcucgcgcagcuggccgu

SEQ ID NO: 2871813 - RNA, 18 nt, Mycobacterium avium subsp. paratuberculosis
agcucgcgcaucagcgga

SEQ ID NO: 2871814 - RNA, 15 nt, Mycobacterium avium subsp. paratuberculosis
agcucgcgccgaccc

SEQ ID NO: 2871815 - RNA, 19 nt, Mycobacterium avium subsp. paratuberculosis
agcucgcgccgacccgccc

SEQ ID NO: 2871816 - RNA, 21 nt, Mycobacterium avium subsp. paratuberculosis
agcucgcgccgacccgcccgc

SEQ ID NO: 2871817 - RNA, 14 nt, Mycobacterium avium subsp. paratuberculosis
agcucgcgcugcau

SEQ ID NO: 2871818 - RNA, 20 nt, Mycobacterium avium subsp. paratuberculosis
agcucgcgcugcaugccggu

SEQ ID NO: 2871819 - RNA, 12 nt, Mycobacterium avium subsp. paratuberculosis
agcucgcggcgc

SEQ ID NO: 2871820 - RNA, 13 nt, Mycobacterium avium subsp. paratuberculosis
agcucgcggcgca

SEQ ID NO: 2871821 - RNA, 16 nt, Mycobacterium avium subsp. paratuberculosis
agcucgcggcgcagcu

SEQ ID NO: 2871822 - RNA, 16 nt, Mycobacterium avium subsp. paratuberculosis
agcucgcgggccugcu

SEQ ID NO: 2871823 - RNA, 13 nt, Mycobacterium avium subsp. paratuberculosis
agcucgcguagcg

SEQ ID NO: 2871824 - RNA, 14 nt, Mycobacterium avium subsp. paratuberculosis
agcucgcgucgacg

SEQ ID NO: 2871825 - RNA, 17 nt, Mycobacterium avium subsp. paratuberculosis
agcucgcgucgacgucg

SEQ ID NO: 2871826 - RNA, 22 nt, Mycobacterium avium subsp. paratuberculosis
agcucgcgucgacgucgggcac

SEQ ID NO: 2871827 - RNA, 21 nt, Mycobacterium avium subsp. paratuberculosis
agcucgcguucgggcccggcc

SEQ ID NO: 2871828 - RNA, 22 nt, Mycobacterium avium subsp. paratuberculosis
agcucgcguucgggcccggccg

SEQ ID NO: 2871829 - RNA, 23 nt, Mycobacterium avium subsp. paratuberculosis
agcucgcguucgggcccggccgc

SEQ ID NO: 2871830 - RNA, 17 nt, Mycobacterium avium subsp. paratuberculosis
agcucgcugagcgggac

SEQ ID NO: 2871831 - RNA, 13 nt, Mycobacterium avium subsp. paratuberculosis
agcucggcagccc

SEQ ID NO: 2871832 - RNA, 19 nt, Mycobacterium avium subsp. paratuberculosis
agcucggccaccagcgccc

SEQ ID NO: 2871833 - RNA, 13 nt, Mycobacterium avium subsp. paratuberculosis
agcucggccaucc

SEQ ID NO: 2871834 - RNA, 18 nt, Mycobacterium avium subsp. paratuberculosis
agcucggccggggcgacc

SEQ ID NO: 2871835 - RNA, 22 nt, Mycobacterium avium subsp. paratuberculosis
agcucggccuuacgcugcgcga

SEQ ID NO: 2871836 - RNA, 13 nt, Mycobacterium avium subsp. paratuberculosis
agcucggcggcca

SEQ ID NO: 2871837 - RNA, 16 nt, Mycobacterium avium subsp. paratuberculosis
agcucggcggccgggu

SEQ ID NO: 2871838 - RNA, 17 nt, Mycobacterium avium subsp. paratuberculosis
agcucggcggccgggug

SEQ ID NO: 2871839 - RNA, 14 nt, Mycobacterium avium subsp. paratuberculosis
agcucggcggccuc

SEQ ID NO: 2871840 - RNA, 16 nt, Mycobacterium avium subsp. paratuberculosis
agcucggcgggcuccc

SEQ ID NO: 2871841 - RNA, 12 nt, Mycobacterium avium subsp. paratuberculosis
agcucgggcagc

SEQ ID NO: 2871842 - RNA, 21 nt, Mycobacterium avium subsp. paratuberculosis
agcucgggcagcccgccgacc

SEQ ID NO: 2871843 - RNA, 14 nt, Mycobacterium avium subsp. paratuberculosis
agcucgggcagcgu

SEQ ID NO: 2871844 - RNA, 23 nt, Mycobacterium avium subsp. paratuberculosis
agcucggggucggcgucgggccg

SEQ ID NO: 2871845 - RNA, 17 nt, Mycobacterium avium subsp. paratuberculosis
agcucggucagccgggc

SEQ ID NO: 2871846 - RNA, 17 nt, Mycobacterium avium subsp. paratuberculosis
agcucggucgcggucgg

SEQ ID NO: 2871847 - RNA, 18 nt, Mycobacterium avium subsp. paratuberculosis
agcucggucgcggucggc

SEQ ID NO: 2871848 - RNA, 19 nt, Mycobacterium avium subsp. paratuberculosis
agcucggucgcggucggcg

SEQ ID NO: 2871849 - RNA, 21 nt, Mycobacterium avium subsp. paratuberculosis
agcucggucgcggucggcgcc

SEQ ID NO: 2871850 - RNA, 17 nt, Mycobacterium avium subsp. paratuberculosis
agcucggugaucugcac

SEQ ID NO: 2871851 - RNA, 23 nt, Mycobacterium avium subsp. paratuberculosis
agcucggugcagaccccggcguc

SEQ ID NO: 2871852 - RNA, 19 nt, Mycobacterium avium subsp. paratuberculosis
agcucgguggcgucggcgg

SEQ ID NO: 2871853 - RNA, 16 nt, Mycobacterium avium subsp. paratuberculosis
agcucgucagcgcggg

SEQ ID NO: 2871854 - RNA, 18 nt, Mycobacterium avium subsp. paratuberculosis
agcucgucagcgcgggcc

SEQ ID NO: 2871855 - RNA, 19 nt, Mycobacterium avium subsp. paratuberculosis
agcucgucagcgcgggcca

SEQ ID NO: 2871856 - RNA, 20 nt, Mycobacterium avium subsp. paratuberculosis
agcucgucagcgcgggccag

SEQ ID NO: 2871857 - RNA, 15 nt, Mycobacterium avium subsp. paratuberculosis
agcucguccagcgug

SEQ ID NO: 2871858 - RNA, 18 nt, Mycobacterium avium subsp. paratuberculosis
agcucguccagcgugccg

SEQ ID NO: 2871859 - RNA, 15 nt, Mycobacterium avium subsp. paratuberculosis
agcucgucgacgucc

SEQ ID NO: 2871860 - RNA, 18 nt, Mycobacterium avium subsp. paratuberculosis
agcucgucgacguccucg

SEQ ID NO: 2871861 - RNA, 13 nt, Mycobacterium avium subsp. paratuberculosis
agcucgucgagcc

SEQ ID NO: 2871862 - RNA, 16 nt, Mycobacterium avium subsp. paratuberculosis
agcucgucgagccggc

SEQ ID NO: 2871863 - RNA, 13 nt, Mycobacterium avium subsp. paratuberculosis
agcucgucgccga

SEQ ID NO: 2871864 - RNA, 15 nt, Mycobacterium avium subsp. paratuberculosis
agcucgucgccgacc

SEQ ID NO: 2871865 - RNA, 17 nt, Mycobacterium avium subsp. paratuberculosis
agcucgucgccgaccag

SEQ ID NO: 2871866 - RNA, 20 nt, Mycobacterium avium subsp. paratuberculosis
agcucgucggguguggcgcc

SEQ ID NO: 2871867 - RNA, 21 nt, Mycobacterium avium subsp. paratuberculosis
agcucgucggguguggcgccg

SEQ ID NO: 2871868 - RNA, 22 nt, Mycobacterium avium subsp. paratuberculosis
agcucgucguacucgggugagu

SEQ ID NO: 2871869 - RNA, 20 nt, Mycobacterium avium subsp. paratuberculosis
agcucgugaugguccagcac

SEQ ID NO: 2871870 - RNA, 15 nt, Mycobacterium avium subsp. paratuberculosis
agcucguggcgggcc

SEQ ID NO: 2871871 - RNA, 23 nt, Mycobacterium avium subsp. paratuberculosis
agcucguggcgggcccgggcgcu

SEQ ID NO: 2871872 - RNA, 16 nt, Mycobacterium avium subsp. paratuberculosis
agcucguugccggcgg

SEQ ID NO: 2871873 - RNA, 18 nt, Mycobacterium avium subsp. paratuberculosis
agcucguugccggcggcc

SEQ ID NO: 2871874 - RNA, 19 nt, Mycobacterium avium subsp. paratuberculosis
agcucguugccggcggcca

SEQ ID NO: 2871875 - RNA, 23 nt, Mycobacterium avium subsp. paratuberculosis
agcucuugaaucgguucggccag

SEQ ID NO: 2871876 - RNA, 18 nt, Mycobacterium avium subsp. paratuberculosis
agcugaacacgaacccgg

SEQ ID NO: 2871877 - RNA, 20 nt, Mycobacterium avium subsp. paratuberculosis
agcugaacacgaacccggcg

SEQ ID NO: 2871878 - RNA, 14 nt, Mycobacterium avium subsp. paratuberculosis
agcugaaguucacc

SEQ ID NO: 2871879 - RNA, 16 nt, Mycobacterium avium subsp. paratuberculosis
agcugaaguucaccac

SEQ ID NO: 2871880 - RNA, 16 nt, Mycobacterium avium subsp. paratuberculosis
agcugacacccgacga

SEQ ID NO: 2871881 - RNA, 15 nt, Mycobacterium avium subsp. paratuberculosis
agcugaccggccacc

SEQ ID NO: 2871882 - RNA, 15 nt, Mycobacterium avium subsp. paratuberculosis
agcugaccggcgauc

SEQ ID NO: 2871883 - RNA, 19 nt, Mycobacterium avium subsp. paratuberculosis
agcugacgaacgcgccgcc

SEQ ID NO: 2871884 - RNA, 21 nt, Mycobacterium avium subsp. paratuberculosis
agcugacgaacgcgccgccca

SEQ ID NO: 2871885 - RNA, 13 nt, Mycobacterium avium subsp. paratuberculosis
agcugacggccau

SEQ ID NO: 2871886 - RNA, 20 nt, Mycobacterium avium subsp. paratuberculosis
agcugacgggccggcggggu

SEQ ID NO: 2871887 - RNA, 15 nt, Mycobacterium avium subsp. paratuberculosis
agcugagcagcaggu

SEQ ID NO: 2871888 - RNA, 14 nt, Mycobacterium avium subsp. paratuberculosis
agcugaucgcggcc

SEQ ID NO: 2871889 - RNA, 19 nt, Mycobacterium avium subsp. paratuberculosis
agcugaucgcggccggcga

SEQ ID NO: 2871890 - RNA, 14 nt, Mycobacterium avium subsp. paratuberculosis
agcugaucgcgucg

SEQ ID NO: 2871891 - RNA, 16 nt, Mycobacterium avium subsp. paratuberculosis
agcugaucgcgucgac

SEQ ID NO: 2871892 - RNA, 23 nt, Mycobacterium avium subsp. paratuberculosis
agcugaucggcguuggcggcguc

SEQ ID NO: 2871893 - RNA, 14 nt, Mycobacterium avium subsp. paratuberculosis
agcugaucggggcc

SEQ ID NO: 2871894 - RNA, 17 nt, Mycobacterium avium subsp. paratuberculosis
agcugauucgcgguggc

SEQ ID NO: 2871895 - RNA, 18 nt, Mycobacterium avium subsp. paratuberculosis
agcugauucgcgguggcg

SEQ ID NO: 2871896 - RNA, 19 nt, Mycobacterium avium subsp. paratuberculosis
agcugcaacgcgucggcgc

SEQ ID NO: 2871897 - RNA, 20 nt, Mycobacterium avium subsp. paratuberculosis
agcugcaacgcgucggcgcc

SEQ ID NO: 2871898 - RNA, 15 nt, Mycobacterium avium subsp. paratuberculosis
agcugcaccggggcc

SEQ ID NO: 2871899 - RNA, 22 nt, Mycobacterium avium subsp. paratuberculosis
agcugcaccggguacaccggcu

SEQ ID NO: 2871900 - RNA, 15 nt, Mycobacterium avium subsp. paratuberculosis
agcugcacgggcgug

SEQ ID NO: 2871901 - RNA, 23 nt, Mycobacterium avium subsp. paratuberculosis
agcugcagcgacugcacccgggu

SEQ ID NO: 2871902 - RNA, 15 nt, Mycobacterium avium subsp. paratuberculosis
agcugcaggcgacga

SEQ ID NO: 2871903 - RNA, 17 nt, Mycobacterium avium subsp. paratuberculosis
agcugcauggacagcga

SEQ ID NO: 2871904 - RNA, 15 nt, Mycobacterium avium subsp. paratuberculosis
agcugcccaccagca

SEQ ID NO: 2871905 - RNA, 13 nt, Mycobacterium avium subsp. paratuberculosis
agcugccccuucg

SEQ ID NO: 2871906 - RNA, 15 nt, Mycobacterium avium subsp. paratuberculosis
agcugcccgcacugg

SEQ ID NO: 2871907 - RNA, 14 nt, Mycobacterium avium subsp. paratuberculosis
agcugcccgccgac

SEQ ID NO: 2871908 - RNA, 16 nt, Mycobacterium avium subsp. paratuberculosis
agcugcccugaagcug

SEQ ID NO: 2871909 - RNA, 15 nt, Mycobacterium avium subsp. paratuberculosis
agcugccgaccagga

SEQ ID NO: 2871910 - RNA, 19 nt, Mycobacterium avium subsp. paratuberculosis
agcugccgcgacucggugu

SEQ ID NO: 2871911 - RNA, 13 nt, Mycobacterium avium subsp. paratuberculosis
agcugccggccgu

SEQ ID NO: 2871912 - RNA, 14 nt, Mycobacterium avium subsp. paratuberculosis
agcugccggcgacc

SEQ ID NO: 2871913 - RNA, 20 nt, Mycobacterium avium subsp. paratuberculosis
agcugccggcgaccagcccc

SEQ ID NO: 2871914 - RNA, 19 nt, Mycobacterium avium subsp. paratuberculosis
agcugccggcggccgccgg

SEQ ID NO: 2871915 - RNA, 21 nt, Mycobacterium avium subsp. paratuberculosis
agcugccggcggccgccggca

SEQ ID NO: 2871916 - RNA, 22 nt, Mycobacterium avium subsp. paratuberculosis
agcugccggcggccgccggcac

SEQ ID NO: 2871917 - RNA, 17 nt, Mycobacterium avium subsp. paratuberculosis
agcugccguccgggucc

SEQ ID NO: 2871918 - RNA, 14 nt, Mycobacterium avium subsp. paratuberculosis
agcugccguugcgc

SEQ ID NO: 2871919 - RNA, 18 nt, Mycobacterium avium subsp. paratuberculosis
agcugccguugcgccagc

SEQ ID NO: 2871920 - RNA, 13 nt, Mycobacterium avium subsp. paratuberculosis
agcugcgccgcgu

SEQ ID NO: 2871921 - RNA, 12 nt, Mycobacterium avium subsp. paratuberculosis
agcugcgccggc

SEQ ID NO: 2871922 - RNA, 15 nt, Mycobacterium avium subsp. paratuberculosis
agcugcgcgccccgg

SEQ ID NO: 2871923 - RNA, 16 nt, Mycobacterium avium subsp. paratuberculosis
agcugcgcgccccggc

SEQ ID NO: 2871924 - RNA, 21 nt, Mycobacterium avium subsp. paratuberculosis
agcugcgcgccccggcccggc

SEQ ID NO: 2871925 - RNA, 22 nt, Mycobacterium avium subsp. paratuberculosis
agcugcgcgccccggcccggcg

SEQ ID NO: 2871926 - RNA, 14 nt, Mycobacterium avium subsp. paratuberculosis
agcugcgcgccggc

SEQ ID NO: 2871927 - RNA, 18 nt, Mycobacterium avium subsp. paratuberculosis
agcugcgcgccggcggcc

SEQ ID NO: 2871928 - RNA, 14 nt, Mycobacterium avium subsp. paratuberculosis
agcugcgcgucgaa

SEQ ID NO: 2871929 - RNA, 18 nt, Mycobacterium avium subsp. paratuberculosis
agcugcgggaccagcgcc

SEQ ID NO: 2871930 - RNA, 23 nt, Mycobacterium avium subsp. paratuberculosis
agcugcgggaccagcgccucggc

SEQ ID NO: 2871931 - RNA, 19 nt, Mycobacterium avium subsp. paratuberculosis
agcugcgggugcucagccu

SEQ ID NO: 2871932 - RNA, 16 nt, Mycobacterium avium subsp. paratuberculosis
agcugcggguugcggg

SEQ ID NO: 2871933 - RNA, 18 nt, Mycobacterium avium subsp. paratuberculosis
agcugcggguugcgggcc

SEQ ID NO: 2871934 - RNA, 14 nt, Mycobacterium avium subsp. paratuberculosis
agcugcgucggcac

SEQ ID NO: 2871935 - RNA, 15 nt, Mycobacterium avium subsp. paratuberculosis
agcugcgucggcacc

SEQ ID NO: 2871936 - RNA, 21 nt, Mycobacterium avium subsp. paratuberculosis
agcugcgucggcaccagcggc

SEQ ID NO: 2871937 - RNA, 22 nt, Mycobacterium avium subsp. paratuberculosis
agcugcgucggcaccagcggca

SEQ ID NO: 2871938 - RNA, 22 nt, Mycobacterium avium subsp. paratuberculosis
agcugcuccgggggcaccgcca

SEQ ID NO: 2871939 - RNA, 14 nt, Mycobacterium avium subsp. paratuberculosis
agcugcucggccac

SEQ ID NO: 2871940 - RNA, 15 nt, Mycobacterium avium subsp. paratuberculosis
agcugcucggccacc

SEQ ID NO: 2871941 - RNA, 17 nt, Mycobacterium avium subsp. paratuberculosis
agcugcucggccaccgc

SEQ ID NO: 2871942 - RNA, 19 nt, Mycobacterium avium subsp. paratuberculosis
agcugcucggccaccgcgc

SEQ ID NO: 2871943 - RNA, 14 nt, Mycobacterium avium subsp. paratuberculosis
agcugcugaugcgg

SEQ ID NO: 2871944 - RNA, 15 nt, Mycobacterium avium subsp. paratuberculosis
agcugcugccgccgc

SEQ ID NO: 2871945 - RNA, 22 nt, Mycobacterium avium subsp. paratuberculosis
agcugcugccgccgcagcagcc

SEQ ID NO: 2871946 - RNA, 15 nt, Mycobacterium avium subsp. paratuberculosis
agcugcugcgcggcg

SEQ ID NO: 2871947 - RNA, 22 nt, Mycobacterium avium subsp. paratuberculosis
agcugcugcgcggcggcggcgc

SEQ ID NO: 2871948 - RNA, 15 nt, Mycobacterium avium subsp. paratuberculosis
agcugcuggcgugaa

SEQ ID NO: 2871949 - RNA, 17 nt, Mycobacterium avium subsp. paratuberculosis
agcugcuggcugcggcc

SEQ ID NO: 2871950 - RNA, 18 nt, Mycobacterium avium subsp. paratuberculosis
agcugcuucgucgccggg

SEQ ID NO: 2871951 - RNA, 19 nt, Mycobacterium avium subsp. paratuberculosis
agcugcuucgucgccgggc

SEQ ID NO: 2871952 - RNA, 20 nt, Mycobacterium avium subsp. paratuberculosis
agcugcuucgucgccgggcu

SEQ ID NO: 2871953 - RNA, 21 nt, Mycobacterium avium subsp. paratuberculosis
agcuggaacaccacggccggc

SEQ ID NO: 2871954 - RNA, 18 nt, Mycobacterium avium subsp. paratuberculosis
agcuggagaggcccggca

SEQ ID NO: 2871955 - RNA, 19 nt, Mycobacterium avium subsp. paratuberculosis
agcuggagaggcccggcag

SEQ ID NO: 2871956 - RNA, 14 nt, Mycobacterium avium subsp. paratuberculosis
agcuggauggcgcc

SEQ ID NO: 2871957 - RNA, 12 nt, Mycobacterium avium subsp. paratuberculosis
agcuggccaccg

SEQ ID NO: 2871958 - RNA, 19 nt, Mycobacterium avium subsp. paratuberculosis
agcuggccaccgcaucgcc

SEQ ID NO: 2871959 - RNA, 12 nt, Mycobacterium avium subsp. paratuberculosis
agcuggccgccc

SEQ ID NO: 2871960 - RNA, 14 nt, Mycobacterium avium subsp. paratuberculosis
agcuggccgcccac

SEQ ID NO: 2871961 - RNA, 16 nt, Mycobacterium avium subsp. paratuberculosis
agcuggccgcccacca

SEQ ID NO: 2871962 - RNA, 14 nt, Mycobacterium avium subsp. paratuberculosis
agcuggccgcgcag

SEQ ID NO: 2871963 - RNA, 15 nt, Mycobacterium avium subsp. paratuberculosis
agcuggccgcgcagc

SEQ ID NO: 2871964 - RNA, 16 nt, Mycobacterium avium subsp. paratuberculosis
agcuggccgugcaccg

SEQ ID NO: 2871965 - RNA, 12 nt, Mycobacterium avium subsp. paratuberculosis
agcuggcgccga

SEQ ID NO: 2871966 - RNA, 24 nt, Mycobacterium avium subsp. paratuberculosis
agcuggcgccgaacagaugccugc

SEQ ID NO: 2871967 - RNA, 23 nt, Mycobacterium avium subsp. paratuberculosis
agcuggcggucgcugaccccgcu

SEQ ID NO: 2871968 - RNA, 18 nt, Mycobacterium avium subsp. paratuberculosis
agcugggacagcgucacc

SEQ ID NO: 2871969 - RNA, 12 nt, Mycobacterium avium subsp. paratuberculosis
agcugggccagc

SEQ ID NO: 2871970 - RNA, 21 nt, Mycobacterium avium subsp. paratuberculosis
agcugggccccuccagccgcc

SEQ ID NO: 2871971 - RNA, 23 nt, Mycobacterium avium subsp. paratuberculosis
agcugggccccuccagccgccgg

SEQ ID NO: 2871972 - RNA, 15 nt, Mycobacterium avium subsp. paratuberculosis
agcugggcgcccaga

SEQ ID NO: 2871973 - RNA, 16 nt, Mycobacterium avium subsp. paratuberculosis
agcugggcggcgcgcu

SEQ ID NO: 2871974 - RNA, 22 nt, Mycobacterium avium subsp. paratuberculosis
agcuggguggucaccagcgcgg

SEQ ID NO: 2871975 - RNA, 23 nt, Mycobacterium avium subsp. paratuberculosis
agcuggguggucaccagcgcggu

SEQ ID NO: 2871976 - RNA, 17 nt, Mycobacterium avium subsp. paratuberculosis
agcugguagaugguggc

SEQ ID NO: 2871977 - RNA, 18 nt, Mycobacterium avium subsp. paratuberculosis
agcugguagaugguggcc

SEQ ID NO: 2871978 - RNA, 23 nt, Mycobacterium avium subsp. paratuberculosis
agcugguagaugguggccgucgg

SEQ ID NO: 2871979 - RNA, 14 nt, Mycobacterium avium subsp. paratuberculosis
agcugguccggccg

SEQ ID NO: 2871980 - RNA, 16 nt, Mycobacterium avium subsp. paratuberculosis
agcugguccggccggc

SEQ ID NO: 2871981 - RNA, 18 nt, Mycobacterium avium subsp. paratuberculosis
agcugguccggccggccg

SEQ ID NO: 2871982 - RNA, 22 nt, Mycobacterium avium subsp. paratuberculosis
agcuggucgccaaacugcgcaa

SEQ ID NO: 2871983 - RNA, 15 nt, Mycobacterium avium subsp. paratuberculosis
agcuggugcgcagcc

SEQ ID NO: 2871984 - RNA, 16 nt, Mycobacterium avium subsp. paratuberculosis
agcuggugcgcagccc

SEQ ID NO: 2871985 - RNA, 20 nt, Mycobacterium avium subsp. paratuberculosis
agcuggugcgcagcccgccg

SEQ ID NO: 2871986 - RNA, 17 nt, Mycobacterium avium subsp. paratuberculosis
agcuggugggccaucgc

SEQ ID NO: 2871987 - RNA, 22 nt, Mycobacterium avium subsp. paratuberculosis
agcuggugggccaucgccagga

SEQ ID NO: 2871988 - RNA, 22 nt, Mycobacterium avium subsp. paratuberculosis
agcugguggugaucggccaggc

SEQ ID NO: 2871989 - RNA, 21 nt, Mycobacterium avium subsp. paratuberculosis
agcugguugagugugaagacc

SEQ ID NO: 2871990 - RNA, 21 nt, Mycobacterium avium subsp. paratuberculosis
agcugucccagugcgugaccu

SEQ ID NO: 2871991 - RNA, 21 nt, Mycobacterium avium subsp. paratuberculosis
agcugucgccgagguccucga

SEQ ID NO: 2871992 - RNA, 23 nt, Mycobacterium avium subsp. paratuberculosis
agcugucgccgagguccucgacc

SEQ ID NO: 2871993 - RNA, 14 nt, Mycobacterium avium subsp. paratuberculosis
agcugugccgcggu

SEQ ID NO: 2871994 - RNA, 15 nt, Mycobacterium avium subsp. paratuberculosis
agcugugccgcggug

SEQ ID NO: 2871995 - RNA, 19 nt, Mycobacterium avium subsp. paratuberculosis
agcugugccgcggugcggc

SEQ ID NO: 2871996 - RNA, 12 nt, Mycobacterium avium subsp. paratuberculosis
agcuucaccggu

SEQ ID NO: 2871997 - RNA, 12 nt, Mycobacterium avium subsp. paratuberculosis
agcuucacgcuc

SEQ ID NO: 2871998 - RNA, 21 nt, Mycobacterium avium subsp. paratuberculosis
agcuucacguucggcgaguga

SEQ ID NO: 2871999 - RNA, 13 nt, Mycobacterium avium subsp. paratuberculosis
agcuucccggcgg

SEQ ID NO: 2872000 - RNA, 13 nt, Mycobacterium avium subsp. paratuberculosis
agcuucccuugcc

SEQ ID NO: 2872001 - RNA, 14 nt, Mycobacterium avium subsp. paratuberculosis
agcuuccgccgagu

SEQ ID NO: 2872002 - RNA, 15 nt, Mycobacterium avium subsp. paratuberculosis
agcuucggcgccgag

SEQ ID NO: 2872003 - RNA, 16 nt, Mycobacterium avium subsp. paratuberculosis
agcuucgugucaccgc

SEQ ID NO: 2872004 - RNA, 18 nt, Mycobacterium avium subsp. paratuberculosis
agcuucgugucaccgccc

SEQ ID NO: 2872005 - RNA, 22 nt, Mycobacterium avium subsp. paratuberculosis
agcuucgugucaccgcccacga

SEQ ID NO: 2872006 - RNA, 16 nt, Mycobacterium avium subsp. paratuberculosis
agcuucucggugauca

SEQ ID NO: 2872007 - RNA, 21 nt, Mycobacterium avium subsp. paratuberculosis
agcuucugcccggccagcagg

SEQ ID NO: 2872008 - RNA, 13 nt, Mycobacterium avium subsp. paratuberculosis
agcuugaccaccc

SEQ ID NO: 2872009 - RNA, 14 nt, Mycobacterium avium subsp. paratuberculosis
agcuugagccccgc

SEQ ID NO: 2872010 - RNA, 21 nt, Mycobacterium avium subsp. paratuberculosis
agcuugauguugccgugcugg

SEQ ID NO: 2872011 - RNA, 13 nt, Mycobacterium avium subsp. paratuberculosis
agcuugcagcugu

SEQ ID NO: 2872012 - RNA, 23 nt, Mycobacterium avium subsp. paratuberculosis
agcuugcucuucaggaacccgaa

SEQ ID NO: 2872013 - RNA, 22 nt, Mycobacterium avium subsp. paratuberculosis
agcuuggcaaggagguggucga

SEQ ID NO: 2872014 - RNA, 15 nt, Mycobacterium avium subsp. paratuberculosis
agcuuggcgcagccg

SEQ ID NO: 2872015 - RNA, 17 nt, Mycobacterium avium subsp. paratuberculosis
agcuuggcgcccuugcc

SEQ ID NO: 2872016 - RNA, 21 nt, Mycobacterium avium subsp. paratuberculosis
agcuugggccggugcagcacg

SEQ ID NO: 2872017 - RNA, 17 nt, Mycobacterium avium subsp. paratuberculosis
agcuugggggccgacgc

SEQ ID NO: 2872018 - RNA, 16 nt, Mycobacterium avium subsp. paratuberculosis
agcuuguccugcaccg

SEQ ID NO: 2872019 - RNA, 18 nt, Mycobacterium avium subsp. paratuberculosis
aggaaagcgucacaguga

SEQ ID NO: 2872020 - RNA, 15 nt, Mycobacterium avium subsp. paratuberculosis
aggaacaaccgcagc

SEQ ID NO: 2872021 - RNA, 22 nt, Mycobacterium avium subsp. paratuberculosis
acggcaggucggugcgcggggu

SEQ ID NO: 2872022 - RNA, 22 nt, Mycobacterium avium subsp. paratuberculosis
acggcaguaucuuguucgccga

SEQ ID NO: 2872023 - RNA, 15 nt, Mycobacterium avium subsp. paratuberculosis
acggcaucgauggcg

SEQ ID NO: 2872024 - RNA, 18 nt, Mycobacterium avium subsp. paratuberculosis
acggcaucgauggcgggc

SEQ ID NO: 2872025 - RNA, 19 nt, Mycobacterium avium subsp. paratuberculosis
acggcaucgauggcgggcg

SEQ ID NO: 2872026 - RNA, 18 nt, Mycobacterium avium subsp. paratuberculosis
acggcaucggcgcccucg

SEQ ID NO: 2872027 - RNA, 11 nt, Mycobacterium avium subsp. paratuberculosis
acggcaugccg

SEQ ID NO: 2872028 - RNA, 18 nt, Mycobacterium avium subsp. paratuberculosis
acggcaugccgggccagc

SEQ ID NO: 2872029 - RNA, 23 nt, Mycobacterium avium subsp. paratuberculosis
acggcaugccgggccagccggcc

SEQ ID NO: 2872030 - RNA, 12 nt, Mycobacterium avium subsp. paratuberculosis
acggcaugguga

SEQ ID NO: 2872031 - RNA, 16 nt, Mycobacterium avium subsp. paratuberculosis
acggcaugucggugga

SEQ ID NO: 2872032 - RNA, 17 nt, Mycobacterium avium subsp. paratuberculosis
acggccaaccgcccggc

SEQ ID NO: 2872033 - RNA, 20 nt, Mycobacterium avium subsp. paratuberculosis
acggccaaccgcccggcgcc

SEQ ID NO: 2872034 - RNA, 17 nt, Mycobacterium avium subsp. paratuberculosis
acggccaacugcaucgc

SEQ ID NO: 2872035 - RNA, 13 nt, Mycobacterium avium subsp. paratuberculosis
acggccaccagca

SEQ ID NO: 2872036 - RNA, 16 nt, Mycobacterium avium subsp. paratuberculosis
acggccaccagcagcg

SEQ ID NO: 2872037 - RNA, 20 nt, Mycobacterium avium subsp. paratuberculosis
acggccaccagcagcgagac

SEQ ID NO: 2872038 - RNA, 23 nt, Mycobacterium avium subsp. paratuberculosis
acggccaccagcagcgagaccgg

SEQ ID NO: 2872039 - RNA, 14 nt, Mycobacterium avium subsp. paratuberculosis
acggccaccgcgac

SEQ ID NO: 2872040 - RNA, 18 nt, Mycobacterium avium subsp. paratuberculosis
acggccaccgcgacgcug

SEQ ID NO: 2872041 - RNA, 16 nt, Mycobacterium avium subsp. paratuberculosis
acggccaccuugucgg

SEQ ID NO: 2872042 - RNA, 18 nt, Mycobacterium avium subsp. paratuberculosis
acggccaccuugucggcg

SEQ ID NO: 2872043 - RNA, 19 nt, Mycobacterium avium subsp. paratuberculosis
acggccaccuugucggcgc

SEQ ID NO: 2872044 - RNA, 20 nt, Mycobacterium avium subsp. paratuberculosis
acggccaccuugucggcgcc

SEQ ID NO: 2872045 - RNA, 17 nt, Mycobacterium avium subsp. paratuberculosis
acggccacugccccggc

SEQ ID NO: 2872046 - RNA, 16 nt, Mycobacterium avium subsp. paratuberculosis
acggccagcaccgcca

SEQ ID NO: 2872047 - RNA, 24 nt, Mycobacterium avium subsp. paratuberculosis
acggccagcaccgccagcgccggc

SEQ ID NO: 2872048 - RNA, 16 nt, Mycobacterium avium subsp. paratuberculosis
acggccagcagcaccg

SEQ ID NO: 2872049 - RNA, 23 nt, Mycobacterium avium subsp. paratuberculosis
acggccagcaggaugaugaccga

SEQ ID NO: 2872050 - RNA, 15 nt, Mycobacterium avium subsp. paratuberculosis
acggccagcagggcg

SEQ ID NO: 2872051 - RNA, 17 nt, Mycobacterium avium subsp. paratuberculosis
acggccagcagggcgcc

SEQ ID NO: 2872052 - RNA, 20 nt, Mycobacterium avium subsp. paratuberculosis
acggccagcagggcgccgac

SEQ ID NO: 2872053 - RNA, 13 nt, Mycobacterium avium subsp. paratuberculosis
acggccagccagc

SEQ ID NO: 2872054 - RNA, 17 nt, Mycobacterium avium subsp. paratuberculosis
acggccagccagccgcc

SEQ ID NO: 2872055 - RNA, 21 nt, Mycobacterium avium subsp. paratuberculosis
acggccagccagccgcccagc

SEQ ID NO: 2872056 - RNA, 15 nt, Mycobacterium avium subsp. paratuberculosis
acggccagcccgucg

SEQ ID NO: 2872057 - RNA, 12 nt, Mycobacterium avium subsp. paratuberculosis
acggccagcgcc

SEQ ID NO: 2872058 - RNA, 15 nt, Mycobacterium avium subsp. paratuberculosis
acggccagcgccguc

SEQ ID NO: 2872059 - RNA, 17 nt, Mycobacterium avium subsp. paratuberculosis
acggccagcgccgucau

SEQ ID NO: 2872060 - RNA, 14 nt, Mycobacterium avium subsp. paratuberculosis
acggccagcgcggc

SEQ ID NO: 2872061 - RNA, 15 nt, Mycobacterium avium subsp. paratuberculosis
acggccagcgcggcg

SEQ ID NO: 2872062 - RNA, 16 nt, Mycobacterium avium subsp. paratuberculosis
acggccagcgcggcgg

SEQ ID NO: 2872063 - RNA, 20 nt, Mycobacterium avium subsp. paratuberculosis
acggccagcugauagccgcc

SEQ ID NO: 2872064 - RNA, 20 nt, Mycobacterium avium subsp. paratuberculosis
acggccaggaagccggcgac

SEQ ID NO: 2872065 - RNA, 21 nt, Mycobacterium avium subsp. paratuberculosis
acggccaggaagccggcgacg

SEQ ID NO: 2872066 - RNA, 23 nt, Mycobacterium avium subsp. paratuberculosis
acggccaggaagccggcgacgac

SEQ ID NO: 2872067 - RNA, 20 nt, Mycobacterium avium subsp. paratuberculosis
acggccaguccaggccgccg

SEQ ID NO: 2872068 - RNA, 14 nt, Mycobacterium avium subsp. paratuberculosis
acggccaugcagac

SEQ ID NO: 2872069 - RNA, 20 nt, Mycobacterium avium subsp. paratuberculosis
acggcccacgucgcgccgau

SEQ ID NO: 2872070 - RNA, 12 nt, Mycobacterium avium subsp. paratuberculosis
acggcccaucac

SEQ ID NO: 2872071 - RNA, 19 nt, Mycobacterium avium subsp. paratuberculosis
acggcccaucaccagcggc

SEQ ID NO: 2872072 - RNA, 16 nt, Mycobacterium avium subsp. paratuberculosis
acggccccagccgccg

SEQ ID NO: 2872073 - RNA, 19 nt, Mycobacterium avium subsp. paratuberculosis
acggccccagccgccgcga

SEQ ID NO: 2872074 - RNA, 16 nt, Mycobacterium avium subsp. paratuberculosis
acggcccgccgccggc

SEQ ID NO: 2872075 - RNA, 18 nt, Mycobacterium avium subsp. paratuberculosis
acggcccgccgccggcgg

SEQ ID NO: 2872076 - RNA, 22 nt, Mycobacterium avium subsp. paratuberculosis
acggcccgccgccggcggcguc

SEQ ID NO: 2872077 - RNA, 14 nt, Mycobacterium avium subsp. paratuberculosis
acggcccgccggag

SEQ ID NO: 2872078 - RNA, 21 nt, Mycobacterium avium subsp. paratuberculosis
acggcccgccggagccgaucg

SEQ ID NO: 2872079 - RNA, 11 nt, Mycobacterium avium subsp. paratuberculosis
acggcccgcgc

SEQ ID NO: 2872080 - RNA, 14 nt, Mycobacterium avium subsp. paratuberculosis
acggcccgcgcccc

SEQ ID NO: 2872081 - RNA, 19 nt, Mycobacterium avium subsp. paratuberculosis
acggcccgcgccccggcgg

SEQ ID NO: 2872082 - RNA, 21 nt, Mycobacterium avium subsp. paratuberculosis
acggcccgcgccccggcggcc

SEQ ID NO: 2872083 - RNA, 22 nt, Mycobacterium avium subsp. paratuberculosis
acggcccgcgccccggcggcca

SEQ ID NO: 2872084 - RNA, 18 nt, Mycobacterium avium subsp. paratuberculosis
acggcccgcggcacgcug

SEQ ID NO: 2872085 - RNA, 22 nt, Mycobacterium avium subsp. paratuberculosis
acggcccgcggcacgcugcgcc

SEQ ID NO: 2872086 - RNA, 17 nt, Mycobacterium avium subsp. paratuberculosis
acggcccggacggagcc

SEQ ID NO: 2872087 - RNA, 21 nt, Mycobacterium avium subsp. paratuberculosis
acggcccggacggagccgugc

SEQ ID NO: 2872088 - RNA, 18 nt, Mycobacterium avium subsp. paratuberculosis
acggcccgggaagccgca

SEQ ID NO: 2872089 - RNA, 13 nt, Mycobacterium avium subsp. paratuberculosis
acggccgacgccc

SEQ ID NO: 2872090 - RNA, 14 nt, Mycobacterium avium subsp. paratuberculosis
acggccgacgccca

SEQ ID NO: 2872091 - RNA, 17 nt, Mycobacterium avium subsp. paratuberculosis
acggccgacgcccagca

SEQ ID NO: 2872092 - RNA, 19 nt, Mycobacterium avium subsp. paratuberculosis
acggccgacgcccagcacc

SEQ ID NO: 2872093 - RNA, 22 nt, Mycobacterium avium subsp. paratuberculosis
acggccgaugcaguuauccaca

SEQ ID NO: 2872094 - RNA, 19 nt, Mycobacterium avium subsp. paratuberculosis
acggccgcaacggcggucg

SEQ ID NO: 2872095 - RNA, 16 nt, Mycobacterium avium subsp. paratuberculosis
acggccgcaccccacc

SEQ ID NO: 2872096 - RNA, 17 nt, Mycobacterium avium subsp. paratuberculosis
acggccgcaccccaccc

SEQ ID NO: 2872097 - RNA, 22 nt, Mycobacterium avium subsp. paratuberculosis
acggccgcaccccacccgcgcg

SEQ ID NO: 2872098 - RNA, 12 nt, Mycobacterium avium subsp. paratuberculosis
acggccgcacgu

SEQ ID NO: 2872099 - RNA, 22 nt, Mycobacterium avium subsp. paratuberculosis
acggccgcacguauccgcgguc

SEQ ID NO: 2872100 - RNA, 15 nt, Mycobacterium avium subsp. paratuberculosis
acggccgcagcgacu

SEQ ID NO: 2872101 - RNA, 16 nt, Mycobacterium avium subsp. paratuberculosis
acggccgccagcagca

SEQ ID NO: 2872102 - RNA, 11 nt, Mycobacterium avium subsp. paratuberculosis
acggccgccga

SEQ ID NO: 2872103 - RNA, 17 nt, Mycobacterium avium subsp. paratuberculosis
acggccgccgaggcgau

SEQ ID NO: 2872104 - RNA, 20 nt, Mycobacterium avium subsp. paratuberculosis
acggccgccgaggcgaugcc

SEQ ID NO: 2872105 - RNA, 20 nt, Mycobacterium avium subsp. paratuberculosis
acggccgccgauuccggccg

SEQ ID NO: 2872106 - RNA, 21 nt, Mycobacterium avium subsp. paratuberculosis
acggccgccgauuccggccgg

SEQ ID NO: 2872107 - RNA, 23 nt, Mycobacterium avium subsp. paratuberculosis
acggccgccgauuccggccggcc

SEQ ID NO: 2872108 - RNA, 14 nt, Mycobacterium avium subsp. paratuberculosis
acggccgccgcgac

SEQ ID NO: 2872109 - RNA, 15 nt, Mycobacterium avium subsp. paratuberculosis
acggccgccgcgacg

SEQ ID NO: 2872110 - RNA, 13 nt, Mycobacterium avium subsp. paratuberculosis
acggccgcgcaga

SEQ ID NO: 2872111 - RNA, 18 nt, Mycobacterium avium subsp. paratuberculosis
acggccgcgcagaucgcc

SEQ ID NO: 2872112 - RNA, 22 nt, Mycobacterium avium subsp. paratuberculosis
acggccgcgcagaucgccagca

SEQ ID NO: 2872113 - RNA, 14 nt, Mycobacterium avium subsp. paratuberculosis
acggccgcgccgaa

SEQ ID NO: 2872114 - RNA, 21 nt, Mycobacterium avium subsp. paratuberculosis
acggccgcgccgaacaccacg

SEQ ID NO: 2872115 - RNA, 22 nt, Mycobacterium avium subsp. paratuberculosis
acggccgcgccguugaccgcgg

SEQ ID NO: 2872116 - RNA, 23 nt, Mycobacterium avium subsp. paratuberculosis
acggccgcgccguugaccgcggc

SEQ ID NO: 2872117 - RNA, 15 nt, Mycobacterium avium subsp. paratuberculosis
acggccgcggccagc

SEQ ID NO: 2872118 - RNA, 16 nt, Mycobacterium avium subsp. paratuberculosis
acggccgcggccagcg

SEQ ID NO: 2872119 - RNA, 14 nt, Mycobacterium avium subsp. paratuberculosis
acggccgcggcccg

SEQ ID NO: 2872120 - RNA, 16 nt, Mycobacterium avium subsp. paratuberculosis
acggccgcggcccggc

SEQ ID NO: 2872121 - RNA, 19 nt, Mycobacterium avium subsp. paratuberculosis
acggccgcggcccggccac

SEQ ID NO: 2872122 - RNA, 20 nt, Mycobacterium avium subsp. paratuberculosis
acggccgcggcccggccacc

SEQ ID NO: 2872123 - RNA, 12 nt, Mycobacterium avium subsp. paratuberculosis
acggccgcggcg

SEQ ID NO: 2872124 - RNA, 13 nt, Mycobacterium avium subsp. paratuberculosis
acggccgcggcgc

SEQ ID NO: 2872125 - RNA, 19 nt, Mycobacterium avium subsp. paratuberculosis
acggccgcggcgcggcccg

SEQ ID NO: 2872126 - RNA, 20 nt, Mycobacterium avium subsp. paratuberculosis
acggccgcggcgcggcccgg

SEQ ID NO: 2872127 - RNA, 20 nt, Mycobacterium avium subsp. paratuberculosis
acggccgcggcggugccggu

SEQ ID NO: 2872128 - RNA, 21 nt, Mycobacterium avium subsp. paratuberculosis
acggccgcggcggugccggug

SEQ ID NO: 2872129 - RNA, 18 nt, Mycobacterium avium subsp. paratuberculosis
acggccggauggccagca

SEQ ID NO: 2872130 - RNA, 12 nt, Mycobacterium avium subsp. paratuberculosis
acggccggccgg

SEQ ID NO: 2872131 - RNA, 18 nt, Mycobacterium avium subsp. paratuberculosis
acggccggccggccgagc

SEQ ID NO: 2872132 - RNA, 14 nt, Mycobacterium avium subsp. paratuberculosis
acggccggcgccgc

SEQ ID NO: 2872133 - RNA, 15 nt, Mycobacterium avium subsp. paratuberculosis
acggccggcgccgcc

SEQ ID NO: 2872134 - RNA, 16 nt, Mycobacterium avium subsp. paratuberculosis
acggccggcgccgccg

SEQ ID NO: 2872135 - RNA, 21 nt, Mycobacterium avium subsp. paratuberculosis
acggccggcgccgccggggcg

SEQ ID NO: 2872136 - RNA, 14 nt, Mycobacterium avium subsp. paratuberculosis
acggccggcgucac

SEQ ID NO: 2872137 - RNA, 18 nt, Mycobacterium avium subsp. paratuberculosis
acggccggggccagcacc

SEQ ID NO: 2872138 - RNA, 22 nt, Mycobacterium avium subsp. paratuberculosis
acggccggggccagcacccaga

SEQ ID NO: 2872139 - RNA, 23 nt, Mycobacterium avium subsp. paratuberculosis
acggccguacgcgguucgugcgc

SEQ ID NO: 2872140 - RNA, 15 nt, Mycobacterium avium subsp. paratuberculosis
acggccguccaggcg

SEQ ID NO: 2872141 - RNA, 16 nt, Mycobacterium avium subsp. paratuberculosis
acggccguccaggcgc

SEQ ID NO: 2872142 - RNA, 16 nt, Mycobacterium avium subsp. paratuberculosis
acggccguccggucgc

SEQ ID NO: 2872143 - RNA, 21 nt, Mycobacterium avium subsp. paratuberculosis
acggccguccggucgcugggc

SEQ ID NO: 2872144 - RNA, 18 nt, Mycobacterium avium subsp. paratuberculosis
acggccgugaugccgggc

SEQ ID NO: 2872145 - RNA, 20 nt, Mycobacterium avium subsp. paratuberculosis
acggccgugaugccgggcaa

SEQ ID NO: 2872146 - RNA, 22 nt, Mycobacterium avium subsp. paratuberculosis
acggccucccacucgucgaucg

SEQ ID NO: 2872147 - RNA, 13 nt, Mycobacterium avium subsp. paratuberculosis
acggccucgauca

SEQ ID NO: 2872148 - RNA, 16 nt, Mycobacterium avium subsp. paratuberculosis
acggccucgaucauca

SEQ ID NO: 2872149 - RNA, 20 nt, Mycobacterium avium subsp. paratuberculosis
acggccucgaucaucaccac

SEQ ID NO: 2872150 - RNA, 22 nt, Mycobacterium avium subsp. paratuberculosis
acggccucgaucaucaccaccg

SEQ ID NO: 2872151 - RNA, 20 nt, Mycobacterium avium subsp. paratuberculosis
acggccucgcccagcgccgc

SEQ ID NO: 2872152 - RNA, 15 nt, Mycobacterium avium subsp. paratuberculosis
acggccucgccgucg

SEQ ID NO: 2872153 - RNA, 16 nt, Mycobacterium avium subsp. paratuberculosis
acggccucgccgucgc

SEQ ID NO: 2872154 - RNA, 16 nt, Mycobacterium avium subsp. paratuberculosis
acggccugcaccacca

SEQ ID NO: 2872155 - RNA, 15 nt, Mycobacterium avium subsp. paratuberculosis
acggcgaacggccgc

SEQ ID NO: 2872156 - RNA, 19 nt, Mycobacterium avium subsp. paratuberculosis
acggcgaacggccgcgaug

SEQ ID NO: 2872157 - RNA, 16 nt, Mycobacterium avium subsp. paratuberculosis
acggcgaacgucgaug

SEQ ID NO: 2872158 - RNA, 17 nt, Mycobacterium avium subsp. paratuberculosis
acggcgaacgucgaugu

SEQ ID NO: 2872159 - RNA, 16 nt, Mycobacterium avium subsp. paratuberculosis
acggcgaacuuggccg

SEQ ID NO: 2872160 - RNA, 14 nt, Mycobacterium avium subsp. paratuberculosis
acggcgaagccggc

SEQ ID NO: 2872161 - RNA, 14 nt, Mycobacterium avium subsp. paratuberculosis
acggcgaauauuuc

SEQ ID NO: 2872162 - RNA, 19 nt, Mycobacterium avium subsp. paratuberculosis
acggcgaauauuucgccga

SEQ ID NO: 2872163 - RNA, 14 nt, Mycobacterium avium subsp. paratuberculosis
acggcgaccacacc

SEQ ID NO: 2872164 - RNA, 21 nt, Mycobacterium avium subsp. paratuberculosis
acggcgaccacaccgucgacg

SEQ ID NO: 2872165 - RNA, 15 nt, Mycobacterium avium subsp. paratuberculosis
acggcgaccagcgag

SEQ ID NO: 2872166 - RNA, 12 nt, Mycobacterium avium subsp. paratuberculosis
acggcgaccccg

SEQ ID NO: 2872167 - RNA, 16 nt, Mycobacterium avium subsp. paratuberculosis
acggcgaccccguucg

SEQ ID NO: 2872168 - RNA, 21 nt, Mycobacterium avium subsp. paratuberculosis
acggcgaccccguucgccgac

SEQ ID NO: 2872169 - RNA, 13 nt, Mycobacterium avium subsp. paratuberculosis
acggcgacgacca

SEQ ID NO: 2872170 - RNA, 20 nt, Mycobacterium avium subsp. paratuberculosis
acggcgacgaccaccaggag

SEQ ID NO: 2872171 - RNA, 17 nt, Mycobacterium avium subsp. paratuberculosis
acggcgacgaccgucau

SEQ ID NO: 2872172 - RNA, 15 nt, Mycobacterium avium subsp. paratuberculosis
acggcgacggcagcg

SEQ ID NO: 2872173 - RNA, 16 nt, Mycobacterium avium subsp. paratuberculosis
acggcgacggcagcgc

SEQ ID NO: 2872174 - RNA, 23 nt, Mycobacterium avium subsp. paratuberculosis
acggcgacggcagcgcgauccgg

SEQ ID NO: 2872175 - RNA, 15 nt, Mycobacterium avium subsp. paratuberculosis
acggcgacggcgucc

SEQ ID NO: 2872176 - RNA, 16 nt, Mycobacterium avium subsp. paratuberculosis
acggcgacggcguccg

SEQ ID NO: 2872177 - RNA, 19 nt, Mycobacterium avium subsp. paratuberculosis
acggcgacggcguccgggc

SEQ ID NO: 2872178 - RNA, 21 nt, Mycobacterium avium subsp. paratuberculosis
acggcgacggcguccgggcgc

SEQ ID NO: 2872179 - RNA, 13 nt, Mycobacterium avium subsp. paratuberculosis
acggcgagccggg

SEQ ID NO: 2872180 - RNA, 14 nt, Mycobacterium avium subsp. paratuberculosis
acggcgagccgggc

SEQ ID NO: 2872181 - RNA, 17 nt, Mycobacterium avium subsp. paratuberculosis
acggcgagccgggccgg

SEQ ID NO: 2872182 - RNA, 14 nt, Mycobacterium avium subsp. paratuberculosis
acggcgagcggccc

SEQ ID NO: 2872183 - RNA, 22 nt, Mycobacterium avium subsp. paratuberculosis
acggcgagcggcccugcgcggc

SEQ ID NO: 2872184 - RNA, 14 nt, Mycobacterium avium subsp. paratuberculosis
acggcgaggauggc

SEQ ID NO: 2872185 - RNA, 22 nt, Mycobacterium avium subsp. paratuberculosis
acggcgaggauggcgaucauca

SEQ ID NO: 2872186 - RNA, 15 nt, Mycobacterium avium subsp. paratuberculosis
acggcgaggucggga

SEQ ID NO: 2872187 - RNA, 14 nt, Mycobacterium avium subsp. paratuberculosis
acggcgauguagga

SEQ ID NO: 2872188 - RNA, 22 nt, Mycobacterium avium subsp. paratuberculosis
acggcgauguaggacgccgcac

SEQ ID NO: 2872189 - RNA, 15 nt, Mycobacterium avium subsp. paratuberculosis
acggcgccaccagcc

SEQ ID NO: 2872190 - RNA, 19 nt, Mycobacterium avium subsp. paratuberculosis
acggcgccaucguggccgc

SEQ ID NO: 2872191 - RNA, 21 nt, Mycobacterium avium subsp. paratuberculosis
acggcgccaucguggccgcgu

SEQ ID NO: 2872192 - RNA, 17 nt, Mycobacterium avium subsp. paratuberculosis
acggcgccaugcgccgc

SEQ ID NO: 2872193 - RNA, 19 nt, Mycobacterium avium subsp. paratuberculosis
acggcgccaugcgccgcgc

SEQ ID NO: 2872194 - RNA, 12 nt, Mycobacterium avium subsp. paratuberculosis
acggcgcccgcc

SEQ ID NO: 2872195 - RNA, 19 nt, Mycobacterium avium subsp. paratuberculosis
acggcgcccgccccgacgu

SEQ ID NO: 2872196 - RNA, 13 nt, Mycobacterium avium subsp. paratuberculosis
acggcgccgacga

SEQ ID NO: 2872197 - RNA, 14 nt, Mycobacterium avium subsp. paratuberculosis
acggcgccgcccgg

SEQ ID NO: 2872198 - RNA, 16 nt, Mycobacterium avium subsp. paratuberculosis
acggcgccgcggccgu

SEQ ID NO: 2872199 - RNA, 13 nt, Mycobacterium avium subsp. paratuberculosis
acggcgccgcguc

SEQ ID NO: 2872200 - RNA, 15 nt, Mycobacterium avium subsp. paratuberculosis
acggcgccgcgucgg

SEQ ID NO: 2872201 - RNA, 13 nt, Mycobacterium avium subsp. paratuberculosis
acggcgccggugc

SEQ ID NO: 2872202 - RNA, 16 nt, Mycobacterium avium subsp. paratuberculosis
acggcgccgugccgcg

SEQ ID NO: 2872203 - RNA, 17 nt, Mycobacterium avium subsp. paratuberculosis
acggcgccgugccgcgc

SEQ ID NO: 2872204 - RNA, 18 nt, Mycobacterium avium subsp. paratuberculosis
acggcgccgugccgcgcg

SEQ ID NO: 2872205 - RNA, 20 nt, Mycobacterium avium subsp. paratuberculosis
acggcgccgugccgcgcggc

SEQ ID NO: 2872206 - RNA, 13 nt, Mycobacterium avium subsp. paratuberculosis
acggcgccgugcg

SEQ ID NO: 2872207 - RNA, 20 nt, Mycobacterium avium subsp. paratuberculosis
acggcgccugauccgcgguc

SEQ ID NO: 2872208 - RNA, 23 nt, Mycobacterium avium subsp. paratuberculosis
acggcgccugauccgcggucaga

SEQ ID NO: 2872209 - RNA, 19 nt, Mycobacterium avium subsp. paratuberculosis
acggcgcgaaccgggccag

SEQ ID NO: 2872210 - RNA, 23 nt, Mycobacterium avium subsp. paratuberculosis
acggcgcgaaccgggccaggaug

SEQ ID NO: 2872211 - RNA, 14 nt, Mycobacterium avium subsp. paratuberculosis
acggcgcgcaccgc

SEQ ID NO: 2872212 - RNA, 18 nt, Mycobacterium avium subsp. paratuberculosis
acggcgcgcaccgcgggc

SEQ ID NO: 2872213 - RNA, 21 nt, Mycobacterium avium subsp. paratuberculosis
acggcgcgcaccgcgggcagc

SEQ ID NO: 2872214 - RNA, 20 nt, Mycobacterium avium subsp. paratuberculosis
acggcgcgguggcgugcagc

SEQ ID NO: 2872215 - RNA, 21 nt, Mycobacterium avium subsp. paratuberculosis
acggcgcgucguagucgcucg

SEQ ID NO: 2872216 - RNA, 23 nt, Mycobacterium avium subsp. paratuberculosis
acggcgcgucguagucgcucggc

SEQ ID NO: 2872217 - RNA, 16 nt, Mycobacterium avium subsp. paratuberculosis
acggcgcucaccggcg

SEQ ID NO: 2872218 - RNA, 20 nt, Mycobacterium avium subsp. paratuberculosis
acggcgcuggccgcggccag

SEQ ID NO: 2872219 - RNA, 23 nt, Mycobacterium avium subsp. paratuberculosis
acggcgcuggcgaccaucagccu

SEQ ID NO: 2872220 - RNA, 19 nt, Mycobacterium avium subsp. paratuberculosis
acggcgcuguggccguuga

SEQ ID NO: 2872221 - RNA, 16 nt, Mycobacterium avium subsp. paratuberculosis
acggcggaaccgggcc

SEQ ID NO: 2872222 - RNA, 14 nt, Mycobacterium avium subsp. paratuberculosis
acggcggaccggcg

SEQ ID NO: 2872223 - RNA, 22 nt, Mycobacterium avium subsp. paratuberculosis
acggcggaccggcggccgccau

SEQ ID NO: 2872224 - RNA, 13 nt, Mycobacterium avium subsp. paratuberculosis
acggcggcagcga

SEQ ID NO: 2872225 - RNA, 16 nt, Mycobacterium avium subsp. paratuberculosis
acggcggcagcgaggc

SEQ ID NO: 2872226 - RNA, 23 nt, Mycobacterium avium subsp. paratuberculosis
acggcggcagcgaggcgcgcagg

SEQ ID NO: 2872227 - RNA, 14 nt, Mycobacterium avium subsp. paratuberculosis
acggcggcagcgcg

SEQ ID NO: 2872228 - RNA, 14 nt, Mycobacterium avium subsp. paratuberculosis
acggcggccgcgga

SEQ ID NO: 2872229 - RNA, 18 nt, Mycobacterium avium subsp. paratuberculosis
acggcggccgcggacccg

SEQ ID NO: 2872230 - RNA, 20 nt, Mycobacterium avium subsp. paratuberculosis
acggcggccgcggacccgac

SEQ ID NO: 2872231 - RNA, 22 nt, Mycobacterium avium subsp. paratuberculosis
acggcggccgucuugcccggcg

SEQ ID NO: 2872232 - RNA, 19 nt, Mycobacterium avium subsp. paratuberculosis
acggcggcgaacgccgccg

SEQ ID NO: 2872233 - RNA, 20 nt, Mycobacterium avium subsp. paratuberculosis
acggcggcgaagacgucggc

SEQ ID NO: 2872234 - RNA, 22 nt, Mycobacterium avium subsp. paratuberculosis
acggcggcgaagacgucggcgc

SEQ ID NO: 2872235 - RNA, 20 nt, Mycobacterium avium subsp. paratuberculosis
acggcggcgaguucggcggc

SEQ ID NO: 2872236 - RNA, 23 nt, Mycobacterium avium subsp. paratuberculosis
acggcggcgcgggcggcgucggc

SEQ ID NO: 2872237 - RNA, 17 nt, Mycobacterium avium subsp. paratuberculosis
acggcggcgcugaugcc

SEQ ID NO: 2872238 - RNA, 19 nt, Mycobacterium avium subsp. paratuberculosis
acggcggcgcugaugccgu

SEQ ID NO: 2872239 - RNA, 14 nt, Mycobacterium avium subsp. paratuberculosis
acggcggcggcacc

SEQ ID NO: 2872240 - RNA, 14 nt, Mycobacterium avium subsp. paratuberculosis
acggcggcggugcc

SEQ ID NO: 2872241 - RNA, 20 nt, Mycobacterium avium subsp. paratuberculosis
acggcggcggugccgcaggc

SEQ ID NO: 2872242 - RNA, 21 nt, Mycobacterium avium subsp. paratuberculosis
acggcggcgugcaccgcccgc

SEQ ID NO: 2872243 - RNA, 23 nt, Mycobacterium avium subsp. paratuberculosis
acggcggcgugcaccgcccgcgc

SEQ ID NO: 2872244 - RNA, 21 nt, Mycobacterium avium subsp. paratuberculosis
acggcggcucgggggugucgu

SEQ ID NO: 2872245 - RNA, 15 nt, Mycobacterium avium subsp. paratuberculosis
acggcgggcccgucg

SEQ ID NO: 2872246 - RNA, 19 nt, Mycobacterium avium subsp. paratuberculosis
acggcgggcccgucgccgg

SEQ ID NO: 2872247 - RNA, 20 nt, Mycobacterium avium subsp. paratuberculosis
acggcgggcccgucgccggc

SEQ ID NO: 2872248 - RNA, 23 nt, Mycobacterium avium subsp. paratuberculosis
acggcgggcccgucgccggcgcg

SEQ ID NO: 2872249 - RNA, 13 nt, Mycobacterium avium subsp. paratuberculosis
acggcgggccggc

SEQ ID NO: 2872250 - RNA, 14 nt, Mycobacterium avium subsp. paratuberculosis
acggcgggccggcg

SEQ ID NO: 2872251 - RNA, 17 nt, Mycobacterium avium subsp. paratuberculosis
acggcgggccggcgccg

SEQ ID NO: 2872252 - RNA, 18 nt, Mycobacterium avium subsp. paratuberculosis
acggcgggccggcgccgg

SEQ ID NO: 2872253 - RNA, 19 nt, Mycobacterium avium subsp. paratuberculosis
acggcgggccggcgccggu

SEQ ID NO: 2872254 - RNA, 20 nt, Mycobacterium avium subsp. paratuberculosis
acggcgggccggcgccggug

SEQ ID NO: 2872255 - RNA, 18 nt, Mycobacterium avium subsp. paratuberculosis
acggcggggaugcccggg

SEQ ID NO: 2872256 - RNA, 22 nt, Mycobacterium avium subsp. paratuberculosis
acggcggggaugcccgggggau

SEQ ID NO: 2872257 - RNA, 12 nt, Mycobacterium avium subsp. paratuberculosis
acggcggggccu

SEQ ID NO: 2872258 - RNA, 23 nt, Mycobacterium avium subsp. paratuberculosis
acggcggggccuccaccagcggc

SEQ ID NO: 2872259 - RNA, 17 nt, Mycobacterium avium subsp. paratuberculosis
acggcggggugcgcggc

SEQ ID NO: 2872260 - RNA, 16 nt, Mycobacterium avium subsp. paratuberculosis
acggcgggugcgacgg

SEQ ID NO: 2872261 - RNA, 18 nt, Mycobacterium avium subsp. paratuberculosis
acggcgggugcgacggca

SEQ ID NO: 2872262 - RNA, 23 nt, Mycobacterium avium subsp. paratuberculosis
acggcgggugggggucuggucgg

SEQ ID NO: 2872263 - RNA, 14 nt, Mycobacterium avium subsp. paratuberculosis
acggcggucgugcg

SEQ ID NO: 2872264 - RNA, 21 nt, Mycobacterium avium subsp. paratuberculosis
acggcggucgugcggcugccc

SEQ ID NO: 2872265 - RNA, 19 nt, Mycobacterium avium subsp. paratuberculosis
acggcggugacguuccagc

SEQ ID NO: 2872266 - RNA, 17 nt, Mycobacterium avium subsp. paratuberculosis
acggcggugggcucggc

SEQ ID NO: 2872267 - RNA, 18 nt, Mycobacterium avium subsp. paratuberculosis
acggcggugggcucggcc

SEQ ID NO: 2872268 - RNA, 21 nt, Mycobacterium avium subsp. paratuberculosis
acggcggugggcucggccauc

SEQ ID NO: 2872269 - RNA, 20 nt, Mycobacterium avium subsp. paratuberculosis
acggcguccagcugcgcgcc

SEQ ID NO: 2872270 - RNA, 12 nt, Mycobacterium avium subsp. paratuberculosis
acggcgucgaca

SEQ ID NO: 2872271 - RNA, 13 nt, Mycobacterium avium subsp. paratuberculosis
acggcgucgacac

SEQ ID NO: 2872272 - RNA, 16 nt, Mycobacterium avium subsp. paratuberculosis
acggcgucgacacccg

SEQ ID NO: 2872273 - RNA, 22 nt, Mycobacterium avium subsp. paratuberculosis
acggcgucgcugaacgcgucgu

SEQ ID NO: 2872274 - RNA, 13 nt, Mycobacterium avium subsp. paratuberculosis
acggcgucggcga

SEQ ID NO: 2872275 - RNA, 17 nt, Mycobacterium avium subsp. paratuberculosis
acggcgucggcggccug

SEQ ID NO: 2872276 - RNA, 19 nt, Mycobacterium avium subsp. paratuberculosis
acggcgucggcggccugcu

SEQ ID NO: 2872277 - RNA, 20 nt, Mycobacterium avium subsp. paratuberculosis
acggcgucggcgucgggcgg

SEQ ID NO: 2872278 - RNA, 14 nt, Mycobacterium avium subsp. paratuberculosis
acggcgucuggccg

SEQ ID NO: 2872279 - RNA, 16 nt, Mycobacterium avium subsp. paratuberculosis
acggcgucuggccgga

SEQ ID NO: 2872280 - RNA, 20 nt, Mycobacterium avium subsp. paratuberculosis
acggcgucuggccggagcgg

SEQ ID NO: 2872281 - RNA, 22 nt, Mycobacterium avium subsp. paratuberculosis
acggcgucuggccggagcggug

SEQ ID NO: 2872282 - RNA, 18 nt, Mycobacterium avium subsp. paratuberculosis
acggcguugaccaacgcc

SEQ ID NO: 2872283 - RNA, 20 nt, Mycobacterium avium subsp. paratuberculosis
acggcguugaccaacgccgc

SEQ ID NO: 2872284 - RNA, 23 nt, Mycobacterium avium subsp. paratuberculosis
acggcguugaccaacgccgccuc

SEQ ID NO: 2872285 - RNA, 14 nt, Mycobacterium avium subsp. paratuberculosis
acggcguugaccgg

SEQ ID NO: 2872286 - RNA, 15 nt, Mycobacterium avium subsp. paratuberculosis
acggcguugaccggg

SEQ ID NO: 2872287 - RNA, 19 nt, Mycobacterium avium subsp. paratuberculosis
acggcguugaccgggccgc

SEQ ID NO: 2872288 - RNA, 19 nt, Mycobacterium avium subsp. paratuberculosis
acggcuaccuaggcgucgu

SEQ ID NO: 2872289 - RNA, 21 nt, Mycobacterium avium subsp. paratuberculosis
acggcuaccuaggcgucgucg

SEQ ID NO: 2872290 - RNA, 20 nt, Mycobacterium avium subsp. paratuberculosis
acggcuaccugaccagcggc

SEQ ID NO: 2872291 - RNA, 14 nt, Mycobacterium avium subsp. paratuberculosis
acggcuacuucuuc

SEQ ID NO: 2872292 - RNA, 14 nt, Mycobacterium avium subsp. paratuberculosis
acggcucaacggcc

SEQ ID NO: 2872293 - RNA, 17 nt, Mycobacterium avium subsp. paratuberculosis
acggcucaacggccggc

SEQ ID NO: 2872294 - RNA, 19 nt, Mycobacterium avium subsp. paratuberculosis
acggcucaacggccggcgc

SEQ ID NO: 2872295 - RNA, 20 nt, Mycobacterium avium subsp. paratuberculosis
acggcucaacggccggcgcc

SEQ ID NO: 2872296 - RNA, 14 nt, Mycobacterium avium subsp. paratuberculosis
acggcucccaggcc

SEQ ID NO: 2872297 - RNA, 19 nt, Mycobacterium avium subsp. paratuberculosis
acggcucccaggcccaucg

SEQ ID NO: 2872298 - RNA, 18 nt, Mycobacterium avium subsp. paratuberculosis
acggcucggucaagccgg

SEQ ID NO: 2872299 - RNA, 16 nt, Mycobacterium avium subsp. paratuberculosis
acggcucuucgcggcg

SEQ ID NO: 2872300 - RNA, 18 nt, Mycobacterium avium subsp. paratuberculosis
acggcucuucgcggcggg

SEQ ID NO: 2872301 - RNA, 19 nt, Mycobacterium avium subsp. paratuberculosis
acggcucuucggcgccgag

SEQ ID NO: 2872302 - RNA, 17 nt, Mycobacterium avium subsp. paratuberculosis
acggcugcccggcccgc

SEQ ID NO: 2872303 - RNA, 18 nt, Mycobacterium avium subsp. paratuberculosis
acggcugcccggcccgcc

SEQ ID NO: 2872304 - RNA, 16 nt, Mycobacterium avium subsp. paratuberculosis
acggcugccgaccucg

SEQ ID NO: 2872305 - RNA, 21 nt, Mycobacterium avium subsp. paratuberculosis
acggcugcgguuggccggccg

SEQ ID NO: 2872306 - RNA, 16 nt, Mycobacterium avium subsp. paratuberculosis
acggcugcugcgcggc

SEQ ID NO: 2872307 - RNA, 22 nt, Mycobacterium avium subsp. paratuberculosis
acggcuggcgcaggugugcggc

SEQ ID NO: 2872308 - RNA, 15 nt, Mycobacterium avium subsp. paratuberculosis
acggcuuccgcggac

SEQ ID NO: 2872309 - RNA, 17 nt, Mycobacterium avium subsp. paratuberculosis
acggcuuccgcggacgg

SEQ ID NO: 2872310 - RNA, 21 nt, Mycobacterium avium subsp. paratuberculosis
acggcuugaugaugcugucgg

SEQ ID NO: 2872311 - RNA, 17 nt, Mycobacterium avium subsp. paratuberculosis
acggcuugcgcucggcc

SEQ ID NO: 2872312 - RNA, 18 nt, Mycobacterium avium subsp. paratuberculosis
acggcuugcgcucggccg

SEQ ID NO: 2872313 - RNA, 22 nt, Mycobacterium avium subsp. paratuberculosis
acggcuuuggugacgccgacgu

SEQ ID NO: 2872314 - RNA, 23 nt, Mycobacterium avium subsp. paratuberculosis
acggcuuuggugacgccgacgua

SEQ ID NO: 2872315 - RNA, 15 nt, Mycobacterium avium subsp. paratuberculosis
acgggaagagcggcg

SEQ ID NO: 2872316 - RNA, 13 nt, Mycobacterium avium subsp. paratuberculosis
acgggaagaucgc

SEQ ID NO: 2872317 - RNA, 20 nt, Mycobacterium avium subsp. paratuberculosis
acgggaccacccgcagcgcg

SEQ ID NO: 2872318 - RNA, 23 nt, Mycobacterium avium subsp. paratuberculosis
acgggaccacccgcagcgcggcg

SEQ ID NO: 2872319 - RNA, 14 nt, Mycobacterium avium subsp. paratuberculosis
acgggaccgcacgc

SEQ ID NO: 2872320 - RNA, 15 nt, Mycobacterium avium subsp. paratuberculosis
acgggaccgcacgcc

SEQ ID NO: 2872321 - RNA, 19 nt, Mycobacterium avium subsp. paratuberculosis
acgggaccgcacgccgggu

SEQ ID NO: 2872322 - RNA, 13 nt, Mycobacterium avium subsp. paratuberculosis
acgggagacgcug

SEQ ID NO: 2872323 - RNA, 13 nt, Mycobacterium avium subsp. paratuberculosis
acgggauaugcgc

SEQ ID NO: 2872324 - RNA, 17 nt, Mycobacterium avium subsp. paratuberculosis
acgggauaugcgccugc

SEQ ID NO: 2872325 - RNA, 13 nt, Mycobacterium avium subsp. paratuberculosis
acgggaucggcgc

SEQ ID NO: 2872326 - RNA, 19 nt, Mycobacterium avium subsp. paratuberculosis
acgggaucggcgcgucggc

SEQ ID NO: 2872327 - RNA, 22 nt, Mycobacterium avium subsp. paratuberculosis
acgggaugaacucgugcggcgc

SEQ ID NO: 2872328 - RNA, 13 nt, Mycobacterium avium subsp. paratuberculosis
acgggaugaucgg

SEQ ID NO: 2872329 - RNA, 17 nt, Mycobacterium avium subsp. paratuberculosis
acgggaugaucggcgcc

SEQ ID NO: 2872330 - RNA, 16 nt, Mycobacterium avium subsp. paratuberculosis
acgggaugcggcacgc

SEQ ID NO: 2872331 - RNA, 18 nt, Mycobacterium avium subsp. paratuberculosis
acgggauggagccgccca

SEQ ID NO: 2872332 - RNA, 15 nt, Mycobacterium avium subsp. paratuberculosis
acgggauggcucagc

SEQ ID NO: 2872333 - RNA, 16 nt, Mycobacterium avium subsp. paratuberculosis
acgggcacaccgucgu

SEQ ID NO: 2872334 - RNA, 18 nt, Mycobacterium avium subsp. paratuberculosis
acgggcacaccgucgucc

SEQ ID NO: 2872335 - RNA, 15 nt, Mycobacterium avium subsp. paratuberculosis
acgggcacccgcgcg

SEQ ID NO: 2872336 - RNA, 14 nt, Mycobacterium avium subsp. paratuberculosis
acgggcaccgacga

SEQ ID NO: 2872337 - RNA, 18 nt, Mycobacterium avium subsp. paratuberculosis
acgggcaccgacgaggag

SEQ ID NO: 2872338 - RNA, 23 nt, Mycobacterium avium subsp. paratuberculosis
acgggcagggugaccgaggccgc

SEQ ID NO: 2872339 - RNA, 10 nt, Mycobacterium avium subsp. paratuberculosis
acgggcaucc

SEQ ID NO: 2872340 - RNA, 23 nt, Mycobacterium avium subsp. paratuberculosis
acgggcauccggcucagaaggcg

SEQ ID NO: 2872341 - RNA, 17 nt, Mycobacterium avium subsp. paratuberculosis
acgggcaugccgucggc

SEQ ID NO: 2872342 - RNA, 12 nt, Mycobacterium avium subsp. paratuberculosis
acgggccaggcg

SEQ ID NO: 2872343 - RNA, 13 nt, Mycobacterium avium subsp. paratuberculosis
acgggccaggcgc

SEQ ID NO: 2872344 - RNA, 14 nt, Mycobacterium avium subsp. paratuberculosis
acgggccaggcgcg

SEQ ID NO: 2872345 - RNA, 15 nt, Mycobacterium avium subsp. paratuberculosis
acgggccaggcgcgc

SEQ ID NO: 2872346 - RNA, 17 nt, Mycobacterium avium subsp. paratuberculosis
acgggccaggcgcgcgc

SEQ ID NO: 2872347 - RNA, 14 nt, Mycobacterium avium subsp. paratuberculosis
acgggccauguccc

SEQ ID NO: 2872348 - RNA, 18 nt, Mycobacterium avium subsp. paratuberculosis
acgggccauguccccgac

SEQ ID NO: 2872349 - RNA, 14 nt, Mycobacterium avium subsp. paratuberculosis
acgggcccagcgcg

SEQ ID NO: 2872350 - RNA, 16 nt, Mycobacterium avium subsp. paratuberculosis
acgggcccagcgcgac

SEQ ID NO: 2872351 - RNA, 19 nt, Mycobacterium avium subsp. paratuberculosis
acgggcccagcgcgacguc

SEQ ID NO: 2872352 - RNA, 14 nt, Mycobacterium avium subsp. paratuberculosis
acgggcccgcggga

SEQ ID NO: 2872353 - RNA, 16 nt, Mycobacterium avium subsp. paratuberculosis
acgggcccguccgcga

SEQ ID NO: 2872354 - RNA, 17 nt, Mycobacterium avium subsp. paratuberculosis
acgggcccguccgcgaa

SEQ ID NO: 2872355 - RNA, 15 nt, Mycobacterium avium subsp. paratuberculosis
acgggccgaucacgc

SEQ ID NO: 2872356 - RNA, 22 nt, Mycobacterium avium subsp. paratuberculosis
acgggccgaucacgcggaucgg

SEQ ID NO: 2872357 - RNA, 17 nt, Mycobacterium avium subsp. paratuberculosis
acgggccgcagccgcgc

SEQ ID NO: 2872358 - RNA, 18 nt, Mycobacterium avium subsp. paratuberculosis
acgggccgcagccgcgcg

SEQ ID NO: 2872359 - RNA, 19 nt, Mycobacterium avium subsp. paratuberculosis
acgggccgcagccgcgcgg

SEQ ID NO: 2872360 - RNA, 20 nt, Mycobacterium avium subsp. paratuberculosis
acgggccgcagccgcgcggc

SEQ ID NO: 2872361 - RNA, 21 nt, Mycobacterium avium subsp. paratuberculosis
acgggccgcagccgcgcggcc

SEQ ID NO: 2872362 - RNA, 12 nt, Mycobacterium avium subsp. paratuberculosis
acgggccgcauc

SEQ ID NO: 2872363 - RNA, 18 nt, Mycobacterium avium subsp. paratuberculosis
acgggccgcauccgcgag

SEQ ID NO: 2872364 - RNA, 16 nt, Mycobacterium avium subsp. paratuberculosis
acgggccgccucacgc

SEQ ID NO: 2872365 - RNA, 13 nt, Mycobacterium avium subsp. paratuberculosis
acgggccgcggcc

SEQ ID NO: 2872366 - RNA, 15 nt, Mycobacterium avium subsp. paratuberculosis
acgggccgcggccag

SEQ ID NO: 2872367 - RNA, 14 nt, Mycobacterium avium subsp. paratuberculosis
acgggccggcgggg

SEQ ID NO: 2872368 - RNA, 16 nt, Mycobacterium avium subsp. paratuberculosis
acgggccggcggggug

SEQ ID NO: 2872369 - RNA, 12 nt, Mycobacterium avium subsp. paratuberculosis
acgggccgggca

SEQ ID NO: 2872370 - RNA, 16 nt, Mycobacterium avium subsp. paratuberculosis
acgggccgggcaccgc

SEQ ID NO: 2872371 - RNA, 17 nt, Mycobacterium avium subsp. paratuberculosis
acgggccgggcaccgcg

SEQ ID NO: 2872372 - RNA, 19 nt, Mycobacterium avium subsp. paratuberculosis
acgggccgggcaccgcgcc

SEQ ID NO: 2872373 - RNA, 20 nt, Mycobacterium avium subsp. paratuberculosis
acgggccgggcacgucgacg

SEQ ID NO: 2872374 - RNA, 14 nt, Mycobacterium avium subsp. paratuberculosis
acgggcgaucuugg

SEQ ID NO: 2872375 - RNA, 14 nt, Mycobacterium avium subsp. paratuberculosis
acgggcgcagcgcc

SEQ ID NO: 2872376 - RNA, 17 nt, Mycobacterium avium subsp. paratuberculosis
acgggcgcagcgccguc

SEQ ID NO: 2872377 - RNA, 18 nt, Mycobacterium avium subsp. paratuberculosis
acgggcggcagggccagc

SEQ ID NO: 2872378 - RNA, 22 nt, Mycobacterium avium subsp. paratuberculosis
acgggcggcagggccagcacca

SEQ ID NO: 2872379 - RNA, 18 nt, Mycobacterium avium subsp. paratuberculosis
acgggcgggcaugguucc

SEQ ID NO: 2872380 - RNA, 18 nt, Mycobacterium avium subsp. paratuberculosis
acgggcgugccggcggcg

SEQ ID NO: 2872381 - RNA, 18 nt, Mycobacterium avium subsp. paratuberculosis
acgggcucagcaccacau

SEQ ID NO: 2872382 - RNA, 12 nt, Mycobacterium avium subsp. paratuberculosis
acgggcucggcg

SEQ ID NO: 2872383 - RNA, 22 nt, Mycobacterium avium subsp. paratuberculosis
acgggcucggcguacaggccgu

SEQ ID NO: 2872384 - RNA, 18 nt, Mycobacterium avium subsp. paratuberculosis
acgggcugaacucgacgu

SEQ ID NO: 2872385 - RNA, 20 nt, Mycobacterium avium subsp. paratuberculosis
acgggcugaacucgacgucg

SEQ ID NO: 2872386 - RNA, 22 nt, Mycobacterium avium subsp. paratuberculosis
acgggcugaagaucaacagccg

SEQ ID NO: 2872387 - RNA, 24 nt, Mycobacterium avium subsp. paratuberculosis
acgggcugaagaucaacagccgcc

SEQ ID NO: 2872388 - RNA, 17 nt, Mycobacterium avium subsp. paratuberculosis
acgggcugaccgccagg

SEQ ID NO: 2872389 - RNA, 19 nt, Mycobacterium avium subsp. paratuberculosis
acgggcugcugcacgucgc

SEQ ID NO: 2872390 - RNA, 15 nt, Mycobacterium avium subsp. paratuberculosis
acgggcuggccaggc

SEQ ID NO: 2872391 - RNA, 21 nt, Mycobacterium avium subsp. paratuberculosis
acgggcugucccggccgcgac

SEQ ID NO: 2872392 - RNA, 21 nt, Mycobacterium avium subsp. paratuberculosis
acggggacgcugaacagcccg

SEQ ID NO: 2872393 - RNA, 13 nt, Mycobacterium avium subsp. paratuberculosis
acggggacgucgu

SEQ ID NO: 2872394 - RNA, 15 nt, Mycobacterium avium subsp. paratuberculosis
acggggacgucgucg

SEQ ID NO: 2872395 - RNA, 12 nt, Mycobacterium avium subsp. paratuberculosis
acggggcccgcg

SEQ ID NO: 2872396 - RNA, 18 nt, Mycobacterium avium subsp. paratuberculosis
acggggcgaugccgacac

SEQ ID NO: 2872397 - RNA, 21 nt, Mycobacterium avium subsp. paratuberculosis
acggggcgaugccgacacccc

SEQ ID NO: 2872398 - RNA, 20 nt, Mycobacterium avium subsp. paratuberculosis
acggggcguugguugcggcc

SEQ ID NO: 2872399 - RNA, 22 nt, Mycobacterium avium subsp. paratuberculosis
acggggcguugguugcggcccc

SEQ ID NO: 2872400 - RNA, 14 nt, Mycobacterium avium subsp. paratuberculosis
acggggcuauccgg

SEQ ID NO: 2872401 - RNA, 19 nt, Mycobacterium avium subsp. paratuberculosis
acgggggaguagcgcgcga

SEQ ID NO: 2872402 - RNA, 16 nt, Mycobacterium avium subsp. paratuberculosis
acgggggugccgaccg

SEQ ID NO: 2872403 - RNA, 21 nt, Mycobacterium avium subsp. paratuberculosis
acgggguggaauaggccgcgu

SEQ ID NO: 2872404 - RNA, 21 nt, Mycobacterium avium subsp. paratuberculosis
acgggguucaguagcagcguc

SEQ ID NO: 2872405 - RNA, 17 nt, Mycobacterium avium subsp. paratuberculosis
acggguccuugccggcg

SEQ ID NO: 2872406 - RNA, 20 nt, Mycobacterium avium subsp. paratuberculosis
acggguccuugccggcggcg

SEQ ID NO: 2872407 - RNA, 16 nt, Mycobacterium avium subsp. paratuberculosis
acgggucgaccgccgc

SEQ ID NO: 2872408 - RNA, 12 nt, Mycobacterium avium subsp. paratuberculosis
acgggucgagca

SEQ ID NO: 2872409 - RNA, 18 nt, Mycobacterium avium subsp. paratuberculosis
acgggucgaucucggcgc

SEQ ID NO: 2872410 - RNA, 13 nt, Mycobacterium avium subsp. paratuberculosis
acgggucgccgau

SEQ ID NO: 2872411 - RNA, 21 nt, Mycobacterium avium subsp. paratuberculosis
acgggucgcugugcagcgggu

SEQ ID NO: 2872412 - RNA, 22 nt, Mycobacterium avium subsp. paratuberculosis
acgggucgcugugcagcggguu

SEQ ID NO: 2872413 - RNA, 14 nt, Mycobacterium avium subsp. paratuberculosis
acgggucggcgacc

SEQ ID NO: 2872414 - RNA, 14 nt, Mycobacterium avium subsp. paratuberculosis
acgggucggcggcg

SEQ ID NO: 2872415 - RNA, 14 nt, Mycobacterium avium subsp. paratuberculosis
acgggucggucggc

SEQ ID NO: 2872416 - RNA, 20 nt, Mycobacterium avium subsp. paratuberculosis
acgggucggucggcccgcug

SEQ ID NO: 2872417 - RNA, 21 nt, Mycobacterium avium subsp. paratuberculosis
acgggucggucggcccgcugc

SEQ ID NO: 2872418 - RNA, 23 nt, Mycobacterium avium subsp. paratuberculosis
acgggucggucggcccgcugcgg

SEQ ID NO: 2872419 - RNA, 13 nt, Mycobacterium avium subsp. paratuberculosis
acgggucgguggu

SEQ ID NO: 2872420 - RNA, 18 nt, Mycobacterium avium subsp. paratuberculosis
acgggucguaggacacca

SEQ ID NO: 2872421 - RNA, 20 nt, Mycobacterium avium subsp. paratuberculosis
acgggucguaggacaccacg

SEQ ID NO: 2872422 - RNA, 19 nt, Mycobacterium avium subsp. paratuberculosis
acgggucucagcgcccgcc

SEQ ID NO: 2872423 - RNA, 21 nt, Mycobacterium avium subsp. paratuberculosis
acgggucucagcgcccgcccg

SEQ ID NO: 2872424 - RNA, 23 nt, Mycobacterium avium subsp. paratuberculosis
acgggucucagcgcccgcccggc

SEQ ID NO: 2872425 - RNA, 12 nt, Mycobacterium avium subsp. paratuberculosis
acgggugaccgg

SEQ ID NO: 2872426 - RNA, 18 nt, Mycobacterium avium subsp. paratuberculosis
acgggugaccggcggcca

SEQ ID NO: 2872427 - RNA, 14 nt, Mycobacterium avium subsp. paratuberculosis
acgggugcggcgcu

SEQ ID NO: 2872428 - RNA, 18 nt, Mycobacterium avium subsp. paratuberculosis
acgggugcggcgcucggu

SEQ ID NO: 2872429 - RNA, 19 nt, Mycobacterium avium subsp. paratuberculosis
acgggugcggcgcucggug

SEQ ID NO: 2872430 - RNA, 19 nt, Mycobacterium avium subsp. paratuberculosis
acggguucggucucggcgg

SEQ ID NO: 2872431 - RNA, 17 nt, Mycobacterium avium subsp. paratuberculosis
acggguugccgucgacg

SEQ ID NO: 2872432 - RNA, 19 nt, Mycobacterium avium subsp. paratuberculosis
acggguugggcgccagcag

SEQ ID NO: 2872433 - RNA, 22 nt, Mycobacterium avium subsp. paratuberculosis
acggguugggcgccagcagcac

SEQ ID NO: 2872434 - RNA, 22 nt, Mycobacterium avium subsp. paratuberculosis
acggguugggcggggcgucgau

SEQ ID NO: 2872435 - RNA, 19 nt, Mycobacterium avium subsp. paratuberculosis
acggguuggucggcgcggc

SEQ ID NO: 2872436 - RNA, 20 nt, Mycobacterium avium subsp. paratuberculosis
acggguuggucggcgcggcg

SEQ ID NO: 2872437 - RNA, 22 nt, Mycobacterium avium subsp. paratuberculosis
acggguuggucggcgcggcgac

SEQ ID NO: 2872438 - RNA, 23 nt, Mycobacterium avium subsp. paratuberculosis
acggguuggucggcgcggcgacg

SEQ ID NO: 2872439 - RNA, 16 nt, Mycobacterium avium subsp. paratuberculosis
acgguacgugcgccgg

SEQ ID NO: 2872440 - RNA, 19 nt, Mycobacterium avium subsp. paratuberculosis
acgguacgugcgccggcgg

SEQ ID NO: 2872441 - RNA, 20 nt, Mycobacterium avium subsp. paratuberculosis
acgguacuguuacgcccgau

SEQ ID NO: 2872442 - RNA, 14 nt, Mycobacterium avium subsp. paratuberculosis
acgguaggcgcggu

SEQ ID NO: 2872443 - RNA, 15 nt, Mycobacterium avium subsp. paratuberculosis
acgguaggcgcgguc

SEQ ID NO: 2872444 - RNA, 17 nt, Mycobacterium avium subsp. paratuberculosis
acgguaggcgcggucgg

SEQ ID NO: 2872445 - RNA, 22 nt, Mycobacterium avium subsp. paratuberculosis
acgguaggcgcggucgguggcg

SEQ ID NO: 2872446 - RNA, 13 nt, Mycobacterium avium subsp. paratuberculosis
acgguaugcccgc

SEQ ID NO: 2872447 - RNA, 22 nt, Mycobacterium avium subsp. paratuberculosis
acggucaccccgaguucggcca

SEQ ID NO: 2872448 - RNA, 16 nt, Mycobacterium avium subsp. paratuberculosis
acggucaccggcaggc

SEQ ID NO: 2872449 - RNA, 14 nt, Mycobacterium avium subsp. paratuberculosis
acggucacggccgc

SEQ ID NO: 2872450 - RNA, 18 nt, Mycobacterium avium subsp. paratuberculosis
acggucacggccgccagc

SEQ ID NO: 2872451 - RNA, 15 nt, Mycobacterium avium subsp. paratuberculosis
acggucagccgcggc

SEQ ID NO: 2872452 - RNA, 17 nt, Mycobacterium avium subsp. paratuberculosis
acggucagccgcggcuc

SEQ ID NO: 2872453 - RNA, 16 nt, Mycobacterium avium subsp. paratuberculosis
acggucagcgcgucgg

SEQ ID NO: 2872454 - RNA, 18 nt, Mycobacterium avium subsp. paratuberculosis
acggucagcgcgucggcg

SEQ ID NO: 2872455 - RNA, 15 nt, Mycobacterium avium subsp. paratuberculosis
acggucagcggccag

SEQ ID NO: 2872456 - RNA, 16 nt, Mycobacterium avium subsp. paratuberculosis
acggucagcggccagc

SEQ ID NO: 2872457 - RNA, 16 nt, Mycobacterium avium subsp. paratuberculosis
acggucagcucgcgcc

SEQ ID NO: 2872458 - RNA, 18 nt, Mycobacterium avium subsp. paratuberculosis
acggucagcucgcgcccg

SEQ ID NO: 2872459 - RNA, 20 nt, Mycobacterium avium subsp. paratuberculosis
acggucagcucgcgcccggc

SEQ ID NO: 2872460 - RNA, 12 nt, Mycobacterium avium subsp. paratuberculosis
acggucaggcgc

SEQ ID NO: 2872461 - RNA, 16 nt, Mycobacterium avium subsp. paratuberculosis
acggucaugccgagcc

SEQ ID NO: 2872462 - RNA, 18 nt, Mycobacterium avium subsp. paratuberculosis
acggucaugccgagccgc

SEQ ID NO: 2872463 - RNA, 21 nt, Mycobacterium avium subsp. paratuberculosis
acgguccaucagcaccgagaa

SEQ ID NO: 2872464 - RNA, 15 nt, Mycobacterium avium subsp. paratuberculosis
acgguccccgcgccc

SEQ ID NO: 2872465 - RNA, 18 nt, Mycobacterium avium subsp. paratuberculosis
acgguccccgcgcccgcc

SEQ ID NO: 2872466 - RNA, 22 nt, Mycobacterium avium subsp. paratuberculosis
acgguccccgcgcccgccgcgu

SEQ ID NO: 2872467 - RNA, 20 nt, Mycobacterium avium subsp. paratuberculosis
acggucccguccaucgccgc

SEQ ID NO: 2872468 - RNA, 22 nt, Mycobacterium avium subsp. paratuberculosis
acggucccguccaucgccgcgc

SEQ ID NO: 2872469 - RNA, 20 nt, Mycobacterium avium subsp. paratuberculosis
acggucgaccucgagcguca

SEQ ID NO: 2872470 - RNA, 15 nt, Mycobacterium avium subsp. paratuberculosis
acggucgcaccgcgg

SEQ ID NO: 2872471 - RNA, 16 nt, Mycobacterium avium subsp. paratuberculosis
acggucgcaccgcggc

SEQ ID NO: 2872472 - RNA, 12 nt, Mycobacterium avium subsp. paratuberculosis
acggucgccgac

SEQ ID NO: 2872473 - RNA, 14 nt, Mycobacterium avium subsp. paratuberculosis
acggucgccgacgu

SEQ ID NO: 2872474 - RNA, 14 nt, Mycobacterium avium subsp. paratuberculosis
acggucgccgcgcc

SEQ ID NO: 2872475 - RNA, 16 nt, Mycobacterium avium subsp. paratuberculosis
acggucgccgcgccgc

SEQ ID NO: 2872476 - RNA, 18 nt, Mycobacterium avium subsp. paratuberculosis
acggucgccgcgccgccg

SEQ ID NO: 2872477 - RNA, 20 nt, Mycobacterium avium subsp. paratuberculosis
acggucgccgcgccgccggu

SEQ ID NO: 2872478 - RNA, 11 nt, Mycobacterium avium subsp. paratuberculosis
acggucgccgg

SEQ ID NO: 2872479 - RNA, 19 nt, Mycobacterium avium subsp. paratuberculosis
acggucggagcccagcgug

SEQ ID NO: 2872480 - RNA, 19 nt, Mycobacterium avium subsp. paratuberculosis
acggucggccccgcgcauc

SEQ ID NO: 2872481 - RNA, 18 nt, Mycobacterium avium subsp. paratuberculosis
acggucggcguccagcgc

SEQ ID NO: 2872482 - RNA, 21 nt, Mycobacterium avium subsp. paratuberculosis
acggucggcguccagcgcggu

SEQ ID NO: 2872483 - RNA, 22 nt, Mycobacterium avium subsp. paratuberculosis
acggucgggaucugcggugagc

SEQ ID NO: 2872484 - RNA, 12 nt, Mycobacterium avium subsp. paratuberculosis
acggucggggcg

SEQ ID NO: 2872485 - RNA, 15 nt, Mycobacterium avium subsp. paratuberculosis
acggucggggcggcg

SEQ ID NO: 2872486 - RNA, 21 nt, Mycobacterium avium subsp. paratuberculosis
acggucgugcugggccgggcg

SEQ ID NO: 2872487 - RNA, 23 nt, Mycobacterium avium subsp. paratuberculosis
acggucuggcuggugaccccguu

SEQ ID NO: 2872488 - RNA, 19 nt, Mycobacterium avium subsp. paratuberculosis
acggucugggaggcggcgg

SEQ ID NO: 2872489 - RNA, 16 nt, Mycobacterium avium subsp. paratuberculosis
acggucuucccgccgc

SEQ ID NO: 2872490 - RNA, 20 nt, Mycobacterium avium subsp. paratuberculosis
acggucuucccgccgccguc

SEQ ID NO: 2872491 - RNA, 22 nt, Mycobacterium avium subsp. paratuberculosis
acggucuucccgccgccgucgg

SEQ ID NO: 2872492 - RNA, 14 nt, Mycobacterium avium subsp. paratuberculosis
acggucuugcggcc

SEQ ID NO: 2872493 - RNA, 15 nt, Mycobacterium avium subsp. paratuberculosis
acggucuugcggccg

SEQ ID NO: 2872494 - RNA, 18 nt, Mycobacterium avium subsp. paratuberculosis
acggucuuugccggccau

SEQ ID NO: 2872495 - RNA, 20 nt, Mycobacterium avium subsp. paratuberculosis
acggucuuugccggccauga

SEQ ID NO: 2872496 - RNA, 18 nt, Mycobacterium avium subsp. paratuberculosis
acggugaacgggccgcac

SEQ ID NO: 2872497 - RNA, 21 nt, Mycobacterium avium subsp. paratuberculosis
acggugaacuucaccgucugc

SEQ ID NO: 2872498 - RNA, 15 nt, Mycobacterium avium subsp. paratuberculosis
acggugaccggcgcg

SEQ ID NO: 2872499 - RNA, 19 nt, Mycobacterium avium subsp. paratuberculosis
acggugaccggcucgagca

SEQ ID NO: 2872500 - RNA, 19 nt, Mycobacterium avium subsp. paratuberculosis
acggugaccucgucgggcg

SEQ ID NO: 2872501 - RNA, 22 nt, Mycobacterium avium subsp. paratuberculosis
acggugagcaacaccggcacga

SEQ ID NO: 2872502 - RNA, 15 nt, Mycobacterium avium subsp. paratuberculosis
acggugagcaccgcc

SEQ ID NO: 2872503 - RNA, 20 nt, Mycobacterium avium subsp. paratuberculosis
acggugagcaccgccguccc

SEQ ID NO: 2872504 - RNA, 18 nt, Mycobacterium avium subsp. paratuberculosis
acggugaggacaccacga

SEQ ID NO: 2872505 - RNA, 15 nt, Mycobacterium avium subsp. paratuberculosis
acggugaucaggguc

SEQ ID NO: 2872506 - RNA, 14 nt, Mycobacterium avium subsp. paratuberculosis
acggugaucgccgg

SEQ ID NO: 2872507 - RNA, 18 nt, Mycobacterium avium subsp. paratuberculosis
acggugaucucgccgagc

SEQ ID NO: 2872508 - RNA, 17 nt, Mycobacterium avium subsp. paratuberculosis
acggugaugucgccggc

SEQ ID NO: 2872509 - RNA, 19 nt, Mycobacterium avium subsp. paratuberculosis
acggugaugucgccggcgg

SEQ ID NO: 2872510 - RNA, 21 nt, Mycobacterium avium subsp. paratuberculosis
acggugaugucgccggcggcg

SEQ ID NO: 2872511 - RNA, 19 nt, Mycobacterium avium subsp. paratuberculosis
acggugauuccggcacccg

SEQ ID NO: 2872512 - RNA, 20 nt, Mycobacterium avium subsp. paratuberculosis
acggugauuccggcacccgc

SEQ ID NO: 2872513 - RNA, 21 nt, Mycobacterium avium subsp. paratuberculosis
acggugauuccggcacccgcc

SEQ ID NO: 2872514 - RNA, 22 nt, Mycobacterium avium subsp. paratuberculosis
acggugauuccggcacccgcca

SEQ ID NO: 2872515 - RNA, 14 nt, Mycobacterium avium subsp. paratuberculosis
acggugcacacgcc

SEQ ID NO: 2872516 - RNA, 16 nt, Mycobacterium avium subsp. paratuberculosis
acggugcacacgccga

SEQ ID NO: 2872517 - RNA, 21 nt, Mycobacterium avium subsp. paratuberculosis
acggugcacacgccgaggcgg

SEQ ID NO: 2872518 - RNA, 16 nt, Mycobacterium avium subsp. paratuberculosis
acggugcagcagcgcc

SEQ ID NO: 2872519 - RNA, 18 nt, Mycobacterium avium subsp. paratuberculosis
acggugcagcagcgccgc

SEQ ID NO: 2872520 - RNA, 14 nt, Mycobacterium avium subsp. paratuberculosis
acggugcagccggg

SEQ ID NO: 2872521 - RNA, 15 nt, Mycobacterium avium subsp. paratuberculosis
acggugcagccgggg

SEQ ID NO: 2872522 - RNA, 15 nt, Mycobacterium avium subsp. paratuberculosis
acggugcccgcagca

SEQ ID NO: 2872523 - RNA, 15 nt, Mycobacterium avium subsp. paratuberculosis
acggugcccgccgau

SEQ ID NO: 2872524 - RNA, 17 nt, Mycobacterium avium subsp. paratuberculosis
acggugcccgccgaucg

SEQ ID NO: 2872525 - RNA, 17 nt, Mycobacterium avium subsp. paratuberculosis
acggugcccgccgcgac

SEQ ID NO: 2872526 - RNA, 16 nt, Mycobacterium avium subsp. paratuberculosis
acggugccgccgugcg

SEQ ID NO: 2872527 - RNA, 20 nt, Mycobacterium avium subsp. paratuberculosis
acggugccgccgugcgcggc

SEQ ID NO: 2872528 - RNA, 21 nt, Mycobacterium avium subsp. paratuberculosis
acggugccgccgugcgcggcg

SEQ ID NO: 2872529 - RNA, 15 nt, Mycobacterium avium subsp. paratuberculosis
acggugcgcaccgac

SEQ ID NO: 2872530 - RNA, 22 nt, Mycobacterium avium subsp. paratuberculosis
acggugcgcccgucgucgccga

SEQ ID NO: 2872531 - RNA, 15 nt, Mycobacterium avium subsp. paratuberculosis
acggugcgccggcag

SEQ ID NO: 2872532 - RNA, 19 nt, Mycobacterium avium subsp. paratuberculosis
acggugcgcucgugaccgg

SEQ ID NO: 2872533 - RNA, 17 nt, Mycobacterium avium subsp. paratuberculosis
acggugcgugccagcag

SEQ ID NO: 2872534 - RNA, 14 nt, Mycobacterium avium subsp. paratuberculosis
acgguggacccgac

SEQ ID NO: 2872535 - RNA, 12 nt, Mycobacterium avium subsp. paratuberculosis
acgguggccgcg

SEQ ID NO: 2872536 - RNA, 13 nt, Mycobacterium avium subsp. paratuberculosis
acgguggccgcga

SEQ ID NO: 2872537 - RNA, 13 nt, Mycobacterium avium subsp. paratuberculosis
acgguggccgucu

SEQ ID NO: 2872538 - RNA, 20 nt, Mycobacterium avium subsp. paratuberculosis
acgguggccgucucgucggc

SEQ ID NO: 2872539 - RNA, 14 nt, Mycobacterium avium subsp. paratuberculosis
acgguggccucggc

SEQ ID NO: 2872540 - RNA, 21 nt, Mycobacterium avium subsp. paratuberculosis
acgguggccucggcgcugccc

SEQ ID NO: 2872541 - RNA, 22 nt, Mycobacterium avium subsp. paratuberculosis
acgguggcgcccagcgagcugc

SEQ ID NO: 2872542 - RNA, 14 nt, Mycobacterium avium subsp. paratuberculosis
acgguggcgccgcg

SEQ ID NO: 2872543 - RNA, 17 nt, Mycobacterium avium subsp. paratuberculosis
acgguggcgccggcauc

SEQ ID NO: 2872544 - RNA, 20 nt, Mycobacterium avium subsp. paratuberculosis
acgguggcgccggcaucgac

SEQ ID NO: 2872545 - RNA, 17 nt, Mycobacterium avium subsp. paratuberculosis
acgguggcgggccgccg

SEQ ID NO: 2872546 - RNA, 18 nt, Mycobacterium avium subsp. paratuberculosis
acgguggcgggccgccgg

SEQ ID NO: 2872547 - RNA, 20 nt, Mycobacterium avium subsp. paratuberculosis
acgguggcgggccgccgggu

SEQ ID NO: 2872548 - RNA, 19 nt, Mycobacterium avium subsp. paratuberculosis
acgguggcguccagcgggu

SEQ ID NO: 2872549 - RNA, 20 nt, Mycobacterium avium subsp. paratuberculosis
acgguggcguccagcggguu

SEQ ID NO: 2872550 - RNA, 14 nt, Mycobacterium avium subsp. paratuberculosis
acggugggacggcg

SEQ ID NO: 2872551 - RNA, 15 nt, Mycobacterium avium subsp. paratuberculosis
acggugggcccgccg

SEQ ID NO: 2872552 - RNA, 17 nt, Mycobacterium avium subsp. paratuberculosis
acggugggcccgccguc

SEQ ID NO: 2872553 - RNA, 14 nt, Mycobacterium avium subsp. paratuberculosis
acggugggcgccgg

SEQ ID NO: 2872554 - RNA, 18 nt, Mycobacterium avium subsp. paratuberculosis
acgguggggcuggccgca

SEQ ID NO: 2872555 - RNA, 21 nt, Mycobacterium avium subsp. paratuberculosis
acgguggggcuggccgcacgg

SEQ ID NO: 2872556 - RNA, 12 nt, Mycobacterium avium subsp. paratuberculosis
acggugguggcg

SEQ ID NO: 2872557 - RNA, 23 nt, Mycobacterium avium subsp. paratuberculosis
acggugguggcgaacagcggguu

SEQ ID NO: 2872558 - RNA, 22 nt, Mycobacterium avium subsp. paratuberculosis
acgguggugucgucgggccgca

SEQ ID NO: 2872559 - RNA, 21 nt, Mycobacterium avium subsp. paratuberculosis
acgguguagacgcgggccggc

SEQ ID NO: 2872560 - RNA, 15 nt, Mycobacterium avium subsp. paratuberculosis
acgguguagcggcgg

SEQ ID NO: 2872561 - RNA, 21 nt, Mycobacterium avium subsp. paratuberculosis
acggugucgcuguaggccagc

SEQ ID NO: 2872562 - RNA, 20 nt, Mycobacterium avium subsp. paratuberculosis
acggugugcgggucgguggu

SEQ ID NO: 2872563 - RNA, 22 nt, Mycobacterium avium subsp. paratuberculosis
acgguguucuugaacggcgcgu

SEQ ID NO: 2872564 - RNA, 14 nt, Mycobacterium avium subsp. paratuberculosis
acgguguugcgcac

SEQ ID NO: 2872565 - RNA, 22 nt, Mycobacterium avium subsp. paratuberculosis
acgguguugcgcacccgcgggu

SEQ ID NO: 2872566 - RNA, 20 nt, Mycobacterium avium subsp. paratuberculosis
acgguguuguucaccggcgu

SEQ ID NO: 2872567 - RNA, 15 nt, Mycobacterium avium subsp. paratuberculosis
acgguucggccgcuc

SEQ ID NO: 2872568 - RNA, 20 nt, Mycobacterium avium subsp. paratuberculosis
acgguucgggaaccuggccg

SEQ ID NO: 2872569 - RNA, 13 nt, Mycobacterium avium subsp. paratuberculosis
acgguuggccggc

SEQ ID NO: 2872570 - RNA, 14 nt, Mycobacterium avium subsp. paratuberculosis
acgguuggccggcc

SEQ ID NO: 2872571 - RNA, 16 nt, Mycobacterium avium subsp. paratuberculosis
acgguuggccggcccg

SEQ ID NO: 2872572 - RNA, 21 nt, Mycobacterium avium subsp. paratuberculosis
acgguuggccggcccgcccgu

SEQ ID NO: 2872573 - RNA, 23 nt, Mycobacterium avium subsp. paratuberculosis
acgguuggccggcccgcccguag

SEQ ID NO: 2872574 - RNA, 17 nt, Mycobacterium avium subsp. paratuberculosis
acgguuguucagcccgg

SEQ ID NO: 2872575 - RNA, 21 nt, Mycobacterium avium subsp. paratuberculosis
acgguuguucagcccggucag

SEQ ID NO: 2872576 - RNA, 17 nt, Mycobacterium avium subsp. paratuberculosis
acgguuucaccgccguc

SEQ ID NO: 2872577 - RNA, 19 nt, Mycobacterium avium subsp. paratuberculosis
acgguuucaccgccguccc

SEQ ID NO: 2872578 - RNA, 20 nt, Mycobacterium avium subsp. paratuberculosis
acgguuucggaguggaacag

SEQ ID NO: 2872579 - RNA, 18 nt, Mycobacterium avium subsp. paratuberculosis
acgguuucugccggccgc

SEQ ID NO: 2872580 - RNA, 15 nt, Mycobacterium avium subsp. paratuberculosis
acgguuugcccggcg

SEQ ID NO: 2872581 - RNA, 21 nt, Mycobacterium avium subsp. paratuberculosis
acgguuuuggucugcgccggc

SEQ ID NO: 2872582 - RNA, 22 nt, Mycobacterium avium subsp. paratuberculosis
acgguuuuggucugcgccggcg

SEQ ID NO: 2872583 - RNA, 23 nt, Mycobacterium avium subsp. paratuberculosis
acgguuuuggucugcgccggcgg

SEQ ID NO: 2872584 - RNA, 19 nt, Mycobacterium avium subsp. paratuberculosis
acgguuuuucccagcggcc

SEQ ID NO: 2872585 - RNA, 21 nt, Mycobacterium avium subsp. paratuberculosis
acguacaccgggaucggggug

SEQ ID NO: 2872586 - RNA, 21 nt, Mycobacterium avium subsp. paratuberculosis
acguacagcgagccgucgacc

SEQ ID NO: 2872587 - RNA, 23 nt, Mycobacterium avium subsp. paratuberculosis
acguaccagcugcccaccagcag

SEQ ID NO: 2872588 - RNA, 15 nt, Mycobacterium avium subsp. paratuberculosis
acguacuggcgccgg

SEQ ID NO: 2872589 - RNA, 17 nt, Mycobacterium avium subsp. paratuberculosis
acguacuggcgccgguc

SEQ ID NO: 2872590 - RNA, 16 nt, Mycobacterium avium subsp. paratuberculosis
acguagaaggcgccgu

SEQ ID NO: 2872591 - RNA, 23 nt, Mycobacterium avium subsp. paratuberculosis
acguagaaggcgccgucgguggg

SEQ ID NO: 2872592 - RNA, 21 nt, Mycobacterium avium subsp. paratuberculosis
acguagacggugucgcccucg

SEQ ID NO: 2872593 - RNA, 19 nt, Mycobacterium avium subsp. paratuberculosis
acguagcaccagucggcca

SEQ ID NO: 2872594 - RNA, 20 nt, Mycobacterium avium subsp. paratuberculosis
acguagcaccagucggccau

SEQ ID NO: 2872595 - RNA, 14 nt, Mycobacterium avium subsp. paratuberculosis
acguagcagcagac

SEQ ID NO: 2872596 - RNA, 19 nt, Mycobacterium avium subsp. paratuberculosis
acguagcagcagaccgcga

SEQ ID NO: 2872597 - RNA, 14 nt, Mycobacterium avium subsp. paratuberculosis
acguagcccagcgc

SEQ ID NO: 2872598 - RNA, 15 nt, Mycobacterium avium subsp. paratuberculosis
acguagcccgccgaa

SEQ ID NO: 2872599 - RNA, 14 nt, Mycobacterium avium subsp. paratuberculosis
acguagccgaccuu

SEQ ID NO: 2872600 - RNA, 13 nt, Mycobacterium avium subsp. paratuberculosis
acguagcgaucgg

SEQ ID NO: 2872601 - RNA, 14 nt, Mycobacterium avium subsp. paratuberculosis
acguagcgaucggu

SEQ ID NO: 2872602 - RNA, 18 nt, Mycobacterium avium subsp. paratuberculosis
acguagcgcggccgcccg

SEQ ID NO: 2872603 - RNA, 20 nt, Mycobacterium avium subsp. paratuberculosis
acguagcgcggccgcccguc

SEQ ID NO: 2872604 - RNA, 15 nt, Mycobacterium avium subsp. paratuberculosis
acguagcgguccagc

SEQ ID NO: 2872605 - RNA, 18 nt, Mycobacterium avium subsp. paratuberculosis
acguaggacagcaccaca

SEQ ID NO: 2872606 - RNA, 21 nt, Mycobacterium avium subsp. paratuberculosis
acguaggacagcaccacaucg

SEQ ID NO: 2872607 - RNA, 16 nt, Mycobacterium avium subsp. paratuberculosis
acguaggccgccugcc

SEQ ID NO: 2872608 - RNA, 19 nt, Mycobacterium avium subsp. paratuberculosis
acguaggcgaucagcgcgc

SEQ ID NO: 2872609 - RNA, 21 nt, Mycobacterium avium subsp. paratuberculosis
acguaggcgaucagcgcgcac

SEQ ID NO: 2872610 - RNA, 17 nt, Mycobacterium avium subsp. paratuberculosis
acguaggcgaugucgac

SEQ ID NO: 2872611 - RNA, 15 nt, Mycobacterium avium subsp. paratuberculosis
acguaggcggccagc

SEQ ID NO: 2872612 - RNA, 18 nt, Mycobacterium avium subsp. paratuberculosis
acguagucgaccgggauc

SEQ ID NO: 2872613 - RNA, 13 nt, Mycobacterium avium subsp. paratuberculosis
acguagucgccga

SEQ ID NO: 2872614 - RNA, 23 nt, Mycobacterium avium subsp. paratuberculosis
acguagucgccgauggagaccuc

SEQ ID NO: 2872615 - RNA, 15 nt, Mycobacterium avium subsp. paratuberculosis
acguagucguccucg

SEQ ID NO: 2872616 - RNA, 19 nt, Mycobacterium avium subsp. paratuberculosis
acguauccgcggucgacca

SEQ ID NO: 2872617 - RNA, 21 nt, Mycobacterium avium subsp. paratuberculosis
acguaucgcgccugcaccggc

SEQ ID NO: 2872618 - RNA, 14 nt, Mycobacterium avium subsp. paratuberculosis
acgucaccgcgcuu

SEQ ID NO: 2872619 - RNA, 16 nt, Mycobacterium avium subsp. paratuberculosis
acgucacgacggucac

SEQ ID NO: 2872620 - RNA, 17 nt, Mycobacterium avium subsp. paratuberculosis
acgucacgggccaggcg

SEQ ID NO: 2872621 - RNA, 19 nt, Mycobacterium avium subsp. paratuberculosis
acgucacgggccaggcgcg

SEQ ID NO: 2872622 - RNA, 14 nt, Mycobacterium avium subsp. paratuberculosis
acgucagcccgcgu

SEQ ID NO: 2872623 - RNA, 20 nt, Mycobacterium avium subsp. paratuberculosis
acgucagcucccccgacacc

SEQ ID NO: 2872624 - RNA, 16 nt, Mycobacterium avium subsp. paratuberculosis
acgucaggcccagcga

SEQ ID NO: 2872625 - RNA, 17 nt, Mycobacterium avium subsp. paratuberculosis
acgucaggcccagcgag

SEQ ID NO: 2872626 - RNA, 16 nt, Mycobacterium avium subsp. paratuberculosis
acgucaggccggucag

SEQ ID NO: 2872627 - RNA, 12 nt, Mycobacterium avium subsp. paratuberculosis
acgucaggccgu

SEQ ID NO: 2872628 - RNA, 17 nt, Mycobacterium avium subsp. paratuberculosis
acgucaggccguagcgg

SEQ ID NO: 2872629 - RNA, 21 nt, Mycobacterium avium subsp. paratuberculosis
acgucaggccgugcacgaaca

SEQ ID NO: 2872630 - RNA, 20 nt, Mycobacterium avium subsp. paratuberculosis
acgucaggggugccggaggc

SEQ ID NO: 2872631 - RNA, 17 nt, Mycobacterium avium subsp. paratuberculosis
acgucaggguggccucg

SEQ ID NO: 2872632 - RNA, 15 nt, Mycobacterium avium subsp. paratuberculosis
acgucaggucgaccg

SEQ ID NO: 2872633 - RNA, 17 nt, Mycobacterium avium subsp. paratuberculosis
acgucaggucgaccggc

SEQ ID NO: 2872634 - RNA, 15 nt, Mycobacterium avium subsp. paratuberculosis
acgucauccggcugc

SEQ ID NO: 2872635 - RNA, 17 nt, Mycobacterium avium subsp. paratuberculosis
acgucauuucggucggc

SEQ ID NO: 2872636 - RNA, 15 nt, Mycobacterium avium subsp. paratuberculosis
acguccaccagcacc

SEQ ID NO: 2872637 - RNA, 16 nt, Mycobacterium avium subsp. paratuberculosis
acguccaccagcacca

SEQ ID NO: 2872638 - RNA, 18 nt, Mycobacterium avium subsp. paratuberculosis
acguccaccaggguggcc

SEQ ID NO: 2872639 - RNA, 23 nt, Mycobacterium avium subsp. paratuberculosis
acguccaccggauggcgcccggc

SEQ ID NO: 2872640 - RNA, 19 nt, Mycobacterium avium subsp. paratuberculosis
acguccacguugaugccgc

SEQ ID NO: 2872641 - RNA, 23 nt, Mycobacterium avium subsp. paratuberculosis
acguccacguugaugccgcccag

SEQ ID NO: 2872642 - RNA, 18 nt, Mycobacterium avium subsp. paratuberculosis
acguccagcccgcgccag

SEQ ID NO: 2872643 - RNA, 15 nt, Mycobacterium avium subsp. paratuberculosis
acguccagcgccgcc

SEQ ID NO: 2872644 - RNA, 18 nt, Mycobacterium avium subsp. paratuberculosis
acguccagcgccgccauc

SEQ ID NO: 2872645 - RNA, 13 nt, Mycobacterium avium subsp. paratuberculosis
acguccagcggcc

SEQ ID NO: 2872646 - RNA, 13 nt, Mycobacterium avium subsp. paratuberculosis
acguccaggccgg

SEQ ID NO: 2872647 - RNA, 16 nt, Mycobacterium avium subsp. paratuberculosis
acguccaggccggcgc

SEQ ID NO: 2872648 - RNA, 18 nt, Mycobacterium avium subsp. paratuberculosis
acguccaggccggcgccg

SEQ ID NO: 2872649 - RNA, 19 nt, Mycobacterium avium subsp. paratuberculosis
acguccaggccggcgccgc

SEQ ID NO: 2872650 - RNA, 23 nt, Mycobacterium avium subsp. paratuberculosis
acguccaucauggcgcugcgcga

SEQ ID NO: 2872651 - RNA, 15 nt, Mycobacterium avium subsp. paratuberculosis
acgucccagcacaac

SEQ ID NO: 2872652 - RNA, 18 nt, Mycobacterium avium subsp. paratuberculosis
acguccccgggcaccccg

SEQ ID NO: 2872653 - RNA, 20 nt, Mycobacterium avium subsp. paratuberculosis
acguccccgggcaccccggu

SEQ ID NO: 2872654 - RNA, 17 nt, Mycobacterium avium subsp. paratuberculosis
acguccgaggucuuggu

SEQ ID NO: 2872655 - RNA, 22 nt, Mycobacterium avium subsp. paratuberculosis
acguccgcgggaauuggcaccg

SEQ ID NO: 2872656 - RNA, 15 nt, Mycobacterium avium subsp. paratuberculosis
acguccgcggugagc

SEQ ID NO: 2872657 - RNA, 17 nt, Mycobacterium avium subsp. paratuberculosis
acguccgcggugagcac

SEQ ID NO: 2872658 - RNA, 15 nt, Mycobacterium avium subsp. paratuberculosis
acguccgcgucggcg

SEQ ID NO: 2872659 - RNA, 20 nt, Mycobacterium avium subsp. paratuberculosis
acguccgcgucggcgccggc

SEQ ID NO: 2872660 - RNA, 17 nt, Mycobacterium avium subsp. paratuberculosis
acguccgggccgccucg

SEQ ID NO: 2872661 - RNA, 14 nt, Mycobacterium avium subsp. paratuberculosis
acguccucgacgau

SEQ ID NO: 2872662 - RNA, 18 nt, Mycobacterium avium subsp. paratuberculosis
acguccucgacgaucagc

SEQ ID NO: 2872663 - RNA, 17 nt, Mycobacterium avium subsp. paratuberculosis
acguccucgcccgggug

SEQ ID NO: 2872664 - RNA, 21 nt, Mycobacterium avium subsp. paratuberculosis
acguccucgucgguccaggug

SEQ ID NO: 2872665 - RNA, 16 nt, Mycobacterium avium subsp. paratuberculosis
acguccuggacgucgu

SEQ ID NO: 2872666 - RNA, 17 nt, Mycobacterium avium subsp. paratuberculosis
acguccuugacccggcc

SEQ ID NO: 2872667 - RNA, 21 nt, Mycobacterium avium subsp. paratuberculosis
acguccuuggugacggccucc

SEQ ID NO: 2872668 - RNA, 15 nt, Mycobacterium avium subsp. paratuberculosis
acgucgaacccgacc

SEQ ID NO: 2872669 - RNA, 24 nt, Mycobacterium avium subsp. paratuberculosis
acgucgaacccgaccccggcgagc

SEQ ID NO: 2872670 - RNA, 23 nt, Mycobacterium avium subsp. paratuberculosis
acgucgaacgcguacacggcccg

SEQ ID NO: 2872671 - RNA, 16 nt, Mycobacterium avium subsp. paratuberculosis
acgucgacacgccggc

SEQ ID NO: 2872672 - RNA, 14 nt, Mycobacterium avium subsp. paratuberculosis
acgucgaccgcgcc

SEQ ID NO: 2872673 - RNA, 20 nt, Mycobacterium avium subsp. paratuberculosis
acgucgaccgcgccggggug

SEQ ID NO: 2872674 - RNA, 17 nt, Mycobacterium avium subsp. paratuberculosis
acgucgaccuugcagcc

SEQ ID NO: 2872675 - RNA, 22 nt, Mycobacterium avium subsp. paratuberculosis
acgucgaccuugcagcccgcgu

SEQ ID NO: 2872676 - RNA, 14 nt, Mycobacterium avium subsp. paratuberculosis
acgucgacgccggu

SEQ ID NO: 2872677 - RNA, 14 nt, Mycobacterium avium subsp. paratuberculosis
acgucgacgcgggc

SEQ ID NO: 2872678 - RNA, 10 nt, Mycobacterium avium subsp. paratuberculosis
acgucgacgg

SEQ ID NO: 2872679 - RNA, 14 nt, Mycobacterium avium subsp. paratuberculosis
acgucgacggcagc

SEQ ID NO: 2872680 - RNA, 19 nt, Mycobacterium avium subsp. paratuberculosis
acgucgacgugggcggcca

SEQ ID NO: 2872681 - RNA, 17 nt, Mycobacterium avium subsp. paratuberculosis
acgucgagaaaggccag

SEQ ID NO: 2872682 - RNA, 18 nt, Mycobacterium avium subsp. paratuberculosis
acgucgagaaaggccagc

SEQ ID NO: 2872683 - RNA, 19 nt, Mycobacterium avium subsp. paratuberculosis
acgucgagaaaggccagca

SEQ ID NO: 2872684 - RNA, 14 nt, Mycobacterium avium subsp. paratuberculosis
acgucgagcaccgc

SEQ ID NO: 2872685 - RNA, 16 nt, Mycobacterium avium subsp. paratuberculosis
acgucgagcaccgcgu

SEQ ID NO: 2872686 - RNA, 17 nt, Mycobacterium avium subsp. paratuberculosis
acgucgagcaccgcguc

SEQ ID NO: 2872687 - RNA, 17 nt, Mycobacterium avium subsp. paratuberculosis
acgucgagccagcgggc

SEQ ID NO: 2872688 - RNA, 19 nt, Mycobacterium avium subsp. paratuberculosis
acgucgagccagcgggccg

SEQ ID NO: 2872689 - RNA, 17 nt, Mycobacterium avium subsp. paratuberculosis
acgucgagcgcggcccg

SEQ ID NO: 2872690 - RNA, 19 nt, Mycobacterium avium subsp. paratuberculosis
acgucgagcgcggcccgcc

SEQ ID NO: 2872691 - RNA, 16 nt, Mycobacterium avium subsp. paratuberculosis
acgucgagcggcgccu

SEQ ID NO: 2872692 - RNA, 17 nt, Mycobacterium avium subsp. paratuberculosis
acgucgagcuccucggc

SEQ ID NO: 2872693 - RNA, 16 nt, Mycobacterium avium subsp. paratuberculosis
acgucgagggcgccgu

SEQ ID NO: 2872694 - RNA, 17 nt, Mycobacterium avium subsp. paratuberculosis
acgucgagggcgccguu

SEQ ID NO: 2872695 - RNA, 13 nt, Mycobacterium avium subsp. paratuberculosis
acgucgaggguga

SEQ ID NO: 2872696 - RNA, 17 nt, Mycobacterium avium subsp. paratuberculosis
acgucgaggucggacgc

SEQ ID NO: 2872697 - RNA, 20 nt, Mycobacterium avium subsp. paratuberculosis
acgucgaggucggacgccuc

SEQ ID NO: 2872698 - RNA, 19 nt, Mycobacterium avium subsp. paratuberculosis
acgucgaucacgccgccgg

SEQ ID NO: 2872699 - RNA, 13 nt, Mycobacterium avium subsp. paratuberculosis
acgucgauccccg

SEQ ID NO: 2872700 - RNA, 14 nt, Mycobacterium avium subsp. paratuberculosis
acgucgauccccgc

SEQ ID NO: 2872701 - RNA, 15 nt, Mycobacterium avium subsp. paratuberculosis
acgucgaugccgaac

SEQ ID NO: 2872702 - RNA, 15 nt, Mycobacterium avium subsp. paratuberculosis
acgucgaugccggcc

SEQ ID NO: 2872703 - RNA, 18 nt, Mycobacterium avium subsp. paratuberculosis
acgucgccaccagaccgg

SEQ ID NO: 2872704 - RNA, 14 nt, Mycobacterium avium subsp. paratuberculosis
acgucgcccacccg

SEQ ID NO: 2872705 - RNA, 15 nt, Mycobacterium avium subsp. paratuberculosis
acgucgcccagcgug

SEQ ID NO: 2872706 - RNA, 20 nt, Mycobacterium avium subsp. paratuberculosis
acgucgccggccugcccgcc

SEQ ID NO: 2872707 - RNA, 21 nt, Mycobacterium avium subsp. paratuberculosis
acgucgccggccugcccgccg

SEQ ID NO: 2872708 - RNA, 13 nt, Mycobacterium avium subsp. paratuberculosis
acgucgccggcga

SEQ ID NO: 2872709 - RNA, 14 nt, Mycobacterium avium subsp. paratuberculosis
acgucgccggcgac

SEQ ID NO: 2872710 - RNA, 21 nt, Mycobacterium avium subsp. paratuberculosis
acgucgccggcgaccgccacc

SEQ ID NO: 2872711 - RNA, 22 nt, Mycobacterium avium subsp. paratuberculosis
acgucgccggcgaccgccaccu

SEQ ID NO: 2872712 - RNA, 13 nt, Mycobacterium avium subsp. paratuberculosis
acgucgccguucu

SEQ ID NO: 2872713 - RNA, 19 nt, Mycobacterium avium subsp. paratuberculosis
acgucgcgauagggccggc

SEQ ID NO: 2872714 - RNA, 21 nt, Mycobacterium avium subsp. paratuberculosis
acgucgcgauagggccggccg

SEQ ID NO: 2872715 - RNA, 14 nt, Mycobacterium avium subsp. paratuberculosis
acgucgcgccgcuc

SEQ ID NO: 2872716 - RNA, 17 nt, Mycobacterium avium subsp. paratuberculosis
acgucgcgccgcucggc

SEQ ID NO: 2872717 - RNA, 20 nt, Mycobacterium avium subsp. paratuberculosis
acgucgcgccgcucggccag

SEQ ID NO: 2872718 - RNA, 23 nt, Mycobacterium avium subsp. paratuberculosis
acgucgcgccgcucggccagcag

SEQ ID NO: 2872719 - RNA, 20 nt, Mycobacterium avium subsp. paratuberculosis
acgucgcgcggggucgggcc

SEQ ID NO: 2872720 - RNA, 21 nt, Mycobacterium avium subsp. paratuberculosis
acgucgcgcggggucgggccg

SEQ ID NO: 2872721 - RNA, 18 nt, Mycobacterium avium subsp. paratuberculosis
acgucgcgcugccggccc

SEQ ID NO: 2872722 - RNA, 19 nt, Mycobacterium avium subsp. paratuberculosis
acgucgcgcugccggcccg

SEQ ID NO: 2872723 - RNA, 24 nt, Mycobacterium avium subsp. paratuberculosis
acgucgcggcccuggaugucacgg

SEQ ID NO: 2872724 - RNA, 18 nt, Mycobacterium avium subsp. paratuberculosis
acgucgcgggugaccggc

SEQ ID NO: 2872725 - RNA, 20 nt, Mycobacterium avium subsp. paratuberculosis
acgucgcgggugaccggcgc

SEQ ID NO: 2872726 - RNA, 21 nt, Mycobacterium avium subsp. paratuberculosis
acgucgcgggugaccggcgcc

SEQ ID NO: 2872727 - RNA, 19 nt, Mycobacterium avium subsp. paratuberculosis
acgucggacgcggccgagc

SEQ ID NO: 2872728 - RNA, 14 nt, Mycobacterium avium subsp. paratuberculosis
acgucggagaucag

SEQ ID NO: 2872729 - RNA, 15 nt, Mycobacterium avium subsp. paratuberculosis
acgucggccacgccg

SEQ ID NO: 2872730 - RNA, 19 nt, Mycobacterium avium subsp. paratuberculosis
acgucggccacgccgggca

SEQ ID NO: 2872731 - RNA, 13 nt, Mycobacterium avium subsp. paratuberculosis
acgucggccagcg

SEQ ID NO: 2872732 - RNA, 14 nt, Mycobacterium avium subsp. paratuberculosis
acgucggccgccag

SEQ ID NO: 2872733 - RNA, 16 nt, Mycobacterium avium subsp. paratuberculosis
acgucggccgccaggg

SEQ ID NO: 2872734 - RNA, 11 nt, Mycobacterium avium subsp. paratuberculosis
acgucggccgg

SEQ ID NO: 2872735 - RNA, 14 nt, Mycobacterium avium subsp. paratuberculosis
acgucggccggguc

SEQ ID NO: 2872736 - RNA, 12 nt, Mycobacterium avium subsp. paratuberculosis
acgucggcgaug

SEQ ID NO: 2872737 - RNA, 12 nt, Mycobacterium avium subsp. paratuberculosis
acgucggcgcgc

SEQ ID NO: 2872738 - RNA, 13 nt, Mycobacterium avium subsp. paratuberculosis
acgucggcgcgca

SEQ ID NO: 2872739 - RNA, 16 nt, Mycobacterium avium subsp. paratuberculosis
acgucggcgcgcaggc

SEQ ID NO: 2872740 - RNA, 13 nt, Mycobacterium avium subsp. paratuberculosis
acgucggcgcgcu

SEQ ID NO: 2872741 - RNA, 14 nt, Mycobacterium avium subsp. paratuberculosis
acgucggcgcgcuc

SEQ ID NO: 2872742 - RNA, 17 nt, Mycobacterium avium subsp. paratuberculosis
acgucggcgcgcucggu

SEQ ID NO: 2872743 - RNA, 12 nt, Mycobacterium avium subsp. paratuberculosis
acgucggcggcc

SEQ ID NO: 2872744 - RNA, 15 nt, Mycobacterium avium subsp. paratuberculosis
acgucggcggccgcg

SEQ ID NO: 2872745 - RNA, 20 nt, Mycobacterium avium subsp. paratuberculosis
acgucggcguacugcgcgac

SEQ ID NO: 2872746 - RNA, 15 nt, Mycobacterium avium subsp. paratuberculosis
acgucggcgucaucg

SEQ ID NO: 2872747 - RNA, 16 nt, Mycobacterium avium subsp. paratuberculosis
acgucggcuggcgugc

SEQ ID NO: 2872748 - RNA, 24 nt, Mycobacterium avium subsp. paratuberculosis
acgucggggaugguuuccacugcc

SEQ ID NO: 2872749 - RNA, 17 nt, Mycobacterium avium subsp. paratuberculosis
acgucggguccgaccag

SEQ ID NO: 2872750 - RNA, 21 nt, Mycobacterium avium subsp. paratuberculosis
acgucggguccgaccagcacc

SEQ ID NO: 2872751 - RNA, 23 nt, Mycobacterium avium subsp. paratuberculosis
acgucggguccgaccagcacccg

SEQ ID NO: 2872752 - RNA, 14 nt, Mycobacterium avium subsp. paratuberculosis
acgucggucagcau

SEQ ID NO: 2872753 - RNA, 19 nt, Mycobacterium avium subsp. paratuberculosis
acgucgguguagucggcga

SEQ ID NO: 2872754 - RNA, 16 nt, Mycobacterium avium subsp. paratuberculosis
acgucguagagcagga

SEQ ID NO: 2872755 - RNA, 23 nt, Mycobacterium avium subsp. paratuberculosis
acgucgucagcaccgugggcccg

SEQ ID NO: 2872756 - RNA, 14 nt, Mycobacterium avium subsp. paratuberculosis
acgucguccggcgc

SEQ ID NO: 2872757 - RNA, 15 nt, Mycobacterium avium subsp. paratuberculosis
acgucguccggcgcg

SEQ ID NO: 2872758 - RNA, 15 nt, Mycobacterium avium subsp. paratuberculosis
acgucgucgacccgc

SEQ ID NO: 2872759 - RNA, 17 nt, Mycobacterium avium subsp. paratuberculosis
acgucgucgacccgcuc

SEQ ID NO: 2872760 - RNA, 13 nt, Mycobacterium avium subsp. paratuberculosis
acgucgucgacgu

SEQ ID NO: 2872761 - RNA, 15 nt, Mycobacterium avium subsp. paratuberculosis
acgucgucgacgucc

SEQ ID NO: 2872762 - RNA, 17 nt, Mycobacterium avium subsp. paratuberculosis
acgucgucgcccacccg

SEQ ID NO: 2872763 - RNA, 23 nt, Mycobacterium avium subsp. paratuberculosis
acgucgucgcggcgcugccggug

SEQ ID NO: 2872764 - RNA, 13 nt, Mycobacterium avium subsp. paratuberculosis
acgucgucggccu

SEQ ID NO: 2872765 - RNA, 15 nt, Mycobacterium avium subsp. paratuberculosis
acgucgucguccucg

SEQ ID NO: 2872766 - RNA, 14 nt, Mycobacterium avium subsp. paratuberculosis
acgucgugcacgcc

SEQ ID NO: 2872767 - RNA, 21 nt, Mycobacterium avium subsp. paratuberculosis
acgucgugcacgccguggcgg

SEQ ID NO: 2872768 - RNA, 23 nt, Mycobacterium avium subsp. paratuberculosis
acgucgugggcgauccgcaggcc

SEQ ID NO: 2872769 - RNA, 19 nt, Mycobacterium avium subsp. paratuberculosis
acgucguugagcacaccca

SEQ ID NO: 2872770 - RNA, 22 nt, Mycobacterium avium subsp. paratuberculosis
acgucguugagcacacccagcg

SEQ ID NO: 2872771 - RNA, 17 nt, Mycobacterium avium subsp. paratuberculosis
acgucguuuuccagccg

SEQ ID NO: 2872772 - RNA, 21 nt, Mycobacterium avium subsp. paratuberculosis
acgucguuuuccagccggcgc

SEQ ID NO: 2872773 - RNA, 14 nt, Mycobacterium avium subsp. paratuberculosis
acgucucggugucg

SEQ ID NO: 2872774 - RNA, 20 nt, Mycobacterium avium subsp. paratuberculosis
acgucucugucgucgaccaa

SEQ ID NO: 2872775 - RNA, 14 nt, Mycobacterium avium subsp. paratuberculosis
acgucugcggcucg

SEQ ID NO: 2872776 - RNA, 16 nt, Mycobacterium avium subsp. paratuberculosis
acgucugcggcucggc

SEQ ID NO: 2872777 - RNA, 20 nt, Mycobacterium avium subsp. paratuberculosis
acgucugcggcucggcgcug

SEQ ID NO: 2872778 - RNA, 18 nt, Mycobacterium avium subsp. paratuberculosis
acgucugcgggaagccca

SEQ ID NO: 2872779 - RNA, 20 nt, Mycobacterium avium subsp. paratuberculosis
acgucugcgggaagcccacc

SEQ ID NO: 2872780 - RNA, 23 nt, Mycobacterium avium subsp. paratuberculosis
acgucugcgggaagcccaccgcg

SEQ ID NO: 2872781 - RNA, 14 nt, Mycobacterium avium subsp. paratuberculosis
acgucugcucggcg

SEQ ID NO: 2872782 - RNA, 15 nt, Mycobacterium avium subsp. paratuberculosis
acgucugcucggcgg

SEQ ID NO: 2872783 - RNA, 19 nt, Mycobacterium avium subsp. paratuberculosis
acgucuggccaccgaagcc

SEQ ID NO: 2872784 - RNA, 15 nt, Mycobacterium avium subsp. paratuberculosis
acgucugggccgccg

SEQ ID NO: 2872785 - RNA, 17 nt, Mycobacterium avium subsp. paratuberculosis
acgucugguuggccggc

SEQ ID NO: 2872786 - RNA, 12 nt, Mycobacterium avium subsp. paratuberculosis
acgucuugcgca

SEQ ID NO: 2872787 - RNA, 13 nt, Mycobacterium avium subsp. paratuberculosis
acgucuugcgcac

SEQ ID NO: 2872788 - RNA, 21 nt, Mycobacterium avium subsp. paratuberculosis
acgucuugucggggaagggcg

SEQ ID NO: 2872789 - RNA, 15 nt, Mycobacterium avium subsp. paratuberculosis
acgugacgaccuggu

SEQ ID NO: 2872790 - RNA, 18 nt, Mycobacterium avium subsp. paratuberculosis
acgugauagcggccgcgg

SEQ ID NO: 2872791 - RNA, 16 nt, Mycobacterium avium subsp. paratuberculosis
acgugauaguggucgu

SEQ ID NO: 2872792 - RNA, 18 nt, Mycobacterium avium subsp. paratuberculosis
acgugauaguggucgucg

SEQ ID NO: 2872793 - RNA, 15 nt, Mycobacterium avium subsp. paratuberculosis
acgugaucgcggugg

SEQ ID NO: 2872794 - RNA, 15 nt, Mycobacterium avium subsp. paratuberculosis
acgugaucuggucgg

SEQ ID NO: 2872795 - RNA, 15 nt, Mycobacterium avium subsp. paratuberculosis
acgugaugcacccgg

SEQ ID NO: 2872796 - RNA, 20 nt, Mycobacterium avium subsp. paratuberculosis
acgugaugcacccggacgug

SEQ ID NO: 2872797 - RNA, 22 nt, Mycobacterium avium subsp. paratuberculosis
acgugaugccguggucggcgaa

SEQ ID NO: 2872798 - RNA, 16 nt, Mycobacterium avium subsp. paratuberculosis
acgugauggcgaaguu

SEQ ID NO: 2872799 - RNA, 13 nt, Mycobacterium avium subsp. paratuberculosis
acgugcaccaccg

SEQ ID NO: 2872800 - RNA, 15 nt, Mycobacterium avium subsp. paratuberculosis
acgugcacccacgcc

SEQ ID NO: 2872801 - RNA, 17 nt, Mycobacterium avium subsp. paratuberculosis
acgugcacccacgccag

SEQ ID NO: 2872802 - RNA, 23 nt, Mycobacterium avium subsp. paratuberculosis
acgugcacccacgccagccgggu

SEQ ID NO: 2872803 - RNA, 15 nt, Mycobacterium avium subsp. paratuberculosis
acgugcaccggcgag

SEQ ID NO: 2872804 - RNA, 22 nt, Mycobacterium avium subsp. paratuberculosis
acgugcaccggcgaguccgcgg

SEQ ID NO: 2872805 - RNA, 17 nt, Mycobacterium avium subsp. paratuberculosis
acgugcaccugcagccg

SEQ ID NO: 2872806 - RNA, 17 nt, Mycobacterium avium subsp. paratuberculosis
acgugcacgcguucgga

SEQ ID NO: 2872807 - RNA, 16 nt, Mycobacterium avium subsp. paratuberculosis
acgugcacggcgccgu

SEQ ID NO: 2872808 - RNA, 17 nt, Mycobacterium avium subsp. paratuberculosis
acgugcacggcgccgug

SEQ ID NO: 2872809 - RNA, 19 nt, Mycobacterium avium subsp. paratuberculosis
acgugcacggcgccgugcc

SEQ ID NO: 2872810 - RNA, 18 nt, Mycobacterium avium subsp. paratuberculosis
acgugcacucagggcgau

SEQ ID NO: 2872811 - RNA, 17 nt, Mycobacterium avium subsp. paratuberculosis
acgugcagcuuccgaac

SEQ ID NO: 2872812 - RNA, 19 nt, Mycobacterium avium subsp. paratuberculosis
acgugccacuggcgccacc

SEQ ID NO: 2872813 - RNA, 20 nt, Mycobacterium avium subsp. paratuberculosis
acgugccacuggcgccaccu

SEQ ID NO: 2872814 - RNA, 15 nt, Mycobacterium avium subsp. paratuberculosis
acgugcccagcccgc

SEQ ID NO: 2872815 - RNA, 17 nt, Mycobacterium avium subsp. paratuberculosis
acgugcccagcccgcgc

SEQ ID NO: 2872816 - RNA, 14 nt, Mycobacterium avium subsp. paratuberculosis
acgugccccuccuc

SEQ ID NO: 2872817 - RNA, 15 nt, Mycobacterium avium subsp. paratuberculosis
acgugccccuccucg

SEQ ID NO: 2872818 - RNA, 21 nt, Mycobacterium avium subsp. paratuberculosis
acgugcccuuccccggcggcc

SEQ ID NO: 2872819 - RNA, 14 nt, Mycobacterium avium subsp. paratuberculosis
acgugccggcgaug

SEQ ID NO: 2872820 - RNA, 13 nt, Mycobacterium avium subsp. paratuberculosis
acgugccggcggc

SEQ ID NO: 2872821 - RNA, 14 nt, Mycobacterium avium subsp. paratuberculosis
acgugccggcggca

SEQ ID NO: 2872822 - RNA, 23 nt, Mycobacterium avium subsp. paratuberculosis
acgugccggcggcaggugaaggu

SEQ ID NO: 2872823 - RNA, 12 nt, Mycobacterium avium subsp. paratuberculosis
acgugcgccggc

SEQ ID NO: 2872824 - RNA, 16 nt, Mycobacterium avium subsp. paratuberculosis
acgugcgccggcggug

SEQ ID NO: 2872825 - RNA, 20 nt, Mycobacterium avium subsp. paratuberculosis
acgugcgcgaagcuggggua

SEQ ID NO: 2872826 - RNA, 14 nt, Mycobacterium avium subsp. paratuberculosis
acgugcgcgccgac

SEQ ID NO: 2872827 - RNA, 12 nt, Mycobacterium avium subsp. paratuberculosis
acgugcgcggcg

SEQ ID NO: 2872828 - RNA, 13 nt, Mycobacterium avium subsp. paratuberculosis
acgugcgcggcgc

SEQ ID NO: 2872829 - RNA, 14 nt, Mycobacterium avium subsp. paratuberculosis
acgugcgcggcgcg

SEQ ID NO: 2872830 - RNA, 15 nt, Mycobacterium avium subsp. paratuberculosis
acgugcgcggcgcgc

SEQ ID NO: 2872831 - RNA, 16 nt, Mycobacterium avium subsp. paratuberculosis
acgugcgcggcgcgcg

SEQ ID NO: 2872832 - RNA, 13 nt, Mycobacterium avium subsp. paratuberculosis
acgugcgcggcgu

SEQ ID NO: 2872833 - RNA, 14 nt, Mycobacterium avium subsp. paratuberculosis
acgugcgcguuggu

SEQ ID NO: 2872834 - RNA, 20 nt, Mycobacterium avium subsp. paratuberculosis
acgugcggguuggcgccggu

SEQ ID NO: 2872835 - RNA, 18 nt, Mycobacterium avium subsp. paratuberculosis
acgugcucggcggccgcc

SEQ ID NO: 2872836 - RNA, 19 nt, Mycobacterium avium subsp. paratuberculosis
acgugcucggcggccgcca

SEQ ID NO: 2872837 - RNA, 22 nt, Mycobacterium avium subsp. paratuberculosis
acgugcuuggccagcucggcgg

SEQ ID NO: 2872838 - RNA, 19 nt, Mycobacterium avium subsp. paratuberculosis
acguggaaauugcugacca

SEQ ID NO: 2872839 - RNA, 16 nt, Mycobacterium avium subsp. paratuberculosis
acguggaccgagcgcg

SEQ ID NO: 2872840 - RNA, 14 nt, Mycobacterium avium subsp. paratuberculosis
acguggacgcgcgc

SEQ ID NO: 2872841 - RNA, 13 nt, Mycobacterium avium subsp. paratuberculosis
acguggaucucga

SEQ ID NO: 2872842 - RNA, 14 nt, Mycobacterium avium subsp. paratuberculosis
acguggcaacgugc

SEQ ID NO: 2872843 - RNA, 22 nt, Mycobacterium avium subsp. paratuberculosis
acguggcaacgugccacaggcc

SEQ ID NO: 2872844 - RNA, 14 nt, Mycobacterium avium subsp. paratuberculosis
acguggcggccguc

SEQ ID NO: 2872845 - RNA, 12 nt, Mycobacterium avium subsp. paratuberculosis
acguggcggcgg

SEQ ID NO: 2872846 - RNA, 16 nt, Mycobacterium avium subsp. paratuberculosis
acgugggcgccccugg

SEQ ID NO: 2872847 - RNA, 14 nt, Mycobacterium avium subsp. paratuberculosis
acgugggcggccac

SEQ ID NO: 2872848 - RNA, 15 nt, Mycobacterium avium subsp. paratuberculosis
acgugggcggccacc

SEQ ID NO: 2872849 - RNA, 17 nt, Mycobacterium avium subsp. paratuberculosis
acgugggucaaccggua

SEQ ID NO: 2872850 - RNA, 23 nt, Mycobacterium avium subsp. paratuberculosis
acgugggucaaccgguagaagau

SEQ ID NO: 2872851 - RNA, 13 nt, Mycobacterium avium subsp. paratuberculosis
acguggguggccc

SEQ ID NO: 2872852 - RNA, 13 nt, Mycobacterium avium subsp. paratuberculosis
acguggucgggca

SEQ ID NO: 2872853 - RNA, 22 nt, Mycobacterium avium subsp. paratuberculosis
acguggucgggcaugccggccg

SEQ ID NO: 2872854 - RNA, 17 nt, Mycobacterium avium subsp. paratuberculosis
acguggugcaccgccag

SEQ ID NO: 2872855 - RNA, 21 nt, Mycobacterium avium subsp. paratuberculosis
acguggugcaccgccagcgcg

SEQ ID NO: 2872856 - RNA, 23 nt, Mycobacterium avium subsp. paratuberculosis
acguggugcaccgccagcgcggc

SEQ ID NO: 2872857 - RNA, 17 nt, Mycobacterium avium subsp. paratuberculosis
acgugguggaugaugcc

SEQ ID NO: 2872858 - RNA, 23 nt, Mycobacterium avium subsp. paratuberculosis
acgugguggaugaugccggcggu

SEQ ID NO: 2872859 - RNA, 16 nt, Mycobacterium avium subsp. paratuberculosis
acgugguugcguucgc

SEQ ID NO: 2872860 - RNA, 22 nt, Mycobacterium avium subsp. paratuberculosis
acgugguugcguucgccggcgu

SEQ ID NO: 2872861 - RNA, 17 nt, Mycobacterium avium subsp. paratuberculosis
acguguacucggcgucg

SEQ ID NO: 2872862 - RNA, 19 nt, Mycobacterium avium subsp. paratuberculosis
acguguacucggcgucgcc

SEQ ID NO: 2872863 - RNA, 15 nt, Mycobacterium avium subsp. paratuberculosis
acgugucccugcggc

SEQ ID NO: 2872864 - RNA, 17 nt, Mycobacterium avium subsp. paratuberculosis
acgugucgagcacgucg

SEQ ID NO: 2872865 - RNA, 21 nt, Mycobacterium avium subsp. paratuberculosis
acgugucgagcacgucgacgc

SEQ ID NO: 2872866 - RNA, 22 nt, Mycobacterium avium subsp. paratuberculosis
acgugucgagcacgucgacgcc

SEQ ID NO: 2872867 - RNA, 13 nt, Mycobacterium avium subsp. paratuberculosis
acgugucggcguc

SEQ ID NO: 2872868 - RNA, 14 nt, Mycobacterium avium subsp. paratuberculosis
acgugucggcgucg

SEQ ID NO: 2872869 - RNA, 22 nt, Mycobacterium avium subsp. paratuberculosis
acgugucgucgucgccgccggu

SEQ ID NO: 2872870 - RNA, 14 nt, Mycobacterium avium subsp. paratuberculosis
acguguggcacccg

SEQ ID NO: 2872871 - RNA, 15 nt, Mycobacterium avium subsp. paratuberculosis
acguguggcacccgg

SEQ ID NO: 2872872 - RNA, 17 nt, Mycobacterium avium subsp. paratuberculosis
acguguggcacccgggu

SEQ ID NO: 2872873 - RNA, 15 nt, Mycobacterium avium subsp. paratuberculosis
acgugugggugagca

SEQ ID NO: 2872874 - RNA, 16 nt, Mycobacterium avium subsp. paratuberculosis
acgugugggugagcau

SEQ ID NO: 2872875 - RNA, 22 nt, Mycobacterium avium subsp. paratuberculosis
acgugugggugagcaucgggcg

SEQ ID NO: 2872876 - RNA, 16 nt, Mycobacterium avium subsp. paratuberculosis
acguguguaccauugc

SEQ ID NO: 2872877 - RNA, 22 nt, Mycobacterium avium subsp. paratuberculosis
acguguucucacggcgaauauu

SEQ ID NO: 2872878 - RNA, 23 nt, Mycobacterium avium subsp. paratuberculosis
acguucagcgacuugccgccggc

SEQ ID NO: 2872879 - RNA, 20 nt, Mycobacterium avium subsp. paratuberculosis
acguuccgaacgugcagcuu

SEQ ID NO: 2872880 - RNA, 16 nt, Mycobacterium avium subsp. paratuberculosis
acguucgagucggcca

SEQ ID NO: 2872881 - RNA, 18 nt, Mycobacterium avium subsp. paratuberculosis
acguucgagucggccacg

SEQ ID NO: 2872882 - RNA, 19 nt, Mycobacterium avium subsp. paratuberculosis
acguucuccccgccggaga

SEQ ID NO: 2872883 - RNA, 13 nt, Mycobacterium avium subsp. paratuberculosis
acguugagcaccc

SEQ ID NO: 2872884 - RNA, 22 nt, Mycobacterium avium subsp. paratuberculosis
acguugagcacgcccgcgaucg

SEQ ID NO: 2872885 - RNA, 15 nt, Mycobacterium avium subsp. paratuberculosis
acguugagcccggac

SEQ ID NO: 2872886 - RNA, 22 nt, Mycobacterium avium subsp. paratuberculosis
acguugagcccggaccggccgu

SEQ ID NO: 2872887 - RNA, 17 nt, Mycobacterium avium subsp. paratuberculosis
acguugaggcggcggcg

SEQ ID NO: 2872888 - RNA, 12 nt, Mycobacterium avium subsp. paratuberculosis
acguugauccga

SEQ ID NO: 2872889 - RNA, 13 nt, Mycobacterium avium subsp. paratuberculosis
acguugaucgcgc

SEQ ID NO: 2872890 - RNA, 17 nt, Mycobacterium avium subsp. paratuberculosis
acguugaucgcgccgau

SEQ ID NO: 2872891 - RNA, 19 nt, Mycobacterium avium subsp. paratuberculosis
acguugaucgcgccgaucu

SEQ ID NO: 2872892 - RNA, 18 nt, Mycobacterium avium subsp. paratuberculosis
acguugaucuugaucgcc

SEQ ID NO: 2872893 - RNA, 21 nt, Mycobacterium avium subsp. paratuberculosis
acguugccgaucccggccagc

SEQ ID NO: 2872894 - RNA, 22 nt, Mycobacterium avium subsp. paratuberculosis
acguugcgggccaggucgagcg

SEQ ID NO: 2872895 - RNA, 15 nt, Mycobacterium avium subsp. paratuberculosis
acguuggcggccagc

SEQ ID NO: 2872896 - RNA, 16 nt, Mycobacterium avium subsp. paratuberculosis
acguuggcggccagcg

SEQ ID NO: 2872897 - RNA, 18 nt, Mycobacterium avium subsp. paratuberculosis
acguuggcggccagcgcg

SEQ ID NO: 2872898 - RNA, 21 nt, Mycobacterium avium subsp. paratuberculosis
acguuggcggccagcgcgccg

SEQ ID NO: 2872899 - RNA, 12 nt, Mycobacterium avium subsp. paratuberculosis
acguuggugauc

SEQ ID NO: 2872900 - RNA, 17 nt, Mycobacterium avium subsp. paratuberculosis
acguuggugaucgccga

SEQ ID NO: 2872901 - RNA, 20 nt, Mycobacterium avium subsp. paratuberculosis
acguuggugaucgccgacgu

SEQ ID NO: 2872902 - RNA, 22 nt, Mycobacterium avium subsp. paratuberculosis
acguugucgcccggguagggca

SEQ ID NO: 2872903 - RNA, 19 nt, Mycobacterium avium subsp. paratuberculosis
acguugugggcgggcgcgu

SEQ ID NO: 2872904 - RNA, 19 nt, Mycobacterium avium subsp. paratuberculosis
acguuguugaccgcggaca

SEQ ID NO: 2872905 - RNA, 22 nt, Mycobacterium avium subsp. paratuberculosis
acuacccgccgacgccugcgcg

SEQ ID NO: 2872906 - RNA, 14 nt, Mycobacterium avium subsp. paratuberculosis
acuaccgacggcac

SEQ ID NO: 2872907 - RNA, 23 nt, Mycobacterium avium subsp. paratuberculosis
acuaccgccucgccagccccacc

SEQ ID NO: 2872908 - RNA, 19 nt, Mycobacterium avium subsp. paratuberculosis
acuacgagcagcaagagca

SEQ ID NO: 2872909 - RNA, 17 nt, Mycobacterium avium subsp. paratuberculosis
acuacgcacccgacacg

SEQ ID NO: 2872910 - RNA, 13 nt, Mycobacterium avium subsp. paratuberculosis
acuagcgcggcgg

SEQ ID NO: 2872911 - RNA, 18 nt, Mycobacterium avium subsp. paratuberculosis
acuagcuucacgcucggc

SEQ ID NO: 2872912 - RNA, 16 nt, Mycobacterium avium subsp. paratuberculosis
acuagcuucacguucg

SEQ ID NO: 2872913 - RNA, 12 nt, Mycobacterium avium subsp. paratuberculosis
acuagguccggc

SEQ ID NO: 2872914 - RNA, 18 nt, Mycobacterium avium subsp. paratuberculosis
acucaccgguggccgcgu

SEQ ID NO: 2872915 - RNA, 19 nt, Mycobacterium avium subsp. paratuberculosis
acucaccgguggccgcguc

SEQ ID NO: 2872916 - RNA, 21 nt, Mycobacterium avium subsp. paratuberculosis
acucacggcggcagcgcggcg

SEQ ID NO: 2872917 - RNA, 22 nt, Mycobacterium avium subsp. paratuberculosis
acucacggcggcagcgcggcgu

SEQ ID NO: 2872918 - RNA, 11 nt, Mycobacterium avium subsp. paratuberculosis
acucagaacag

SEQ ID NO: 2872919 - RNA, 14 nt, Mycobacterium avium subsp. paratuberculosis
acucagagcagcgc

SEQ ID NO: 2872920 - RNA, 15 nt, Mycobacterium avium subsp. paratuberculosis
acucagagcagcgcc

SEQ ID NO: 2872921 - RNA, 22 nt, Mycobacterium avium subsp. paratuberculosis
acucagcccggcccagccgguc

SEQ ID NO: 2872922 - RNA, 13 nt, Mycobacterium avium subsp. paratuberculosis
acucagcgcccag

SEQ ID NO: 2872923 - RNA, 14 nt, Mycobacterium avium subsp. paratuberculosis
acucaggcgcgcac

SEQ ID NO: 2872924 - RNA, 18 nt, Mycobacterium avium subsp. paratuberculosis
acuccaauacggcccggc

SEQ ID NO: 2872925 - RNA, 20 nt, Mycobacterium avium subsp. paratuberculosis
acuccaccaaacgaagugau

SEQ ID NO: 2872926 - RNA, 16 nt, Mycobacterium avium subsp. paratuberculosis
acuccaccaccggccg

SEQ ID NO: 2872927 - RNA, 17 nt, Mycobacterium avium subsp. paratuberculosis
acuccaccaccggccgc

SEQ ID NO: 2872928 - RNA, 18 nt, Mycobacterium avium subsp. paratuberculosis
acuccaccaccggccgcg

SEQ ID NO: 2872929 - RNA, 19 nt, Mycobacterium avium subsp. paratuberculosis
acuccaccaccggccgcgc

SEQ ID NO: 2872930 - RNA, 12 nt, Mycobacterium avium subsp. paratuberculosis
acuccaccaccu

SEQ ID NO: 2872931 - RNA, 19 nt, Mycobacterium avium subsp. paratuberculosis
acuccaccaccuggccggc

SEQ ID NO: 2872932 - RNA, 13 nt, Mycobacterium avium subsp. paratuberculosis
acuccacccugcc

SEQ ID NO: 2872933 - RNA, 15 nt, Mycobacterium avium subsp. paratuberculosis
acuccaccgccaccg

SEQ ID NO: 2872934 - RNA, 23 nt, Mycobacterium avium subsp. paratuberculosis
acuccagcaccagcacggcgacc

SEQ ID NO: 2872935 - RNA, 14 nt, Mycobacterium avium subsp. paratuberculosis
acuccagcaccgga

SEQ ID NO: 2872936 - RNA, 17 nt, Mycobacterium avium subsp. paratuberculosis
acuccagcaccggcgcc

SEQ ID NO: 2872937 - RNA, 18 nt, Mycobacterium avium subsp. paratuberculosis
acuccagcaccggcgcca

SEQ ID NO: 2872938 - RNA, 19 nt, Mycobacterium avium subsp. paratuberculosis
acuccagcaccggcgccau

SEQ ID NO: 2872939 - RNA, 15 nt, Mycobacterium avium subsp. paratuberculosis
acuccagcagcgcca

SEQ ID NO: 2872940 - RNA, 19 nt, Mycobacterium avium subsp. paratuberculosis
acuccagcagcgccagcac

SEQ ID NO: 2872941 - RNA, 18 nt, Mycobacterium avium subsp. paratuberculosis
acuccagcagcgccuugc

SEQ ID NO: 2872942 - RNA, 13 nt, Mycobacterium avium subsp. paratuberculosis
acuccagcagcug

SEQ ID NO: 2872943 - RNA, 15 nt, Mycobacterium avium subsp. paratuberculosis
acuccagcgcgauca

SEQ ID NO: 2872944 - RNA, 13 nt, Mycobacterium avium subsp. paratuberculosis
acuccagcggcgg

SEQ ID NO: 2872945 - RNA, 14 nt, Mycobacterium avium subsp. paratuberculosis
acuccagcggcggc

SEQ ID NO: 2872946 - RNA, 23 nt, Mycobacterium avium subsp. paratuberculosis
acuccaggguucucgcggcggcc

SEQ ID NO: 2872947 - RNA, 15 nt, Mycobacterium avium subsp. paratuberculosis
acuccaguugacggc

SEQ ID NO: 2872948 - RNA, 22 nt, Mycobacterium avium subsp. paratuberculosis
acuccaucacgaccucgaacac

SEQ ID NO: 2872949 - RNA, 13 nt, Mycobacterium avium subsp. paratuberculosis
acucccagccgcc

SEQ ID NO: 2872950 - RNA, 15 nt, Mycobacterium avium subsp. paratuberculosis
acucccaggccgcgg

SEQ ID NO: 2872951 - RNA, 16 nt, Mycobacterium avium subsp. paratuberculosis
acucccaggccgcggc

SEQ ID NO: 2872952 - RNA, 17 nt, Mycobacterium avium subsp. paratuberculosis
acucccaggccgcggcc

SEQ ID NO: 2872953 - RNA, 18 nt, Mycobacterium avium subsp. paratuberculosis
acucccaggccgcggcca

SEQ ID NO: 2872954 - RNA, 13 nt, Mycobacterium avium subsp. paratuberculosis
acucccccaccac

SEQ ID NO: 2872955 - RNA, 16 nt, Mycobacterium avium subsp. paratuberculosis
acucccgcgccgcggc

SEQ ID NO: 2872956 - RNA, 18 nt, Mycobacterium avium subsp. paratuberculosis
acucccgcgccgcggcca

SEQ ID NO: 2872957 - RNA, 23 nt, Mycobacterium avium subsp. paratuberculosis
acuccgcgauggccuccgacccg

SEQ ID NO: 2872958 - RNA, 19 nt, Mycobacterium avium subsp. paratuberculosis
acuccgcucgggcccgcgc

SEQ ID NO: 2872959 - RNA, 12 nt, Mycobacterium avium subsp. paratuberculosis
acuccggcgaca

SEQ ID NO: 2872960 - RNA, 12 nt, Mycobacterium avium subsp. paratuberculosis
acuccggcgccg

SEQ ID NO: 2872961 - RNA, 17 nt, Mycobacterium avium subsp. paratuberculosis
acuccggcgccggucag

SEQ ID NO: 2872962 - RNA, 18 nt, Mycobacterium avium subsp. paratuberculosis
acuccggcggcagccagg

SEQ ID NO: 2872963 - RNA, 15 nt, Mycobacterium avium subsp. paratuberculosis
acuccggguggaacu

SEQ ID NO: 2872964 - RNA, 22 nt, Mycobacterium avium subsp. paratuberculosis
acuccgguaccacgccgucgac

SEQ ID NO: 2872965 - RNA, 13 nt, Mycobacterium avium subsp. paratuberculosis
acuccgucgcgau

SEQ ID NO: 2872966 - RNA, 17 nt, Mycobacterium avium subsp. paratuberculosis
acuccgucucgccguac

SEQ ID NO: 2872967 - RNA, 13 nt, Mycobacterium avium subsp. paratuberculosis
acuccucacaccu

SEQ ID NO: 2872968 - RNA, 14 nt, Mycobacterium avium subsp. paratuberculosis
acuccucacaccuc

SEQ ID NO: 2872969 - RNA, 15 nt, Mycobacterium avium subsp. paratuberculosis
acuccuccucggcca

SEQ ID NO: 2872970 - RNA, 21 nt, Mycobacterium avium subsp. paratuberculosis
acuccuccucggccagcccca

SEQ ID NO: 2872971 - RNA, 22 nt, Mycobacterium avium subsp. paratuberculosis
acuccuccucggccagccccac

SEQ ID NO: 2872972 - RNA, 17 nt, Mycobacterium avium subsp. paratuberculosis
acuccucgaucugggcc

SEQ ID NO: 2872973 - RNA, 14 nt, Mycobacterium avium subsp. paratuberculosis
acuccucgcgaugg

SEQ ID NO: 2872974 - RNA, 13 nt, Mycobacterium avium subsp. paratuberculosis
acuccuggccccg

SEQ ID NO: 2872975 - RNA, 15 nt, Mycobacterium avium subsp. paratuberculosis
acuccuggccccgau

SEQ ID NO: 2872976 - RNA, 19 nt, Mycobacterium avium subsp. paratuberculosis
acuccuggguaagccaggu

SEQ ID NO: 2872977 - RNA, 15 nt, Mycobacterium avium subsp. paratuberculosis
acucgaagcugcgcc

SEQ ID NO: 2872978 - RNA, 17 nt, Mycobacterium avium subsp. paratuberculosis
acucgaccccgcccagc

SEQ ID NO: 2872979 - RNA, 17 nt, Mycobacterium avium subsp. paratuberculosis
acucgaccgcgacuuuc

SEQ ID NO: 2872980 - RNA, 19 nt, Mycobacterium avium subsp. paratuberculosis
acucgaccugcccgggccc

SEQ ID NO: 2872981 - RNA, 20 nt, Mycobacterium avium subsp. paratuberculosis
acucgaccugcccgggcccg

SEQ ID NO: 2872982 - RNA, 22 nt, Mycobacterium avium subsp. paratuberculosis
acucgaccuucgagccgccgcc

SEQ ID NO: 2872983 - RNA, 13 nt, Mycobacterium avium subsp. paratuberculosis
acucgacggagug

SEQ ID NO: 2872984 - RNA, 21 nt, Mycobacterium avium subsp. paratuberculosis
acucgacggagugcgugucac

SEQ ID NO: 2872985 - RNA, 15 nt, Mycobacterium avium subsp. paratuberculosis
acucgacguucggcg

SEQ ID NO: 2872986 - RNA, 19 nt, Mycobacterium avium subsp. paratuberculosis
acucgacguucggcgggca

SEQ ID NO: 2872987 - RNA, 14 nt, Mycobacterium avium subsp. paratuberculosis
acucgagcgcgcuc

SEQ ID NO: 2872988 - RNA, 22 nt, Mycobacterium avium subsp. paratuberculosis
acucgagcgcgcucaaccgccc

SEQ ID NO: 2872989 - RNA, 15 nt, Mycobacterium avium subsp. paratuberculosis
acucgaucagcaccg

SEQ ID NO: 2872990 - RNA, 19 nt, Mycobacterium avium subsp. paratuberculosis
acucgaucagcaccgccac

SEQ ID NO: 2872991 - RNA, 13 nt, Mycobacterium avium subsp. paratuberculosis
acucgaucgccac

SEQ ID NO: 2872992 - RNA, 16 nt, Mycobacterium avium subsp. paratuberculosis
acucgaucgccaccga

SEQ ID NO: 2872993 - RNA, 15 nt, Mycobacterium avium subsp. paratuberculosis
acucgaucugcagcc

SEQ ID NO: 2872994 - RNA, 21 nt, Mycobacterium avium subsp. paratuberculosis
acucgaugcgcgugacgcgcg

SEQ ID NO: 2872995 - RNA, 17 nt, Mycobacterium avium subsp. paratuberculosis
acucgaugcggcagcuu

SEQ ID NO: 2872996 - RNA, 18 nt, Mycobacterium avium subsp. paratuberculosis
acucgaugggggugccgc

SEQ ID NO: 2872997 - RNA, 18 nt, Mycobacterium avium subsp. paratuberculosis
acucgauguagccgggcu

SEQ ID NO: 2872998 - RNA, 15 nt, Mycobacterium avium subsp. paratuberculosis
acucgcaggugccgg

SEQ ID NO: 2872999 - RNA, 17 nt, Mycobacterium avium subsp. paratuberculosis
acucgcaggugccggug

SEQ ID NO: 2873000 - RNA, 22 nt, Mycobacterium avium subsp. paratuberculosis
acucgcccagggcgugcgcggc

SEQ ID NO: 2873001 - RNA, 20 nt, Mycobacterium avium subsp. paratuberculosis
acucgccgcgaacgacgacc

SEQ ID NO: 2873002 - RNA, 19 nt, Mycobacterium avium subsp. paratuberculosis
acucgccggagcgccccag

SEQ ID NO: 2873003 - RNA, 15 nt, Mycobacterium avium subsp. paratuberculosis
acucgccggcggcgc

SEQ ID NO: 2873004 - RNA, 16 nt, Mycobacterium avium subsp. paratuberculosis
acucgccggcggcgcc

SEQ ID NO: 2873005 - RNA, 18 nt, Mycobacterium avium subsp. paratuberculosis
acucgccggcggcgccgg

SEQ ID NO: 2873006 - RNA, 21 nt, Mycobacterium avium subsp. paratuberculosis
acucgccucggaggccaccgc

SEQ ID NO: 2873007 - RNA, 14 nt, Mycobacterium avium subsp. paratuberculosis
acucgcgaggccgc

SEQ ID NO: 2873008 - RNA, 20 nt, Mycobacterium avium subsp. paratuberculosis
acucgcgcucccggcgccgc

SEQ ID NO: 2873009 - RNA, 19 nt, Mycobacterium avium subsp. paratuberculosis
acucgcgggacggcggcga

SEQ ID NO: 2873010 - RNA, 20 nt, Mycobacterium avium subsp. paratuberculosis
acucgcgggcgagcagcgcc

SEQ ID NO: 2873011 - RNA, 22 nt, Mycobacterium avium subsp. paratuberculosis
acucgcgggcgagcagcgcccg

SEQ ID NO: 2873012 - RNA, 21 nt, Mycobacterium avium subsp. paratuberculosis
acucgcguccccgcgccgggc

SEQ ID NO: 2873013 - RNA, 22 nt, Mycobacterium avium subsp. paratuberculosis
acucgcguccccgcgccgggca

SEQ ID NO: 2873014 - RNA, 21 nt, Mycobacterium avium subsp. paratuberculosis
acucgcugcgauugguggccc

SEQ ID NO: 2873015 - RNA, 16 nt, Mycobacterium avium subsp. paratuberculosis
acucggacagguggcc

SEQ ID NO: 2873016 - RNA, 15 nt, Mycobacterium avium subsp. paratuberculosis
acucggacgccggca

SEQ ID NO: 2873017 - RNA, 22 nt, Mycobacterium avium subsp. paratuberculosis
acucggccaggaugaacacccg

SEQ ID NO: 2873018 - RNA, 22 nt, Mycobacterium avium subsp. paratuberculosis
acucggccagggcucgugcagc

SEQ ID NO: 2873019 - RNA, 20 nt, Mycobacterium avium subsp. paratuberculosis
acucggccuccgcgcgcggc

SEQ ID NO: 2873020 - RNA, 15 nt, Mycobacterium avium subsp. paratuberculosis
acucggccuucgccu

SEQ ID NO: 2873021 - RNA, 23 nt, Mycobacterium avium subsp. paratuberculosis
acucggcgaagucaucaccgggg

SEQ ID NO: 2873022 - RNA, 17 nt, Mycobacterium avium subsp. paratuberculosis
acucggcgaugcgccgu

SEQ ID NO: 2873023 - RNA, 18 nt, Mycobacterium avium subsp. paratuberculosis
acucggcgccgccggucg

SEQ ID NO: 2873024 - RNA, 19 nt, Mycobacterium avium subsp. paratuberculosis
acucggcgccgccggucgc

SEQ ID NO: 2873025 - RNA, 14 nt, Mycobacterium avium subsp. paratuberculosis
acucggcggcgggc

SEQ ID NO: 2873026 - RNA, 16 nt, Mycobacterium avium subsp. paratuberculosis
acucggcggcgggcag

SEQ ID NO: 2873027 - RNA, 15 nt, Mycobacterium avium subsp. paratuberculosis
acucggcggugccgu

SEQ ID NO: 2873028 - RNA, 16 nt, Mycobacterium avium subsp. paratuberculosis
acucggcggugccguc

SEQ ID NO: 2873029 - RNA, 22 nt, Mycobacterium avium subsp. paratuberculosis
acucggcggugccguccucggc

SEQ ID NO: 2873030 - RNA, 16 nt, Mycobacterium avium subsp. paratuberculosis
acucggcgucgccgag

SEQ ID NO: 2873031 - RNA, 18 nt, Mycobacterium avium subsp. paratuberculosis
acucggcgucgccgagcu

SEQ ID NO: 2873032 - RNA, 17 nt, Mycobacterium avium subsp. paratuberculosis
acucggcuucgucgggu

SEQ ID NO: 2873033 - RNA, 19 nt, Mycobacterium avium subsp. paratuberculosis
acucgggaaaugcgucggc

SEQ ID NO: 2873034 - RNA, 21 nt, Mycobacterium avium subsp. paratuberculosis
acucgggaaaugcgucggcag

SEQ ID NO: 2873035 - RNA, 18 nt, Mycobacterium avium subsp. paratuberculosis
acucgggcaacgcgccgg

SEQ ID NO: 2873036 - RNA, 20 nt, Mycobacterium avium subsp. paratuberculosis
acucgggcaacgcgccggcg

SEQ ID NO: 2873037 - RNA, 15 nt, Mycobacterium avium subsp. paratuberculosis
acucgggccagccca

SEQ ID NO: 2873038 - RNA, 14 nt, Mycobacterium avium subsp. paratuberculosis
acuucgcguuccgc

SEQ ID NO: 2873039 - RNA, 22 nt, Mycobacterium avium subsp. paratuberculosis
acuucggcucggcgacaacagc

SEQ ID NO: 2873040 - RNA, 20 nt, Mycobacterium avium subsp. paratuberculosis
acuucguugguggucgacgc

SEQ ID NO: 2873041 - RNA, 22 nt, Mycobacterium avium subsp. paratuberculosis
acuucguugguggucgacgcgc

SEQ ID NO: 2873042 - RNA, 22 nt, Mycobacterium avium subsp. paratuberculosis
acuucuacggcgggccggcgcc

SEQ ID NO: 2873043 - RNA, 18 nt, Mycobacterium avium subsp. paratuberculosis
acuucuccacgccgacga

SEQ ID NO: 2873044 - RNA, 12 nt, Mycobacterium avium subsp. paratuberculosis
acuucuucgccg

SEQ ID NO: 2873045 - RNA, 14 nt, Mycobacterium avium subsp. paratuberculosis
acuugaccagcagc

SEQ ID NO: 2873046 - RNA, 16 nt, Mycobacterium avium subsp. paratuberculosis
acuugaccagcagcug

SEQ ID NO: 2873047 - RNA, 14 nt, Mycobacterium avium subsp. paratuberculosis
acuugaucgcggcg

SEQ ID NO: 2873048 - RNA, 19 nt, Mycobacterium avium subsp. paratuberculosis
acuugaugcugcccggcgc

SEQ ID NO: 2873049 - RNA, 20 nt, Mycobacterium avium subsp. paratuberculosis
acuugaugcugcccggcgcc

SEQ ID NO: 2873050 - RNA, 15 nt, Mycobacterium avium subsp. paratuberculosis
acuugccgaucaccu

SEQ ID NO: 2873051 - RNA, 12 nt, Mycobacterium avium subsp. paratuberculosis
acuugccgccgc

SEQ ID NO: 2873052 - RNA, 23 nt, Mycobacterium avium subsp. paratuberculosis
acuugcgccggguggccggggcc

SEQ ID NO: 2873053 - RNA, 20 nt, Mycobacterium avium subsp. paratuberculosis
acuuggccucgggcgacgac

SEQ ID NO: 2873054 - RNA, 21 nt, Mycobacterium avium subsp. paratuberculosis
acuuguggaaggcgccggcgc

SEQ ID NO: 2873055 - RNA, 16 nt, Mycobacterium avium subsp. paratuberculosis
acuuguucgagaugcg

SEQ ID NO: 2873056 - RNA, 21 nt, Mycobacterium avium subsp. paratuberculosis
acuuguugacgaaaccgccau

SEQ ID NO: 2873057 - RNA, 18 nt, Mycobacterium avium subsp. paratuberculosis
acuuucgcgagcgcgcuu

SEQ ID NO: 2873058 - RNA, 13 nt, Mycobacterium avium subsp. paratuberculosis
acuuucgcggcaa

SEQ ID NO: 2873059 - RNA, 17 nt, Mycobacterium avium subsp. paratuberculosis
agaaaagcgaccagcgc

SEQ ID NO: 2873060 - RNA, 16 nt, Mycobacterium avium subsp. paratuberculosis
agaaaauccagaacag

SEQ ID NO: 2873061 - RNA, 23 nt, Mycobacterium avium subsp. paratuberculosis
agaacaauguuuuucugcucuuc

SEQ ID NO: 2873062 - RNA, 20 nt, Mycobacterium avium subsp. paratuberculosis
agaacacguuucggcccucc

SEQ ID NO: 2873063 - RNA, 23 nt, Mycobacterium avium subsp. paratuberculosis
agaacauuucgucgaaguagggc

SEQ ID NO: 2873064 - RNA, 21 nt, Mycobacterium avium subsp. paratuberculosis
agaaccaacugagcgcggcga

SEQ ID NO: 2873065 - RNA, 15 nt, Mycobacterium avium subsp. paratuberculosis
agaaccagcccggcc

SEQ ID NO: 2873066 - RNA, 16 nt, Mycobacterium avium subsp. paratuberculosis
agaaccagcccggccc

SEQ ID NO: 2873067 - RNA, 17 nt, Mycobacterium avium subsp. paratuberculosis
agaaccagcccggcccg

SEQ ID NO: 2873068 - RNA, 18 nt, Mycobacterium avium subsp. paratuberculosis
agaaccagcccggcccgu

SEQ ID NO: 2873069 - RNA, 14 nt, Mycobacterium avium subsp. paratuberculosis
agaacccggcgugc

SEQ ID NO: 2873070 - RNA, 19 nt, Mycobacterium avium subsp. paratuberculosis
agaaccgcaacaccagcac

SEQ ID NO: 2873071 - RNA, 16 nt, Mycobacterium avium subsp. paratuberculosis
agaaccgcucggcggc

SEQ ID NO: 2873072 - RNA, 20 nt, Mycobacterium avium subsp. paratuberculosis
agaaccgcucggcggcgccg

SEQ ID NO: 2873073 - RNA, 12 nt, Mycobacterium avium subsp. paratuberculosis
agaaccggggcc

SEQ ID NO: 2873074 - RNA, 16 nt, Mycobacterium avium subsp. paratuberculosis
agaaccucaacgugac

SEQ ID NO: 2873075 - RNA, 23 nt, Mycobacterium avium subsp. paratuberculosis
agaacgacgccaguucgucggcc

SEQ ID NO: 2873076 - RNA, 23 nt, Mycobacterium avium subsp. paratuberculosis
agaacgacgcgcucagccccagc

SEQ ID NO: 2873077 - RNA, 13 nt, Mycobacterium avium subsp. paratuberculosis
agaacgacuggcg

SEQ ID NO: 2873078 - RNA, 17 nt, Mycobacterium avium subsp. paratuberculosis
agaacgacuggcggcgg

SEQ ID NO: 2873079 - RNA, 17 nt, Mycobacterium avium subsp. paratuberculosis
agaacgcaaucgcccag

SEQ ID NO: 2873080 - RNA, 21 nt, Mycobacterium avium subsp. paratuberculosis
agaacgggcugaacucgacgu

SEQ ID NO: 2873081 - RNA, 22 nt, Mycobacterium avium subsp. paratuberculosis
agaacgucaggcccagcgaggc

SEQ ID NO: 2873082 - RNA, 17 nt, Mycobacterium avium subsp. paratuberculosis
agaacucgaucugcagc

SEQ ID NO: 2873083 - RNA, 20 nt, Mycobacterium avium subsp. paratuberculosis
agaacucgaucugcagccgg

SEQ ID NO: 2873084 - RNA, 22 nt, Mycobacterium avium subsp. paratuberculosis
agaacuggcugagcaccggggu

SEQ ID NO: 2873085 - RNA, 14 nt, Mycobacterium avium subsp. paratuberculosis
agaacugggccgcc

SEQ ID NO: 2873086 - RNA, 16 nt, Mycobacterium avium subsp. paratuberculosis
agaacuucaucuggaa

SEQ ID NO: 2873087 - RNA, 18 nt, Mycobacterium avium subsp. paratuberculosis
agaacuucgccagcgggc

SEQ ID NO: 2873088 - RNA, 23 nt, Mycobacterium avium subsp. paratuberculosis
agaacuucgccagcgggccgacc

SEQ ID NO: 2873089 - RNA, 18 nt, Mycobacterium avium subsp. paratuberculosis
agaacuucuccgccggca

SEQ ID NO: 2873090 - RNA, 21 nt, Mycobacterium avium subsp. paratuberculosis
agaagccccgguuccaaccac

SEQ ID NO: 2873091 - RNA, 18 nt, Mycobacterium avium subsp. paratuberculosis
agaagccgugggugccga

SEQ ID NO: 2873092 - RNA, 19 nt, Mycobacterium avium subsp. paratuberculosis
agaagcggccgacgaacaa

SEQ ID NO: 2873093 - RNA, 12 nt, Mycobacterium avium subsp. paratuberculosis
agaagcgggcca

SEQ ID NO: 2873094 - RNA, 14 nt, Mycobacterium avium subsp. paratuberculosis
agaagcuaacgcca

SEQ ID NO: 2873095 - RNA, 18 nt, Mycobacterium avium subsp. paratuberculosis
agaagcuccacgccgccg

SEQ ID NO: 2873096 - RNA, 21 nt, Mycobacterium avium subsp. paratuberculosis
agaagcuccacgccgccggga

SEQ ID NO: 2873097 - RNA, 14 nt, Mycobacterium avium subsp. paratuberculosis
agaaggcgccgucg

SEQ ID NO: 2873098 - RNA, 14 nt, Mycobacterium avium subsp. paratuberculosis
agaaggcggcgucg

SEQ ID NO: 2873099 - RNA, 15 nt, Mycobacterium avium subsp. paratuberculosis
agaaggcggcgucga

SEQ ID NO: 2873100 - RNA, 20 nt, Mycobacterium avium subsp. paratuberculosis
agaaggcgucaucguggaca

SEQ ID NO: 2873101 - RNA, 17 nt, Mycobacterium avium subsp. paratuberculosis
agaaguauucgccgucg

SEQ ID NO: 2873102 - RNA, 20 nt, Mycobacterium avium subsp. paratuberculosis
agaaguccuuguggcccagg

SEQ ID NO: 2873103 - RNA, 21 nt, Mycobacterium avium subsp. paratuberculosis
agaaguccuuguggcccaggc

SEQ ID NO: 2873104 - RNA, 21 nt, Mycobacterium avium subsp. paratuberculosis
agaagucgauugccgcggccg

SEQ ID NO: 2873105 - RNA, 23 nt, Mycobacterium avium subsp. paratuberculosis
agaagucgauugccgcggccgcg

SEQ ID NO: 2873106 - RNA, 15 nt, Mycobacterium avium subsp. paratuberculosis
agaagucgcccgcgu

SEQ ID NO: 2873107 - RNA, 15 nt, Mycobacterium avium subsp. paratuberculosis
agaagugggccauca

SEQ ID NO: 2873108 - RNA, 15 nt, Mycobacterium avium subsp. paratuberculosis
agaaguggucgaucu

SEQ ID NO: 2873109 - RNA, 17 nt, Mycobacterium avium subsp. paratuberculosis
agaaguggucgaucugc

SEQ ID NO: 2873110 - RNA, 19 nt, Mycobacterium avium subsp. paratuberculosis
agaauucgccggggcacca

SEQ ID NO: 2873111 - RNA, 20 nt, Mycobacterium avium subsp. paratuberculosis
agacaaccggugugccuggc

SEQ ID NO: 2873112 - RNA, 19 nt, Mycobacterium avium subsp. paratuberculosis
agacagcguggucgcgcag

SEQ ID NO: 2873113 - RNA, 14 nt, Mycobacterium avium subsp. paratuberculosis
agacaggccggccg

SEQ ID NO: 2873114 - RNA, 21 nt, Mycobacterium avium subsp. paratuberculosis
agacauucggggccaccaggc

SEQ ID NO: 2873115 - RNA, 14 nt, Mycobacterium avium subsp. paratuberculosis
agaccagcaucagc

SEQ ID NO: 2873116 - RNA, 14 nt, Mycobacterium avium subsp. paratuberculosis
agaccagcgacgcc

SEQ ID NO: 2873117 - RNA, 22 nt, Mycobacterium avium subsp. paratuberculosis
agaccagcgugucgccggggcg

SEQ ID NO: 2873118 - RNA, 15 nt, Mycobacterium avium subsp. paratuberculosis
agaccaugccgccga

SEQ ID NO: 2873119 - RNA, 16 nt, Mycobacterium avium subsp. paratuberculosis
agaccaugccgccgaa

SEQ ID NO: 2873120 - RNA, 16 nt, Mycobacterium avium subsp. paratuberculosis
agaccaugucggccag

SEQ ID NO: 2873121 - RNA, 18 nt, Mycobacterium avium subsp. paratuberculosis
agaccaugucggccaggu

SEQ ID NO: 2873122 - RNA, 15 nt, Mycobacterium avium subsp. paratuberculosis
agacccacagcugcc

SEQ ID NO: 2873123 - RNA, 16 nt, Mycobacterium avium subsp. paratuberculosis
agacccacagcugccg

SEQ ID NO: 2873124 - RNA, 19 nt, Mycobacterium avium subsp. paratuberculosis
agacccacagcugccggcc

SEQ ID NO: 2873125 - RNA, 13 nt, Mycobacterium avium subsp. paratuberculosis
agacccagcagcg

SEQ ID NO: 2873126 - RNA, 16 nt, Mycobacterium avium subsp. paratuberculosis
agacccgaaacuggga

SEQ ID NO: 2873127 - RNA, 13 nt, Mycobacterium avium subsp. paratuberculosis
agacccgccgcgg

SEQ ID NO: 2873128 - RNA, 13 nt, Mycobacterium avium subsp. paratuberculosis
agacccgcgucga

SEQ ID NO: 2873129 - RNA, 19 nt, Mycobacterium avium subsp. paratuberculosis
agacccuggaugaucucga

SEQ ID NO: 2873130 - RNA, 22 nt, Mycobacterium avium subsp. paratuberculosis
agacccuggaugaucucgaugc

SEQ ID NO: 2873131 - RNA, 14 nt, Mycobacterium avium subsp. paratuberculosis
agacccuguggguc

SEQ ID NO: 2873132 - RNA, 17 nt, Mycobacterium avium subsp. paratuberculosis
agaccgaacgucacggc

SEQ ID NO: 2873133 - RNA, 20 nt, Mycobacterium avium subsp. paratuberculosis
agaccgaagaucaccgcgac

SEQ ID NO: 2873134 - RNA, 11 nt, Mycobacterium avium subsp. paratuberculosis
agaccgcggcg

SEQ ID NO: 2873135 - RNA, 14 nt, Mycobacterium avium subsp. paratuberculosis
agaccgcggcgguc

SEQ ID NO: 2873136 - RNA, 19 nt, Mycobacterium avium subsp. paratuberculosis
agaccgcggcggucgccac

SEQ ID NO: 2873137 - RNA, 17 nt, Mycobacterium avium subsp. paratuberculosis
agaccgcggucaccggu

SEQ ID NO: 2873138 - RNA, 16 nt, Mycobacterium avium subsp. paratuberculosis
agaccgcuugcggcuc

SEQ ID NO: 2873139 - RNA, 22 nt, Mycobacterium avium subsp. paratuberculosis
agaccggccggggcgggcacgu

SEQ ID NO: 2873140 - RNA, 12 nt, Mycobacterium avium subsp. paratuberculosis
agaccucccggc

SEQ ID NO: 2873141 - RNA, 13 nt, Mycobacterium avium subsp. paratuberculosis
agaccucgccgac

SEQ ID NO: 2873142 - RNA, 17 nt, Mycobacterium avium subsp. paratuberculosis
agaccucgccgacggug

SEQ ID NO: 2873143 - RNA, 21 nt, Mycobacterium avium subsp. paratuberculosis
agaccucuugggacuggaugg

SEQ ID NO: 2873144 - RNA, 17 nt, Mycobacterium avium subsp. paratuberculosis
agaccuugaccaccgag

SEQ ID NO: 2873145 - RNA, 14 nt, Mycobacterium avium subsp. paratuberculosis
agacgaacgcggcc

SEQ ID NO: 2873146 - RNA, 13 nt, Mycobacterium avium subsp. paratuberculosis
agacgaccagguc

SEQ ID NO: 2873147 - RNA, 23 nt, Mycobacterium avium subsp. paratuberculosis
agacgaccagguccaccccgcca

SEQ ID NO: 2873148 - RNA, 20 nt, Mycobacterium avium subsp. paratuberculosis
agacgacgacgaacgcggug

SEQ ID NO: 2873149 - RNA, 18 nt, Mycobacterium avium subsp. paratuberculosis
agacgacgucgaccgcgc

SEQ ID NO: 2873150 - RNA, 19 nt, Mycobacterium avium subsp. paratuberculosis
agacgacgucgaccgcgcc

SEQ ID NO: 2873151 - RNA, 15 nt, Mycobacterium avium subsp. paratuberculosis
agacgagccgccgcg

SEQ ID NO: 2873152 - RNA, 18 nt, Mycobacterium avium subsp. paratuberculosis
agacgagcucaccgccga

SEQ ID NO: 2873153 - RNA, 19 nt, Mycobacterium avium subsp. paratuberculosis
agacgagcucaccgccgau

SEQ ID NO: 2873154 - RNA, 14 nt, Mycobacterium avium subsp. paratuberculosis
agacgaucaccggc

SEQ ID NO: 2873155 - RNA, 17 nt, Mycobacterium avium subsp. paratuberculosis
agacgaucucgccgucc

SEQ ID NO: 2873156 - RNA, 22 nt, Mycobacterium avium subsp. paratuberculosis
agacgaugaaaccccagccggc

SEQ ID NO: 2873157 - RNA, 14 nt, Mycobacterium avium subsp. paratuberculosis
agacgaugcccagc

SEQ ID NO: 2873158 - RNA, 18 nt, Mycobacterium avium subsp. paratuberculosis
agacgcgaaagcacccga

SEQ ID NO: 2873159 - RNA, 14 nt, Mycobacterium avium subsp. paratuberculosis
agacgcgcaccagg

SEQ ID NO: 2873160 - RNA, 15 nt, Mycobacterium avium subsp. paratuberculosis
agacgcgcaccaggg

SEQ ID NO: 2873161 - RNA, 19 nt, Mycobacterium avium subsp. paratuberculosis
agacgcgcaccgccaccgc

SEQ ID NO: 2873162 - RNA, 22 nt, Mycobacterium avium subsp. paratuberculosis
agacgcgcaccgccaccgcccg

SEQ ID NO: 2873163 - RNA, 14 nt, Mycobacterium avium subsp. paratuberculosis
agacgcgggccggc

SEQ ID NO: 2873164 - RNA, 17 nt, Mycobacterium avium subsp. paratuberculosis
agacgcgggcgcccagc

SEQ ID NO: 2873165 - RNA, 20 nt, Mycobacterium avium subsp. paratuberculosis
agacgcgggcgcccagcaaa

SEQ ID NO: 2873166 - RNA, 20 nt, Mycobacterium avium subsp. paratuberculosis
agacggccagcagcaccgcg

SEQ ID NO: 2873167 - RNA, 12 nt, Mycobacterium avium subsp. paratuberculosis
agacggcgaggu

SEQ ID NO: 2873168 - RNA, 23 nt, Mycobacterium avium subsp. paratuberculosis
agacggcguggcugaggccgccc

SEQ ID NO: 2873169 - RNA, 21 nt, Mycobacterium avium subsp. paratuberculosis
agacguaagccauggcggccc

SEQ ID NO: 2873170 - RNA, 14 nt, Mycobacterium avium subsp. paratuberculosis
agacguagcaccag

SEQ ID NO: 2873171 - RNA, 14 nt, Mycobacterium avium subsp. paratuberculosis
agacguaggcggcc

SEQ ID NO: 2873172 - RNA, 17 nt, Mycobacterium avium subsp. paratuberculosis
agacguaggcggccagc

SEQ ID NO: 2873173 - RNA, 19 nt, Mycobacterium avium subsp. paratuberculosis
agacguagugcagccgccc

SEQ ID NO: 2873174 - RNA, 20 nt, Mycobacterium avium subsp. paratuberculosis
agacguccagcgccgccauc

SEQ ID NO: 2873175 - RNA, 13 nt, Mycobacterium avium subsp. paratuberculosis
agacguccgcguc

SEQ ID NO: 2873176 - RNA, 18 nt, Mycobacterium avium subsp. paratuberculosis
agacguccgcgucggcgc

SEQ ID NO: 2873177 - RNA, 19 nt, Mycobacterium avium subsp. paratuberculosis
agacguccgcgucggcgcc

SEQ ID NO: 2873178 - RNA, 22 nt, Mycobacterium avium subsp. paratuberculosis
agacguccgcgucggcgccggc

SEQ ID NO: 2873179 - RNA, 24 nt, Mycobacterium avium subsp. paratuberculosis
agacguccgcgucggcgccggcca

SEQ ID NO: 2873180 - RNA, 20 nt, Mycobacterium avium subsp. paratuberculosis
agacgucgaccuugcagccc

SEQ ID NO: 2873181 - RNA, 12 nt, Mycobacterium avium subsp. paratuberculosis
agacgucggccg

SEQ ID NO: 2873182 - RNA, 14 nt, Mycobacterium avium subsp. paratuberculosis
agacgucggccggg

SEQ ID NO: 2873183 - RNA, 12 nt, Mycobacterium avium subsp. paratuberculosis
agacgucggcgc

SEQ ID NO: 2873184 - RNA, 22 nt, Mycobacterium avium subsp. paratuberculosis
agacgucggcgcggucgcaggc

SEQ ID NO: 2873185 - RNA, 12 nt, Mycobacterium avium subsp. paratuberculosis
agacgucggcgu

SEQ ID NO: 2873186 - RNA, 21 nt, Mycobacterium avium subsp. paratuberculosis
agacgucgggcugggcggggu

SEQ ID NO: 2873187 - RNA, 12 nt, Mycobacterium avium subsp. paratuberculosis
agacgugcacgu

SEQ ID NO: 2873188 - RNA, 14 nt, Mycobacterium avium subsp. paratuberculosis
agacguggcggcgg

SEQ ID NO: 2873189 - RNA, 19 nt, Mycobacterium avium subsp. paratuberculosis
agacguugccgaucccggc

SEQ ID NO: 2873190 - RNA, 17 nt, Mycobacterium avium subsp. paratuberculosis
agacguugccgcacacc

SEQ ID NO: 2873191 - RNA, 18 nt, Mycobacterium avium subsp. paratuberculosis
agacguugccgcacaccg

SEQ ID NO: 2873192 - RNA, 14 nt, Mycobacterium avium subsp. paratuberculosis
agacucagcccggc

SEQ ID NO: 2873193 - RNA, 19 nt, Mycobacterium avium subsp. paratuberculosis
agacugaugaagccgccga

SEQ ID NO: 2873194 - RNA, 13 nt, Mycobacterium avium subsp. paratuberculosis
agacugaugcccu

SEQ ID NO: 2873195 - RNA, 21 nt, Mycobacterium avium subsp. paratuberculosis
agacugaugcccucgccgguc

SEQ ID NO: 2873196 - RNA, 14 nt, Mycobacterium avium subsp. paratuberculosis
agacugaugguggc

SEQ ID NO: 2873197 - RNA, 21 nt, Mycobacterium avium subsp. paratuberculosis
agacugccgagcaucagcugc

SEQ ID NO: 2873198 - RNA, 22 nt, Mycobacterium avium subsp. paratuberculosis
agacugccgagcaucagcugcc

SEQ ID NO: 2873199 - RNA, 17 nt, Mycobacterium avium subsp. paratuberculosis
agagaucgccccgccgu

SEQ ID NO: 2873200 - RNA, 20 nt, Mycobacterium avium subsp. paratuberculosis
agagcaggaccgagccgcgc

SEQ ID NO: 2873201 - RNA, 19 nt, Mycobacterium avium subsp. paratuberculosis
agagccgcugcacgcguug

SEQ ID NO: 2873202 - RNA, 18 nt, Mycobacterium avium subsp. paratuberculosis
agagccguuuggcgccgc

SEQ ID NO: 2873203 - RNA, 20 nt, Mycobacterium avium subsp. paratuberculosis
agagcgcgucgacgcggucg

SEQ ID NO: 2873204 - RNA, 21 nt, Mycobacterium avium subsp. paratuberculosis
agagcgcgucgacgcggucga

SEQ ID NO: 2873205 - RNA, 14 nt, Mycobacterium avium subsp. paratuberculosis
agagcggcaccagg

SEQ ID NO: 2873206 - RNA, 22 nt, Mycobacterium avium subsp. paratuberculosis
agagcgggaucccgcagccgcg

SEQ ID NO: 2873207 - RNA, 20 nt, Mycobacterium avium subsp. paratuberculosis
agagcgggccgaccgucagc

SEQ ID NO: 2873208 - RNA, 21 nt, Mycobacterium avium subsp. paratuberculosis
agagcggugacaucgccaccu

SEQ ID NO: 2873209 - RNA, 15 nt, Mycobacterium avium subsp. paratuberculosis
agagcgguuugcggg

SEQ ID NO: 2873210 - RNA, 17 nt, Mycobacterium avium subsp. paratuberculosis
agaggcccggcagccgg

SEQ ID NO: 2873211 - RNA, 13 nt, Mycobacterium avium subsp. paratuberculosis
agaggcgcggcgc

SEQ ID NO: 2873212 - RNA, 14 nt, Mycobacterium avium subsp. paratuberculosis
agaggcgcggcgcg

SEQ ID NO: 2873213 - RNA, 18 nt, Mycobacterium avium subsp. paratuberculosis
agaggcggcgaccgcgac

SEQ ID NO: 2873214 - RNA, 16 nt, Mycobacterium avium subsp. paratuberculosis
agaggcgggcacuuaa

SEQ ID NO: 2873215 - RNA, 16 nt, Mycobacterium avium subsp. paratuberculosis
agaggcuguccagcag

SEQ ID NO: 2873216 - RNA, 17 nt, Mycobacterium avium subsp. paratuberculosis
agaggcuguccagcagc

SEQ ID NO: 2873217 - RNA, 18 nt, Mycobacterium avium subsp. paratuberculosis
agaggcuguccagcagcg

SEQ ID NO: 2873218 - RNA, 18 nt, Mycobacterium avium subsp. paratuberculosis
agagggccauccggccgg

SEQ ID NO: 2873219 - RNA, 20 nt, Mycobacterium avium subsp. paratuberculosis
agagggccauccggccggcg

SEQ ID NO: 2873220 - RNA, 20 nt, Mycobacterium avium subsp. paratuberculosis
agagggcgugacgccgcugc

SEQ ID NO: 2873221 - RNA, 21 nt, Mycobacterium avium subsp. paratuberculosis
agaguaucgccacgccgacca

SEQ ID NO: 2873222 - RNA, 13 nt, Mycobacterium avium subsp. paratuberculosis
agaguccgccgcc

SEQ ID NO: 2873223 - RNA, 18 nt, Mycobacterium avium subsp. paratuberculosis
agaguccgccgccgggcc

SEQ ID NO: 2873224 - RNA, 17 nt, Mycobacterium avium subsp. paratuberculosis
agagucgcuggcgcgcu

SEQ ID NO: 2873225 - RNA, 14 nt, Mycobacterium avium subsp. paratuberculosis
agauaccggccggc

SEQ ID NO: 2873226 - RNA, 16 nt, Mycobacterium avium subsp. paratuberculosis
agauaccggccggcgc

SEQ ID NO: 2873227 - RNA, 18 nt, Mycobacterium avium subsp. paratuberculosis
agauacggucgcaccgcg

SEQ ID NO: 2873228 - RNA, 19 nt, Mycobacterium avium subsp. paratuberculosis
agauagcccagccagccgg

SEQ ID NO: 2873229 - RNA, 13 nt, Mycobacterium avium subsp. paratuberculosis
agauaggcggcga

SEQ ID NO: 2873230 - RNA, 23 nt, Mycobacterium avium subsp. paratuberculosis
agauagggauucgucauggacag

SEQ ID NO: 2873231 - RNA, 15 nt, Mycobacterium avium subsp. paratuberculosis
agaucaacagccgcc

SEQ ID NO: 2873232 - RNA, 17 nt, Mycobacterium avium subsp. paratuberculosis
agaucaacagccgcccc

SEQ ID NO: 2873233 - RNA, 14 nt, Mycobacterium avium subsp. paratuberculosis
agaucacagcgccc

SEQ ID NO: 2873234 - RNA, 14 nt, Mycobacterium avium subsp. paratuberculosis
agaucaccgcgacg

SEQ ID NO: 2873235 - RNA, 21 nt, Mycobacterium avium subsp. paratuberculosis
agaucaccgcguagcgccgcc

SEQ ID NO: 2873236 - RNA, 22 nt, Mycobacterium avium subsp. paratuberculosis
agaucaccgcguagcgccgccc

SEQ ID NO: 2873237 - RNA, 12 nt, Mycobacterium avium subsp. paratuberculosis
agaucaccggca

SEQ ID NO: 2873238 - RNA, 17 nt, Mycobacterium avium subsp. paratuberculosis
agaucaccggcaccccc

SEQ ID NO: 2873239 - RNA, 13 nt, Mycobacterium avium subsp. paratuberculosis
agaucacgccggu

SEQ ID NO: 2873240 - RNA, 15 nt, Mycobacterium avium subsp. paratuberculosis
agaucacguucaccu

SEQ ID NO: 2873241 - RNA, 14 nt, Mycobacterium avium subsp. paratuberculosis
agaucagcaccguc

SEQ ID NO: 2873242 - RNA, 19 nt, Mycobacterium avium subsp. paratuberculosis
agaucagcaccguccacag

SEQ ID NO: 2873243 - RNA, 22 nt, Mycobacterium avium subsp. paratuberculosis
agaucagcaccguccacagccg

SEQ ID NO: 2873244 - RNA, 16 nt, Mycobacterium avium subsp. paratuberculosis
agaucagcaggcccuc

SEQ ID NO: 2873245 - RNA, 17 nt, Mycobacterium avium subsp. paratuberculosis
agaucagcaggcuggcg

SEQ ID NO: 2873246 - RNA, 11 nt, Mycobacterium avium subsp. paratuberculosis
agaucagcgaa

SEQ ID NO: 2873247 - RNA, 18 nt, Mycobacterium avium subsp. paratuberculosis
agaucagcgccagcaaca

SEQ ID NO: 2873248 - RNA, 17 nt, Mycobacterium avium subsp. paratuberculosis
agaucagcgccaugcug

SEQ ID NO: 2873249 - RNA, 12 nt, Mycobacterium avium subsp. paratuberculosis
agaucagcgccu

SEQ ID NO: 2873250 - RNA, 22 nt, Mycobacterium avium subsp. paratuberculosis
agaucagcgcguccaaccgcgg

SEQ ID NO: 2873251 - RNA, 17 nt, Mycobacterium avium subsp. paratuberculosis
agaucagggugcucagc

SEQ ID NO: 2873252 - RNA, 22 nt, Mycobacterium avium subsp. paratuberculosis
agaucagggugcucagccgcac

SEQ ID NO: 2873253 - RNA, 16 nt, Mycobacterium avium subsp. paratuberculosis
agaucaucccggccac

SEQ ID NO: 2873254 - RNA, 17 nt, Mycobacterium avium subsp. paratuberculosis
agaucaucccggccacc

SEQ ID NO: 2873255 - RNA, 17 nt, Mycobacterium avium subsp. paratuberculosis
agauccaccgcgcggcc

SEQ ID NO: 2873256 - RNA, 16 nt, Mycobacterium avium subsp. paratuberculosis
agaucccgccggcggc

SEQ ID NO: 2873257 - RNA, 21 nt, Mycobacterium avium subsp. paratuberculosis
agaucccgccggcggccacga

SEQ ID NO: 2873258 - RNA, 14 nt, Mycobacterium avium subsp. paratuberculosis
agaucccgcuggcc

SEQ ID NO: 2873259 - RNA, 17 nt, Mycobacterium avium subsp. paratuberculosis
agauccuuugcggcccc

SEQ ID NO: 2873260 - RNA, 18 nt, Mycobacterium avium subsp. paratuberculosis
agauccuuugcggcccca

SEQ ID NO: 2873261 - RNA, 16 nt, Mycobacterium avium subsp. paratuberculosis
agaucgacagggcguc

SEQ ID NO: 2873262 - RNA, 20 nt, Mycobacterium avium subsp. paratuberculosis
agaucgagcugggcccgcgc

SEQ ID NO: 2873263 - RNA, 13 nt, Mycobacterium avium subsp. paratuberculosis
agaucgccagcac

SEQ ID NO: 2873264 - RNA, 18 nt, Mycobacterium avium subsp. paratuberculosis
agaucgccagcaccggcg

SEQ ID NO: 2873265 - RNA, 21 nt, Mycobacterium avium subsp. paratuberculosis
agaucgccagcgcccccagcg

SEQ ID NO: 2873266 - RNA, 20 nt, Mycobacterium avium subsp. paratuberculosis
agaucgccccggggguagcg

SEQ ID NO: 2873267 - RNA, 15 nt, Mycobacterium avium subsp. paratuberculosis
agaucgcccgccgcg

SEQ ID NO: 2873268 - RNA, 15 nt, Mycobacterium avium subsp. paratuberculosis
agaucgccugcaggg

SEQ ID NO: 2873269 - RNA, 19 nt, Mycobacterium avium subsp. paratuberculosis
agaucgcgcaucacccggc

SEQ ID NO: 2873270 - RNA, 23 nt, Mycobacterium avium subsp. paratuberculosis
agaucgcgcaucacccggcgcgc

SEQ ID NO: 2873271 - RNA, 13 nt, Mycobacterium avium subsp. paratuberculosis
agaucgcggcccg

SEQ ID NO: 2873272 - RNA, 16 nt, Mycobacterium avium subsp. paratuberculosis
agaucgcggcccgccg

SEQ ID NO: 2873273 - RNA, 17 nt, Mycobacterium avium subsp. paratuberculosis
agaucgcgguccaccag

SEQ ID NO: 2873274 - RNA, 19 nt, Mycobacterium avium subsp. paratuberculosis
agaucgcgguggcgcccgc

SEQ ID NO: 2873275 - RNA, 22 nt, Mycobacterium avium subsp. paratuberculosis
agaucggccagcgcggccgggc

SEQ ID NO: 2873276 - RNA, 14 nt, Mycobacterium avium subsp. paratuberculosis
agaucggccagguu

SEQ ID NO: 2873277 - RNA, 20 nt, Mycobacterium avium subsp. paratuberculosis
agaucggcgucacugcccag

SEQ ID NO: 2873278 - RNA, 17 nt, Mycobacterium avium subsp. paratuberculosis
agaucggcucaccgaac

SEQ ID NO: 2873279 - RNA, 21 nt, Mycobacterium avium subsp. paratuberculosis
agaucggggccuugacucccu

SEQ ID NO: 2873280 - RNA, 14 nt, Mycobacterium avium subsp. paratuberculosis
agaucgggucccag

SEQ ID NO: 2873281 - RNA, 20 nt, Mycobacterium avium subsp. paratuberculosis
agaucguagggcucggcguc

SEQ ID NO: 2873282 - RNA, 17 nt, Mycobacterium avium subsp. paratuberculosis
agaucgucucggccagc

SEQ ID NO: 2873283 - RNA, 18 nt, Mycobacterium avium subsp. paratuberculosis
agaucgucucggccagcc

SEQ ID NO: 2873284 - RNA, 16 nt, Mycobacterium avium subsp. paratuberculosis
agaucuccaggcucga

SEQ ID NO: 2873285 - RNA, 14 nt, Mycobacterium avium subsp. paratuberculosis
agaucucgcgccgc

SEQ ID NO: 2873286 - RNA, 16 nt, Mycobacterium avium subsp. paratuberculosis
agaucucgcgccgcgc

SEQ ID NO: 2873287 - RNA, 21 nt, Mycobacterium avium subsp. paratuberculosis
agaucucgucgaugggcucga

SEQ ID NO: 2873288 - RNA, 15 nt, Mycobacterium avium subsp. paratuberculosis
agaucugcacgcugu

SEQ ID NO: 2873289 - RNA, 12 nt, Mycobacterium avium subsp. paratuberculosis
agaucugcaggg

SEQ ID NO: 2873290 - RNA, 21 nt, Mycobacterium avium subsp. paratuberculosis
agaucugccggugccgccggc

SEQ ID NO: 2873291 - RNA, 22 nt, Mycobacterium avium subsp. paratuberculosis
agaucuuccaucacgccccggc

SEQ ID NO: 2873292 - RNA, 21 nt, Mycobacterium avium subsp. paratuberculosis
agaugaagacccggccgugga

SEQ ID NO: 2873293 - RNA, 17 nt, Mycobacterium avium subsp. paratuberculosis
agaugaccgucguugcc

SEQ ID NO: 2873294 - RNA, 17 nt, Mycobacterium avium subsp. paratuberculosis
agaugaccugaucgagu

SEQ ID NO: 2873295 - RNA, 22 nt, Mycobacterium avium subsp. paratuberculosis
agaugagauccuuugcggcccc

SEQ ID NO: 2873296 - RNA, 17 nt, Mycobacterium avium subsp. paratuberculosis
agaugagccgcagccgg

SEQ ID NO: 2873297 - RNA, 13 nt, Mycobacterium avium subsp. paratuberculosis
agaugaucagcgc

SEQ ID NO: 2873298 - RNA, 21 nt, Mycobacterium avium subsp. paratuberculosis
agaugauugcgugcccggcca

SEQ ID NO: 2873299 - RNA, 22 nt, Mycobacterium avium subsp. paratuberculosis
agaugauugcgugcccggccag

SEQ ID NO: 2873300 - RNA, 14 nt, Mycobacterium avium subsp. paratuberculosis
agaugccagacgaa

SEQ ID NO: 2873301 - RNA, 19 nt, Mycobacterium avium subsp. paratuberculosis
agaugcccacccgcucggc

SEQ ID NO: 2873302 - RNA, 15 nt, Mycobacterium avium subsp. paratuberculosis
agaugcccagcagga

SEQ ID NO: 2873303 - RNA, 15 nt, Mycobacterium avium subsp. paratuberculosis
agaugccccaggcga

SEQ ID NO: 2873304 - RNA, 16 nt, Mycobacterium avium subsp. paratuberculosis
agaugcccgccccgcc

SEQ ID NO: 2873305 - RNA, 13 nt, Mycobacterium avium subsp. paratuberculosis
agaugccgccgcc

SEQ ID NO: 2873306 - RNA, 19 nt, Mycobacterium avium subsp. paratuberculosis
agaugccgccgccagcgcg

SEQ ID NO: 2873307 - RNA, 14 nt, Mycobacterium avium subsp. paratuberculosis
agaugccgcucggc

SEQ ID NO: 2873308 - RNA, 23 nt, Mycobacterium avium subsp. paratuberculosis
agaugccgcucggcgcuccagcg

SEQ ID NO: 2873309 - RNA, 12 nt, Mycobacterium avium subsp. paratuberculosis
agaugccgggcu

SEQ ID NO: 2873310 - RNA, 24 nt, Mycobacterium avium subsp. paratuberculosis
agaugccgggcuccgcguucgacc

SEQ ID NO: 2873311 - RNA, 22 nt, Mycobacterium avium subsp. paratuberculosis
agaugcgccggguccagccgcg

SEQ ID NO: 2873312 - RNA, 15 nt, Mycobacterium avium subsp. paratuberculosis
agaugcgcgacggcc

SEQ ID NO: 2873313 - RNA, 13 nt, Mycobacterium avium subsp. paratuberculosis
agaugcggcacca

SEQ ID NO: 2873314 - RNA, 17 nt, Mycobacterium avium subsp. paratuberculosis
agaugcggcaccagccc

SEQ ID NO: 2873315 - RNA, 18 nt, Mycobacterium avium subsp. paratuberculosis
agaugcggcaccagcccg

SEQ ID NO: 2873316 - RNA, 21 nt, Mycobacterium avium subsp. paratuberculosis
agaugcggcaccagcccgccg

SEQ ID NO: 2873317 - RNA, 16 nt, Mycobacterium avium subsp. paratuberculosis
agaugcggcccagccc

SEQ ID NO: 2873318 - RNA, 16 nt, Mycobacterium avium subsp. paratuberculosis
agaugcgggccaccgu

SEQ ID NO: 2873319 - RNA, 16 nt, Mycobacterium avium subsp. paratuberculosis
agaugcguuccaggug

SEQ ID NO: 2873320 - RNA, 15 nt, Mycobacterium avium subsp. paratuberculosis
agaugcguucggccg

SEQ ID NO: 2873321 - RNA, 20 nt, Mycobacterium avium subsp. paratuberculosis
agaugcuguggaagggcccc

SEQ ID NO: 2873322 - RNA, 19 nt, Mycobacterium avium subsp. paratuberculosis
agaugcuucagcccucgag

SEQ ID NO: 2873323 - RNA, 19 nt, Mycobacterium avium subsp. paratuberculosis
agauggccagcaccaccgc

SEQ ID NO: 2873324 - RNA, 22 nt, Mycobacterium avium subsp. paratuberculosis
agauggccagcaccaccgcgag

SEQ ID NO: 2873325 - RNA, 22 nt, Mycobacterium avium subsp. paratuberculosis
agauggccagcgcggcgucacc

SEQ ID NO: 2873326 - RNA, 12 nt, Mycobacterium avium subsp. paratuberculosis
agauggccaggu

SEQ ID NO: 2873327 - RNA, 19 nt, Mycobacterium avium subsp. paratuberculosis
agauggcgugccacagcau

SEQ ID NO: 2873328 - RNA, 13 nt, Mycobacterium avium subsp. paratuberculosis
agaugggcgccga

SEQ ID NO: 2873329 - RNA, 15 nt, Mycobacterium avium subsp. paratuberculosis
agaugggcgccgagu

SEQ ID NO: 2873330 - RNA, 13 nt, Mycobacterium avium subsp. paratuberculosis
agauggggugaug

SEQ ID NO: 2873331 - RNA, 20 nt, Mycobacterium avium subsp. paratuberculosis
agauggucgccgacgguggc

SEQ ID NO: 2873332 - RNA, 21 nt, Mycobacterium avium subsp. paratuberculosis
agauggucgccgacgguggcg

SEQ ID NO: 2873333 - RNA, 20 nt, Mycobacterium avium subsp. paratuberculosis
agauggucgcgccgcggcgc

SEQ ID NO: 2873334 - RNA, 19 nt, Mycobacterium avium subsp. paratuberculosis
agauggucgggacgucggc

SEQ ID NO: 2873335 - RNA, 16 nt, Mycobacterium avium subsp. paratuberculosis
agauggugaaggugcc

SEQ ID NO: 2873336 - RNA, 16 nt, Mycobacterium avium subsp. paratuberculosis
agauggugaaguugcc

SEQ ID NO: 2873337 - RNA, 15 nt, Mycobacterium avium subsp. paratuberculosis
agaugguggccgucg

SEQ ID NO: 2873338 - RNA, 17 nt, Mycobacterium avium subsp. paratuberculosis
agaugguggccgucggc

SEQ ID NO: 2873339 - RNA, 15 nt, Mycobacterium avium subsp. paratuberculosis
agaugucacccguuu

SEQ ID NO: 2873340 - RNA, 13 nt, Mycobacterium avium subsp. paratuberculosis
agaugucgcggcg

SEQ ID NO: 2873341 - RNA, 13 nt, Mycobacterium avium subsp. paratuberculosis
agaugucggugcc

SEQ ID NO: 2873342 - RNA, 15 nt, Mycobacterium avium subsp. paratuberculosis
agaugucggugccga

SEQ ID NO: 2873343 - RNA, 21 nt, Mycobacterium avium subsp. paratuberculosis
agauguugaugaucgagccgc

SEQ ID NO: 2873344 - RNA, 16 nt, Mycobacterium avium subsp. paratuberculosis
agauguugcggccggc

SEQ ID NO: 2873345 - RNA, 13 nt, Mycobacterium avium subsp. paratuberculosis
agauguugcggcg

SEQ ID NO: 2873346 - RNA, 18 nt, Mycobacterium avium subsp. paratuberculosis
agauguuggagaucucgg

SEQ ID NO: 2873347 - RNA, 20 nt, Mycobacterium avium subsp. paratuberculosis
agauguuggagaucucggcg

SEQ ID NO: 2873348 - RNA, 21 nt, Mycobacterium avium subsp. paratuberculosis
agauguuggagaucucggcgu

SEQ ID NO: 2873349 - RNA, 17 nt, Mycobacterium avium subsp. paratuberculosis
agauuggauuccagauc

SEQ ID NO: 2873350 - RNA, 12 nt, Mycobacterium avium subsp. paratuberculosis
agauugggccac

SEQ ID NO: 2873351 - RNA, 15 nt, Mycobacterium avium subsp. paratuberculosis
agauugguucggccg

SEQ ID NO: 2873352 - RNA, 13 nt, Mycobacterium avium subsp. paratuberculosis
agauuuuguuugg

SEQ ID NO: 2873353 - RNA, 19 nt, Mycobacterium avium subsp. paratuberculosis
agauuuuguuuggagaguu

SEQ ID NO: 2873354 - RNA, 20 nt, Mycobacterium avium subsp. paratuberculosis
agcaaagguaguccagcaca

SEQ ID NO: 2873355 - RNA, 13 nt, Mycobacterium avium subsp. paratuberculosis
agcaaauccggca

SEQ ID NO: 2873356 - RNA, 14 nt, Mycobacterium avium subsp. paratuberculosis
agcaaauccggcag

SEQ ID NO: 2873357 - RNA, 15 nt, Mycobacterium avium subsp. paratuberculosis
agcaacaccagggug

SEQ ID NO: 2873358 - RNA, 19 nt, Mycobacterium avium subsp. paratuberculosis
agcaacaccuuucggccgc

SEQ ID NO: 2873359 - RNA, 19 nt, Mycobacterium avium subsp. paratuberculosis
agcaacaugauuccgccgg

SEQ ID NO: 2873360 - RNA, 14 nt, Mycobacterium avium subsp. paratuberculosis
agcaaccccgcggu

SEQ ID NO: 2873361 - RNA, 17 nt, Mycobacterium avium subsp. paratuberculosis
agcaacccgaaagcccc

SEQ ID NO: 2873362 - RNA, 19 nt, Mycobacterium avium subsp. paratuberculosis
agcaacccgaaagccccca

SEQ ID NO: 2873363 - RNA, 14 nt, Mycobacterium avium subsp. paratuberculosis
agcaacccgccgag

SEQ ID NO: 2873364 - RNA, 20 nt, Mycobacterium avium subsp. paratuberculosis
agcaacccgccgagcgugaa

SEQ ID NO: 2873365 - RNA, 14 nt, Mycobacterium avium subsp. paratuberculosis
agcaaccggcggcu

SEQ ID NO: 2873366 - RNA, 23 nt, Mycobacterium avium subsp. paratuberculosis
agcaaccggcggcugggcagccg

SEQ ID NO: 2873367 - RNA, 11 nt, Mycobacterium avium subsp. paratuberculosis
agcaaccggga

SEQ ID NO: 2873368 - RNA, 20 nt, Mycobacterium avium subsp. paratuberculosis
agcaaccgggauaccgcgac

SEQ ID NO: 2873369 - RNA, 13 nt, Mycobacterium avium subsp. paratuberculosis
agcaaccggguca

SEQ ID NO: 2873370 - RNA, 12 nt, Mycobacterium avium subsp. paratuberculosis
agcaaccgguuc

SEQ ID NO: 2873371 - RNA, 15 nt, Mycobacterium avium subsp. paratuberculosis
agcaacgccagcgcg

SEQ ID NO: 2873372 - RNA, 23 nt, Mycobacterium avium subsp. paratuberculosis
agcaacgcgguguuggcggcguc

SEQ ID NO: 2873373 - RNA, 16 nt, Mycobacterium avium subsp. paratuberculosis
agcaacggcggcggca

SEQ ID NO: 2873374 - RNA, 21 nt, Mycobacterium avium subsp. paratuberculosis
agcaacggcggcggcaccgau

SEQ ID NO: 2873375 - RNA, 16 nt, Mycobacterium avium subsp. paratuberculosis
agcaacgguacgugcg

SEQ ID NO: 2873376 - RNA, 21 nt, Mycobacterium avium subsp. paratuberculosis
agcaacgguacgugcgccggc

SEQ ID NO: 2873377 - RNA, 17 nt, Mycobacterium avium subsp. paratuberculosis
agcaacugcucgaccag

SEQ ID NO: 2873378 - RNA, 15 nt, Mycobacterium avium subsp. paratuberculosis
agcaagucggcggug

SEQ ID NO: 2873379 - RNA, 23 nt, Mycobacterium avium subsp. paratuberculosis
agcaagucggcggugaugcgcgc

SEQ ID NO: 2873380 - RNA, 22 nt, Mycobacterium avium subsp. paratuberculosis
agcacaaaagggcccaugccgc

SEQ ID NO: 2873381 - RNA, 22 nt, Mycobacterium avium subsp. paratuberculosis
agcacacccucaccccgcccag

SEQ ID NO: 2873382 - RNA, 23 nt, Mycobacterium avium subsp. paratuberculosis
agcacacccucaccccgcccagc

SEQ ID NO: 2873383 - RNA, 18 nt, Mycobacterium avium subsp. paratuberculosis
agcacaccggaucggcug

SEQ ID NO: 2873384 - RNA, 19 nt, Mycobacterium avium subsp. paratuberculosis
agcacaccgucgcccgccc

SEQ ID NO: 2873385 - RNA, 21 nt, Mycobacterium avium subsp. paratuberculosis
agcacaccgucgcccgcccag

SEQ ID NO: 2873386 - RNA, 13 nt, Mycobacterium avium subsp. paratuberculosis
agcacaccuucca

SEQ ID NO: 2873387 - RNA, 21 nt, Mycobacterium avium subsp. paratuberculosis
agcacaccuuccaccaccgcg

SEQ ID NO: 2873388 - RNA, 17 nt, Mycobacterium avium subsp. paratuberculosis
agcacagcacggcaucg

SEQ ID NO: 2873389 - RNA, 18 nt, Mycobacterium avium subsp. paratuberculosis
agcacagcacggcaucga

SEQ ID NO: 2873390 - RNA, 14 nt, Mycobacterium avium subsp. paratuberculosis
agcacagccgucgc

SEQ ID NO: 2873391 - RNA, 17 nt, Mycobacterium avium subsp. paratuberculosis
agcacagccgucgcacu

SEQ ID NO: 2873392 - RNA, 18 nt, Mycobacterium avium subsp. paratuberculosis
agcacagcgaggcgacgu

SEQ ID NO: 2873393 - RNA, 19 nt, Mycobacterium avium subsp. paratuberculosis
agcacaggaacgcgacggu

SEQ ID NO: 2873394 - RNA, 13 nt, Mycobacterium avium subsp. paratuberculosis
agcacaucggcgu

SEQ ID NO: 2873395 - RNA, 19 nt, Mycobacterium avium subsp. paratuberculosis
agcaccaacagcggcccga

SEQ ID NO: 2873396 - RNA, 13 nt, Mycobacterium avium subsp. paratuberculosis
agcaccaccaaca

SEQ ID NO: 2873397 - RNA, 19 nt, Mycobacterium avium subsp. paratuberculosis
agcaccaccaacagcagcg

SEQ ID NO: 2873398 - RNA, 22 nt, Mycobacterium avium subsp. paratuberculosis
agcaccaccaacggcucgccgc

SEQ ID NO: 2873399 - RNA, 14 nt, Mycobacterium avium subsp. paratuberculosis
agcaccaccagguc

SEQ ID NO: 2873400 - RNA, 14 nt, Mycobacterium avium subsp. paratuberculosis
agcaccacccgcac

SEQ ID NO: 2873401 - RNA, 15 nt, Mycobacterium avium subsp. paratuberculosis
agcaccacccgcacc

SEQ ID NO: 2873402 - RNA, 15 nt, Mycobacterium avium subsp. paratuberculosis
agcaccacccgggug

SEQ ID NO: 2873403 - RNA, 19 nt, Mycobacterium avium subsp. paratuberculosis
agcaccacccggucgaugu

SEQ ID NO: 2873404 - RNA, 15 nt, Mycobacterium avium subsp. paratuberculosis
agcaccaccgcgagc

SEQ ID NO: 2873405 - RNA, 21 nt, Mycobacterium avium subsp. paratuberculosis
agcaccaccucgcgcggggcg

SEQ ID NO: 2873406 - RNA, 22 nt, Mycobacterium avium subsp. paratuberculosis
agcaccaccuugucaccgaacc

SEQ ID NO: 2873407 - RNA, 13 nt, Mycobacterium avium subsp. paratuberculosis
agcaccacgaggc

SEQ ID NO: 2873408 - RNA, 14 nt, Mycobacterium avium subsp. paratuberculosis
agcaccacggcccg

SEQ ID NO: 2873409 - RNA, 15 nt, Mycobacterium avium subsp. paratuberculosis
agcaccacggcccgc

SEQ ID NO: 2873410 - RNA, 18 nt, Mycobacterium avium subsp. paratuberculosis
agcaccacggcccgcgcc

SEQ ID NO: 2873411 - RNA, 18 nt, Mycobacterium avium subsp. paratuberculosis
agcaccacguccgcggug

SEQ ID NO: 2873412 - RNA, 13 nt, Mycobacterium avium subsp. paratuberculosis
agcaccacuucca

SEQ ID NO: 2873413 - RNA, 19 nt, Mycobacterium avium subsp. paratuberculosis
agcaccacuuccagcaccg

SEQ ID NO: 2873414 - RNA, 20 nt, Mycobacterium avium subsp. paratuberculosis
agcaccacuuccagcaccgg

SEQ ID NO: 2873415 - RNA, 21 nt, Mycobacterium avium subsp. paratuberculosis
agcaccacuuccagcaccggc

SEQ ID NO: 2873416 - RNA, 20 nt, Mycobacterium avium subsp. paratuberculosis
agcaccagaugcaccucgcc

SEQ ID NO: 2873417 - RNA, 9 nt, Mycobacterium avium subsp. paratuberculosis
agcaccagc

SEQ ID NO: 2873418 - RNA, 19 nt, Mycobacterium avium subsp. paratuberculosis
agcaccagcaacaccaggg

SEQ ID NO: 2873419 - RNA, 12 nt, Mycobacterium avium subsp. paratuberculosis
agcaccagcacc

SEQ ID NO: 2873420 - RNA, 23 nt, Mycobacterium avium subsp. paratuberculosis
agcaccagcccgaugccgccgag

SEQ ID NO: 2873421 - RNA, 13 nt, Mycobacterium avium subsp. paratuberculosis
agcaccagcccgg

SEQ ID NO: 2873422 - RNA, 14 nt, Mycobacterium avium subsp. paratuberculosis
agcaccagcccggc

SEQ ID NO: 2873423 - RNA, 17 nt, Mycobacterium avium subsp. paratuberculosis
agcaccagcccggccag

SEQ ID NO: 2873424 - RNA, 13 nt, Mycobacterium avium subsp. paratuberculosis
agcaccagcgccg

SEQ ID NO: 2873425 - RNA, 12 nt, Mycobacterium avium subsp. paratuberculosis
agcaccagcgcg

SEQ ID NO: 2873426 - RNA, 15 nt, Mycobacterium avium subsp. paratuberculosis
agcaccagcgucgac

SEQ ID NO: 2873427 - RNA, 16 nt, Mycobacterium avium subsp. paratuberculosis
agcaccagcgucgacg

SEQ ID NO: 2873428 - RNA, 17 nt, Mycobacterium avium subsp. paratuberculosis
agcaccagcgucgacgc

SEQ ID NO: 2873429 - RNA, 19 nt, Mycobacterium avium subsp. paratuberculosis
agcaccagcguggccggca

SEQ ID NO: 2873430 - RNA, 20 nt, Mycobacterium avium subsp. paratuberculosis
agcaccagcguggccggcag

SEQ ID NO: 2873431 - RNA, 16 nt, Mycobacterium avium subsp. paratuberculosis
agcaccaggaaggcga

SEQ ID NO: 2873432 - RNA, 23 nt, Mycobacterium avium subsp. paratuberculosis
agcaccaggcccuccugggugag

SEQ ID NO: 2873433 - RNA, 20 nt, Mycobacterium avium subsp. paratuberculosis
agcaccaggcccucgccgcg

SEQ ID NO: 2873434 - RNA, 23 nt, Mycobacterium avium subsp. paratuberculosis
agcaccaggcccucgccgcgguc

SEQ ID NO: 2873435 - RNA, 16 nt, Mycobacterium avium subsp. paratuberculosis
agcaccaggcgcacca

SEQ ID NO: 2873436 - RNA, 19 nt, Mycobacterium avium subsp. paratuberculosis
agcaccaggcgcaccagcu

SEQ ID NO: 2873437 - RNA, 21 nt, Mycobacterium avium subsp. paratuberculosis
agcaccaggcgcaccagcuga

SEQ ID NO: 2873438 - RNA, 14 nt, Mycobacterium avium subsp. paratuberculosis
agcaccaggcgggu

SEQ ID NO: 2873439 - RNA, 18 nt, Mycobacterium avium subsp. paratuberculosis
agcaccaggcgggucacc

SEQ ID NO: 2873440 - RNA, 19 nt, Mycobacterium avium subsp. paratuberculosis
agcaccaggcgggucaccu

SEQ ID NO: 2873441 - RNA, 13 nt, Mycobacterium avium subsp. paratuberculosis
agcaccaggcuga

SEQ ID NO: 2873442 - RNA, 22 nt, Mycobacterium avium subsp. paratuberculosis
agcaccaggcugaccagcgccu

SEQ ID NO: 2873443 - RNA, 22 nt, Mycobacterium avium subsp. paratuberculosis
agcaccagggcguguugcaggc

SEQ ID NO: 2873444 - RNA, 16 nt, Mycobacterium avium subsp. paratuberculosis
agcaccagguggcccg

SEQ ID NO: 2873445 - RNA, 18 nt, Mycobacterium avium subsp. paratuberculosis
agcaccagguugucgccg

SEQ ID NO: 2873446 - RNA, 21 nt, Mycobacterium avium subsp. paratuberculosis
agcaccagguugucgccgcgc

SEQ ID NO: 2873447 - RNA, 16 nt, Mycobacterium avium subsp. paratuberculosis
agcaccagucggccau

SEQ ID NO: 2873448 - RNA, 18 nt, Mycobacterium avium subsp. paratuberculosis
agcaccaguugcaccggc

SEQ ID NO: 2873449 - RNA, 19 nt, Mycobacterium avium subsp. paratuberculosis
agcaccaguugcaccggca

SEQ ID NO: 2873450 - RNA, 20 nt, Mycobacterium avium subsp. paratuberculosis
agcaccaguugcaccggcac

SEQ ID NO: 2873451 - RNA, 20 nt, Mycobacterium avium subsp. paratuberculosis
agcaccaguuugguguucgg

SEQ ID NO: 2873452 - RNA, 15 nt, Mycobacterium avium subsp. paratuberculosis
agcaccauccgcgcg

SEQ ID NO: 2873453 - RNA, 14 nt, Mycobacterium avium subsp. paratuberculosis
agcaccaugaucag

SEQ ID NO: 2873454 - RNA, 19 nt, Mycobacterium avium subsp. paratuberculosis
agcacccaggugcugcccu

SEQ ID NO: 2873455 - RNA, 16 nt, Mycobacterium avium subsp. paratuberculosis
agcaccccgccgcagc

SEQ ID NO: 2873456 - RNA, 16 nt, Mycobacterium avium subsp. paratuberculosis
agcaccccggcggccg

SEQ ID NO: 2873457 - RNA, 19 nt, Mycobacterium avium subsp. paratuberculosis
agcaccccggcggccgcgu

SEQ ID NO: 2873458 - RNA, 20 nt, Mycobacterium avium subsp. paratuberculosis
agcaccccggcggccgcguc

SEQ ID NO: 2873459 - RNA, 16 nt, Mycobacterium avium subsp. paratuberculosis
agcaccccgguccagg

SEQ ID NO: 2873460 - RNA, 14 nt, Mycobacterium avium subsp. paratuberculosis
agcaccccgucgag

SEQ ID NO: 2873461 - RNA, 19 nt, Mycobacterium avium subsp. paratuberculosis
agcaccccgucgagguuca

SEQ ID NO: 2873462 - RNA, 19 nt, Mycobacterium avium subsp. paratuberculosis
agcacccgacuucggcucg

SEQ ID NO: 2873463 - RNA, 23 nt, Mycobacterium avium subsp. paratuberculosis
agcacccgacuucggcucggcga

SEQ ID NO: 2873464 - RNA, 17 nt, Mycobacterium avium subsp. paratuberculosis
agcacccgcagccgcga

SEQ ID NO: 2873465 - RNA, 23 nt, Mycobacterium avium subsp. paratuberculosis
agcacccgcagccgcgagucgag

SEQ ID NO: 2873466 - RNA, 21 nt, Mycobacterium avium subsp. paratuberculosis
agcacccgcagcucgccgagc

SEQ ID NO: 2873467 - RNA, 22 nt, Mycobacterium avium subsp. paratuberculosis
agcacccgcugauccagcagcg

SEQ ID NO: 2873468 - RNA, 18 nt, Mycobacterium avium subsp. paratuberculosis
agcacccgcugcagccgg

SEQ ID NO: 2873469 - RNA, 14 nt, Mycobacterium avium subsp. paratuberculosis
agcacccggcccac

SEQ ID NO: 2873470 - RNA, 14 nt, Mycobacterium avium subsp. paratuberculosis
agcacccggccggc

SEQ ID NO: 2873471 - RNA, 16 nt, Mycobacterium avium subsp. paratuberculosis
agcacccggccggcga

SEQ ID NO: 2873472 - RNA, 13 nt, Mycobacterium avium subsp. paratuberculosis
agcacccggcggg

SEQ ID NO: 2873473 - RNA, 13 nt, Mycobacterium avium subsp. paratuberculosis
agcacccgggccu

SEQ ID NO: 2873474 - RNA, 23 nt, Mycobacterium avium subsp. paratuberculosis
agcacccgggccugcggcggccg

SEQ ID NO: 2873475 - RNA, 23 nt, Mycobacterium avium subsp. paratuberculosis
agcacccgguuccaccgggccgc

SEQ ID NO: 2873476 - RNA, 17 nt, Mycobacterium avium subsp. paratuberculosis
agcaccgaaccggcggg

SEQ ID NO: 2873477 - RNA, 20 nt, Mycobacterium avium subsp. paratuberculosis
agcaccgaaucgccgagcuc

SEQ ID NO: 2873478 - RNA, 22 nt, Mycobacterium avium subsp. paratuberculosis
agcaccgaaucgccgagcucga

SEQ ID NO: 2873479 - RNA, 16 nt, Mycobacterium avium subsp. paratuberculosis
agcaccgacgcggcga

SEQ ID NO: 2873480 - RNA, 17 nt, Mycobacterium avium subsp. paratuberculosis
agcaccgacgcggcgac

SEQ ID NO: 2873481 - RNA, 21 nt, Mycobacterium avium subsp. paratuberculosis
agcaccgacuccuccggcccg

SEQ ID NO: 2873482 - RNA, 22 nt, Mycobacterium avium subsp. paratuberculosis
agcaccgacuccuccggcccga

SEQ ID NO: 2873483 - RNA, 19 nt, Mycobacterium avium subsp. paratuberculosis
agcaccgagaucucgucga

SEQ ID NO: 2873484 - RNA, 21 nt, Mycobacterium avium subsp. paratuberculosis
agcaccgagaucucgucgaug

SEQ ID NO: 2873485 - RNA, 18 nt, Mycobacterium avium subsp. paratuberculosis
agcaccgcauaggaccgg

SEQ ID NO: 2873486 - RNA, 23 nt, Mycobacterium avium subsp. paratuberculosis
agcaccgcauggggcaguagcga

SEQ ID NO: 2873487 - RNA, 13 nt, Mycobacterium avium subsp. paratuberculosis
agcaccgccaccg

SEQ ID NO: 2873488 - RNA, 14 nt, Mycobacterium avium subsp. paratuberculosis
agcaccgccacgcc

SEQ ID NO: 2873489 - RNA, 20 nt, Mycobacterium avium subsp. paratuberculosis
agcaccgccagcauccgcug

SEQ ID NO: 2873490 - RNA, 15 nt, Mycobacterium avium subsp. paratuberculosis
agcaccgccagcgcc

SEQ ID NO: 2873491 - RNA, 16 nt, Mycobacterium avium subsp. paratuberculosis
agcaccgccagcgccg

SEQ ID NO: 2873492 - RNA, 15 nt, Mycobacterium avium subsp. paratuberculosis
agcaccgccgacauc

SEQ ID NO: 2873493 - RNA, 20 nt, Mycobacterium avium subsp. paratuberculosis
agcaccgccgacaucgcccg

SEQ ID NO: 2873494 - RNA, 21 nt, Mycobacterium avium subsp. paratuberculosis
agcaccgccgagccgucgucg

SEQ ID NO: 2873495 - RNA, 14 nt, Mycobacterium avium subsp. paratuberculosis
agcaccgccgcggg

SEQ ID NO: 2873496 - RNA, 16 nt, Mycobacterium avium subsp. paratuberculosis
agcaccgccgcgggcu

SEQ ID NO: 2873497 - RNA, 20 nt, Mycobacterium avium subsp. paratuberculosis
agcaccgccgcgggcucccg

SEQ ID NO: 2873498 - RNA, 15 nt, Mycobacterium avium subsp. paratuberculosis
agcaccgccggcgcc

SEQ ID NO: 2873499 - RNA, 16 nt, Mycobacterium avium subsp. paratuberculosis
agcaccgccggcgccg

SEQ ID NO: 2873500 - RNA, 14 nt, Mycobacterium avium subsp. paratuberculosis
agcaccgccucggc

SEQ ID NO: 2873501 - RNA, 18 nt, Mycobacterium avium subsp. paratuberculosis
agcaccgccucggccacc

SEQ ID NO: 2873502 - RNA, 15 nt, Mycobacterium avium subsp. paratuberculosis
agcaccgccuggguc

SEQ ID NO: 2873503 - RNA, 17 nt, Mycobacterium avium subsp. paratuberculosis
agcaccgcgaacagcac

SEQ ID NO: 2873504 - RNA, 18 nt, Mycobacterium avium subsp. paratuberculosis
agcaccgcgaacaucgcc

SEQ ID NO: 2873505 - RNA, 20 nt, Mycobacterium avium subsp. paratuberculosis
agcaccgcgaccacgccgcg

SEQ ID NO: 2873506 - RNA, 18 nt, Mycobacterium avium subsp. paratuberculosis
agcaccgcgacccaggcc

SEQ ID NO: 2873507 - RNA, 14 nt, Mycobacterium avium subsp. paratuberculosis
agcaccgcgacgau

SEQ ID NO: 2873508 - RNA, 15 nt, Mycobacterium avium subsp. paratuberculosis
agcaccgcgacgauc

SEQ ID NO: 2873509 - RNA, 21 nt, Mycobacterium avium subsp. paratuberculosis
agcaccgcgaucaccgagaug

SEQ ID NO: 2873510 - RNA, 17 nt, Mycobacterium avium subsp. paratuberculosis
agcaccgcgaucgccga

SEQ ID NO: 2873511 - RNA, 20 nt, Mycobacterium avium subsp. paratuberculosis
agcaccgcgaucgccgacgu

SEQ ID NO: 2873512 - RNA, 16 nt, Mycobacterium avium subsp. paratuberculosis
agcaccgcgcggcggu

SEQ ID NO: 2873513 - RNA, 22 nt, Mycobacterium avium subsp. paratuberculosis
agcaccgcggccgucgcggcga

SEQ ID NO: 2873514 - RNA, 14 nt, Mycobacterium avium subsp. paratuberculosis
agcaccgcggcgau

SEQ ID NO: 2873515 - RNA, 23 nt, Mycobacterium avium subsp. paratuberculosis
agcaccgcggcguagcgccaguc

SEQ ID NO: 2873516 - RNA, 19 nt, Mycobacterium avium subsp. paratuberculosis
agcaccgcgggggcggccg

SEQ ID NO: 2873517 - RNA, 16 nt, Mycobacterium avium subsp. paratuberculosis
agcaccgcgucgaugu

SEQ ID NO: 2873518 - RNA, 20 nt, Mycobacterium avium subsp. paratuberculosis
agcaccgcguuguccggggu

SEQ ID NO: 2873519 - RNA, 16 nt, Mycobacterium avium subsp. paratuberculosis
agcaccggaucgacca

SEQ ID NO: 2873520 - RNA, 21 nt, Mycobacterium avium subsp. paratuberculosis
agcaccggaucgaccaacucc

SEQ ID NO: 2873521 - RNA, 17 nt, Mycobacterium avium subsp. paratuberculosis
agcaccggcaccgcggc

SEQ ID NO: 2873522 - RNA, 20 nt, Mycobacterium avium subsp. paratuberculosis
agcaccggcaccgcggcgau

SEQ ID NO: 2873523 - RNA, 18 nt, Mycobacterium avium subsp. paratuberculosis
agcaccggcagcaccgcc

SEQ ID NO: 2873524 - RNA, 19 nt, Mycobacterium avium subsp. paratuberculosis
agcaccggcagcaccgccg

SEQ ID NO: 2873525 - RNA, 20 nt, Mycobacterium avium subsp. paratuberculosis
agcaccggcagcaccgccga

SEQ ID NO: 2873526 - RNA, 21 nt, Mycobacterium avium subsp. paratuberculosis
agcaccggcagcaccgccgag

SEQ ID NO: 2873527 - RNA, 22 nt, Mycobacterium avium subsp. paratuberculosis
agcaccggcagcaccgccgagc

SEQ ID NO: 2873528 - RNA, 14 nt, Mycobacterium avium subsp. paratuberculosis
agcaccggcagccg

SEQ ID NO: 2873529 - RNA, 18 nt, Mycobacterium avium subsp. paratuberculosis
agcaccggcagccgcagc

SEQ ID NO: 2873530 - RNA, 14 nt, Mycobacterium avium subsp. paratuberculosis
agcaccggcgccau

SEQ ID NO: 2873531 - RNA, 20 nt, Mycobacterium avium subsp. paratuberculosis
agcaccggcgccccgggcag

SEQ ID NO: 2873532 - RNA, 17 nt, Mycobacterium avium subsp. paratuberculosis
agcaccggcgcgccgcg

SEQ ID NO: 2873533 - RNA, 13 nt, Mycobacterium avium subsp. paratuberculosis
agcaccggcggca

SEQ ID NO: 2873534 - RNA, 17 nt, Mycobacterium avium subsp. paratuberculosis
agcaccggcggcagcga

SEQ ID NO: 2873535 - RNA, 20 nt, Mycobacterium avium subsp. paratuberculosis
agcaccggcuggccgagcgg

SEQ ID NO: 2873536 - RNA, 15 nt, Mycobacterium avium subsp. paratuberculosis
agcaccggcuggucg

SEQ ID NO: 2873537 - RNA, 22 nt, Mycobacterium avium subsp. paratuberculosis
agcaccggcuggugcagcagcu

SEQ ID NO: 2873538 - RNA, 21 nt, Mycobacterium avium subsp. paratuberculosis
agcaccgggaacagccaggcg

SEQ ID NO: 2873539 - RNA, 15 nt, Mycobacterium avium subsp. paratuberculosis
agcaccgggcccagc

SEQ ID NO: 2873540 - RNA, 23 nt, Mycobacterium avium subsp. paratuberculosis
agcaccgggccgaaggcggcgcc

SEQ ID NO: 2873541 - RNA, 14 nt, Mycobacterium avium subsp. paratuberculosis
agcaccgggcgucg

SEQ ID NO: 2873542 - RNA, 19 nt, Mycobacterium avium subsp. paratuberculosis
agcaccgggcgucggggcc

SEQ ID NO: 2873543 - RNA, 20 nt, Mycobacterium avium subsp. paratuberculosis
agcaccgggcugucgggcag

SEQ ID NO: 2873544 - RNA, 22 nt, Mycobacterium avium subsp. paratuberculosis
agcaccgggcugucgggcaggc

SEQ ID NO: 2873545 - RNA, 12 nt, Mycobacterium avium subsp. paratuberculosis
agcaccggggcc

SEQ ID NO: 2873546 - RNA, 14 nt, Mycobacterium avium subsp. paratuberculosis
agcaccggggucug

SEQ ID NO: 2873547 - RNA, 19 nt, Mycobacterium avium subsp. paratuberculosis
agcaccggggucugcacga

SEQ ID NO: 2873548 - RNA, 15 nt, Mycobacterium avium subsp. paratuberculosis
agcaccgucaccgcc

SEQ ID NO: 2873549 - RNA, 23 nt, Mycobacterium avium subsp. paratuberculosis
agcaccgucaccuucacccccac

SEQ ID NO: 2873550 - RNA, 15 nt, Mycobacterium avium subsp. paratuberculosis
agcaccgucagccag

SEQ ID NO: 2873551 - RNA, 13 nt, Mycobacterium avium subsp. paratuberculosis
agcaccgugccgu

SEQ ID NO: 2873552 - RNA, 14 nt, Mycobacterium avium subsp. paratuberculosis
agcaccgugccguc

SEQ ID NO: 2873553 - RNA, 21 nt, Mycobacterium avium subsp. paratuberculosis
agcaccgugccgucggcgucg

SEQ ID NO: 2873554 - RNA, 21 nt, Mycobacterium avium subsp. paratuberculosis
agcaccgugcugauccacgcc

SEQ ID NO: 2873555 - RNA, 16 nt, Mycobacterium avium subsp. paratuberculosis
agcaccucgaacgccg

SEQ ID NO: 2873556 - RNA, 16 nt, Mycobacterium avium subsp. paratuberculosis
agcaccucgaagccga

SEQ ID NO: 2873557 - RNA, 19 nt, Mycobacterium avium subsp. paratuberculosis
agcaccucgaagccgacgu

SEQ ID NO: 2873558 - RNA, 16 nt, Mycobacterium avium subsp. paratuberculosis
agcaccucgcccugca

SEQ ID NO: 2873559 - RNA, 21 nt, Mycobacterium avium subsp. paratuberculosis
agcaccucgcccugcagcgcg

SEQ ID NO: 2873560 - RNA, 22 nt, Mycobacterium avium subsp. paratuberculosis
agcaccucgcccugcagcgcga

SEQ ID NO: 2873561 - RNA, 23 nt, Mycobacterium avium subsp. paratuberculosis
agcaccucgcgcagcaccgaugc

SEQ ID NO: 2873562 - RNA, 16 nt, Mycobacterium avium subsp. paratuberculosis
agcaccucgcgcgcga

SEQ ID NO: 2873563 - RNA, 13 nt, Mycobacterium avium subsp. paratuberculosis
agcaccucggcga

SEQ ID NO: 2873564 - RNA, 13 nt, Mycobacterium avium subsp. paratuberculosis
agcaccucgucgc

SEQ ID NO: 2873565 - RNA, 14 nt, Mycobacterium avium subsp. paratuberculosis
agcaccucgucgcc

SEQ ID NO: 2873566 - RNA, 20 nt, Mycobacterium avium subsp. paratuberculosis
agcaccucgucgcccggcgu

SEQ ID NO: 2873567 - RNA, 17 nt, Mycobacterium avium subsp. paratuberculosis
agcaccugaacggccgc

SEQ ID NO: 2873568 - RNA, 13 nt, Mycobacterium avium subsp. paratuberculosis
agcaccugcgcga

SEQ ID NO: 2873569 - RNA, 16 nt, Mycobacterium avium subsp. paratuberculosis
agcaccugcucgaugc

SEQ ID NO: 2873570 - RNA, 22 nt, Mycobacterium avium subsp. paratuberculosis
agcaccugcucgaugcgcgcca

SEQ ID NO: 2873571 - RNA, 16 nt, Mycobacterium avium subsp. paratuberculosis
agcaccuggagcgggu

SEQ ID NO: 2873572 - RNA, 17 nt, Mycobacterium avium subsp. paratuberculosis
agcaccuggagcggguc

SEQ ID NO: 2873573 - RNA, 18 nt, Mycobacterium avium subsp. paratuberculosis
agcaccuggauccaguuc

SEQ ID NO: 2873574 - RNA, 19 nt, Mycobacterium avium subsp. paratuberculosis
agcaccuggcgcaccgccg

SEQ ID NO: 2873575 - RNA, 20 nt, Mycobacterium avium subsp. paratuberculosis
agcaccuggcgcaccgccgc

SEQ ID NO: 2873576 - RNA, 21 nt, Mycobacterium avium subsp. paratuberculosis
agcaccuggcgcaccgccgcg

SEQ ID NO: 2873577 - RNA, 21 nt, Mycobacterium avium subsp. paratuberculosis
agcaccuucagcgggcgcagc

SEQ ID NO: 2873578 - RNA, 21 nt, Mycobacterium avium subsp. paratuberculosis
agcaccuugcccaggugcaga

SEQ ID NO: 2873579 - RNA, 15 nt, Mycobacterium avium subsp. paratuberculosis
agcaccuugccgguc

SEQ ID NO: 2873580 - RNA, 15 nt, Mycobacterium avium subsp. paratuberculosis
agcacgaacaccacg

SEQ ID NO: 2873581 - RNA, 19 nt, Mycobacterium avium subsp. paratuberculosis
agcacgaacagcagcggga

SEQ ID NO: 2873582 - RNA, 15 nt, Mycobacterium avium subsp. paratuberculosis
agcacgaacgcggcc

SEQ ID NO: 2873583 - RNA, 19 nt, Mycobacterium avium subsp. paratuberculosis
agcacgaacgcggccgcca

SEQ ID NO: 2873584 - RNA, 23 nt, Mycobacterium avium subsp. paratuberculosis
agcacgaagaaggcuccgccgau

SEQ ID NO: 2873585 - RNA, 15 nt, Mycobacterium avium subsp. paratuberculosis
agcacgaaggccgcc

SEQ ID NO: 2873586 - RNA, 19 nt, Mycobacterium avium subsp. paratuberculosis
agcacgacaccgacgacca

SEQ ID NO: 2873587 - RNA, 13 nt, Mycobacterium avium subsp. paratuberculosis
agcacgacauccu

SEQ ID NO: 2873588 - RNA, 19 nt, Mycobacterium avium subsp. paratuberculosis
agcacgaccacacccgcac

SEQ ID NO: 2873589 - RNA, 19 nt, Mycobacterium avium subsp. paratuberculosis
agcacgaccccgcccacga

SEQ ID NO: 2873590 - RNA, 19 nt, Mycobacterium avium subsp. paratuberculosis
agcacgaccgccagcagca

SEQ ID NO: 2873591 - RNA, 14 nt, Mycobacterium avium subsp. paratuberculosis
agcacgacgucgac

SEQ ID NO: 2873592 - RNA, 16 nt, Mycobacterium avium subsp. paratuberculosis
agcacgacgucgacgu

SEQ ID NO: 2873593 - RNA, 17 nt, Mycobacterium avium subsp. paratuberculosis
agcacgaucccgccgcc

SEQ ID NO: 2873594 - RNA, 18 nt, Mycobacterium avium subsp. paratuberculosis
agcacgaucccgccgccc

SEQ ID NO: 2873595 - RNA, 17 nt, Mycobacterium avium subsp. paratuberculosis
agcacgaucgagccggu

SEQ ID NO: 2873596 - RNA, 13 nt, Mycobacterium avium subsp. paratuberculosis
agcacgcagccgc

SEQ ID NO: 2873597 - RNA, 20 nt, Mycobacterium avium subsp. paratuberculosis
agcacgcagccgcgcccgau

SEQ ID NO: 2873598 - RNA, 20 nt, Mycobacterium avium subsp. paratuberculosis
agcacgcccagaugcaggcu

SEQ ID NO: 2873599 - RNA, 14 nt, Mycobacterium avium subsp. paratuberculosis
agcacgcccagccc

SEQ ID NO: 2873600 - RNA, 18 nt, Mycobacterium avium subsp. paratuberculosis
agcacgcccagcccgcgg

SEQ ID NO: 2873601 - RNA, 19 nt, Mycobacterium avium subsp. paratuberculosis
agcacgcccuggaaggcga

SEQ ID NO: 2873602 - RNA, 13 nt, Mycobacterium avium subsp. paratuberculosis
agcacgccgccgg

SEQ ID NO: 2873603 - RNA, 13 nt, Mycobacterium avium subsp. paratuberculosis
agcacgccgcgga

SEQ ID NO: 2873604 - RNA, 13 nt, Mycobacterium avium subsp. paratuberculosis
agcacgccggccg

SEQ ID NO: 2873605 - RNA, 15 nt, Mycobacterium avium subsp. paratuberculosis
agcacgccggccggc

SEQ ID NO: 2873606 - RNA, 17 nt, Mycobacterium avium subsp. paratuberculosis
agcacgccggccggcgu

SEQ ID NO: 2873607 - RNA, 13 nt, Mycobacterium avium subsp. paratuberculosis
agcacgccgggca

SEQ ID NO: 2873608 - RNA, 22 nt, Mycobacterium avium subsp. paratuberculosis
agcacgccguccuuggccgcca

SEQ ID NO: 2873609 - RNA, 22 nt, Mycobacterium avium subsp. paratuberculosis
agcacgcggaccuuggugucgg

SEQ ID NO: 2873610 - RNA, 22 nt, Mycobacterium avium subsp. paratuberculosis
agcacgcggaucgcgcugacca

SEQ ID NO: 2873611 - RNA, 15 nt, Mycobacterium avium subsp. paratuberculosis
agcacgcggccgcgc

SEQ ID NO: 2873612 - RNA, 19 nt, Mycobacterium avium subsp. paratuberculosis
agcacgcggccgcgccggc

SEQ ID NO: 2873613 - RNA, 19 nt, Mycobacterium avium subsp. paratuberculosis
agcacgcugaagcccaccg

SEQ ID NO: 2873614 - RNA, 22 nt, Mycobacterium avium subsp. paratuberculosis
agcacgcugaagcccaccgccg

SEQ ID NO: 2873615 - RNA, 18 nt, Mycobacterium avium subsp. paratuberculosis
agcacgcugaucaccacg

SEQ ID NO: 2873616 - RNA, 19 nt, Mycobacterium avium subsp. paratuberculosis
agcacggcaaugguugcgg

SEQ ID NO: 2873617 - RNA, 12 nt, Mycobacterium avium subsp. paratuberculosis
agcacggcacgc

SEQ ID NO: 2873618 - RNA, 15 nt, Mycobacterium avium subsp. paratuberculosis
agcacggcacgcccg

SEQ ID NO: 2873619 - RNA, 23 nt, Mycobacterium avium subsp. paratuberculosis
agcacggcauagauaccggccag

SEQ ID NO: 2873620 - RNA, 16 nt, Mycobacterium avium subsp. paratuberculosis
agcacggccaccagca

SEQ ID NO: 2873621 - RNA, 17 nt, Mycobacterium avium subsp. paratuberculosis
agcacggccaccagcag

SEQ ID NO: 2873622 - RNA, 18 nt, Mycobacterium avium subsp. paratuberculosis
agcacggccaccagcagc

SEQ ID NO: 2873623 - RNA, 20 nt, Mycobacterium avium subsp. paratuberculosis
agcacggccacugccccggc

SEQ ID NO: 2873624 - RNA, 15 nt, Mycobacterium avium subsp. paratuberculosis
agcacggccagccag

SEQ ID NO: 2873625 - RNA, 20 nt, Mycobacterium avium subsp. paratuberculosis
agcacggccagccagccgcc

SEQ ID NO: 2873626 - RNA, 13 nt, Mycobacterium avium subsp. paratuberculosis
agcacggccgcgg

SEQ ID NO: 2873627 - RNA, 14 nt, Mycobacterium avium subsp. paratuberculosis
agcacggccgcggc

SEQ ID NO: 2873628 - RNA, 17 nt, Mycobacterium avium subsp. paratuberculosis
agcacggccgcggccag

SEQ ID NO: 2873629 - RNA, 18 nt, Mycobacterium avium subsp. paratuberculosis
agcacggccgcggccagc

SEQ ID NO: 2873630 - RNA, 16 nt, Mycobacterium avium subsp. paratuberculosis
agcacggcgaccagcg

SEQ ID NO: 2873631 - RNA, 17 nt, Mycobacterium avium subsp. paratuberculosis
agcacggcggcgcugau

SEQ ID NO: 2873632 - RNA, 19 nt, Mycobacterium avium subsp. paratuberculosis
agcacgggaugaucggcgc

SEQ ID NO: 2873633 - RNA, 16 nt, Mycobacterium avium subsp. paratuberculosis
agcacgggcgggcaga

SEQ ID NO: 2873634 - RNA, 23 nt, Mycobacterium avium subsp. paratuberculosis
agcacgggggaguagcgcgcgaa

SEQ ID NO: 2873635 - RNA, 17 nt, Mycobacterium avium subsp. paratuberculosis
agcacggugaucagcag

SEQ ID NO: 2873636 - RNA, 19 nt, Mycobacterium avium subsp. paratuberculosis
agcacggugaucagcagca

SEQ ID NO: 2873637 - RNA, 18 nt, Mycobacterium avium subsp. paratuberculosis
agcacggugaugcgggug

SEQ ID NO: 2873638 - RNA, 15 nt, Mycobacterium avium subsp. paratuberculosis
agcacggugggcgcc

SEQ ID NO: 2873639 - RNA, 16 nt, Mycobacterium avium subsp. paratuberculosis
agcacggugggcgccg

SEQ ID NO: 2873640 - RNA, 13 nt, Mycobacterium avium subsp. paratuberculosis
agcacgucaccgc

SEQ ID NO: 2873641 - RNA, 21 nt, Mycobacterium avium subsp. paratuberculosis
agcacguccccgggcaccccg

SEQ ID NO: 2873642 - RNA, 22 nt, Mycobacterium avium subsp. paratuberculosis
agcacguccccgggcaccccgg

SEQ ID NO: 2873643 - RNA, 13 nt, Mycobacterium avium subsp. paratuberculosis
agcacgucgacgc

SEQ ID NO: 2873644 - RNA, 17 nt, Mycobacterium avium subsp. paratuberculosis
agcacgucgagcaccgc

SEQ ID NO: 2873645 - RNA, 18 nt, Mycobacterium avium subsp. paratuberculosis
agcacgucgagcaccgcg

SEQ ID NO: 2873646 - RNA, 17 nt, Mycobacterium avium subsp. paratuberculosis
agcacgucgggguggcc

SEQ ID NO: 2873647 - RNA, 21 nt, Mycobacterium avium subsp. paratuberculosis
agcacgucgggguggccggcc

SEQ ID NO: 2873648 - RNA, 22 nt, Mycobacterium avium subsp. paratuberculosis
agcacgucgggguggccggcca

SEQ ID NO: 2873649 - RNA, 23 nt, Mycobacterium avium subsp. paratuberculosis
agcacgucgggguggccggccag

SEQ ID NO: 2873650 - RNA, 14 nt, Mycobacterium avium subsp. paratuberculosis
agcacgucggucag

SEQ ID NO: 2873651 - RNA, 17 nt, Mycobacterium avium subsp. paratuberculosis
agcacgugcccagcccg

SEQ ID NO: 2873652 - RNA, 18 nt, Mycobacterium avium subsp. paratuberculosis
agcacguggccgggcucg

SEQ ID NO: 2873653 - RNA, 18 nt, Mycobacterium avium subsp. paratuberculosis
agcacguuguucaggucg

SEQ ID NO: 2873654 - RNA, 15 nt, Mycobacterium avium subsp. paratuberculosis
agcacucgcgggacg

SEQ ID NO: 2873655 - RNA, 20 nt, Mycobacterium avium subsp. paratuberculosis
agcacucgcgggacggcggc

SEQ ID NO: 2873656 - RNA, 22 nt, Mycobacterium avium subsp. paratuberculosis
agcacuucauggucgucgucga

SEQ ID NO: 2873657 - RNA, 13 nt, Mycobacterium avium subsp. paratuberculosis
agcacuuucgcgg

SEQ ID NO: 2873658 - RNA, 17 nt, Mycobacterium avium subsp. paratuberculosis
agcagaaaauagcccag

SEQ ID NO: 2873659 - RNA, 16 nt, Mycobacterium avium subsp. paratuberculosis
agcagaacgccaucac

SEQ ID NO: 2873660 - RNA, 20 nt, Mycobacterium avium subsp. paratuberculosis
agcagaacuucuccgccggc

SEQ ID NO: 2873661 - RNA, 21 nt, Mycobacterium avium subsp. paratuberculosis
agcagaacuucuccgccggca

SEQ ID NO: 2873662 - RNA, 20 nt, Mycobacterium avium subsp. paratuberculosis
agcagacacaaaagcaccca

SEQ ID NO: 2873663 - RNA, 17 nt, Mycobacterium avium subsp. paratuberculosis
agcagacccgccgcggc

SEQ ID NO: 2873664 - RNA, 19 nt, Mycobacterium avium subsp. paratuberculosis
agcagaccgcgaucagccc

SEQ ID NO: 2873665 - RNA, 22 nt, Mycobacterium avium subsp. paratuberculosis
agcagaccgcgaucagccccag

SEQ ID NO: 2873666 - RNA, 20 nt, Mycobacterium avium subsp. paratuberculosis
agcagacgcaaaaaccccca

SEQ ID NO: 2873667 - RNA, 20 nt, Mycobacterium avium subsp. paratuberculosis
agcagacgcaaaagccccca

SEQ ID NO: 2873668 - RNA, 18 nt, Mycobacterium avium subsp. paratuberculosis
agcagacgguaugcccgc

SEQ ID NO: 2873669 - RNA, 20 nt, Mycobacterium avium subsp. paratuberculosis
agcagacgugaaaucccccg

SEQ ID NO: 2873670 - RNA, 22 nt, Mycobacterium avium subsp. paratuberculosis
agcagacgugaaaucccccgac

SEQ ID NO: 2873671 - RNA, 18 nt, Mycobacterium avium subsp. paratuberculosis
agcagauagcccagccag

SEQ ID NO: 2873672 - RNA, 22 nt, Mycobacterium avium subsp. paratuberculosis
agcagaucaucgagggcguccu

SEQ ID NO: 2873673 - RNA, 17 nt, Mycobacterium avium subsp. paratuberculosis
agcagauccucagcagc

SEQ ID NO: 2873674 - RNA, 13 nt, Mycobacterium avium subsp. paratuberculosis
agcagaucggguc

SEQ ID NO: 2873675 - RNA, 18 nt, Mycobacterium avium subsp. paratuberculosis
agcagaucgggucccaga

SEQ ID NO: 2873676 - RNA, 19 nt, Mycobacterium avium subsp. paratuberculosis
agcagaucuuccaucacgc

SEQ ID NO: 2873677 - RNA, 14 nt, Mycobacterium avium subsp. paratuberculosis
agcagaugccgccc

SEQ ID NO: 2873678 - RNA, 15 nt, Mycobacterium avium subsp. paratuberculosis
agcagaugcgcgucg

SEQ ID NO: 2873679 - RNA, 20 nt, Mycobacterium avium subsp. paratuberculosis
agcagaugcgugcggugguc

SEQ ID NO: 2873680 - RNA, 16 nt, Mycobacterium avium subsp. paratuberculosis
agcagcaacggcggcg

SEQ ID NO: 2873681 - RNA, 15 nt, Mycobacterium avium subsp. paratuberculosis
agcagcaccacccgc

SEQ ID NO: 2873682 - RNA, 18 nt, Mycobacterium avium subsp. paratuberculosis
agcagcaccacccgcacc

SEQ ID NO: 2873683 - RNA, 23 nt, Mycobacterium avium subsp. paratuberculosis
agcagcaccacccgcaccucgcc

SEQ ID NO: 2873684 - RNA, 12 nt, Mycobacterium avium subsp. paratuberculosis
agcagcaccaga

SEQ ID NO: 2873685 - RNA, 13 nt, Mycobacterium avium subsp. paratuberculosis
agcagcaccagau

SEQ ID NO: 2873686 - RNA, 14 nt, Mycobacterium avium subsp. paratuberculosis
agcagcaccagaug

SEQ ID NO: 2873687 - RNA, 14 nt, Mycobacterium avium subsp. paratuberculosis
agcagcaccagcgc

SEQ ID NO: 2873688 - RNA, 15 nt, Mycobacterium avium subsp. paratuberculosis
agcagcaccagcgcc

SEQ ID NO: 2873689 - RNA, 22 nt, Mycobacterium avium subsp. paratuberculosis
agcagcaccaggcugaccagcg

SEQ ID NO: 2873690 - RNA, 24 nt, Mycobacterium avium subsp. paratuberculosis
agcagcaccaggcugaccagcgcc

SEQ ID NO: 2873691 - RNA, 13 nt, Mycobacterium avium subsp. paratuberculosis
agcagcaccccga

SEQ ID NO: 2873692 - RNA, 12 nt, Mycobacterium avium subsp. paratuberculosis
agcagcacccga

SEQ ID NO: 2873693 - RNA, 13 nt, Mycobacterium avium subsp. paratuberculosis
agcagcacccgac

SEQ ID NO: 2873694 - RNA, 23 nt, Mycobacterium avium subsp. paratuberculosis
agcagcacccggucgccggugug

SEQ ID NO: 2873695 - RNA, 12 nt, Mycobacterium avium subsp. paratuberculosis
agcagcaccgca

SEQ ID NO: 2873696 - RNA, 14 nt, Mycobacterium avium subsp. paratuberculosis
agcagcaccgcgac

SEQ ID NO: 2873697 - RNA, 15 nt, Mycobacterium avium subsp. paratuberculosis
agcagcaccgcgacc

SEQ ID NO: 2873698 - RNA, 17 nt, Mycobacterium avium subsp. paratuberculosis
agcagcaccgcgaccca

SEQ ID NO: 2873699 - RNA, 17 nt, Mycobacterium avium subsp. paratuberculosis
agcagcaccggcaccgc

SEQ ID NO: 2873700 - RNA, 21 nt, Mycobacterium avium subsp. paratuberculosis
agcagcaccggcaccgcggcg

SEQ ID NO: 2873701 - RNA, 14 nt, Mycobacterium avium subsp. paratuberculosis
agcagcaccggcgc

SEQ ID NO: 2873702 - RNA, 15 nt, Mycobacterium avium subsp. paratuberculosis
agcagcaccggcgcc

SEQ ID NO: 2873703 - RNA, 16 nt, Mycobacterium avium subsp. paratuberculosis
agcagcaccggcgccu

SEQ ID NO: 2873704 - RNA, 17 nt, Mycobacterium avium subsp. paratuberculosis
agcagcaccuggaucca

SEQ ID NO: 2873705 - RNA, 20 nt, Mycobacterium avium subsp. paratuberculosis
agcagcaccuggauccaguu

SEQ ID NO: 2873706 - RNA, 21 nt, Mycobacterium avium subsp. paratuberculosis
agcagcacgaucgagccggug

SEQ ID NO: 2873707 - RNA, 18 nt, Mycobacterium avium subsp. paratuberculosis
agcagcagaaccagcacc

SEQ ID NO: 2873708 - RNA, 19 nt, Mycobacterium avium subsp. paratuberculosis
agcagcagaaccagcaccg

SEQ ID NO: 2873709 - RNA, 15 nt, Mycobacterium avium subsp. paratuberculosis
agcagcagaccgccg

SEQ ID NO: 2873710 - RNA, 16 nt, Mycobacterium avium subsp. paratuberculosis
agcagcagaccgccgg

SEQ ID NO: 2873711 - RNA, 15 nt, Mycobacterium avium subsp. paratuberculosis
agcagcagaccgcga

SEQ ID NO: 2873712 - RNA, 16 nt, Mycobacterium avium subsp. paratuberculosis
agcagcagaccgcgau

SEQ ID NO: 2873713 - RNA, 17 nt, Mycobacterium avium subsp. paratuberculosis
agcagcagaccgcgauc

SEQ ID NO: 2873714 - RNA, 20 nt, Mycobacterium avium subsp. paratuberculosis
agcagcagaccgcgaucagc

SEQ ID NO: 2873715 - RNA, 13 nt, Mycobacterium avium subsp. paratuberculosis
agcagcagccacg

SEQ ID NO: 2873716 - RNA, 16 nt, Mycobacterium avium subsp. paratuberculosis
agcagcagccacgcca

SEQ ID NO: 2873717 - RNA, 12 nt, Mycobacterium avium subsp. paratuberculosis
agcagcagcccg

SEQ ID NO: 2873718 - RNA, 16 nt, Mycobacterium avium subsp. paratuberculosis
agcagcagcccgccga

SEQ ID NO: 2873719 - RNA, 13 nt, Mycobacterium avium subsp. paratuberculosis
agcagcagccgcc

SEQ ID NO: 2873720 - RNA, 17 nt, Mycobacterium avium subsp. paratuberculosis
agcagcagccgccgggc

SEQ ID NO: 2873721 - RNA, 16 nt, Mycobacterium avium subsp. paratuberculosis
agcagcagccgcgccg

SEQ ID NO: 2873722 - RNA, 12 nt, Mycobacterium avium subsp. paratuberculosis
agcagcagcgcc

SEQ ID NO: 2873723 - RNA, 19 nt, Mycobacterium avium subsp. paratuberculosis
agcagcagcgccgccaccg

SEQ ID NO: 2873724 - RNA, 15 nt, Mycobacterium avium subsp. paratuberculosis
agcagcagcgcggug

SEQ ID NO: 2873725 - RNA, 16 nt, Mycobacterium avium subsp. paratuberculosis
agcagcagcgcggugc

SEQ ID NO: 2873726 - RNA, 17 nt, Mycobacterium avium subsp. paratuberculosis
agcagcagcgcggugcc

SEQ ID NO: 2873727 - RNA, 19 nt, Mycobacterium avium subsp. paratuberculosis
agcagcagcgcggugccga

SEQ ID NO: 2873728 - RNA, 21 nt, Mycobacterium avium subsp. paratuberculosis
agcagcaggucggccagcugc

SEQ ID NO: 2873729 - RNA, 22 nt, Mycobacterium avium subsp. paratuberculosis
agcagcaggucggccagcugcg

SEQ ID NO: 2873730 - RNA, 17 nt, Mycobacterium avium subsp. paratuberculosis
agcagcaggucggcgug

SEQ ID NO: 2873731 - RNA, 16 nt, Mycobacterium avium subsp. paratuberculosis
agcagcaugccgagca

SEQ ID NO: 2873732 - RNA, 17 nt, Mycobacterium avium subsp. paratuberculosis
agcagcaugccgagcac

SEQ ID NO: 2873733 - RNA, 21 nt, Mycobacterium avium subsp. paratuberculosis
agcagccacgacaccagcguc

SEQ ID NO: 2873734 - RNA, 18 nt, Mycobacterium avium subsp. paratuberculosis
agcagccacgccagccag

SEQ ID NO: 2873735 - RNA, 22 nt, Mycobacterium avium subsp. paratuberculosis
agcagccacgccagccaggcga

SEQ ID NO: 2873736 - RNA, 15 nt, Mycobacterium avium subsp. paratuberculosis
agcagccagcccagc

SEQ ID NO: 2873737 - RNA, 16 nt, Mycobacterium avium subsp. paratuberculosis
agcagccagcccagcc

SEQ ID NO: 2873738 - RNA, 16 nt, Mycobacterium avium subsp. paratuberculosis
agcagccaggacagcg

SEQ ID NO: 2873739 - RNA, 21 nt, Mycobacterium avium subsp. paratuberculosis
agcagccaggacagcgucagc

SEQ ID NO: 2873740 - RNA, 23 nt, Mycobacterium avium subsp. paratuberculosis
agcagccagguccgggcacucga

SEQ ID NO: 2873741 - RNA, 20 nt, Mycobacterium avium subsp. paratuberculosis
agcagccagucggucaacgu

SEQ ID NO: 2873742 - RNA, 14 nt, Mycobacterium avium subsp. paratuberculosis
agcagcccgccgau

SEQ ID NO: 2873743 - RNA, 14 nt, Mycobacterium avium subsp. paratuberculosis
agcagcccggccag

SEQ ID NO: 2873744 - RNA, 16 nt, Mycobacterium avium subsp. paratuberculosis
agcagcccggccagcc

SEQ ID NO: 2873745 - RNA, 23 nt, Mycobacterium avium subsp. paratuberculosis
agcagcccggccagccgggcggc

SEQ ID NO: 2873746 - RNA, 13 nt, Mycobacterium avium subsp. paratuberculosis
agcagcccggcga

SEQ ID NO: 2873747 - RNA, 15 nt, Mycobacterium avium subsp. paratuberculosis
agcagccgaucuggc

SEQ ID NO: 2873748 - RNA, 12 nt, Mycobacterium avium subsp. paratuberculosis
agcagccgcaac

SEQ ID NO: 2873749 - RNA, 14 nt, Mycobacterium avium subsp. paratuberculosis
agcagccgcaacca

SEQ ID NO: 2873750 - RNA, 16 nt, Mycobacterium avium subsp. paratuberculosis
agcagccgcagcgcgc

SEQ ID NO: 2873751 - RNA, 18 nt, Mycobacterium avium subsp. paratuberculosis
agcagccgcagcgcgcga

SEQ ID NO: 2873752 - RNA, 17 nt, Mycobacterium avium subsp. paratuberculosis
agcagccgcagcggcgg

SEQ ID NO: 2873753 - RNA, 14 nt, Mycobacterium avium subsp. paratuberculosis
agcagccgcgacac

SEQ ID NO: 2873754 - RNA, 15 nt, Mycobacterium avium subsp. paratuberculosis
agcagccgcgccacc

SEQ ID NO: 2873755 - RNA, 19 nt, Mycobacterium avium subsp. paratuberculosis
agcagccgcgccaccgcgg

SEQ ID NO: 2873756 - RNA, 17 nt, Mycobacterium avium subsp. paratuberculosis
agcagccgcgccgacgc

SEQ ID NO: 2873757 - RNA, 14 nt, Mycobacterium avium subsp. paratuberculosis
agcagccgcgcgag

SEQ ID NO: 2873758 - RNA, 15 nt, Mycobacterium avium subsp. paratuberculosis
agcagccgcgcgagc

SEQ ID NO: 2873759 - RNA, 13 nt, Mycobacterium avium subsp. paratuberculosis
agcagccgcucgu

SEQ ID NO: 2873760 - RNA, 21 nt, Mycobacterium avium subsp. paratuberculosis
agcagccgcugcugggugccg

SEQ ID NO: 2873761 - RNA, 22 nt, Mycobacterium avium subsp. paratuberculosis
agcagccggaaggccaaggcca

SEQ ID NO: 2873762 - RNA, 15 nt, Mycobacterium avium subsp. paratuberculosis
agcagccgggccagc

SEQ ID NO: 2873763 - RNA, 23 nt, Mycobacterium avium subsp. paratuberculosis
agcagccgggccagcaacagcag

SEQ ID NO: 2873764 - RNA, 23 nt, Mycobacterium avium subsp. paratuberculosis
agcagccgggugcccaucugcac

SEQ ID NO: 2873765 - RNA, 23 nt, Mycobacterium avium subsp. paratuberculosis
agcagccggucgaggucgccgac

SEQ ID NO: 2873766 - RNA, 14 nt, Mycobacterium avium subsp. paratuberculosis
agcagccugccccc

SEQ ID NO: 2873767 - RNA, 13 nt, Mycobacterium avium subsp. paratuberculosis
agcagcgaacccg

SEQ ID NO: 2873768 - RNA, 14 nt, Mycobacterium avium subsp. paratuberculosis
agcagcgaacccgc

SEQ ID NO: 2873769 - RNA, 21 nt, Mycobacterium avium subsp. paratuberculosis
agcagcgacaugaccaccgcg

SEQ ID NO: 2873770 - RNA, 23 nt, Mycobacterium avium subsp. paratuberculosis
agcagcgacaugaccaccgcguc

SEQ ID NO: 2873771 - RNA, 20 nt, Mycobacterium avium subsp. paratuberculosis
agcagcgacuugaccagcag

SEQ ID NO: 2873772 - RNA, 21 nt, Mycobacterium avium subsp. paratuberculosis
agcagcgacuugaccagcagc

SEQ ID NO: 2873773 - RNA, 22 nt, Mycobacterium avium subsp. paratuberculosis
agcagcgacuugaccagcagcu

SEQ ID NO: 2873774 - RNA, 20 nt, Mycobacterium avium subsp. paratuberculosis
agcagcgagaaccggcgcag

SEQ ID NO: 2873775 - RNA, 17 nt, Mycobacterium avium subsp. paratuberculosis
agcagcgagaccggcac

SEQ ID NO: 2873776 - RNA, 22 nt, Mycobacterium avium subsp. paratuberculosis
agcagcgaggcguccagcgcgu

SEQ ID NO: 2873777 - RNA, 22 nt, Mycobacterium avium subsp. paratuberculosis
agcagcgccacaauggauccga

SEQ ID NO: 2873778 - RNA, 12 nt, Mycobacterium avium subsp. paratuberculosis
agcagcgccagc

SEQ ID NO: 2873779 - RNA, 15 nt, Mycobacterium avium subsp. paratuberculosis
agcagcgccagcagc

SEQ ID NO: 2873780 - RNA, 19 nt, Mycobacterium avium subsp. paratuberculosis
agcagcgccagcagcggca

SEQ ID NO: 2873781 - RNA, 10 nt, Mycobacterium avium subsp. paratuberculosis
agcagcgccg

SEQ ID NO: 2873782 - RNA, 14 nt, Mycobacterium avium subsp. paratuberculosis
agcagcgccgccac

SEQ ID NO: 2873783 - RNA, 15 nt, Mycobacterium avium subsp. paratuberculosis
agcagcgccgccacc

SEQ ID NO: 2873784 - RNA, 16 nt, Mycobacterium avium subsp. paratuberculosis
agcagcgccgccaccg

SEQ ID NO: 2873785 - RNA, 17 nt, Mycobacterium avium subsp. paratuberculosis
agcagcgccgccaccgg

SEQ ID NO: 2873786 - RNA, 19 nt, Mycobacterium avium subsp. paratuberculosis
agcagcgccgccaccggcc

SEQ ID NO: 2873787 - RNA, 14 nt, Mycobacterium avium subsp. paratuberculosis
agcagcgccggcag

SEQ ID NO: 2873788 - RNA, 15 nt, Mycobacterium avium subsp. paratuberculosis
agcagcgccggcagc

SEQ ID NO: 2873789 - RNA, 16 nt, Mycobacterium avium subsp. paratuberculosis
agcagcgccggcagcg

SEQ ID NO: 2873790 - RNA, 19 nt, Mycobacterium avium subsp. paratuberculosis
agcagcgccucgccgggcc

SEQ ID NO: 2873791 - RNA, 20 nt, Mycobacterium avium subsp. paratuberculosis
agcagcgccucggcgaucgg

SEQ ID NO: 2873792 - RNA, 15 nt, Mycobacterium avium subsp. paratuberculosis
agcagcgccugcugc

SEQ ID NO: 2873793 - RNA, 21 nt, Mycobacterium avium subsp. paratuberculosis
agcagcgccugcugccaggac

SEQ ID NO: 2873794 - RNA, 22 nt, Mycobacterium avium subsp. paratuberculosis
agcagcgccugcugccaggaca

SEQ ID NO: 2873795 - RNA, 23 nt, Mycobacterium avium subsp. paratuberculosis
agcagcgccuugccgacgacguc

SEQ ID NO: 2873796 - RNA, 22 nt, Mycobacterium avium subsp. paratuberculosis
agcagcgcgaugccggccaggc

SEQ ID NO: 2873797 - RNA, 14 nt, Mycobacterium avium subsp. paratuberculosis
agcagcgcgccgcg

SEQ ID NO: 2873798 - RNA, 22 nt, Mycobacterium avium subsp. paratuberculosis
agcagcgcgccgcgcuggccga

SEQ ID NO: 2873799 - RNA, 14 nt, Mycobacterium avium subsp. paratuberculosis
agcagcgcgcgguu

SEQ ID NO: 2873800 - RNA, 23 nt, Mycobacterium avium subsp. paratuberculosis
agcagcgcggcauggcuggcggc

SEQ ID NO: 2873801 - RNA, 20 nt, Mycobacterium avium subsp. paratuberculosis
agcagcgcggcuuggccacc

SEQ ID NO: 2873802 - RNA, 22 nt, Mycobacterium avium subsp. paratuberculosis
agcagcgcggcuuggccaccac

SEQ ID NO: 2873803 - RNA, 19 nt, Mycobacterium avium subsp. paratuberculosis
agcagcgcggucaacaccg

SEQ ID NO: 2873804 - RNA, 15 nt, Mycobacterium avium subsp. paratuberculosis
agcagcgcggugccg

SEQ ID NO: 2873805 - RNA, 23 nt, Mycobacterium avium subsp. paratuberculosis
agcagcgcgucgcgggcccgggc

SEQ ID NO: 2873806 - RNA, 13 nt, Mycobacterium avium subsp. paratuberculosis
agcagcggcaccc

SEQ ID NO: 2873807 - RNA, 14 nt, Mycobacterium avium subsp. paratuberculosis
agcagcggcacccg

SEQ ID NO: 2873808 - RNA, 15 nt, Mycobacterium avium subsp. paratuberculosis
agcagcggcagccac

SEQ ID NO: 2873809 - RNA, 21 nt, Mycobacterium avium subsp. paratuberculosis
agcagcggcagccacggcagc

SEQ ID NO: 2873810 - RNA, 22 nt, Mycobacterium avium subsp. paratuberculosis
agcagcggcagccacggcagcu

SEQ ID NO: 2873811 - RNA, 13 nt, Mycobacterium avium subsp. paratuberculosis
agcagcggcagcg

SEQ ID NO: 2873812 - RNA, 14 nt, Mycobacterium avium subsp. paratuberculosis
agcagcggcaugcc

SEQ ID NO: 2873813 - RNA, 21 nt, Mycobacterium avium subsp. paratuberculosis
agcagcggccggcgcagccgg

SEQ ID NO: 2873814 - RNA, 23 nt, Mycobacterium avium subsp. paratuberculosis
agcagcggccggcgcagccggcc

SEQ ID NO: 2873815 - RNA, 21 nt, Mycobacterium avium subsp. paratuberculosis
agcagcggcuuggucaccagc

SEQ ID NO: 2873816 - RNA, 22 nt, Mycobacterium avium subsp. paratuberculosis
agcagcggcuuggucaccagcu

SEQ ID NO: 2873817 - RNA, 15 nt, Mycobacterium avium subsp. paratuberculosis
agcagcgggaucagc

SEQ ID NO: 2873818 - RNA, 17 nt, Mycobacterium avium subsp. paratuberculosis
agcagcgggaucagcuc

SEQ ID NO: 2873819 - RNA, 17 nt, Mycobacterium avium subsp. paratuberculosis
agcagcgggcccgggcu

SEQ ID NO: 2873820 - RNA, 14 nt, Mycobacterium avium subsp. paratuberculosis
agcagcgggccgaa

SEQ ID NO: 2873821 - RNA, 12 nt, Mycobacterium avium subsp. paratuberculosis
agcagcggggcg

SEQ ID NO: 2873822 - RNA, 21 nt, Mycobacterium avium subsp. paratuberculosis
agcagcggggugagcaccgcg

SEQ ID NO: 2873823 - RNA, 22 nt, Mycobacterium avium subsp. paratuberculosis
agcagcggggugagcaccgcga

SEQ ID NO: 2873824 - RNA, 20 nt, Mycobacterium avium subsp. paratuberculosis
agcagcggggugugcucggc

SEQ ID NO: 2873825 - RNA, 23 nt, Mycobacterium avium subsp. paratuberculosis
agcagcgggucgucgggccgggg

SEQ ID NO: 2873826 - RNA, 12 nt, Mycobacterium avium subsp. paratuberculosis
agcagcgucguc

SEQ ID NO: 2873827 - RNA, 18 nt, Mycobacterium avium subsp. paratuberculosis
agcagcgucugcgccagc

SEQ ID NO: 2873828 - RNA, 20 nt, Mycobacterium avium subsp. paratuberculosis
agcagcgucugcgccagcug

SEQ ID NO: 2873829 - RNA, 16 nt, Mycobacterium avium subsp. paratuberculosis
agcagcgucugcgccc

SEQ ID NO: 2873830 - RNA, 19 nt, Mycobacterium avium subsp. paratuberculosis
agcagcgucugcgccccgg

SEQ ID NO: 2873831 - RNA, 20 nt, Mycobacterium avium subsp. paratuberculosis
agcagcgucugcgccccggc

SEQ ID NO: 2873832 - RNA, 22 nt, Mycobacterium avium subsp. paratuberculosis
agcagcgucugcgccccggcgu

SEQ ID NO: 2873833 - RNA, 18 nt, Mycobacterium avium subsp. paratuberculosis
agcagcguuccgucggcg

SEQ ID NO: 2873834 - RNA, 20 nt, Mycobacterium avium subsp. paratuberculosis
agcagcguuccgucggcgag

SEQ ID NO: 2873835 - RNA, 16 nt, Mycobacterium avium subsp. paratuberculosis
agcagcguucggucag

SEQ ID NO: 2873836 - RNA, 17 nt, Mycobacterium avium subsp. paratuberculosis
agcagcguucggucagc

SEQ ID NO: 2873837 - RNA, 21 nt, Mycobacterium avium subsp. paratuberculosis
agcagcguucggucagcacga

SEQ ID NO: 2873838 - RNA, 19 nt, Mycobacterium avium subsp. paratuberculosis
agcagcucauacagcggcg

SEQ ID NO: 2873839 - RNA, 21 nt, Mycobacterium avium subsp. paratuberculosis
agcagcucauacagcggcgcg

SEQ ID NO: 2873840 - RNA, 16 nt, Mycobacterium avium subsp. paratuberculosis
agcagcuccggucggc

SEQ ID NO: 2873841 - RNA, 17 nt, Mycobacterium avium subsp. paratuberculosis
agcagcuccggucggcg

SEQ ID NO: 2873842 - RNA, 21 nt, Mycobacterium avium subsp. paratuberculosis
agcagcuccggucggcgcucg

SEQ ID NO: 2873843 - RNA, 22 nt, Mycobacterium avium subsp. paratuberculosis
agcagcuccggucggcgcucgc

SEQ ID NO: 2873844 - RNA, 21 nt, Mycobacterium avium subsp. paratuberculosis
agcagcucgcggauccgcagc

SEQ ID NO: 2873845 - RNA, 20 nt, Mycobacterium avium subsp. paratuberculosis
agcagcucgcguagcgaggu

SEQ ID NO: 2873846 - RNA, 21 nt, Mycobacterium avium subsp. paratuberculosis
agcagcucgcguagcgaggug

SEQ ID NO: 2873847 - RNA, 13 nt, Mycobacterium avium subsp. paratuberculosis
agcagcucggcgg

SEQ ID NO: 2873848 - RNA, 15 nt, Mycobacterium avium subsp. paratuberculosis
agcagcucggcggcc

SEQ ID NO: 2873849 - RNA, 15 nt, Mycobacterium avium subsp. paratuberculosis
agcagcucggucacc

SEQ ID NO: 2873850 - RNA, 16 nt, Mycobacterium avium subsp. paratuberculosis
agcagcucggucacca

SEQ ID NO: 2873851 - RNA, 21 nt, Mycobacterium avium subsp. paratuberculosis
agcagcucggucaccagcggc

SEQ ID NO: 2873852 - RNA, 22 nt, Mycobacterium avium subsp. paratuberculosis
agcagcucggucaccagcggcc

SEQ ID NO: 2873853 - RNA, 15 nt, Mycobacterium avium subsp. paratuberculosis
agcagcugcacccgc

SEQ ID NO: 2873854 - RNA, 16 nt, Mycobacterium avium subsp. paratuberculosis
agcagcugcagcgucg

SEQ ID NO: 2873855 - RNA, 14 nt, Mycobacterium avium subsp. paratuberculosis
agcagcugcccgag

SEQ ID NO: 2873856 - RNA, 19 nt, Mycobacterium avium subsp. paratuberculosis
agcagcugcgucggcacca

SEQ ID NO: 2873857 - RNA, 20 nt, Mycobacterium avium subsp. paratuberculosis
agcagcugcgucggcaccag

SEQ ID NO: 2873858 - RNA, 23 nt, Mycobacterium avium subsp. paratuberculosis
agcagcuggaaauaggccgggca

SEQ ID NO: 2873859 - RNA, 23 nt, Mycobacterium avium subsp. paratuberculosis
agcagcugggacagcgucaccaa

SEQ ID NO: 2873860 - RNA, 14 nt, Mycobacterium avium subsp. paratuberculosis
agcagcuucaugcc

SEQ ID NO: 2873861 - RNA, 15 nt, Mycobacterium avium subsp. paratuberculosis
agcagcuugaucgcc

SEQ ID NO: 2873862 - RNA, 21 nt, Mycobacterium avium subsp. paratuberculosis
agcagcuugaucgccggggcg

SEQ ID NO: 2873863 - RNA, 23 nt, Mycobacterium avium subsp. paratuberculosis
agcagcuugaucgccggggcgcu

SEQ ID NO: 2873864 - RNA, 14 nt, Mycobacterium avium subsp. paratuberculosis
agcaggaccgagcc

SEQ ID NO: 2873865 - RNA, 17 nt, Mycobacterium avium subsp. paratuberculosis
agcaggacgcgcccggc

SEQ ID NO: 2873866 - RNA, 13 nt, Mycobacterium avium subsp. paratuberculosis
agcaggacggugg

SEQ ID NO: 2873867 - RNA, 19 nt, Mycobacterium avium subsp. paratuberculosis
agcaggaucuccggccggu

SEQ ID NO: 2873868 - RNA, 20 nt, Mycobacterium avium subsp. paratuberculosis
agcaggaucuccggccggug

SEQ ID NO: 2873869 - RNA, 17 nt, Mycobacterium avium subsp. paratuberculosis
agcaggaucuggugcgc

SEQ ID NO: 2873870 - RNA, 21 nt, Mycobacterium avium subsp. paratuberculosis
agcaggaucuggugcgcgcgc

SEQ ID NO: 2873871 - RNA, 19 nt, Mycobacterium avium subsp. paratuberculosis
agcaggaugaugaccgaca

SEQ ID NO: 2873872 - RNA, 13 nt, Mycobacterium avium subsp. paratuberculosis
agcaggcaucgcg

SEQ ID NO: 2873873 - RNA, 19 nt, Mycobacterium avium subsp. paratuberculosis
agcaggccaggugcagcug

SEQ ID NO: 2873874 - RNA, 18 nt, Mycobacterium avium subsp. paratuberculosis
agcaggcccucggccagc

SEQ ID NO: 2873875 - RNA, 13 nt, Mycobacterium avium subsp. paratuberculosis
agcaggcgccgca

SEQ ID NO: 2873876 - RNA, 15 nt, Mycobacterium avium subsp. paratuberculosis
agcaggcgccgcagc

SEQ ID NO: 2873877 - RNA, 15 nt, Mycobacterium avium subsp. paratuberculosis
agcaggcgccggucg

SEQ ID NO: 2873878 - RNA, 12 nt, Mycobacterium avium subsp. paratuberculosis
agcaggcgcgca

SEQ ID NO: 2873879 - RNA, 14 nt, Mycobacterium avium subsp. paratuberculosis
agcaggcgcgcagc

SEQ ID NO: 2873880 - RNA, 15 nt, Mycobacterium avium subsp. paratuberculosis
agcaggcgcgcagca

SEQ ID NO: 2873881 - RNA, 16 nt, Mycobacterium avium subsp. paratuberculosis
agcaggcgcgccgagc

SEQ ID NO: 2873882 - RNA, 20 nt, Mycobacterium avium subsp. paratuberculosis
agcaggcgcgccgagcgcug

SEQ ID NO: 2873883 - RNA, 16 nt, Mycobacterium avium subsp. paratuberculosis
agcaggcggacggcga

SEQ ID NO: 2873884 - RNA, 17 nt, Mycobacterium avium subsp. paratuberculosis
agcaggcggacggcgac

SEQ ID NO: 2873885 - RNA, 18 nt, Mycobacterium avium subsp. paratuberculosis
agcaggcggacggcgacc

SEQ ID NO: 2873886 - RNA, 15 nt, Mycobacterium avium subsp. paratuberculosis
agcagggcaccgacg

SEQ ID NO: 2873887 - RNA, 18 nt, Mycobacterium avium subsp. paratuberculosis
agcagggccucgccguug

SEQ ID NO: 2873888 - RNA, 12 nt, Mycobacterium avium subsp. paratuberculosis
agcagggcgccg

SEQ ID NO: 2873889 - RNA, 14 nt, Mycobacterium avium subsp. paratuberculosis
agcagggcgccgac

SEQ ID NO: 2873890 - RNA, 15 nt, Mycobacterium avium subsp. paratuberculosis
agcagggcgccgacg

SEQ ID NO: 2873891 - RNA, 13 nt, Mycobacterium avium subsp. paratuberculosis
agcagggcggcga

SEQ ID NO: 2873892 - RNA, 14 nt, Mycobacterium avium subsp. paratuberculosis
agcagggcggcgau

SEQ ID NO: 2873893 - RNA, 16 nt, Mycobacterium avium subsp. paratuberculosis
agcagggucagcgaca

SEQ ID NO: 2873894 - RNA, 13 nt, Mycobacterium avium subsp. paratuberculosis
agcagggugccgc

SEQ ID NO: 2873895 - RNA, 17 nt, Mycobacterium avium subsp. paratuberculosis
agcagguaaaccagcag

SEQ ID NO: 2873896 - RNA, 20 nt, Mycobacterium avium subsp. paratuberculosis
agcagguaaaccagcagcgc

SEQ ID NO: 2873897 - RNA, 17 nt, Mycobacterium avium subsp. paratuberculosis
agcagguagaagccgcg

SEQ ID NO: 2873898 - RNA, 17 nt, Mycobacterium avium subsp. paratuberculosis
agcagguagaucgccag

SEQ ID NO: 2873899 - RNA, 18 nt, Mycobacterium avium subsp. paratuberculosis
agcagguagaucgccagc

SEQ ID NO: 2873900 - RNA, 12 nt, Mycobacterium avium subsp. paratuberculosis
agcagguagcgg

SEQ ID NO: 2873901 - RNA, 20 nt, Mycobacterium avium subsp. paratuberculosis
agcagguagcggcugaccga

SEQ ID NO: 2873902 - RNA, 21 nt, Mycobacterium avium subsp. paratuberculosis
agcagguccauggccuugacg

SEQ ID NO: 2873903 - RNA, 15 nt, Mycobacterium avium subsp. paratuberculosis
agcagguccgccggu

SEQ ID NO: 2873904 - RNA, 17 nt, Mycobacterium avium subsp. paratuberculosis
agcagguccucgaucga

SEQ ID NO: 2873905 - RNA, 19 nt, Mycobacterium avium subsp. paratuberculosis
agcaggucgaaggcggccg

SEQ ID NO: 2873906 - RNA, 21 nt, Mycobacterium avium subsp. paratuberculosis
agcaggucgaaggcggccgcg

SEQ ID NO: 2873907 - RNA, 13 nt, Mycobacterium avium subsp. paratuberculosis
agcaggucgaucu

SEQ ID NO: 2873908 - RNA, 18 nt, Mycobacterium avium subsp. paratuberculosis
agcaggucgaucugcggc

SEQ ID NO: 2873909 - RNA, 15 nt, Mycobacterium avium subsp. paratuberculosis
agcaggucggccagc

SEQ ID NO: 2873910 - RNA, 18 nt, Mycobacterium avium subsp. paratuberculosis
agcaggucggcgugcucg

SEQ ID NO: 2873911 - RNA, 17 nt, Mycobacterium avium subsp. paratuberculosis
agcaggucgucgacguc

SEQ ID NO: 2873912 - RNA, 14 nt, Mycobacterium avium subsp. paratuberculosis
agcaggugcaccac

SEQ ID NO: 2873913 - RNA, 16 nt, Mycobacterium avium subsp. paratuberculosis
agcaggugcaucgacc

SEQ ID NO: 2873914 - RNA, 19 nt, Mycobacterium avium subsp. paratuberculosis
agcaggugcaucgaccggc

SEQ ID NO: 2873915 - RNA, 20 nt, Mycobacterium avium subsp. paratuberculosis
agcaggugcaucgccaccgu

SEQ ID NO: 2873916 - RNA, 23 nt, Mycobacterium avium subsp. paratuberculosis
agcagguuguagucggcgccgac

SEQ ID NO: 2873917 - RNA, 17 nt, Mycobacterium avium subsp. paratuberculosis
agcaguagacgccgccg

SEQ ID NO: 2873918 - RNA, 23 nt, Mycobacterium avium subsp. paratuberculosis
agcaguccccgccuucgaugccc

SEQ ID NO: 2873919 - RNA, 13 nt, Mycobacterium avium subsp. paratuberculosis
agcagucgugacg

SEQ ID NO: 2873920 - RNA, 18 nt, Mycobacterium avium subsp. paratuberculosis
agcagugcaucgcugccg

SEQ ID NO: 2873921 - RNA, 22 nt, Mycobacterium avium subsp. paratuberculosis
agcagugcaucgcugccgucca

SEQ ID NO: 2873922 - RNA, 13 nt, Mycobacterium avium subsp. paratuberculosis
agcagugccacca

SEQ ID NO: 2873923 - RNA, 19 nt, Mycobacterium avium subsp. paratuberculosis
agcagugccaccaccacgg

SEQ ID NO: 2873924 - RNA, 18 nt, Mycobacterium avium subsp. paratuberculosis
agcagugccccguccggc

SEQ ID NO: 2873925 - RNA, 22 nt, Mycobacterium avium subsp. paratuberculosis
agcagugccccguccggcgcca

SEQ ID NO: 2873926 - RNA, 19 nt, Mycobacterium avium subsp. paratuberculosis
agcaguguccagucggccg

SEQ ID NO: 2873927 - RNA, 15 nt, Mycobacterium avium subsp. paratuberculosis
agcaguuccgacauc

SEQ ID NO: 2873928 - RNA, 16 nt, Mycobacterium avium subsp. paratuberculosis
agcaguucgaugcgcu

SEQ ID NO: 2873929 - RNA, 18 nt, Mycobacterium avium subsp. paratuberculosis
agcaguucguagcgggag

SEQ ID NO: 2873930 - RNA, 22 nt, Mycobacterium avium subsp. paratuberculosis
agcaguuuggucauccgcucca

SEQ ID NO: 2873931 - RNA, 13 nt, Mycobacterium avium subsp. paratuberculosis
agcaucagcugcc

SEQ ID NO: 2873932 - RNA, 14 nt, Mycobacterium avium subsp. paratuberculosis
agcaucagcugccg

SEQ ID NO: 2873933 - RNA, 15 nt, Mycobacterium avium subsp. paratuberculosis
agcauccagguggcg

SEQ ID NO: 2873934 - RNA, 20 nt, Mycobacterium avium subsp. paratuberculosis
agcauccccuuggugcgguc

SEQ ID NO: 2873935 - RNA, 24 nt, Mycobacterium avium subsp. paratuberculosis
agcauccccuuggugcggucgaug

SEQ ID NO: 2873936 - RNA, 21 nt, Mycobacterium avium subsp. paratuberculosis
agcauccgcaacgugcgccgg

SEQ ID NO: 2873937 - RNA, 22 nt, Mycobacterium avium subsp. paratuberculosis
agcauccgcaacgugcgccggc

SEQ ID NO: 2873938 - RNA, 12 nt, Mycobacterium avium subsp. paratuberculosis
agcauccgccga

SEQ ID NO: 2873939 - RNA, 17 nt, Mycobacterium avium subsp. paratuberculosis
agcauccgccgacgaua

SEQ ID NO: 2873940 - RNA, 23 nt, Mycobacterium avium subsp. paratuberculosis
agcauccgcuggugcgcgccggc

SEQ ID NO: 2873941 - RNA, 13 nt, Mycobacterium avium subsp. paratuberculosis
agcauccggcgca

SEQ ID NO: 2873942 - RNA, 21 nt, Mycobacterium avium subsp. paratuberculosis
agcauccggcgcacggcgccc

SEQ ID NO: 2873943 - RNA, 13 nt, Mycobacterium avium subsp. paratuberculosis
agcaucgccgagc

SEQ ID NO: 2873944 - RNA, 17 nt, Mycobacterium avium subsp. paratuberculosis
agcaucgccgagcgcau

SEQ ID NO: 2873945 - RNA, 14 nt, Mycobacterium avium subsp. paratuberculosis
agcaucgccgcgac

SEQ ID NO: 2873946 - RNA, 15 nt, Mycobacterium avium subsp. paratuberculosis
agcaucgccgcggug

SEQ ID NO: 2873947 - RNA, 19 nt, Mycobacterium avium subsp. paratuberculosis
agcaucgccgcggugcgcg

SEQ ID NO: 2873948 - RNA, 20 nt, Mycobacterium avium subsp. paratuberculosis
agcaucgccgcggugcgcga

SEQ ID NO: 2873949 - RNA, 13 nt, Mycobacterium avium subsp. paratuberculosis
agcaucgccgucg

SEQ ID NO: 2873950 - RNA, 21 nt, Mycobacterium avium subsp. paratuberculosis
agcaucgccgucgucagccgg

SEQ ID NO: 2873951 - RNA, 14 nt, Mycobacterium avium subsp. paratuberculosis
agcaucggaugccg

SEQ ID NO: 2873952 - RNA, 17 nt, Mycobacterium avium subsp. paratuberculosis
agcaucgggacgccugc

SEQ ID NO: 2873953 - RNA, 18 nt, Mycobacterium avium subsp. paratuberculosis
agcaucgggacgccugcc

SEQ ID NO: 2873954 - RNA, 19 nt, Mycobacterium avium subsp. paratuberculosis
agcaucgggguuccaccgu

SEQ ID NO: 2873955 - RNA, 19 nt, Mycobacterium avium subsp. paratuberculosis
agcaucggguugccggcgg

SEQ ID NO: 2873956 - RNA, 13 nt, Mycobacterium avium subsp. paratuberculosis
agcaucuccgagu

SEQ ID NO: 2873957 - RNA, 14 nt, Mycobacterium avium subsp. paratuberculosis
agcaucucggugcc

SEQ ID NO: 2873958 - RNA, 15 nt, Mycobacterium avium subsp. paratuberculosis
agcaucucggugccg

SEQ ID NO: 2873959 - RNA, 20 nt, Mycobacterium avium subsp. paratuberculosis
agcaucuuggccacgggguc

SEQ ID NO: 2873960 - RNA, 23 nt, Mycobacterium avium subsp. paratuberculosis
agcaugaagaucagcaccgucca

SEQ ID NO: 2873961 - RNA, 17 nt, Mycobacterium avium subsp. paratuberculosis
agcaugacgaacucguu

SEQ ID NO: 2873962 - RNA, 15 nt, Mycobacterium avium subsp. paratuberculosis
agcaugaucaccgcc

SEQ ID NO: 2873963 - RNA, 17 nt, Mycobacterium avium subsp. paratuberculosis
agcaugaucaccgccag

SEQ ID NO: 2873964 - RNA, 20 nt, Mycobacterium avium subsp. paratuberculosis
agcaugccgagcaccuccga

SEQ ID NO: 2873965 - RNA, 20 nt, Mycobacterium avium subsp. paratuberculosis
agcaugcgccagagcgcgaa

SEQ ID NO: 2873966 - RNA, 17 nt, Mycobacterium avium subsp. paratuberculosis
agcaugcguccggucug

SEQ ID NO: 2873967 - RNA, 16 nt, Mycobacterium avium subsp. paratuberculosis
agcauggucucgcuga

SEQ ID NO: 2873968 - RNA, 17 nt, Mycobacterium avium subsp. paratuberculosis
agcauguccucggggug

SEQ ID NO: 2873969 - RNA, 18 nt, Mycobacterium avium subsp. paratuberculosis
agcaugucgcccgcgucg

SEQ ID NO: 2873970 - RNA, 21 nt, Mycobacterium avium subsp. paratuberculosis
agcauucgccggggucgcgcg

SEQ ID NO: 2873971 - RNA, 17 nt, Mycobacterium avium subsp. paratuberculosis
agcauuggaaaguccuu

SEQ ID NO: 2873972 - RNA, 15 nt, Mycobacterium avium subsp. paratuberculosis
agcauuucgcgcacg

SEQ ID NO: 2873973 - RNA, 13 nt, Mycobacterium avium subsp. paratuberculosis
agcauuucgcgcg

SEQ ID NO: 2873974 - RNA, 16 nt, Mycobacterium avium subsp. paratuberculosis
agcauuucgcgcggca

SEQ ID NO: 2873975 - RNA, 19 nt, Mycobacterium avium subsp. paratuberculosis
agccaaagccuacggcgcc

SEQ ID NO: 2873976 - RNA, 20 nt, Mycobacterium avium subsp. paratuberculosis
agccaaagccuacggcgccg

SEQ ID NO: 2873977 - RNA, 23 nt, Mycobacterium avium subsp. paratuberculosis
agccaaucgccgaugaccacccu

SEQ ID NO: 2873978 - RNA, 15 nt, Mycobacterium avium subsp. paratuberculosis
agccacaccgccgcg

SEQ ID NO: 2873979 - RNA, 14 nt, Mycobacterium avium subsp. paratuberculosis
agccacaccgccgg

SEQ ID NO: 2873980 - RNA, 15 nt, Mycobacterium avium subsp. paratuberculosis
agccacaccgccggc

SEQ ID NO: 2873981 - RNA, 16 nt, Mycobacterium avium subsp. paratuberculosis
agccacaccgccggcg

SEQ ID NO: 2873982 - RNA, 16 nt, Mycobacterium avium subsp. paratuberculosis
agccacagcucgggca

SEQ ID NO: 2873983 - RNA, 22 nt, Mycobacterium avium subsp. paratuberculosis
agccacauguucuccucgucgc

SEQ ID NO: 2873984 - RNA, 11 nt, Mycobacterium avium subsp. paratuberculosis
agccaccacau

SEQ ID NO: 2873985 - RNA, 16 nt, Mycobacterium avium subsp. paratuberculosis
agccaccacugcgccg

SEQ ID NO: 2873986 - RNA, 14 nt, Mycobacterium avium subsp. paratuberculosis
agccacccgcgccu

SEQ ID NO: 2873987 - RNA, 12 nt, Mycobacterium avium subsp. paratuberculosis
agccacccgucg

SEQ ID NO: 2873988 - RNA, 19 nt, Mycobacterium avium subsp. paratuberculosis
agccacgacaccagcgucg

SEQ ID NO: 2873989 - RNA, 22 nt, Mycobacterium avium subsp. paratuberculosis
agccacgacaccagcgucgcga

SEQ ID NO: 2873990 - RNA, 15 nt, Mycobacterium avium subsp. paratuberculosis
agccacgagcccagc

SEQ ID NO: 2873991 - RNA, 17 nt, Mycobacterium avium subsp. paratuberculosis
agccacgagcccagccg

SEQ ID NO: 2873992 - RNA, 18 nt, Mycobacterium avium subsp. paratuberculosis
agccacgagcccagccgu

SEQ ID NO: 2873993 - RNA, 20 nt, Mycobacterium avium subsp. paratuberculosis
agccacgagcccagccgucg

SEQ ID NO: 2873994 - RNA, 13 nt, Mycobacterium avium subsp. paratuberculosis
agccacgccgaca

SEQ ID NO: 2873995 - RNA, 14 nt, Mycobacterium avium subsp. paratuberculosis
agccacgccggcac

SEQ ID NO: 2873996 - RNA, 13 nt, Mycobacterium avium subsp. paratuberculosis
agccacuccacca

SEQ ID NO: 2873997 - RNA, 22 nt, Mycobacterium avium subsp. paratuberculosis
agccacuccaccaccggccgcg

SEQ ID NO: 2873998 - RNA, 19 nt, Mycobacterium avium subsp. paratuberculosis
agccacuccaggguucucg

SEQ ID NO: 2873999 - RNA, 20 nt, Mycobacterium avium subsp. paratuberculosis
agccacucgccgugagaagu

SEQ ID NO: 2874000 - RNA, 21 nt, Mycobacterium avium subsp. paratuberculosis
agccagaacacgccccggcgg

SEQ ID NO: 2874001 - RNA, 14 nt, Mycobacterium avium subsp. paratuberculosis
agccagaccucgcc

SEQ ID NO: 2874002 - RNA, 17 nt, Mycobacterium avium subsp. paratuberculosis
agccagaccucgccgac

SEQ ID NO: 2874003 - RNA, 13 nt, Mycobacterium avium subsp. paratuberculosis
agccagcaccgcc

SEQ ID NO: 2874004 - RNA, 14 nt, Mycobacterium avium subsp. paratuberculosis
agccagcaccgccc

SEQ ID NO: 2874005 - RNA, 15 nt, Mycobacterium avium subsp. paratuberculosis
agccagcaccgcccc

SEQ ID NO: 2874006 - RNA, 20 nt, Mycobacterium avium subsp. paratuberculosis
agccagcaccgccccgguca

SEQ ID NO: 2874007 - RNA, 14 nt, Mycobacterium avium subsp. paratuberculosis
agccagcccagccg

SEQ ID NO: 2874008 - RNA, 16 nt, Mycobacterium avium subsp. paratuberculosis
agccagcccagccgcc

SEQ ID NO: 2874009 - RNA, 15 nt, Mycobacterium avium subsp. paratuberculosis
agccagcccgcgcaa

SEQ ID NO: 2874010 - RNA, 20 nt, Mycobacterium avium subsp. paratuberculosis
agccagcccguggccagcgc

SEQ ID NO: 2874011 - RNA, 15 nt, Mycobacterium avium subsp. paratuberculosis
agccagccgcccagc

SEQ ID NO: 2874012 - RNA, 16 nt, Mycobacterium avium subsp. paratuberculosis
agccagccgcccagca

SEQ ID NO: 2874013 - RNA, 14 nt, Mycobacterium avium subsp. paratuberculosis
agccagccgcgccg

SEQ ID NO: 2874014 - RNA, 15 nt, Mycobacterium avium subsp. paratuberculosis
agccagccgcgccgc

SEQ ID NO: 2874015 - RNA, 16 nt, Mycobacterium avium subsp. paratuberculosis
agccagccgcgccgcg

SEQ ID NO: 2874016 - RNA, 20 nt, Mycobacterium avium subsp. paratuberculosis
agccagccggugcggucggc

SEQ ID NO: 2874017 - RNA, 14 nt, Mycobacterium avium subsp. paratuberculosis
agccagccgguggc

SEQ ID NO: 2874018 - RNA, 15 nt, Mycobacterium avium subsp. paratuberculosis
agccagccgguggcg

SEQ ID NO: 2874019 - RNA, 18 nt, Mycobacterium avium subsp. paratuberculosis
agccagccuggcggcgac

SEQ ID NO: 2874020 - RNA, 14 nt, Mycobacterium avium subsp. paratuberculosis
agccagcgcccggc

SEQ ID NO: 2874021 - RNA, 17 nt, Mycobacterium avium subsp. paratuberculosis
agccagcgggccgagcg

SEQ ID NO: 2874022 - RNA, 21 nt, Mycobacterium avium subsp. paratuberculosis
agccagcugcgcgucggccgc

SEQ ID NO: 2874023 - RNA, 12 nt, Mycobacterium avium subsp. paratuberculosis
agccaggacagc

SEQ ID NO: 2874024 - RNA, 16 nt, Mycobacterium avium subsp. paratuberculosis
agccagguccgggcac

SEQ ID NO: 2874025 - RNA, 13 nt, Mycobacterium avium subsp. paratuberculosis
agccaggugguga

SEQ ID NO: 2874026 - RNA, 18 nt, Mycobacterium avium subsp. paratuberculosis
agccagguguaggcggcc

SEQ ID NO: 2874027 - RNA, 23 nt, Mycobacterium avium subsp. paratuberculosis
agccagguguuguccgguaggcc

SEQ ID NO: 2874028 - RNA, 15 nt, Mycobacterium avium subsp. paratuberculosis
agccagucgccggcc

SEQ ID NO: 2874029 - RNA, 17 nt, Mycobacterium avium subsp. paratuberculosis
agccagucgccggccag

SEQ ID NO: 2874030 - RNA, 14 nt, Mycobacterium avium subsp. paratuberculosis
agccaguucgccag

SEQ ID NO: 2874031 - RNA, 15 nt, Mycobacterium avium subsp. paratuberculosis
agccaguucgccagc

SEQ ID NO: 2874032 - RNA, 16 nt, Mycobacterium avium subsp. paratuberculosis
agccaguucgccagca

SEQ ID NO: 2874033 - RNA, 17 nt, Mycobacterium avium subsp. paratuberculosis
agccaguugaucagccc

SEQ ID NO: 2874034 - RNA, 21 nt, Mycobacterium avium subsp. paratuberculosis
agccaguugggggccagcgcc

SEQ ID NO: 2874035 - RNA, 15 nt, Mycobacterium avium subsp. paratuberculosis
agccauaaaccggcc

SEQ ID NO: 2874036 - RNA, 16 nt, Mycobacterium avium subsp. paratuberculosis
agccauaaaccggccg

SEQ ID NO: 2874037 - RNA, 18 nt, Mycobacterium avium subsp. paratuberculosis
agccauaaaccggccggc

SEQ ID NO: 2874038 - RNA, 21 nt, Mycobacterium avium subsp. paratuberculosis
agccauaaaccggccggcgcg

SEQ ID NO: 2874039 - RNA, 18 nt, Mycobacterium avium subsp. paratuberculosis
agccauacugacgccggu

SEQ ID NO: 2874040 - RNA, 17 nt, Mycobacterium avium subsp. paratuberculosis
agccaucagaacgcccg

SEQ ID NO: 2874041 - RNA, 18 nt, Mycobacterium avium subsp. paratuberculosis
agccaucagaacgcccgc

SEQ ID NO: 2874042 - RNA, 19 nt, Mycobacterium avium subsp. paratuberculosis
agccaucagaacgcccgca

SEQ ID NO: 2874043 - RNA, 12 nt, Mycobacterium avium subsp. paratuberculosis
agccaucugcug

SEQ ID NO: 2874044 - RNA, 17 nt, Mycobacterium avium subsp. paratuberculosis
agccaucugcugacuuu

SEQ ID NO: 2874045 - RNA, 12 nt, Mycobacterium avium subsp. paratuberculosis
agccaugccggg

SEQ ID NO: 2874046 - RNA, 20 nt, Mycobacterium avium subsp. paratuberculosis
agccaugccgggggaggcgu

SEQ ID NO: 2874047 - RNA, 15 nt, Mycobacterium avium subsp. paratuberculosis
agccauggcggcccg

SEQ ID NO: 2874048 - RNA, 16 nt, Mycobacterium avium subsp. paratuberculosis
agccauggcggcccgc

SEQ ID NO: 2874049 - RNA, 18 nt, Mycobacterium avium subsp. paratuberculosis
agccauggcggcccgcgc

SEQ ID NO: 2874050 - RNA, 19 nt, Mycobacterium avium subsp. paratuberculosis
agccauggcggcccgcgcc

SEQ ID NO: 2874051 - RNA, 22 nt, Mycobacterium avium subsp. paratuberculosis
agccauggcggcccgcgccggc

SEQ ID NO: 2874052 - RNA, 23 nt, Mycobacterium avium subsp. paratuberculosis
agccauggcggcccgcgccggcg

SEQ ID NO: 2874053 - RNA, 24 nt, Mycobacterium avium subsp. paratuberculosis
agccauggcggcccgcgccggcgu

SEQ ID NO: 2874054 - RNA, 12 nt, Mycobacterium avium subsp. paratuberculosis
agccauucgucg

SEQ ID NO: 2874055 - RNA, 16 nt, Mycobacterium avium subsp. paratuberculosis
agccauuucagcagcg

SEQ ID NO: 2874056 - RNA, 17 nt, Mycobacterium avium subsp. paratuberculosis
agccauuucagcagcgc

SEQ ID NO: 2874057 - RNA, 18 nt, Mycobacterium avium subsp. paratuberculosis
agccauuucagcagcgcg

SEQ ID NO: 2874058 - RNA, 19 nt, Mycobacterium avium subsp. paratuberculosis
agccauuucagcagcgcgg

SEQ ID NO: 2874059 - RNA, 19 nt, Mycobacterium avium subsp. paratuberculosis
agcccaagugcccgcgggu

SEQ ID NO: 2874060 - RNA, 20 nt, Mycobacterium avium subsp. paratuberculosis
agcccaagugcccgcgggug

SEQ ID NO: 2874061 - RNA, 13 nt, Mycobacterium avium subsp. paratuberculosis
agcccaccgccgu

SEQ ID NO: 2874062 - RNA, 18 nt, Mycobacterium avium subsp. paratuberculosis
agcccaccgcgcccagcc

SEQ ID NO: 2874063 - RNA, 19 nt, Mycobacterium avium subsp. paratuberculosis
agcccaccgcgcccagccc

SEQ ID NO: 2874064 - RNA, 20 nt, Mycobacterium avium subsp. paratuberculosis
agcccaccgcgcccagcccc

SEQ ID NO: 2874065 - RNA, 16 nt, Mycobacterium avium subsp. paratuberculosis
agcccaccucgagcac

SEQ ID NO: 2874066 - RNA, 13 nt, Mycobacterium avium subsp. paratuberculosis
agcccagccagcc

SEQ ID NO: 2874067 - RNA, 17 nt, Mycobacterium avium subsp. paratuberculosis
agcccagccagccggug

SEQ ID NO: 2874068 - RNA, 15 nt, Mycobacterium avium subsp. paratuberculosis
agcccagccagcgac

SEQ ID NO: 2874069 - RNA, 14 nt, Mycobacterium avium subsp. paratuberculosis
agcccagccgccag

SEQ ID NO: 2874070 - RNA, 16 nt, Mycobacterium avium subsp. paratuberculosis
agcccagcgcguugcg

SEQ ID NO: 2874071 - RNA, 15 nt, Mycobacterium avium subsp. paratuberculosis
agcccagcuuggcgc

SEQ ID NO: 2874072 - RNA, 16 nt, Mycobacterium avium subsp. paratuberculosis
agcccagcuuggcgcc

SEQ ID NO: 2874073 - RNA, 18 nt, Mycobacterium avium subsp. paratuberculosis
agcccagcuuggcgcccu

SEQ ID NO: 2874074 - RNA, 19 nt, Mycobacterium avium subsp. paratuberculosis
agcccaggcccagcagcac

SEQ ID NO: 2874075 - RNA, 15 nt, Mycobacterium avium subsp. paratuberculosis
agcccaggcccggca

SEQ ID NO: 2874076 - RNA, 12 nt, Mycobacterium avium subsp. paratuberculosis
agcccagguaau

SEQ ID NO: 2874077 - RNA, 23 nt, Mycobacterium avium subsp. paratuberculosis
agcccaucccgauccgcgccgcc

SEQ ID NO: 2874078 - RNA, 16 nt, Mycobacterium avium subsp. paratuberculosis
agcccaugccgaugcc

SEQ ID NO: 2874079 - RNA, 20 nt, Mycobacterium avium subsp. paratuberculosis
agcccauguaguucgacugg

SEQ ID NO: 2874080 - RNA, 15 nt, Mycobacterium avium subsp. paratuberculosis
agcccaugucgccgg

SEQ ID NO: 2874081 - RNA, 17 nt, Mycobacterium avium subsp. paratuberculosis
agcccaugucgccggug

SEQ ID NO: 2874082 - RNA, 23 nt, Mycobacterium avium subsp. paratuberculosis
agcccaugucgccggugcugguc

SEQ ID NO: 2874083 - RNA, 14 nt, Mycobacterium avium subsp. paratuberculosis
agccccaccaccgc

SEQ ID NO: 2874084 - RNA, 17 nt, Mycobacterium avium subsp. paratuberculosis
agccccaccaccgccac

SEQ ID NO: 2874085 - RNA, 18 nt, Mycobacterium avium subsp. paratuberculosis
agccccaccaccgccacc

SEQ ID NO: 2874086 - RNA, 22 nt, Mycobacterium avium subsp. paratuberculosis
agccccaccaccgccaccagcg

SEQ ID NO: 2874087 - RNA, 15 nt, Mycobacterium avium subsp. paratuberculosis
agccccaccggccac

SEQ ID NO: 2874088 - RNA, 16 nt, Mycobacterium avium subsp. paratuberculosis
agccccaccggccacu

SEQ ID NO: 2874089 - RNA, 12 nt, Mycobacterium avium subsp. paratuberculosis
agccccagcgga

SEQ ID NO: 2874090 - RNA, 21 nt, Mycobacterium avium subsp. paratuberculosis
agccccagggugcgccgcucg

SEQ ID NO: 2874091 - RNA, 14 nt, Mycobacterium avium subsp. paratuberculosis
agcccccaauguca

SEQ ID NO: 2874092 - RNA, 14 nt, Mycobacterium avium subsp. paratuberculosis
agcccccaccgcgc

SEQ ID NO: 2874093 - RNA, 15 nt, Mycobacterium avium subsp. paratuberculosis
agcccccaccgcgcc

SEQ ID NO: 2874094 - RNA, 22 nt, Mycobacterium avium subsp. paratuberculosis
agcccccaccugaucgcggcga

SEQ ID NO: 2874095 - RNA, 18 nt, Mycobacterium avium subsp. paratuberculosis
agcccccacgcucggcgc

SEQ ID NO: 2874096 - RNA, 12 nt, Mycobacterium avium subsp. paratuberculosis
agcccccagcuc

SEQ ID NO: 2874097 - RNA, 13 nt, Mycobacterium avium subsp. paratuberculosis
agcccccgcagcc

SEQ ID NO: 2874098 - RNA, 14 nt, Mycobacterium avium subsp. paratuberculosis
agcccccgcagccc

SEQ ID NO: 2874099 - RNA, 21 nt, Mycobacterium avium subsp. paratuberculosis
agcccccgcgggucgucgacg

SEQ ID NO: 2874100 - RNA, 22 nt, Mycobacterium avium subsp. paratuberculosis
agcccccgcgggucgucgacgu

SEQ ID NO: 2874101 - RNA, 12 nt, Mycobacterium avium subsp. paratuberculosis
agcccccggacc

SEQ ID NO: 2874102 - RNA, 16 nt, Mycobacterium avium subsp. paratuberculosis
agccccgagccgcgga

SEQ ID NO: 2874103 - RNA, 14 nt, Mycobacterium avium subsp. paratuberculosis
agccccgccaggcg

SEQ ID NO: 2874104 - RNA, 15 nt, Mycobacterium avium subsp. paratuberculosis
agccccggaccggag

SEQ ID NO: 2874105 - RNA, 18 nt, Mycobacterium avium subsp. paratuberculosis
agccccgggaaccagccc

SEQ ID NO: 2874106 - RNA, 19 nt, Mycobacterium avium subsp. paratuberculosis
agccccgggaaccagccca

SEQ ID NO: 2874107 - RNA, 23 nt, Mycobacterium avium subsp. paratuberculosis
agccccgggaaccagcccagguc

SEQ ID NO: 2874108 - RNA, 20 nt, Mycobacterium avium subsp. paratuberculosis
agccccgguuccaaccaccg

SEQ ID NO: 2874109 - RNA, 17 nt, Mycobacterium avium subsp. paratuberculosis
agccccgucggucccga

SEQ ID NO: 2874110 - RNA, 18 nt, Mycobacterium avium subsp. paratuberculosis
agccccucccaccacggc

SEQ ID NO: 2874111 - RNA, 14 nt, Mycobacterium avium subsp. paratuberculosis
agccccucgaccac

SEQ ID NO: 2874112 - RNA, 20 nt, Mycobacterium avium subsp. paratuberculosis
agccccucgaccaccucuuc

SEQ ID NO: 2874113 - RNA, 16 nt, Mycobacterium avium subsp. paratuberculosis
agccccucgccgggcg

SEQ ID NO: 2874114 - RNA, 11 nt, Mycobacterium avium subsp. paratuberculosis
agccccucggg

SEQ ID NO: 2874115 - RNA, 23 nt, Mycobacterium avium subsp. paratuberculosis
agccccucguccaggugcacccg

SEQ ID NO: 2874116 - RNA, 13 nt, Mycobacterium avium subsp. paratuberculosis
agccccugcacca

SEQ ID NO: 2874117 - RNA, 15 nt, Mycobacterium avium subsp. paratuberculosis
agccccugcaccacg

SEQ ID NO: 2874118 - RNA, 22 nt, Mycobacterium avium subsp. paratuberculosis
agcccgaaacgucgcagcccgg

SEQ ID NO: 2874119 - RNA, 19 nt, Mycobacterium avium subsp. paratuberculosis
agcccgaaaguccccgggu

SEQ ID NO: 2874120 - RNA, 20 nt, Mycobacterium avium subsp. paratuberculosis
agcccgaacagccgggccag

SEQ ID NO: 2874121 - RNA, 13 nt, Mycobacterium avium subsp. paratuberculosis
agcccgaacagcu

SEQ ID NO: 2874122 - RNA, 17 nt, Mycobacterium avium subsp. paratuberculosis
agcccgaacagcuugcc

SEQ ID NO: 2874123 - RNA, 20 nt, Mycobacterium avium subsp. paratuberculosis
agcccgacaucugccgggcg

SEQ ID NO: 2874124 - RNA, 22 nt, Mycobacterium avium subsp. paratuberculosis
agcccgacaucugccgggcggc

SEQ ID NO: 2874125 - RNA, 23 nt, Mycobacterium avium subsp. paratuberculosis
agcccgacaucugccgggcggcg

SEQ ID NO: 2874126 - RNA, 19 nt, Mycobacterium avium subsp. paratuberculosis
agcccgaccaccuccccgc

SEQ ID NO: 2874127 - RNA, 22 nt, Mycobacterium avium subsp. paratuberculosis
agcccgaccgucgucccgguga

SEQ ID NO: 2874128 - RNA, 17 nt, Mycobacterium avium subsp. paratuberculosis
agcccgaccuucugcug

SEQ ID NO: 2874129 - RNA, 20 nt, Mycobacterium avium subsp. paratuberculosis
agcccgacgggcgugccggc

SEQ ID NO: 2874130 - RNA, 15 nt, Mycobacterium avium subsp. paratuberculosis
agcccgagcggcauc

SEQ ID NO: 2874131 - RNA, 21 nt, Mycobacterium avium subsp. paratuberculosis
agcccgagcggcaucaguucg

SEQ ID NO: 2874132 - RNA, 14 nt, Mycobacterium avium subsp. paratuberculosis
agcccgagcgucac

SEQ ID NO: 2874133 - RNA, 22 nt, Mycobacterium avium subsp. paratuberculosis
agcccgagcgucacgccagcgu

SEQ ID NO: 2874134 - RNA, 16 nt, Mycobacterium avium subsp. paratuberculosis
agcccgaucacccccg

SEQ ID NO: 2874135 - RNA, 17 nt, Mycobacterium avium subsp. paratuberculosis
agcccgaucacccccga

SEQ ID NO: 2874136 - RNA, 15 nt, Mycobacterium avium subsp. paratuberculosis
agcccgaucgccagc

SEQ ID NO: 2874137 - RNA, 18 nt, Mycobacterium avium subsp. paratuberculosis
agcccgaucucgcggucg

SEQ ID NO: 2874138 - RNA, 19 nt, Mycobacterium avium subsp. paratuberculosis
agcccgaucucgcggucga

SEQ ID NO: 2874139 - RNA, 16 nt, Mycobacterium avium subsp. paratuberculosis
agcccgaugccgccga

SEQ ID NO: 2874140 - RNA, 15 nt, Mycobacterium avium subsp. paratuberculosis
agcccgauucagccg

SEQ ID NO: 2874141 - RNA, 18 nt, Mycobacterium avium subsp. paratuberculosis
agcccgauucagccggcg

SEQ ID NO: 2874142 - RNA, 19 nt, Mycobacterium avium subsp. paratuberculosis
agcccgcaaaucagccgag

SEQ ID NO: 2874143 - RNA, 11 nt, Mycobacterium avium subsp. paratuberculosis
agcccgcagcg

SEQ ID NO: 2874144 - RNA, 23 nt, Mycobacterium avium subsp. paratuberculosis
agcccgcauuccgucuuggccag

SEQ ID NO: 2874145 - RNA, 15 nt, Mycobacterium avium subsp. paratuberculosis
agcccgcccaccacg

SEQ ID NO: 2874146 - RNA, 16 nt, Mycobacterium avium subsp. paratuberculosis
agcccgcccaccacga

SEQ ID NO: 2874147 - RNA, 15 nt, Mycobacterium avium subsp. paratuberculosis
agcccgcccagcgcc

SEQ ID NO: 2874148 - RNA, 16 nt, Mycobacterium avium subsp. paratuberculosis
agcccgcccagcgcca

SEQ ID NO: 2874149 - RNA, 21 nt, Mycobacterium avium subsp. paratuberculosis
agcccgcccuuggccgcggag

SEQ ID NO: 2874150 - RNA, 22 nt, Mycobacterium avium subsp. paratuberculosis
agcccgccgauggacacgcugc

SEQ ID NO: 2874151 - RNA, 13 nt, Mycobacterium avium subsp. paratuberculosis
agcccgccgcgga

SEQ ID NO: 2874152 - RNA, 15 nt, Mycobacterium avium subsp. paratuberculosis
agcccgccgcggcga

SEQ ID NO: 2874153 - RNA, 17 nt, Mycobacterium avium subsp. paratuberculosis
agcccgccgcggcgacc

SEQ ID NO: 2874154 - RNA, 23 nt, Mycobacterium avium subsp. paratuberculosis
agcccgccgcggcgaccggggcg

SEQ ID NO: 2874155 - RNA, 17 nt, Mycobacterium avium subsp. paratuberculosis
agcccgccggcggcgau

SEQ ID NO: 2874156 - RNA, 19 nt, Mycobacterium avium subsp. paratuberculosis
agcccgccggcggcgauga

SEQ ID NO: 2874157 - RNA, 13 nt, Mycobacterium avium subsp. paratuberculosis
agcccgccgggau

SEQ ID NO: 2874158 - RNA, 13 nt, Mycobacterium avium subsp. paratuberculosis
agcccgccgggcu

SEQ ID NO: 2874159 - RNA, 18 nt, Mycobacterium avium subsp. paratuberculosis
agcccgccucagugucgu

SEQ ID NO: 2874160 - RNA, 19 nt, Mycobacterium avium subsp. paratuberculosis
agcccgcgcaauacccgac

SEQ ID NO: 2874161 - RNA, 22 nt, Mycobacterium avium subsp. paratuberculosis
agcccgcgcaauacccgaccag

SEQ ID NO: 2874162 - RNA, 18 nt, Mycobacterium avium subsp. paratuberculosis
agcccgcgccagcucggc

SEQ ID NO: 2874163 - RNA, 12 nt, Mycobacterium avium subsp. paratuberculosis
agcccgcgccca

SEQ ID NO: 2874164 - RNA, 13 nt, Mycobacterium avium subsp. paratuberculosis
agcccgcgccgag

SEQ ID NO: 2874165 - RNA, 21 nt, Mycobacterium avium subsp. paratuberculosis
agcccgcgccgagcaaccggg

SEQ ID NO: 2874166 - RNA, 21 nt, Mycobacterium avium subsp. paratuberculosis
agcccgcgcgagcgcagcgcc

SEQ ID NO: 2874167 - RNA, 16 nt, Mycobacterium avium subsp. paratuberculosis
agcccgcggaucgcgu

SEQ ID NO: 2874168 - RNA, 14 nt, Mycobacterium avium subsp. paratuberculosis
agcccgcggcagcc

SEQ ID NO: 2874169 - RNA, 18 nt, Mycobacterium avium subsp. paratuberculosis
agcccgcggcagccagcc

SEQ ID NO: 2874170 - RNA, 17 nt, Mycobacterium avium subsp. paratuberculosis
agcccgcguccagcagc

SEQ ID NO: 2874171 - RNA, 18 nt, Mycobacterium avium subsp. paratuberculosis
agcccgcguccagcagca

SEQ ID NO: 2874172 - RNA, 21 nt, Mycobacterium avium subsp. paratuberculosis
agcccgcgucguguccgggcc

SEQ ID NO: 2874173 - RNA, 16 nt, Mycobacterium avium subsp. paratuberculosis
agcccgcugaccaggc

SEQ ID NO: 2874174 - RNA, 17 nt, Mycobacterium avium subsp. paratuberculosis
agcccgcugaccaggcc

SEQ ID NO: 2874175 - RNA, 23 nt, Mycobacterium avium subsp. paratuberculosis
agcccggaaaaccccaccccgag

SEQ ID NO: 2874176 - RNA, 19 nt, Mycobacterium avium subsp. paratuberculosis
agcccggaaucgucggcca

SEQ ID NO: 2874177 - RNA, 21 nt, Mycobacterium avium subsp. paratuberculosis
agcccggaaucgucggccacg

SEQ ID NO: 2874178 - RNA, 15 nt, Mycobacterium avium subsp. paratuberculosis
agcccggaccggccg

SEQ ID NO: 2874179 - RNA, 17 nt, Mycobacterium avium subsp. paratuberculosis
agcccggaguagccggu

SEQ ID NO: 2874180 - RNA, 16 nt, Mycobacterium avium subsp. paratuberculosis
agcccggcagcggggc

SEQ ID NO: 2874181 - RNA, 13 nt, Mycobacterium avium subsp. paratuberculosis
agcccggccagca

SEQ ID NO: 2874182 - RNA, 15 nt, Mycobacterium avium subsp. paratuberculosis
agcccggccagcacc

SEQ ID NO: 2874183 - RNA, 15 nt, Mycobacterium avium subsp. paratuberculosis
agcccggccagcggc

SEQ ID NO: 2874184 - RNA, 15 nt, Mycobacterium avium subsp. paratuberculosis
agcccggcccagccg

SEQ ID NO: 2874185 - RNA, 17 nt, Mycobacterium avium subsp. paratuberculosis
agcccggcccagccggu

SEQ ID NO: 2874186 - RNA, 13 nt, Mycobacterium avium subsp. paratuberculosis
agcccggcccgca

SEQ ID NO: 2874187 - RNA, 17 nt, Mycobacterium avium subsp. paratuberculosis
agcccggcccgcaucga

SEQ ID NO: 2874188 - RNA, 14 nt, Mycobacterium avium subsp. paratuberculosis
agcccggcccgucg

SEQ ID NO: 2874189 - RNA, 16 nt, Mycobacterium avium subsp. paratuberculosis
agcccggcccgucgag

SEQ ID NO: 2874190 - RNA, 17 nt, Mycobacterium avium subsp. paratuberculosis
agcccggccgccgagga

SEQ ID NO: 2874191 - RNA, 14 nt, Mycobacterium avium subsp. paratuberculosis
agcccggccgcggc

SEQ ID NO: 2874192 - RNA, 17 nt, Mycobacterium avium subsp. paratuberculosis
agcccggccgcggccca

SEQ ID NO: 2874193 - RNA, 13 nt, Mycobacterium avium subsp. paratuberculosis
agcccggcgacga

SEQ ID NO: 2874194 - RNA, 15 nt, Mycobacterium avium subsp. paratuberculosis
agcccggcgacgucg

SEQ ID NO: 2874195 - RNA, 22 nt, Mycobacterium avium subsp. paratuberculosis
agcccggcgcucaccgcgauga

SEQ ID NO: 2874196 - RNA, 23 nt, Mycobacterium avium subsp. paratuberculosis
agcccggcgcugcgcccggucag

SEQ ID NO: 2874197 - RNA, 22 nt, Mycobacterium avium subsp. paratuberculosis
agcccggcguccugcagcagcc

SEQ ID NO: 2874198 - RNA, 19 nt, Mycobacterium avium subsp. paratuberculosis
agcccggcuaauucgggcc

SEQ ID NO: 2874199 - RNA, 14 nt, Mycobacterium avium subsp. paratuberculosis
agcccggcuggcag

SEQ ID NO: 2874200 - RNA, 18 nt, Mycobacterium avium subsp. paratuberculosis
agcccggcuggcaggucg

SEQ ID NO: 2874201 - RNA, 17 nt, Mycobacterium avium subsp. paratuberculosis
agcccgggcaggcggcg

SEQ ID NO: 2874202 - RNA, 18 nt, Mycobacterium avium subsp. paratuberculosis
agcccgggcaggcggcgc

SEQ ID NO: 2874203 - RNA, 19 nt, Mycobacterium avium subsp. paratuberculosis
agcccgggcaggcggcgcg

SEQ ID NO: 2874204 - RNA, 22 nt, Mycobacterium avium subsp. paratuberculosis
agcccggguccuggcccccgcc

SEQ ID NO: 2874205 - RNA, 12 nt, Mycobacterium avium subsp. paratuberculosis
agcccggucagu

SEQ ID NO: 2874206 - RNA, 18 nt, Mycobacterium avium subsp. paratuberculosis
agcccggucaguucgucg

SEQ ID NO: 2874207 - RNA, 23 nt, Mycobacterium avium subsp. paratuberculosis
agcccgguuuccaguccggcgcc

SEQ ID NO: 2874208 - RNA, 12 nt, Mycobacterium avium subsp. paratuberculosis
agcccgucgacg

SEQ ID NO: 2874209 - RNA, 19 nt, Mycobacterium avium subsp. paratuberculosis
agcccgucgacgggccacc

SEQ ID NO: 2874210 - RNA, 20 nt, Mycobacterium avium subsp. paratuberculosis
agcccgucgacgggccacca

SEQ ID NO: 2874211 - RNA, 23 nt, Mycobacterium avium subsp. paratuberculosis
agcccgucgacgggccaccagcg

SEQ ID NO: 2874212 - RNA, 13 nt, Mycobacterium avium subsp. paratuberculosis
agcccgucgacgu

SEQ ID NO: 2874213 - RNA, 13 nt, Mycobacterium avium subsp. paratuberculosis
agcccgucggccu

SEQ ID NO: 2874214 - RNA, 22 nt, Mycobacterium avium subsp. paratuberculosis
agcccgugcggcggggccucga

SEQ ID NO: 2874215 - RNA, 13 nt, Mycobacterium avium subsp. paratuberculosis
agcccguggccag

SEQ ID NO: 2874216 - RNA, 18 nt, Mycobacterium avium subsp. paratuberculosis
agcccguggccagcgcca

SEQ ID NO: 2874217 - RNA, 17 nt, Mycobacterium avium subsp. paratuberculosis
agcccguucagugacca

SEQ ID NO: 2874218 - RNA, 20 nt, Mycobacterium avium subsp. paratuberculosis
agcccguucagugaccagug

SEQ ID NO: 2874219 - RNA, 20 nt, Mycobacterium avium subsp. paratuberculosis
agcccguugcugcguucggc

SEQ ID NO: 2874220 - RNA, 16 nt, Mycobacterium avium subsp. paratuberculosis
agcccguugucgagca

SEQ ID NO: 2874221 - RNA, 23 nt, Mycobacterium avium subsp. paratuberculosis
agcccguugucgagcaccgcgau

SEQ ID NO: 2874222 - RNA, 14 nt, Mycobacterium avium subsp. paratuberculosis
agcccuaccggcuc

SEQ ID NO: 2874223 - RNA, 15 nt, Mycobacterium avium subsp. paratuberculosis
agcccuaccggcucg

SEQ ID NO: 2874224 - RNA, 21 nt, Mycobacterium avium subsp. paratuberculosis
agcccucccggaacagcuugg

SEQ ID NO: 2874225 - RNA, 15 nt, Mycobacterium avium subsp. paratuberculosis
agcccucgucgauga

SEQ ID NO: 2874226 - RNA, 20 nt, Mycobacterium avium subsp. paratuberculosis
agcccucgugcguagcggcc

SEQ ID NO: 2874227 - RNA, 15 nt, Mycobacterium avium subsp. paratuberculosis
agcccucuucgauca

SEQ ID NO: 2874228 - RNA, 13 nt, Mycobacterium avium subsp. paratuberculosis
agcccugcaggua

SEQ ID NO: 2874229 - RNA, 17 nt, Mycobacterium avium subsp. paratuberculosis
agcccugcagguaggug

SEQ ID NO: 2874230 - RNA, 20 nt, Mycobacterium avium subsp. paratuberculosis
agcccugcagguagguggcc

SEQ ID NO: 2874231 - RNA, 18 nt, Mycobacterium avium subsp. paratuberculosis
agcccugcgccagcagca

SEQ ID NO: 2874232 - RNA, 16 nt, Mycobacterium avium subsp. paratuberculosis
agcccugcucggccag

SEQ ID NO: 2874233 - RNA, 16 nt, Mycobacterium avium subsp. paratuberculosis
agcccugcuugaccgc

SEQ ID NO: 2874234 - RNA, 22 nt, Mycobacterium avium subsp. paratuberculosis
agcccuuggacucccccaccac

SEQ ID NO: 2874235 - RNA, 21 nt, Mycobacterium avium subsp. paratuberculosis
agcccuuggcgaagcguuuca

SEQ ID NO: 2874236 - RNA, 19 nt, Mycobacterium avium subsp. paratuberculosis
agcccuuugcgcugcccga

SEQ ID NO: 2874237 - RNA, 15 nt, Mycobacterium avium subsp. paratuberculosis
agccgaaacggugcc

SEQ ID NO: 2874238 - RNA, 17 nt, Mycobacterium avium subsp. paratuberculosis
agccgaacgacagcagg

SEQ ID NO: 2874239 - RNA, 17 nt, Mycobacterium avium subsp. paratuberculosis
agccgaagccgccgucc

SEQ ID NO: 2874240 - RNA, 16 nt, Mycobacterium avium subsp. paratuberculosis
agccgaaguauccggu

SEQ ID NO: 2874241 - RNA, 15 nt, Mycobacterium avium subsp. paratuberculosis
agccgacaccggguc

SEQ ID NO: 2874242 - RNA, 21 nt, Mycobacterium avium subsp. paratuberculosis
agccgacaccgggucccccgc

SEQ ID NO: 2874243 - RNA, 12 nt, Mycobacterium avium subsp. paratuberculosis
agccgaccagcg

SEQ ID NO: 2874244 - RNA, 15 nt, Mycobacterium avium subsp. paratuberculosis
agccgaccagcgcga

SEQ ID NO: 2874245 - RNA, 19 nt, Mycobacterium avium subsp. paratuberculosis
agccgaccgacccggccag

SEQ ID NO: 2874246 - RNA, 18 nt, Mycobacterium avium subsp. paratuberculosis
agccgaccgaucagcgga

SEQ ID NO: 2874247 - RNA, 14 nt, Mycobacterium avium subsp. paratuberculosis
agccgaccgccccg

SEQ ID NO: 2874248 - RNA, 15 nt, Mycobacterium avium subsp. paratuberculosis
agccgaccgccccgc

SEQ ID NO: 2874249 - RNA, 16 nt, Mycobacterium avium subsp. paratuberculosis
agccgaccgccccgcu

SEQ ID NO: 2874250 - RNA, 17 nt, Mycobacterium avium subsp. paratuberculosis
agccgaccucggcgacg

SEQ ID NO: 2874251 - RNA, 22 nt, Mycobacterium avium subsp. paratuberculosis
agccgaccuugacccaggcccg

SEQ ID NO: 2874252 - RNA, 23 nt, Mycobacterium avium subsp. paratuberculosis
agccgacgccguuucggauccau

SEQ ID NO: 2874253 - RNA, 13 nt, Mycobacterium avium subsp. paratuberculosis
agccgacgggauc

SEQ ID NO: 2874254 - RNA, 16 nt, Mycobacterium avium subsp. paratuberculosis
agccgacgucgaccag

SEQ ID NO: 2874255 - RNA, 23 nt, Mycobacterium avium subsp. paratuberculosis
agccgacgucgaccagguaggcg

SEQ ID NO: 2874256 - RNA, 17 nt, Mycobacterium avium subsp. paratuberculosis
agccgacugccccgcuc

SEQ ID NO: 2874257 - RNA, 18 nt, Mycobacterium avium subsp. paratuberculosis
agccgagacugauggugg

SEQ ID NO: 2874258 - RNA, 16 nt, Mycobacterium avium subsp. paratuberculosis
agccgagcaccggcag

SEQ ID NO: 2874259 - RNA, 14 nt, Mycobacterium avium subsp. paratuberculosis
agccgagcaccggg

SEQ ID NO: 2874260 - RNA, 22 nt, Mycobacterium avium subsp. paratuberculosis
agccgagcacgcagccgcgccc

SEQ ID NO: 2874261 - RNA, 14 nt, Mycobacterium avium subsp. paratuberculosis
agccgagccgggcc

SEQ ID NO: 2874262 - RNA, 13 nt, Mycobacterium avium subsp. paratuberculosis
agccgagccgggu

SEQ ID NO: 2874263 - RNA, 12 nt, Mycobacterium avium subsp. paratuberculosis
agccgagccggu

SEQ ID NO: 2874264 - RNA, 20 nt, Mycobacterium avium subsp. paratuberculosis
agccgagccgguccgaccag

SEQ ID NO: 2874265 - RNA, 13 nt, Mycobacterium avium subsp. paratuberculosis
agccgagcggcgc

SEQ ID NO: 2874266 - RNA, 15 nt, Mycobacterium avium subsp. paratuberculosis
agccgagcggcgcca

SEQ ID NO: 2874267 - RNA, 16 nt, Mycobacterium avium subsp. paratuberculosis
agccgagcggcgccac

SEQ ID NO: 2874268 - RNA, 21 nt, Mycobacterium avium subsp. paratuberculosis
agccgaggccgauggcgccca

SEQ ID NO: 2874269 - RNA, 15 nt, Mycobacterium avium subsp. paratuberculosis
agccgaggcgcucgc

SEQ ID NO: 2874270 - RNA, 23 nt, Mycobacterium avium subsp. paratuberculosis
agccgaggucgccgacgccgucg

SEQ ID NO: 2874271 - RNA, 16 nt, Mycobacterium avium subsp. paratuberculosis
agccgaggucgccggu

SEQ ID NO: 2874272 - RNA, 18 nt, Mycobacterium avium subsp. paratuberculosis
agccgaggucgcggcggc

SEQ ID NO: 2874273 - RNA, 20 nt, Mycobacterium avium subsp. paratuberculosis
agccgaggucgcggcggccg

SEQ ID NO: 2874274 - RNA, 22 nt, Mycobacterium avium subsp. paratuberculosis
agccgaggucgcggcggccggc

SEQ ID NO: 2874275 - RNA, 21 nt, Mycobacterium avium subsp. paratuberculosis
agccgaggucuuucaucgccc

SEQ ID NO: 2874276 - RNA, 18 nt, Mycobacterium avium subsp. paratuberculosis
agccgaguuuggcgucga

SEQ ID NO: 2874277 - RNA, 22 nt, Mycobacterium avium subsp. paratuberculosis
agccgaguuuggcgucgaugcg

SEQ ID NO: 2874278 - RNA, 18 nt, Mycobacterium avium subsp. paratuberculosis
agccgauacaugugccga

SEQ ID NO: 2874279 - RNA, 23 nt, Mycobacterium avium subsp. paratuberculosis
agccgauacaugugccgaugucu

SEQ ID NO: 2874280 - RNA, 17 nt, Mycobacterium avium subsp. paratuberculosis
agccgaucaccggcgcg

SEQ ID NO: 2874281 - RNA, 18 nt, Mycobacterium avium subsp. paratuberculosis
agccgaucaccggcgcgu

SEQ ID NO: 2874282 - RNA, 20 nt, Mycobacterium avium subsp. paratuberculosis
agccgaucaccggcgcguug

SEQ ID NO: 2874283 - RNA, 13 nt, Mycobacterium avium subsp. paratuberculosis
agccgaucgacga

SEQ ID NO: 2874284 - RNA, 23 nt, Mycobacterium avium subsp. paratuberculosis
agccgaucgccuccgucagcgcc

SEQ ID NO: 2874285 - RNA, 16 nt, Mycobacterium avium subsp. paratuberculosis
agccgaucgcggugcu

SEQ ID NO: 2874286 - RNA, 16 nt, Mycobacterium avium subsp. paratuberculosis
agccgaucuccaccga

SEQ ID NO: 2874287 - RNA, 17 nt, Mycobacterium avium subsp. paratuberculosis
agccgaucuccaccgag

SEQ ID NO: 2874288 - RNA, 20 nt, Mycobacterium avium subsp. paratuberculosis
agccgaucuccaccgagugc

SEQ ID NO: 2874289 - RNA, 16 nt, Mycobacterium avium subsp. paratuberculosis
agccgaucuggcgggc

SEQ ID NO: 2874290 - RNA, 22 nt, Mycobacterium avium subsp. paratuberculosis
agccgaugaugaaaccggccag

SEQ ID NO: 2874291 - RNA, 23 nt, Mycobacterium avium subsp. paratuberculosis
agccgaugaugaaaccggccagc

SEQ ID NO: 2874292 - RNA, 15 nt, Mycobacterium avium subsp. paratuberculosis
agccgaugcccagca

SEQ ID NO: 2874293 - RNA, 16 nt, Mycobacterium avium subsp. paratuberculosis
agccgaugcccagcag

SEQ ID NO: 2874294 - RNA, 17 nt, Mycobacterium avium subsp. paratuberculosis
agccgaugcccagcagc

SEQ ID NO: 2874295 - RNA, 19 nt, Mycobacterium avium subsp. paratuberculosis
agccgaugcccagcagcgg

SEQ ID NO: 2874296 - RNA, 15 nt, Mycobacterium avium subsp. paratuberculosis
agccgaugcgcccgc

SEQ ID NO: 2874297 - RNA, 16 nt, Mycobacterium avium subsp. paratuberculosis
agccgaugcgcccgcg

SEQ ID NO: 2874298 - RNA, 20 nt, Mycobacterium avium subsp. paratuberculosis
agccgaugcgcccgcgccac

SEQ ID NO: 2874299 - RNA, 17 nt, Mycobacterium avium subsp. paratuberculosis
agccgcaacacggccuc

SEQ ID NO: 2874300 - RNA, 13 nt, Mycobacterium avium subsp. paratuberculosis
agccgcacaccgc

SEQ ID NO: 2874301 - RNA, 17 nt, Mycobacterium avium subsp. paratuberculosis
agccgcacaccgcggcg

SEQ ID NO: 2874302 - RNA, 21 nt, Mycobacterium avium subsp. paratuberculosis
agccgcacaccgcggcggcgu

SEQ ID NO: 2874303 - RNA, 23 nt, Mycobacterium avium subsp. paratuberculosis
agccgcaccagaucgucgggcac

SEQ ID NO: 2874304 - RNA, 12 nt, Mycobacterium avium subsp. paratuberculosis
agccgcaccgcc

SEQ ID NO: 2874305 - RNA, 14 nt, Mycobacterium avium subsp. paratuberculosis
agccgcaccgccuc

SEQ ID NO: 2874306 - RNA, 15 nt, Mycobacterium avium subsp. paratuberculosis
agccgcaccgcgacc

SEQ ID NO: 2874307 - RNA, 15 nt, Mycobacterium avium subsp. paratuberculosis
agccgcaccggcgcc

SEQ ID NO: 2874308 - RNA, 17 nt, Mycobacterium avium subsp. paratuberculosis
agccgcaccggcgccgc

SEQ ID NO: 2874309 - RNA, 17 nt, Mycobacterium avium subsp. paratuberculosis
agccgcaccucggggcg

SEQ ID NO: 2874310 - RNA, 18 nt, Mycobacterium avium subsp. paratuberculosis
agccgcaccucggggcgu

SEQ ID NO: 2874311 - RNA, 22 nt, Mycobacterium avium subsp. paratuberculosis
agccgcaccucggggcguggcg

SEQ ID NO: 2874312 - RNA, 23 nt, Mycobacterium avium subsp. paratuberculosis
agccgcacgaaccgcucgaacac

SEQ ID NO: 2874313 - RNA, 14 nt, Mycobacterium avium subsp. paratuberculosis
agccgcacuuggcc

SEQ ID NO: 2874314 - RNA, 20 nt, Mycobacterium avium subsp. paratuberculosis
agccgcacuuggccucgggc

SEQ ID NO: 2874315 - RNA, 12 nt, Mycobacterium avium subsp. paratuberculosis
agccgcagcagc

SEQ ID NO: 2874316 - RNA, 18 nt, Mycobacterium avium subsp. paratuberculosis
agccgcagcagccgcgcc

SEQ ID NO: 2874317 - RNA, 19 nt, Mycobacterium avium subsp. paratuberculosis
agccgcagcagccgcgcca

SEQ ID NO: 2874318 - RNA, 14 nt, Mycobacterium avium subsp. paratuberculosis
agccgcagcaggug

SEQ ID NO: 2874319 - RNA, 16 nt, Mycobacterium avium subsp. paratuberculosis
agccgcagcaggugcg

SEQ ID NO: 2874320 - RNA, 16 nt, Mycobacterium avium subsp. paratuberculosis
agccgcagcgcgcgac

SEQ ID NO: 2874321 - RNA, 17 nt, Mycobacterium avium subsp. paratuberculosis
agccgcagcgcgcgacc

SEQ ID NO: 2874322 - RNA, 19 nt, Mycobacterium avium subsp. paratuberculosis
agccgcagcgcgcgaccgc

SEQ ID NO: 2874323 - RNA, 15 nt, Mycobacterium avium subsp. paratuberculosis
agccgcagcggcggc

SEQ ID NO: 2874324 - RNA, 16 nt, Mycobacterium avium subsp. paratuberculosis
agccgcagcggcggcu

SEQ ID NO: 2874325 - RNA, 19 nt, Mycobacterium avium subsp. paratuberculosis
agccgcagcggcggcucgu

SEQ ID NO: 2874326 - RNA, 20 nt, Mycobacterium avium subsp. paratuberculosis
agccgcagcggcggcucguc

SEQ ID NO: 2874327 - RNA, 23 nt, Mycobacterium avium subsp. paratuberculosis
agccgcagcggcggcucguccag

SEQ ID NO: 2874328 - RNA, 16 nt, Mycobacterium avium subsp. paratuberculosis
agccgcaggugcagcu

SEQ ID NO: 2874329 - RNA, 17 nt, Mycobacterium avium subsp. paratuberculosis
agccgcaggugcucgcc

SEQ ID NO: 2874330 - RNA, 18 nt, Mycobacterium avium subsp. paratuberculosis
agccgcagucgaucaccg

SEQ ID NO: 2874331 - RNA, 15 nt, Mycobacterium avium subsp. paratuberculosis
agccgcaucgcaaga

SEQ ID NO: 2874332 - RNA, 19 nt, Mycobacterium avium subsp. paratuberculosis
agccgcaucgcaagaaccu

SEQ ID NO: 2874333 - RNA, 15 nt, Mycobacterium avium subsp. paratuberculosis
agccgcauggugcgg

SEQ ID NO: 2874334 - RNA, 23 nt, Mycobacterium avium subsp. paratuberculosis
agccgcauggugcggguguccga

SEQ ID NO: 2874335 - RNA, 15 nt, Mycobacterium avium subsp. paratuberculosis
agccgccacagcgcc

SEQ ID NO: 2874336 - RNA, 19 nt, Mycobacterium avium subsp. paratuberculosis
agccgccacagcgccucgc

SEQ ID NO: 2874337 - RNA, 14 nt, Mycobacterium avium subsp. paratuberculosis
agccgcccagcauc

SEQ ID NO: 2874338 - RNA, 14 nt, Mycobacterium avium subsp. paratuberculosis
agccgcccggcgcc

SEQ ID NO: 2874339 - RNA, 11 nt, Mycobacterium avium subsp. paratuberculosis
agccgccgagc

SEQ ID NO: 2874340 - RNA, 12 nt, Mycobacterium avium subsp. paratuberculosis
agccgccgagcc

SEQ ID NO: 2874341 - RNA, 16 nt, Mycobacterium avium subsp. paratuberculosis
agccgccgagccggca

SEQ ID NO: 2874342 - RNA, 17 nt, Mycobacterium avium subsp. paratuberculosis
agccgccgagccggcac

SEQ ID NO: 2874343 - RNA, 14 nt, Mycobacterium avium subsp. paratuberculosis
agccgccgccgacc

SEQ ID NO: 2874344 - RNA, 20 nt, Mycobacterium avium subsp. paratuberculosis
agccgccgccgaccacaugc

SEQ ID NO: 2874345 - RNA, 12 nt, Mycobacterium avium subsp. paratuberculosis
agccgccgccgg

SEQ ID NO: 2874346 - RNA, 14 nt, Mycobacterium avium subsp. paratuberculosis
agccgccgccggcg

SEQ ID NO: 2874347 - RNA, 15 nt, Mycobacterium avium subsp. paratuberculosis
agccgccgccggcgu

SEQ ID NO: 2874348 - RNA, 19 nt, Mycobacterium avium subsp. paratuberculosis
agccgccgcgacacccgcg

SEQ ID NO: 2874349 - RNA, 13 nt, Mycobacterium avium subsp. paratuberculosis
agccgccgcggca

SEQ ID NO: 2874350 - RNA, 15 nt, Mycobacterium avium subsp. paratuberculosis
agccgccgcggcacc

SEQ ID NO: 2874351 - RNA, 16 nt, Mycobacterium avium subsp. paratuberculosis
agccgccgcggcaccu

SEQ ID NO: 2874352 - RNA, 11 nt, Mycobacterium avium subsp. paratuberculosis
agccgccggcc

SEQ ID NO: 2874353 - RNA, 15 nt, Mycobacterium avium subsp. paratuberculosis
agccgccggccacca

SEQ ID NO: 2874354 - RNA, 19 nt, Mycobacterium avium subsp. paratuberculosis
agccgccggcucagcggca

SEQ ID NO: 2874355 - RNA, 18 nt, Mycobacterium avium subsp. paratuberculosis
agccgccgggcuucccca

SEQ ID NO: 2874356 - RNA, 19 nt, Mycobacterium avium subsp. paratuberculosis
agccgccgggcuuccccaa

SEQ ID NO: 2874357 - RNA, 18 nt, Mycobacterium avium subsp. paratuberculosis
agccgccggggcgccgcc

SEQ ID NO: 2874358 - RNA, 21 nt, Mycobacterium avium subsp. paratuberculosis
agccgccggggcgccgccgaa

SEQ ID NO: 2874359 - RNA, 12 nt, Mycobacterium avium subsp. paratuberculosis
agccgccggugg

SEQ ID NO: 2874360 - RNA, 20 nt, Mycobacterium avium subsp. paratuberculosis
agccgccgguggcgucggug

SEQ ID NO: 2874361 - RNA, 16 nt, Mycobacterium avium subsp. paratuberculosis
agccgccgguugauca

SEQ ID NO: 2874362 - RNA, 17 nt, Mycobacterium avium subsp. paratuberculosis
agccgccguccccgcgc

SEQ ID NO: 2874363 - RNA, 14 nt, Mycobacterium avium subsp. paratuberculosis
agccgccugcgcgc

SEQ ID NO: 2874364 - RNA, 20 nt, Mycobacterium avium subsp. paratuberculosis
agccgcgaacgccucggcga

SEQ ID NO: 2874365 - RNA, 23 nt, Mycobacterium avium subsp. paratuberculosis
agccgcgaacgccucggcgagcc

SEQ ID NO: 2874366 - RNA, 20 nt, Mycobacterium avium subsp. paratuberculosis
agccgcgacacgugcaucug

SEQ ID NO: 2874367 - RNA, 19 nt, Mycobacterium avium subsp. paratuberculosis
agccgcgacagccgcccgg

SEQ ID NO: 2874368 - RNA, 21 nt, Mycobacterium avium subsp. paratuberculosis
agccgcgacggucaguccggg

SEQ ID NO: 2874369 - RNA, 15 nt, Mycobacterium avium subsp. paratuberculosis
agccgcgacgguugu

SEQ ID NO: 2874370 - RNA, 12 nt, Mycobacterium avium subsp. paratuberculosis
agccgcgaucgg

SEQ ID NO: 2874371 - RNA, 20 nt, Mycobacterium avium subsp. paratuberculosis
agccgcgcaccacgguggcg

SEQ ID NO: 2874372 - RNA, 20 nt, Mycobacterium avium subsp. paratuberculosis
agccgcgccaccgcggggcu

SEQ ID NO: 2874373 - RNA, 19 nt, Mycobacterium avium subsp. paratuberculosis
agccgcgcccgauggaggu

SEQ ID NO: 2874374 - RNA, 13 nt, Mycobacterium avium subsp. paratuberculosis
agccgcgccgacg

SEQ ID NO: 2874375 - RNA, 13 nt, Mycobacterium avium subsp. paratuberculosis
agccgcgccgccg

SEQ ID NO: 2874376 - RNA, 21 nt, Mycobacterium avium subsp. paratuberculosis
agccgcgcgagcaucaccguc

SEQ ID NO: 2874377 - RNA, 14 nt, Mycobacterium avium subsp. paratuberculosis
agccgcgcgccgag

SEQ ID NO: 2874378 - RNA, 19 nt, Mycobacterium avium subsp. paratuberculosis
agccgcgcggccggccacg

SEQ ID NO: 2874379 - RNA, 13 nt, Mycobacterium avium subsp. paratuberculosis
agccgcgcggcgu

SEQ ID NO: 2874380 - RNA, 17 nt, Mycobacterium avium subsp. paratuberculosis
agccgcgcggcgucggc

SEQ ID NO: 2874381 - RNA, 18 nt, Mycobacterium avium subsp. paratuberculosis
agccgcgcggcgucggcc

SEQ ID NO: 2874382 - RNA, 17 nt, Mycobacterium avium subsp. paratuberculosis
agccgcgcgugcagccg

SEQ ID NO: 2874383 - RNA, 20 nt, Mycobacterium avium subsp. paratuberculosis
agccgcgcgugcagccgggc

SEQ ID NO: 2874384 - RNA, 11 nt, Mycobacterium avium subsp. paratuberculosis
agccgcggacg

SEQ ID NO: 2874385 - RNA, 13 nt, Mycobacterium avium subsp. paratuberculosis
agccgcggacggc

SEQ ID NO: 2874386 - RNA, 16 nt, Mycobacterium avium subsp. paratuberculosis
agccgcggacggccag

SEQ ID NO: 2874387 - RNA, 12 nt, Mycobacterium avium subsp. paratuberculosis
agccgcggcggc

SEQ ID NO: 2874388 - RNA, 18 nt, Mycobacterium avium subsp. paratuberculosis
agccgcggcucgauggac

SEQ ID NO: 2874389 - RNA, 20 nt, Mycobacterium avium subsp. paratuberculosis
agccgcgggugaaauccgac

SEQ ID NO: 2874390 - RNA, 15 nt, Mycobacterium avium subsp. paratuberculosis
agccgcgggugacga

SEQ ID NO: 2874391 - RNA, 12 nt, Mycobacterium avium subsp. paratuberculosis
agccgcgguggc

SEQ ID NO: 2874392 - RNA, 13 nt, Mycobacterium avium subsp. paratuberculosis
agccgcgguggcg

SEQ ID NO: 2874393 - RNA, 15 nt, Mycobacterium avium subsp. paratuberculosis
agccgcgguggcggu

SEQ ID NO: 2874394 - RNA, 18 nt, Mycobacterium avium subsp. paratuberculosis
agccgcgguucggcgucg

SEQ ID NO: 2874395 - RNA, 12 nt, Mycobacterium avium subsp. paratuberculosis
agccgcgguucu

SEQ ID NO: 2874396 - RNA, 17 nt, Mycobacterium avium subsp. paratuberculosis
agccgcgucacgucggc

SEQ ID NO: 2874397 - RNA, 20 nt, Mycobacterium avium subsp. paratuberculosis
agccgcgucacgucggccug

SEQ ID NO: 2874398 - RNA, 21 nt, Mycobacterium avium subsp. paratuberculosis
agccgcgucacgucggccugc

SEQ ID NO: 2874399 - RNA, 23 nt, Mycobacterium avium subsp. paratuberculosis
agccgcucaaguccucgguggcc

SEQ ID NO: 2874400 - RNA, 16 nt, Mycobacterium avium subsp. paratuberculosis
agccgcucacacagcc

SEQ ID NO: 2874401 - RNA, 22 nt, Mycobacterium avium subsp. paratuberculosis
agccgcuccaccgcguccugca

SEQ ID NO: 2874402 - RNA, 13 nt, Mycobacterium avium subsp. paratuberculosis
agccgcucccggc

SEQ ID NO: 2874403 - RNA, 15 nt, Mycobacterium avium subsp. paratuberculosis
agccgcuccgcggcg

SEQ ID NO: 2874404 - RNA, 18 nt, Mycobacterium avium subsp. paratuberculosis
agccgcuccgcggcgggc

SEQ ID NO: 2874405 - RNA, 20 nt, Mycobacterium avium subsp. paratuberculosis
agccgcuccgcggcgggcgu

SEQ ID NO: 2874406 - RNA, 16 nt, Mycobacterium avium subsp. paratuberculosis
agccgcuccggcccga

SEQ ID NO: 2874407 - RNA, 17 nt, Mycobacterium avium subsp. paratuberculosis
agccgcuccggcccgag

SEQ ID NO: 2874408 - RNA, 20 nt, Mycobacterium avium subsp. paratuberculosis
agccgcuccggcccgagcac

SEQ ID NO: 2874409 - RNA, 13 nt, Mycobacterium avium subsp. paratuberculosis
agccgcuccucgu

SEQ ID NO: 2874410 - RNA, 16 nt, Mycobacterium avium subsp. paratuberculosis
agccgcucgcccagcg

SEQ ID NO: 2874411 - RNA, 17 nt, Mycobacterium avium subsp. paratuberculosis
agccgcucgcccagcgc

SEQ ID NO: 2874412 - RNA, 19 nt, Mycobacterium avium subsp. paratuberculosis
agccgcucgcccagcgcgg

SEQ ID NO: 2874413 - RNA, 21 nt, Mycobacterium avium subsp. paratuberculosis
agccgcucgcccagcgcggcg

SEQ ID NO: 2874414 - RNA, 20 nt, Mycobacterium avium subsp. paratuberculosis
agccgcucgcuauaucgcac

SEQ ID NO: 2874415 - RNA, 16 nt, Mycobacterium avium subsp. paratuberculosis
agccgcucggauuccc

SEQ ID NO: 2874416 - RNA, 21 nt, Mycobacterium avium subsp. paratuberculosis
agccgcucggauucccgcucg

SEQ ID NO: 2874417 - RNA, 17 nt, Mycobacterium avium subsp. paratuberculosis
agccgcucggggauccc

SEQ ID NO: 2874418 - RNA, 20 nt, Mycobacterium avium subsp. paratuberculosis
agccgcucguaguuggggcc

SEQ ID NO: 2874419 - RNA, 23 nt, Mycobacterium avium subsp. paratuberculosis
agccgcucguaguuggggccggc

SEQ ID NO: 2874420 - RNA, 17 nt, Mycobacterium avium subsp. paratuberculosis
agccgcugacgauggcg

SEQ ID NO: 2874421 - RNA, 20 nt, Mycobacterium avium subsp. paratuberculosis
agccgcugacgauggcgacc

SEQ ID NO: 2874422 - RNA, 19 nt, Mycobacterium avium subsp. paratuberculosis
agccgcugagcuucugccc

SEQ ID NO: 2874423 - RNA, 22 nt, Mycobacterium avium subsp. paratuberculosis
agccgcugcacgcguugcagcg

SEQ ID NO: 2874424 - RNA, 17 nt, Mycobacterium avium subsp. paratuberculosis
agccgcugcagcgccgc

SEQ ID NO: 2874425 - RNA, 23 nt, Mycobacterium avium subsp. paratuberculosis
agccgcugccguucgccgguacc

SEQ ID NO: 2874426 - RNA, 13 nt, Mycobacterium avium subsp. paratuberculosis
agccgcugcgaca

SEQ ID NO: 2874427 - RNA, 15 nt, Mycobacterium avium subsp. paratuberculosis
agccgcugcgacagg

SEQ ID NO: 2874428 - RNA, 19 nt, Mycobacterium avium subsp. paratuberculosis
agccgcugcugggugccgc

SEQ ID NO: 2874429 - RNA, 20 nt, Mycobacterium avium subsp. paratuberculosis
agccgcugcugggugccgcg

SEQ ID NO: 2874430 - RNA, 19 nt, Mycobacterium avium subsp. paratuberculosis
agccgcuggccgcgccaca

SEQ ID NO: 2874431 - RNA, 23 nt, Mycobacterium avium subsp. paratuberculosis
agccgcuggccgcgccacagcgu

SEQ ID NO: 2874432 - RNA, 18 nt, Mycobacterium avium subsp. paratuberculosis
agccgcuuggcgcgccgc

SEQ ID NO: 2874433 - RNA, 15 nt, Mycobacterium avium subsp. paratuberculosis
agccgcuugguggcg

SEQ ID NO: 2874434 - RNA, 16 nt, Mycobacterium avium subsp. paratuberculosis
agccgcuugguggcgc

SEQ ID NO: 2874435 - RNA, 17 nt, Mycobacterium avium subsp. paratuberculosis
agccggaaggccaaggc

SEQ ID NO: 2874436 - RNA, 22 nt, Mycobacterium avium subsp. paratuberculosis
agccggacaucucccgcacccg

SEQ ID NO: 2874437 - RNA, 22 nt, Mycobacterium avium subsp. paratuberculosis
agccggaccgcuugacgccgcc

SEQ ID NO: 2874438 - RNA, 23 nt, Mycobacterium avium subsp. paratuberculosis
agccggacgaacgaguugccccg

SEQ ID NO: 2874439 - RNA, 20 nt, Mycobacterium avium subsp. paratuberculosis
agccggacgggaucggcgcg

SEQ ID NO: 2874440 - RNA, 18 nt, Mycobacterium avium subsp. paratuberculosis
agccggacuauacacgcc

SEQ ID NO: 2874441 - RNA, 20 nt, Mycobacterium avium subsp. paratuberculosis
agccggacuauacacgccug

SEQ ID NO: 2874442 - RNA, 22 nt, Mycobacterium avium subsp. paratuberculosis
agccggagaacuaucuggucug

SEQ ID NO: 2874443 - RNA, 23 nt, Mycobacterium avium subsp. paratuberculosis
agccggagaaggcgaacgggcug

SEQ ID NO: 2874444 - RNA, 13 nt, Mycobacterium avium subsp. paratuberculosis
agccggagccggc

SEQ ID NO: 2874445 - RNA, 15 nt, Mycobacterium avium subsp. paratuberculosis
agccggagccggccu

SEQ ID NO: 2874446 - RNA, 17 nt, Mycobacterium avium subsp. paratuberculosis
agccggagccggccucg

SEQ ID NO: 2874447 - RNA, 14 nt, Mycobacterium avium subsp. paratuberculosis
agccggaucaccug

SEQ ID NO: 2874448 - RNA, 15 nt, Mycobacterium avium subsp. paratuberculosis
agccggaucggggug

SEQ ID NO: 2874449 - RNA, 21 nt, Mycobacterium avium subsp. paratuberculosis
agccggauguccuacggcggg

SEQ ID NO: 2874450 - RNA, 22 nt, Mycobacterium avium subsp. paratuberculosis
agccggauguccuacggcgggu

SEQ ID NO: 2874451 - RNA, 14 nt, Mycobacterium avium subsp. paratuberculosis
agccggcacgcgcg

SEQ ID NO: 2874452 - RNA, 19 nt, Mycobacterium avium subsp. paratuberculosis
agccggcacgcgcgccgga

SEQ ID NO: 2874453 - RNA, 14 nt, Mycobacterium avium subsp. paratuberculosis
agccggcacggccg

SEQ ID NO: 2874454 - RNA, 16 nt, Mycobacterium avium subsp. paratuberculosis
agccggcacggccggc

SEQ ID NO: 2874455 - RNA, 17 nt, Mycobacterium avium subsp. paratuberculosis
agccggccaacagcagc

SEQ ID NO: 2874456 - RNA, 20 nt, Mycobacterium avium subsp. paratuberculosis
agccggccaacagcagcgcc

SEQ ID NO: 2874457 - RNA, 21 nt, Mycobacterium avium subsp. paratuberculosis
agccggccaccgccccagccg

SEQ ID NO: 2874458 - RNA, 16 nt, Mycobacterium avium subsp. paratuberculosis
agccggccaccucguc

SEQ ID NO: 2874459 - RNA, 23 nt, Mycobacterium avium subsp. paratuberculosis
agccggccaccucgucccagcgc

SEQ ID NO: 2874460 - RNA, 16 nt, Mycobacterium avium subsp. paratuberculosis
agccggccagcagcgg

SEQ ID NO: 2874461 - RNA, 12 nt, Mycobacterium avium subsp. paratuberculosis
agccggccagcg

SEQ ID NO: 2874462 - RNA, 17 nt, Mycobacterium avium subsp. paratuberculosis
agccggccagcgucgcg

SEQ ID NO: 2874463 - RNA, 12 nt, Mycobacterium avium subsp. paratuberculosis
agccggccagcu

SEQ ID NO: 2874464 - RNA, 13 nt, Mycobacterium avium subsp. paratuberculosis
agccggccagcuc

SEQ ID NO: 2874465 - RNA, 14 nt, Mycobacterium avium subsp. paratuberculosis
agccggccagcucg

SEQ ID NO: 2874466 - RNA, 15 nt, Mycobacterium avium subsp. paratuberculosis
agccggccagcucga

SEQ ID NO: 2874467 - RNA, 18 nt, Mycobacterium avium subsp. paratuberculosis
agccggccagcucgagca

SEQ ID NO: 2874468 - RNA, 19 nt, Mycobacterium avium subsp. paratuberculosis
agccggccaggcccagccc

SEQ ID NO: 2874469 - RNA, 21 nt, Mycobacterium avium subsp. paratuberculosis
agccggccagguugaccacca

SEQ ID NO: 2874470 - RNA, 21 nt, Mycobacterium avium subsp. paratuberculosis
agccggccaguucccgggcga

SEQ ID NO: 2874471 - RNA, 15 nt, Mycobacterium avium subsp. paratuberculosis
agccggccaucucgg

SEQ ID NO: 2874472 - RNA, 22 nt, Mycobacterium avium subsp. paratuberculosis
agccggcccgagcccugcgcca

SEQ ID NO: 2874473 - RNA, 11 nt, Mycobacterium avium subsp. paratuberculosis
agccggcccgc

SEQ ID NO: 2874474 - RNA, 18 nt, Mycobacterium avium subsp. paratuberculosis
agccggcccgcagccagc

SEQ ID NO: 2874475 - RNA, 19 nt, Mycobacterium avium subsp. paratuberculosis
agccggcccgcagccagcg

SEQ ID NO: 2874476 - RNA, 21 nt, Mycobacterium avium subsp. paratuberculosis
agccggcccgcagccagcgca

SEQ ID NO: 2874477 - RNA, 15 nt, Mycobacterium avium subsp. paratuberculosis
agccggcccgcaucg

SEQ ID NO: 2874478 - RNA, 20 nt, Mycobacterium avium subsp. paratuberculosis
agccggcccgcaucgcggcg

SEQ ID NO: 2874479 - RNA, 22 nt, Mycobacterium avium subsp. paratuberculosis
agccggcccgcaucgcggcgau

SEQ ID NO: 2874480 - RNA, 13 nt, Mycobacterium avium subsp. paratuberculosis
agccggccgaccg

SEQ ID NO: 2874481 - RNA, 18 nt, Mycobacterium avium subsp. paratuberculosis
agccggccgacgcggccu

SEQ ID NO: 2874482 - RNA, 20 nt, Mycobacterium avium subsp. paratuberculosis
agccggccgacgcggccucg

SEQ ID NO: 2874483 - RNA, 13 nt, Mycobacterium avium subsp. paratuberculosis
agccggccgccga

SEQ ID NO: 2874484 - RNA, 15 nt, Mycobacterium avium subsp. paratuberculosis
agccggccgcgucgc

SEQ ID NO: 2874485 - RNA, 16 nt, Mycobacterium avium subsp. paratuberculosis
agccggccggacaccg

SEQ ID NO: 2874486 - RNA, 20 nt, Mycobacterium avium subsp. paratuberculosis
agccggccggacaccgaacc

SEQ ID NO: 2874487 - RNA, 12 nt, Mycobacterium avium subsp. paratuberculosis
agccggccggca

SEQ ID NO: 2874488 - RNA, 16 nt, Mycobacterium avium subsp. paratuberculosis
agccggccggccgaca

SEQ ID NO: 2874489 - RNA, 16 nt, Mycobacterium avium subsp. paratuberculosis
agccggccggcggacg

SEQ ID NO: 2874490 - RNA, 23 nt, Mycobacterium avium subsp. paratuberculosis
agccggccguagcggacgacggc

SEQ ID NO: 2874491 - RNA, 12 nt, Mycobacterium avium subsp. paratuberculosis
agccggccguca

SEQ ID NO: 2874492 - RNA, 14 nt, Mycobacterium avium subsp. paratuberculosis
agccggccgucagg

SEQ ID NO: 2874493 - RNA, 21 nt, Mycobacterium avium subsp. paratuberculosis
agccggccguccacggcggug

SEQ ID NO: 2874494 - RNA, 15 nt, Mycobacterium avium subsp. paratuberculosis
agccggccucgccgg

SEQ ID NO: 2874495 - RNA, 17 nt, Mycobacterium avium subsp. paratuberculosis
agccggccucgccggcg

SEQ ID NO: 2874496 - RNA, 19 nt, Mycobacterium avium subsp. paratuberculosis
agccggccucgccggcgcc

SEQ ID NO: 2874497 - RNA, 23 nt, Mycobacterium avium subsp. paratuberculosis
agccggccucgccggcgccgggc

SEQ ID NO: 2874498 - RNA, 19 nt, Mycobacterium avium subsp. paratuberculosis
agccggcgacgaccgcacc

SEQ ID NO: 2874499 - RNA, 15 nt, Mycobacterium avium subsp. paratuberculosis
agccggcgagcgcgc

SEQ ID NO: 2874500 - RNA, 17 nt, Mycobacterium avium subsp. paratuberculosis
agccggcgagcgcgcug

SEQ ID NO: 2874501 - RNA, 13 nt, Mycobacterium avium subsp. paratuberculosis
agccggcgaucgu

SEQ ID NO: 2874502 - RNA, 21 nt, Mycobacterium avium subsp. paratuberculosis
agccggcgaucgucgccguca

SEQ ID NO: 2874503 - RNA, 16 nt, Mycobacterium avium subsp. paratuberculosis
agccggcgcaccgcgu

SEQ ID NO: 2874504 - RNA, 18 nt, Mycobacterium avium subsp. paratuberculosis
agccggcgcaccgcgucg

SEQ ID NO: 2874505 - RNA, 20 nt, Mycobacterium avium subsp. paratuberculosis
agccggcgcaccgcgucgau

SEQ ID NO: 2874506 - RNA, 16 nt, Mycobacterium avium subsp. paratuberculosis
agccggcgcacucccg

SEQ ID NO: 2874507 - RNA, 19 nt, Mycobacterium avium subsp. paratuberculosis
agccggcgcacucccgcgu

SEQ ID NO: 2874508 - RNA, 23 nt, Mycobacterium avium subsp. paratuberculosis
agccggcgcagguguccagcccu

SEQ ID NO: 2874509 - RNA, 17 nt, Mycobacterium avium subsp. paratuberculosis
agccggcgcccgcaggc

SEQ ID NO: 2874510 - RNA, 15 nt, Mycobacterium avium subsp. paratuberculosis
agccggcgcgcggug

SEQ ID NO: 2874511 - RNA, 22 nt, Mycobacterium avium subsp. paratuberculosis
agccggcgcggcagggccaggc

SEQ ID NO: 2874512 - RNA, 18 nt, Mycobacterium avium subsp. paratuberculosis
agccggcggcgccuugcc

SEQ ID NO: 2874513 - RNA, 12 nt, Mycobacterium avium subsp. paratuberculosis
agccggcggcgg

SEQ ID NO: 2874514 - RNA, 23 nt, Mycobacterium avium subsp. paratuberculosis
agccggcggcggcggucggcaua

SEQ ID NO: 2874515 - RNA, 22 nt, Mycobacterium avium subsp. paratuberculosis
agccggcgguggccaugcgcga

SEQ ID NO: 2874516 - RNA, 16 nt, Mycobacterium avium subsp. paratuberculosis
agccggcguacccgcc

SEQ ID NO: 2874517 - RNA, 18 nt, Mycobacterium avium subsp. paratuberculosis
agccggcguacccgccca

SEQ ID NO: 2874518 - RNA, 22 nt, Mycobacterium avium subsp. paratuberculosis
agccggcgucgaugaugccggc

SEQ ID NO: 2874519 - RNA, 12 nt, Mycobacterium avium subsp. paratuberculosis
agccggcgucgc

SEQ ID NO: 2874520 - RNA, 13 nt, Mycobacterium avium subsp. paratuberculosis
agccggcgucgcc

SEQ ID NO: 2874521 - RNA, 18 nt, Mycobacterium avium subsp. paratuberculosis
agccggcgucgccgcugg

SEQ ID NO: 2874522 - RNA, 19 nt, Mycobacterium avium subsp. paratuberculosis
agccggcucagggugcgcu

SEQ ID NO: 2874523 - RNA, 23 nt, Mycobacterium avium subsp. paratuberculosis
agccggcucgaaaugccuuggcg

SEQ ID NO: 2874524 - RNA, 17 nt, Mycobacterium avium subsp. paratuberculosis
agccggcucgguaugcg

SEQ ID NO: 2874525 - RNA, 22 nt, Mycobacterium avium subsp. paratuberculosis
agccggcucgguaugcggcgac

SEQ ID NO: 2874526 - RNA, 23 nt, Mycobacterium avium subsp. paratuberculosis
agccggcucgguaugcggcgacg

SEQ ID NO: 2874527 - RNA, 18 nt, Mycobacterium avium subsp. paratuberculosis
agccggcucuuggcgacc

SEQ ID NO: 2874528 - RNA, 19 nt, Mycobacterium avium subsp. paratuberculosis
agccggcucuuggcgaccu

SEQ ID NO: 2874529 - RNA, 19 nt, Mycobacterium avium subsp. paratuberculosis
agccgggaaucgagggcgc

SEQ ID NO: 2874530 - RNA, 15 nt, Mycobacterium avium subsp. paratuberculosis
agccgggcagcgcga

SEQ ID NO: 2874531 - RNA, 15 nt, Mycobacterium avium subsp. paratuberculosis
agccgggccagcagc

SEQ ID NO: 2874532 - RNA, 15 nt, Mycobacterium avium subsp. paratuberculosis
agccgggccagcccg

SEQ ID NO: 2874533 - RNA, 14 nt, Mycobacterium avium subsp. paratuberculosis
agccgggcccgggu

SEQ ID NO: 2874534 - RNA, 14 nt, Mycobacterium avium subsp. paratuberculosis
agccgggccgcccg

SEQ ID NO: 2874535 - RNA, 16 nt, Mycobacterium avium subsp. paratuberculosis
agccgggccgcccgcg

SEQ ID NO: 2874536 - RNA, 20 nt, Mycobacterium avium subsp. paratuberculosis
agccgggccgcccgcgcgug

SEQ ID NO: 2874537 - RNA, 20 nt, Mycobacterium avium subsp. paratuberculosis
agccgggccugcggcgcggc

SEQ ID NO: 2874538 - RNA, 13 nt, Mycobacterium avium subsp. paratuberculosis
agccgggcgcggg

SEQ ID NO: 2874539 - RNA, 22 nt, Mycobacterium avium subsp. paratuberculosis
agccgggcgcgggcgccgucgg

SEQ ID NO: 2874540 - RNA, 17 nt, Mycobacterium avium subsp. paratuberculosis
agccgggcggcagcagc

SEQ ID NO: 2874541 - RNA, 18 nt, Mycobacterium avium subsp. paratuberculosis
agccgggcggcagcagcu

SEQ ID NO: 2874542 - RNA, 19 nt, Mycobacterium avium subsp. paratuberculosis
agccgggcggcagcagcug

SEQ ID NO: 2874543 - RNA, 14 nt, Mycobacterium avium subsp. paratuberculosis
agccgggcggccag

SEQ ID NO: 2874544 - RNA, 16 nt, Mycobacterium avium subsp. paratuberculosis
agccgggcggccaggg

SEQ ID NO: 2874545 - RNA, 13 nt, Mycobacterium avium subsp. paratuberculosis
agccgggcggccg

SEQ ID NO: 2874546 - RNA, 16 nt, Mycobacterium avium subsp. paratuberculosis
agccgggcggccgggc

SEQ ID NO: 2874547 - RNA, 14 nt, Mycobacterium avium subsp. paratuberculosis
agccgggcggcgcc

SEQ ID NO: 2874548 - RNA, 15 nt, Mycobacterium avium subsp. paratuberculosis
agccgggcggcgccg

SEQ ID NO: 2874549 - RNA, 16 nt, Mycobacterium avium subsp. paratuberculosis
agccgggcggcgccga

SEQ ID NO: 2874550 - RNA, 17 nt, Mycobacterium avium subsp. paratuberculosis
agccgggcggcgccgaa

SEQ ID NO: 2874551 - RNA, 19 nt, Mycobacterium avium subsp. paratuberculosis
agccgggcggcgccgaacc

SEQ ID NO: 2874552 - RNA, 22 nt, Mycobacterium avium subsp. paratuberculosis
agccgggcggcgccgaaccggg

SEQ ID NO: 2874553 - RNA, 15 nt, Mycobacterium avium subsp. paratuberculosis
agccgggcggcggcc

SEQ ID NO: 2874554 - RNA, 17 nt, Mycobacterium avium subsp. paratuberculosis
agccgggcggcggccuc

SEQ ID NO: 2874555 - RNA, 18 nt, Mycobacterium avium subsp. paratuberculosis
agccgggcggcggccucc

SEQ ID NO: 2874556 - RNA, 17 nt, Mycobacterium avium subsp. paratuberculosis
agccgggcggugauggu

SEQ ID NO: 2874557 - RNA, 23 nt, Mycobacterium avium subsp. paratuberculosis
agccgggcggugauggucaccgu

SEQ ID NO: 2874558 - RNA, 15 nt, Mycobacterium avium subsp. paratuberculosis
agccgggcucgagca

SEQ ID NO: 2874559 - RNA, 17 nt, Mycobacterium avium subsp. paratuberculosis
agccggggcagcugcug

SEQ ID NO: 2874560 - RNA, 17 nt, Mycobacterium avium subsp. paratuberculosis
agccgggggaucaccuc

SEQ ID NO: 2874561 - RNA, 14 nt, Mycobacterium avium subsp. paratuberculosis
agccgggggcggug

SEQ ID NO: 2874562 - RNA, 18 nt, Mycobacterium avium subsp. paratuberculosis
agccgggggcggugcagc

SEQ ID NO: 2874563 - RNA, 20 nt, Mycobacterium avium subsp. paratuberculosis
agccgggggcggugcagccg

SEQ ID NO: 2874564 - RNA, 23 nt, Mycobacterium avium subsp. paratuberculosis
agccgggggcggugcagccgggg

SEQ ID NO: 2874565 - RNA, 13 nt, Mycobacterium avium subsp. paratuberculosis
agccgggguaggg

SEQ ID NO: 2874566 - RNA, 18 nt, Mycobacterium avium subsp. paratuberculosis
agccgggguagggcggcg

SEQ ID NO: 2874567 - RNA, 18 nt, Mycobacterium avium subsp. paratuberculosis
agccggggugcccgggcc

SEQ ID NO: 2874568 - RNA, 20 nt, Mycobacterium avium subsp. paratuberculosis
agccgggucaguucgcggcg

SEQ ID NO: 2874569 - RNA, 18 nt, Mycobacterium avium subsp. paratuberculosis
agccgggucauccagccg

SEQ ID NO: 2874570 - RNA, 23 nt, Mycobacterium avium subsp. paratuberculosis
agccgggugaacccgacguugcc

SEQ ID NO: 2874571 - RNA, 15 nt, Mycobacterium avium subsp. paratuberculosis
agccgggugcccauc

SEQ ID NO: 2874572 - RNA, 16 nt, Mycobacterium avium subsp. paratuberculosis
agccgggugcccgcgu

SEQ ID NO: 2874573 - RNA, 17 nt, Mycobacterium avium subsp. paratuberculosis
agccgggugcgggccag

SEQ ID NO: 2874574 - RNA, 18 nt, Mycobacterium avium subsp. paratuberculosis
agccgggugcgggccagc

SEQ ID NO: 2874575 - RNA, 22 nt, Mycobacterium avium subsp. paratuberculosis
agccgggugcgggccagcagcc

SEQ ID NO: 2874576 - RNA, 24 nt, Mycobacterium avium subsp. paratuberculosis
agccgggugcggugcagccgcggu

SEQ ID NO: 2874577 - RNA, 18 nt, Mycobacterium avium subsp. paratuberculosis
agccggguggcccgcgcg

SEQ ID NO: 2874578 - RNA, 20 nt, Mycobacterium avium subsp. paratuberculosis
agccggguggcccgcgcgcu

SEQ ID NO: 2874579 - RNA, 20 nt, Mycobacterium avium subsp. paratuberculosis
agccgguacggaucgccgga

SEQ ID NO: 2874580 - RNA, 23 nt, Mycobacterium avium subsp. paratuberculosis
agccgguacggaucgccggacag

SEQ ID NO: 2874581 - RNA, 14 nt, Mycobacterium avium subsp. paratuberculosis
agccgguacggcuc

SEQ ID NO: 2874582 - RNA, 19 nt, Mycobacterium avium subsp. paratuberculosis
agccgguagaucagcgccu

SEQ ID NO: 2874583 - RNA, 22 nt, Mycobacterium avium subsp. paratuberculosis
agccgguagaucagcgccuggu

SEQ ID NO: 2874584 - RNA, 16 nt, Mycobacterium avium subsp. paratuberculosis
agccgguaggccugcg

SEQ ID NO: 2874585 - RNA, 17 nt, Mycobacterium avium subsp. paratuberculosis
agccgguaugcgaucgc

SEQ ID NO: 2874586 - RNA, 21 nt, Mycobacterium avium subsp. paratuberculosis
agccggucacgcugaucgacc

SEQ ID NO: 2874587 - RNA, 15 nt, Mycobacterium avium subsp. paratuberculosis
agccgguccgaccag

SEQ ID NO: 2874588 - RNA, 17 nt, Mycobacterium avium subsp. paratuberculosis
agccgguccgaccagcg

SEQ ID NO: 2874589 - RNA, 18 nt, Mycobacterium avium subsp. paratuberculosis
agccgguccgaccagcgg

SEQ ID NO: 2874590 - RNA, 19 nt, Mycobacterium avium subsp. paratuberculosis
agccgguccgaccagcggc

SEQ ID NO: 2874591 - RNA, 18 nt, Mycobacterium avium subsp. paratuberculosis
agccgguccgaccgccac

SEQ ID NO: 2874592 - RNA, 19 nt, Mycobacterium avium subsp. paratuberculosis
agccgguccgaccgccacc

SEQ ID NO: 2874593 - RNA, 19 nt, Mycobacterium avium subsp. paratuberculosis
agccgguccgacggcugcg

SEQ ID NO: 2874594 - RNA, 19 nt, Mycobacterium avium subsp. paratuberculosis
agccgguccugggccuccg

SEQ ID NO: 2874595 - RNA, 22 nt, Mycobacterium avium subsp. paratuberculosis
agccgguccuuggccugcuugg

SEQ ID NO: 2874596 - RNA, 19 nt, Mycobacterium avium subsp. paratuberculosis
agccggucgaacgccagcg

SEQ ID NO: 2874597 - RNA, 21 nt, Mycobacterium avium subsp. paratuberculosis
agccggucgaacgccagcgcc

SEQ ID NO: 2874598 - RNA, 21 nt, Mycobacterium avium subsp. paratuberculosis
agccggucgaggucgccgaca

SEQ ID NO: 2874599 - RNA, 23 nt, Mycobacterium avium subsp. paratuberculosis
agccggucgaggucgccgacagc

SEQ ID NO: 2874600 - RNA, 16 nt, Mycobacterium avium subsp. paratuberculosis
agccggucgcagguga

SEQ ID NO: 2874601 - RNA, 20 nt, Mycobacterium avium subsp. paratuberculosis
agccggucgcaggugaucuu

SEQ ID NO: 2874602 - RNA, 21 nt, Mycobacterium avium subsp. paratuberculosis
agccggucgcaggugaucuug

SEQ ID NO: 2874603 - RNA, 13 nt, Mycobacterium avium subsp. paratuberculosis
agccggucgccgg

SEQ ID NO: 2874604 - RNA, 15 nt, Mycobacterium avium subsp. paratuberculosis
agccggucgccgggc

SEQ ID NO: 2874605 - RNA, 15 nt, Mycobacterium avium subsp. paratuberculosis
agccggucgcgcauc

SEQ ID NO: 2874606 - RNA, 21 nt, Mycobacterium avium subsp. paratuberculosis
agccggucgcgcaucgccucg

SEQ ID NO: 2874607 - RNA, 23 nt, Mycobacterium avium subsp. paratuberculosis
agccggucgcgcaucgccucggc

SEQ ID NO: 2874608 - RNA, 15 nt, Mycobacterium avium subsp. paratuberculosis
agccggucggaggcc

SEQ ID NO: 2874609 - RNA, 17 nt, Mycobacterium avium subsp. paratuberculosis
agccggucggcccgcuc

SEQ ID NO: 2874610 - RNA, 14 nt, Mycobacterium avium subsp. paratuberculosis
agccggucgggauc

SEQ ID NO: 2874611 - RNA, 22 nt, Mycobacterium avium subsp. paratuberculosis
agccggucgucggggcaucgca

SEQ ID NO: 2874612 - RNA, 15 nt, Mycobacterium avium subsp. paratuberculosis
agccggucugggcga

SEQ ID NO: 2874613 - RNA, 18 nt, Mycobacterium avium subsp. paratuberculosis
agccggucugggcgacca

SEQ ID NO: 2874614 - RNA, 14 nt, Mycobacterium avium subsp. paratuberculosis
agccggugaucgcg

SEQ ID NO: 2874615 - RNA, 17 nt, Mycobacterium avium subsp. paratuberculosis
agccggugaucgcggcg

SEQ ID NO: 2874616 - RNA, 21 nt, Mycobacterium avium subsp. paratuberculosis
agccggugaugacgucgccca

SEQ ID NO: 2874617 - RNA, 22 nt, Mycobacterium avium subsp. paratuberculosis
agccggugaugacgucgcccac

SEQ ID NO: 2874618 - RNA, 14 nt, Mycobacterium avium subsp. paratuberculosis
agccggugcaccac

SEQ ID NO: 2874619 - RNA, 13 nt, Mycobacterium avium subsp. paratuberculosis
agccggugcccau

SEQ ID NO: 2874620 - RNA, 14 nt, Mycobacterium avium subsp. paratuberculosis
agccggugcccauc

SEQ ID NO: 2874621 - RNA, 12 nt, Mycobacterium avium subsp. paratuberculosis
agccggugccga

SEQ ID NO: 2874622 - RNA, 14 nt, Mycobacterium avium subsp. paratuberculosis
agccggugccgagg

SEQ ID NO: 2874623 - RNA, 15 nt, Mycobacterium avium subsp. paratuberculosis
agccggugcgagccg

SEQ ID NO: 2874624 - RNA, 23 nt, Mycobacterium avium subsp. paratuberculosis
agccggugcggucggcgucguac

SEQ ID NO: 2874625 - RNA, 21 nt, Mycobacterium avium subsp. paratuberculosis
agccgguggaauucuggccga

SEQ ID NO: 2874626 - RNA, 13 nt, Mycobacterium avium subsp. paratuberculosis
agccgguggcggc

SEQ ID NO: 2874627 - RNA, 14 nt, Mycobacterium avium subsp. paratuberculosis
agccgguggcggcc

SEQ ID NO: 2874628 - RNA, 16 nt, Mycobacterium avium subsp. paratuberculosis
agccgguggcggccac

SEQ ID NO: 2874629 - RNA, 18 nt, Mycobacterium avium subsp. paratuberculosis
agccgguggcggccacga

SEQ ID NO: 2874630 - RNA, 18 nt, Mycobacterium avium subsp. paratuberculosis
agccgguggucaacgcgc

SEQ ID NO: 2874631 - RNA, 19 nt, Mycobacterium avium subsp. paratuberculosis
agccgguucgucccgcgcg

SEQ ID NO: 2874632 - RNA, 17 nt, Mycobacterium avium subsp. paratuberculosis
agccgguugcgguggcc

SEQ ID NO: 2874633 - RNA, 19 nt, Mycobacterium avium subsp. paratuberculosis
agccgguugcgguggccga

SEQ ID NO: 2874634 - RNA, 16 nt, Mycobacterium avium subsp. paratuberculosis
agccguaacgaugccg

SEQ ID NO: 2874635 - RNA, 13 nt, Mycobacterium avium subsp. paratuberculosis
agccguacacggc

SEQ ID NO: 2874636 - RNA, 15 nt, Mycobacterium avium subsp. paratuberculosis
agccguacacggcgg

SEQ ID NO: 2874637 - RNA, 18 nt, Mycobacterium avium subsp. paratuberculosis
agccguacacggcggcga

SEQ ID NO: 2874638 - RNA, 15 nt, Mycobacterium avium subsp. paratuberculosis
agccguaccgcaaca

SEQ ID NO: 2874639 - RNA, 19 nt, Mycobacterium avium subsp. paratuberculosis
agccguaccgcaacaccga

SEQ ID NO: 2874640 - RNA, 21 nt, Mycobacterium avium subsp. paratuberculosis
agccguagcgcaacaccgaaa

SEQ ID NO: 2874641 - RNA, 15 nt, Mycobacterium avium subsp. paratuberculosis
agccguaggccaggu

SEQ ID NO: 2874642 - RNA, 13 nt, Mycobacterium avium subsp. paratuberculosis
agccguccaggcc

SEQ ID NO: 2874643 - RNA, 16 nt, Mycobacterium avium subsp. paratuberculosis
agccguccaggccgcu

SEQ ID NO: 2874644 - RNA, 14 nt, Mycobacterium avium subsp. paratuberculosis
agccgucccgccgu

SEQ ID NO: 2874645 - RNA, 16 nt, Mycobacterium avium subsp. paratuberculosis
agccgucccuguucgc

SEQ ID NO: 2874646 - RNA, 19 nt, Mycobacterium avium subsp. paratuberculosis
agccgucccuguucgcgcc

SEQ ID NO: 2874647 - RNA, 22 nt, Mycobacterium avium subsp. paratuberculosis
agccgucccuguucgcgccggu

SEQ ID NO: 2874648 - RNA, 20 nt, Mycobacterium avium subsp. paratuberculosis
agccgucgaaacggcugcug

SEQ ID NO: 2874649 - RNA, 17 nt, Mycobacterium avium subsp. paratuberculosis
agccgucgaagaugacc

SEQ ID NO: 2874650 - RNA, 18 nt, Mycobacterium avium subsp. paratuberculosis
agccgucgaccccgccgg

SEQ ID NO: 2874651 - RNA, 20 nt, Mycobacterium avium subsp. paratuberculosis
agccgucgaugccggcgacg

SEQ ID NO: 2874652 - RNA, 17 nt, Mycobacterium avium subsp. paratuberculosis
agccgucgcacuagguc

SEQ ID NO: 2874653 - RNA, 13 nt, Mycobacterium avium subsp. paratuberculosis
agccgucgccgcg

SEQ ID NO: 2874654 - RNA, 23 nt, Mycobacterium avium subsp. paratuberculosis
agccgucggcggaggucauggcg

SEQ ID NO: 2874655 - RNA, 13 nt, Mycobacterium avium subsp. paratuberculosis
agccgucggcggc

SEQ ID NO: 2874656 - RNA, 17 nt, Mycobacterium avium subsp. paratuberculosis
agccgucggcggccuug

SEQ ID NO: 2874657 - RNA, 22 nt, Mycobacterium avium subsp. paratuberculosis
agccgucggcuuccuccucggc

SEQ ID NO: 2874658 - RNA, 16 nt, Mycobacterium avium subsp. paratuberculosis
agccgucguaggcgcg

SEQ ID NO: 2874659 - RNA, 19 nt, Mycobacterium avium subsp. paratuberculosis
agccgucgucguccgcaac

SEQ ID NO: 2874660 - RNA, 22 nt, Mycobacterium avium subsp. paratuberculosis
agccgucgucguccgcaaccgc

SEQ ID NO: 2874661 - RNA, 19 nt, Mycobacterium avium subsp. paratuberculosis
agccgucguugcgggcggc

SEQ ID NO: 2874662 - RNA, 22 nt, Mycobacterium avium subsp. paratuberculosis
agccgucguugcgggcggcgcg

SEQ ID NO: 2874663 - RNA, 18 nt, Mycobacterium avium subsp. paratuberculosis
agccgucucggagcggug

SEQ ID NO: 2874664 - RNA, 13 nt, Mycobacterium avium subsp. paratuberculosis
agccgugcacgcc

SEQ ID NO: 2874665 - RNA, 17 nt, Mycobacterium avium subsp. paratuberculosis
agccgugcacgccgucg

SEQ ID NO: 2874666 - RNA, 19 nt, Mycobacterium avium subsp. paratuberculosis
agccgugcacgccgucgug

SEQ ID NO: 2874667 - RNA, 12 nt, Mycobacterium avium subsp. paratuberculosis
agccgugcagcg

SEQ ID NO: 2874668 - RNA, 15 nt, Mycobacterium avium subsp. paratuberculosis
agccgugcagcgccc

SEQ ID NO: 2874669 - RNA, 17 nt, Mycobacterium avium subsp. paratuberculosis
agccgugcagcgcccag

SEQ ID NO: 2874670 - RNA, 14 nt, Mycobacterium avium subsp. paratuberculosis
agccgugccccagg

SEQ ID NO: 2874671 - RNA, 15 nt, Mycobacterium avium subsp. paratuberculosis
agccgugccccaggu

SEQ ID NO: 2874672 - RNA, 13 nt, Mycobacterium avium subsp. paratuberculosis
agccgugcccgag

SEQ ID NO: 2874673 - RNA, 22 nt, Mycobacterium avium subsp. paratuberculosis
agccguggcaggcacgagcgaa

SEQ ID NO: 2874674 - RNA, 15 nt, Mycobacterium avium subsp. paratuberculosis
agccgugggugccga

SEQ ID NO: 2874675 - RNA, 19 nt, Mycobacterium avium subsp. paratuberculosis
agccgugggugccgacgag

SEQ ID NO: 2874676 - RNA, 21 nt, Mycobacterium avium subsp. paratuberculosis
agccgugggugccgacgagcu

SEQ ID NO: 2874677 - RNA, 19 nt, Mycobacterium avium subsp. paratuberculosis
agccgugggugucggcgaa

SEQ ID NO: 2874678 - RNA, 17 nt, Mycobacterium avium subsp. paratuberculosis
agccguuccaucgggcc

SEQ ID NO: 2874679 - RNA, 15 nt, Mycobacterium avium subsp. paratuberculosis
agccguucccggcag

SEQ ID NO: 2874680 - RNA, 15 nt, Mycobacterium avium subsp. paratuberculosis
agccguucgcgccga

SEQ ID NO: 2874681 - RNA, 16 nt, Mycobacterium avium subsp. paratuberculosis
agccguucgcgccgag

SEQ ID NO: 2874682 - RNA, 17 nt, Mycobacterium avium subsp. paratuberculosis
agccguucgcgccgaga

SEQ ID NO: 2874683 - RNA, 14 nt, Mycobacterium avium subsp. paratuberculosis
agccguucgcugcc

SEQ ID NO: 2874684 - RNA, 20 nt, Mycobacterium avium subsp. paratuberculosis
agccguucucguccugggcc

SEQ ID NO: 2874685 - RNA, 16 nt, Mycobacterium avium subsp. paratuberculosis
agccguugacgguguu

SEQ ID NO: 2874686 - RNA, 18 nt, Mycobacterium avium subsp. paratuberculosis
agccguugccgccgcgcg

SEQ ID NO: 2874687 - RNA, 23 nt, Mycobacterium avium subsp. paratuberculosis
agccguugggcagcucggcgggc

SEQ ID NO: 2874688 - RNA, 19 nt, Mycobacterium avium subsp. paratuberculosis
agccguuugaugccguccg

SEQ ID NO: 2874689 - RNA, 15 nt, Mycobacterium avium subsp. paratuberculosis
agccguuuggcgccg

SEQ ID NO: 2874690 - RNA, 16 nt, Mycobacterium avium subsp. paratuberculosis
agccguuuggcgccgc

SEQ ID NO: 2874691 - RNA, 18 nt, Mycobacterium avium subsp. paratuberculosis
agccguuuggcgccgccc

SEQ ID NO: 2874692 - RNA, 16 nt, Mycobacterium avium subsp. paratuberculosis
agccuacggcgccggu

SEQ ID NO: 2874693 - RNA, 21 nt, Mycobacterium avium subsp. paratuberculosis
agccuaugaggcgacccccgg

SEQ ID NO: 2874694 - RNA, 13 nt, Mycobacterium avium subsp. paratuberculosis
agccucagcgcgc

SEQ ID NO: 2874695 - RNA, 15 nt, Mycobacterium avium subsp. paratuberculosis
agccucagcgcgcaa

SEQ ID NO: 2874696 - RNA, 20 nt, Mycobacterium avium subsp. paratuberculosis
agccucagggcgcgcugucg

SEQ ID NO: 2874697 - RNA, 18 nt, Mycobacterium avium subsp. paratuberculosis
agccuccgcgaucagcuc

SEQ ID NO: 2874698 - RNA, 16 nt, Mycobacterium avium subsp. paratuberculosis
agccugaccgcgggug

SEQ ID NO: 2874699 - RNA, 18 nt, Mycobacterium avium subsp. paratuberculosis
agccugaucuugcugguc

SEQ ID NO: 2874700 - RNA, 15 nt, Mycobacterium avium subsp. paratuberculosis
agccugaugccgguc

SEQ ID NO: 2874701 - RNA, 19 nt, Mycobacterium avium subsp. paratuberculosis
agccugcagugucggaauc

SEQ ID NO: 2874702 - RNA, 14 nt, Mycobacterium avium subsp. paratuberculosis
agccugcggccugc

SEQ ID NO: 2874703 - RNA, 15 nt, Mycobacterium avium subsp. paratuberculosis
agccugcggccugca

SEQ ID NO: 2874704 - RNA, 21 nt, Mycobacterium avium subsp. paratuberculosis
agccuggcacgacgccgccga

SEQ ID NO: 2874705 - RNA, 15 nt, Mycobacterium avium subsp. paratuberculosis
agccuggcggcgacc

SEQ ID NO: 2874706 - RNA, 19 nt, Mycobacterium avium subsp. paratuberculosis
agccugggauugccgggca

SEQ ID NO: 2874707 - RNA, 23 nt, Mycobacterium avium subsp. paratuberculosis
agccuguuggccagauacuccuc

SEQ ID NO: 2874708 - RNA, 23 nt, Mycobacterium avium subsp. paratuberculosis
agccuucgccgcacguguucuca

SEQ ID NO: 2874709 - RNA, 20 nt, Mycobacterium avium subsp. paratuberculosis
agccuucuucgccgcagccu

SEQ ID NO: 2874710 - RNA, 13 nt, Mycobacterium avium subsp. paratuberculosis
agccuucuugacc

SEQ ID NO: 2874711 - RNA, 16 nt, Mycobacterium avium subsp. paratuberculosis
agccuucuuggcgggc

SEQ ID NO: 2874712 - RNA, 21 nt, Mycobacterium avium subsp. paratuberculosis
agccuucuuggcgggcgccuu

SEQ ID NO: 2874713 - RNA, 15 nt, Mycobacterium avium subsp. paratuberculosis
agccuugcagccgcu

SEQ ID NO: 2874714 - RNA, 20 nt, Mycobacterium avium subsp. paratuberculosis
agccuuggccgcaggcggcc

SEQ ID NO: 2874715 - RNA, 19 nt, Mycobacterium avium subsp. paratuberculosis
agccuuggucgcggccuuc

SEQ ID NO: 2874716 - RNA, 18 nt, Mycobacterium avium subsp. paratuberculosis
agccuuugccgugcucgg

SEQ ID NO: 2874717 - RNA, 12 nt, Mycobacterium avium subsp. paratuberculosis
agcgaacccgcc

SEQ ID NO: 2874718 - RNA, 14 nt, Mycobacterium avium subsp. paratuberculosis
agcgaaccgacaua

SEQ ID NO: 2874719 - RNA, 21 nt, Mycobacterium avium subsp. paratuberculosis
agcgaacgucaggauccaguu

SEQ ID NO: 2874720 - RNA, 17 nt, Mycobacterium avium subsp. paratuberculosis
agcgaacugccggcaua

SEQ ID NO: 2874721 - RNA, 15 nt, Mycobacterium avium subsp. paratuberculosis
agcgaagcgggacug

SEQ ID NO: 2874722 - RNA, 21 nt, Mycobacterium avium subsp. paratuberculosis
agcgaagcgggacugcagcgc

SEQ ID NO: 2874723 - RNA, 14 nt, Mycobacterium avium subsp. paratuberculosis
agcgaauccgggug

SEQ ID NO: 2874724 - RNA, 21 nt, Mycobacterium avium subsp. paratuberculosis
agcgaaucgaccggguuggcg

SEQ ID NO: 2874725 - RNA, 21 nt, Mycobacterium avium subsp. paratuberculosis
agcgaauggcaauacgccucg

SEQ ID NO: 2874726 - RNA, 15 nt, Mycobacterium avium subsp. paratuberculosis
agcgacaaaggaggg

SEQ ID NO: 2874727 - RNA, 17 nt, Mycobacterium avium subsp. paratuberculosis
agcgacaaaggaggggc

SEQ ID NO: 2874728 - RNA, 21 nt, Mycobacterium avium subsp. paratuberculosis
agcgacaaaggaggggcgcgg

SEQ ID NO: 2874729 - RNA, 14 nt, Mycobacterium avium subsp. paratuberculosis
agcgacaacggccc

SEQ ID NO: 2874730 - RNA, 15 nt, Mycobacterium avium subsp. paratuberculosis
agcgacaacggcccc

SEQ ID NO: 2874731 - RNA, 14 nt, Mycobacterium avium subsp. paratuberculosis
agcgacaacguggu

SEQ ID NO: 2874732 - RNA, 18 nt, Mycobacterium avium subsp. paratuberculosis
agcgacaaucggcucgcc

SEQ ID NO: 2874733 - RNA, 22 nt, Mycobacterium avium subsp. paratuberculosis
agcgacaaucucgggcaccccu

SEQ ID NO: 2874734 - RNA, 14 nt, Mycobacterium avium subsp. paratuberculosis
agcgacagcacccg

SEQ ID NO: 2874735 - RNA, 21 nt, Mycobacterium avium subsp. paratuberculosis
agcgacagcgcgucggccagc

SEQ ID NO: 2874736 - RNA, 23 nt, Mycobacterium avium subsp. paratuberculosis
agcgacagcgcgucggccagcgc

SEQ ID NO: 2874737 - RNA, 16 nt, Mycobacterium avium subsp. paratuberculosis
agcgacagggugccga

SEQ ID NO: 2874738 - RNA, 22 nt, Mycobacterium avium subsp. paratuberculosis
agcgacauggucgggcgcacca

SEQ ID NO: 2874739 - RNA, 15 nt, Mycobacterium avium subsp. paratuberculosis
agcgaccagcgcgcc

SEQ ID NO: 2874740 - RNA, 19 nt, Mycobacterium avium subsp. paratuberculosis
agcgaccagcgcgccggcc

SEQ ID NO: 2874741 - RNA, 16 nt, Mycobacterium avium subsp. paratuberculosis
agcgaccagucggcgu

SEQ ID NO: 2874742 - RNA, 18 nt, Mycobacterium avium subsp. paratuberculosis
agcgacccgaaccggauc

SEQ ID NO: 2874743 - RNA, 20 nt, Mycobacterium avium subsp. paratuberculosis
agcgaccgcaggucgauggc

SEQ ID NO: 2874744 - RNA, 18 nt, Mycobacterium avium subsp. paratuberculosis
agcgaccugguccaccgc

SEQ ID NO: 2874745 - RNA, 23 nt, Mycobacterium avium subsp. paratuberculosis
agcgaccugguccaccgcggcgg

SEQ ID NO: 2874746 - RNA, 22 nt, Mycobacterium avium subsp. paratuberculosis
agcgacgaggugaugccgucca

SEQ ID NO: 2874747 - RNA, 21 nt, Mycobacterium avium subsp. paratuberculosis
agcgacgccagcggcagcgcc

SEQ ID NO: 2874748 - RNA, 13 nt, Mycobacterium avium subsp. paratuberculosis
agcgacgcgacgc

SEQ ID NO: 2874749 - RNA, 17 nt, Mycobacterium avium subsp. paratuberculosis
agcgacgcgacgcgcuc

SEQ ID NO: 2874750 - RNA, 20 nt, Mycobacterium avium subsp. paratuberculosis
agcgacgcggugagcgcgcc

SEQ ID NO: 2874751 - RNA, 20 nt, Mycobacterium avium subsp. paratuberculosis
agcgacggaucggccgcguc

SEQ ID NO: 2874752 - RNA, 16 nt, Mycobacterium avium subsp. paratuberculosis
agcgacggcccgccgg

SEQ ID NO: 2874753 - RNA, 13 nt, Mycobacterium avium subsp. paratuberculosis
agcgacggccggg

SEQ ID NO: 2874754 - RNA, 14 nt, Mycobacterium avium subsp. paratuberculosis
agcgacggccgggu

SEQ ID NO: 2874755 - RNA, 15 nt, Mycobacterium avium subsp. paratuberculosis
agcgacgggccgggc

SEQ ID NO: 2874756 - RNA, 17 nt, Mycobacterium avium subsp. paratuberculosis
agcgacgucaggucgac

SEQ ID NO: 2874757 - RNA, 18 nt, Mycobacterium avium subsp. paratuberculosis
agcgacgucaggucgacc

SEQ ID NO: 2874758 - RNA, 23 nt, Mycobacterium avium subsp. paratuberculosis
agcgacgucaggucgaccggcuc

SEQ ID NO: 2874759 - RNA, 16 nt, Mycobacterium avium subsp. paratuberculosis
agcgacgucugcggcu

SEQ ID NO: 2874760 - RNA, 17 nt, Mycobacterium avium subsp. paratuberculosis
agcgacgucugcggcuc

SEQ ID NO: 2874761 - RNA, 23 nt, Mycobacterium avium subsp. paratuberculosis
agcgacgucugcggcucggcgcu

SEQ ID NO: 2874762 - RNA, 15 nt, Mycobacterium avium subsp. paratuberculosis
agcgacuccagcgcg

SEQ ID NO: 2874763 - RNA, 16 nt, Mycobacterium avium subsp. paratuberculosis
agcgacuccagcgcga

SEQ ID NO: 2874764 - RNA, 15 nt, Mycobacterium avium subsp. paratuberculosis
agcgacuccugacgc

SEQ ID NO: 2874765 - RNA, 20 nt, Mycobacterium avium subsp. paratuberculosis
agcgacucgaccccgcccag

SEQ ID NO: 2874766 - RNA, 23 nt, Mycobacterium avium subsp. paratuberculosis
agcgacucgaccccgcccagcga

SEQ ID NO: 2874767 - RNA, 14 nt, Mycobacterium avium subsp. paratuberculosis
agcgacucguuggc

SEQ ID NO: 2874768 - RNA, 16 nt, Mycobacterium avium subsp. paratuberculosis
agcgacuugaccagca

SEQ ID NO: 2874769 - RNA, 18 nt, Mycobacterium avium subsp. paratuberculosis
agcgacuugaccagcagc

SEQ ID NO: 2874770 - RNA, 20 nt, Mycobacterium avium subsp. paratuberculosis
agcgacuugaccagcagcug

SEQ ID NO: 2874771 - RNA, 18 nt, Mycobacterium avium subsp. paratuberculosis
agcgacuugccgccggcg

SEQ ID NO: 2874772 - RNA, 16 nt, Mycobacterium avium subsp. paratuberculosis
agcgagaagucgccga

SEQ ID NO: 2874773 - RNA, 18 nt, Mycobacterium avium subsp. paratuberculosis
agcgagaagucgcucagc

SEQ ID NO: 2874774 - RNA, 18 nt, Mycobacterium avium subsp. paratuberculosis
agcgagaccucccggcgc

SEQ ID NO: 2874775 - RNA, 17 nt, Mycobacterium avium subsp. paratuberculosis
agcgagaugaucagccg

SEQ ID NO: 2874776 - RNA, 16 nt, Mycobacterium avium subsp. paratuberculosis
agcgagcacagcggcg

SEQ ID NO: 2874777 - RNA, 19 nt, Mycobacterium avium subsp. paratuberculosis
agcgagcaggucaccggau

SEQ ID NO: 2874778 - RNA, 13 nt, Mycobacterium avium subsp. paratuberculosis
agcgagcccagcu

SEQ ID NO: 2874779 - RNA, 17 nt, Mycobacterium avium subsp. paratuberculosis
agcgagcccagcugcgc

SEQ ID NO: 2874780 - RNA, 23 nt, Mycobacterium avium subsp. paratuberculosis
agcgagccgagacugaugguggc

SEQ ID NO: 2874781 - RNA, 14 nt, Mycobacterium avium subsp. paratuberculosis
agcgagccggcacg

SEQ ID NO: 2874782 - RNA, 19 nt, Mycobacterium avium subsp. paratuberculosis
agcgagccggcacgcgcgc

SEQ ID NO: 2874783 - RNA, 20 nt, Mycobacterium avium subsp. paratuberculosis
agcgagccggcacgcgcgcc

SEQ ID NO: 2874784 - RNA, 13 nt, Mycobacterium avium subsp. paratuberculosis
agcgagcgcuggc

SEQ ID NO: 2874785 - RNA, 21 nt, Mycobacterium avium subsp. paratuberculosis
agcgagcgggcacgccgccgc

SEQ ID NO: 2874786 - RNA, 20 nt, Mycobacterium avium subsp. paratuberculosis
agcgagcugccggcggccgc

SEQ ID NO: 2874787 - RNA, 21 nt, Mycobacterium avium subsp. paratuberculosis
agcgaggacgucgagcggcgc

SEQ ID NO: 2874788 - RNA, 16 nt, Mycobacterium avium subsp. paratuberculosis
agcgaggccucgccgc

SEQ ID NO: 2874789 - RNA, 15 nt, Mycobacterium avium subsp. paratuberculosis
agcgaggcgacgucg

SEQ ID NO: 2874790 - RNA, 18 nt, Mycobacterium avium subsp. paratuberculosis
agcgaggcgacgucgaac

SEQ ID NO: 2874791 - RNA, 20 nt, Mycobacterium avium subsp. paratuberculosis
agcgaggcgauggugcccuc

SEQ ID NO: 2874792 - RNA, 13 nt, Mycobacterium avium subsp. paratuberculosis
agcgaggcgccac

SEQ ID NO: 2874793 - RNA, 24 nt, Mycobacterium avium subsp. paratuberculosis
agcgaggcgccacaacuggucgug

SEQ ID NO: 2874794 - RNA, 15 nt, Mycobacterium avium subsp. paratuberculosis
agcgaggcgcgcagg

SEQ ID NO: 2874795 - RNA, 20 nt, Mycobacterium avium subsp. paratuberculosis
agcgaggcgcgcagguagcc

SEQ ID NO: 2874796 - RNA, 23 nt, Mycobacterium avium subsp. paratuberculosis
agcgaggggguggguccggucag

SEQ ID NO: 2874797 - RNA, 15 nt, Mycobacterium avium subsp. paratuberculosis
agcgaggucucccgg

SEQ ID NO: 2874798 - RNA, 15 nt, Mycobacterium avium subsp. paratuberculosis
agcgaggugugagga

SEQ ID NO: 2874799 - RNA, 16 nt, Mycobacterium avium subsp. paratuberculosis
agcgaggugugaggag

SEQ ID NO: 2874800 - RNA, 16 nt, Mycobacterium avium subsp. paratuberculosis
agcgaguccagccagc

SEQ ID NO: 2874801 - RNA, 18 nt, Mycobacterium avium subsp. paratuberculosis
agcgagucgaaggcgcgg

SEQ ID NO: 2874802 - RNA, 22 nt, Mycobacterium avium subsp. paratuberculosis
agcgagucgagaaacgcgcgca

SEQ ID NO: 2874803 - RNA, 12 nt, Mycobacterium avium subsp. paratuberculosis
agcgagucgaug

SEQ ID NO: 2874804 - RNA, 16 nt, Mycobacterium avium subsp. paratuberculosis
agcgagucgaugaccu

SEQ ID NO: 2874805 - RNA, 11 nt, Mycobacterium avium subsp. paratuberculosis
agcgagucggc

SEQ ID NO: 2874806 - RNA, 17 nt, Mycobacterium avium subsp. paratuberculosis
agcgagucggcgaaggc

SEQ ID NO: 2874807 - RNA, 16 nt, Mycobacterium avium subsp. paratuberculosis
agcgagugccggccag

SEQ ID NO: 2874808 - RNA, 17 nt, Mycobacterium avium subsp. paratuberculosis
agcgagugccggccagc

SEQ ID NO: 2874809 - RNA, 21 nt, Mycobacterium avium subsp. paratuberculosis
agcgagugccggccagcucgc

SEQ ID NO: 2874810 - RNA, 13 nt, Mycobacterium avium subsp. paratuberculosis
agcgaguggguga

SEQ ID NO: 2874811 - RNA, 18 nt, Mycobacterium avium subsp. paratuberculosis
agcgagugguaccgggug

SEQ ID NO: 2874812 - RNA, 21 nt, Mycobacterium avium subsp. paratuberculosis
agcgagugguaccggguggcc

SEQ ID NO: 2874813 - RNA, 19 nt, Mycobacterium avium subsp. paratuberculosis
agcgauacccguugcgccc

SEQ ID NO: 2874814 - RNA, 13 nt, Mycobacterium avium subsp. paratuberculosis
agcgaucggcggc

SEQ ID NO: 2874815 - RNA, 17 nt, Mycobacterium avium subsp. paratuberculosis
agcgaucggugaacccg

SEQ ID NO: 2874816 - RNA, 22 nt, Mycobacterium avium subsp. paratuberculosis
agcgaugggcgcgaucaggcug

SEQ ID NO: 2874817 - RNA, 17 nt, Mycobacterium avium subsp. paratuberculosis
agcgauuacgaccaguu

SEQ ID NO: 2874818 - RNA, 14 nt, Mycobacterium avium subsp. paratuberculosis
agcgauugcggccg

SEQ ID NO: 2874819 - RNA, 15 nt, Mycobacterium avium subsp. paratuberculosis
agcgauugcggccgc

SEQ ID NO: 2874820 - RNA, 19 nt, Mycobacterium avium subsp. paratuberculosis
agcgauugcggccgccggc

SEQ ID NO: 2874821 - RNA, 21 nt, Mycobacterium avium subsp. paratuberculosis
agcgauugcggccgccggcca

SEQ ID NO: 2874822 - RNA, 13 nt, Mycobacterium avium subsp. paratuberculosis
agcgcaacaccga

SEQ ID NO: 2874823 - RNA, 16 nt, Mycobacterium avium subsp. paratuberculosis
agcgcaaccgcggcgg

SEQ ID NO: 2874824 - RNA, 17 nt, Mycobacterium avium subsp. paratuberculosis
agcgcaaccgcggcggc

SEQ ID NO: 2874825 - RNA, 15 nt, Mycobacterium avium subsp. paratuberculosis
agcgcacacagcagc

SEQ ID NO: 2874826 - RNA, 16 nt, Mycobacterium avium subsp. paratuberculosis
agcgcacacagcagca

SEQ ID NO: 2874827 - RNA, 19 nt, Mycobacterium avium subsp. paratuberculosis
agcgcaccagauucaccag

SEQ ID NO: 2874828 - RNA, 15 nt, Mycobacterium avium subsp. paratuberculosis
agcgcaccgagcccg

SEQ ID NO: 2874829 - RNA, 15 nt, Mycobacterium avium subsp. paratuberculosis
agcgcaccggcgaug

SEQ ID NO: 2874830 - RNA, 22 nt, Mycobacterium avium subsp. paratuberculosis
agcgcaccgggcccgcccgcag

SEQ ID NO: 2874831 - RNA, 15 nt, Mycobacterium avium subsp. paratuberculosis
agcgcaccggucagc

SEQ ID NO: 2874832 - RNA, 16 nt, Mycobacterium avium subsp. paratuberculosis
agcgcacgucgccgcc

SEQ ID NO: 2874833 - RNA, 17 nt, Mycobacterium avium subsp. paratuberculosis
agcgcagaucgcgcauc

SEQ ID NO: 2874834 - RNA, 20 nt, Mycobacterium avium subsp. paratuberculosis
agcgcagaucgcgcaucacc

SEQ ID NO: 2874835 - RNA, 15 nt, Mycobacterium avium subsp. paratuberculosis
agcgcagcaccaggc

SEQ ID NO: 2874836 - RNA, 16 nt, Mycobacterium avium subsp. paratuberculosis
agcgcagcaccuccga

SEQ ID NO: 2874837 - RNA, 20 nt, Mycobacterium avium subsp. paratuberculosis
agcgcagcacugagcggcag

SEQ ID NO: 2874838 - RNA, 22 nt, Mycobacterium avium subsp. paratuberculosis
agcgcagcagguaaaccagcag

SEQ ID NO: 2874839 - RNA, 14 nt, Mycobacterium avium subsp. paratuberculosis
agcgcagcaucacg

SEQ ID NO: 2874840 - RNA, 17 nt, Mycobacterium avium subsp. paratuberculosis
agcgcagcaucacgucg

SEQ ID NO: 2874841 - RNA, 16 nt, Mycobacterium avium subsp. paratuberculosis
agcgcagcaucuccga

SEQ ID NO: 2874842 - RNA, 12 nt, Mycobacterium avium subsp. paratuberculosis
agcgcagcgcca

SEQ ID NO: 2874843 - RNA, 16 nt, Mycobacterium avium subsp. paratuberculosis
agcgcagcgccaggca

SEQ ID NO: 2874844 - RNA, 20 nt, Mycobacterium avium subsp. paratuberculosis
agcgcagcgccucggcggcc

SEQ ID NO: 2874845 - RNA, 23 nt, Mycobacterium avium subsp. paratuberculosis
agcgcagcgccucggcggccccu

SEQ ID NO: 2874846 - RNA, 22 nt, Mycobacterium avium subsp. paratuberculosis
agcgcagcggggaggcccagcc

SEQ ID NO: 2874847 - RNA, 12 nt, Mycobacterium avium subsp. paratuberculosis
agcgcaggccgu

SEQ ID NO: 2874848 - RNA, 13 nt, Mycobacterium avium subsp. paratuberculosis
agcgcaucagcuc

SEQ ID NO: 2874849 - RNA, 20 nt, Mycobacterium avium subsp. paratuberculosis
agcgcauccgacaccgccuu

SEQ ID NO: 2874850 - RNA, 23 nt, Mycobacterium avium subsp. paratuberculosis
agcgcauccucauagccggccgc

SEQ ID NO: 2874851 - RNA, 18 nt, Mycobacterium avium subsp. paratuberculosis
agcgcaucgacugcgaca

SEQ ID NO: 2874852 - RNA, 23 nt, Mycobacterium avium subsp. paratuberculosis
agcgcaucgacugcgacacccgc

SEQ ID NO: 2874853 - RNA, 14 nt, Mycobacterium avium subsp. paratuberculosis
agcgcaucgccggc

SEQ ID NO: 2874854 - RNA, 15 nt, Mycobacterium avium subsp. paratuberculosis
agcgcaucgccggcg

SEQ ID NO: 2874855 - RNA, 16 nt, Mycobacterium avium subsp. paratuberculosis
agcgcaucgccggcga

SEQ ID NO: 2874856 - RNA, 16 nt, Mycobacterium avium subsp. paratuberculosis
agcgcaucgccggcgc

SEQ ID NO: 2874857 - RNA, 21 nt, Mycobacterium avium subsp. paratuberculosis
agcgcaucgccggcgcgcuga

SEQ ID NO: 2874858 - RNA, 16 nt, Mycobacterium avium subsp. paratuberculosis
agcgcaugaugcccag

SEQ ID NO: 2874859 - RNA, 19 nt, Mycobacterium avium subsp. paratuberculosis
agcgcaugaugcccaggcc

SEQ ID NO: 2874860 - RNA, 22 nt, Mycobacterium avium subsp. paratuberculosis
agcgcaugccgaacaacagggc

SEQ ID NO: 2874861 - RNA, 17 nt, Mycobacterium avium subsp. paratuberculosis
agcgcauguaggacacc

SEQ ID NO: 2874862 - RNA, 21 nt, Mycobacterium avium subsp. paratuberculosis
agcgcauguaggacaccccgg

SEQ ID NO: 2874863 - RNA, 14 nt, Mycobacterium avium subsp. paratuberculosis
agcgccaacauggc

SEQ ID NO: 2874864 - RNA, 14 nt, Mycobacterium avium subsp. paratuberculosis
agcgccacaucagc

SEQ ID NO: 2874865 - RNA, 16 nt, Mycobacterium avium subsp. paratuberculosis
agcgccaccagcaccg

SEQ ID NO: 2874866 - RNA, 18 nt, Mycobacterium avium subsp. paratuberculosis
agcgccaccagcaccggg

SEQ ID NO: 2874867 - RNA, 13 nt, Mycobacterium avium subsp. paratuberculosis
agcgccacccccc

SEQ ID NO: 2874868 - RNA, 23 nt, Mycobacterium avium subsp. paratuberculosis
agcgccaccccccaguuucccgu

SEQ ID NO: 2874869 - RNA, 13 nt, Mycobacterium avium subsp. paratuberculosis
agcgccaccccga

SEQ ID NO: 2874870 - RNA, 16 nt, Mycobacterium avium subsp. paratuberculosis
agcgccaccccgaacc

SEQ ID NO: 2874871 - RNA, 17 nt, Mycobacterium avium subsp. paratuberculosis
agcgccacggggcgccg

SEQ ID NO: 2874872 - RNA, 14 nt, Mycobacterium avium subsp. paratuberculosis
agcgccagcaccgc

SEQ ID NO: 2874873 - RNA, 23 nt, Mycobacterium avium subsp. paratuberculosis
agcgccagcaccgggcccagcuc

SEQ ID NO: 2874874 - RNA, 18 nt, Mycobacterium avium subsp. paratuberculosis
agcgccagcacggccacc

SEQ ID NO: 2874875 - RNA, 21 nt, Mycobacterium avium subsp. paratuberculosis
agcgccagcacggccaccagc

SEQ ID NO: 2874876 - RNA, 18 nt, Mycobacterium avium subsp. paratuberculosis
agcgccagcagcggcacc

SEQ ID NO: 2874877 - RNA, 22 nt, Mycobacterium avium subsp. paratuberculosis
agcgccagcagcggcacccggu

SEQ ID NO: 2874878 - RNA, 14 nt, Mycobacterium avium subsp. paratuberculosis
agcgccagcaugcc

SEQ ID NO: 2874879 - RNA, 21 nt, Mycobacterium avium subsp. paratuberculosis
agcgccagcgagugggugaag

SEQ ID NO: 2874880 - RNA, 15 nt, Mycobacterium avium subsp. paratuberculosis
agcgccagcgcggug

SEQ ID NO: 2874881 - RNA, 17 nt, Mycobacterium avium subsp. paratuberculosis
agcgccagcgcggugcc

SEQ ID NO: 2874882 - RNA, 20 nt, Mycobacterium avium subsp. paratuberculosis
agcgccagcgcggugcccag

SEQ ID NO: 2874883 - RNA, 22 nt, Mycobacterium avium subsp. paratuberculosis
agcgccagcggcuugccguugu

SEQ ID NO: 2874884 - RNA, 15 nt, Mycobacterium avium subsp. paratuberculosis
agcgccagcgggaua

SEQ ID NO: 2874885 - RNA, 16 nt, Mycobacterium avium subsp. paratuberculosis
agcgccagcgggauac

SEQ ID NO: 2874886 - RNA, 22 nt, Mycobacterium avium subsp. paratuberculosis
agcgccagcgggauacccauga

SEQ ID NO: 2874887 - RNA, 15 nt, Mycobacterium avium subsp. paratuberculosis
agcgccagcguggcc

SEQ ID NO: 2874888 - RNA, 16 nt, Mycobacterium avium subsp. paratuberculosis
agcgccagcguggcca

SEQ ID NO: 2874889 - RNA, 21 nt, Mycobacterium avium subsp. paratuberculosis
agcgccagcguggccagcacc

SEQ ID NO: 2874890 - RNA, 22 nt, Mycobacterium avium subsp. paratuberculosis
agcgccagcguggccagcaccg

SEQ ID NO: 2874891 - RNA, 17 nt, Mycobacterium avium subsp. paratuberculosis
agcgccaggcagaagcu

SEQ ID NO: 2874892 - RNA, 23 nt, Mycobacterium avium subsp. paratuberculosis
agcgccaggcagaagcuccacgc

SEQ ID NO: 2874893 - RNA, 22 nt, Mycobacterium avium subsp. paratuberculosis
agcgccagggucuggcccggug

SEQ ID NO: 2874894 - RNA, 17 nt, Mycobacterium avium subsp. paratuberculosis
agcgccagggugccccg

SEQ ID NO: 2874895 - RNA, 17 nt, Mycobacterium avium subsp. paratuberculosis
agcgccaggugggugaa

SEQ ID NO: 2874896 - RNA, 21 nt, Mycobacterium avium subsp. paratuberculosis
agcgccaggugggugaacgcc

SEQ ID NO: 2874897 - RNA, 15 nt, Mycobacterium avium subsp. paratuberculosis
agcgccagucgcggc

SEQ ID NO: 2874898 - RNA, 17 nt, Mycobacterium avium subsp. paratuberculosis
agcgccagucgcggcga

SEQ ID NO: 2874899 - RNA, 22 nt, Mycobacterium avium subsp. paratuberculosis
agcgccauccgccgguucgucg

SEQ ID NO: 2874900 - RNA, 15 nt, Mycobacterium avium subsp. paratuberculosis
agcgccaugccgccg

SEQ ID NO: 2874901 - RNA, 17 nt, Mycobacterium avium subsp. paratuberculosis
agcgccaugccgccgac

SEQ ID NO: 2874902 - RNA, 12 nt, Mycobacterium avium subsp. paratuberculosis
agcgcccagccg

SEQ ID NO: 2874903 - RNA, 13 nt, Mycobacterium avium subsp. paratuberculosis
agcgcccagccga

SEQ ID NO: 2874904 - RNA, 16 nt, Mycobacterium avium subsp. paratuberculosis
agcgcccagccgagcc

SEQ ID NO: 2874905 - RNA, 19 nt, Mycobacterium avium subsp. paratuberculosis
agcgcccagccgagccggg

SEQ ID NO: 2874906 - RNA, 15 nt, Mycobacterium avium subsp. paratuberculosis
agcgcccaggaugac

SEQ ID NO: 2874907 - RNA, 20 nt, Mycobacterium avium subsp. paratuberculosis
agcgcccaggcgugcgcgug

SEQ ID NO: 2874908 - RNA, 17 nt, Mycobacterium avium subsp. paratuberculosis
agcgcccccgacaggcc

SEQ ID NO: 2874909 - RNA, 20 nt, Mycobacterium avium subsp. paratuberculosis
agcgccccgaaguucgacac

SEQ ID NO: 2874910 - RNA, 18 nt, Mycobacterium avium subsp. paratuberculosis
agcgccccgguccggcug

SEQ ID NO: 2874911 - RNA, 18 nt, Mycobacterium avium subsp. paratuberculosis
agcgcccgauuccccggc

SEQ ID NO: 2874912 - RNA, 19 nt, Mycobacterium avium subsp. paratuberculosis
agcgcccgauuccccggcg

SEQ ID NO: 2874913 - RNA, 20 nt, Mycobacterium avium subsp. paratuberculosis
agcgcccgauuccccggcgu

SEQ ID NO: 2874914 - RNA, 23 nt, Mycobacterium avium subsp. paratuberculosis
agcgcccgauuccccggcguguc

SEQ ID NO: 2874915 - RNA, 13 nt, Mycobacterium avium subsp. paratuberculosis
agcgcccgcccgg

SEQ ID NO: 2874916 - RNA, 14 nt, Mycobacterium avium subsp. paratuberculosis
agcgcccgcccgga

SEQ ID NO: 2874917 - RNA, 17 nt, Mycobacterium avium subsp. paratuberculosis
agcgcccgcccggcccg

SEQ ID NO: 2874918 - RNA, 21 nt, Mycobacterium avium subsp. paratuberculosis
agcgcccgcccggcccggcgc

SEQ ID NO: 2874919 - RNA, 13 nt, Mycobacterium avium subsp. paratuberculosis
agcgcccgcgcga

SEQ ID NO: 2874920 - RNA, 16 nt, Mycobacterium avium subsp. paratuberculosis
agcgcccgcgcgggcu

SEQ ID NO: 2874921 - RNA, 14 nt, Mycobacterium avium subsp. paratuberculosis
agcgcccgcgcgug

SEQ ID NO: 2874922 - RNA, 16 nt, Mycobacterium avium subsp. paratuberculosis
agcgcccgcgcguggg

SEQ ID NO: 2874923 - RNA, 20 nt, Mycobacterium avium subsp. paratuberculosis
agcgcccgcgcgugggccaa

SEQ ID NO: 2874924 - RNA, 23 nt, Mycobacterium avium subsp. paratuberculosis
agcgcccggaugucgggcgaggu

SEQ ID NO: 2874925 - RNA, 16 nt, Mycobacterium avium subsp. paratuberculosis
agcgcccggcagcggu

SEQ ID NO: 2874926 - RNA, 16 nt, Mycobacterium avium subsp. paratuberculosis
agcgcccggccagccg

SEQ ID NO: 2874927 - RNA, 13 nt, Mycobacterium avium subsp. paratuberculosis
agcgcccggccgu

SEQ ID NO: 2874928 - RNA, 15 nt, Mycobacterium avium subsp. paratuberculosis
agcgcccggccguga

SEQ ID NO: 2874929 - RNA, 14 nt, Mycobacterium avium subsp. paratuberculosis
agcgcccggcgacc

SEQ ID NO: 2874930 - RNA, 22 nt, Mycobacterium avium subsp. paratuberculosis
agcgcccggcgaccaccagccg

SEQ ID NO: 2874931 - RNA, 23 nt, Mycobacterium avium subsp. paratuberculosis
agcgcccgggcgcgugcacaccg

SEQ ID NO: 2874932 - RNA, 21 nt, Mycobacterium avium subsp. paratuberculosis
agcgcccgggcguucccgcgc

SEQ ID NO: 2874933 - RNA, 22 nt, Mycobacterium avium subsp. paratuberculosis
agcgcccgggcguucccgcgcg

SEQ ID NO: 2874934 - RNA, 18 nt, Mycobacterium avium subsp. paratuberculosis
agcgcccggucgaggucg

SEQ ID NO: 2874935 - RNA, 17 nt, Mycobacterium avium subsp. paratuberculosis
agcgccgagaccagcca

SEQ ID NO: 2874936 - RNA, 21 nt, Mycobacterium avium subsp. paratuberculosis
agcgccgagaucgcgguggcg

SEQ ID NO: 2874937 - RNA, 16 nt, Mycobacterium avium subsp. paratuberculosis
agcgccgagcacggcu

SEQ ID NO: 2874938 - RNA, 15 nt, Mycobacterium avium subsp. paratuberculosis
agcgccgaggccagc

SEQ ID NO: 2874939 - RNA, 16 nt, Mycobacterium avium subsp. paratuberculosis
agcgccgaggccagca

SEQ ID NO: 2874940 - RNA, 19 nt, Mycobacterium avium subsp. paratuberculosis
agcgccgaggugcugucgu

SEQ ID NO: 2874941 - RNA, 13 nt, Mycobacterium avium subsp. paratuberculosis
agcgccgcaugcc

SEQ ID NO: 2874942 - RNA, 22 nt, Mycobacterium avium subsp. paratuberculosis
agcgccgcaugcccuugucgcu

SEQ ID NO: 2874943 - RNA, 14 nt, Mycobacterium avium subsp. paratuberculosis
agcgccgccaccgg

SEQ ID NO: 2874944 - RNA, 16 nt, Mycobacterium avium subsp. paratuberculosis
agcgccgccaccggcc

SEQ ID NO: 2874945 - RNA, 19 nt, Mycobacterium avium subsp. paratuberculosis
agcgccgccacggccaccg

SEQ ID NO: 2874946 - RNA, 22 nt, Mycobacterium avium subsp. paratuberculosis
agcgccgccacggccaccgccg

SEQ ID NO: 2874947 - RNA, 11 nt, Mycobacterium avium subsp. paratuberculosis
agcgccgccag

SEQ ID NO: 2874948 - RNA, 14 nt, Mycobacterium avium subsp. paratuberculosis
agcgccgccagccg

SEQ ID NO: 2874949 - RNA, 15 nt, Mycobacterium avium subsp. paratuberculosis
agcgccgccagccgc

SEQ ID NO: 2874950 - RNA, 16 nt, Mycobacterium avium subsp. paratuberculosis
agcgccgccagccgca

SEQ ID NO: 2874951 - RNA, 17 nt, Mycobacterium avium subsp. paratuberculosis
agcgccgccagccgcag

SEQ ID NO: 2874952 - RNA, 19 nt, Mycobacterium avium subsp. paratuberculosis
agcgccgccagccgcagca

SEQ ID NO: 2874953 - RNA, 14 nt, Mycobacterium avium subsp. paratuberculosis
agcgccgccaucgc

SEQ ID NO: 2874954 - RNA, 15 nt, Mycobacterium avium subsp. paratuberculosis
agcgccgcccgcacc

SEQ ID NO: 2874955 - RNA, 19 nt, Mycobacterium avium subsp. paratuberculosis
agcgccgcccgggcggccc

SEQ ID NO: 2874956 - RNA, 17 nt, Mycobacterium avium subsp. paratuberculosis
agcgccgcccguccagc

SEQ ID NO: 2874957 - RNA, 19 nt, Mycobacterium avium subsp. paratuberculosis
agcgccgcccguccagcgc

SEQ ID NO: 2874958 - RNA, 21 nt, Mycobacterium avium subsp. paratuberculosis
agcgccgcccguccagcgcau

SEQ ID NO: 2874959 - RNA, 20 nt, Mycobacterium avium subsp. paratuberculosis
agcgccgcgcgcgcggccuc

SEQ ID NO: 2874960 - RNA, 15 nt, Mycobacterium avium subsp. paratuberculosis
agcgccgcggccagc

SEQ ID NO: 2874961 - RNA, 18 nt, Mycobacterium avium subsp. paratuberculosis
agcgccgcggccagccgg

SEQ ID NO: 2874962 - RNA, 19 nt, Mycobacterium avium subsp. paratuberculosis
agcgccgcggccggugcca

SEQ ID NO: 2874963 - RNA, 22 nt, Mycobacterium avium subsp. paratuberculosis
agcgccgcggcgaaaacgccug

SEQ ID NO: 2874964 - RNA, 18 nt, Mycobacterium avium subsp. paratuberculosis
agcgccgcguugucggcg

SEQ ID NO: 2874965 - RNA, 22 nt, Mycobacterium avium subsp. paratuberculosis
agcgccgcguugucggcguccu

SEQ ID NO: 2874966 - RNA, 13 nt, Mycobacterium avium subsp. paratuberculosis
agcgccgcucggc

SEQ ID NO: 2874967 - RNA, 15 nt, Mycobacterium avium subsp. paratuberculosis
agcgccgcuucgucg

SEQ ID NO: 2874968 - RNA, 20 nt, Mycobacterium avium subsp. paratuberculosis
agcgccgcuucgucgccggc

SEQ ID NO: 2874969 - RNA, 22 nt, Mycobacterium avium subsp. paratuberculosis
agcgccggacucgaagaucgcc

SEQ ID NO: 2874970 - RNA, 16 nt, Mycobacterium avium subsp. paratuberculosis
agcgccggcaccagca

SEQ ID NO: 2874971 - RNA, 17 nt, Mycobacterium avium subsp. paratuberculosis
agcgccggcaccagcag

SEQ ID NO: 2874972 - RNA, 19 nt, Mycobacterium avium subsp. paratuberculosis
agcgccggcaccagcagcc

SEQ ID NO: 2874973 - RNA, 21 nt, Mycobacterium avium subsp. paratuberculosis
agcgccggcaccagcagccgc

SEQ ID NO: 2874974 - RNA, 22 nt, Mycobacterium avium subsp. paratuberculosis
agcgccggcaccagcagccgca

SEQ ID NO: 2874975 - RNA, 20 nt, Mycobacterium avium subsp. paratuberculosis
agcgccggcagcaaccggcg

SEQ ID NO: 2874976 - RNA, 23 nt, Mycobacterium avium subsp. paratuberculosis
agcgccggcagcaaccggcggcu

SEQ ID NO: 2874977 - RNA, 15 nt, Mycobacterium avium subsp. paratuberculosis
agcgccggcagcgcc

SEQ ID NO: 2874978 - RNA, 17 nt, Mycobacterium avium subsp. paratuberculosis
agcgccggcagcgccuc

SEQ ID NO: 2874979 - RNA, 12 nt, Mycobacterium avium subsp. paratuberculosis
agcgccggggcg

SEQ ID NO: 2874980 - RNA, 17 nt, Mycobacterium avium subsp. paratuberculosis
agcgccggguugcaggc

SEQ ID NO: 2874981 - RNA, 20 nt, Mycobacterium avium subsp. paratuberculosis
agcgccgguaggccgcgccg

SEQ ID NO: 2874982 - RNA, 21 nt, Mycobacterium avium subsp. paratuberculosis
agcgccgguaggccgcgccga

SEQ ID NO: 2874983 - RNA, 19 nt, Mycobacterium avium subsp. paratuberculosis
agcgccgucaucaccgccg

SEQ ID NO: 2874984 - RNA, 22 nt, Mycobacterium avium subsp. paratuberculosis
agcgccgucuccucgaccagcg

SEQ ID NO: 2874985 - RNA, 15 nt, Mycobacterium avium subsp. paratuberculosis
agcgccgucucgacc

SEQ ID NO: 2874986 - RNA, 13 nt, Mycobacterium avium subsp. paratuberculosis
agcgccuccagcc

SEQ ID NO: 2874987 - RNA, 17 nt, Mycobacterium avium subsp. paratuberculosis
agcgccuccagccgcuc

SEQ ID NO: 2874988 - RNA, 20 nt, Mycobacterium avium subsp. paratuberculosis
agcgccuccagccgcuccuc

SEQ ID NO: 2874989 - RNA, 22 nt, Mycobacterium avium subsp. paratuberculosis
agcgccucccggaccaccagga

SEQ ID NO: 2874990 - RNA, 23 nt, Mycobacterium avium subsp. paratuberculosis
agcgccucgagcaacggccgcag

SEQ ID NO: 2874991 - RNA, 14 nt, Mycobacterium avium subsp. paratuberculosis
agcgccucgagcac

SEQ ID NO: 2874992 - RNA, 17 nt, Mycobacterium avium subsp. paratuberculosis
agcgccucgagcaccac

SEQ ID NO: 2874993 - RNA, 20 nt, Mycobacterium avium subsp. paratuberculosis
agcgccucgagcaccacggc

SEQ ID NO: 2874994 - RNA, 22 nt, Mycobacterium avium subsp. paratuberculosis
agcgccucgagcaccacggccc

SEQ ID NO: 2874995 - RNA, 19 nt, Mycobacterium avium subsp. paratuberculosis
agcgccucgccgggcccgc

SEQ ID NO: 2874996 - RNA, 15 nt, Mycobacterium avium subsp. paratuberculosis
agcgccucgcgggug

SEQ ID NO: 2874997 - RNA, 16 nt, Mycobacterium avium subsp. paratuberculosis
agcgccucggccucgu

SEQ ID NO: 2874998 - RNA, 20 nt, Mycobacterium avium subsp. paratuberculosis
agcgccucggccucgucgac

SEQ ID NO: 2874999 - RNA, 22 nt, Mycobacterium avium subsp. paratuberculosis
agcgccucggccucgucgacgu

SEQ ID NO: 2875000 - RNA, 23 nt, Mycobacterium avium subsp. paratuberculosis
agcgccucggccucgucgacguc

SEQ ID NO: 2875001 - RNA, 21 nt, Mycobacterium avium subsp. paratuberculosis
agcgccucggccugcgcccgg

SEQ ID NO: 2875002 - RNA, 22 nt, Mycobacterium avium subsp. paratuberculosis
agcgccucggcgaucggccgcu

SEQ ID NO: 2875003 - RNA, 16 nt, Mycobacterium avium subsp. paratuberculosis
agcgccucggcgucac

SEQ ID NO: 2875004 - RNA, 19 nt, Mycobacterium avium subsp. paratuberculosis
agcgccucggcgucaccgc

SEQ ID NO: 2875005 - RNA, 23 nt, Mycobacterium avium subsp. paratuberculosis
agcgccucggcgucaccgcgggu

SEQ ID NO: 2875006 - RNA, 22 nt, Mycobacterium avium subsp. paratuberculosis
agcgccucggcguggcaggcga

SEQ ID NO: 2875007 - RNA, 20 nt, Mycobacterium avium subsp. paratuberculosis
agcgccucggugaagccgcg

SEQ ID NO: 2875008 - RNA, 15 nt, Mycobacterium avium subsp. paratuberculosis
agcgccucgucgagc

SEQ ID NO: 2875009 - RNA, 21 nt, Mycobacterium avium subsp. paratuberculosis
agcgccucgucgagccgggcc

SEQ ID NO: 2875010 - RNA, 18 nt, Mycobacterium avium subsp. paratuberculosis
agcgccugguccucccgg

SEQ ID NO: 2875011 - RNA, 21 nt, Mycobacterium avium subsp. paratuberculosis
agcgccugguccucccgggug

SEQ ID NO: 2875012 - RNA, 20 nt, Mycobacterium avium subsp. paratuberculosis
agcgccuucggcgccagccc

SEQ ID NO: 2875013 - RNA, 21 nt, Mycobacterium avium subsp. paratuberculosis
agcgccuucggcgccagcccg

SEQ ID NO: 2875014 - RNA, 16 nt, Mycobacterium avium subsp. paratuberculosis
agcgccuugccgacga

SEQ ID NO: 2875015 - RNA, 21 nt, Mycobacterium avium subsp. paratuberculosis
agcgccuugccgacgacgucg

SEQ ID NO: 2875016 - RNA, 22 nt, Mycobacterium avium subsp. paratuberculosis
agcgccuugccgacgacgucgu

SEQ ID NO: 2875017 - RNA, 19 nt, Mycobacterium avium subsp. paratuberculosis
agcgccuugggucccaucg

SEQ ID NO: 2875018 - RNA, 23 nt, Mycobacterium avium subsp. paratuberculosis
agcgcgaaauacgacgagccgac

SEQ ID NO: 2875019 - RNA, 17 nt, Mycobacterium avium subsp. paratuberculosis
agcgcgaacaaucgcug

SEQ ID NO: 2875020 - RNA, 18 nt, Mycobacterium avium subsp. paratuberculosis
agcgcgaacaaucgcugc

SEQ ID NO: 2875021 - RNA, 14 nt, Mycobacterium avium subsp. paratuberculosis
agcgcgaacagcgc

SEQ ID NO: 2875022 - RNA, 17 nt, Mycobacterium avium subsp. paratuberculosis
agcgcgaacagcgcggc

SEQ ID NO: 2875023 - RNA, 18 nt, Mycobacterium avium subsp. paratuberculosis
agcgcgaacagcgcggcc

SEQ ID NO: 2875024 - RNA, 20 nt, Mycobacterium avium subsp. paratuberculosis
agcgcgaacagcgcggccac

SEQ ID NO: 2875025 - RNA, 15 nt, Mycobacterium avium subsp. paratuberculosis
agcgcgacaccggac

SEQ ID NO: 2875026 - RNA, 14 nt, Mycobacterium avium subsp. paratuberculosis
agcgcgacaucgcc

SEQ ID NO: 2875027 - RNA, 18 nt, Mycobacterium avium subsp. paratuberculosis
agcgcgacaucgccggcg

SEQ ID NO: 2875028 - RNA, 19 nt, Mycobacterium avium subsp. paratuberculosis
agcgcgacaucgccggcga

SEQ ID NO: 2875029 - RNA, 15 nt, Mycobacterium avium subsp. paratuberculosis
agcgcgaccagcccg

SEQ ID NO: 2875030 - RNA, 12 nt, Mycobacterium avium subsp. paratuberculosis
agcgcgaccagu

SEQ ID NO: 2875031 - RNA, 20 nt, Mycobacterium avium subsp. paratuberculosis
agcgcgacccgcucgacgcg

SEQ ID NO: 2875032 - RNA, 17 nt, Mycobacterium avium subsp. paratuberculosis
agcgcgacgaacagcac

SEQ ID NO: 2875033 - RNA, 23 nt, Mycobacterium avium subsp. paratuberculosis
agcgcgacgaacagcaccgccac

SEQ ID NO: 2875034 - RNA, 15 nt, Mycobacterium avium subsp. paratuberculosis
agcgcgacgcacgcc

SEQ ID NO: 2875035 - RNA, 18 nt, Mycobacterium avium subsp. paratuberculosis
agcgcgacgcacgccggc

SEQ ID NO: 2875036 - RNA, 19 nt, Mycobacterium avium subsp. paratuberculosis
agcgcgacgccgacgccca

SEQ ID NO: 2875037 - RNA, 13 nt, Mycobacterium avium subsp. paratuberculosis
agcgcgacgggcu

SEQ ID NO: 2875038 - RNA, 17 nt, Mycobacterium avium subsp. paratuberculosis
agcgcgacgggcugcug

SEQ ID NO: 2875039 - RNA, 22 nt, Mycobacterium avium subsp. paratuberculosis
agcgcgacgggcugcugcacgu

SEQ ID NO: 2875040 - RNA, 18 nt, Mycobacterium avium subsp. paratuberculosis
agcgcgacgugccggcga

SEQ ID NO: 2875041 - RNA, 22 nt, Mycobacterium avium subsp. paratuberculosis
agcgcgacugggugcucccgcc

SEQ ID NO: 2875042 - RNA, 14 nt, Mycobacterium avium subsp. paratuberculosis
agcgcgaggucgac

SEQ ID NO: 2875043 - RNA, 16 nt, Mycobacterium avium subsp. paratuberculosis
agcgcgaggucgacgg

SEQ ID NO: 2875044 - RNA, 22 nt, Mycobacterium avium subsp. paratuberculosis
agcgcgauccggggggcggggu

SEQ ID NO: 2875045 - RNA, 16 nt, Mycobacterium avium subsp. paratuberculosis
agcgcgaucgccggga

SEQ ID NO: 2875046 - RNA, 16 nt, Mycobacterium avium subsp. paratuberculosis
agcgcgaugccggcca

SEQ ID NO: 2875047 - RNA, 21 nt, Mycobacterium avium subsp. paratuberculosis
agcgcgcacaauucggucagc

SEQ ID NO: 2875048 - RNA, 14 nt, Mycobacterium avium subsp. paratuberculosis
agcgcgcacagcgc

SEQ ID NO: 2875049 - RNA, 16 nt, Mycobacterium avium subsp. paratuberculosis
agcgcgcacagcgcca

SEQ ID NO: 2875050 - RNA, 22 nt, Mycobacterium avium subsp. paratuberculosis
agcgcgcacagcgccacaccga

SEQ ID NO: 2875051 - RNA, 19 nt, Mycobacterium avium subsp. paratuberculosis
agcgcgcagaacaccaccg

SEQ ID NO: 2875052 - RNA, 17 nt, Mycobacterium avium subsp. paratuberculosis
agcgcgcaucgcgggcc

SEQ ID NO: 2875053 - RNA, 15 nt, Mycobacterium avium subsp. paratuberculosis
agcgcgcccaggccc

SEQ ID NO: 2875054 - RNA, 21 nt, Mycobacterium avium subsp. paratuberculosis
agcgcgcccaggcugaacacc

SEQ ID NO: 2875055 - RNA, 12 nt, Mycobacterium avium subsp. paratuberculosis
agcgcgccccag

SEQ ID NO: 2875056 - RNA, 21 nt, Mycobacterium avium subsp. paratuberculosis
agcgcgcccugaggcccggug

SEQ ID NO: 2875057 - RNA, 15 nt, Mycobacterium avium subsp. paratuberculosis
agcgcgccgagcagc

SEQ ID NO: 2875058 - RNA, 16 nt, Mycobacterium avium subsp. paratuberculosis
agcgcgccgagcagcu

SEQ ID NO: 2875059 - RNA, 18 nt, Mycobacterium avium subsp. paratuberculosis
agcgcgccgagcagcugg

SEQ ID NO: 2875060 - RNA, 21 nt, Mycobacterium avium subsp. paratuberculosis
agcgcgccgagguggcccgcc

SEQ ID NO: 2875061 - RNA, 14 nt, Mycobacterium avium subsp. paratuberculosis
agcgcgccgcccag

SEQ ID NO: 2875062 - RNA, 16 nt, Mycobacterium avium subsp. paratuberculosis
agcgcgccgcccagcg

SEQ ID NO: 2875063 - RNA, 19 nt, Mycobacterium avium subsp. paratuberculosis
agcgcgccgcccagcggcc

SEQ ID NO: 2875064 - RNA, 20 nt, Mycobacterium avium subsp. paratuberculosis
agcgcgccgcccagcgguga

SEQ ID NO: 2875065 - RNA, 13 nt, Mycobacterium avium subsp. paratuberculosis
agcgcgccgccgc

SEQ ID NO: 2875066 - RNA, 16 nt, Mycobacterium avium subsp. paratuberculosis
agcgcgccggccagca

SEQ ID NO: 2875067 - RNA, 21 nt, Mycobacterium avium subsp. paratuberculosis
agcgcgccggccagcagcagg

SEQ ID NO: 2875068 - RNA, 13 nt, Mycobacterium avium subsp. paratuberculosis
agcgcgccggccc

SEQ ID NO: 2875069 - RNA, 15 nt, Mycobacterium avium subsp. paratuberculosis
agcgcgccggcccga

SEQ ID NO: 2875070 - RNA, 14 nt, Mycobacterium avium subsp. paratuberculosis
agcgcgccggccgg

SEQ ID NO: 2875071 - RNA, 13 nt, Mycobacterium avium subsp. paratuberculosis
agcgcgccggggu

SEQ ID NO: 2875072 - RNA, 17 nt, Mycobacterium avium subsp. paratuberculosis
agcgcgccgggguccuc

SEQ ID NO: 2875073 - RNA, 12 nt, Mycobacterium avium subsp. paratuberculosis
agcgcgccgucg

SEQ ID NO: 2875074 - RNA, 13 nt, Mycobacterium avium subsp. paratuberculosis
agcgcgccgucgg

SEQ ID NO: 2875075 - RNA, 13 nt, Mycobacterium avium subsp. paratuberculosis
agcgcgcgaccgc

SEQ ID NO: 2875076 - RNA, 16 nt, Mycobacterium avium subsp. paratuberculosis
agcgcgcgagacaccu

SEQ ID NO: 2875077 - RNA, 20 nt, Mycobacterium avium subsp. paratuberculosis
agcgcgcgaucuccgucacc

SEQ ID NO: 2875078 - RNA, 20 nt, Mycobacterium avium subsp. paratuberculosis
agcgcgcgcucggucagcac

SEQ ID NO: 2875079 - RNA, 13 nt, Mycobacterium avium subsp. paratuberculosis
agcgcgcggcgca

SEQ ID NO: 2875080 - RNA, 12 nt, Mycobacterium avium subsp. paratuberculosis
agcgcgcgggcg

SEQ ID NO: 2875081 - RNA, 17 nt, Mycobacterium avium subsp. paratuberculosis
agcgcgcggugaugacc

SEQ ID NO: 2875082 - RNA, 18 nt, Mycobacterium avium subsp. paratuberculosis
agcgcgcggugaugaccu

SEQ ID NO: 2875083 - RNA, 18 nt, Mycobacterium avium subsp. paratuberculosis
agcgcgcggugcgccagc

SEQ ID NO: 2875084 - RNA, 19 nt, Mycobacterium avium subsp. paratuberculosis
agcgcgcggugcgccagcg

SEQ ID NO: 2875085 - RNA, 16 nt, Mycobacterium avium subsp. paratuberculosis
agcgcgcugugcgcca

SEQ ID NO: 2875086 - RNA, 20 nt, Mycobacterium avium subsp. paratuberculosis
agcgcgcuuaauacagcgcg

SEQ ID NO: 2875087 - RNA, 22 nt, Mycobacterium avium subsp. paratuberculosis
agcgcgcuuaauacagcgcguu

SEQ ID NO: 2875088 - RNA, 16 nt, Mycobacterium avium subsp. paratuberculosis
agcgcggacaccaggu

SEQ ID NO: 2875089 - RNA, 18 nt, Mycobacterium avium subsp. paratuberculosis
agcgcggauuccagcgcg

SEQ ID NO: 2875090 - RNA, 19 nt, Mycobacterium avium subsp. paratuberculosis
agcgcggauuccagcgcga

SEQ ID NO: 2875091 - RNA, 15 nt, Mycobacterium avium subsp. paratuberculosis
agcgcggcaugccgc

SEQ ID NO: 2875092 - RNA, 15 nt, Mycobacterium avium subsp. paratuberculosis
agcgcggccacaccg

SEQ ID NO: 2875093 - RNA, 17 nt, Mycobacterium avium subsp. paratuberculosis
agcgcggccaccaccac

SEQ ID NO: 2875094 - RNA, 23 nt, Mycobacterium avium subsp. paratuberculosis
agcgcggccaccaccacggccau

SEQ ID NO: 2875095 - RNA, 14 nt, Mycobacterium avium subsp. paratuberculosis
agcgcggccaccuc

SEQ ID NO: 2875096 - RNA, 21 nt, Mycobacterium avium subsp. paratuberculosis
agcgcggccaccuccagcccg

SEQ ID NO: 2875097 - RNA, 12 nt, Mycobacterium avium subsp. paratuberculosis
agcgcggccagc

SEQ ID NO: 2875098 - RNA, 11 nt, Mycobacterium avium subsp. paratuberculosis
agcgcggcccg

SEQ ID NO: 2875099 - RNA, 12 nt, Mycobacterium avium subsp. paratuberculosis
agcgcggcccgc

SEQ ID NO: 2875100 - RNA, 13 nt, Mycobacterium avium subsp. paratuberculosis
agcgcggcccgcc

SEQ ID NO: 2875101 - RNA, 15 nt, Mycobacterium avium subsp. paratuberculosis
agcgcggcccgccga

SEQ ID NO: 2875102 - RNA, 16 nt, Mycobacterium avium subsp. paratuberculosis
agcgcggcccgccgaa

SEQ ID NO: 2875103 - RNA, 17 nt, Mycobacterium avium subsp. paratuberculosis
agcgcggcccgcggcgu

SEQ ID NO: 2875104 - RNA, 19 nt, Mycobacterium avium subsp. paratuberculosis
agcgcggcccgcggcguca

SEQ ID NO: 2875105 - RNA, 14 nt, Mycobacterium avium subsp. paratuberculosis
agcgcggccgcccg

SEQ ID NO: 2875106 - RNA, 15 nt, Mycobacterium avium subsp. paratuberculosis
agcgcggccgcccgu

SEQ ID NO: 2875107 - RNA, 13 nt, Mycobacterium avium subsp. paratuberculosis
agcgcggccggaa

SEQ ID NO: 2875108 - RNA, 15 nt, Mycobacterium avium subsp. paratuberculosis
agcgcggccggaaga

SEQ ID NO: 2875109 - RNA, 14 nt, Mycobacterium avium subsp. paratuberculosis
agcgcggccgggcg

SEQ ID NO: 2875110 - RNA, 19 nt, Mycobacterium avium subsp. paratuberculosis
agcgcggccgggcgccccg

SEQ ID NO: 2875111 - RNA, 21 nt, Mycobacterium avium subsp. paratuberculosis
agcgcggccgggcgccccgac

SEQ ID NO: 2875112 - RNA, 17 nt, Mycobacterium avium subsp. paratuberculosis
agcgcggcgaacccgag

SEQ ID NO: 2875113 - RNA, 19 nt, Mycobacterium avium subsp. paratuberculosis
agcgcggcgacauuggccg

SEQ ID NO: 2875114 - RNA, 21 nt, Mycobacterium avium subsp. paratuberculosis
agcgcggcgaucucggcggcc

SEQ ID NO: 2875115 - RNA, 17 nt, Mycobacterium avium subsp. paratuberculosis
agcgcggcggccaccuc

SEQ ID NO: 2875116 - RNA, 20 nt, Mycobacterium avium subsp. paratuberculosis
agcgcggcggccaccucggc

SEQ ID NO: 2875117 - RNA, 14 nt, Mycobacterium avium subsp. paratuberculosis
agcgcggcggccag

SEQ ID NO: 2875118 - RNA, 16 nt, Mycobacterium avium subsp. paratuberculosis
agcgcggcggccagcu

SEQ ID NO: 2875119 - RNA, 19 nt, Mycobacterium avium subsp. paratuberculosis
agcgcggcggccagcucgg

SEQ ID NO: 2875120 - RNA, 13 nt, Mycobacterium avium subsp. paratuberculosis
agcgcggcggcgc

SEQ ID NO: 2875121 - RNA, 14 nt, Mycobacterium avium subsp. paratuberculosis
agcgcggcggcgcc

SEQ ID NO: 2875122 - RNA, 15 nt, Mycobacterium avium subsp. paratuberculosis
agcgcggcggcgccg

SEQ ID NO: 2875123 - RNA, 18 nt, Mycobacterium avium subsp. paratuberculosis
agcgcggcgggccagucg

SEQ ID NO: 2875124 - RNA, 19 nt, Mycobacterium avium subsp. paratuberculosis
agcgcggcggucgcgcgcc

SEQ ID NO: 2875125 - RNA, 19 nt, Mycobacterium avium subsp. paratuberculosis
agcgcggcguucagcagcg

SEQ ID NO: 2875126 - RNA, 20 nt, Mycobacterium avium subsp. paratuberculosis
agcgcggcguucagcagcgc

SEQ ID NO: 2875127 - RNA, 22 nt, Mycobacterium avium subsp. paratuberculosis
agcgcggcguucagcagcgcgg

SEQ ID NO: 2875128 - RNA, 16 nt, Mycobacterium avium subsp. paratuberculosis
agcgcggcuuggccac

SEQ ID NO: 2875129 - RNA, 16 nt, Mycobacterium avium subsp. paratuberculosis
agcgcgggcaccgucg

SEQ ID NO: 2875130 - RNA, 16 nt, Mycobacterium avium subsp. paratuberculosis
agcgcgggccagcagu

SEQ ID NO: 2875131 - RNA, 23 nt, Mycobacterium avium subsp. paratuberculosis
agcgcgggccagcaguucgucca

SEQ ID NO: 2875132 - RNA, 11 nt, Mycobacterium avium subsp. paratuberculosis
agcgcggucaa

SEQ ID NO: 2875133 - RNA, 18 nt, Mycobacterium avium subsp. paratuberculosis
agcgcggucaacaccggg

SEQ ID NO: 2875134 - RNA, 16 nt, Mycobacterium avium subsp. paratuberculosis
agcgcggucaucguca

SEQ ID NO: 2875135 - RNA, 18 nt, Mycobacterium avium subsp. paratuberculosis
agcgcgguccacgguggc

SEQ ID NO: 2875136 - RNA, 19 nt, Mycobacterium avium subsp. paratuberculosis
agcgcgguccacgguggcg

SEQ ID NO: 2875137 - RNA, 15 nt, Mycobacterium avium subsp. paratuberculosis
agcgcggucucgauc

SEQ ID NO: 2875138 - RNA, 22 nt, Mycobacterium avium subsp. paratuberculosis
agcgcggucucgaucugcacca

SEQ ID NO: 2875139 - RNA, 22 nt, Mycobacterium avium subsp. paratuberculosis
agcgcggugaagucggugccca

SEQ ID NO: 2875140 - RNA, 17 nt, Mycobacterium avium subsp. paratuberculosis
agcgcggugagcagcau

SEQ ID NO: 2875141 - RNA, 15 nt, Mycobacterium avium subsp. paratuberculosis
agcgcggugcccagc

SEQ ID NO: 2875142 - RNA, 21 nt, Mycobacterium avium subsp. paratuberculosis
agcgcggugcccagccaggcc

SEQ ID NO: 2875143 - RNA, 18 nt, Mycobacterium avium subsp. paratuberculosis
agcgcggugccggugauc

SEQ ID NO: 2875144 - RNA, 23 nt, Mycobacterium avium subsp. paratuberculosis
agcgcggugccggugauccacuc

SEQ ID NO: 2875145 - RNA, 15 nt, Mycobacterium avium subsp. paratuberculosis
agcgcgguggccagc

SEQ ID NO: 2875146 - RNA, 20 nt, Mycobacterium avium subsp. paratuberculosis
agcgcgguggccagcagggu

SEQ ID NO: 2875147 - RNA, 21 nt, Mycobacterium avium subsp. paratuberculosis
agcgcgguggucagcaccggc

SEQ ID NO: 2875148 - RNA, 18 nt, Mycobacterium avium subsp. paratuberculosis
agcgcgguggucagcggc

SEQ ID NO: 2875149 - RNA, 21 nt, Mycobacterium avium subsp. paratuberculosis
agcgcgguggucagcggcgcc

SEQ ID NO: 2875150 - RNA, 20 nt, Mycobacterium avium subsp. paratuberculosis
agcgcgguguacagcgcgcc

SEQ ID NO: 2875151 - RNA, 22 nt, Mycobacterium avium subsp. paratuberculosis
agcgcgguguacagcgcgccgc

SEQ ID NO: 2875152 - RNA, 17 nt, Mycobacterium avium subsp. paratuberculosis
agcgcgguuuccggcga

SEQ ID NO: 2875153 - RNA, 19 nt, Mycobacterium avium subsp. paratuberculosis
agcgcgguuuccggcgauu

SEQ ID NO: 2875154 - RNA, 19 nt, Mycobacterium avium subsp. paratuberculosis
agcgcguacuccgacagau

SEQ ID NO: 2875155 - RNA, 18 nt, Mycobacterium avium subsp. paratuberculosis
agcgcguagucggcgucg

SEQ ID NO: 2875156 - RNA, 20 nt, Mycobacterium avium subsp. paratuberculosis
agcgcguagucggcgucggc

SEQ ID NO: 2875157 - RNA, 13 nt, Mycobacterium avium subsp. paratuberculosis
agcgcguccaggu

SEQ ID NO: 2875158 - RNA, 16 nt, Mycobacterium avium subsp. paratuberculosis
agcgcguccaggugcg

SEQ ID NO: 2875159 - RNA, 17 nt, Mycobacterium avium subsp. paratuberculosis
agcgcguccaggugcgc

SEQ ID NO: 2875160 - RNA, 19 nt, Mycobacterium avium subsp. paratuberculosis
agcgcguccaggugcgccg

SEQ ID NO: 2875161 - RNA, 13 nt, Mycobacterium avium subsp. paratuberculosis
agcgcgucgacca

SEQ ID NO: 2875162 - RNA, 17 nt, Mycobacterium avium subsp. paratuberculosis
agcgcgucgacgcgguc

SEQ ID NO: 2875163 - RNA, 13 nt, Mycobacterium avium subsp. paratuberculosis
agcgcgucgaggu

SEQ ID NO: 2875164 - RNA, 14 nt, Mycobacterium avium subsp. paratuberculosis
agcgcgucgagguc

SEQ ID NO: 2875165 - RNA, 21 nt, Mycobacterium avium subsp. paratuberculosis
agcgcgucgaggucgcgcagc

SEQ ID NO: 2875166 - RNA, 21 nt, Mycobacterium avium subsp. paratuberculosis
agcgcgucgcacagcgccgcg

SEQ ID NO: 2875167 - RNA, 24 nt, Mycobacterium avium subsp. paratuberculosis
agcgcgucgcgcccggcgucggug

SEQ ID NO: 2875168 - RNA, 15 nt, Mycobacterium avium subsp. paratuberculosis
agcgcgucgcugccg

SEQ ID NO: 2875169 - RNA, 18 nt, Mycobacterium avium subsp. paratuberculosis
agcgcgucggccagcacc

SEQ ID NO: 2875170 - RNA, 19 nt, Mycobacterium avium subsp. paratuberculosis
agcgcgucggccagcgcgc

SEQ ID NO: 2875171 - RNA, 15 nt, Mycobacterium avium subsp. paratuberculosis
agcgcgucggcgacc

SEQ ID NO: 2875172 - RNA, 13 nt, Mycobacterium avium subsp. paratuberculosis
agcgcgucgggcu

SEQ ID NO: 2875173 - RNA, 20 nt, Mycobacterium avium subsp. paratuberculosis
agcgcgucggugaugucggu

SEQ ID NO: 2875174 - RNA, 20 nt, Mycobacterium avium subsp. paratuberculosis
agcgcgucgucgauggccac

SEQ ID NO: 2875175 - RNA, 17 nt, Mycobacterium avium subsp. paratuberculosis
agcgcgucgucggucag

SEQ ID NO: 2875176 - RNA, 18 nt, Mycobacterium avium subsp. paratuberculosis
agcgcgucgucggucagg

SEQ ID NO: 2875177 - RNA, 17 nt, Mycobacterium avium subsp. paratuberculosis
agcgcgucgugcaacuc

SEQ ID NO: 2875178 - RNA, 20 nt, Mycobacterium avium subsp. paratuberculosis
agcgcgugaccccggcgacc

SEQ ID NO: 2875179 - RNA, 20 nt, Mycobacterium avium subsp. paratuberculosis
agcgcgugcuggggguggcg

SEQ ID NO: 2875180 - RNA, 21 nt, Mycobacterium avium subsp. paratuberculosis
agcgcguucagggugcaggcc

SEQ ID NO: 2875181 - RNA, 21 nt, Mycobacterium avium subsp. paratuberculosis
agcgcguucuccaccgcgcgc

SEQ ID NO: 2875182 - RNA, 18 nt, Mycobacterium avium subsp. paratuberculosis
agcgcguugaagcugacg

SEQ ID NO: 2875183 - RNA, 20 nt, Mycobacterium avium subsp. paratuberculosis
agcgcguugcggccguccag

SEQ ID NO: 2875184 - RNA, 19 nt, Mycobacterium avium subsp. paratuberculosis
agcgcuaacaaaagcccga

SEQ ID NO: 2875185 - RNA, 20 nt, Mycobacterium avium subsp. paratuberculosis
agcgcuaacaaaagcccgag

SEQ ID NO: 2875186 - RNA, 23 nt, Mycobacterium avium subsp. paratuberculosis
agcgcuaacaaaagcccgagauc

SEQ ID NO: 2875187 - RNA, 22 nt, Mycobacterium avium subsp. paratuberculosis
agcgcuaaccgcgggcaucgcc

SEQ ID NO: 2875188 - RNA, 23 nt, Mycobacterium avium subsp. paratuberculosis
agcgcuaaggccgcugcccggcg

SEQ ID NO: 2875189 - RNA, 13 nt, Mycobacterium avium subsp. paratuberculosis
agcgcuaccgcgc

SEQ ID NO: 2875190 - RNA, 14 nt, Mycobacterium avium subsp. paratuberculosis
agcgcuaccgcgcu

SEQ ID NO: 2875191 - RNA, 15 nt, Mycobacterium avium subsp. paratuberculosis
agcgcuaccgcgcuc

SEQ ID NO: 2875192 - RNA, 21 nt, Mycobacterium avium subsp. paratuberculosis
agcgcuaccgcgcucaccguc

SEQ ID NO: 2875193 - RNA, 12 nt, Mycobacterium avium subsp. paratuberculosis
agcgcuccacca

SEQ ID NO: 2875194 - RNA, 15 nt, Mycobacterium avium subsp. paratuberculosis
agcgcuccaccaccg

SEQ ID NO: 2875195 - RNA, 18 nt, Mycobacterium avium subsp. paratuberculosis
agcgcuccugcagcgcgg

SEQ ID NO: 2875196 - RNA, 20 nt, Mycobacterium avium subsp. paratuberculosis
agcgcuccugcagcgcggcg

SEQ ID NO: 2875197 - RNA, 15 nt, Mycobacterium avium subsp. paratuberculosis
agcgcucgacgaggc

SEQ ID NO: 2875198 - RNA, 20 nt, Mycobacterium avium subsp. paratuberculosis
agcgcucgacgaggcgggcg

SEQ ID NO: 2875199 - RNA, 14 nt, Mycobacterium avium subsp. paratuberculosis
agcgcucggucagg

SEQ ID NO: 2875200 - RNA, 20 nt, Mycobacterium avium subsp. paratuberculosis
agcgcucggucaggcccagg

SEQ ID NO: 2875201 - RNA, 23 nt, Mycobacterium avium subsp. paratuberculosis
agcgcucgucgucggagacguug

SEQ ID NO: 2875202 - RNA, 23 nt, Mycobacterium avium subsp. paratuberculosis
agcgcugaaccgguagucgucga

SEQ ID NO: 2875203 - RNA, 23 nt, Mycobacterium avium subsp. paratuberculosis
agcgcugcauagucggcccgauc

SEQ ID NO: 2875204 - RNA, 17 nt, Mycobacterium avium subsp. paratuberculosis
agcgcuggccggccacc

SEQ ID NO: 2875205 - RNA, 17 nt, Mycobacterium avium subsp. paratuberculosis
agcgcugggugaacacc

SEQ ID NO: 2875206 - RNA, 21 nt, Mycobacterium avium subsp. paratuberculosis
agcgcugggugaacaccccgc

SEQ ID NO: 2875207 - RNA, 15 nt, Mycobacterium avium subsp. paratuberculosis
agcgcugguaccggu

SEQ ID NO: 2875208 - RNA, 16 nt, Mycobacterium avium subsp. paratuberculosis
agcgcugguaguacac

SEQ ID NO: 2875209 - RNA, 18 nt, Mycobacterium avium subsp. paratuberculosis
agcgcugguugucgacgc

SEQ ID NO: 2875210 - RNA, 21 nt, Mycobacterium avium subsp. paratuberculosis
agcgcugguugucgacgcugc

SEQ ID NO: 2875211 - RNA, 19 nt, Mycobacterium avium subsp. paratuberculosis
agcgcugucgcgggcccgc

SEQ ID NO: 2875212 - RNA, 21 nt, Mycobacterium avium subsp. paratuberculosis
agcgcugucgcgggcccgcgu

SEQ ID NO: 2875213 - RNA, 16 nt, Mycobacterium avium subsp. paratuberculosis
agcgcuuccagcgcgg

SEQ ID NO: 2875214 - RNA, 17 nt, Mycobacterium avium subsp. paratuberculosis
agcgcuuggcggagagc

SEQ ID NO: 2875215 - RNA, 15 nt, Mycobacterium avium subsp. paratuberculosis
agcgcuugucgcaga

SEQ ID NO: 2875216 - RNA, 18 nt, Mycobacterium avium subsp. paratuberculosis
agcgcuuucccugcucga

SEQ ID NO: 2875217 - RNA, 15 nt, Mycobacterium avium subsp. paratuberculosis
agcgcuuucgccgaa

SEQ ID NO: 2875218 - RNA, 16 nt, Mycobacterium avium subsp. paratuberculosis
agcgcuuucgccgaau

SEQ ID NO: 2875219 - RNA, 23 nt, Mycobacterium avium subsp. paratuberculosis
agcgcuuucgcgcacgccaucgc

SEQ ID NO: 2875220 - RNA, 20 nt, Mycobacterium avium subsp. paratuberculosis
agcgcuuucgcuggucgcga

SEQ ID NO: 2875221 - RNA, 20 nt, Mycobacterium avium subsp. paratuberculosis
agcgcuuugaucagcucgcc

SEQ ID NO: 2875222 - RNA, 22 nt, Mycobacterium avium subsp. paratuberculosis
agcgcuuugaucagcucgccga

SEQ ID NO: 2875223 - RNA, 16 nt, Mycobacterium avium subsp. paratuberculosis
agcggaaacgacgucg

SEQ ID NO: 2875224 - RNA, 20 nt, Mycobacterium avium subsp. paratuberculosis
agcggaaacgacgucgccac

SEQ ID NO: 2875225 - RNA, 14 nt, Mycobacterium avium subsp. paratuberculosis
agcggaaccgacac

SEQ ID NO: 2875226 - RNA, 15 nt, Mycobacterium avium subsp. paratuberculosis
agcggaaugaacgcg

SEQ ID NO: 2875227 - RNA, 20 nt, Mycobacterium avium subsp. paratuberculosis
agcggaaugaacgcggccag

SEQ ID NO: 2875228 - RNA, 18 nt, Mycobacterium avium subsp. paratuberculosis
agcggacccggucggccg

SEQ ID NO: 2875229 - RNA, 19 nt, Mycobacterium avium subsp. paratuberculosis
agcggacccggucggccgc

SEQ ID NO: 2875230 - RNA, 18 nt, Mycobacterium avium subsp. paratuberculosis
agcggacccuucagccag

SEQ ID NO: 2875231 - RNA, 14 nt, Mycobacterium avium subsp. paratuberculosis
agcggacgacggcc

SEQ ID NO: 2875232 - RNA, 15 nt, Mycobacterium avium subsp. paratuberculosis
agcggacgacggcca

SEQ ID NO: 2875233 - RNA, 17 nt, Mycobacterium avium subsp. paratuberculosis
agcggacgacggccagc

SEQ ID NO: 2875234 - RNA, 19 nt, Mycobacterium avium subsp. paratuberculosis
agcggacgacggccagcug

SEQ ID NO: 2875235 - RNA, 17 nt, Mycobacterium avium subsp. paratuberculosis
agcggagugaccgccag

SEQ ID NO: 2875236 - RNA, 22 nt, Mycobacterium avium subsp. paratuberculosis
agcggaucaggucggucaccga

SEQ ID NO: 2875237 - RNA, 18 nt, Mycobacterium avium subsp. paratuberculosis
agcggaucccgguucccg

SEQ ID NO: 2875238 - RNA, 13 nt, Mycobacterium avium subsp. paratuberculosis
agcggaucggccu

SEQ ID NO: 2875239 - RNA, 19 nt, Mycobacterium avium subsp. paratuberculosis
agcggaugccggaggcgcc

SEQ ID NO: 2875240 - RNA, 18 nt, Mycobacterium avium subsp. paratuberculosis
agcggauggcgacggcga

SEQ ID NO: 2875241 - RNA, 22 nt, Mycobacterium avium subsp. paratuberculosis
agcggauggcgacggcgacgac

SEQ ID NO: 2875242 - RNA, 14 nt, Mycobacterium avium subsp. paratuberculosis
agcggauugaccag

SEQ ID NO: 2875243 - RNA, 15 nt, Mycobacterium avium subsp. paratuberculosis
agcggauugaccagc

SEQ ID NO: 2875244 - RNA, 16 nt, Mycobacterium avium subsp. paratuberculosis
agcggauugaccagca

SEQ ID NO: 2875245 - RNA, 17 nt, Mycobacterium avium subsp. paratuberculosis
agcggauugaccagcac

SEQ ID NO: 2875246 - RNA, 18 nt, Mycobacterium avium subsp. paratuberculosis
agcggauugaccagcacg

SEQ ID NO: 2875247 - RNA, 16 nt, Mycobacterium avium subsp. paratuberculosis
agcggauuggucgggc

SEQ ID NO: 2875248 - RNA, 17 nt, Mycobacterium avium subsp. paratuberculosis
agcggcaacacgccggc

SEQ ID NO: 2875249 - RNA, 19 nt, Mycobacterium avium subsp. paratuberculosis
agcggcaacugggcggccu

SEQ ID NO: 2875250 - RNA, 13 nt, Mycobacterium avium subsp. paratuberculosis
agcggcaccaacc

SEQ ID NO: 2875251 - RNA, 16 nt, Mycobacterium avium subsp. paratuberculosis
agcggcaccaacccga

SEQ ID NO: 2875252 - RNA, 13 nt, Mycobacterium avium subsp. paratuberculosis
agcggcaccaggu

SEQ ID NO: 2875253 - RNA, 19 nt, Mycobacterium avium subsp. paratuberculosis
agcggcaccagguaccggc

SEQ ID NO: 2875254 - RNA, 14 nt, Mycobacterium avium subsp. paratuberculosis
agcggcaccgccau

SEQ ID NO: 2875255 - RNA, 19 nt, Mycobacterium avium subsp. paratuberculosis
agcggcaccuuggugagca

SEQ ID NO: 2875256 - RNA, 20 nt, Mycobacterium avium subsp. paratuberculosis
agcggcaccuuggugagcac

SEQ ID NO: 2875257 - RNA, 23 nt, Mycobacterium avium subsp. paratuberculosis
agcggcacgaaguugguguccac

SEQ ID NO: 2875258 - RNA, 17 nt, Mycobacterium avium subsp. paratuberculosis
agcggcacgaucucgac

SEQ ID NO: 2875259 - RNA, 22 nt, Mycobacterium avium subsp. paratuberculosis
agcggcacgaucucgaccaggc

SEQ ID NO: 2875260 - RNA, 18 nt, Mycobacterium avium subsp. paratuberculosis
agcggcacgggcaccgac

SEQ ID NO: 2875261 - RNA, 16 nt, Mycobacterium avium subsp. paratuberculosis
agcggcacgucgccgu

SEQ ID NO: 2875262 - RNA, 16 nt, Mycobacterium avium subsp. paratuberculosis
agcggcagauggucuc

SEQ ID NO: 2875263 - RNA, 21 nt, Mycobacterium avium subsp. paratuberculosis
agcggcagauggucucgaucu

SEQ ID NO: 2875264 - RNA, 13 nt, Mycobacterium avium subsp. paratuberculosis
agcggcagcagca

SEQ ID NO: 2875265 - RNA, 17 nt, Mycobacterium avium subsp. paratuberculosis
agcggcagcagcaccag

SEQ ID NO: 2875266 - RNA, 20 nt, Mycobacterium avium subsp. paratuberculosis
agcggcagcagcaccagcgu

SEQ ID NO: 2875267 - RNA, 21 nt, Mycobacterium avium subsp. paratuberculosis
agcggcagcagcaccagcgug

SEQ ID NO: 2875268 - RNA, 17 nt, Mycobacterium avium subsp. paratuberculosis
agcggcagccacggcag

SEQ ID NO: 2875269 - RNA, 18 nt, Mycobacterium avium subsp. paratuberculosis
agcggcagccacggcagc

SEQ ID NO: 2875270 - RNA, 15 nt, Mycobacterium avium subsp. paratuberculosis
agcggcagcgccagc

SEQ ID NO: 2875271 - RNA, 16 nt, Mycobacterium avium subsp. paratuberculosis
agcggcaggucgucgu

SEQ ID NO: 2875272 - RNA, 20 nt, Mycobacterium avium subsp. paratuberculosis
agcggcaggucgucgucgcc

SEQ ID NO: 2875273 - RNA, 12 nt, Mycobacterium avium subsp. paratuberculosis
agcggcaguagc

SEQ ID NO: 2875274 - RNA, 14 nt, Mycobacterium avium subsp. paratuberculosis
agcggcaucgagga

SEQ ID NO: 2875275 - RNA, 15 nt, Mycobacterium avium subsp. paratuberculosis
agcggcaucgaggac

SEQ ID NO: 2875276 - RNA, 20 nt, Mycobacterium avium subsp. paratuberculosis
agcggcaucgaggaccggcg

SEQ ID NO: 2875277 - RNA, 12 nt, Mycobacterium avium subsp. paratuberculosis
agcggcaucgcc

SEQ ID NO: 2875278 - RNA, 19 nt, Mycobacterium avium subsp. paratuberculosis
agcggccacaccggggcca

SEQ ID NO: 2875279 - RNA, 20 nt, Mycobacterium avium subsp. paratuberculosis
agcggccagcccgcggcagc

SEQ ID NO: 2875280 - RNA, 21 nt, Mycobacterium avium subsp. paratuberculosis
agcggccaucgccgccaucgc

SEQ ID NO: 2875281 - RNA, 20 nt, Mycobacterium avium subsp. paratuberculosis
agcggcccaacacgcccugc

SEQ ID NO: 2875282 - RNA, 21 nt, Mycobacterium avium subsp. paratuberculosis
agcggcccaacacgcccugca

SEQ ID NO: 2875283 - RNA, 14 nt, Mycobacterium avium subsp. paratuberculosis
agcggcccaccgcg

SEQ ID NO: 2875284 - RNA, 15 nt, Mycobacterium avium subsp. paratuberculosis
agcggcccaccgcga

SEQ ID NO: 2875285 - RNA, 16 nt, Mycobacterium avium subsp. paratuberculosis
agcggcccaccgcgac

SEQ ID NO: 2875286 - RNA, 17 nt, Mycobacterium avium subsp. paratuberculosis
agcggcccaccgcgacc

SEQ ID NO: 2875287 - RNA, 23 nt, Mycobacterium avium subsp. paratuberculosis
agcggcccagguucuccggcccg

SEQ ID NO: 2875288 - RNA, 22 nt, Mycobacterium avium subsp. paratuberculosis
agcggccccccgcacaccggcc

SEQ ID NO: 2875289 - RNA, 21 nt, Mycobacterium avium subsp. paratuberculosis
agcggcccgaaaacgcccggg

SEQ ID NO: 2875290 - RNA, 12 nt, Mycobacterium avium subsp. paratuberculosis
agcggcccgaga

SEQ ID NO: 2875291 - RNA, 19 nt, Mycobacterium avium subsp. paratuberculosis
agcggcccgaucaccaggc

SEQ ID NO: 2875292 - RNA, 21 nt, Mycobacterium avium subsp. paratuberculosis
agcggcccgaucaccaggccc

SEQ ID NO: 2875293 - RNA, 17 nt, Mycobacterium avium subsp. paratuberculosis
agcggcccgaucaccgc

SEQ ID NO: 2875294 - RNA, 18 nt, Mycobacterium avium subsp. paratuberculosis
agcggcccgaucaccgcc

SEQ ID NO: 2875295 - RNA, 16 nt, Mycobacterium avium subsp. paratuberculosis
agcggcccgucgccga

SEQ ID NO: 2875296 - RNA, 14 nt, Mycobacterium avium subsp. paratuberculosis
agcggcccugcgcg

SEQ ID NO: 2875297 - RNA, 19 nt, Mycobacterium avium subsp. paratuberculosis
agcggcccugcgcggccug

SEQ ID NO: 2875298 - RNA, 19 nt, Mycobacterium avium subsp. paratuberculosis
agcggccgacugauccacc

SEQ ID NO: 2875299 - RNA, 20 nt, Mycobacterium avium subsp. paratuberculosis
agcggccgacugauccacca

SEQ ID NO: 2875300 - RNA, 19 nt, Mycobacterium avium subsp. paratuberculosis
agcggccgaucauggucgg

SEQ ID NO: 2875301 - RNA, 22 nt, Mycobacterium avium subsp. paratuberculosis
agcggccgcaaucggcgccggc

SEQ ID NO: 2875302 - RNA, 22 nt, Mycobacterium avium subsp. paratuberculosis
agcggccgcacgcgaacaccag

SEQ ID NO: 2875303 - RNA, 15 nt, Mycobacterium avium subsp. paratuberculosis
agcggccgcagcgca

SEQ ID NO: 2875304 - RNA, 16 nt, Mycobacterium avium subsp. paratuberculosis
agcggccgcagcgcga

SEQ ID NO: 2875305 - RNA, 17 nt, Mycobacterium avium subsp. paratuberculosis
agcggccgcagcgcgac

SEQ ID NO: 2875306 - RNA, 18 nt, Mycobacterium avium subsp. paratuberculosis
agcggccgcagcgcgacg

SEQ ID NO: 2875307 - RNA, 17 nt, Mycobacterium avium subsp. paratuberculosis
agcggccggaacagcug

SEQ ID NO: 2875308 - RNA, 21 nt, Mycobacterium avium subsp. paratuberculosis
agcggccggcgcagccggcca

SEQ ID NO: 2875309 - RNA, 12 nt, Mycobacterium avium subsp. paratuberculosis
agcggccgucca

SEQ ID NO: 2875310 - RNA, 12 nt, Mycobacterium avium subsp. paratuberculosis
agcggccgucgc

SEQ ID NO: 2875311 - RNA, 17 nt, Mycobacterium avium subsp. paratuberculosis
agcggccgucgccgggc

SEQ ID NO: 2875312 - RNA, 23 nt, Mycobacterium avium subsp. paratuberculosis
agcggccgucgccgggcggggug

SEQ ID NO: 2875313 - RNA, 17 nt, Mycobacterium avium subsp. paratuberculosis
agcggccgucgcgcagc

SEQ ID NO: 2875314 - RNA, 23 nt, Mycobacterium avium subsp. paratuberculosis
agcggccuaacgaguaggcggcu

SEQ ID NO: 2875315 - RNA, 21 nt, Mycobacterium avium subsp. paratuberculosis
agcggccuaugcgcccgggaa

SEQ ID NO: 2875316 - RNA, 15 nt, Mycobacterium avium subsp. paratuberculosis
agcggccucggaagg

SEQ ID NO: 2875317 - RNA, 18 nt, Mycobacterium avium subsp. paratuberculosis
agcggccucggaagggcu

SEQ ID NO: 2875318 - RNA, 22 nt, Mycobacterium avium subsp. paratuberculosis
agcggcgaaaucggugaagccg

SEQ ID NO: 2875319 - RNA, 22 nt, Mycobacterium avium subsp. paratuberculosis
agcggcgacuccagcagcgcca

SEQ ID NO: 2875320 - RNA, 22 nt, Mycobacterium avium subsp. paratuberculosis
agcggcgaugcccacagccagg

SEQ ID NO: 2875321 - RNA, 23 nt, Mycobacterium avium subsp. paratuberculosis
agcggcgaugcccacagccaggu

SEQ ID NO: 2875322 - RNA, 13 nt, Mycobacterium avium subsp. paratuberculosis
agcggcgccaccg

SEQ ID NO: 2875323 - RNA, 14 nt, Mycobacterium avium subsp. paratuberculosis
agcggcgccaccgg

SEQ ID NO: 2875324 - RNA, 15 nt, Mycobacterium avium subsp. paratuberculosis
agcggcgccaccggc

SEQ ID NO: 2875325 - RNA, 21 nt, Mycobacterium avium subsp. paratuberculosis
ggcgaccuggacgccgcacgc

SEQ ID NO: 2875326 - RNA, 15 nt, Mycobacterium avium subsp. paratuberculosis
ggcgaccuggugcuc

SEQ ID NO: 2875327 - RNA, 18 nt, Mycobacterium avium subsp. paratuberculosis
ggcgaccuggugcucgau

SEQ ID NO: 2875328 - RNA, 20 nt, Mycobacterium avium subsp. paratuberculosis
ggcgaccuguuuggccagcc

SEQ ID NO: 2875329 - RNA, 21 nt, Mycobacterium avium subsp. paratuberculosis
ggcgaccuguuuggccagcca

SEQ ID NO: 2875330 - RNA, 22 nt, Mycobacterium avium subsp. paratuberculosis
ggcgaccuguuuggccagccag

SEQ ID NO: 2875331 - RNA, 22 nt, Mycobacterium avium subsp. paratuberculosis
ggcgaccuugcgcagccggcag

SEQ ID NO: 2875332 - RNA, 19 nt, Mycobacterium avium subsp. paratuberculosis
ggcgacgaaaaugcccagu

SEQ ID NO: 2875333 - RNA, 22 nt, Mycobacterium avium subsp. paratuberculosis
ggcgacgaaccuggcugccugg

SEQ ID NO: 2875334 - RNA, 17 nt, Mycobacterium avium subsp. paratuberculosis
ggcgacgaacgccggca

SEQ ID NO: 2875335 - RNA, 18 nt, Mycobacterium avium subsp. paratuberculosis
ggcgacgaacgccggcau

SEQ ID NO: 2875336 - RNA, 18 nt, Mycobacterium avium subsp. paratuberculosis
ggcgacgaagcagcucgc

SEQ ID NO: 2875337 - RNA, 19 nt, Mycobacterium avium subsp. paratuberculosis
ggcgacgaagcagcucgcg

SEQ ID NO: 2875338 - RNA, 20 nt, Mycobacterium avium subsp. paratuberculosis
ggcgacgaagcagcucgcgu

SEQ ID NO: 2875339 - RNA, 23 nt, Mycobacterium avium subsp. paratuberculosis
ggcgacgaagcagcucgcguagc

SEQ ID NO: 2875340 - RNA, 18 nt, Mycobacterium avium subsp. paratuberculosis
ggcgacgaagucgacggc

SEQ ID NO: 2875341 - RNA, 20 nt, Mycobacterium avium subsp. paratuberculosis
ggcgacgaagucgacggcgg

SEQ ID NO: 2875342 - RNA, 13 nt, Mycobacterium avium subsp. paratuberculosis
ggcgacgaccgca

SEQ ID NO: 2875343 - RNA, 22 nt, Mycobacterium avium subsp. paratuberculosis
ggcgacgaccgcaccgaccagc

SEQ ID NO: 2875344 - RNA, 13 nt, Mycobacterium avium subsp. paratuberculosis
ggcgacgacgccg

SEQ ID NO: 2875345 - RNA, 14 nt, Mycobacterium avium subsp. paratuberculosis
ggcgacgacgccga

SEQ ID NO: 2875346 - RNA, 16 nt, Mycobacterium avium subsp. paratuberculosis
ggcgacgacgccgauc

SEQ ID NO: 2875347 - RNA, 12 nt, Mycobacterium avium subsp. paratuberculosis
ggcgacgacgcg

SEQ ID NO: 2875348 - RNA, 18 nt, Mycobacterium avium subsp. paratuberculosis
ggcgacgacgcggucguc

SEQ ID NO: 2875349 - RNA, 21 nt, Mycobacterium avium subsp. paratuberculosis
ggcgacgacgcggucgucguc

SEQ ID NO: 2875350 - RNA, 14 nt, Mycobacterium avium subsp. paratuberculosis
ggcgacgacggcgg

SEQ ID NO: 2875351 - RNA, 15 nt, Mycobacterium avium subsp. paratuberculosis
ggcgacgacggcgga

SEQ ID NO: 2875352 - RNA, 23 nt, Mycobacterium avium subsp. paratuberculosis
ggcgacgauaucggccgcggggc

SEQ ID NO: 2875353 - RNA, 15 nt, Mycobacterium avium subsp. paratuberculosis
ggcgacgaucggcuc

SEQ ID NO: 2875354 - RNA, 17 nt, Mycobacterium avium subsp. paratuberculosis
ggcgacgaucggcucga

SEQ ID NO: 2875355 - RNA, 20 nt, Mycobacterium avium subsp. paratuberculosis
ggcgacgaucggcucgagcu

SEQ ID NO: 2875356 - RNA, 19 nt, Mycobacterium avium subsp. paratuberculosis
ggcgacgaugaagacccgc

SEQ ID NO: 2875357 - RNA, 21 nt, Mycobacterium avium subsp. paratuberculosis
ggcgacgaugaagacccgccg

SEQ ID NO: 2875358 - RNA, 19 nt, Mycobacterium avium subsp. paratuberculosis
ggcgacgaugccggccggg

SEQ ID NO: 2875359 - RNA, 21 nt, Mycobacterium avium subsp. paratuberculosis
ggcgacgaugccggccgggac

SEQ ID NO: 2875360 - RNA, 14 nt, Mycobacterium avium subsp. paratuberculosis
ggcgacgauggcca

SEQ ID NO: 2875361 - RNA, 22 nt, Mycobacterium avium subsp. paratuberculosis
ggcgacgauggccaggcccagc

SEQ ID NO: 2875362 - RNA, 23 nt, Mycobacterium avium subsp. paratuberculosis
ggcgacgauggccaggcccagcc

SEQ ID NO: 2875363 - RNA, 12 nt, Mycobacterium avium subsp. paratuberculosis
ggcgacgcacga

SEQ ID NO: 2875364 - RNA, 13 nt, Mycobacterium avium subsp. paratuberculosis
ggcgacgccgccg

SEQ ID NO: 2875365 - RNA, 15 nt, Mycobacterium avium subsp. paratuberculosis
ggcgacgccgccguc

SEQ ID NO: 2875366 - RNA, 21 nt, Mycobacterium avium subsp. paratuberculosis
ggcgacgccgcgcuggccggg

SEQ ID NO: 2875367 - RNA, 13 nt, Mycobacterium avium subsp. paratuberculosis
ggcgacgccgcgg

SEQ ID NO: 2875368 - RNA, 17 nt, Mycobacterium avium subsp. paratuberculosis
ggcgacgccgcggaagc

SEQ ID NO: 2875369 - RNA, 22 nt, Mycobacterium avium subsp. paratuberculosis
ggcgacgccgcggaagccccag

SEQ ID NO: 2875370 - RNA, 20 nt, Mycobacterium avium subsp. paratuberculosis
ggcgacgccggcgaggcggu

SEQ ID NO: 2875371 - RNA, 12 nt, Mycobacterium avium subsp. paratuberculosis
ggcgacgcggcg

SEQ ID NO: 2875372 - RNA, 22 nt, Mycobacterium avium subsp. paratuberculosis
ggcgacgcugguggccugcaac

SEQ ID NO: 2875373 - RNA, 17 nt, Mycobacterium avium subsp. paratuberculosis
ggcgacgcugugcucgg

SEQ ID NO: 2875374 - RNA, 13 nt, Mycobacterium avium subsp. paratuberculosis
ggcgacggcaccg

SEQ ID NO: 2875375 - RNA, 23 nt, Mycobacterium avium subsp. paratuberculosis
ggcgacggcaccgccggcggccu

SEQ ID NO: 2875376 - RNA, 13 nt, Mycobacterium avium subsp. paratuberculosis
ggcgacggccagc

SEQ ID NO: 2875377 - RNA, 17 nt, Mycobacterium avium subsp. paratuberculosis
ggcgacggccagcgcgg

SEQ ID NO: 2875378 - RNA, 18 nt, Mycobacterium avium subsp. paratuberculosis
ggcgacggccagcgcggc

SEQ ID NO: 2875379 - RNA, 21 nt, Mycobacterium avium subsp. paratuberculosis
ggcgacggccagcgcggcggu

SEQ ID NO: 2875380 - RNA, 23 nt, Mycobacterium avium subsp. paratuberculosis
ggcgacggccguccggucgcugg

SEQ ID NO: 2875381 - RNA, 18 nt, Mycobacterium avium subsp. paratuberculosis
ggcgacggcgacggccag

SEQ ID NO: 2875382 - RNA, 19 nt, Mycobacterium avium subsp. paratuberculosis
ggcgacggcgacggccaga

SEQ ID NO: 2875383 - RNA, 12 nt, Mycobacterium avium subsp. paratuberculosis
ggcgacggcgcc

SEQ ID NO: 2875384 - RNA, 13 nt, Mycobacterium avium subsp. paratuberculosis
ggcgacggcgccu

SEQ ID NO: 2875385 - RNA, 16 nt, Mycobacterium avium subsp. paratuberculosis
ggcgacggcgcucacc

SEQ ID NO: 2875386 - RNA, 17 nt, Mycobacterium avium subsp. paratuberculosis
ggcgacggcgcucaccg

SEQ ID NO: 2875387 - RNA, 20 nt, Mycobacterium avium subsp. paratuberculosis
ggcgacggcgcucaccggcg

SEQ ID NO: 2875388 - RNA, 18 nt, Mycobacterium avium subsp. paratuberculosis
ggcgacggcgcuguggcc

SEQ ID NO: 2875389 - RNA, 13 nt, Mycobacterium avium subsp. paratuberculosis
ggcgacggcggcg

SEQ ID NO: 2875390 - RNA, 12 nt, Mycobacterium avium subsp. paratuberculosis
ggcgacggcggg

SEQ ID NO: 2875391 - RNA, 16 nt, Mycobacterium avium subsp. paratuberculosis
ggcgacggcggggugc

SEQ ID NO: 2875392 - RNA, 21 nt, Mycobacterium avium subsp. paratuberculosis
ggcgacggcgguucgaagcgc

SEQ ID NO: 2875393 - RNA, 16 nt, Mycobacterium avium subsp. paratuberculosis
ggcgacggcguccagc

SEQ ID NO: 2875394 - RNA, 22 nt, Mycobacterium avium subsp. paratuberculosis
ggcgacggcguccagcugcgcg

SEQ ID NO: 2875395 - RNA, 16 nt, Mycobacterium avium subsp. paratuberculosis
ggcgacggcgucggcg

SEQ ID NO: 2875396 - RNA, 14 nt, Mycobacterium avium subsp. paratuberculosis
ggcgacggcguugc

SEQ ID NO: 2875397 - RNA, 16 nt, Mycobacterium avium subsp. paratuberculosis
ggcgacgggccgauca

SEQ ID NO: 2875398 - RNA, 20 nt, Mycobacterium avium subsp. paratuberculosis
gggucgaacaucacccggcg

SEQ ID NO: 2875399 - RNA, 21 nt, Mycobacterium avium subsp. paratuberculosis
gggucgaacaucacccggcgg

SEQ ID NO: 2875400 - RNA, 23 nt, Mycobacterium avium subsp. paratuberculosis
gggucgaacaucacccggcggca

SEQ ID NO: 2875401 - RNA, 16 nt, Mycobacterium avium subsp. paratuberculosis
gggucgaacggcaacc

SEQ ID NO: 2875402 - RNA, 18 nt, Mycobacterium avium subsp. paratuberculosis
gggucgaaguccugcgcc

SEQ ID NO: 2875403 - RNA, 23 nt, Mycobacterium avium subsp. paratuberculosis
gggucgaaguccugcgccgcggu

SEQ ID NO: 2875404 - RNA, 16 nt, Mycobacterium avium subsp. paratuberculosis
gggucgacagccugac

SEQ ID NO: 2875405 - RNA, 21 nt, Mycobacterium avium subsp. paratuberculosis
gggucgacagccugaccgcgg

SEQ ID NO: 2875406 - RNA, 14 nt, Mycobacterium avium subsp. paratuberculosis
gggucgacccgccg

SEQ ID NO: 2875407 - RNA, 19 nt, Mycobacterium avium subsp. paratuberculosis
gggucgacccgccgcagcc

SEQ ID NO: 2875408 - RNA, 14 nt, Mycobacterium avium subsp. paratuberculosis
gggucgaccgccgc

SEQ ID NO: 2875409 - RNA, 18 nt, Mycobacterium avium subsp. paratuberculosis
gggucgaccgccgcgucg

SEQ ID NO: 2875410 - RNA, 11 nt, Mycobacterium avium subsp. paratuberculosis
gggucgacgag

SEQ ID NO: 2875411 - RNA, 13 nt, Mycobacterium avium subsp. paratuberculosis
gggucgacgagca

SEQ ID NO: 2875412 - RNA, 19 nt, Mycobacterium avium subsp. paratuberculosis
gggucgagaagcccgugcg

SEQ ID NO: 2875413 - RNA, 19 nt, Mycobacterium avium subsp. paratuberculosis
gggucgagacaccgucgcg

SEQ ID NO: 2875414 - RNA, 19 nt, Mycobacterium avium subsp. paratuberculosis
gggucgagaucagcaccgg

SEQ ID NO: 2875415 - RNA, 15 nt, Mycobacterium avium subsp. paratuberculosis
gggucgagcacgugg

SEQ ID NO: 2875416 - RNA, 13 nt, Mycobacterium avium subsp. paratuberculosis
gggucgagcgcgc

SEQ ID NO: 2875417 - RNA, 15 nt, Mycobacterium avium subsp. paratuberculosis
gggucgaucucggcg

SEQ ID NO: 2875418 - RNA, 17 nt, Mycobacterium avium subsp. paratuberculosis
gggucgcagcggcacgu

SEQ ID NO: 2875419 - RNA, 18 nt, Mycobacterium avium subsp. paratuberculosis
gggucgccaggccaccgc

SEQ ID NO: 2875420 - RNA, 19 nt, Mycobacterium avium subsp. paratuberculosis
gggucgccgaucucggcca

SEQ ID NO: 2875421 - RNA, 21 nt, Mycobacterium avium subsp. paratuberculosis
gggucgccgaucucggccaac

SEQ ID NO: 2875422 - RNA, 13 nt, Mycobacterium avium subsp. paratuberculosis
gggucgccgggca

SEQ ID NO: 2875423 - RNA, 15 nt, Mycobacterium avium subsp. paratuberculosis
gggucgccgggcagg

SEQ ID NO: 2875424 - RNA, 13 nt, Mycobacterium avium subsp. paratuberculosis
gggucgccggucu

SEQ ID NO: 2875425 - RNA, 12 nt, Mycobacterium avium subsp. paratuberculosis
gggucgccgucg

SEQ ID NO: 2875426 - RNA, 15 nt, Mycobacterium avium subsp. paratuberculosis
gggucgccgucgagg

SEQ ID NO: 2875427 - RNA, 15 nt, Mycobacterium avium subsp. paratuberculosis
gggucgcgccgguag

SEQ ID NO: 2875428 - RNA, 22 nt, Mycobacterium avium subsp. paratuberculosis
gggucgcgccgguagagcgcca

SEQ ID NO: 2875429 - RNA, 13 nt, Mycobacterium avium subsp. paratuberculosis
gggucgcggccca

SEQ ID NO: 2875430 - RNA, 15 nt, Mycobacterium avium subsp. paratuberculosis
gggucgcgggcgccg

SEQ ID NO: 2875431 - RNA, 18 nt, Mycobacterium avium subsp. paratuberculosis
gggucgcguccgcgaucg

SEQ ID NO: 2875432 - RNA, 19 nt, Mycobacterium avium subsp. paratuberculosis
gggucggagcgcuccacca

SEQ ID NO: 2875433 - RNA, 14 nt, Mycobacterium avium subsp. paratuberculosis
gggucggccagucg

SEQ ID NO: 2875434 - RNA, 15 nt, Mycobacterium avium subsp. paratuberculosis
gggucggccggaucg

SEQ ID NO: 2875435 - RNA, 12 nt, Mycobacterium avium subsp. paratuberculosis
gggucggccggc

SEQ ID NO: 2875436 - RNA, 14 nt, Mycobacterium avium subsp. paratuberculosis
gggucggccggcgg

SEQ ID NO: 2875437 - RNA, 15 nt, Mycobacterium avium subsp. paratuberculosis
gggucggccggcggg

SEQ ID NO: 2875438 - RNA, 16 nt, Mycobacterium avium subsp. paratuberculosis
gggucggcgaccaugc

SEQ ID NO: 2875439 - RNA, 12 nt, Mycobacterium avium subsp. paratuberculosis
gggucggcgccg

SEQ ID NO: 2875440 - RNA, 21 nt, Mycobacterium avium subsp. paratuberculosis
gggucggcgccgcgcgccagc

SEQ ID NO: 2875441 - RNA, 17 nt, Mycobacterium avium subsp. paratuberculosis
gggucggcgccggccag

SEQ ID NO: 2875442 - RNA, 14 nt, Mycobacterium avium subsp. paratuberculosis
gggucggcgucggg

SEQ ID NO: 2875443 - RNA, 17 nt, Mycobacterium avium subsp. paratuberculosis
gggucggcgucgggccg

SEQ ID NO: 2875444 - RNA, 22 nt, Mycobacterium avium subsp. paratuberculosis
gggucggcgucgggccgggggc

SEQ ID NO: 2875445 - RNA, 22 nt, Mycobacterium avium subsp. paratuberculosis
gggucggcucggcucggccggc

SEQ ID NO: 2875446 - RNA, 19 nt, Mycobacterium avium subsp. paratuberculosis
gggucgggaggcagcgcgg

SEQ ID NO: 2875447 - RNA, 17 nt, Mycobacterium avium subsp. paratuberculosis
gggucgggccggacagc

SEQ ID NO: 2875448 - RNA, 21 nt, Mycobacterium avium subsp. paratuberculosis
gggucgggggugggcucccag

SEQ ID NO: 2875449 - RNA, 17 nt, Mycobacterium avium subsp. paratuberculosis
gggucgggugcggcggu

SEQ ID NO: 2875450 - RNA, 13 nt, Mycobacterium avium subsp. paratuberculosis
gggucggucggcc

SEQ ID NO: 2875451 - RNA, 16 nt, Mycobacterium avium subsp. paratuberculosis
gggucggucggcccgc

SEQ ID NO: 2875452 - RNA, 19 nt, Mycobacterium avium subsp. paratuberculosis
gggucgguggcccagccgg

SEQ ID NO: 2875453 - RNA, 17 nt, Mycobacterium avium subsp. paratuberculosis
gggucguaccaccacca

SEQ ID NO: 2875454 - RNA, 19 nt, Mycobacterium avium subsp. paratuberculosis
gggucguaggacaccacgg

SEQ ID NO: 2875455 - RNA, 15 nt, Mycobacterium avium subsp. paratuberculosis
gggucguccgcgacg

SEQ ID NO: 2875456 - RNA, 22 nt, Mycobacterium avium subsp. paratuberculosis
gggucguccgcgacgcugagcg

SEQ ID NO: 2875457 - RNA, 13 nt, Mycobacterium avium subsp. paratuberculosis
gggucgucgacgg

SEQ ID NO: 2875458 - RNA, 17 nt, Mycobacterium avium subsp. paratuberculosis
gggucgucgacggccgc

SEQ ID NO: 2875459 - RNA, 18 nt, Mycobacterium avium subsp. paratuberculosis
gggucgucgacggccgcg

SEQ ID NO: 2875460 - RNA, 14 nt, Mycobacterium avium subsp. paratuberculosis
gggucgucgacguc

SEQ ID NO: 2875461 - RNA, 23 nt, Mycobacterium avium subsp. paratuberculosis
gggucgucgacgucggacgcggc

SEQ ID NO: 2875462 - RNA, 13 nt, Mycobacterium avium subsp. paratuberculosis
gggucgucggcgu

SEQ ID NO: 2875463 - RNA, 19 nt, Mycobacterium avium subsp. paratuberculosis
gggucgucgggcggcagga

SEQ ID NO: 2875464 - RNA, 21 nt, Mycobacterium avium subsp. paratuberculosis
gggucgucguucucgggggcg

SEQ ID NO: 2875465 - RNA, 19 nt, Mycobacterium avium subsp. paratuberculosis
gggucgugcaucggcgccu

SEQ ID NO: 2875466 - RNA, 16 nt, Mycobacterium avium subsp. paratuberculosis
gggucguuggcggcgg

SEQ ID NO: 2875467 - RNA, 17 nt, Mycobacterium avium subsp. paratuberculosis
gggucguuggcggcggu

SEQ ID NO: 2875468 - RNA, 20 nt, Mycobacterium avium subsp. paratuberculosis
gggucucgaaccgggcggug

SEQ ID NO: 2875469 - RNA, 14 nt, Mycobacterium avium subsp. paratuberculosis
gggucucgcccacc

SEQ ID NO: 2875470 - RNA, 14 nt, Mycobacterium avium subsp. paratuberculosis
gggucucgcgccac

SEQ ID NO: 2875471 - RNA, 14 nt, Mycobacterium avium subsp. paratuberculosis
gggucuggcccggu

SEQ ID NO: 2875472 - RNA, 16 nt, Mycobacterium avium subsp. paratuberculosis
gggucuggcccggugc

SEQ ID NO: 2875473 - RNA, 17 nt, Mycobacterium avium subsp. paratuberculosis
gggucugugaccacggu

SEQ ID NO: 2875474 - RNA, 14 nt, Mycobacterium avium subsp. paratuberculosis
gggucuuccacgcc

SEQ ID NO: 2875475 - RNA, 18 nt, Mycobacterium avium subsp. paratuberculosis
gggucuuccacgccggug

SEQ ID NO: 2875476 - RNA, 17 nt, Mycobacterium avium subsp. paratuberculosis
gggucuucucgaagcgc

SEQ ID NO: 2875477 - RNA, 21 nt, Mycobacterium avium subsp. paratuberculosis
gggucuucucgaagcgcagca

SEQ ID NO: 2875478 - RNA, 16 nt, Mycobacterium avium subsp. paratuberculosis
gggugaacgaggccgc

SEQ ID NO: 2875479 - RNA, 22 nt, Mycobacterium avium subsp. paratuberculosis
gggugaaggccuggaugccgcc

SEQ ID NO: 2875480 - RNA, 14 nt, Mycobacterium avium subsp. paratuberculosis
gggugaaggcggcc

SEQ ID NO: 2875481 - RNA, 15 nt, Mycobacterium avium subsp. paratuberculosis
gggugaagucguucu

SEQ ID NO: 2875482 - RNA, 14 nt, Mycobacterium avium subsp. paratuberculosis
gggugaaucaccaa

SEQ ID NO: 2875483 - RNA, 21 nt, Mycobacterium avium subsp. paratuberculosis
gucccguccugggccuggcgc

SEQ ID NO: 2875484 - RNA, 12 nt, Mycobacterium avium subsp. paratuberculosis
gucccgucggcc

SEQ ID NO: 2875485 - RNA, 24 nt, Mycobacterium avium subsp. paratuberculosis
gucccgucggccaguucgccggug

SEQ ID NO: 2875486 - RNA, 13 nt, Mycobacterium avium subsp. paratuberculosis
gucccgucggcgc

SEQ ID NO: 2875487 - RNA, 15 nt, Mycobacterium avium subsp. paratuberculosis
gucccgucggcgcga

SEQ ID NO: 2875488 - RNA, 14 nt, Mycobacterium avium subsp. paratuberculosis
gucccgugcgccgc

SEQ ID NO: 2875489 - RNA, 15 nt, Mycobacterium avium subsp. paratuberculosis
gucccgugcgccgcc

SEQ ID NO: 2875490 - RNA, 16 nt, Mycobacterium avium subsp. paratuberculosis
gucccgugcgccgccc

SEQ ID NO: 2875491 - RNA, 22 nt, Mycobacterium avium subsp. paratuberculosis
gucccguugcgggacugggcga

SEQ ID NO: 2875492 - RNA, 13 nt, Mycobacterium avium subsp. paratuberculosis
gucccguuggcgc

SEQ ID NO: 2875493 - RNA, 16 nt, Mycobacterium avium subsp. paratuberculosis
gucccguuggucucga

SEQ ID NO: 2875494 - RNA, 12 nt, Mycobacterium avium subsp. paratuberculosis
gucccucggcga

SEQ ID NO: 2875495 - RNA, 20 nt, Mycobacterium avium subsp. paratuberculosis
gucccucggcgagcgaggcc

SEQ ID NO: 2875496 - RNA, 23 nt, Mycobacterium avium subsp. paratuberculosis
gucccucgucuuggugcgagcca

SEQ ID NO: 2875497 - RNA, 16 nt, Mycobacterium avium subsp. paratuberculosis
gucccuggcgaugauc

SEQ ID NO: 2875498 - RNA, 18 nt, Mycobacterium avium subsp. paratuberculosis
guccgaaaaacgcgucgc

SEQ ID NO: 2875499 - RNA, 21 nt, Mycobacterium avium subsp. paratuberculosis
guccgaaacaucaaacggcag

SEQ ID NO: 2875500 - RNA, 13 nt, Mycobacterium avium subsp. paratuberculosis
guccgacagcccg

SEQ ID NO: 2875501 - RNA, 13 nt, Mycobacterium avium subsp. paratuberculosis
guccgacagcgcc

SEQ ID NO: 2875502 - RNA, 17 nt, Mycobacterium avium subsp. paratuberculosis
guccgacagcgccugcc

SEQ ID NO: 2875503 - RNA, 13 nt, Mycobacterium avium subsp. paratuberculosis
guccgaccagcac

SEQ ID NO: 2875504 - RNA, 12 nt, Mycobacterium avium subsp. paratuberculosis
guccgaccagcg

SEQ ID NO: 2875505 - RNA, 14 nt, Mycobacterium avium subsp. paratuberculosis
guccgaccagcggc

SEQ ID NO: 2875506 - RNA, 15 nt, Mycobacterium avium subsp. paratuberculosis
guccgaccagcggcc

SEQ ID NO: 2875507 - RNA, 15 nt, Mycobacterium avium subsp. paratuberculosis
guccgaccaggaaca

SEQ ID NO: 2875508 - RNA, 19 nt, Mycobacterium avium subsp. paratuberculosis
guccgaccgcguacagggc

SEQ ID NO: 2875509 - RNA, 13 nt, Mycobacterium avium subsp. paratuberculosis
guccgaccgguug

SEQ ID NO: 2875510 - RNA, 18 nt, Mycobacterium avium subsp. paratuberculosis
guccgaccguugaccgac

SEQ ID NO: 2875511 - RNA, 17 nt, Mycobacterium avium subsp. paratuberculosis
guccgacgagucgacgc

SEQ ID NO: 2875512 - RNA, 12 nt, Mycobacterium avium subsp. paratuberculosis
guccgacgccgu

SEQ ID NO: 2875513 - RNA, 14 nt, Mycobacterium avium subsp. paratuberculosis
guccgacgccgucg

SEQ ID NO: 2875514 - RNA, 15 nt, Mycobacterium avium subsp. paratuberculosis
guccgacgccgucga

SEQ ID NO: 2875515 - RNA, 17 nt, Mycobacterium avium subsp. paratuberculosis
guccgacgccgucgagc

SEQ ID NO: 2875516 - RNA, 16 nt, Mycobacterium avium subsp. paratuberculosis
guccgacgcgacgguc

SEQ ID NO: 2875517 - RNA, 19 nt, Mycobacterium avium subsp. paratuberculosis
guccgagaagggccgccgc

SEQ ID NO: 2875518 - RNA, 13 nt, Mycobacterium avium subsp. paratuberculosis
guccgagacgucg

SEQ ID NO: 2875519 - RNA, 14 nt, Mycobacterium avium subsp. paratuberculosis
guccgagacgucgg

SEQ ID NO: 2875520 - RNA, 15 nt, Mycobacterium avium subsp. paratuberculosis
guccgagacgucggc

SEQ ID NO: 2875521 - RNA, 16 nt, Mycobacterium avium subsp. paratuberculosis
guccgagcagcagccg

SEQ ID NO: 2875522 - RNA, 15 nt, Mycobacterium avium subsp. paratuberculosis
guccgagccgcccac

SEQ ID NO: 2875523 - RNA, 16 nt, Mycobacterium avium subsp. paratuberculosis
guccgagccgcccacg

SEQ ID NO: 2875524 - RNA, 13 nt, Mycobacterium avium subsp. paratuberculosis
guccgagcgggcc

SEQ ID NO: 2875525 - RNA, 18 nt, Mycobacterium avium subsp. paratuberculosis
guccgagcgggccguggc

SEQ ID NO: 2875526 - RNA, 14 nt, Mycobacterium avium subsp. paratuberculosis
guccgaggccccgc

SEQ ID NO: 2875527 - RNA, 18 nt, Mycobacterium avium subsp. paratuberculosis
guccgaggccccgccaga

SEQ ID NO: 2875528 - RNA, 22 nt, Mycobacterium avium subsp. paratuberculosis
guccgaggcgguuccgguggcg

SEQ ID NO: 2875529 - RNA, 23 nt, Mycobacterium avium subsp. paratuberculosis
guccgaggucuuggugaugcgcu

SEQ ID NO: 2875530 - RNA, 15 nt, Mycobacterium avium subsp. paratuberculosis
guccgaggugaucgc

SEQ ID NO: 2875531 - RNA, 16 nt, Mycobacterium avium subsp. paratuberculosis
guccgaggugaucgcg

SEQ ID NO: 2875532 - RNA, 17 nt, Mycobacterium avium subsp. paratuberculosis
guccgauaccagccgcg

SEQ ID NO: 2875533 - RNA, 19 nt, Mycobacterium avium subsp. paratuberculosis
guccgauaccagccgcgga

SEQ ID NO: 2875534 - RNA, 13 nt, Mycobacterium avium subsp. paratuberculosis
guccgaugacgag

SEQ ID NO: 2875535 - RNA, 18 nt, Mycobacterium avium subsp. paratuberculosis
guccgaugacgagcagcg

SEQ ID NO: 2875536 - RNA, 21 nt, Mycobacterium avium subsp. paratuberculosis
guccgauuucccgacuccuca

SEQ ID NO: 2875537 - RNA, 23 nt, Mycobacterium avium subsp. paratuberculosis
guccgauuucccgacuccucaca

SEQ ID NO: 2875538 - RNA, 16 nt, Mycobacterium avium subsp. paratuberculosis
guccgcaaccgccggc

SEQ ID NO: 2875539 - RNA, 17 nt, Mycobacterium avium subsp. paratuberculosis
guccgcaaccgccggca

SEQ ID NO: 2875540 - RNA, 14 nt, Mycobacterium avium subsp. paratuberculosis
guccgcaacgccgg

SEQ ID NO: 2875541 - RNA, 16 nt, Mycobacterium avium subsp. paratuberculosis
guccgcaacgccggcg

SEQ ID NO: 2875542 - RNA, 19 nt, Mycobacterium avium subsp. paratuberculosis
guccgcaacgccggcgugc

SEQ ID NO: 2875543 - RNA, 20 nt, Mycobacterium avium subsp. paratuberculosis
guccgcaacgccggcgugca

SEQ ID NO: 2875544 - RNA, 24 nt, Mycobacterium avium subsp. paratuberculosis
guccgcacccgggcccggucgucg

SEQ ID NO: 2875545 - RNA, 15 nt, Mycobacterium avium subsp. paratuberculosis
guccgcaccgcgacg

SEQ ID NO: 2875546 - RNA, 18 nt, Mycobacterium avium subsp. paratuberculosis
guccgcaugucgaagaag

SEQ ID NO: 2875547 - RNA, 14 nt, Mycobacterium avium subsp. paratuberculosis
guccgccagggugc

SEQ ID NO: 2875548 - RNA, 18 nt, Mycobacterium avium subsp. paratuberculosis
guccgccagggugccgcu

SEQ ID NO: 2875549 - RNA, 15 nt, Mycobacterium avium subsp. paratuberculosis
guccgcccagacgcg

SEQ ID NO: 2875550 - RNA, 15 nt, Mycobacterium avium subsp. paratuberculosis
guccgcccagcgagu

SEQ ID NO: 2875551 - RNA, 19 nt, Mycobacterium avium subsp. paratuberculosis
guccgccccgaugcgcauc

SEQ ID NO: 2875552 - RNA, 17 nt, Mycobacterium avium subsp. paratuberculosis
guccgccgcagcggcgc

SEQ ID NO: 2875553 - RNA, 21 nt, Mycobacterium avium subsp. paratuberculosis
guccgccgcagcggcgccgca

SEQ ID NO: 2875554 - RNA, 11 nt, Mycobacterium avium subsp. paratuberculosis
guccgccgccg

SEQ ID NO: 2875555 - RNA, 13 nt, Mycobacterium avium subsp. paratuberculosis
guccgccgccggc

SEQ ID NO: 2875556 - RNA, 15 nt, Mycobacterium avium subsp. paratuberculosis
guccgccgccggcgg

SEQ ID NO: 2875557 - RNA, 21 nt, Mycobacterium avium subsp. paratuberculosis
guccgccggagaccagcagcu

SEQ ID NO: 2875558 - RNA, 13 nt, Mycobacterium avium subsp. paratuberculosis
guccgccggccgg

SEQ ID NO: 2875559 - RNA, 15 nt, Mycobacterium avium subsp. paratuberculosis
guccgccggccgguc

SEQ ID NO: 2875560 - RNA, 15 nt, Mycobacterium avium subsp. paratuberculosis
guccgccggcggugc

SEQ ID NO: 2875561 - RNA, 20 nt, Mycobacterium avium subsp. paratuberculosis
guccgccggcuggcgggcga

SEQ ID NO: 2875562 - RNA, 23 nt, Mycobacterium avium subsp. paratuberculosis
guccgccggcuggcgggcgaucg

SEQ ID NO: 2875563 - RNA, 17 nt, Mycobacterium avium subsp. paratuberculosis
guccgccuccgaccagc

SEQ ID NO: 2875564 - RNA, 20 nt, Mycobacterium avium subsp. paratuberculosis
guccgccuccgaccagccgg

SEQ ID NO: 2875565 - RNA, 19 nt, Mycobacterium avium subsp. paratuberculosis
guccgcgaacgggugcggc

SEQ ID NO: 2875566 - RNA, 21 nt, Mycobacterium avium subsp. paratuberculosis
guccgcgaacgggugcggcgc

SEQ ID NO: 2875567 - RNA, 22 nt, Mycobacterium avium subsp. paratuberculosis
guccgcgaacgggugcggcgcu

SEQ ID NO: 2875568 - RNA, 15 nt, Mycobacterium avium subsp. paratuberculosis
guccggcucggugcc

SEQ ID NO: 2875569 - RNA, 16 nt, Mycobacterium avium subsp. paratuberculosis
guccggcucggugccg

SEQ ID NO: 2875570 - RNA, 23 nt, Mycobacterium avium subsp. paratuberculosis
guccggcucugccugcaggaugg

SEQ ID NO: 2875571 - RNA, 19 nt, Mycobacterium avium subsp. paratuberculosis
guccggcugaacgccagca

SEQ ID NO: 2875572 - RNA, 16 nt, Mycobacterium avium subsp. paratuberculosis
guccggcuggucggcc

SEQ ID NO: 2875573 - RNA, 17 nt, Mycobacterium avium subsp. paratuberculosis
guccggcuucaccguca

SEQ ID NO: 2875574 - RNA, 22 nt, Mycobacterium avium subsp. paratuberculosis
guccgggaacagcgacuccuga

SEQ ID NO: 2875575 - RNA, 21 nt, Mycobacterium avium subsp. paratuberculosis
guccgggauaguucgccgccg

SEQ ID NO: 2875576 - RNA, 22 nt, Mycobacterium avium subsp. paratuberculosis
guccgggauaguucgccgccgc

SEQ ID NO: 2875577 - RNA, 20 nt, Mycobacterium avium subsp. paratuberculosis
guccgggcacccgacgucga

SEQ ID NO: 2875578 - RNA, 14 nt, Mycobacterium avium subsp. paratuberculosis
guccgggccgccgg

SEQ ID NO: 2875579 - RNA, 16 nt, Mycobacterium avium subsp. paratuberculosis
guccgggccgccggcc

SEQ ID NO: 2875580 - RNA, 19 nt, Mycobacterium avium subsp. paratuberculosis
guccgggccgccggccgcg

SEQ ID NO: 2875581 - RNA, 22 nt, Mycobacterium avium subsp. paratuberculosis
guccgggcgcugcgcgguggcg

SEQ ID NO: 2875582 - RNA, 16 nt, Mycobacterium avium subsp. paratuberculosis
guccgggcguagugca

SEQ ID NO: 2875583 - RNA, 20 nt, Mycobacterium avium subsp. paratuberculosis
guccgggcguagugcagcug

SEQ ID NO: 2875584 - RNA, 23 nt, Mycobacterium avium subsp. paratuberculosis
guccgggcugcgguuccgggcgc

SEQ ID NO: 2875585 - RNA, 20 nt, Mycobacterium avium subsp. paratuberculosis
guccggggccggugcguccg

SEQ ID NO: 2875586 - RNA, 21 nt, Mycobacterium avium subsp. paratuberculosis
guccggggccggugcguccgc

SEQ ID NO: 2875587 - RNA, 18 nt, Mycobacterium avium subsp. paratuberculosis
guccggggugagcagggc

SEQ ID NO: 2875588 - RNA, 19 nt, Mycobacterium avium subsp. paratuberculosis
guccggggugagcagggcc

SEQ ID NO: 2875589 - RNA, 16 nt, Mycobacterium avium subsp. paratuberculosis
guccggggugggcacg

SEQ ID NO: 2875590 - RNA, 20 nt, Mycobacterium avium subsp. paratuberculosis
guccggggugggcacgucgg

SEQ ID NO: 2875591 - RNA, 14 nt, Mycobacterium avium subsp. paratuberculosis
guccgggucgcaca

SEQ ID NO: 2875592 - RNA, 20 nt, Mycobacterium avium subsp. paratuberculosis
guccgggucgcacagccgca

SEQ ID NO: 2875593 - RNA, 23 nt, Mycobacterium avium subsp. paratuberculosis
guccggguucgacgccucggugc

SEQ ID NO: 2875594 - RNA, 18 nt, Mycobacterium avium subsp. paratuberculosis
guccggguugggcgccug

SEQ ID NO: 2875595 - RNA, 19 nt, Mycobacterium avium subsp. paratuberculosis
guccgguaggccggccgca

SEQ ID NO: 2875596 - RNA, 20 nt, Mycobacterium avium subsp. paratuberculosis
guccgguaggugaucgccuc

SEQ ID NO: 2875597 - RNA, 16 nt, Mycobacterium avium subsp. paratuberculosis
guccggucagcaccgc

SEQ ID NO: 2875598 - RNA, 21 nt, Mycobacterium avium subsp. paratuberculosis
guccggucagcaccgcgcggc

SEQ ID NO: 2875599 - RNA, 21 nt, Mycobacterium avium subsp. paratuberculosis
guccggucucggucgcggcgu

SEQ ID NO: 2875600 - RNA, 20 nt, Mycobacterium avium subsp. paratuberculosis
guccgguucgaccggcguca

SEQ ID NO: 2875601 - RNA, 15 nt, Mycobacterium avium subsp. paratuberculosis
guccgguucggcggc

SEQ ID NO: 2875602 - RNA, 16 nt, Mycobacterium avium subsp. paratuberculosis
guccgguucggcggca

SEQ ID NO: 2875603 - RNA, 20 nt, Mycobacterium avium subsp. paratuberculosis
guccguagugcucggcgucc

SEQ ID NO: 2875604 - RNA, 21 nt, Mycobacterium avium subsp. paratuberculosis
guccguagugcucggcguccc

SEQ ID NO: 2875605 - RNA, 16 nt, Mycobacterium avium subsp. paratuberculosis
guccgugccacggccg

SEQ ID NO: 2875606 - RNA, 18 nt, Mycobacterium avium subsp. paratuberculosis
guccgugccacggccgcg

SEQ ID NO: 2875607 - RNA, 17 nt, Mycobacterium avium subsp. paratuberculosis
guccgugccguccggcc

SEQ ID NO: 2875608 - RNA, 19 nt, Mycobacterium avium subsp. paratuberculosis
guccgugcugccggccggc

SEQ ID NO: 2875609 - RNA, 17 nt, Mycobacterium avium subsp. paratuberculosis
guccguggugaucgccg

SEQ ID NO: 2875610 - RNA, 22 nt, Mycobacterium avium subsp. paratuberculosis
guccguuggaggugaucgccag

SEQ ID NO: 2875611 - RNA, 19 nt, Mycobacterium avium subsp. paratuberculosis
guccguugggggcgccgcg

SEQ ID NO: 2875612 - RNA, 23 nt, Mycobacterium avium subsp. paratuberculosis
guccguugggggcgccgcggcgc

SEQ ID NO: 2875613 - RNA, 22 nt, Mycobacterium avium subsp. paratuberculosis
guccuacggcgggugcgacggc

SEQ ID NO: 2875614 - RNA, 13 nt, Mycobacterium avium subsp. paratuberculosis
guccuccagcggc

SEQ ID NO: 2875615 - RNA, 15 nt, Mycobacterium avium subsp. paratuberculosis
guccucccagcgccc

SEQ ID NO: 2875616 - RNA, 16 nt, Mycobacterium avium subsp. paratuberculosis
guccucccagcgcccg

SEQ ID NO: 2875617 - RNA, 23 nt, Mycobacterium avium subsp. paratuberculosis
guccucccagcgcccgggcgcgu

SEQ ID NO: 2875618 - RNA, 21 nt, Mycobacterium avium subsp. paratuberculosis
guccuccccgcuggcgccggc

SEQ ID NO: 2875619 - RNA, 22 nt, Mycobacterium avium subsp. paratuberculosis
guccuccccgcuggcgccggcg

SEQ ID NO: 2875620 - RNA, 13 nt, Mycobacterium avium subsp. paratuberculosis
guccucccgggug

SEQ ID NO: 2875621 - RNA, 23 nt, Mycobacterium avium subsp. paratuberculosis
guccucccgggugggcagcgcga

SEQ ID NO: 2875622 - RNA, 11 nt, Mycobacterium avium subsp. paratuberculosis
guccuccucgu

SEQ ID NO: 2875623 - RNA, 13 nt, Mycobacterium avium subsp. paratuberculosis
guccuccucgucc

SEQ ID NO: 2875624 - RNA, 14 nt, Mycobacterium avium subsp. paratuberculosis
guccuccucguccg

SEQ ID NO: 2875625 - RNA, 16 nt, Mycobacterium avium subsp. paratuberculosis
guccuccugcgccggc

SEQ ID NO: 2875626 - RNA, 23 nt, Mycobacterium avium subsp. paratuberculosis
guccucgaccacccgcuggucaa

SEQ ID NO: 2875627 - RNA, 16 nt, Mycobacterium avium subsp. paratuberculosis
guccucgacgccgcgc

SEQ ID NO: 2875628 - RNA, 19 nt, Mycobacterium avium subsp. paratuberculosis
guccucgagagucgcuggc

SEQ ID NO: 2875629 - RNA, 13 nt, Mycobacterium avium subsp. paratuberculosis
guccucgagcugc

SEQ ID NO: 2875630 - RNA, 15 nt, Mycobacterium avium subsp. paratuberculosis
guccucgagcuggcc

SEQ ID NO: 2875631 - RNA, 16 nt, Mycobacterium avium subsp. paratuberculosis
guccucgagcuggccg

SEQ ID NO: 2875632 - RNA, 22 nt, Mycobacterium avium subsp. paratuberculosis
guccucgaucaccgacagcgcg

SEQ ID NO: 2875633 - RNA, 22 nt, Mycobacterium avium subsp. paratuberculosis
guccucgauccgguccagcccg

SEQ ID NO: 2875634 - RNA, 20 nt, Mycobacterium avium subsp. paratuberculosis
guccucgaugacgccggaca

SEQ ID NO: 2875635 - RNA, 22 nt, Mycobacterium avium subsp. paratuberculosis
guccucgaugacgccggacagc

SEQ ID NO: 2875636 - RNA, 16 nt, Mycobacterium avium subsp. paratuberculosis
guccucgaugccgacc

SEQ ID NO: 2875637 - RNA, 16 nt, Mycobacterium avium subsp. paratuberculosis
guccucgauggcggcg

SEQ ID NO: 2875638 - RNA, 12 nt, Mycobacterium avium subsp. paratuberculosis
guccucgcgguu

SEQ ID NO: 2875639 - RNA, 18 nt, Mycobacterium avium subsp. paratuberculosis
guccucgcgucgcgcggu

SEQ ID NO: 2875640 - RNA, 13 nt, Mycobacterium avium subsp. paratuberculosis
guccucgcuggcg

SEQ ID NO: 2875641 - RNA, 19 nt, Mycobacterium avium subsp. paratuberculosis
guccucggccgccaccgcc

SEQ ID NO: 2875642 - RNA, 14 nt, Mycobacterium avium subsp. paratuberculosis
guccucggcgaugu

SEQ ID NO: 2875643 - RNA, 23 nt, Mycobacterium avium subsp. paratuberculosis
guccucggggaugugcugcaggu

SEQ ID NO: 2875644 - RNA, 19 nt, Mycobacterium avium subsp. paratuberculosis
guccucggucucguccagu

SEQ ID NO: 2875645 - RNA, 14 nt, Mycobacterium avium subsp. paratuberculosis
guccucgucaccgu

SEQ ID NO: 2875646 - RNA, 16 nt, Mycobacterium avium subsp. paratuberculosis
guccucgucgaugccg

SEQ ID NO: 2875647 - RNA, 20 nt, Mycobacterium avium subsp. paratuberculosis
guccucgucggaggcgucga

SEQ ID NO: 2875648 - RNA, 14 nt, Mycobacterium avium subsp. paratuberculosis
guccucgucggcga

SEQ ID NO: 2875649 - RNA, 18 nt, Mycobacterium avium subsp. paratuberculosis
guccucguucuggcccgc

SEQ ID NO: 2875650 - RNA, 15 nt, Mycobacterium avium subsp. paratuberculosis
guccucucggcgccg

SEQ ID NO: 2875651 - RNA, 15 nt, Mycobacterium avium subsp. paratuberculosis
guccucuucgcggau

SEQ ID NO: 2875652 - RNA, 20 nt, Mycobacterium avium subsp. paratuberculosis
gucgaagaagcggccgacga

SEQ ID NO: 2875653 - RNA, 23 nt, Mycobacterium avium subsp. paratuberculosis
gucgaagaagucguucagcugca

SEQ ID NO: 2875654 - RNA, 15 nt, Mycobacterium avium subsp. paratuberculosis
gucgaagaccacgaa

SEQ ID NO: 2875655 - RNA, 16 nt, Mycobacterium avium subsp. paratuberculosis
gucgaagacggcgagg

SEQ ID NO: 2875656 - RNA, 17 nt, Mycobacterium avium subsp. paratuberculosis
gucgaagaggugcucga

SEQ ID NO: 2875657 - RNA, 16 nt, Mycobacterium avium subsp. paratuberculosis
gucgaagauggccagg

SEQ ID NO: 2875658 - RNA, 17 nt, Mycobacterium avium subsp. paratuberculosis
gucgaagauggccaggu

SEQ ID NO: 2875659 - RNA, 19 nt, Mycobacterium avium subsp. paratuberculosis
gucgaagaugucgcggcgc

SEQ ID NO: 2875660 - RNA, 22 nt, Mycobacterium avium subsp. paratuberculosis
gucgaagaugucgcggcgcacg

SEQ ID NO: 2875661 - RNA, 15 nt, Mycobacterium avium subsp. paratuberculosis
gucgaagcccgccgu

SEQ ID NO: 2875662 - RNA, 22 nt, Mycobacterium avium subsp. paratuberculosis
gucgaagcccuucaccucggcc

SEQ ID NO: 2875663 - RNA, 19 nt, Mycobacterium avium subsp. paratuberculosis
gucgaagccgaucaccggc

SEQ ID NO: 2875664 - RNA, 14 nt, Mycobacterium avium subsp. paratuberculosis
gucgaagccguggc

SEQ ID NO: 2875665 - RNA, 22 nt, Mycobacterium avium subsp. paratuberculosis
gucgaagccguggcaggcacga

SEQ ID NO: 2875666 - RNA, 17 nt, Mycobacterium avium subsp. paratuberculosis
gucgaagcgcagcaccu

SEQ ID NO: 2875667 - RNA, 16 nt, Mycobacterium avium subsp. paratuberculosis
gucgaagcgcaugccg

SEQ ID NO: 2875668 - RNA, 13 nt, Mycobacterium avium subsp. paratuberculosis
gucgaaggccggg

SEQ ID NO: 2875669 - RNA, 14 nt, Mycobacterium avium subsp. paratuberculosis
gucgaaggcgcggg

SEQ ID NO: 2875670 - RNA, 22 nt, Mycobacterium avium subsp. paratuberculosis
gucgaaggcgcgggcguccacg

SEQ ID NO: 2875671 - RNA, 17 nt, Mycobacterium avium subsp. paratuberculosis
gucgaaggcggccgcga

SEQ ID NO: 2875672 - RNA, 18 nt, Mycobacterium avium subsp. paratuberculosis
gucgaaggcggccgcgag

SEQ ID NO: 2875673 - RNA, 19 nt, Mycobacterium avium subsp. paratuberculosis
gucgaaggcggccgcgagc

SEQ ID NO: 2875674 - RNA, 20 nt, Mycobacterium avium subsp. paratuberculosis
gucgaaggcggccgcgagcc

SEQ ID NO: 2875675 - RNA, 15 nt, Mycobacterium avium subsp. paratuberculosis
gucgaagggcaucgg

SEQ ID NO: 2875676 - RNA, 14 nt, Mycobacterium avium subsp. paratuberculosis
gucgaagggucggu

SEQ ID NO: 2875677 - RNA, 17 nt, Mycobacterium avium subsp. paratuberculosis
gucgaagggucggucga

SEQ ID NO: 2875678 - RNA, 20 nt, Mycobacterium avium subsp. paratuberculosis
gucgaaggucugcagcagcc

SEQ ID NO: 2875679 - RNA, 20 nt, Mycobacterium avium subsp. paratuberculosis
gucgaaggugaugaaaaccg

SEQ ID NO: 2875680 - RNA, 20 nt, Mycobacterium avium subsp. paratuberculosis
gucgaaguagggccgcagcg

SEQ ID NO: 2875681 - RNA, 21 nt, Mycobacterium avium subsp. paratuberculosis
gucgaaguagggccgcagcgc

SEQ ID NO: 2875682 - RNA, 18 nt, Mycobacterium avium subsp. paratuberculosis
gucgaaguccugcgccgc

SEQ ID NO: 2875683 - RNA, 18 nt, Mycobacterium avium subsp. paratuberculosis
gucgaagucgaucccggg

SEQ ID NO: 2875684 - RNA, 17 nt, Mycobacterium avium subsp. paratuberculosis
gucgaagugcucgagca

SEQ ID NO: 2875685 - RNA, 14 nt, Mycobacterium avium subsp. paratuberculosis
gucgaaguucggca

SEQ ID NO: 2875686 - RNA, 12 nt, Mycobacterium avium subsp. paratuberculosis
gucgaaucacaa

SEQ ID NO: 2875687 - RNA, 20 nt, Mycobacterium avium subsp. paratuberculosis
gucgacaccccgcucggcca

SEQ ID NO: 2875688 - RNA, 21 nt, Mycobacterium avium subsp. paratuberculosis
gucgacacgaucggcaugacg

SEQ ID NO: 2875689 - RNA, 14 nt, Mycobacterium avium subsp. paratuberculosis
gucgacacgccggc

SEQ ID NO: 2875690 - RNA, 15 nt, Mycobacterium avium subsp. paratuberculosis
gucgacacgccggcc

SEQ ID NO: 2875691 - RNA, 22 nt, Mycobacterium avium subsp. paratuberculosis
gucgacagccggucgcgcaucg

SEQ ID NO: 2875692 - RNA, 23 nt, Mycobacterium avium subsp. paratuberculosis
gucgacagccugaccgcggguga

SEQ ID NO: 2875693 - RNA, 22 nt, Mycobacterium avium subsp. paratuberculosis
gucgaccaagacggugggcccg

SEQ ID NO: 2875694 - RNA, 17 nt, Mycobacterium avium subsp. paratuberculosis
gucgaccaaugcgauca

SEQ ID NO: 2875695 - RNA, 14 nt, Mycobacterium avium subsp. paratuberculosis
gucgaccacccgca

SEQ ID NO: 2875696 - RNA, 16 nt, Mycobacterium avium subsp. paratuberculosis
gucgaccacccgcagc

SEQ ID NO: 2875697 - RNA, 13 nt, Mycobacterium avium subsp. paratuberculosis
gucgaccaccgcc

SEQ ID NO: 2875698 - RNA, 14 nt, Mycobacterium avium subsp. paratuberculosis
gucgaccaccgccg

SEQ ID NO: 2875699 - RNA, 15 nt, Mycobacterium avium subsp. paratuberculosis
gucgaccaccgccgg

SEQ ID NO: 2875700 - RNA, 14 nt, Mycobacterium avium subsp. paratuberculosis
gucgaccaccgggu

SEQ ID NO: 2875701 - RNA, 15 nt, Mycobacterium avium subsp. paratuberculosis
gucgaccaccgggua

SEQ ID NO: 2875702 - RNA, 20 nt, Mycobacterium avium subsp. paratuberculosis
gucgaccacgaagggcgcca

SEQ ID NO: 2875703 - RNA, 14 nt, Mycobacterium avium subsp. paratuberculosis
gucgaccagccgca

SEQ ID NO: 2875704 - RNA, 17 nt, Mycobacterium avium subsp. paratuberculosis
gucgaccagccgcauca

SEQ ID NO: 2875705 - RNA, 20 nt, Mycobacterium avium subsp. paratuberculosis
gucgaccagcgggcugucgg

SEQ ID NO: 2875706 - RNA, 23 nt, Mycobacterium avium subsp. paratuberculosis
gucgaccagcgggcugucggcgc

SEQ ID NO: 2875707 - RNA, 20 nt, Mycobacterium avium subsp. paratuberculosis
gucgaccagcuugucgaucu

SEQ ID NO: 2875708 - RNA, 17 nt, Mycobacterium avium subsp. paratuberculosis
gucgaccagggcgauca

SEQ ID NO: 2875709 - RNA, 21 nt, Mycobacterium avium subsp. paratuberculosis
gucgaccagggcgaucaccgc

SEQ ID NO: 2875710 - RNA, 12 nt, Mycobacterium avium subsp. paratuberculosis
gucgaccaggua

SEQ ID NO: 2875711 - RNA, 18 nt, Mycobacterium avium subsp. paratuberculosis
gucgaccaucugccggcg

SEQ ID NO: 2875712 - RNA, 19 nt, Mycobacterium avium subsp. paratuberculosis
gucgaccaucugccggcgc

SEQ ID NO: 2875713 - RNA, 14 nt, Mycobacterium avium subsp. paratuberculosis
gucgaccccgccgg

SEQ ID NO: 2875714 - RNA, 15 nt, Mycobacterium avium subsp. paratuberculosis
gucgaccccgccggc

SEQ ID NO: 2875715 - RNA, 16 nt, Mycobacterium avium subsp. paratuberculosis
gucgaccccgccggcc

SEQ ID NO: 2875716 - RNA, 17 nt, Mycobacterium avium subsp. paratuberculosis
gucgaccccgccggccc

SEQ ID NO: 2875717 - RNA, 13 nt, Mycobacterium avium subsp. paratuberculosis
gucgacccgcggc

SEQ ID NO: 2875718 - RNA, 14 nt, Mycobacterium avium subsp. paratuberculosis
gucgacccgcggcg

SEQ ID NO: 2875719 - RNA, 18 nt, Mycobacterium avium subsp. paratuberculosis
gucgacccgcggcgccgc

SEQ ID NO: 2875720 - RNA, 12 nt, Mycobacterium avium subsp. paratuberculosis
gucgacccggcc

SEQ ID NO: 2875721 - RNA, 20 nt, Mycobacterium avium subsp. paratuberculosis
gucgacccggccgcgccgga

SEQ ID NO: 2875722 - RNA, 22 nt, Mycobacterium avium subsp. paratuberculosis
gucgacccggccgcgccggaug

SEQ ID NO: 2875723 - RNA, 18 nt, Mycobacterium avium subsp. paratuberculosis
gucgacccguuccccggc

SEQ ID NO: 2875724 - RNA, 21 nt, Mycobacterium avium subsp. paratuberculosis
gucgacccguuccccggccga

SEQ ID NO: 2875725 - RNA, 14 nt, Mycobacterium avium subsp. paratuberculosis
gucgaccgccacca

SEQ ID NO: 2875726 - RNA, 14 nt, Mycobacterium avium subsp. paratuberculosis
gucgaccgccccgc

SEQ ID NO: 2875727 - RNA, 19 nt, Mycobacterium avium subsp. paratuberculosis
gucgaccgccccgccggug

SEQ ID NO: 2875728 - RNA, 12 nt, Mycobacterium avium subsp. paratuberculosis
gucgaccgccgc

SEQ ID NO: 2875729 - RNA, 12 nt, Mycobacterium avium subsp. paratuberculosis
gucgaccgccuc

SEQ ID NO: 2875730 - RNA, 17 nt, Mycobacterium avium subsp. paratuberculosis
gucgaccgcgacgaccu

SEQ ID NO: 2875731 - RNA, 19 nt, Mycobacterium avium subsp. paratuberculosis
gucgaccgcgaugguggcg

SEQ ID NO: 2875732 - RNA, 16 nt, Mycobacterium avium subsp. paratuberculosis
gucgaccgcgcaccgg

SEQ ID NO: 2875733 - RNA, 17 nt, Mycobacterium avium subsp. paratuberculosis
gucgaccgcgcaccggc

SEQ ID NO: 2875734 - RNA, 12 nt, Mycobacterium avium subsp. paratuberculosis
gucgaccgcgcc

SEQ ID NO: 2875735 - RNA, 15 nt, Mycobacterium avium subsp. paratuberculosis
gucgaccgcgccggg

SEQ ID NO: 2875736 - RNA, 13 nt, Mycobacterium avium subsp. paratuberculosis
gucgaccgcggcc

SEQ ID NO: 2875737 - RNA, 22 nt, Mycobacterium avium subsp. paratuberculosis
gucgacgucggacgcggccgag

SEQ ID NO: 2875738 - RNA, 13 nt, Mycobacterium avium subsp. paratuberculosis
gucgacgucgggc

SEQ ID NO: 2875739 - RNA, 16 nt, Mycobacterium avium subsp. paratuberculosis
gucgacgucgggcacg

SEQ ID NO: 2875740 - RNA, 18 nt, Mycobacterium avium subsp. paratuberculosis
gucgacgucggggauggu

SEQ ID NO: 2875741 - RNA, 14 nt, Mycobacterium avium subsp. paratuberculosis
gucgacgucggugg

SEQ ID NO: 2875742 - RNA, 19 nt, Mycobacterium avium subsp. paratuberculosis
gucgacgucgucgacccgc

SEQ ID NO: 2875743 - RNA, 17 nt, Mycobacterium avium subsp. paratuberculosis
gucgacgugcgcggcgu

SEQ ID NO: 2875744 - RNA, 17 nt, Mycobacterium avium subsp. paratuberculosis
gucgacgugcucggcgg

SEQ ID NO: 2875745 - RNA, 19 nt, Mycobacterium avium subsp. paratuberculosis
gucgacgugcucggcggcc

SEQ ID NO: 2875746 - RNA, 22 nt, Mycobacterium avium subsp. paratuberculosis
gucgacgugcucggcggccgcc

SEQ ID NO: 2875747 - RNA, 23 nt, Mycobacterium avium subsp. paratuberculosis
gucgacgugcucggcggccgcca

SEQ ID NO: 2875748 - RNA, 17 nt, Mycobacterium avium subsp. paratuberculosis
gucgacgugggcggcca

SEQ ID NO: 2875749 - RNA, 18 nt, Mycobacterium avium subsp. paratuberculosis
gucgacguggugcaccgc

SEQ ID NO: 2875750 - RNA, 20 nt, Mycobacterium avium subsp. paratuberculosis
gucgacguggugcaccgcca

SEQ ID NO: 2875751 - RNA, 22 nt, Mycobacterium avium subsp. paratuberculosis
gucgacguggugcaccgccagc

SEQ ID NO: 2875752 - RNA, 19 nt, Mycobacterium avium subsp. paratuberculosis
gucgacguucgagucggcc

SEQ ID NO: 2875753 - RNA, 16 nt, Mycobacterium avium subsp. paratuberculosis
gucgacguucgccgcc

SEQ ID NO: 2875754 - RNA, 17 nt, Mycobacterium avium subsp. paratuberculosis
gucgacguucgccgcca

SEQ ID NO: 2875755 - RNA, 15 nt, Mycobacterium avium subsp. paratuberculosis
gucgacucggcggug

SEQ ID NO: 2875756 - RNA, 17 nt, Mycobacterium avium subsp. paratuberculosis
gucgacucggcggugcc

SEQ ID NO: 2875757 - RNA, 16 nt, Mycobacterium avium subsp. paratuberculosis
gucgacugcaccgacu

SEQ ID NO: 2875758 - RNA, 18 nt, Mycobacterium avium subsp. paratuberculosis
gucgacugggccaggucg

SEQ ID NO: 2875759 - RNA, 12 nt, Mycobacterium avium subsp. paratuberculosis
gucgacuggucg

SEQ ID NO: 2875760 - RNA, 17 nt, Mycobacterium avium subsp. paratuberculosis
gucgacuuguugcguga

SEQ ID NO: 2875761 - RNA, 16 nt, Mycobacterium avium subsp. paratuberculosis
gucgagaaaagcggcg

SEQ ID NO: 2875762 - RNA, 14 nt, Mycobacterium avium subsp. paratuberculosis
gucgagaaacgcgc

SEQ ID NO: 2875763 - RNA, 17 nt, Mycobacterium avium subsp. paratuberculosis
gucgagaaaggccagca

SEQ ID NO: 2875764 - RNA, 21 nt, Mycobacterium avium subsp. paratuberculosis
gucgagaagaccugguugccg

SEQ ID NO: 2875765 - RNA, 15 nt, Mycobacterium avium subsp. paratuberculosis
gucgagaagcccgug

SEQ ID NO: 2875766 - RNA, 19 nt, Mycobacterium avium subsp. paratuberculosis
gucgagacaccgucgcgca

SEQ ID NO: 2875767 - RNA, 22 nt, Mycobacterium avium subsp. paratuberculosis
gucgagacaccgucgcgcaccc

SEQ ID NO: 2875768 - RNA, 12 nt, Mycobacterium avium subsp. paratuberculosis
gucgagagccgc

SEQ ID NO: 2875769 - RNA, 15 nt, Mycobacterium avium subsp. paratuberculosis
gucgagagccgcauc

SEQ ID NO: 2875770 - RNA, 16 nt, Mycobacterium avium subsp. paratuberculosis
gucgagagccgcaucg

SEQ ID NO: 2875771 - RNA, 15 nt, Mycobacterium avium subsp. paratuberculosis
gucgagaucagcacc

SEQ ID NO: 2875772 - RNA, 20 nt, Mycobacterium avium subsp. paratuberculosis
gucgagaucagcaccgggug

SEQ ID NO: 2875773 - RNA, 17 nt, Mycobacterium avium subsp. paratuberculosis
gucgagaucgucgugga

SEQ ID NO: 2875774 - RNA, 19 nt, Mycobacterium avium subsp. paratuberculosis
gucgagcaccacccgggug

SEQ ID NO: 2875775 - RNA, 12 nt, Mycobacterium avium subsp. paratuberculosis
gucgagcaccgc

SEQ ID NO: 2875776 - RNA, 13 nt, Mycobacterium avium subsp. paratuberculosis
gucgagcaccgcg

SEQ ID NO: 2875777 - RNA, 14 nt, Mycobacterium avium subsp. paratuberculosis
gucgagcaccgcga

SEQ ID NO: 2875778 - RNA, 15 nt, Mycobacterium avium subsp. paratuberculosis
gucgagcaccgcgac

SEQ ID NO: 2875779 - RNA, 19 nt, Mycobacterium avium subsp. paratuberculosis
gucgagcaccgcgaccacg

SEQ ID NO: 2875780 - RNA, 15 nt, Mycobacterium avium subsp. paratuberculosis
gucgagcaccgcgau

SEQ ID NO: 2875781 - RNA, 21 nt, Mycobacterium avium subsp. paratuberculosis
gucgagcaccgcgaucaccga

SEQ ID NO: 2875782 - RNA, 23 nt, Mycobacterium avium subsp. paratuberculosis
gucgagcaccgcguccgcgucgu

SEQ ID NO: 2875783 - RNA, 22 nt, Mycobacterium avium subsp. paratuberculosis
gucgagcaccggcagccgcagc

SEQ ID NO: 2875784 - RNA, 14 nt, Mycobacterium avium subsp. paratuberculosis
gucgagcaccggcu

SEQ ID NO: 2875785 - RNA, 17 nt, Mycobacterium avium subsp. paratuberculosis
gucgagcaccggcuggu

SEQ ID NO: 2875786 - RNA, 23 nt, Mycobacterium avium subsp. paratuberculosis
gucgagcaccggcuggugcagca

SEQ ID NO: 2875787 - RNA, 14 nt, Mycobacterium avium subsp. paratuberculosis
gucgagcaccucca

SEQ ID NO: 2875788 - RNA, 17 nt, Mycobacterium avium subsp. paratuberculosis
gucgagcacgucgacgc

SEQ ID NO: 2875789 - RNA, 19 nt, Mycobacterium avium subsp. paratuberculosis
gucgagcacgucgacgccg

SEQ ID NO: 2875790 - RNA, 14 nt, Mycobacterium avium subsp. paratuberculosis
gucgagcagcacca

SEQ ID NO: 2875791 - RNA, 16 nt, Mycobacterium avium subsp. paratuberculosis
gucgagcagcaccacc

SEQ ID NO: 2875792 - RNA, 21 nt, Mycobacterium avium subsp. paratuberculosis
gucgagcagcagccgccgggc

SEQ ID NO: 2875793 - RNA, 22 nt, Mycobacterium avium subsp. paratuberculosis
gucgagcagcagccgccgggcc

SEQ ID NO: 2875794 - RNA, 13 nt, Mycobacterium avium subsp. paratuberculosis
gucgagcagccgc

SEQ ID NO: 2875795 - RNA, 14 nt, Mycobacterium avium subsp. paratuberculosis
gucgagcagccgca

SEQ ID NO: 2875796 - RNA, 15 nt, Mycobacterium avium subsp. paratuberculosis
gucgagcagccgcaa

SEQ ID NO: 2875797 - RNA, 16 nt, Mycobacterium avium subsp. paratuberculosis
gucgagcagccgcaac

SEQ ID NO: 2875798 - RNA, 13 nt, Mycobacterium avium subsp. paratuberculosis
gucgagcagcgcc

SEQ ID NO: 2875799 - RNA, 14 nt, Mycobacterium avium subsp. paratuberculosis
gucgagcagcgccc

SEQ ID NO: 2875800 - RNA, 22 nt, Mycobacterium avium subsp. paratuberculosis
gucgagcagguucuccucccag

SEQ ID NO: 2875801 - RNA, 23 nt, Mycobacterium avium subsp. paratuberculosis
gucgagcagguucuccucccagc

SEQ ID NO: 2875802 - RNA, 22 nt, Mycobacterium avium subsp. paratuberculosis
gucgagccaccacugcgccguc

SEQ ID NO: 2875803 - RNA, 23 nt, Mycobacterium avium subsp. paratuberculosis
gucgagccaccacugcgccguca

SEQ ID NO: 2875804 - RNA, 19 nt, Mycobacterium avium subsp. paratuberculosis
gucgagccgcagucgauca

SEQ ID NO: 2875805 - RNA, 15 nt, Mycobacterium avium subsp. paratuberculosis
gucgagccgcucgcg

SEQ ID NO: 2875806 - RNA, 18 nt, Mycobacterium avium subsp. paratuberculosis
gucgagccgcucgcgcac

SEQ ID NO: 2875807 - RNA, 22 nt, Mycobacterium avium subsp. paratuberculosis
gucgagccgcucgcgcaccggg

SEQ ID NO: 2875808 - RNA, 23 nt, Mycobacterium avium subsp. paratuberculosis
gucgagccggccggacaccgaac

SEQ ID NO: 2875809 - RNA, 19 nt, Mycobacterium avium subsp. paratuberculosis
gucgagccgggcccgggug

SEQ ID NO: 2875810 - RNA, 14 nt, Mycobacterium avium subsp. paratuberculosis
gucgagccggugcc

SEQ ID NO: 2875811 - RNA, 17 nt, Mycobacterium avium subsp. paratuberculosis
gucgagccggugccgag

SEQ ID NO: 2875812 - RNA, 15 nt, Mycobacterium avium subsp. paratuberculosis
gucgagccuggugau

SEQ ID NO: 2875813 - RNA, 15 nt, Mycobacterium avium subsp. paratuberculosis
gucgagcgcgccgag

SEQ ID NO: 2875814 - RNA, 16 nt, Mycobacterium avium subsp. paratuberculosis
gucgagcgcggcccgc

SEQ ID NO: 2875815 - RNA, 19 nt, Mycobacterium avium subsp. paratuberculosis
gucgagcgcggcccgccga

SEQ ID NO: 2875816 - RNA, 21 nt, Mycobacterium avium subsp. paratuberculosis
gucgagcgcggcccgccgaac

SEQ ID NO: 2875817 - RNA, 15 nt, Mycobacterium avium subsp. paratuberculosis
gucgagcgcucgcgg

SEQ ID NO: 2875818 - RNA, 15 nt, Mycobacterium avium subsp. paratuberculosis
gucgagcggcccgca

SEQ ID NO: 2875819 - RNA, 17 nt, Mycobacterium avium subsp. paratuberculosis
gucgagcggcccgcacc

SEQ ID NO: 2875820 - RNA, 21 nt, Mycobacterium avium subsp. paratuberculosis
gucgagcggcccgcaccgaug

SEQ ID NO: 2875821 - RNA, 23 nt, Mycobacterium avium subsp. paratuberculosis
gucgagcggcccgucgccgauca

SEQ ID NO: 2875822 - RNA, 15 nt, Mycobacterium avium subsp. paratuberculosis
gucgauccccgcagc

SEQ ID NO: 2875823 - RNA, 15 nt, Mycobacterium avium subsp. paratuberculosis
gucgaucgacgccga

SEQ ID NO: 2875824 - RNA, 16 nt, Mycobacterium avium subsp. paratuberculosis
gucgaucgacgccgac

SEQ ID NO: 2875825 - RNA, 17 nt, Mycobacterium avium subsp. paratuberculosis
gucgaucgacgccgaca

SEQ ID NO: 2875826 - RNA, 12 nt, Mycobacterium avium subsp. paratuberculosis
gucgaucgccag

SEQ ID NO: 2875827 - RNA, 17 nt, Mycobacterium avium subsp. paratuberculosis
gucgaucgccagcgcgc

SEQ ID NO: 2875828 - RNA, 20 nt, Mycobacterium avium subsp. paratuberculosis
gucgaucgccagcgcgcaga

SEQ ID NO: 2875829 - RNA, 21 nt, Mycobacterium avium subsp. paratuberculosis
gucgaucgcggcgauggacgu

SEQ ID NO: 2875830 - RNA, 23 nt, Mycobacterium avium subsp. paratuberculosis
gucgaucgcguaggguucgccga

SEQ ID NO: 2875831 - RNA, 17 nt, Mycobacterium avium subsp. paratuberculosis
gucgaucggcucggcgc

SEQ ID NO: 2875832 - RNA, 23 nt, Mycobacterium avium subsp. paratuberculosis
gucgaucuccucgcgcggcacca

SEQ ID NO: 2875833 - RNA, 17 nt, Mycobacterium avium subsp. paratuberculosis
gucgaucucggccagcg

SEQ ID NO: 2875834 - RNA, 14 nt, Mycobacterium avium subsp. paratuberculosis
gucgaucucggcgc

SEQ ID NO: 2875835 - RNA, 18 nt, Mycobacterium avium subsp. paratuberculosis
gucgaucucggcgcaggu

SEQ ID NO: 2875836 - RNA, 19 nt, Mycobacterium avium subsp. paratuberculosis
gucgaucucuucgccggac

SEQ ID NO: 2875837 - RNA, 20 nt, Mycobacterium avium subsp. paratuberculosis
gucgaucucuucgccggaca

SEQ ID NO: 2875838 - RNA, 18 nt, Mycobacterium avium subsp. paratuberculosis
gucgaucugcggcacggu

SEQ ID NO: 2875839 - RNA, 19 nt, Mycobacterium avium subsp. paratuberculosis
gucgaucugcggcacggug

SEQ ID NO: 2875840 - RNA, 22 nt, Mycobacterium avium subsp. paratuberculosis
gucgaucuugcguuccucgacg

SEQ ID NO: 2875841 - RNA, 23 nt, Mycobacterium avium subsp. paratuberculosis
gucgaugaaccgcugcugcucgg

SEQ ID NO: 2875842 - RNA, 17 nt, Mycobacterium avium subsp. paratuberculosis
gucgaugaagucgguga

SEQ ID NO: 2875843 - RNA, 23 nt, Mycobacterium avium subsp. paratuberculosis
gucgaugaagucggugagcaccg

SEQ ID NO: 2875844 - RNA, 21 nt, Mycobacterium avium subsp. paratuberculosis
gucgaugaauuccggugugcc

SEQ ID NO: 2875845 - RNA, 16 nt, Mycobacterium avium subsp. paratuberculosis
gucgaugaccucgcgc

SEQ ID NO: 2875846 - RNA, 19 nt, Mycobacterium avium subsp. paratuberculosis
gucgaugaccucgcgcagc

SEQ ID NO: 2875847 - RNA, 19 nt, Mycobacterium avium subsp. paratuberculosis
gucgaugaccucgcgcccg

SEQ ID NO: 2875848 - RNA, 20 nt, Mycobacterium avium subsp. paratuberculosis
gucgaugaccucgcgcccgg

SEQ ID NO: 2875849 - RNA, 22 nt, Mycobacterium avium subsp. paratuberculosis
gucgaugaccucgcgcccggcg

SEQ ID NO: 2875850 - RNA, 16 nt, Mycobacterium avium subsp. paratuberculosis
gucgaugacgccgcgc

SEQ ID NO: 2875851 - RNA, 19 nt, Mycobacterium avium subsp. paratuberculosis
gucgaugacgccgcgccgc

SEQ ID NO: 2875852 - RNA, 15 nt, Mycobacterium avium subsp. paratuberculosis
gucgaugacggcggc

SEQ ID NO: 2875853 - RNA, 13 nt, Mycobacterium avium subsp. paratuberculosis
gucgaugacgguc

SEQ ID NO: 2875854 - RNA, 18 nt, Mycobacterium avium subsp. paratuberculosis
gucgaugacguccaccag

SEQ ID NO: 2875855 - RNA, 14 nt, Mycobacterium avium subsp. paratuberculosis
gucgaugagcuggu

SEQ ID NO: 2875856 - RNA, 19 nt, Mycobacterium avium subsp. paratuberculosis
gucgaugagcuggugcagc

SEQ ID NO: 2875857 - RNA, 16 nt, Mycobacterium avium subsp. paratuberculosis
gucgaugaucuggcgg

SEQ ID NO: 2875858 - RNA, 16 nt, Mycobacterium avium subsp. paratuberculosis
gucgaugcacgccgga

SEQ ID NO: 2875859 - RNA, 14 nt, Mycobacterium avium subsp. paratuberculosis
gucgaugcccgcgc

SEQ ID NO: 2875860 - RNA, 19 nt, Mycobacterium avium subsp. paratuberculosis
gucgaugcccgcgccgacc

SEQ ID NO: 2875861 - RNA, 20 nt, Mycobacterium avium subsp. paratuberculosis
gucgaugcccgcgccgacca

SEQ ID NO: 2875862 - RNA, 23 nt, Mycobacterium avium subsp. paratuberculosis
gucgaugcccgcgccgaccagcg

SEQ ID NO: 2875863 - RNA, 15 nt, Mycobacterium avium subsp. paratuberculosis
gucgaugcccgcguc

SEQ ID NO: 2875864 - RNA, 20 nt, Mycobacterium avium subsp. paratuberculosis
gucgaugcccuagcgguggc

SEQ ID NO: 2875865 - RNA, 21 nt, Mycobacterium avium subsp. paratuberculosis
gucgaugcccuagcgguggcg

SEQ ID NO: 2875866 - RNA, 18 nt, Mycobacterium avium subsp. paratuberculosis
gucgaugccgaaccgcuc

SEQ ID NO: 2875867 - RNA, 23 nt, Mycobacterium avium subsp. paratuberculosis
gucgaugccgaaccgcuccccga

SEQ ID NO: 2875868 - RNA, 18 nt, Mycobacterium avium subsp. paratuberculosis
gucgaugccgagccggcc

SEQ ID NO: 2875869 - RNA, 20 nt, Mycobacterium avium subsp. paratuberculosis
gucgaugccgagccggccga

SEQ ID NO: 2875870 - RNA, 13 nt, Mycobacterium avium subsp. paratuberculosis
gucgaugccggcc

SEQ ID NO: 2875871 - RNA, 20 nt, Mycobacterium avium subsp. paratuberculosis
gucgaugccggccagcggcc

SEQ ID NO: 2875872 - RNA, 14 nt, Mycobacterium avium subsp. paratuberculosis
gucgaugccggcga

SEQ ID NO: 2875873 - RNA, 13 nt, Mycobacterium avium subsp. paratuberculosis
gucgaugcgcagc

SEQ ID NO: 2875874 - RNA, 14 nt, Mycobacterium avium subsp. paratuberculosis
gucgaugcgcagca

SEQ ID NO: 2875875 - RNA, 14 nt, Mycobacterium avium subsp. paratuberculosis
gucgaugcgggccc

SEQ ID NO: 2875876 - RNA, 17 nt, Mycobacterium avium subsp. paratuberculosis
gucgaugcgggcccgca

SEQ ID NO: 2875877 - RNA, 15 nt, Mycobacterium avium subsp. paratuberculosis
gucgauggcgcggcc

SEQ ID NO: 2875878 - RNA, 20 nt, Mycobacterium avium subsp. paratuberculosis
gucgauggucgccugcugga

SEQ ID NO: 2875879 - RNA, 13 nt, Mycobacterium avium subsp. paratuberculosis
gucgauggucugc

SEQ ID NO: 2875880 - RNA, 21 nt, Mycobacterium avium subsp. paratuberculosis
gucgauggucugcccgccgcc

SEQ ID NO: 2875881 - RNA, 23 nt, Mycobacterium avium subsp. paratuberculosis
gucgauggucugcccgccgccga

SEQ ID NO: 2875882 - RNA, 16 nt, Mycobacterium avium subsp. paratuberculosis
gucgaugucgcccggc

SEQ ID NO: 2875883 - RNA, 22 nt, Mycobacterium avium subsp. paratuberculosis
gucgaugucggcgaaccagggc

SEQ ID NO: 2875884 - RNA, 21 nt, Mycobacterium avium subsp. paratuberculosis
gucgaugucggcggcccggua

SEQ ID NO: 2875885 - RNA, 17 nt, Mycobacterium avium subsp. paratuberculosis
gucgaugucggugcggc

SEQ ID NO: 2875886 - RNA, 17 nt, Mycobacterium avium subsp. paratuberculosis
gucgaugucgguggcgc

SEQ ID NO: 2875887 - RNA, 14 nt, Mycobacterium avium subsp. paratuberculosis
gucgaugucgucgu

SEQ ID NO: 2875888 - RNA, 17 nt, Mycobacterium avium subsp. paratuberculosis
gucgaugucgucgucga

SEQ ID NO: 2875889 - RNA, 16 nt, Mycobacterium avium subsp. paratuberculosis
gucgaugugcgcgcug

SEQ ID NO: 2875890 - RNA, 14 nt, Mycobacterium avium subsp. paratuberculosis
gucgaugugcucgg

SEQ ID NO: 2875891 - RNA, 18 nt, Mycobacterium avium subsp. paratuberculosis
gucgaugugggccgcagc

SEQ ID NO: 2875892 - RNA, 22 nt, Mycobacterium avium subsp. paratuberculosis
gucgaugugggccgcagcagcg

SEQ ID NO: 2875893 - RNA, 14 nt, Mycobacterium avium subsp. paratuberculosis
gucgauucaucgcc

SEQ ID NO: 2875894 - RNA, 15 nt, Mycobacterium avium subsp. paratuberculosis
gucgauucaucgccg

SEQ ID NO: 2875895 - RNA, 15 nt, Mycobacterium avium subsp. paratuberculosis
gucgauugccgcggc

SEQ ID NO: 2875896 - RNA, 17 nt, Mycobacterium avium subsp. paratuberculosis
gucgauugccgcggccg

SEQ ID NO: 2875897 - RNA, 18 nt, Mycobacterium avium subsp. paratuberculosis
gucgauugccgcggccgc

SEQ ID NO: 2875898 - RNA, 22 nt, Mycobacterium avium subsp. paratuberculosis
gucgcaaagacauucggggcca

SEQ ID NO: 2875899 - RNA, 14 nt, Mycobacterium avium subsp. paratuberculosis
gucgcaacggucgg

SEQ ID NO: 2875900 - RNA, 22 nt, Mycobacterium avium subsp. paratuberculosis
gucgcacaaccgugacugggug

SEQ ID NO: 2875901 - RNA, 23 nt, Mycobacterium avium subsp. paratuberculosis
gucgcacaaccgugacugggugg

SEQ ID NO: 2875902 - RNA, 16 nt, Mycobacterium avium subsp. paratuberculosis
gucgcacaccagcacg

SEQ ID NO: 2875903 - RNA, 19 nt, Mycobacterium avium subsp. paratuberculosis
gucgcacaccagcacggcg

SEQ ID NO: 2875904 - RNA, 23 nt, Mycobacterium avium subsp. paratuberculosis
gucgcacaccagcacggcggcgc

SEQ ID NO: 2875905 - RNA, 14 nt, Mycobacterium avium subsp. paratuberculosis
gucgcacagccgca

SEQ ID NO: 2875906 - RNA, 22 nt, Mycobacterium avium subsp. paratuberculosis
gucgcccagcgugucggcgauc

SEQ ID NO: 2875907 - RNA, 16 nt, Mycobacterium avium subsp. paratuberculosis
gucgcccagcugggcc

SEQ ID NO: 2875908 - RNA, 18 nt, Mycobacterium avium subsp. paratuberculosis
gucgcccccucggccggu

SEQ ID NO: 2875909 - RNA, 13 nt, Mycobacterium avium subsp. paratuberculosis
gucgccccgcacc

SEQ ID NO: 2875910 - RNA, 14 nt, Mycobacterium avium subsp. paratuberculosis
gucgccccgcaccg

SEQ ID NO: 2875911 - RNA, 17 nt, Mycobacterium avium subsp. paratuberculosis
gucgccccgcaccgagc

SEQ ID NO: 2875912 - RNA, 17 nt, Mycobacterium avium subsp. paratuberculosis
gucgccccggccgcggu

SEQ ID NO: 2875913 - RNA, 19 nt, Mycobacterium avium subsp. paratuberculosis
gucgccccggccgcgguga

SEQ ID NO: 2875914 - RNA, 16 nt, Mycobacterium avium subsp. paratuberculosis
gucgcccgccgacggc

SEQ ID NO: 2875915 - RNA, 17 nt, Mycobacterium avium subsp. paratuberculosis
gucgcccgccgacggcu

SEQ ID NO: 2875916 - RNA, 21 nt, Mycobacterium avium subsp. paratuberculosis
gucgcccgccgacggcugccc

SEQ ID NO: 2875917 - RNA, 17 nt, Mycobacterium avium subsp. paratuberculosis
gucgcccgcguugcggc

SEQ ID NO: 2875918 - RNA, 19 nt, Mycobacterium avium subsp. paratuberculosis
gucgcccgcguugcggcgc

SEQ ID NO: 2875919 - RNA, 20 nt, Mycobacterium avium subsp. paratuberculosis
gucgcccgcguugcggcgca

SEQ ID NO: 2875920 - RNA, 12 nt, Mycobacterium avium subsp. paratuberculosis
gucgcccggcgc

SEQ ID NO: 2875921 - RNA, 15 nt, Mycobacterium avium subsp. paratuberculosis
gucgcccggcgcggc

SEQ ID NO: 2875922 - RNA, 13 nt, Mycobacterium avium subsp. paratuberculosis
gucgcccggcggc

SEQ ID NO: 2875923 - RNA, 20 nt, Mycobacterium avium subsp. paratuberculosis
gucgcccggcggcaccgagu

SEQ ID NO: 2875924 - RNA, 14 nt, Mycobacterium avium subsp. paratuberculosis
gucgcccggcucgc

SEQ ID NO: 2875925 - RNA, 14 nt, Mycobacterium avium subsp. paratuberculosis
gucgcccggguugc

SEQ ID NO: 2875926 - RNA, 18 nt, Mycobacterium avium subsp. paratuberculosis
gucgcccgucucggcgug

SEQ ID NO: 2875927 - RNA, 15 nt, Mycobacterium avium subsp. paratuberculosis
gucgcccucgaucgc

SEQ ID NO: 2875928 - RNA, 13 nt, Mycobacterium avium subsp. paratuberculosis
gucgcccucgcgc

SEQ ID NO: 2875929 - RNA, 18 nt, Mycobacterium avium subsp. paratuberculosis
gucgcccugacacagcac

SEQ ID NO: 2875930 - RNA, 18 nt, Mycobacterium avium subsp. paratuberculosis
gucgcccuggauauccag

SEQ ID NO: 2875931 - RNA, 20 nt, Mycobacterium avium subsp. paratuberculosis
gucgcccuggauauccagcc

SEQ ID NO: 2875932 - RNA, 17 nt, Mycobacterium avium subsp. paratuberculosis
gucgccgaacgccacca

SEQ ID NO: 2875933 - RNA, 18 nt, Mycobacterium avium subsp. paratuberculosis
gucgccgaacgccaccac

SEQ ID NO: 2875934 - RNA, 21 nt, Mycobacterium avium subsp. paratuberculosis
gucgccgaacgccaccaccuc

SEQ ID NO: 2875935 - RNA, 21 nt, Mycobacterium avium subsp. paratuberculosis
gucgccgaacgugcgcggcgc

SEQ ID NO: 2875936 - RNA, 23 nt, Mycobacterium avium subsp. paratuberculosis
gucgccgaaguuccagccgaucg

SEQ ID NO: 2875937 - RNA, 17 nt, Mycobacterium avium subsp. paratuberculosis
gucgccgaauccggcgg

SEQ ID NO: 2875938 - RNA, 21 nt, Mycobacterium avium subsp. paratuberculosis
gucgccgaauccggcggggac

SEQ ID NO: 2875939 - RNA, 16 nt, Mycobacterium avium subsp. paratuberculosis
gucgccgacagcgucg

SEQ ID NO: 2875940 - RNA, 13 nt, Mycobacterium avium subsp. paratuberculosis
gucgccgaccagc

SEQ ID NO: 2875941 - RNA, 14 nt, Mycobacterium avium subsp. paratuberculosis
gucgccgaccagcc

SEQ ID NO: 2875942 - RNA, 14 nt, Mycobacterium avium subsp. paratuberculosis
gucgccgacgccgu

SEQ ID NO: 2875943 - RNA, 16 nt, Mycobacterium avium subsp. paratuberculosis
gucgccgacgccgucg

SEQ ID NO: 2875944 - RNA, 18 nt, Mycobacterium avium subsp. paratuberculosis
gucgccgacgccgucgau

SEQ ID NO: 2875945 - RNA, 21 nt, Mycobacterium avium subsp. paratuberculosis
gucgccgacgggcccagcgcg

SEQ ID NO: 2875946 - RNA, 23 nt, Mycobacterium avium subsp. paratuberculosis
gucgccgacgggcccagcgcgac

SEQ ID NO: 2875947 - RNA, 13 nt, Mycobacterium avium subsp. paratuberculosis
gucgccgacucgc

SEQ ID NO: 2875948 - RNA, 17 nt, Mycobacterium avium subsp. paratuberculosis
ucgcccagcgccgcggc

SEQ ID NO: 2875949 - RNA, 18 nt, Mycobacterium avium subsp. paratuberculosis
ucgcccagcgccgcggcg

SEQ ID NO: 2875950 - RNA, 14 nt, Mycobacterium avium subsp. paratuberculosis
ucgcccagcgcggc

SEQ ID NO: 2875951 - RNA, 18 nt, Mycobacterium avium subsp. paratuberculosis
ucgcccagcgcggcggcc

SEQ ID NO: 2875952 - RNA, 13 nt, Mycobacterium avium subsp. paratuberculosis
ucgcccagcggca

SEQ ID NO: 2875953 - RNA, 16 nt, Mycobacterium avium subsp. paratuberculosis
ucgcccagcggcacga

SEQ ID NO: 2875954 - RNA, 18 nt, Mycobacterium avium subsp. paratuberculosis
ucgcccagcgugucggcg

SEQ ID NO: 2875955 - RNA, 16 nt, Mycobacterium avium subsp. paratuberculosis
ucgcccagcugggcca

SEQ ID NO: 2875956 - RNA, 21 nt, Mycobacterium avium subsp. paratuberculosis
ucgcccagggcgugcgcggcc

SEQ ID NO: 2875957 - RNA, 16 nt, Mycobacterium avium subsp. paratuberculosis
ucgcccagugcgcgcc

SEQ ID NO: 2875958 - RNA, 21 nt, Mycobacterium avium subsp. paratuberculosis
ucgcccaucaccagcagaccc

SEQ ID NO: 2875959 - RNA, 24 nt, Mycobacterium avium subsp. paratuberculosis
ucgcccaucaccagcagacccgac

SEQ ID NO: 2875960 - RNA, 23 nt, Mycobacterium avium subsp. paratuberculosis
ucgccccagaacugguccuccaa

SEQ ID NO: 2875961 - RNA, 13 nt, Mycobacterium avium subsp. paratuberculosis
ucgcccccucggc

SEQ ID NO: 2875962 - RNA, 17 nt, Mycobacterium avium subsp. paratuberculosis
ucgcccccucggccggu

SEQ ID NO: 2875963 - RNA, 15 nt, Mycobacterium avium subsp. paratuberculosis
ucgccccgcaccgag

SEQ ID NO: 2875964 - RNA, 15 nt, Mycobacterium avium subsp. paratuberculosis
ucgccccgcuggaac

SEQ ID NO: 2875965 - RNA, 19 nt, Mycobacterium avium subsp. paratuberculosis
ucgccccgcuggaacgccg

SEQ ID NO: 2875966 - RNA, 15 nt, Mycobacterium avium subsp. paratuberculosis
ucgccccggaugacc

SEQ ID NO: 2875967 - RNA, 15 nt, Mycobacterium avium subsp. paratuberculosis
ucgccccggccgcgg

SEQ ID NO: 2875968 - RNA, 22 nt, Mycobacterium avium subsp. paratuberculosis
ucgcccgaacucauggcgugcu

SEQ ID NO: 2875969 - RNA, 17 nt, Mycobacterium avium subsp. paratuberculosis
ucgcccgcagcacgccc

SEQ ID NO: 2875970 - RNA, 20 nt, Mycobacterium avium subsp. paratuberculosis
ucgcccgcagcacgcccgua

SEQ ID NO: 2875971 - RNA, 13 nt, Mycobacterium avium subsp. paratuberculosis
ucgcccgccgacg

SEQ ID NO: 2875972 - RNA, 19 nt, Mycobacterium avium subsp. paratuberculosis
gucgccgacucgcaggugc

SEQ ID NO: 2875973 - RNA, 23 nt, Mycobacterium avium subsp. paratuberculosis
gucgccgacucgcaggugccggu

SEQ ID NO: 2875974 - RNA, 15 nt, Mycobacterium avium subsp. paratuberculosis
gucgccgagccgcac

SEQ ID NO: 2875975 - RNA, 18 nt, Mycobacterium avium subsp. paratuberculosis
gucgccgagccgcaccgc

SEQ ID NO: 2875976 - RNA, 19 nt, Mycobacterium avium subsp. paratuberculosis
gucgccgagccgcaccgcc

SEQ ID NO: 2875977 - RNA, 20 nt, Mycobacterium avium subsp. paratuberculosis
gucgccgagccgcaccgccu

SEQ ID NO: 2875978 - RNA, 14 nt, Mycobacterium avium subsp. paratuberculosis
gucgccgagccgcg

SEQ ID NO: 2875979 - RNA, 17 nt, Mycobacterium avium subsp. paratuberculosis
gucgccgagccgcgcca

SEQ ID NO: 2875980 - RNA, 20 nt, Mycobacterium avium subsp. paratuberculosis
gucgccgagcucgugauggu

SEQ ID NO: 2875981 - RNA, 17 nt, Mycobacterium avium subsp. paratuberculosis
gucgccgaucgcccggu

SEQ ID NO: 2875982 - RNA, 15 nt, Mycobacterium avium subsp. paratuberculosis
gucgccgaucucggc

SEQ ID NO: 2875983 - RNA, 14 nt, Mycobacterium avium subsp. paratuberculosis
gucgccgaugcgcc

SEQ ID NO: 2875984 - RNA, 18 nt, Mycobacterium avium subsp. paratuberculosis
gucgccgaugcgccgcac

SEQ ID NO: 2875985 - RNA, 17 nt, Mycobacterium avium subsp. paratuberculosis
gucgccgauggagaccu

SEQ ID NO: 2875986 - RNA, 13 nt, Mycobacterium avium subsp. paratuberculosis
gucgccgauggcg

SEQ ID NO: 2875987 - RNA, 13 nt, Mycobacterium avium subsp. paratuberculosis
gucgccgauggug

SEQ ID NO: 2875988 - RNA, 19 nt, Mycobacterium avium subsp. paratuberculosis
gucgccgauguaguccagc

SEQ ID NO: 2875989 - RNA, 19 nt, Mycobacterium avium subsp. paratuberculosis
gucgccgauuucggugucg

SEQ ID NO: 2875990 - RNA, 20 nt, Mycobacterium avium subsp. paratuberculosis
gucgccgauuucggugucga

SEQ ID NO: 2875991 - RNA, 15 nt, Mycobacterium avium subsp. paratuberculosis
gucgccgcagaucag

SEQ ID NO: 2875992 - RNA, 21 nt, Mycobacterium avium subsp. paratuberculosis
gucgccgcagaucagggcgau

SEQ ID NO: 2875993 - RNA, 17 nt, Mycobacterium avium subsp. paratuberculosis
gucgccgcccacgccgu

SEQ ID NO: 2875994 - RNA, 14 nt, Mycobacterium avium subsp. paratuberculosis
gucgccgcccgggc

SEQ ID NO: 2875995 - RNA, 19 nt, Mycobacterium avium subsp. paratuberculosis
gucgccgcccgggccgcgc

SEQ ID NO: 2875996 - RNA, 22 nt, Mycobacterium avium subsp. paratuberculosis
gucgccgcccgggccgcgccca

SEQ ID NO: 2875997 - RNA, 16 nt, Mycobacterium avium subsp. paratuberculosis
gucgccgccgcgcacc

SEQ ID NO: 2875998 - RNA, 17 nt, Mycobacterium avium subsp. paratuberculosis
gucgccgccgcgcaccg

SEQ ID NO: 2875999 - RNA, 19 nt, Mycobacterium avium subsp. paratuberculosis
gucgccgccgcgcaccgcg

SEQ ID NO: 2876000 - RNA, 22 nt, Mycobacterium avium subsp. paratuberculosis
gucgccgccgcgcaccgcgcgu

SEQ ID NO: 2876001 - RNA, 21 nt, Mycobacterium avium subsp. paratuberculosis
gucgccgccgggcgccacccg

SEQ ID NO: 2876002 - RNA, 14 nt, Mycobacterium avium subsp. paratuberculosis
gucgccgccgucca

SEQ ID NO: 2876003 - RNA, 16 nt, Mycobacterium avium subsp. paratuberculosis
gucgccgcgcagaucg

SEQ ID NO: 2876004 - RNA, 19 nt, Mycobacterium avium subsp. paratuberculosis
gucgccgcgcagaucgaug

SEQ ID NO: 2876005 - RNA, 16 nt, Mycobacterium avium subsp. paratuberculosis
gucgccgcgcagcacc

SEQ ID NO: 2876006 - RNA, 20 nt, Mycobacterium avium subsp. paratuberculosis
gucgccgcgcagcaccgcgu

SEQ ID NO: 2876007 - RNA, 12 nt, Mycobacterium avium subsp. paratuberculosis
gucgccgcgcca

SEQ ID NO: 2876008 - RNA, 13 nt, Mycobacterium avium subsp. paratuberculosis
gucgccgcgccag

SEQ ID NO: 2876009 - RNA, 14 nt, Mycobacterium avium subsp. paratuberculosis
gucgccgcgccagc

SEQ ID NO: 2876010 - RNA, 16 nt, Mycobacterium avium subsp. paratuberculosis
gucgccgcgccagccg

SEQ ID NO: 2876011 - RNA, 20 nt, Mycobacterium avium subsp. paratuberculosis
gucgccgcgccagccgccgc

SEQ ID NO: 2876012 - RNA, 14 nt, Mycobacterium avium subsp. paratuberculosis
gucgccgcgcccgc

SEQ ID NO: 2876013 - RNA, 18 nt, Mycobacterium avium subsp. paratuberculosis
gucgccgcgcccgccggc

SEQ ID NO: 2876014 - RNA, 19 nt, Mycobacterium avium subsp. paratuberculosis
gucgccgcgcccgccggcc

SEQ ID NO: 2876015 - RNA, 13 nt, Mycobacterium avium subsp. paratuberculosis
gucgccgcgccgc

SEQ ID NO: 2876016 - RNA, 14 nt, Mycobacterium avium subsp. paratuberculosis
gucgccgcgccgcc

SEQ ID NO: 2876017 - RNA, 15 nt, Mycobacterium avium subsp. paratuberculosis
gucgccgcgccgccg

SEQ ID NO: 2876018 - RNA, 23 nt, Mycobacterium avium subsp. paratuberculosis
gucgccgcgguagacaccgccgu

SEQ ID NO: 2876019 - RNA, 21 nt, Mycobacterium avium subsp. paratuberculosis
gucgccgcucuucgacgaccc

SEQ ID NO: 2876020 - RNA, 23 nt, Mycobacterium avium subsp. paratuberculosis
gucgccgcucuucgacgacccga

SEQ ID NO: 2876021 - RNA, 20 nt, Mycobacterium avium subsp. paratuberculosis
gucgccggacucgaucgcca

SEQ ID NO: 2876022 - RNA, 17 nt, Mycobacterium avium subsp. paratuberculosis
gucgccggaggcgauca

SEQ ID NO: 2876023 - RNA, 23 nt, Mycobacterium avium subsp. paratuberculosis
gucgccggccaggauggagcuga

SEQ ID NO: 2876024 - RNA, 17 nt, Mycobacterium avium subsp. paratuberculosis
gucgccggccaggccgg

SEQ ID NO: 2876025 - RNA, 21 nt, Mycobacterium avium subsp. paratuberculosis
gucgccggccaggccggccug

SEQ ID NO: 2876026 - RNA, 16 nt, Mycobacterium avium subsp. paratuberculosis
gucgccggccgccagc

SEQ ID NO: 2876027 - RNA, 21 nt, Mycobacterium avium subsp. paratuberculosis
gucgccggccgccagcgcccg

SEQ ID NO: 2876028 - RNA, 13 nt, Mycobacterium avium subsp. paratuberculosis
gucgccggccugc

SEQ ID NO: 2876029 - RNA, 15 nt, Mycobacterium avium subsp. paratuberculosis
gucgccggccugccc

SEQ ID NO: 2876030 - RNA, 17 nt, Mycobacterium avium subsp. paratuberculosis
gucgccggccugcccgc

SEQ ID NO: 2876031 - RNA, 20 nt, Mycobacterium avium subsp. paratuberculosis
gucgccggccugcccgccgc

SEQ ID NO: 2876032 - RNA, 14 nt, Mycobacterium avium subsp. paratuberculosis
gucgccggcgaccg

SEQ ID NO: 2876033 - RNA, 15 nt, Mycobacterium avium subsp. paratuberculosis
gucgccggcgaccgc

SEQ ID NO: 2876034 - RNA, 17 nt, Mycobacterium avium subsp. paratuberculosis
gucgccggcgaccgccu

SEQ ID NO: 2876035 - RNA, 13 nt, Mycobacterium avium subsp. paratuberculosis
gucgccggcgcgc

SEQ ID NO: 2876036 - RNA, 17 nt, Mycobacterium avium subsp. paratuberculosis
gucgccggcgcgcagcg

SEQ ID NO: 2876037 - RNA, 21 nt, Mycobacterium avium subsp. paratuberculosis
gucgccggcgcgggccgcagc

SEQ ID NO: 2876038 - RNA, 12 nt, Mycobacterium avium subsp. paratuberculosis
gucgccggcggc

SEQ ID NO: 2876039 - RNA, 13 nt, Mycobacterium avium subsp. paratuberculosis
gucgccggcggcc

SEQ ID NO: 2876040 - RNA, 17 nt, Mycobacterium avium subsp. paratuberculosis
gucgccggcggccgaca

SEQ ID NO: 2876041 - RNA, 22 nt, Mycobacterium avium subsp. paratuberculosis
gucgccggcggccgacagggug

SEQ ID NO: 2876042 - RNA, 15 nt, Mycobacterium avium subsp. paratuberculosis
gucgccggcggggcg

SEQ ID NO: 2876043 - RNA, 18 nt, Mycobacterium avium subsp. paratuberculosis
gucgccggcggggcgucg

SEQ ID NO: 2876044 - RNA, 19 nt, Mycobacterium avium subsp. paratuberculosis
gucgccggcugacugccgg

SEQ ID NO: 2876045 - RNA, 14 nt, Mycobacterium avium subsp. paratuberculosis
gucgccgggccggc

SEQ ID NO: 2876046 - RNA, 18 nt, Mycobacterium avium subsp. paratuberculosis
gucgccgggccggccggu

SEQ ID NO: 2876047 - RNA, 15 nt, Mycobacterium avium subsp. paratuberculosis
gucgccgggcggggu

SEQ ID NO: 2876048 - RNA, 17 nt, Mycobacterium avium subsp. paratuberculosis
gucgccgggcggggugg

SEQ ID NO: 2876049 - RNA, 23 nt, Mycobacterium avium subsp. paratuberculosis
gucgccgggcggggugguggacg

SEQ ID NO: 2876050 - RNA, 14 nt, Mycobacterium avium subsp. paratuberculosis
gucgccgggcgggu

SEQ ID NO: 2876051 - RNA, 15 nt, Mycobacterium avium subsp. paratuberculosis
gucgccgggcugggu

SEQ ID NO: 2876052 - RNA, 16 nt, Mycobacterium avium subsp. paratuberculosis
gucgccgggcuggguc

SEQ ID NO: 2876053 - RNA, 13 nt, Mycobacterium avium subsp. paratuberculosis
gucgccgggcuug

SEQ ID NO: 2876054 - RNA, 13 nt, Mycobacterium avium subsp. paratuberculosis
gucgccggugcug

SEQ ID NO: 2876055 - RNA, 16 nt, Mycobacterium avium subsp. paratuberculosis
gucgccggugcugguc

SEQ ID NO: 2876056 - RNA, 14 nt, Mycobacterium avium subsp. paratuberculosis
gucgccgguggccg

SEQ ID NO: 2876057 - RNA, 18 nt, Mycobacterium avium subsp. paratuberculosis
gucgccgguggccgccgg

SEQ ID NO: 2876058 - RNA, 20 nt, Mycobacterium avium subsp. paratuberculosis
gucgccgguguagaucggcu

SEQ ID NO: 2876059 - RNA, 23 nt, Mycobacterium avium subsp. paratuberculosis
gucgccggugucauaccagccgu

SEQ ID NO: 2876060 - RNA, 18 nt, Mycobacterium avium subsp. paratuberculosis
gucgccggugugcagcca

SEQ ID NO: 2876061 - RNA, 22 nt, Mycobacterium avium subsp. paratuberculosis
gucgccggugugcagccacccg

SEQ ID NO: 2876062 - RNA, 16 nt, Mycobacterium avium subsp. paratuberculosis
gucgccgucaccucga

SEQ ID NO: 2876063 - RNA, 17 nt, Mycobacterium avium subsp. paratuberculosis
gucgccgucaccucgag

SEQ ID NO: 2876064 - RNA, 14 nt, Mycobacterium avium subsp. paratuberculosis
gucgccguccaaca

SEQ ID NO: 2876065 - RNA, 13 nt, Mycobacterium avium subsp. paratuberculosis
gucgccguccggg

SEQ ID NO: 2876066 - RNA, 19 nt, Mycobacterium avium subsp. paratuberculosis
gucgccguccggggccggu

SEQ ID NO: 2876067 - RNA, 13 nt, Mycobacterium avium subsp. paratuberculosis
gucgccgucgagg

SEQ ID NO: 2876068 - RNA, 14 nt, Mycobacterium avium subsp. paratuberculosis
gucgccgucgccgc

SEQ ID NO: 2876069 - RNA, 15 nt, Mycobacterium avium subsp. paratuberculosis
gucgccgucgccgca

SEQ ID NO: 2876070 - RNA, 19 nt, Mycobacterium avium subsp. paratuberculosis
gucgccgucggggucgcgc

SEQ ID NO: 2876071 - RNA, 21 nt, Mycobacterium avium subsp. paratuberculosis
gucgccgucggggucgcgccg

SEQ ID NO: 2876072 - RNA, 22 nt, Mycobacterium avium subsp. paratuberculosis
gucgccgucguauucgacggcg

SEQ ID NO: 2876073 - RNA, 14 nt, Mycobacterium avium subsp. paratuberculosis
gucgccgucgugcu

SEQ ID NO: 2876074 - RNA, 15 nt, Mycobacterium avium subsp. paratuberculosis
gucgccgucgugcuc

SEQ ID NO: 2876075 - RNA, 18 nt, Mycobacterium avium subsp. paratuberculosis
gucgccgugaucuggugg

SEQ ID NO: 2876076 - RNA, 16 nt, Mycobacterium avium subsp. paratuberculosis
gucgccgugccggacc

SEQ ID NO: 2876077 - RNA, 17 nt, Mycobacterium avium subsp. paratuberculosis
gucgccgugccggaccg

SEQ ID NO: 2876078 - RNA, 18 nt, Mycobacterium avium subsp. paratuberculosis
gucgccgugcggcguucg

SEQ ID NO: 2876079 - RNA, 17 nt, Mycobacterium avium subsp. paratuberculosis
gucgccguggcggcccg

SEQ ID NO: 2876080 - RNA, 19 nt, Mycobacterium avium subsp. paratuberculosis
gucgccguggcggcccgac

SEQ ID NO: 2876081 - RNA, 23 nt, Mycobacterium avium subsp. paratuberculosis
gucgccguggcggcccgaccagc

SEQ ID NO: 2876082 - RNA, 23 nt, Mycobacterium avium subsp. paratuberculosis
gucgccguuggcguggauggccg

SEQ ID NO: 2876083 - RNA, 20 nt, Mycobacterium avium subsp. paratuberculosis
gucgccguuggucugcgcga

SEQ ID NO: 2876084 - RNA, 22 nt, Mycobacterium avium subsp. paratuberculosis
gucgccguuggucugcgcgagc

SEQ ID NO: 2876085 - RNA, 22 nt, Mycobacterium avium subsp. paratuberculosis
gucgccuccgagauggacagca

SEQ ID NO: 2876086 - RNA, 15 nt, Mycobacterium avium subsp. paratuberculosis
gucgccuccugcugg

SEQ ID NO: 2876087 - RNA, 20 nt, Mycobacterium avium subsp. paratuberculosis
gucgccuccugcuggcgcug

SEQ ID NO: 2876088 - RNA, 23 nt, Mycobacterium avium subsp. paratuberculosis
gucgccuccugcuggcgcugcca

SEQ ID NO: 2876089 - RNA, 16 nt, Mycobacterium avium subsp. paratuberculosis
gucgccugcuucugga

SEQ ID NO: 2876090 - RNA, 16 nt, Mycobacterium avium subsp. paratuberculosis
gucgcgaaaaucggug

SEQ ID NO: 2876091 - RNA, 20 nt, Mycobacterium avium subsp. paratuberculosis
gucgcgaaaaucgguggugu

SEQ ID NO: 2876092 - RNA, 20 nt, Mycobacterium avium subsp. paratuberculosis
gucgcgaagacgcuggccac

SEQ ID NO: 2876093 - RNA, 12 nt, Mycobacterium avium subsp. paratuberculosis
gucgcgaagcgu

SEQ ID NO: 2876094 - RNA, 20 nt, Mycobacterium avium subsp. paratuberculosis
gucgcgaagcguaugccggu

SEQ ID NO: 2876095 - RNA, 22 nt, Mycobacterium avium subsp. paratuberculosis
gucgcgaagcguaugccggugg

SEQ ID NO: 2876096 - RNA, 16 nt, Mycobacterium avium subsp. paratuberculosis
gucgcgaccgccggac

SEQ ID NO: 2876097 - RNA, 22 nt, Mycobacterium avium subsp. paratuberculosis
gucgcgacgagcgggccgauca

SEQ ID NO: 2876098 - RNA, 18 nt, Mycobacterium avium subsp. paratuberculosis
gucgcgauagggccggcc

SEQ ID NO: 2876099 - RNA, 17 nt, Mycobacterium avium subsp. paratuberculosis
gucgcgaucgcggucca

SEQ ID NO: 2876100 - RNA, 22 nt, Mycobacterium avium subsp. paratuberculosis
gucgcgaugcccaagccggcca

SEQ ID NO: 2876101 - RNA, 16 nt, Mycobacterium avium subsp. paratuberculosis
gucgcgaugugcucga

SEQ ID NO: 2876102 - RNA, 17 nt, Mycobacterium avium subsp. paratuberculosis
gucgcgaugugcucgau

SEQ ID NO: 2876103 - RNA, 20 nt, Mycobacterium avium subsp. paratuberculosis
gucgcgcaaacugacaggcg

SEQ ID NO: 2876104 - RNA, 14 nt, Mycobacterium avium subsp. paratuberculosis
gucgcgcaccaucc

SEQ ID NO: 2876105 - RNA, 17 nt, Mycobacterium avium subsp. paratuberculosis
gucgcgcaccauccgcg

SEQ ID NO: 2876106 - RNA, 13 nt, Mycobacterium avium subsp. paratuberculosis
gucgcgcacccag

SEQ ID NO: 2876107 - RNA, 13 nt, Mycobacterium avium subsp. paratuberculosis
gucgcgcaccgca

SEQ ID NO: 2876108 - RNA, 13 nt, Mycobacterium avium subsp. paratuberculosis
gucgcgcaccgcg

SEQ ID NO: 2876109 - RNA, 14 nt, Mycobacterium avium subsp. paratuberculosis
gucgcgcaccgcgg

SEQ ID NO: 2876110 - RNA, 14 nt, Mycobacterium avium subsp. paratuberculosis
gucgcgcagcaccu

SEQ ID NO: 2876111 - RNA, 14 nt, Mycobacterium avium subsp. paratuberculosis
gucgcgcagcagcg

SEQ ID NO: 2876112 - RNA, 19 nt, Mycobacterium avium subsp. paratuberculosis
gucgcgcagcagcgggauc

SEQ ID NO: 2876113 - RNA, 12 nt, Mycobacterium avium subsp. paratuberculosis
gucgcgcagcau

SEQ ID NO: 2876114 - RNA, 15 nt, Mycobacterium avium subsp. paratuberculosis
gucgcgcagcccgau

SEQ ID NO: 2876115 - RNA, 19 nt, Mycobacterium avium subsp. paratuberculosis
gucgcgcagcccgaucgcc

SEQ ID NO: 2876116 - RNA, 20 nt, Mycobacterium avium subsp. paratuberculosis
gucgcgcagcccgaucgcca

SEQ ID NO: 2876117 - RNA, 21 nt, Mycobacterium avium subsp. paratuberculosis
gucgcgcagcccgaucgccag

SEQ ID NO: 2876118 - RNA, 15 nt, Mycobacterium avium subsp. paratuberculosis
gucgcgcagccgggc

SEQ ID NO: 2876119 - RNA, 16 nt, Mycobacterium avium subsp. paratuberculosis
gucgcgcagccgggcg

SEQ ID NO: 2876120 - RNA, 18 nt, Mycobacterium avium subsp. paratuberculosis
gucgcgcagccgggcggc

SEQ ID NO: 2876121 - RNA, 16 nt, Mycobacterium avium subsp. paratuberculosis
gucgcgcagccucaga

SEQ ID NO: 2876122 - RNA, 18 nt, Mycobacterium avium subsp. paratuberculosis
gucgcgcagcugcgccgc

SEQ ID NO: 2876123 - RNA, 14 nt, Mycobacterium avium subsp. paratuberculosis
gucgcgcagcuggg

SEQ ID NO: 2876124 - RNA, 22 nt, Mycobacterium avium subsp. paratuberculosis
gucgcgcaggaugcccagcacc

SEQ ID NO: 2876125 - RNA, 15 nt, Mycobacterium avium subsp. paratuberculosis
gucgcgcagguaggu

SEQ ID NO: 2876126 - RNA, 21 nt, Mycobacterium avium subsp. paratuberculosis
gucgcgcaggucgggccggcc

SEQ ID NO: 2876127 - RNA, 23 nt, Mycobacterium avium subsp. paratuberculosis
gucgcgcaggucgggccggccga

SEQ ID NO: 2876128 - RNA, 20 nt, Mycobacterium avium subsp. paratuberculosis
gucgcgcaucgccucggcgg

SEQ ID NO: 2876129 - RNA, 21 nt, Mycobacterium avium subsp. paratuberculosis
gucgcgcaucgccucggcggc

SEQ ID NO: 2876130 - RNA, 13 nt, Mycobacterium avium subsp. paratuberculosis
gucgcgcccagga

SEQ ID NO: 2876131 - RNA, 23 nt, Mycobacterium avium subsp. paratuberculosis
gucgcgcccaggaacgcgccggc

SEQ ID NO: 2876132 - RNA, 15 nt, Mycobacterium avium subsp. paratuberculosis
gucgcgcccggcguc

SEQ ID NO: 2876133 - RNA, 16 nt, Mycobacterium avium subsp. paratuberculosis
gucgcgcccggcgucg

SEQ ID NO: 2876134 - RNA, 20 nt, Mycobacterium avium subsp. paratuberculosis
gucgcgccgaccuggucgcc

SEQ ID NO: 2876135 - RNA, 21 nt, Mycobacterium avium subsp. paratuberculosis
gucgcgccgaccuggucgccg

SEQ ID NO: 2876136 - RNA, 22 nt, Mycobacterium avium subsp. paratuberculosis
gucgcgccgaccuggucgccga

SEQ ID NO: 2876137 - RNA, 18 nt, Mycobacterium avium subsp. paratuberculosis
gucgcgccgagguggccg

SEQ ID NO: 2876138 - RNA, 12 nt, Mycobacterium avium subsp. paratuberculosis
gucgcgccgcca

SEQ ID NO: 2876139 - RNA, 15 nt, Mycobacterium avium subsp. paratuberculosis
gucgcgccgccaccc

SEQ ID NO: 2876140 - RNA, 22 nt, Mycobacterium avium subsp. paratuberculosis
gucgcgccgccagcaaccccgc

SEQ ID NO: 2876141 - RNA, 15 nt, Mycobacterium avium subsp. paratuberculosis
gucgcgccgcggcgc

SEQ ID NO: 2876142 - RNA, 12 nt, Mycobacterium avium subsp. paratuberculosis
gucgcgccgcgu

SEQ ID NO: 2876143 - RNA, 15 nt, Mycobacterium avium subsp. paratuberculosis
gucgcgccgcucggc

SEQ ID NO: 2876144 - RNA, 17 nt, Mycobacterium avium subsp. paratuberculosis
gucgcgccgcucggcca

SEQ ID NO: 2876145 - RNA, 19 nt, Mycobacterium avium subsp. paratuberculosis
gucgcgccgcucggccagc

SEQ ID NO: 2876146 - RNA, 20 nt, Mycobacterium avium subsp. paratuberculosis
gucgcgccgcucggccagca

SEQ ID NO: 2876147 - RNA, 17 nt, Mycobacterium avium subsp. paratuberculosis
gucgcgcgaacagccga

SEQ ID NO: 2876148 - RNA, 19 nt, Mycobacterium avium subsp. paratuberculosis
gucgcgcgaacagccgacc

SEQ ID NO: 2876149 - RNA, 14 nt, Mycobacterium avium subsp. paratuberculosis
gucgcgcgaccagu

SEQ ID NO: 2876150 - RNA, 15 nt, Mycobacterium avium subsp. paratuberculosis
gucgcgcgaccagua

SEQ ID NO: 2876151 - RNA, 20 nt, Mycobacterium avium subsp. paratuberculosis
gucgcgcgacugggcgccca

SEQ ID NO: 2876152 - RNA, 22 nt, Mycobacterium avium subsp. paratuberculosis
gucgcgcgacugggcgcccacc

SEQ ID NO: 2876153 - RNA, 15 nt, Mycobacterium avium subsp. paratuberculosis
gucgcgcgccggcgc

SEQ ID NO: 2876154 - RNA, 22 nt, Mycobacterium avium subsp. paratuberculosis
gucgcgcgccggcgcagcggcc

SEQ ID NO: 2876155 - RNA, 13 nt, Mycobacterium avium subsp. paratuberculosis
gucgcgcggggug

SEQ ID NO: 2876156 - RNA, 18 nt, Mycobacterium avium subsp. paratuberculosis
gucgcgcggggugacgcc

SEQ ID NO: 2876157 - RNA, 16 nt, Mycobacterium avium subsp. paratuberculosis
gucgcgcucagugcac

SEQ ID NO: 2876158 - RNA, 18 nt, Mycobacterium avium subsp. paratuberculosis
gucgcgcucagugcacgc

SEQ ID NO: 2876159 - RNA, 22 nt, Mycobacterium avium subsp. paratuberculosis
gucgcgcucagugcacgcucgg

SEQ ID NO: 2876160 - RNA, 23 nt, Mycobacterium avium subsp. paratuberculosis
gucgcgcucagugcacgcucggc

SEQ ID NO: 2876161 - RNA, 15 nt, Mycobacterium avium subsp. paratuberculosis
gucgcgcucgacgau

SEQ ID NO: 2876162 - RNA, 23 nt, Mycobacterium avium subsp. paratuberculosis
gucgcgcucgacgaugucgacgc

SEQ ID NO: 2876163 - RNA, 14 nt, Mycobacterium avium subsp. paratuberculosis
gucgcgcugccggc

SEQ ID NO: 2876164 - RNA, 16 nt, Mycobacterium avium subsp. paratuberculosis
gucgcgcugccggccc

SEQ ID NO: 2876165 - RNA, 17 nt, Mycobacterium avium subsp. paratuberculosis
gucgcgcugccggcccg

SEQ ID NO: 2876166 - RNA, 18 nt, Mycobacterium avium subsp. paratuberculosis
gucgcgcugccggcccga

SEQ ID NO: 2876167 - RNA, 21 nt, Mycobacterium avium subsp. paratuberculosis
gucgcgcugccggcccgauag

SEQ ID NO: 2876168 - RNA, 15 nt, Mycobacterium avium subsp. paratuberculosis
gucgcggaacagccg

SEQ ID NO: 2876169 - RNA, 17 nt, Mycobacterium avium subsp. paratuberculosis
gucgcggaacagccggc

SEQ ID NO: 2876170 - RNA, 17 nt, Mycobacterium avium subsp. paratuberculosis
gucgcggaaccggccgg

SEQ ID NO: 2876171 - RNA, 21 nt, Mycobacterium avium subsp. paratuberculosis
gucgcggaaccggccggggcg

SEQ ID NO: 2876172 - RNA, 22 nt, Mycobacterium avium subsp. paratuberculosis
gucgcggaaccggccggggcgc

SEQ ID NO: 2876173 - RNA, 18 nt, Mycobacterium avium subsp. paratuberculosis
gucgcggaacgggucgau

SEQ ID NO: 2876174 - RNA, 17 nt, Mycobacterium avium subsp. paratuberculosis
gucgcggacccuggcca

SEQ ID NO: 2876175 - RNA, 19 nt, Mycobacterium avium subsp. paratuberculosis
gucgcggacccuggccagc

SEQ ID NO: 2876176 - RNA, 20 nt, Mycobacterium avium subsp. paratuberculosis
gucgcggacccuggccagca

SEQ ID NO: 2876177 - RNA, 22 nt, Mycobacterium avium subsp. paratuberculosis
gucgcggacccuggccagcacc

SEQ ID NO: 2876178 - RNA, 23 nt, Mycobacterium avium subsp. paratuberculosis
gucgcggacccuggccagcaccg

SEQ ID NO: 2876179 - RNA, 15 nt, Mycobacterium avium subsp. paratuberculosis
gucgcggacuggugg

SEQ ID NO: 2876180 - RNA, 18 nt, Mycobacterium avium subsp. paratuberculosis
gucgcggacuggugggcg

SEQ ID NO: 2876181 - RNA, 22 nt, Mycobacterium avium subsp. paratuberculosis
gucgcggacuggugggcgucgu

SEQ ID NO: 2876182 - RNA, 15 nt, Mycobacterium avium subsp. paratuberculosis
gucgcggagcggguc

SEQ ID NO: 2876183 - RNA, 18 nt, Mycobacterium avium subsp. paratuberculosis
gucgcggaggaugccggc

SEQ ID NO: 2876184 - RNA, 22 nt, Mycobacterium avium subsp. paratuberculosis
gucgcggaggaugccggccagc

SEQ ID NO: 2876185 - RNA, 18 nt, Mycobacterium avium subsp. paratuberculosis
gucgcggauacgcccggc

SEQ ID NO: 2876186 - RNA, 19 nt, Mycobacterium avium subsp. paratuberculosis
gucgcggauacgcccggcc

SEQ ID NO: 2876187 - RNA, 20 nt, Mycobacterium avium subsp. paratuberculosis
gucgcggauacgcccggcca

SEQ ID NO: 2876188 - RNA, 23 nt, Mycobacterium avium subsp. paratuberculosis
gucgcggauacgcccggccaccu

SEQ ID NO: 2876189 - RNA, 17 nt, Mycobacterium avium subsp. paratuberculosis
gucgcggaugcgggcgc

SEQ ID NO: 2876190 - RNA, 19 nt, Mycobacterium avium subsp. paratuberculosis
gucgcggaugcgggcgcug

SEQ ID NO: 2876191 - RNA, 22 nt, Mycobacterium avium subsp. paratuberculosis
gucgcggaugcgggcgcugccg

SEQ ID NO: 2876192 - RNA, 17 nt, Mycobacterium avium subsp. paratuberculosis
gucgcggcaucccuggu

SEQ ID NO: 2876193 - RNA, 19 nt, Mycobacterium avium subsp. paratuberculosis
gucgcggcaucccugguga

SEQ ID NO: 2876194 - RNA, 18 nt, Mycobacterium avium subsp. paratuberculosis
gucgcggccaacgcccac

SEQ ID NO: 2876195 - RNA, 14 nt, Mycobacterium avium subsp. paratuberculosis
gucgcggcccaccg

SEQ ID NO: 2876196 - RNA, 15 nt, Mycobacterium avium subsp. paratuberculosis
gucgcggcccaccgc

SEQ ID NO: 2876197 - RNA, 16 nt, Mycobacterium avium subsp. paratuberculosis
gucgcggcccaccgcg

SEQ ID NO: 2876198 - RNA, 17 nt, Mycobacterium avium subsp. paratuberculosis
gucgcggcccaccgcgu

SEQ ID NO: 2876199 - RNA, 20 nt, Mycobacterium avium subsp. paratuberculosis
gucgcggcccaccgcgucgc

SEQ ID NO: 2876200 - RNA, 15 nt, Mycobacterium avium subsp. paratuberculosis
gucgcggcccagcac

SEQ ID NO: 2876201 - RNA, 16 nt, Mycobacterium avium subsp. paratuberculosis
gucgcggcccagcacc

SEQ ID NO: 2876202 - RNA, 17 nt, Mycobacterium avium subsp. paratuberculosis
gucgcggcccagcacca

SEQ ID NO: 2876203 - RNA, 18 nt, Mycobacterium avium subsp. paratuberculosis
gucgcggcccagcaccac

SEQ ID NO: 2876204 - RNA, 20 nt, Mycobacterium avium subsp. paratuberculosis
gucgcggccuccgagcggcg

SEQ ID NO: 2876205 - RNA, 21 nt, Mycobacterium avium subsp. paratuberculosis
gucgcggccuucuuggccgga

SEQ ID NO: 2876206 - RNA, 19 nt, Mycobacterium avium subsp. paratuberculosis
gucgcggccuugcgcaccg

SEQ ID NO: 2876207 - RNA, 22 nt, Mycobacterium avium subsp. paratuberculosis
gucgcggccuugcgcaccggag

SEQ ID NO: 2876208 - RNA, 22 nt, Mycobacterium avium subsp. paratuberculosis
gucgcggcgaaccagcaugcgc

SEQ ID NO: 2876209 - RNA, 14 nt, Mycobacterium avium subsp. paratuberculosis
gucgcggcgccggu

SEQ ID NO: 2876210 - RNA, 15 nt, Mycobacterium avium subsp. paratuberculosis
gucgcggcgcggacc

SEQ ID NO: 2876211 - RNA, 12 nt, Mycobacterium avium subsp. paratuberculosis
gucgcggcgcug

SEQ ID NO: 2876212 - RNA, 17 nt, Mycobacterium avium subsp. paratuberculosis
gucgcggcgcugcgccg

SEQ ID NO: 2876213 - RNA, 18 nt, Mycobacterium avium subsp. paratuberculosis
gucgcggcgcugcgccgu

SEQ ID NO: 2876214 - RNA, 15 nt, Mycobacterium avium subsp. paratuberculosis
gucgcggcggcccgu

SEQ ID NO: 2876215 - RNA, 18 nt, Mycobacterium avium subsp. paratuberculosis
gucgcggcggcccgucgc

SEQ ID NO: 2876216 - RNA, 17 nt, Mycobacterium avium subsp. paratuberculosis
gucgcggcggccggcgc

SEQ ID NO: 2876217 - RNA, 22 nt, Mycobacterium avium subsp. paratuberculosis
gucgcggcggccggcgccgacc

SEQ ID NO: 2876218 - RNA, 12 nt, Mycobacterium avium subsp. paratuberculosis
gucgcggcggcg

SEQ ID NO: 2876219 - RNA, 17 nt, Mycobacterium avium subsp. paratuberculosis
gucgcggcggcgcuggu

SEQ ID NO: 2876220 - RNA, 20 nt, Mycobacterium avium subsp. paratuberculosis
gucgcggcggcgcuggucgg

SEQ ID NO: 2876221 - RNA, 11 nt, Mycobacterium avium subsp. paratuberculosis
gucgcggcggg

SEQ ID NO: 2876222 - RNA, 20 nt, Mycobacterium avium subsp. paratuberculosis
gucgcggcggugcgcagccg

SEQ ID NO: 2876223 - RNA, 13 nt, Mycobacterium avium subsp. paratuberculosis
gucgcggcgucgc

SEQ ID NO: 2876224 - RNA, 11 nt, Mycobacterium avium subsp. paratuberculosis
gucgcggcugc

SEQ ID NO: 2876225 - RNA, 14 nt, Mycobacterium avium subsp. paratuberculosis
gucgcggcugccgg

SEQ ID NO: 2876226 - RNA, 16 nt, Mycobacterium avium subsp. paratuberculosis
gucgcggcugccggug

SEQ ID NO: 2876227 - RNA, 14 nt, Mycobacterium avium subsp. paratuberculosis
gucgcggcugcgca

SEQ ID NO: 2876228 - RNA, 16 nt, Mycobacterium avium subsp. paratuberculosis
gucgcggcugcgcacg

SEQ ID NO: 2876229 - RNA, 16 nt, Mycobacterium avium subsp. paratuberculosis
gucgcggcuggugccg

SEQ ID NO: 2876230 - RNA, 18 nt, Mycobacterium avium subsp. paratuberculosis
gucgcggcuggugccgcc

SEQ ID NO: 2876231 - RNA, 20 nt, Mycobacterium avium subsp. paratuberculosis
gucgcggcuggugccgccgg

SEQ ID NO: 2876232 - RNA, 21 nt, Mycobacterium avium subsp. paratuberculosis
gucgcggcuggugccgccggc

SEQ ID NO: 2876233 - RNA, 22 nt, Mycobacterium avium subsp. paratuberculosis
gucgcggcuggugccgccggcg

SEQ ID NO: 2876234 - RNA, 23 nt, Mycobacterium avium subsp. paratuberculosis
gucgcggcuggugccgccggcga

SEQ ID NO: 2876235 - RNA, 24 nt, Mycobacterium avium subsp. paratuberculosis
gucgcggcuggugccgccggcgau

SEQ ID NO: 2876236 - RNA, 17 nt, Mycobacterium avium subsp. paratuberculosis
gucgcgggacaacacca

SEQ ID NO: 2876237 - RNA, 20 nt, Mycobacterium avium subsp. paratuberculosis
gucgcgggacaacacgaucg

SEQ ID NO: 2876238 - RNA, 20 nt, Mycobacterium avium subsp. paratuberculosis
gucgcgggagagcgcgggca

SEQ ID NO: 2876239 - RNA, 23 nt, Mycobacterium avium subsp. paratuberculosis
gucgcgggagagcgcgggcaccg

SEQ ID NO: 2876240 - RNA, 16 nt, Mycobacterium avium subsp. paratuberculosis
gucgcgggcagccggc

SEQ ID NO: 2876241 - RNA, 18 nt, Mycobacterium avium subsp. paratuberculosis
gucgcgggcagccggcgc

SEQ ID NO: 2876242 - RNA, 21 nt, Mycobacterium avium subsp. paratuberculosis
gucgcgggcagccggcgcccg

SEQ ID NO: 2876243 - RNA, 22 nt, Mycobacterium avium subsp. paratuberculosis
gucgcgggcccgggccacccgc

SEQ ID NO: 2876244 - RNA, 23 nt, Mycobacterium avium subsp. paratuberculosis
gucgcgggcccgggccacccgcg

SEQ ID NO: 2876245 - RNA, 12 nt, Mycobacterium avium subsp. paratuberculosis
gucgcgggcgaa

SEQ ID NO: 2876246 - RNA, 13 nt, Mycobacterium avium subsp. paratuberculosis
gucgcgggcgaaa

SEQ ID NO: 2876247 - RNA, 18 nt, Mycobacterium avium subsp. paratuberculosis
gucgcgggcgagccgaca

SEQ ID NO: 2876248 - RNA, 14 nt, Mycobacterium avium subsp. paratuberculosis
gucgcgggcgccga

SEQ ID NO: 2876249 - RNA, 14 nt, Mycobacterium avium subsp. paratuberculosis
gucgcgggcggggc

SEQ ID NO: 2876250 - RNA, 15 nt, Mycobacterium avium subsp. paratuberculosis
gucgcgggcggggcg

SEQ ID NO: 2876251 - RNA, 21 nt, Mycobacterium avium subsp. paratuberculosis
gucgcgggcggggcgccgaca

SEQ ID NO: 2876252 - RNA, 16 nt, Mycobacterium avium subsp. paratuberculosis
gucgcgggcgucgggc

SEQ ID NO: 2876253 - RNA, 20 nt, Mycobacterium avium subsp. paratuberculosis
gucgcgggcgucgggcagca

SEQ ID NO: 2876254 - RNA, 17 nt, Mycobacterium avium subsp. paratuberculosis
gucgcgggucuggcucg

SEQ ID NO: 2876255 - RNA, 18 nt, Mycobacterium avium subsp. paratuberculosis
gucgcgggucuggcucgg

SEQ ID NO: 2876256 - RNA, 18 nt, Mycobacterium avium subsp. paratuberculosis
gucgcgggugaccggcgc

SEQ ID NO: 2876257 - RNA, 20 nt, Mycobacterium avium subsp. paratuberculosis
gucgcgggugaccggcgccg

SEQ ID NO: 2876258 - RNA, 21 nt, Mycobacterium avium subsp. paratuberculosis
gucgcgggugauccggugcca

SEQ ID NO: 2876259 - RNA, 22 nt, Mycobacterium avium subsp. paratuberculosis
gucgcgggugauccggugccac

SEQ ID NO: 2876260 - RNA, 21 nt, Mycobacterium avium subsp. paratuberculosis
gucgcgguagaucgacagggc

SEQ ID NO: 2876261 - RNA, 22 nt, Mycobacterium avium subsp. paratuberculosis
gucgcgguaguuguccccgauu

SEQ ID NO: 2876262 - RNA, 14 nt, Mycobacterium avium subsp. paratuberculosis
gucgcgguccacgc

SEQ ID NO: 2876263 - RNA, 18 nt, Mycobacterium avium subsp. paratuberculosis
gucgcgguccacgccggc

SEQ ID NO: 2876264 - RNA, 19 nt, Mycobacterium avium subsp. paratuberculosis
gucgcgguccacgccggcg

SEQ ID NO: 2876265 - RNA, 20 nt, Mycobacterium avium subsp. paratuberculosis
gucgcgguccacgccggcga

SEQ ID NO: 2876266 - RNA, 14 nt, Mycobacterium avium subsp. paratuberculosis
gucgcggucggcgc

SEQ ID NO: 2876267 - RNA, 15 nt, Mycobacterium avium subsp. paratuberculosis
gucgcggucggcgcc

SEQ ID NO: 2876268 - RNA, 16 nt, Mycobacterium avium subsp. paratuberculosis
gucgcggucggcgucg

SEQ ID NO: 2876269 - RNA, 19 nt, Mycobacterium avium subsp. paratuberculosis
gucgcggugcccagccgca

SEQ ID NO: 2876270 - RNA, 20 nt, Mycobacterium avium subsp. paratuberculosis
gucgcgguggagcacagcac

SEQ ID NO: 2876271 - RNA, 23 nt, Mycobacterium avium subsp. paratuberculosis
gucgcggugggcgcgggccgcgu

SEQ ID NO: 2876272 - RNA, 18 nt, Mycobacterium avium subsp. paratuberculosis
gucgcggugggcucggcg

SEQ ID NO: 2876273 - RNA, 23 nt, Mycobacterium avium subsp. paratuberculosis
gucgcggugggcucggcgccgac

SEQ ID NO: 2876274 - RNA, 15 nt, Mycobacterium avium subsp. paratuberculosis
gucgcggugucggcg

SEQ ID NO: 2876275 - RNA, 18 nt, Mycobacterium avium subsp. paratuberculosis
gucgcggugucggcgucg

SEQ ID NO: 2876276 - RNA, 21 nt, Mycobacterium avium subsp. paratuberculosis
gucgcggugucggcgucgauc

SEQ ID NO: 2876277 - RNA, 23 nt, Mycobacterium avium subsp. paratuberculosis
gucgcgguugaucacaccgucgg

SEQ ID NO: 2876278 - RNA, 22 nt, Mycobacterium avium subsp. paratuberculosis
gucgcguacgggaugaucagca

SEQ ID NO: 2876279 - RNA, 13 nt, Mycobacterium avium subsp. paratuberculosis
gucgcguccagca

SEQ ID NO: 2876280 - RNA, 17 nt, Mycobacterium avium subsp. paratuberculosis
gucgcguccagcaugcc

SEQ ID NO: 2876281 - RNA, 22 nt, Mycobacterium avium subsp. paratuberculosis
gucgcguccagcaugcccacgc

SEQ ID NO: 2876282 - RNA, 15 nt, Mycobacterium avium subsp. paratuberculosis
gucgcgucccuggcg

SEQ ID NO: 2876283 - RNA, 22 nt, Mycobacterium avium subsp. paratuberculosis
gucgcgucccuggcgaugauca

SEQ ID NO: 2876284 - RNA, 20 nt, Mycobacterium avium subsp. paratuberculosis
gucgcguccgagcagcagcc

SEQ ID NO: 2876285 - RNA, 14 nt, Mycobacterium avium subsp. paratuberculosis
gucgcguccgcgau

SEQ ID NO: 2876286 - RNA, 14 nt, Mycobacterium avium subsp. paratuberculosis
gucgcgucgucggc

SEQ ID NO: 2876287 - RNA, 15 nt, Mycobacterium avium subsp. paratuberculosis
gucgcgucgucggcg

SEQ ID NO: 2876288 - RNA, 18 nt, Mycobacterium avium subsp. paratuberculosis
gucgcgucgucggcgggc

SEQ ID NO: 2876289 - RNA, 20 nt, Mycobacterium avium subsp. paratuberculosis
gucgcgucgugcggccggcg

SEQ ID NO: 2876290 - RNA, 14 nt, Mycobacterium avium subsp. paratuberculosis
gucgcgugaccggc

SEQ ID NO: 2876291 - RNA, 16 nt, Mycobacterium avium subsp. paratuberculosis
gucgcgugaccggcgg

SEQ ID NO: 2876292 - RNA, 17 nt, Mycobacterium avium subsp. paratuberculosis
gucgcgugaccggcggu

SEQ ID NO: 2876293 - RNA, 18 nt, Mycobacterium avium subsp. paratuberculosis
gucgcgugaccggcggug

SEQ ID NO: 2876294 - RNA, 19 nt, Mycobacterium avium subsp. paratuberculosis
gucgcgugaccggcggugc

SEQ ID NO: 2876295 - RNA, 23 nt, Mycobacterium avium subsp. paratuberculosis
gucgcguucccgggcccgcugca

SEQ ID NO: 2876296 - RNA, 19 nt, Mycobacterium avium subsp. paratuberculosis
gucgcguucgacccacacc

SEQ ID NO: 2876297 - RNA, 14 nt, Mycobacterium avium subsp. paratuberculosis
gucgcuaccucacc

SEQ ID NO: 2876298 - RNA, 20 nt, Mycobacterium avium subsp. paratuberculosis
gucgcuaguugcacuuucgc

SEQ ID NO: 2876299 - RNA, 20 nt, Mycobacterium avium subsp. paratuberculosis
gucgcucaaaggcgggcacu

SEQ ID NO: 2876300 - RNA, 18 nt, Mycobacterium avium subsp. paratuberculosis
gucgcucagaggcgggca

SEQ ID NO: 2876301 - RNA, 18 nt, Mycobacterium avium subsp. paratuberculosis
gucgcucaucccgauguc

SEQ ID NO: 2876302 - RNA, 24 nt, Mycobacterium avium subsp. paratuberculosis
gucgcucauguugugcaggcagcc

SEQ ID NO: 2876303 - RNA, 20 nt, Mycobacterium avium subsp. paratuberculosis
gucgcuccacaucugccggc

SEQ ID NO: 2876304 - RNA, 23 nt, Mycobacterium avium subsp. paratuberculosis
gucgcuccacaucugccggcaga

SEQ ID NO: 2876305 - RNA, 16 nt, Mycobacterium avium subsp. paratuberculosis
gucgcucggcggcgac

SEQ ID NO: 2876306 - RNA, 19 nt, Mycobacterium avium subsp. paratuberculosis
gucgcugaacgccccgugg

SEQ ID NO: 2876307 - RNA, 15 nt, Mycobacterium avium subsp. paratuberculosis
gucgcugaccaccga

SEQ ID NO: 2876308 - RNA, 19 nt, Mycobacterium avium subsp. paratuberculosis
gucgcugaccaccgaggug

SEQ ID NO: 2876309 - RNA, 12 nt, Mycobacterium avium subsp. paratuberculosis
gucgcugacccc

SEQ ID NO: 2876310 - RNA, 19 nt, Mycobacterium avium subsp. paratuberculosis
gucgcugaccccgcucggc

SEQ ID NO: 2876311 - RNA, 13 nt, Mycobacterium avium subsp. paratuberculosis
gucgcugacccgc

SEQ ID NO: 2876312 - RNA, 19 nt, Mycobacterium avium subsp. paratuberculosis
gucgcugacccgccgcaac

SEQ ID NO: 2876313 - RNA, 24 nt, Mycobacterium avium subsp. paratuberculosis
gucgcugaguaugcagaugaugcc

SEQ ID NO: 2876314 - RNA, 13 nt, Mycobacterium avium subsp. paratuberculosis
gucgcugaucgcg

SEQ ID NO: 2876315 - RNA, 16 nt, Mycobacterium avium subsp. paratuberculosis
gucgcugaucgcgauc

SEQ ID NO: 2876316 - RNA, 21 nt, Mycobacterium avium subsp. paratuberculosis
gucgcugaucgcgauccgggc

SEQ ID NO: 2876317 - RNA, 17 nt, Mycobacterium avium subsp. paratuberculosis
gucgcugcagcggcggc

SEQ ID NO: 2876318 - RNA, 22 nt, Mycobacterium avium subsp. paratuberculosis
gucgcugcaguagccggccagc

SEQ ID NO: 2876319 - RNA, 14 nt, Mycobacterium avium subsp. paratuberculosis
gucgcugcccggcg

SEQ ID NO: 2876320 - RNA, 16 nt, Mycobacterium avium subsp. paratuberculosis
gucgcugcccggcgug

SEQ ID NO: 2876321 - RNA, 14 nt, Mycobacterium avium subsp. paratuberculosis
gucgcugccgccgc

SEQ ID NO: 2876322 - RNA, 15 nt, Mycobacterium avium subsp. paratuberculosis
gucgcugccgccgcc

SEQ ID NO: 2876323 - RNA, 19 nt, Mycobacterium avium subsp. paratuberculosis
gucgcugccgccgccggcg

SEQ ID NO: 2876324 - RNA, 21 nt, Mycobacterium avium subsp. paratuberculosis
gucgcugccgccgccggcggu

SEQ ID NO: 2876325 - RNA, 13 nt, Mycobacterium avium subsp. paratuberculosis
gucgcuggccagg

SEQ ID NO: 2876326 - RNA, 14 nt, Mycobacterium avium subsp. paratuberculosis
gucgcuggccgcga

SEQ ID NO: 2876327 - RNA, 17 nt, Mycobacterium avium subsp. paratuberculosis
gucgcuggcgcgcuugg

SEQ ID NO: 2876328 - RNA, 19 nt, Mycobacterium avium subsp. paratuberculosis
gucgcugggcagccguccc

SEQ ID NO: 2876329 - RNA, 16 nt, Mycobacterium avium subsp. paratuberculosis
gucgcuguaggccagc

SEQ ID NO: 2876330 - RNA, 22 nt, Mycobacterium avium subsp. paratuberculosis
gucgcuguaggccagcccggcg

SEQ ID NO: 2876331 - RNA, 15 nt, Mycobacterium avium subsp. paratuberculosis
gucgcuguccucgag

SEQ ID NO: 2876332 - RNA, 13 nt, Mycobacterium avium subsp. paratuberculosis
gucgcugucggcg

SEQ ID NO: 2876333 - RNA, 18 nt, Mycobacterium avium subsp. paratuberculosis
gucgcuguuggcgacggc

SEQ ID NO: 2876334 - RNA, 19 nt, Mycobacterium avium subsp. paratuberculosis
gucgcuguuggcgacggcg

SEQ ID NO: 2876335 - RNA, 20 nt, Mycobacterium avium subsp. paratuberculosis
gucgcuguuggcgacggcgc

SEQ ID NO: 2876336 - RNA, 19 nt, Mycobacterium avium subsp. paratuberculosis
gucgcuuucggugaccauc

SEQ ID NO: 2876337 - RNA, 20 nt, Mycobacterium avium subsp. paratuberculosis
gucgcuuucggugaccauca

SEQ ID NO: 2876338 - RNA, 20 nt, Mycobacterium avium subsp. paratuberculosis
gucggaaacuuguucgagau

SEQ ID NO: 2876339 - RNA, 15 nt, Mycobacterium avium subsp. paratuberculosis
gucggaaucggcgcc

SEQ ID NO: 2876340 - RNA, 13 nt, Mycobacterium avium subsp. paratuberculosis
gucggacagcagc

SEQ ID NO: 2876341 - RNA, 16 nt, Mycobacterium avium subsp. paratuberculosis
gucggacagcagcacc

SEQ ID NO: 2876342 - RNA, 17 nt, Mycobacterium avium subsp. paratuberculosis
gucggacagcagcaccg

SEQ ID NO: 2876343 - RNA, 18 nt, Mycobacterium avium subsp. paratuberculosis
gucggacaugccggcgcc

SEQ ID NO: 2876344 - RNA, 20 nt, Mycobacterium avium subsp. paratuberculosis
gucggacaugccggcgccga

SEQ ID NO: 2876345 - RNA, 19 nt, Mycobacterium avium subsp. paratuberculosis
gucggaccccgaugcgcuc

SEQ ID NO: 2876346 - RNA, 23 nt, Mycobacterium avium subsp. paratuberculosis
gucggacgccaguggcugcacgu

SEQ ID NO: 2876347 - RNA, 15 nt, Mycobacterium avium subsp. paratuberculosis
gucggacgcggccga

SEQ ID NO: 2876348 - RNA, 18 nt, Mycobacterium avium subsp. paratuberculosis
gucggacgcggccgagcc

SEQ ID NO: 2876349 - RNA, 15 nt, Mycobacterium avium subsp. paratuberculosis
gucggacucgcgccg

SEQ ID NO: 2876350 - RNA, 15 nt, Mycobacterium avium subsp. paratuberculosis
gucggagacccgccc

SEQ ID NO: 2876351 - RNA, 16 nt, Mycobacterium avium subsp. paratuberculosis
gucggagacccgcccg

SEQ ID NO: 2876352 - RNA, 23 nt, Mycobacterium avium subsp. paratuberculosis
gucggagacguugccgcacaccg

SEQ ID NO: 2876353 - RNA, 17 nt, Mycobacterium avium subsp. paratuberculosis
gucggagaucaccggca

SEQ ID NO: 2876354 - RNA, 20 nt, Mycobacterium avium subsp. paratuberculosis
gucggagaucaccggcaccc

SEQ ID NO: 2876355 - RNA, 17 nt, Mycobacterium avium subsp. paratuberculosis
gucggagaucagggugc

SEQ ID NO: 2876356 - RNA, 18 nt, Mycobacterium avium subsp. paratuberculosis
gucggagaucggcgagug

SEQ ID NO: 2876357 - RNA, 20 nt, Mycobacterium avium subsp. paratuberculosis
gucggagaugcgggccaccg

SEQ ID NO: 2876358 - RNA, 14 nt, Mycobacterium avium subsp. paratuberculosis
gucggagcgcucca

SEQ ID NO: 2876359 - RNA, 19 nt, Mycobacterium avium subsp. paratuberculosis
gucggagcgcuccaccacc

SEQ ID NO: 2876360 - RNA, 21 nt, Mycobacterium avium subsp. paratuberculosis
gucggagcugcgcgccccggc

SEQ ID NO: 2876361 - RNA, 14 nt, Mycobacterium avium subsp. paratuberculosis
gucggaggcgucga

SEQ ID NO: 2876362 - RNA, 17 nt, Mycobacterium avium subsp. paratuberculosis
gucggaggcgucgacgc

SEQ ID NO: 2876363 - RNA, 17 nt, Mycobacterium avium subsp. paratuberculosis
gucggaguccagcacgc

SEQ ID NO: 2876364 - RNA, 18 nt, Mycobacterium avium subsp. paratuberculosis
gucggaguccagcacgcc

SEQ ID NO: 2876365 - RNA, 23 nt, Mycobacterium avium subsp. paratuberculosis
gucggaucgaaggcgugcucgau

SEQ ID NO: 2876366 - RNA, 23 nt, Mycobacterium avium subsp. paratuberculosis
gucggaucgagcucgcagucgau

SEQ ID NO: 2876367 - RNA, 16 nt, Mycobacterium avium subsp. paratuberculosis
gucggaucgcuugacc

SEQ ID NO: 2876368 - RNA, 20 nt, Mycobacterium avium subsp. paratuberculosis
gucggaucgcuugaccagca

SEQ ID NO: 2876369 - RNA, 14 nt, Mycobacterium avium subsp. paratuberculosis
gucggcaacccgac

SEQ ID NO: 2876370 - RNA, 17 nt, Mycobacterium avium subsp. paratuberculosis
gucggcaacccgaccuc

SEQ ID NO: 2876371 - RNA, 16 nt, Mycobacterium avium subsp. paratuberculosis
gucggcaacgccgggu

SEQ ID NO: 2876372 - RNA, 20 nt, Mycobacterium avium subsp. paratuberculosis
gucggcaaugaccggcacca

SEQ ID NO: 2876373 - RNA, 15 nt, Mycobacterium avium subsp. paratuberculosis
gucggcaccagcggc

SEQ ID NO: 2876374 - RNA, 19 nt, Mycobacterium avium subsp. paratuberculosis
gucggcaccuccugcaccc

SEQ ID NO: 2876375 - RNA, 16 nt, Mycobacterium avium subsp. paratuberculosis
gucggcacugcccgca

SEQ ID NO: 2876376 - RNA, 13 nt, Mycobacterium avium subsp. paratuberculosis
gucggcagcaccg

SEQ ID NO: 2876377 - RNA, 16 nt, Mycobacterium avium subsp. paratuberculosis
gucggcagcgacgcgg

SEQ ID NO: 2876378 - RNA, 16 nt, Mycobacterium avium subsp. paratuberculosis
gucggcaggauccgga

SEQ ID NO: 2876379 - RNA, 19 nt, Mycobacterium avium subsp. paratuberculosis
gucggcaggauccggacga

SEQ ID NO: 2876380 - RNA, 20 nt, Mycobacterium avium subsp. paratuberculosis
gucggcaguugcacuuucgc

SEQ ID NO: 2876381 - RNA, 16 nt, Mycobacterium avium subsp. paratuberculosis
gucggcauagcgccgc

SEQ ID NO: 2876382 - RNA, 17 nt, Mycobacterium avium subsp. paratuberculosis
gucggcauagcgccgcu

SEQ ID NO: 2876383 - RNA, 19 nt, Mycobacterium avium subsp. paratuberculosis
gucggcauagcgccgcucg

SEQ ID NO: 2876384 - RNA, 23 nt, Mycobacterium avium subsp. paratuberculosis
gucggcauagcgccgcucggccg

SEQ ID NO: 2876385 - RNA, 13 nt, Mycobacterium avium subsp. paratuberculosis
gucggccaccgcg

SEQ ID NO: 2876386 - RNA, 14 nt, Mycobacterium avium subsp. paratuberculosis
gucggccaccgcga

SEQ ID NO: 2876387 - RNA, 15 nt, Mycobacterium avium subsp. paratuberculosis
gucggccaccgcgau

SEQ ID NO: 2876388 - RNA, 23 nt, Mycobacterium avium subsp. paratuberculosis
gucggccaccgcgaucucgaugg

SEQ ID NO: 2876389 - RNA, 14 nt, Mycobacterium avium subsp. paratuberculosis
gucggccaccgcgc

SEQ ID NO: 2876390 - RNA, 15 nt, Mycobacterium avium subsp. paratuberculosis
gucggccaccgcgcc

SEQ ID NO: 2876391 - RNA, 13 nt, Mycobacterium avium subsp. paratuberculosis
gucggccacgacg

SEQ ID NO: 2876392 - RNA, 19 nt, Mycobacterium avium subsp. paratuberculosis
gucggccacgacgcggcgc

SEQ ID NO: 2876393 - RNA, 14 nt, Mycobacterium avium subsp. paratuberculosis
gucggccacgccgg

SEQ ID NO: 2876394 - RNA, 16 nt, Mycobacterium avium subsp. paratuberculosis
gucggccacguugccg

SEQ ID NO: 2876395 - RNA, 20 nt, Mycobacterium avium subsp. paratuberculosis
gucggccacguugccgggua

SEQ ID NO: 2876396 - RNA, 13 nt, Mycobacterium avium subsp. paratuberculosis
gucggccagauag

SEQ ID NO: 2876397 - RNA, 16 nt, Mycobacterium avium subsp. paratuberculosis
gucggccagauagaug

SEQ ID NO: 2876398 - RNA, 17 nt, Mycobacterium avium subsp. paratuberculosis
gucggccagauagauga

SEQ ID NO: 2876399 - RNA, 16 nt, Mycobacterium avium subsp. paratuberculosis
gucggccagcaccacc

SEQ ID NO: 2876400 - RNA, 14 nt, Mycobacterium avium subsp. paratuberculosis
gucggccagcagcg

SEQ ID NO: 2876401 - RNA, 23 nt, Mycobacterium avium subsp. paratuberculosis
gucggccagcagcgcgucgcggg

SEQ ID NO: 2876402 - RNA, 15 nt, Mycobacterium avium subsp. paratuberculosis
gucggccagcagguc

SEQ ID NO: 2876403 - RNA, 16 nt, Mycobacterium avium subsp. paratuberculosis
gucggccagcgaaugg

SEQ ID NO: 2876404 - RNA, 16 nt, Mycobacterium avium subsp. paratuberculosis
gucggccagcgccgcc

SEQ ID NO: 2876405 - RNA, 17 nt, Mycobacterium avium subsp. paratuberculosis
gucggccagcgccgccc

SEQ ID NO: 2876406 - RNA, 20 nt, Mycobacterium avium subsp. paratuberculosis
gucggccagcgccgcccggg

SEQ ID NO: 2876407 - RNA, 13 nt, Mycobacterium avium subsp. paratuberculosis
gucggccagcgcg

SEQ ID NO: 2876408 - RNA, 19 nt, Mycobacterium avium subsp. paratuberculosis
gucggccagcgcgcgcagc

SEQ ID NO: 2876409 - RNA, 16 nt, Mycobacterium avium subsp. paratuberculosis
gucggccagcgcgcgg

SEQ ID NO: 2876410 - RNA, 14 nt, Mycobacterium avium subsp. paratuberculosis
gucggccagcgcgg

SEQ ID NO: 2876411 - RNA, 16 nt, Mycobacterium avium subsp. paratuberculosis
gucggccagcgcguga

SEQ ID NO: 2876412 - RNA, 13 nt, Mycobacterium avium subsp. paratuberculosis
gucggccagcggc

SEQ ID NO: 2876413 - RNA, 13 nt, Mycobacterium avium subsp. paratuberculosis
gucggccagcugc

SEQ ID NO: 2876414 - RNA, 16 nt, Mycobacterium avium subsp. paratuberculosis
gucggccagcugcggg

SEQ ID NO: 2876415 - RNA, 17 nt, Mycobacterium avium subsp. paratuberculosis
gucggccagcugcgggu

SEQ ID NO: 2876416 - RNA, 17 nt, Mycobacterium avium subsp. paratuberculosis
gucggccagggcgugga

SEQ ID NO: 2876417 - RNA, 16 nt, Mycobacterium avium subsp. paratuberculosis
gucggccagucguacu

SEQ ID NO: 2876418 - RNA, 17 nt, Mycobacterium avium subsp. paratuberculosis
gucggccaguucaccgc

SEQ ID NO: 2876419 - RNA, 18 nt, Mycobacterium avium subsp. paratuberculosis
gucggccaguucaccgcg

SEQ ID NO: 2876420 - RNA, 20 nt, Mycobacterium avium subsp. paratuberculosis
gucggccaguucgccgguga

SEQ ID NO: 2876421 - RNA, 13 nt, Mycobacterium avium subsp. paratuberculosis
gucggccaucagc

SEQ ID NO: 2876422 - RNA, 18 nt, Mycobacterium avium subsp. paratuberculosis
gucggccaucagcaccga

SEQ ID NO: 2876423 - RNA, 20 nt, Mycobacterium avium subsp. paratuberculosis
gucggccaucagcaccgaau

SEQ ID NO: 2876424 - RNA, 17 nt, Mycobacterium avium subsp. paratuberculosis
gucggccaucagccgcc

SEQ ID NO: 2876425 - RNA, 19 nt, Mycobacterium avium subsp. paratuberculosis
gucggccaucagccgccgu

SEQ ID NO: 2876426 - RNA, 18 nt, Mycobacterium avium subsp. paratuberculosis
gucggcccagacgauguc

SEQ ID NO: 2876427 - RNA, 16 nt, Mycobacterium avium subsp. paratuberculosis
gucggcccaggccaac

SEQ ID NO: 2876428 - RNA, 21 nt, Mycobacterium avium subsp. paratuberculosis
gucggcccaguccagucgcgc

SEQ ID NO: 2876429 - RNA, 14 nt, Mycobacterium avium subsp. paratuberculosis
gucggccccgcgca

SEQ ID NO: 2876430 - RNA, 20 nt, Mycobacterium avium subsp. paratuberculosis
gucggcccgaucgcgucgac

SEQ ID NO: 2876431 - RNA, 16 nt, Mycobacterium avium subsp. paratuberculosis
gucggcccgccaaaac

SEQ ID NO: 2876432 - RNA, 14 nt, Mycobacterium avium subsp. paratuberculosis
gucggcccgccggg

SEQ ID NO: 2876433 - RNA, 20 nt, Mycobacterium avium subsp. paratuberculosis
gucggcccgccgggccggau

SEQ ID NO: 2876434 - RNA, 19 nt, Mycobacterium avium subsp. paratuberculosis
gucggccgagguccgcggu

SEQ ID NO: 2876435 - RNA, 20 nt, Mycobacterium avium subsp. paratuberculosis
gucggccgcacgucccgccc

SEQ ID NO: 2876436 - RNA, 13 nt, Mycobacterium avium subsp. paratuberculosis
gucggccgcccgu

SEQ ID NO: 2876437 - RNA, 19 nt, Mycobacterium avium subsp. paratuberculosis
gucggccgcccguccgggc

SEQ ID NO: 2876438 - RNA, 23 nt, Mycobacterium avium subsp. paratuberculosis
gucggccgcccguccgggccggc

SEQ ID NO: 2876439 - RNA, 12 nt, Mycobacterium avium subsp. paratuberculosis
gucggccgccga

SEQ ID NO: 2876440 - RNA, 13 nt, Mycobacterium avium subsp. paratuberculosis
gucggccgccgac

SEQ ID NO: 2876441 - RNA, 14 nt, Mycobacterium avium subsp. paratuberculosis
gucggccgccgacu

SEQ ID NO: 2876442 - RNA, 22 nt, Mycobacterium avium subsp. paratuberculosis
gucggccgcgacgaccgccugc

SEQ ID NO: 2876443 - RNA, 18 nt, Mycobacterium avium subsp. paratuberculosis
gucggccgcggccggcgg

SEQ ID NO: 2876444 - RNA, 19 nt, Mycobacterium avium subsp. paratuberculosis
gucggccgcggccggcggc

SEQ ID NO: 2876445 - RNA, 12 nt, Mycobacterium avium subsp. paratuberculosis
gucggccggcgg

SEQ ID NO: 2876446 - RNA, 15 nt, Mycobacterium avium subsp. paratuberculosis
gucggccggcugcag

SEQ ID NO: 2876447 - RNA, 21 nt, Mycobacterium avium subsp. paratuberculosis
gucggccgggccggcggugau

SEQ ID NO: 2876448 - RNA, 20 nt, Mycobacterium avium subsp. paratuberculosis
gucggccgggcugcccacca

SEQ ID NO: 2876449 - RNA, 13 nt, Mycobacterium avium subsp. paratuberculosis
gucggccgggggc

SEQ ID NO: 2876450 - RNA, 14 nt, Mycobacterium avium subsp. paratuberculosis
gucggccgggggcg

SEQ ID NO: 2876451 - RNA, 16 nt, Mycobacterium avium subsp. paratuberculosis
gucggccgggggcgcg

SEQ ID NO: 2876452 - RNA, 22 nt, Mycobacterium avium subsp. paratuberculosis
gucggccgggggcgcgggcggc

SEQ ID NO: 2876453 - RNA, 15 nt, Mycobacterium avium subsp. paratuberculosis
gucggccgucggcgc

SEQ ID NO: 2876454 - RNA, 16 nt, Mycobacterium avium subsp. paratuberculosis
gucggccgucggcgcc

SEQ ID NO: 2876455 - RNA, 17 nt, Mycobacterium avium subsp. paratuberculosis
gucggccgucggcgccg

SEQ ID NO: 2876456 - RNA, 17 nt, Mycobacterium avium subsp. paratuberculosis
gucggccuccagccggc

SEQ ID NO: 2876457 - RNA, 13 nt, Mycobacterium avium subsp. paratuberculosis
gucggccucggcg

SEQ ID NO: 2876458 - RNA, 14 nt, Mycobacterium avium subsp. paratuberculosis
gucggccucggcgg

SEQ ID NO: 2876459 - RNA, 15 nt, Mycobacterium avium subsp. paratuberculosis
gucggccucggcggc

SEQ ID NO: 2876460 - RNA, 16 nt, Mycobacterium avium subsp. paratuberculosis
gucggccucggcggcc

SEQ ID NO: 2876461 - RNA, 19 nt, Mycobacterium avium subsp. paratuberculosis
gucggccucggcggccggg

SEQ ID NO: 2876462 - RNA, 20 nt, Mycobacterium avium subsp. paratuberculosis
gucggccucggcgguggccu

SEQ ID NO: 2876463 - RNA, 20 nt, Mycobacterium avium subsp. paratuberculosis
gucggccugcacgucggcgc

SEQ ID NO: 2876464 - RNA, 20 nt, Mycobacterium avium subsp. paratuberculosis
gucggccugcagcucggugc

SEQ ID NO: 2876465 - RNA, 16 nt, Mycobacterium avium subsp. paratuberculosis
gucggccugcccgcgg

SEQ ID NO: 2876466 - RNA, 23 nt, Mycobacterium avium subsp. paratuberculosis
gucggccugcccgcggguggccu

SEQ ID NO: 2876467 - RNA, 21 nt, Mycobacterium avium subsp. paratuberculosis
gucggccugcgcugcggccaa

SEQ ID NO: 2876468 - RNA, 19 nt, Mycobacterium avium subsp. paratuberculosis
gucggccuucagcguccac

SEQ ID NO: 2876469 - RNA, 22 nt, Mycobacterium avium subsp. paratuberculosis
gucggccuucagcguccacgau

SEQ ID NO: 2876470 - RNA, 17 nt, Mycobacterium avium subsp. paratuberculosis
gucggccuugaccagga

SEQ ID NO: 2876471 - RNA, 17 nt, Mycobacterium avium subsp. paratuberculosis
gucggccuugcgccacu

SEQ ID NO: 2876472 - RNA, 17 nt, Mycobacterium avium subsp. paratuberculosis
gucggcgaacaccugcu

SEQ ID NO: 2876473 - RNA, 17 nt, Mycobacterium avium subsp. paratuberculosis
gucggcgaacagugcac

SEQ ID NO: 2876474 - RNA, 18 nt, Mycobacterium avium subsp. paratuberculosis
gucggcgaaccagggcag

SEQ ID NO: 2876475 - RNA, 19 nt, Mycobacterium avium subsp. paratuberculosis
gucggcgaaccagggcagc

SEQ ID NO: 2876476 - RNA, 17 nt, Mycobacterium avium subsp. paratuberculosis
gucggcgaacgcccggu

SEQ ID NO: 2876477 - RNA, 15 nt, Mycobacterium avium subsp. paratuberculosis
gucggcgaacggcca

SEQ ID NO: 2876478 - RNA, 20 nt, Mycobacterium avium subsp. paratuberculosis
gucggcgaacggccagucca

SEQ ID NO: 2876479 - RNA, 23 nt, Mycobacterium avium subsp. paratuberculosis
gucggcgaacuccagaucgccgc

SEQ ID NO: 2876480 - RNA, 20 nt, Mycobacterium avium subsp. paratuberculosis
gucggcgaacugcuugauca

SEQ ID NO: 2876481 - RNA, 17 nt, Mycobacterium avium subsp. paratuberculosis
gucggcgaaggcgcgca

SEQ ID NO: 2876482 - RNA, 19 nt, Mycobacterium avium subsp. paratuberculosis
gucggcgaaggcgcgcagg

SEQ ID NO: 2876483 - RNA, 23 nt, Mycobacterium avium subsp. paratuberculosis
gucggcgaaggcgcgcagggcga

SEQ ID NO: 2876484 - RNA, 17 nt, Mycobacterium avium subsp. paratuberculosis
gucggcgaaggugcccc

SEQ ID NO: 2876485 - RNA, 20 nt, Mycobacterium avium subsp. paratuberculosis
gucggcgaaggugccccgcu

SEQ ID NO: 2876486 - RNA, 21 nt, Mycobacterium avium subsp. paratuberculosis
gucggcgaaggugccccgcug

SEQ ID NO: 2876487 - RNA, 22 nt, Mycobacterium avium subsp. paratuberculosis
gucggcgaaggugccccgcugg

SEQ ID NO: 2876488 - RNA, 14 nt, Mycobacterium avium subsp. paratuberculosis
gucggcgaccaugc

SEQ ID NO: 2876489 - RNA, 21 nt, Mycobacterium avium subsp. paratuberculosis
gucggcgaccaugccguagcg

SEQ ID NO: 2876490 - RNA, 13 nt, Mycobacterium avium subsp. paratuberculosis
gucggcgacccgc

SEQ ID NO: 2876491 - RNA, 14 nt, Mycobacterium avium subsp. paratuberculosis
gucggcgacccgca

SEQ ID NO: 2876492 - RNA, 15 nt, Mycobacterium avium subsp. paratuberculosis
gucggcgacccgcac

SEQ ID NO: 2876493 - RNA, 16 nt, Mycobacterium avium subsp. paratuberculosis
gucggcgacccgcacg

SEQ ID NO: 2876494 - RNA, 17 nt, Mycobacterium avium subsp. paratuberculosis
gucggcgacccgcacga

SEQ ID NO: 2876495 - RNA, 19 nt, Mycobacterium avium subsp. paratuberculosis
gucggcgacccgcuuggug

SEQ ID NO: 2876496 - RNA, 15 nt, Mycobacterium avium subsp. paratuberculosis
gucggcgaccgcgcg

SEQ ID NO: 2876497 - RNA, 18 nt, Mycobacterium avium subsp. paratuberculosis
gucggcgaccgcgcgcgg

SEQ ID NO: 2876498 - RNA, 16 nt, Mycobacterium avium subsp. paratuberculosis
gucggcgaccuccugc

SEQ ID NO: 2876499 - RNA, 14 nt, Mycobacterium avium subsp. paratuberculosis
gucggcgacgccgu

SEQ ID NO: 2876500 - RNA, 22 nt, Mycobacterium avium subsp. paratuberculosis
gucggcgacggcgcucaccggc

SEQ ID NO: 2876501 - RNA, 18 nt, Mycobacterium avium subsp. paratuberculosis
gucggcgacggcggggug

SEQ ID NO: 2876502 - RNA, 19 nt, Mycobacterium avium subsp. paratuberculosis
gucggcgacggcggggugc

SEQ ID NO: 2876503 - RNA, 23 nt, Mycobacterium avium subsp. paratuberculosis
gucggcgacggcggggugcgcgg

SEQ ID NO: 2876504 - RNA, 22 nt, Mycobacterium avium subsp. paratuberculosis
gucggcgacggcguccagcugc

SEQ ID NO: 2876505 - RNA, 21 nt, Mycobacterium avium subsp. paratuberculosis
gucggcgagcagcagcgcggu

SEQ ID NO: 2876506 - RNA, 22 nt, Mycobacterium avium subsp. paratuberculosis
gucggcgagcagcagcgcggug

SEQ ID NO: 2876507 - RNA, 14 nt, Mycobacterium avium subsp. paratuberculosis
gucggcgagcagcc

SEQ ID NO: 2876508 - RNA, 17 nt, Mycobacterium avium subsp. paratuberculosis
gucggcgagcagccgcg

SEQ ID NO: 2876509 - RNA, 18 nt, Mycobacterium avium subsp. paratuberculosis
gucggcgagcagccgcgc

SEQ ID NO: 2876510 - RNA, 19 nt, Mycobacterium avium subsp. paratuberculosis
gucggcgagcagccgcgcc

SEQ ID NO: 2876511 - RNA, 20 nt, Mycobacterium avium subsp. paratuberculosis
gucggcgagcagccgcgccg

SEQ ID NO: 2876512 - RNA, 15 nt, Mycobacterium avium subsp. paratuberculosis
gucggcgagcuuggc

SEQ ID NO: 2876513 - RNA, 17 nt, Mycobacterium avium subsp. paratuberculosis
gucggcgagcuuggcgg

SEQ ID NO: 2876514 - RNA, 21 nt, Mycobacterium avium subsp. paratuberculosis
gucggcgagcuuggcgguguu

SEQ ID NO: 2876515 - RNA, 22 nt, Mycobacterium avium subsp. paratuberculosis
gucggcgagcuuguccugcacc

SEQ ID NO: 2876516 - RNA, 23 nt, Mycobacterium avium subsp. paratuberculosis
gucggcgaguucgaccuccaccc

SEQ ID NO: 2876517 - RNA, 17 nt, Mycobacterium avium subsp. paratuberculosis
gucggcgaucagcuccu

SEQ ID NO: 2876518 - RNA, 11 nt, Mycobacterium avium subsp. paratuberculosis
gucggcgaucc

SEQ ID NO: 2876519 - RNA, 19 nt, Mycobacterium avium subsp. paratuberculosis
gucggcgaucgccagcacg

SEQ ID NO: 2876520 - RNA, 18 nt, Mycobacterium avium subsp. paratuberculosis
gucggcgaucgccgggga

SEQ ID NO: 2876521 - RNA, 20 nt, Mycobacterium avium subsp. paratuberculosis
gucggcgaucggcgugccgg

SEQ ID NO: 2876522 - RNA, 17 nt, Mycobacterium avium subsp. paratuberculosis
gucggcgaucucgguca

SEQ ID NO: 2876523 - RNA, 17 nt, Mycobacterium avium subsp. paratuberculosis
gucggcgaugccggaaa

SEQ ID NO: 2876524 - RNA, 16 nt, Mycobacterium avium subsp. paratuberculosis
gucggcgaugcgcacc

SEQ ID NO: 2876525 - RNA, 17 nt, Mycobacterium avium subsp. paratuberculosis
gucggcgaugcgguggu

SEQ ID NO: 2876526 - RNA, 20 nt, Mycobacterium avium subsp. paratuberculosis
gucggcgaugcgguggucga

SEQ ID NO: 2876527 - RNA, 12 nt, Mycobacterium avium subsp. paratuberculosis
gucggcgaugga

SEQ ID NO: 2876528 - RNA, 19 nt, Mycobacterium avium subsp. paratuberculosis
gucggcgauggcggcgugc

SEQ ID NO: 2876529 - RNA, 16 nt, Mycobacterium avium subsp. paratuberculosis
gucggcgauguccuug

SEQ ID NO: 2876530 - RNA, 23 nt, Mycobacterium avium subsp. paratuberculosis
gucggcgauguccuugucgcuca

SEQ ID NO: 2876531 - RNA, 14 nt, Mycobacterium avium subsp. paratuberculosis
gucggcgcccagga

SEQ ID NO: 2876532 - RNA, 14 nt, Mycobacterium avium subsp. paratuberculosis
gucggcgcccggca

SEQ ID NO: 2876533 - RNA, 21 nt, Mycobacterium avium subsp. paratuberculosis
gucggcgcccggcccagccgc

SEQ ID NO: 2876534 - RNA, 23 nt, Mycobacterium avium subsp. paratuberculosis
gucggcgcccggcccagccgcug

SEQ ID NO: 2876535 - RNA, 16 nt, Mycobacterium avium subsp. paratuberculosis
gucggcgcccucggcg

SEQ ID NO: 2876536 - RNA, 18 nt, Mycobacterium avium subsp. paratuberculosis
gucggcgcccucggcgau

SEQ ID NO: 2876537 - RNA, 23 nt, Mycobacterium avium subsp. paratuberculosis
gucggcgcccuugagcucggccu

SEQ ID NO: 2876538 - RNA, 14 nt, Mycobacterium avium subsp. paratuberculosis
gucggcgccgauca

SEQ ID NO: 2876539 - RNA, 15 nt, Mycobacterium avium subsp. paratuberculosis
gucggcgccgaugca

SEQ ID NO: 2876540 - RNA, 12 nt, Mycobacterium avium subsp. paratuberculosis
gucggcgccgcc

SEQ ID NO: 2876541 - RNA, 14 nt, Mycobacterium avium subsp. paratuberculosis
gucggcgccgccga

SEQ ID NO: 2876542 - RNA, 21 nt, Mycobacterium avium subsp. paratuberculosis
gucggcgccgccgagccgcgg

SEQ ID NO: 2876543 - RNA, 18 nt, Mycobacterium avium subsp. paratuberculosis
gucggcgccgcgccggca

SEQ ID NO: 2876544 - RNA, 14 nt, Mycobacterium avium subsp. paratuberculosis
gucggcgccgcgcg

SEQ ID NO: 2876545 - RNA, 16 nt, Mycobacterium avium subsp. paratuberculosis
gucggcgccgcgcgcc

SEQ ID NO: 2876546 - RNA, 19 nt, Mycobacterium avium subsp. paratuberculosis
gucggcgccggaucggccc

SEQ ID NO: 2876547 - RNA, 16 nt, Mycobacterium avium subsp. paratuberculosis
gucggcgccggccagc

SEQ ID NO: 2876548 - RNA, 17 nt, Mycobacterium avium subsp. paratuberculosis
gucggcgccggccagcg

SEQ ID NO: 2876549 - RNA, 13 nt, Mycobacterium avium subsp. paratuberculosis
gucggcgccggcg

SEQ ID NO: 2876550 - RNA, 14 nt, Mycobacterium avium subsp. paratuberculosis
gucggcgccggcgc

SEQ ID NO: 2876551 - RNA, 15 nt, Mycobacterium avium subsp. paratuberculosis
gucggcgccggcgcg

SEQ ID NO: 2876552 - RNA, 17 nt, Mycobacterium avium subsp. paratuberculosis
gucggcgccggcgcgca

SEQ ID NO: 2876553 - RNA, 22 nt, Mycobacterium avium subsp. paratuberculosis
gucggcgcgaggcggguaggcg

SEQ ID NO: 2876554 - RNA, 16 nt, Mycobacterium avium subsp. paratuberculosis
gucggcgcgcaccgcg

SEQ ID NO: 2876555 - RNA, 15 nt, Mycobacterium avium subsp. paratuberculosis
gucggcgcgccaccc

SEQ ID NO: 2876556 - RNA, 16 nt, Mycobacterium avium subsp. paratuberculosis
gucggcgcgccacccg

SEQ ID NO: 2876557 - RNA, 17 nt, Mycobacterium avium subsp. paratuberculosis
gucggcgcgccacccga

SEQ ID NO: 2876558 - RNA, 19 nt, Mycobacterium avium subsp. paratuberculosis
gucggcgcgccacccgacg

SEQ ID NO: 2876559 - RNA, 17 nt, Mycobacterium avium subsp. paratuberculosis
gucggcgcgcucggugc

SEQ ID NO: 2876560 - RNA, 16 nt, Mycobacterium avium subsp. paratuberculosis
gucggcgcggacguga

SEQ ID NO: 2876561 - RNA, 18 nt, Mycobacterium avium subsp. paratuberculosis
gucggcgcggggccacca

SEQ ID NO: 2876562 - RNA, 14 nt, Mycobacterium avium subsp. paratuberculosis
gucggcgcgguugu

SEQ ID NO: 2876563 - RNA, 20 nt, Mycobacterium avium subsp. paratuberculosis
gucggcgcgguugucguuga

SEQ ID NO: 2876564 - RNA, 21 nt, Mycobacterium avium subsp. paratuberculosis
gucggcgcgucguacaccucg

SEQ ID NO: 2876565 - RNA, 14 nt, Mycobacterium avium subsp. paratuberculosis
gucggcgcgugcca

SEQ ID NO: 2876566 - RNA, 16 nt, Mycobacterium avium subsp. paratuberculosis
gucggcgcguuggccg

SEQ ID NO: 2876567 - RNA, 14 nt, Mycobacterium avium subsp. paratuberculosis
gucggcgcucgcgg

SEQ ID NO: 2876568 - RNA, 17 nt, Mycobacterium avium subsp. paratuberculosis
gucggcgcucgcgggug

SEQ ID NO: 2876569 - RNA, 18 nt, Mycobacterium avium subsp. paratuberculosis
gucggcgcuggccagcgc

SEQ ID NO: 2876570 - RNA, 23 nt, Mycobacterium avium subsp. paratuberculosis
gucggcgcuuuccaccucgagca

SEQ ID NO: 2876571 - RNA, 16 nt, Mycobacterium avium subsp. paratuberculosis
gucggcggacuggcug

SEQ ID NO: 2876572 - RNA, 14 nt, Mycobacterium avium subsp. paratuberculosis
gucggcggccgacc

SEQ ID NO: 2876573 - RNA, 18 nt, Mycobacterium avium subsp. paratuberculosis
gucggcggccgacccugc

SEQ ID NO: 2876574 - RNA, 16 nt, Mycobacterium avium subsp. paratuberculosis
gucggcggccgcgaag

SEQ ID NO: 2876575 - RNA, 11 nt, Mycobacterium avium subsp. paratuberculosis
gucggcggccu

SEQ ID NO: 2876576 - RNA, 12 nt, Mycobacterium avium subsp. paratuberculosis
gucggcggccuu

SEQ ID NO: 2876577 - RNA, 21 nt, Mycobacterium avium subsp. paratuberculosis
gucggcggccuuuuccggcga

SEQ ID NO: 2876578 - RNA, 22 nt, Mycobacterium avium subsp. paratuberculosis
gucggcggcgacggcgaccaca

SEQ ID NO: 2876579 - RNA, 20 nt, Mycobacterium avium subsp. paratuberculosis
gucggcggcgacgugccggc

SEQ ID NO: 2876580 - RNA, 15 nt, Mycobacterium avium subsp. paratuberculosis
gucggcggcggccug

SEQ ID NO: 2876581 - RNA, 13 nt, Mycobacterium avium subsp. paratuberculosis
gucggcggcggcg

SEQ ID NO: 2876582 - RNA, 20 nt, Mycobacterium avium subsp. paratuberculosis
gucggcggcugaaccaccgc

SEQ ID NO: 2876583 - RNA, 18 nt, Mycobacterium avium subsp. paratuberculosis
gucggcgggagccggcgg

SEQ ID NO: 2876584 - RNA, 22 nt, Mycobacterium avium subsp. paratuberculosis
gucggcgggagccggcggcggu

SEQ ID NO: 2876585 - RNA, 16 nt, Mycobacterium avium subsp. paratuberculosis
gucggcgggcaccucg

SEQ ID NO: 2876586 - RNA, 12 nt, Mycobacterium avium subsp. paratuberculosis
gucggcgggcag

SEQ ID NO: 2876587 - RNA, 23 nt, Mycobacterium avium subsp. paratuberculosis
gucggcgggcagcgagucgaagg

SEQ ID NO: 2876588 - RNA, 16 nt, Mycobacterium avium subsp. paratuberculosis
gucggcggggccggug

SEQ ID NO: 2876589 - RNA, 20 nt, Mycobacterium avium subsp. paratuberculosis
gucggcgggggauccgccug

SEQ ID NO: 2876590 - RNA, 14 nt, Mycobacterium avium subsp. paratuberculosis
gucggcggucaaca

SEQ ID NO: 2876591 - RNA, 14 nt, Mycobacterium avium subsp. paratuberculosis
gucggcggucgcca

SEQ ID NO: 2876592 - RNA, 19 nt, Mycobacterium avium subsp. paratuberculosis
gucggcggucgccagcgcc

SEQ ID NO: 2876593 - RNA, 23 nt, Mycobacterium avium subsp. paratuberculosis
gucggcggucgccagcgccacgc

SEQ ID NO: 2876594 - RNA, 15 nt, Mycobacterium avium subsp. paratuberculosis
gucggcggucgcggu

SEQ ID NO: 2876595 - RNA, 20 nt, Mycobacterium avium subsp. paratuberculosis
gucggcggucgcggugccca

SEQ ID NO: 2876596 - RNA, 19 nt, Mycobacterium avium subsp. paratuberculosis
gucggcggucuuggcggcc

SEQ ID NO: 2876597 - RNA, 22 nt, Mycobacterium avium subsp. paratuberculosis
gucggcggugaugcgcgccgac

SEQ ID NO: 2876598 - RNA, 23 nt, Mycobacterium avium subsp. paratuberculosis
gucggcggugccgagcccgccgg

SEQ ID NO: 2876599 - RNA, 14 nt, Mycobacterium avium subsp. paratuberculosis
gucggcggugggcg

SEQ ID NO: 2876600 - RNA, 23 nt, Mycobacterium avium subsp. paratuberculosis
gucggcgguucgauaccguccgc

SEQ ID NO: 2876601 - RNA, 21 nt, Mycobacterium avium subsp. paratuberculosis
gucggcgguuucggugccggc

SEQ ID NO: 2876602 - RNA, 22 nt, Mycobacterium avium subsp. paratuberculosis
gucggcgguuucggugccggcc

SEQ ID NO: 2876603 - RNA, 23 nt, Mycobacterium avium subsp. paratuberculosis
gucggcguagggcagcccgagca

SEQ ID NO: 2876604 - RNA, 19 nt, Mycobacterium avium subsp. paratuberculosis
gucggcgucaccccaccga

SEQ ID NO: 2876605 - RNA, 20 nt, Mycobacterium avium subsp. paratuberculosis
gucggcgucaccccaccgag

SEQ ID NO: 2876606 - RNA, 13 nt, Mycobacterium avium subsp. paratuberculosis
gucggcguccagc

SEQ ID NO: 2876607 - RNA, 22 nt, Mycobacterium avium subsp. paratuberculosis
gucggcguccgugccguccggc

SEQ ID NO: 2876608 - RNA, 16 nt, Mycobacterium avium subsp. paratuberculosis
gucggcgucgaacggc

SEQ ID NO: 2876609 - RNA, 18 nt, Mycobacterium avium subsp. paratuberculosis
gucggcgucgaucgccgu

SEQ ID NO: 2876610 - RNA, 20 nt, Mycobacterium avium subsp. paratuberculosis
gucggcgucgaucgccguca

SEQ ID NO: 2876611 - RNA, 22 nt, Mycobacterium avium subsp. paratuberculosis
gucggcgucgaugucgucgucg

SEQ ID NO: 2876612 - RNA, 14 nt, Mycobacterium avium subsp. paratuberculosis
gucggcgucgccga

SEQ ID NO: 2876613 - RNA, 19 nt, Mycobacterium avium subsp. paratuberculosis
gucggcgucgccgagccgc

SEQ ID NO: 2876614 - RNA, 14 nt, Mycobacterium avium subsp. paratuberculosis
gucggcgucgcggc

SEQ ID NO: 2876615 - RNA, 18 nt, Mycobacterium avium subsp. paratuberculosis
gucggcgucgcggcgcac

SEQ ID NO: 2876616 - RNA, 19 nt, Mycobacterium avium subsp. paratuberculosis
gucggcgucggaggcggcg

SEQ ID NO: 2876617 - RNA, 16 nt, Mycobacterium avium subsp. paratuberculosis
gucggcgucggccacc

SEQ ID NO: 2876618 - RNA, 17 nt, Mycobacterium avium subsp. paratuberculosis
gucggcgucggccaccg

SEQ ID NO: 2876619 - RNA, 20 nt, Mycobacterium avium subsp. paratuberculosis
gucggcgucgggccgggggc

SEQ ID NO: 2876620 - RNA, 20 nt, Mycobacterium avium subsp. paratuberculosis
gucggcgucgggcggggugu

SEQ ID NO: 2876621 - RNA, 20 nt, Mycobacterium avium subsp. paratuberculosis
gucggcgucguacagcagcc

SEQ ID NO: 2876622 - RNA, 22 nt, Mycobacterium avium subsp. paratuberculosis
gucggcgugauaggccucgugg

SEQ ID NO: 2876623 - RNA, 19 nt, Mycobacterium avium subsp. paratuberculosis
gucggcgugaucccgaucc

SEQ ID NO: 2876624 - RNA, 15 nt, Mycobacterium avium subsp. paratuberculosis
gucggcgugcagcac

SEQ ID NO: 2876625 - RNA, 16 nt, Mycobacterium avium subsp. paratuberculosis
gucggcgugcccgccg

SEQ ID NO: 2876626 - RNA, 17 nt, Mycobacterium avium subsp. paratuberculosis
gucggcgugcccgccga

SEQ ID NO: 2876627 - RNA, 18 nt, Mycobacterium avium subsp. paratuberculosis
gucggcgugcccgccgac

SEQ ID NO: 2876628 - RNA, 17 nt, Mycobacterium avium subsp. paratuberculosis
gucggcgugcucgucgc

SEQ ID NO: 2876629 - RNA, 20 nt, Mycobacterium avium subsp. paratuberculosis
gucggcgugcucgucgcgga

SEQ ID NO: 2876630 - RNA, 16 nt, Mycobacterium avium subsp. paratuberculosis
gucggcguggccgucc

SEQ ID NO: 2876631 - RNA, 17 nt, Mycobacterium avium subsp. paratuberculosis
gucggcguggccguccg

SEQ ID NO: 2876632 - RNA, 17 nt, Mycobacterium avium subsp. paratuberculosis
gucggcguucagcggca

SEQ ID NO: 2876633 - RNA, 19 nt, Mycobacterium avium subsp. paratuberculosis
gucggcguucagcggcacc

SEQ ID NO: 2876634 - RNA, 20 nt, Mycobacterium avium subsp. paratuberculosis
gucggcguucagcggcaccg

SEQ ID NO: 2876635 - RNA, 23 nt, Mycobacterium avium subsp. paratuberculosis
gucggcguucagcggcaccguca

SEQ ID NO: 2876636 - RNA, 20 nt, Mycobacterium avium subsp. paratuberculosis
gucggcguugguccacacgu

SEQ ID NO: 2876637 - RNA, 18 nt, Mycobacterium avium subsp. paratuberculosis
gucggcucgcccgcgacu

SEQ ID NO: 2876638 - RNA, 20 nt, Mycobacterium avium subsp. paratuberculosis
gucggcuuccuccucggcgc

SEQ ID NO: 2876639 - RNA, 16 nt, Mycobacterium avium subsp. paratuberculosis
gucgggaaaucggacc

SEQ ID NO: 2876640 - RNA, 18 nt, Mycobacterium avium subsp. paratuberculosis
gucgggaaaucggaccca

SEQ ID NO: 2876641 - RNA, 14 nt, Mycobacterium avium subsp. paratuberculosis
gucgggaacgccga

SEQ ID NO: 2876642 - RNA, 15 nt, Mycobacterium avium subsp. paratuberculosis
gucgggaacgccgau

SEQ ID NO: 2876643 - RNA, 22 nt, Mycobacterium avium subsp. paratuberculosis
gucgggaacgccgaucaccgcg

SEQ ID NO: 2876644 - RNA, 16 nt, Mycobacterium avium subsp. paratuberculosis
gucgggaauggggccc

SEQ ID NO: 2876645 - RNA, 17 nt, Mycobacterium avium subsp. paratuberculosis
gucgggaaugucggcgu

SEQ ID NO: 2876646 - RNA, 17 nt, Mycobacterium avium subsp. paratuberculosis
gucgggacccuugucca

SEQ ID NO: 2876647 - RNA, 20 nt, Mycobacterium avium subsp. paratuberculosis
gucgggaccgaugccgcuga

SEQ ID NO: 2876648 - RNA, 16 nt, Mycobacterium avium subsp. paratuberculosis
gucgggaccgucgcgc

SEQ ID NO: 2876649 - RNA, 17 nt, Mycobacterium avium subsp. paratuberculosis
gucgggaccgucgcgca

SEQ ID NO: 2876650 - RNA, 19 nt, Mycobacterium avium subsp. paratuberculosis
gucgggaccgucgcgcagc

SEQ ID NO: 2876651 - RNA, 23 nt, Mycobacterium avium subsp. paratuberculosis
gucgggaccgucgcgcagcccga

SEQ ID NO: 2876652 - RNA, 14 nt, Mycobacterium avium subsp. paratuberculosis
gucgggacguccgc

SEQ ID NO: 2876653 - RNA, 18 nt, Mycobacterium avium subsp. paratuberculosis
gucgggacguccgcgcga

SEQ ID NO: 2876654 - RNA, 16 nt, Mycobacterium avium subsp. paratuberculosis
gucgggacgucggcgc

SEQ ID NO: 2876655 - RNA, 18 nt, Mycobacterium avium subsp. paratuberculosis
gucgggaggcagcgcgga

SEQ ID NO: 2876656 - RNA, 14 nt, Mycobacterium avium subsp. paratuberculosis
gucgggaucgaucc

SEQ ID NO: 2876657 - RNA, 22 nt, Mycobacterium avium subsp. paratuberculosis
gucgggaucgaucccgucggcc

SEQ ID NO: 2876658 - RNA, 23 nt, Mycobacterium avium subsp. paratuberculosis
gucgggaucgaucccgucggcca

SEQ ID NO: 2876659 - RNA, 19 nt, Mycobacterium avium subsp. paratuberculosis
gucgggauggucgauccac

SEQ ID NO: 2876660 - RNA, 16 nt, Mycobacterium avium subsp. paratuberculosis
gucgggcaaucggacc

SEQ ID NO: 2876661 - RNA, 18 nt, Mycobacterium avium subsp. paratuberculosis
gucgggcaaucggaccca

SEQ ID NO: 2876662 - RNA, 21 nt, Mycobacterium avium subsp. paratuberculosis
gucgggcaaucggacccagcc

SEQ ID NO: 2876663 - RNA, 18 nt, Mycobacterium avium subsp. paratuberculosis
gucgggcacagccagcgc

SEQ ID NO: 2876664 - RNA, 16 nt, Mycobacterium avium subsp. paratuberculosis
gucgggcacaucccgc

SEQ ID NO: 2876665 - RNA, 17 nt, Mycobacterium avium subsp. paratuberculosis
gucgggcacaucccgca

SEQ ID NO: 2876666 - RNA, 14 nt, Mycobacterium avium subsp. paratuberculosis
gucgggcaccacgg

SEQ ID NO: 2876667 - RNA, 16 nt, Mycobacterium avium subsp. paratuberculosis
gucgggcaccacggcg

SEQ ID NO: 2876668 - RNA, 19 nt, Mycobacterium avium subsp. paratuberculosis
gucgggcaccacggcggca

SEQ ID NO: 2876669 - RNA, 14 nt, Mycobacterium avium subsp. paratuberculosis
gucgggcaccagca

SEQ ID NO: 2876670 - RNA, 19 nt, Mycobacterium avium subsp. paratuberculosis
gucgggcaccagcaccgag

SEQ ID NO: 2876671 - RNA, 18 nt, Mycobacterium avium subsp. paratuberculosis
gucgggcaccgccaggaa

SEQ ID NO: 2876672 - RNA, 16 nt, Mycobacterium avium subsp. paratuberculosis
gucgggcaggccggug

SEQ ID NO: 2876673 - RNA, 18 nt, Mycobacterium avium subsp. paratuberculosis
gucgggcagugcacgacg

SEQ ID NO: 2876674 - RNA, 20 nt, Mycobacterium avium subsp. paratuberculosis
gucgggcagugcacgacgac

SEQ ID NO: 2876675 - RNA, 23 nt, Mycobacterium avium subsp. paratuberculosis
gucgggcagugcacgacgaccgc

SEQ ID NO: 2876676 - RNA, 19 nt, Mycobacterium avium subsp. paratuberculosis
gucgggcaugccggccggc

SEQ ID NO: 2876677 - RNA, 14 nt, Mycobacterium avium subsp. paratuberculosis
gucgggccaacugg

SEQ ID NO: 2876678 - RNA, 13 nt, Mycobacterium avium subsp. paratuberculosis
gucgggcccgccc

SEQ ID NO: 2876679 - RNA, 15 nt, Mycobacterium avium subsp. paratuberculosis
gucgggcccgccccu

SEQ ID NO: 2876680 - RNA, 13 nt, Mycobacterium avium subsp. paratuberculosis
gucgggccgcacu

SEQ ID NO: 2876681 - RNA, 23 nt, Mycobacterium avium subsp. paratuberculosis
gucgggccgcacuccgucgcgau

SEQ ID NO: 2876682 - RNA, 13 nt, Mycobacterium avium subsp. paratuberculosis
gucgggccgcagc

SEQ ID NO: 2876683 - RNA, 14 nt, Mycobacterium avium subsp. paratuberculosis
gucgggccgcagca

SEQ ID NO: 2876684 - RNA, 15 nt, Mycobacterium avium subsp. paratuberculosis
gucgggccgcagcac

SEQ ID NO: 2876685 - RNA, 16 nt, Mycobacterium avium subsp. paratuberculosis
gucgggccgcagcacg

SEQ ID NO: 2876686 - RNA, 17 nt, Mycobacterium avium subsp. paratuberculosis
gucgggccggacagcgg

SEQ ID NO: 2876687 - RNA, 18 nt, Mycobacterium avium subsp. paratuberculosis
gucgggccggacagcggc

SEQ ID NO: 2876688 - RNA, 14 nt, Mycobacterium avium subsp. paratuberculosis
gucgggccggauca

SEQ ID NO: 2876689 - RNA, 20 nt, Mycobacterium avium subsp. paratuberculosis
gucgggccggccgaugaccu

SEQ ID NO: 2876690 - RNA, 15 nt, Mycobacterium avium subsp. paratuberculosis
gucgggccgggggcg

SEQ ID NO: 2876691 - RNA, 19 nt, Mycobacterium avium subsp. paratuberculosis
gucgggccguccgccggcu

SEQ ID NO: 2876692 - RNA, 18 nt, Mycobacterium avium subsp. paratuberculosis
gucgggcgagguguagau

SEQ ID NO: 2876693 - RNA, 13 nt, Mycobacterium avium subsp. paratuberculosis
gucgggcgccggc

SEQ ID NO: 2876694 - RNA, 11 nt, Mycobacterium avium subsp. paratuberculosis
gucgggcgcgg

SEQ ID NO: 2876695 - RNA, 13 nt, Mycobacterium avium subsp. paratuberculosis
gucgggcgcggcg

SEQ ID NO: 2876696 - RNA, 22 nt, Mycobacterium avium subsp. paratuberculosis
gucgggcggcaggaaccggguc

SEQ ID NO: 2876697 - RNA, 17 nt, Mycobacterium avium subsp. paratuberculosis
gucgggcgggguggcca

SEQ ID NO: 2876698 - RNA, 16 nt, Mycobacterium avium subsp. paratuberculosis
gucgggcguugcgcuc

SEQ ID NO: 2876699 - RNA, 18 nt, Mycobacterium avium subsp. paratuberculosis
gucgggcguugcgcucug

SEQ ID NO: 2876700 - RNA, 13 nt, Mycobacterium avium subsp. paratuberculosis
gucgggcucgcgc

SEQ ID NO: 2876701 - RNA, 15 nt, Mycobacterium avium subsp. paratuberculosis
gucgggcucggccgc

SEQ ID NO: 2876702 - RNA, 16 nt, Mycobacterium avium subsp. paratuberculosis
gucgggcucggccgcc

SEQ ID NO: 2876703 - RNA, 20 nt, Mycobacterium avium subsp. paratuberculosis
gucgggcucggccgccgaca

SEQ ID NO: 2876704 - RNA, 16 nt, Mycobacterium avium subsp. paratuberculosis
gucgggcucgucguga

SEQ ID NO: 2876705 - RNA, 14 nt, Mycobacterium avium subsp. paratuberculosis
gucgggcugggcgg

SEQ ID NO: 2876706 - RNA, 19 nt, Mycobacterium avium subsp. paratuberculosis
gucggggaauuccggcgcg

SEQ ID NO: 2876707 - RNA, 21 nt, Mycobacterium avium subsp. paratuberculosis
gucggggaauuccggcgcgau

SEQ ID NO: 2876708 - RNA, 14 nt, Mycobacterium avium subsp. paratuberculosis
gucggggaucagcg

SEQ ID NO: 2876709 - RNA, 21 nt, Mycobacterium avium subsp. paratuberculosis
gucggggaucagcgucgcgau

SEQ ID NO: 2876710 - RNA, 19 nt, Mycobacterium avium subsp. paratuberculosis
gucggggaugucgucgggc

SEQ ID NO: 2876711 - RNA, 18 nt, Mycobacterium avium subsp. paratuberculosis
gucggggcagccgucgau

SEQ ID NO: 2876712 - RNA, 18 nt, Mycobacterium avium subsp. paratuberculosis
gucggggcaucgcagcgc

SEQ ID NO: 2876713 - RNA, 20 nt, Mycobacterium avium subsp. paratuberculosis
gucggggcaucgcagcgcgc

SEQ ID NO: 2876714 - RNA, 15 nt, Mycobacterium avium subsp. paratuberculosis
gucggggcccggccc

SEQ ID NO: 2876715 - RNA, 14 nt, Mycobacterium avium subsp. paratuberculosis
gucggggcggcggg

SEQ ID NO: 2876716 - RNA, 15 nt, Mycobacterium avium subsp. paratuberculosis
gucggggcgucggcg

SEQ ID NO: 2876717 - RNA, 14 nt, Mycobacterium avium subsp. paratuberculosis
gucggggcuggcgg

SEQ ID NO: 2876718 - RNA, 16 nt, Mycobacterium avium subsp. paratuberculosis
gucggggcuggcggcg

SEQ ID NO: 2876719 - RNA, 21 nt, Mycobacterium avium subsp. paratuberculosis
gucggggucgaacaucacccg

SEQ ID NO: 2876720 - RNA, 16 nt, Mycobacterium avium subsp. paratuberculosis
gucggggucggcgccg

SEQ ID NO: 2876721 - RNA, 19 nt, Mycobacterium avium subsp. paratuberculosis
gucggggucggcgccgcgc

SEQ ID NO: 2876722 - RNA, 21 nt, Mycobacterium avium subsp. paratuberculosis
gucggggucgucgacggccgc

SEQ ID NO: 2876723 - RNA, 23 nt, Mycobacterium avium subsp. paratuberculosis
gucggggucgucgacggccgcgc

SEQ ID NO: 2876724 - RNA, 14 nt, Mycobacterium avium subsp. paratuberculosis
gucggggucgucgc

SEQ ID NO: 2876725 - RNA, 15 nt, Mycobacterium avium subsp. paratuberculosis
gucggggugcgccag

SEQ ID NO: 2876726 - RNA, 19 nt, Mycobacterium avium subsp. paratuberculosis
gucggggugcggucggcga

SEQ ID NO: 2876727 - RNA, 22 nt, Mycobacterium avium subsp. paratuberculosis
gucggggugcucgaucggcgcg

SEQ ID NO: 2876728 - RNA, 16 nt, Mycobacterium avium subsp. paratuberculosis
gucgggguggccggcc

SEQ ID NO: 2876729 - RNA, 17 nt, Mycobacterium avium subsp. paratuberculosis
gucggggugggcgacgu

SEQ ID NO: 2876730 - RNA, 16 nt, Mycobacterium avium subsp. paratuberculosis
gucgggguggugggcg

SEQ ID NO: 2876731 - RNA, 22 nt, Mycobacterium avium subsp. paratuberculosis
gucggguagggcgccgucggcg

SEQ ID NO: 2876732 - RNA, 16 nt, Mycobacterium avium subsp. paratuberculosis
gucgggucccggcaac

SEQ ID NO: 2876733 - RNA, 17 nt, Mycobacterium avium subsp. paratuberculosis
gucgggugcgcucaccg

SEQ ID NO: 2876734 - RNA, 16 nt, Mycobacterium avium subsp. paratuberculosis
gucgggugcggcggug

SEQ ID NO: 2876735 - RNA, 19 nt, Mycobacterium avium subsp. paratuberculosis
gucgggugucaggucggcg

SEQ ID NO: 2876736 - RNA, 21 nt, Mycobacterium avium subsp. paratuberculosis
gucgggugucaggucggcgau

SEQ ID NO: 2876737 - RNA, 23 nt, Mycobacterium avium subsp. paratuberculosis
gucgggugucaggucggcgaugg

SEQ ID NO: 2876738 - RNA, 14 nt, Mycobacterium avium subsp. paratuberculosis
gucggguguggcgc

SEQ ID NO: 2876739 - RNA, 23 nt, Mycobacterium avium subsp. paratuberculosis
gucggucacccgguugagcaccg

SEQ ID NO: 2876740 - RNA, 14 nt, Mycobacterium avium subsp. paratuberculosis
gucggucagcaggc

SEQ ID NO: 2876741 - RNA, 16 nt, Mycobacterium avium subsp. paratuberculosis
gucggucagcaggcgc

SEQ ID NO: 2876742 - RNA, 20 nt, Mycobacterium avium subsp. paratuberculosis
gucggucagcaggcgccgca

SEQ ID NO: 2876743 - RNA, 13 nt, Mycobacterium avium subsp. paratuberculosis
gucggucagcauc

SEQ ID NO: 2876744 - RNA, 13 nt, Mycobacterium avium subsp. paratuberculosis
gucggucagcgcc

SEQ ID NO: 2876745 - RNA, 14 nt, Mycobacterium avium subsp. paratuberculosis
gucggucagcgcca

SEQ ID NO: 2876746 - RNA, 17 nt, Mycobacterium avium subsp. paratuberculosis
gucggucagcggcguca

SEQ ID NO: 2876747 - RNA, 18 nt, Mycobacterium avium subsp. paratuberculosis
gucggucagcgucgccgc

SEQ ID NO: 2876748 - RNA, 17 nt, Mycobacterium avium subsp. paratuberculosis
gucggucaggaacgcgg

SEQ ID NO: 2876749 - RNA, 23 nt, Mycobacterium avium subsp. paratuberculosis
gucggucaggcacucgaucagca

SEQ ID NO: 2876750 - RNA, 16 nt, Mycobacterium avium subsp. paratuberculosis
gucggucaggccggcg

SEQ ID NO: 2876751 - RNA, 18 nt, Mycobacterium avium subsp. paratuberculosis
gucggucaggccggcgcc

SEQ ID NO: 2876752 - RNA, 15 nt, Mycobacterium avium subsp. paratuberculosis
gucggucagucgcgc

SEQ ID NO: 2876753 - RNA, 20 nt, Mycobacterium avium subsp. paratuberculosis
gucggucagucgcgccgcca

SEQ ID NO: 2876754 - RNA, 15 nt, Mycobacterium avium subsp. paratuberculosis
gucgguccagguggc

SEQ ID NO: 2876755 - RNA, 16 nt, Mycobacterium avium subsp. paratuberculosis
gucggucccgacgcgg

SEQ ID NO: 2876756 - RNA, 22 nt, Mycobacterium avium subsp. paratuberculosis
gucggucggcaggauccggacg

SEQ ID NO: 2876757 - RNA, 15 nt, Mycobacterium avium subsp. paratuberculosis
gucggucggcccgcu

SEQ ID NO: 2876758 - RNA, 17 nt, Mycobacterium avium subsp. paratuberculosis
gucggucggcccgcugc

SEQ ID NO: 2876759 - RNA, 15 nt, Mycobacterium avium subsp. paratuberculosis
gucggugaacgccgg

SEQ ID NO: 2876760 - RNA, 18 nt, Mycobacterium avium subsp. paratuberculosis
gucggugaacgccgguga

SEQ ID NO: 2876761 - RNA, 19 nt, Mycobacterium avium subsp. paratuberculosis
gucggugaaguccgagacg

SEQ ID NO: 2876762 - RNA, 14 nt, Mycobacterium avium subsp. paratuberculosis
gucggugaccaccu

SEQ ID NO: 2876763 - RNA, 21 nt, Mycobacterium avium subsp. paratuberculosis
gucggugaccacggucggcgg

SEQ ID NO: 2876764 - RNA, 22 nt, Mycobacterium avium subsp. paratuberculosis
gucggugaccacggucggcggg

SEQ ID NO: 2876765 - RNA, 14 nt, Mycobacterium avium subsp. paratuberculosis
gucggugaccugca

SEQ ID NO: 2876766 - RNA, 14 nt, Mycobacterium avium subsp. paratuberculosis
gucggugagcaccg

SEQ ID NO: 2876767 - RNA, 16 nt, Mycobacterium avium subsp. paratuberculosis
gucggugagcaccguu

SEQ ID NO: 2876768 - RNA, 18 nt, Mycobacterium avium subsp. paratuberculosis
gucggugagcgccacccc

SEQ ID NO: 2876769 - RNA, 16 nt, Mycobacterium avium subsp. paratuberculosis
gucggugagcuggccg

SEQ ID NO: 2876770 - RNA, 19 nt, Mycobacterium avium subsp. paratuberculosis
gucggugagcuggccgcgc

SEQ ID NO: 2876771 - RNA, 23 nt, Mycobacterium avium subsp. paratuberculosis
gucggugagcuggccgcgcagcg

SEQ ID NO: 2876772 - RNA, 15 nt, Mycobacterium avium subsp. paratuberculosis
gucggugaggcuggg

SEQ ID NO: 2876773 - RNA, 17 nt, Mycobacterium avium subsp. paratuberculosis
gucggugauggccggcu

SEQ ID NO: 2876774 - RNA, 14 nt, Mycobacterium avium subsp. paratuberculosis
gucggugcccagca

SEQ ID NO: 2876775 - RNA, 16 nt, Mycobacterium avium subsp. paratuberculosis
gucggugcccagcgcg

SEQ ID NO: 2876776 - RNA, 19 nt, Mycobacterium avium subsp. paratuberculosis
gucggugcccagcgcgagg

SEQ ID NO: 2876777 - RNA, 17 nt, Mycobacterium avium subsp. paratuberculosis
gucggugcccaggucgc

SEQ ID NO: 2876778 - RNA, 17 nt, Mycobacterium avium subsp. paratuberculosis
gucggugcccugugagg

SEQ ID NO: 2876779 - RNA, 13 nt, Mycobacterium avium subsp. paratuberculosis
gucggugcccuug

SEQ ID NO: 2876780 - RNA, 22 nt, Mycobacterium avium subsp. paratuberculosis
gucggugccgagcacgcggccg

SEQ ID NO: 2876781 - RNA, 15 nt, Mycobacterium avium subsp. paratuberculosis
gucggugcgacccgg

SEQ ID NO: 2876782 - RNA, 17 nt, Mycobacterium avium subsp. paratuberculosis
gucggugcgcagcacgu

SEQ ID NO: 2876783 - RNA, 15 nt, Mycobacterium avium subsp. paratuberculosis
gucggugcgcgccgc

SEQ ID NO: 2876784 - RNA, 16 nt, Mycobacterium avium subsp. paratuberculosis
gucggugcgcgccgca

SEQ ID NO: 2876785 - RNA, 17 nt, Mycobacterium avium subsp. paratuberculosis
gucggugcgcgccgcaa

SEQ ID NO: 2876786 - RNA, 21 nt, Mycobacterium avium subsp. paratuberculosis
gucggugcgcgggguggcgcc

SEQ ID NO: 2876787 - RNA, 17 nt, Mycobacterium avium subsp. paratuberculosis
gucggugcgcuccucga

SEQ ID NO: 2876788 - RNA, 22 nt, Mycobacterium avium subsp. paratuberculosis
gucggugcgcuccucgacguag

SEQ ID NO: 2876789 - RNA, 14 nt, Mycobacterium avium subsp. paratuberculosis
gucgguggccacca

SEQ ID NO: 2876790 - RNA, 20 nt, Mycobacterium avium subsp. paratuberculosis
gucgguggcccagccggccg

SEQ ID NO: 2876791 - RNA, 23 nt, Mycobacterium avium subsp. paratuberculosis
gucgguggcccagccggccgacg

SEQ ID NO: 2876792 - RNA, 24 nt, Mycobacterium avium subsp. paratuberculosis
gucgguggcccagccggccgacgc

SEQ ID NO: 2876793 - RNA, 14 nt, Mycobacterium avium subsp. paratuberculosis
gucgguggcgcgca

SEQ ID NO: 2876794 - RNA, 19 nt, Mycobacterium avium subsp. paratuberculosis
gucgguggcggcggcgacg

SEQ ID NO: 2876795 - RNA, 19 nt, Mycobacterium avium subsp. paratuberculosis
gucgguggcggugccgcgg

SEQ ID NO: 2876796 - RNA, 23 nt, Mycobacterium avium subsp. paratuberculosis
gucggugggcagcucgucggcgc

SEQ ID NO: 2876797 - RNA, 14 nt, Mycobacterium avium subsp. paratuberculosis
gucggugggccgca

SEQ ID NO: 2876798 - RNA, 15 nt, Mycobacterium avium subsp. paratuberculosis
gucggugggccgcac

SEQ ID NO: 2876799 - RNA, 14 nt, Mycobacterium avium subsp. paratuberculosis
gucggugggccgcc

SEQ ID NO: 2876800 - RNA, 18 nt, Mycobacterium avium subsp. paratuberculosis
gucggugggccgccgcgg

SEQ ID NO: 2876801 - RNA, 20 nt, Mycobacterium avium subsp. paratuberculosis
gucggugggccgccgcggcg

SEQ ID NO: 2876802 - RNA, 17 nt, Mycobacterium avium subsp. paratuberculosis
gucggugggggccaggc

SEQ ID NO: 2876803 - RNA, 13 nt, Mycobacterium avium subsp. paratuberculosis
gucggugggguga

SEQ ID NO: 2876804 - RNA, 18 nt, Mycobacterium avium subsp. paratuberculosis
gucgguggugaucgcggc

SEQ ID NO: 2876805 - RNA, 22 nt, Mycobacterium avium subsp. paratuberculosis
gucgguggugaucgcggcggcg

SEQ ID NO: 2876806 - RNA, 16 nt, Mycobacterium avium subsp. paratuberculosis
gucggugguggggccg

SEQ ID NO: 2876807 - RNA, 19 nt, Mycobacterium avium subsp. paratuberculosis
gucggugguggggccggcg

SEQ ID NO: 2876808 - RNA, 21 nt, Mycobacterium avium subsp. paratuberculosis
gucggugguggggccggcgaa

SEQ ID NO: 2876809 - RNA, 22 nt, Mycobacterium avium subsp. paratuberculosis
gucggugguguggcagguggcg

SEQ ID NO: 2876810 - RNA, 23 nt, Mycobacterium avium subsp. paratuberculosis
gucgguguagcgagugccggcca

SEQ ID NO: 2876811 - RNA, 18 nt, Mycobacterium avium subsp. paratuberculosis
gucgguguagucggcgau

SEQ ID NO: 2876812 - RNA, 18 nt, Mycobacterium avium subsp. paratuberculosis
gucggugucccgcgcccg

SEQ ID NO: 2876813 - RNA, 14 nt, Mycobacterium avium subsp. paratuberculosis
gucggugucgaaga

SEQ ID NO: 2876814 - RNA, 20 nt, Mycobacterium avium subsp. paratuberculosis
gucggugucgaaguacgccg

SEQ ID NO: 2876815 - RNA, 14 nt, Mycobacterium avium subsp. paratuberculosis
gucggugucgccga

SEQ ID NO: 2876816 - RNA, 17 nt, Mycobacterium avium subsp. paratuberculosis
gucgguguggaccgcgc

SEQ ID NO: 2876817 - RNA, 20 nt, Mycobacterium avium subsp. paratuberculosis
gucggugugggucagcgagg

SEQ ID NO: 2876818 - RNA, 16 nt, Mycobacterium avium subsp. paratuberculosis
gucgguuucgaccugc

SEQ ID NO: 2876819 - RNA, 18 nt, Mycobacterium avium subsp. paratuberculosis
gucgguuucgaccugcgg

SEQ ID NO: 2876820 - RNA, 16 nt, Mycobacterium avium subsp. paratuberculosis
gucgguuugcgggcca

SEQ ID NO: 2876821 - RNA, 15 nt, Mycobacterium avium subsp. paratuberculosis
gucgguuuggcuggu

SEQ ID NO: 2876822 - RNA, 13 nt, Mycobacterium avium subsp. paratuberculosis
gucguacagcagc

SEQ ID NO: 2876823 - RNA, 15 nt, Mycobacterium avium subsp. paratuberculosis
gucguaccaccacca

SEQ ID NO: 2876824 - RNA, 14 nt, Mycobacterium avium subsp. paratuberculosis
gucguacgggcgca

SEQ ID NO: 2876825 - RNA, 17 nt, Mycobacterium avium subsp. paratuberculosis
gucguacgggcgcagcg

SEQ ID NO: 2876826 - RNA, 20 nt, Mycobacterium avium subsp. paratuberculosis
gucguacgucuugcgcaccu

SEQ ID NO: 2876827 - RNA, 16 nt, Mycobacterium avium subsp. paratuberculosis
gucguacucccaggcc

SEQ ID NO: 2876828 - RNA, 20 nt, Mycobacterium avium subsp. paratuberculosis
gucguacucccaggccgcgg

SEQ ID NO: 2876829 - RNA, 21 nt, Mycobacterium avium subsp. paratuberculosis
gucguacucccaggccgcggc

SEQ ID NO: 2876830 - RNA, 23 nt, Mycobacterium avium subsp. paratuberculosis
gucguacucccaggccgcggcca

SEQ ID NO: 2876831 - RNA, 16 nt, Mycobacterium avium subsp. paratuberculosis
gucguacucgaccgcg

SEQ ID NO: 2876832 - RNA, 16 nt, Mycobacterium avium subsp. paratuberculosis
gucguagaacucgccg

SEQ ID NO: 2876833 - RNA, 17 nt, Mycobacterium avium subsp. paratuberculosis
gucguagaacucgccgu

SEQ ID NO: 2876834 - RNA, 19 nt, Mycobacterium avium subsp. paratuberculosis
gucguagacgacgucgacc

SEQ ID NO: 2876835 - RNA, 14 nt, Mycobacterium avium subsp. paratuberculosis
gucguagacgcugc

SEQ ID NO: 2876836 - RNA, 16 nt, Mycobacterium avium subsp. paratuberculosis
gucguagacgcugccg

SEQ ID NO: 2876837 - RNA, 15 nt, Mycobacterium avium subsp. paratuberculosis
gucguagagcaggac

SEQ ID NO: 2876838 - RNA, 15 nt, Mycobacterium avium subsp. paratuberculosis
gucguagagcgcgaa

SEQ ID NO: 2876839 - RNA, 23 nt, Mycobacterium avium subsp. paratuberculosis
gucguagagcugacgggaccgca

SEQ ID NO: 2876840 - RNA, 17 nt, Mycobacterium avium subsp. paratuberculosis
gucguagaggggccgga

SEQ ID NO: 2876841 - RNA, 22 nt, Mycobacterium avium subsp. paratuberculosis
gucguagaggggccggacggug

SEQ ID NO: 2876842 - RNA, 17 nt, Mycobacterium avium subsp. paratuberculosis
gucguagaugguccgca

SEQ ID NO: 2876843 - RNA, 17 nt, Mycobacterium avium subsp. paratuberculosis
gucguagccgaagccgc

SEQ ID NO: 2876844 - RNA, 19 nt, Mycobacterium avium subsp. paratuberculosis
gucguagccgaagccgccg

SEQ ID NO: 2876845 - RNA, 17 nt, Mycobacterium avium subsp. paratuberculosis
gucguagccggcacgca

SEQ ID NO: 2876846 - RNA, 17 nt, Mycobacterium avium subsp. paratuberculosis
gucguagcggcccaggu

SEQ ID NO: 2876847 - RNA, 15 nt, Mycobacterium avium subsp. paratuberculosis
gucguagcggcgcca

SEQ ID NO: 2876848 - RNA, 14 nt, Mycobacterium avium subsp. paratuberculosis
gucguagcggucgg

SEQ ID NO: 2876849 - RNA, 22 nt, Mycobacterium avium subsp. paratuberculosis
gucguaggacaccacgguggcg

SEQ ID NO: 2876850 - RNA, 20 nt, Mycobacterium avium subsp. paratuberculosis
gucguaguagcggaucaggu

SEQ ID NO: 2876851 - RNA, 20 nt, Mycobacterium avium subsp. paratuberculosis
gucguaguaggcgccgaacg

SEQ ID NO: 2876852 - RNA, 17 nt, Mycobacterium avium subsp. paratuberculosis
gucguaguaggugcgcg

SEQ ID NO: 2876853 - RNA, 21 nt, Mycobacterium avium subsp. paratuberculosis
gucguagucgcucggcggcga

SEQ ID NO: 2876854 - RNA, 17 nt, Mycobacterium avium subsp. paratuberculosis
gucguaguugcgcgccg

SEQ ID NO: 2876855 - RNA, 18 nt, Mycobacterium avium subsp. paratuberculosis
gucguaguugcggccggc

SEQ ID NO: 2876856 - RNA, 22 nt, Mycobacterium avium subsp. paratuberculosis
gucguaguugcggccggcggug

SEQ ID NO: 2876857 - RNA, 17 nt, Mycobacterium avium subsp. paratuberculosis
gucguauucgacggcga

SEQ ID NO: 2876858 - RNA, 14 nt, Mycobacterium avium subsp. paratuberculosis
gucguauuguccug

SEQ ID NO: 2876859 - RNA, 20 nt, Mycobacterium avium subsp. paratuberculosis
gucgucaacgacccggaucu

SEQ ID NO: 2876860 - RNA, 18 nt, Mycobacterium avium subsp. paratuberculosis
gucgucaccucgaccaga

SEQ ID NO: 2876861 - RNA, 12 nt, Mycobacterium avium subsp. paratuberculosis
gucgucagcacc

SEQ ID NO: 2876862 - RNA, 14 nt, Mycobacterium avium subsp. paratuberculosis
gucgucagcaccgu

SEQ ID NO: 2876863 - RNA, 15 nt, Mycobacterium avium subsp. paratuberculosis
gucgucagcaccgug

SEQ ID NO: 2876864 - RNA, 16 nt, Mycobacterium avium subsp. paratuberculosis
gucgucagccgggcca

SEQ ID NO: 2876865 - RNA, 14 nt, Mycobacterium avium subsp. paratuberculosis
gucgucaucgucuc

SEQ ID NO: 2876866 - RNA, 16 nt, Mycobacterium avium subsp. paratuberculosis
gucguccacgcccagc

SEQ ID NO: 2876867 - RNA, 20 nt, Mycobacterium avium subsp. paratuberculosis
gucguccacgcccagcgccc

SEQ ID NO: 2876868 - RNA, 22 nt, Mycobacterium avium subsp. paratuberculosis
gucguccacgcccagcgccccg

SEQ ID NO: 2876869 - RNA, 16 nt, Mycobacterium avium subsp. paratuberculosis
gucguccagcgucgac

SEQ ID NO: 2876870 - RNA, 20 nt, Mycobacterium avium subsp. paratuberculosis
gucguccagcuucucggcgu

SEQ ID NO: 2876871 - RNA, 20 nt, Mycobacterium avium subsp. paratuberculosis
gucgucccggcgccucggcg

SEQ ID NO: 2876872 - RNA, 16 nt, Mycobacterium avium subsp. paratuberculosis
gucgucccggugauga

SEQ ID NO: 2876873 - RNA, 21 nt, Mycobacterium avium subsp. paratuberculosis
gucgucccgucggcgcgaggc

SEQ ID NO: 2876874 - RNA, 21 nt, Mycobacterium avium subsp. paratuberculosis
gucguccgacaggaugcuggg

SEQ ID NO: 2876875 - RNA, 20 nt, Mycobacterium avium subsp. paratuberculosis
gucguccgcaaccgccggca

SEQ ID NO: 2876876 - RNA, 22 nt, Mycobacterium avium subsp. paratuberculosis
gucguccgcaaccgccggcagc

SEQ ID NO: 2876877 - RNA, 18 nt, Mycobacterium avium subsp. paratuberculosis
gucguccggcgcgcagca

SEQ ID NO: 2876878 - RNA, 20 nt, Mycobacterium avium subsp. paratuberculosis
gucguccucgaucaccgaca

SEQ ID NO: 2876879 - RNA, 15 nt, Mycobacterium avium subsp. paratuberculosis
gucguccucggucag

SEQ ID NO: 2876880 - RNA, 17 nt, Mycobacterium avium subsp. paratuberculosis
gucguccucggucaggc

SEQ ID NO: 2876881 - RNA, 19 nt, Mycobacterium avium subsp. paratuberculosis
gucguccucguucuggccc

SEQ ID NO: 2876882 - RNA, 16 nt, Mycobacterium avium subsp. paratuberculosis
gucguccucuucgcgg

SEQ ID NO: 2876883 - RNA, 21 nt, Mycobacterium avium subsp. paratuberculosis
gucguccuugagcccccaccu

SEQ ID NO: 2876884 - RNA, 18 nt, Mycobacterium avium subsp. paratuberculosis
gucgucgaacgcggcgaa

SEQ ID NO: 2876885 - RNA, 22 nt, Mycobacterium avium subsp. paratuberculosis
gucgucgaacucgaugggggug

SEQ ID NO: 2876886 - RNA, 19 nt, Mycobacterium avium subsp. paratuberculosis
gucgucgaagagcuggucg

SEQ ID NO: 2876887 - RNA, 20 nt, Mycobacterium avium subsp. paratuberculosis
gucgucgaagagcuggucgc

SEQ ID NO: 2876888 - RNA, 23 nt, Mycobacterium avium subsp. paratuberculosis
gucgucgaagagcuggucgccca

SEQ ID NO: 2876889 - RNA, 21 nt, Mycobacterium avium subsp. paratuberculosis
gucgucgacccgcuccccgau

SEQ ID NO: 2876890 - RNA, 16 nt, Mycobacterium avium subsp. paratuberculosis
gucgucgaccgccacc

SEQ ID NO: 2876891 - RNA, 16 nt, Mycobacterium avium subsp. paratuberculosis
gucgucgaccucgauc

SEQ ID NO: 2876892 - RNA, 17 nt, Mycobacterium avium subsp. paratuberculosis
gucgucgaccucgauca

SEQ ID NO: 2876893 - RNA, 14 nt, Mycobacterium avium subsp. paratuberculosis
gucgucgacgcuga

SEQ ID NO: 2876894 - RNA, 15 nt, Mycobacterium avium subsp. paratuberculosis
gucgucgacggccgc

SEQ ID NO: 2876895 - RNA, 15 nt, Mycobacterium avium subsp. paratuberculosis
gucgucgacgucgga

SEQ ID NO: 2876896 - RNA, 19 nt, Mycobacterium avium subsp. paratuberculosis
gucgucgagcaccacccgg

SEQ ID NO: 2876897 - RNA, 14 nt, Mycobacterium avium subsp. paratuberculosis
gucgucgagcaccg

SEQ ID NO: 2876898 - RNA, 19 nt, Mycobacterium avium subsp. paratuberculosis
gucgucgagcaccggcagc

SEQ ID NO: 2876899 - RNA, 22 nt, Mycobacterium avium subsp. paratuberculosis
gucgucgagccgcucgcgcacc

SEQ ID NO: 2876900 - RNA, 16 nt, Mycobacterium avium subsp. paratuberculosis
gucgucgagcgcucgc

SEQ ID NO: 2876901 - RNA, 18 nt, Mycobacterium avium subsp. paratuberculosis
gucgucgagcgcucgcgg

SEQ ID NO: 2876902 - RNA, 20 nt, Mycobacterium avium subsp. paratuberculosis
gucgucgagcugacacccga

SEQ ID NO: 2876903 - RNA, 19 nt, Mycobacterium avium subsp. paratuberculosis
gucgucgagggccaccggc

SEQ ID NO: 2876904 - RNA, 13 nt, Mycobacterium avium subsp. paratuberculosis
gucgucgaucagg

SEQ ID NO: 2876905 - RNA, 17 nt, Mycobacterium avium subsp. paratuberculosis
gucgucgaucucgguga

SEQ ID NO: 2876906 - RNA, 18 nt, Mycobacterium avium subsp. paratuberculosis
gucgucgaugaacaucgc

SEQ ID NO: 2876907 - RNA, 17 nt, Mycobacterium avium subsp. paratuberculosis
gucgucgaugaagucgg

SEQ ID NO: 2876908 - RNA, 15 nt, Mycobacterium avium subsp. paratuberculosis
gucgucgaugcgcag

SEQ ID NO: 2876909 - RNA, 19 nt, Mycobacterium avium subsp. paratuberculosis
gucgucgauggccaccagg

SEQ ID NO: 2876910 - RNA, 13 nt, Mycobacterium avium subsp. paratuberculosis
gucgucgcaccgg

SEQ ID NO: 2876911 - RNA, 14 nt, Mycobacterium avium subsp. paratuberculosis
gucgucgcagugcc

SEQ ID NO: 2876912 - RNA, 18 nt, Mycobacterium avium subsp. paratuberculosis
gucgucgcagugcccgcc

SEQ ID NO: 2876913 - RNA, 13 nt, Mycobacterium avium subsp. paratuberculosis
gucgucgcccacc

SEQ ID NO: 2876914 - RNA, 21 nt, Mycobacterium avium subsp. paratuberculosis
gucgucgccgaugcgccgcac

SEQ ID NO: 2876915 - RNA, 22 nt, Mycobacterium avium subsp. paratuberculosis
gucgucgccgaugcgccgcacc

SEQ ID NO: 2876916 - RNA, 16 nt, Mycobacterium avium subsp. paratuberculosis
gucgucgccgccggug

SEQ ID NO: 2876917 - RNA, 18 nt, Mycobacterium avium subsp. paratuberculosis
gucgucgccggccgcggu

SEQ ID NO: 2876918 - RNA, 14 nt, Mycobacterium avium subsp. paratuberculosis
gucgucgccggggu

SEQ ID NO: 2876919 - RNA, 14 nt, Mycobacterium avium subsp. paratuberculosis
gucgucgccggugg

SEQ ID NO: 2876920 - RNA, 15 nt, Mycobacterium avium subsp. paratuberculosis
gucgucgccgguggc

SEQ ID NO: 2876921 - RNA, 19 nt, Mycobacterium avium subsp. paratuberculosis
gucgucgccgguggccgcc

SEQ ID NO: 2876922 - RNA, 22 nt, Mycobacterium avium subsp. paratuberculosis
gucgucgccgguggccgccgga

SEQ ID NO: 2876923 - RNA, 21 nt, Mycobacterium avium subsp. paratuberculosis
gucgucgccguggcggcccga

SEQ ID NO: 2876924 - RNA, 20 nt, Mycobacterium avium subsp. paratuberculosis
gucgucgcgcaccagcucga

SEQ ID NO: 2876925 - RNA, 14 nt, Mycobacterium avium subsp. paratuberculosis
gucgucgcgcaccc

SEQ ID NO: 2876926 - RNA, 14 nt, Mycobacterium avium subsp. paratuberculosis
gucgucgcgcaggu

SEQ ID NO: 2876927 - RNA, 22 nt, Mycobacterium avium subsp. paratuberculosis
gucgucgcggccaacgcccacc

SEQ ID NO: 2876928 - RNA, 13 nt, Mycobacterium avium subsp. paratuberculosis
gucgucgcggcgc

SEQ ID NO: 2876929 - RNA, 15 nt, Mycobacterium avium subsp. paratuberculosis
gucgucgcgguccac

SEQ ID NO: 2876930 - RNA, 23 nt, Mycobacterium avium subsp. paratuberculosis
gucgucgcuccacaucugccggc

SEQ ID NO: 2876931 - RNA, 20 nt, Mycobacterium avium subsp. paratuberculosis
gucgucgcugacgccgagca

SEQ ID NO: 2876932 - RNA, 14 nt, Mycobacterium avium subsp. paratuberculosis
gucgucggacagca

SEQ ID NO: 2876933 - RNA, 19 nt, Mycobacterium avium subsp. paratuberculosis
gucgucggacagcagcacc

SEQ ID NO: 2876934 - RNA, 24 nt, Mycobacterium avium subsp. paratuberculosis
gucgucggacagcagcaccggcac

SEQ ID NO: 2876935 - RNA, 18 nt, Mycobacterium avium subsp. paratuberculosis
gucgucggagacguugcc

SEQ ID NO: 2876936 - RNA, 22 nt, Mycobacterium avium subsp. paratuberculosis
gucgucggagacguugccgcac

SEQ ID NO: 2876937 - RNA, 20 nt, Mycobacterium avium subsp. paratuberculosis
gucgucggccaguucaccgc

SEQ ID NO: 2876938 - RNA, 21 nt, Mycobacterium avium subsp. paratuberculosis
gucgucggccaguucaccgcg

SEQ ID NO: 2876939 - RNA, 13 nt, Mycobacterium avium subsp. paratuberculosis
gucgucggccggg

SEQ ID NO: 2876940 - RNA, 19 nt, Mycobacterium avium subsp. paratuberculosis
gucgucggccucggcggcc

SEQ ID NO: 2876941 - RNA, 14 nt, Mycobacterium avium subsp. paratuberculosis
gucgucggccugca

SEQ ID NO: 2876942 - RNA, 16 nt, Mycobacterium avium subsp. paratuberculosis
gucgucggccugcacg

SEQ ID NO: 2876943 - RNA, 17 nt, Mycobacterium avium subsp. paratuberculosis
gucgucggccugcacgu

SEQ ID NO: 2876944 - RNA, 16 nt, Mycobacterium avium subsp. paratuberculosis
gucgucggccuguccg

SEQ ID NO: 2876945 - RNA, 14 nt, Mycobacterium avium subsp. paratuberculosis
gucgucggcgacga

SEQ ID NO: 2876946 - RNA, 13 nt, Mycobacterium avium subsp. paratuberculosis
gucgucggcgccg

SEQ ID NO: 2876947 - RNA, 15 nt, Mycobacterium avium subsp. paratuberculosis
gucgucggcgccgcg

SEQ ID NO: 2876948 - RNA, 20 nt, Mycobacterium avium subsp. paratuberculosis
gucgucggcgccgcgccggc

SEQ ID NO: 2876949 - RNA, 14 nt, Mycobacterium avium subsp. paratuberculosis
gucgucggcgcggu

SEQ ID NO: 2876950 - RNA, 19 nt, Mycobacterium avium subsp. paratuberculosis
gucgucggcgggcugcagc

SEQ ID NO: 2876951 - RNA, 14 nt, Mycobacterium avium subsp. paratuberculosis
gucgucggcgucgg

SEQ ID NO: 2876952 - RNA, 22 nt, Mycobacterium avium subsp. paratuberculosis
gucgucgggcaccacggcggca

SEQ ID NO: 2876953 - RNA, 16 nt, Mycobacterium avium subsp. paratuberculosis
gucgucgggccgcagc

SEQ ID NO: 2876954 - RNA, 19 nt, Mycobacterium avium subsp. paratuberculosis
gucgucgggccgcagcacg

SEQ ID NO: 2876955 - RNA, 14 nt, Mycobacterium avium subsp. paratuberculosis
gucgucgggcgccg

SEQ ID NO: 2876956 - RNA, 16 nt, Mycobacterium avium subsp. paratuberculosis
gucgucgggcgccggu

SEQ ID NO: 2876957 - RNA, 13 nt, Mycobacterium avium subsp. paratuberculosis
gucgucgggcgcg

SEQ ID NO: 2876958 - RNA, 15 nt, Mycobacterium avium subsp. paratuberculosis
gucgucgggcgcggu

SEQ ID NO: 2876959 - RNA, 21 nt, Mycobacterium avium subsp. paratuberculosis
gucgucggggcaucgcagcgc

SEQ ID NO: 2876960 - RNA, 17 nt, Mycobacterium avium subsp. paratuberculosis
gucgucggggcuggcgg

SEQ ID NO: 2876961 - RNA, 18 nt, Mycobacterium avium subsp. paratuberculosis
gucgucggggcuggcggc

SEQ ID NO: 2876962 - RNA, 18 nt, Mycobacterium avium subsp. paratuberculosis
gucgucggguuggccagg

SEQ ID NO: 2876963 - RNA, 13 nt, Mycobacterium avium subsp. paratuberculosis
gucgucggucagc

SEQ ID NO: 2876964 - RNA, 17 nt, Mycobacterium avium subsp. paratuberculosis
gucgucggucagcucga

SEQ ID NO: 2876965 - RNA, 20 nt, Mycobacterium avium subsp. paratuberculosis
gucgucggucaggccggcgc

SEQ ID NO: 2876966 - RNA, 22 nt, Mycobacterium avium subsp. paratuberculosis
gucgucggucaggccggcgccg

SEQ ID NO: 2876967 - RNA, 22 nt, Mycobacterium avium subsp. paratuberculosis
gucgucggucucuucgacccgg

SEQ ID NO: 2876968 - RNA, 19 nt, Mycobacterium avium subsp. paratuberculosis
gucgucggugaacgccggu

SEQ ID NO: 2876969 - RNA, 15 nt, Mycobacterium avium subsp. paratuberculosis
gucgucggugauggu

SEQ ID NO: 2876970 - RNA, 18 nt, Mycobacterium avium subsp. paratuberculosis
gucgucggugccgaagcg

SEQ ID NO: 2876971 - RNA, 19 nt, Mycobacterium avium subsp. paratuberculosis
gucgucggugccgaagcgc

SEQ ID NO: 2876972 - RNA, 20 nt, Mycobacterium avium subsp. paratuberculosis
gucgucggugccgaagcgcc

SEQ ID NO: 2876973 - RNA, 15 nt, Mycobacterium avium subsp. paratuberculosis
gucgucggugggccg

SEQ ID NO: 2876974 - RNA, 22 nt, Mycobacterium avium subsp. paratuberculosis
gucgucggugggccgccgcggc

SEQ ID NO: 2876975 - RNA, 21 nt, Mycobacterium avium subsp. paratuberculosis
gucgucgucccaggguugccg

SEQ ID NO: 2876976 - RNA, 22 nt, Mycobacterium avium subsp. paratuberculosis
gucgucguccgcaaccgccggc

SEQ ID NO: 2876977 - RNA, 15 nt, Mycobacterium avium subsp. paratuberculosis
gucgucgucgaaggc

SEQ ID NO: 2876978 - RNA, 16 nt, Mycobacterium avium subsp. paratuberculosis
gucgucgucgaaggcc

SEQ ID NO: 2876979 - RNA, 13 nt, Mycobacterium avium subsp. paratuberculosis
gucgucgucgacc

SEQ ID NO: 2876980 - RNA, 17 nt, Mycobacterium avium subsp. paratuberculosis
gucgucgucgagcacga

SEQ ID NO: 2876981 - RNA, 16 nt, Mycobacterium avium subsp. paratuberculosis
gucgucgucgagccgc

SEQ ID NO: 2876982 - RNA, 14 nt, Mycobacterium avium subsp. paratuberculosis
gucgucgucgccgc

SEQ ID NO: 2876983 - RNA, 16 nt, Mycobacterium avium subsp. paratuberculosis
gucgucgucgccgccg

SEQ ID NO: 2876984 - RNA, 15 nt, Mycobacterium avium subsp. paratuberculosis
gucgucgucgccgcg

SEQ ID NO: 2876985 - RNA, 22 nt, Mycobacterium avium subsp. paratuberculosis
gucgucgugcaccacgacgucg

SEQ ID NO: 2876986 - RNA, 17 nt, Mycobacterium avium subsp. paratuberculosis
gucgucgugcgcgggcg

SEQ ID NO: 2876987 - RNA, 15 nt, Mycobacterium avium subsp. paratuberculosis
gucgucguggugacg

SEQ ID NO: 2876988 - RNA, 23 nt, Mycobacterium avium subsp. paratuberculosis
gucgucguggugacgggcgucgg

SEQ ID NO: 2876989 - RNA, 22 nt, Mycobacterium avium subsp. paratuberculosis
gucgucguuggcccgccgcggc

SEQ ID NO: 2876990 - RNA, 11 nt, Mycobacterium avium subsp. paratuberculosis
gucgucguugu

SEQ ID NO: 2876991 - RNA, 22 nt, Mycobacterium avium subsp. paratuberculosis
gucgucguugugggccagcgcg

SEQ ID NO: 2876992 - RNA, 21 nt, Mycobacterium avium subsp. paratuberculosis
gucgucguuguuggcggcggu

SEQ ID NO: 2876993 - RNA, 21 nt, Mycobacterium avium subsp. paratuberculosis
gucgucuucuuggccgcggcc

SEQ ID NO: 2876994 - RNA, 17 nt, Mycobacterium avium subsp. paratuberculosis
gucgugaaacauggcgc

SEQ ID NO: 2876995 - RNA, 23 nt, Mycobacterium avium subsp. paratuberculosis
gucgugaaacauggcgcccgcgu

SEQ ID NO: 2876996 - RNA, 15 nt, Mycobacterium avium subsp. paratuberculosis
gucgugacgcggcgu

SEQ ID NO: 2876997 - RNA, 21 nt, Mycobacterium avium subsp. paratuberculosis
gucgugcaacucccgcgccgc

SEQ ID NO: 2876998 - RNA, 24 nt, Mycobacterium avium subsp. paratuberculosis
gucgugcaacucccgcgccgcggc

SEQ ID NO: 2876999 - RNA, 14 nt, Mycobacterium avium subsp. paratuberculosis
gucgugcaccacga

SEQ ID NO: 2877000 - RNA, 20 nt, Mycobacterium avium subsp. paratuberculosis
gucgugcacgccguggcggc

SEQ ID NO: 2877001 - RNA, 17 nt, Mycobacterium avium subsp. paratuberculosis
gucgugcagcaccgcca

SEQ ID NO: 2877002 - RNA, 18 nt, Mycobacterium avium subsp. paratuberculosis
gucgugcagcaccgccag

SEQ ID NO: 2877003 - RNA, 15 nt, Mycobacterium avium subsp. paratuberculosis
gucgugcaucggcgc

SEQ ID NO: 2877004 - RNA, 16 nt, Mycobacterium avium subsp. paratuberculosis
gucgugcaucggcgcc

SEQ ID NO: 2877005 - RNA, 16 nt, Mycobacterium avium subsp. paratuberculosis
gucgugccgagcguga

SEQ ID NO: 2877006 - RNA, 14 nt, Mycobacterium avium subsp. paratuberculosis
gucgugcggccggc

SEQ ID NO: 2877007 - RNA, 15 nt, Mycobacterium avium subsp. paratuberculosis
gucgugcggccggcg

SEQ ID NO: 2877008 - RNA, 20 nt, Mycobacterium avium subsp. paratuberculosis
gucgugcgggaugccgagca

SEQ ID NO: 2877009 - RNA, 17 nt, Mycobacterium avium subsp. paratuberculosis
gucgugcucgucggcgg

SEQ ID NO: 2877010 - RNA, 13 nt, Mycobacterium avium subsp. paratuberculosis
gucguggcccgga

SEQ ID NO: 2877011 - RNA, 23 nt, Mycobacterium avium subsp. paratuberculosis
gucguggcccugcucgucguuga

SEQ ID NO: 2877012 - RNA, 18 nt, Mycobacterium avium subsp. paratuberculosis
gucguggggcucagccga

SEQ ID NO: 2877013 - RNA, 20 nt, Mycobacterium avium subsp. paratuberculosis
gucguggguauccgccgcca

SEQ ID NO: 2877014 - RNA, 14 nt, Mycobacterium avium subsp. paratuberculosis
gucguggucgacgc

SEQ ID NO: 2877015 - RNA, 17 nt, Mycobacterium avium subsp. paratuberculosis
gucguggucgcugcuca

SEQ ID NO: 2877016 - RNA, 14 nt, Mycobacterium avium subsp. paratuberculosis
gucguggugacggg

SEQ ID NO: 2877017 - RNA, 17 nt, Mycobacterium avium subsp. paratuberculosis
gucgugguggccgcgaa

SEQ ID NO: 2877018 - RNA, 23 nt, Mycobacterium avium subsp. paratuberculosis
gucguguccgggcccgaacaucg

SEQ ID NO: 2877019 - RNA, 15 nt, Mycobacterium avium subsp. paratuberculosis
gucguguucgccgag

SEQ ID NO: 2877020 - RNA, 17 nt, Mycobacterium avium subsp. paratuberculosis
gucguucagcugcagcc

SEQ ID NO: 2877021 - RNA, 17 nt, Mycobacterium avium subsp. paratuberculosis
gucguucaugaucggca

SEQ ID NO: 2877022 - RNA, 18 nt, Mycobacterium avium subsp. paratuberculosis
gucguucaugaucggcag

SEQ ID NO: 2877023 - RNA, 18 nt, Mycobacterium avium subsp. paratuberculosis
gucguucgauccgccggu

SEQ ID NO: 2877024 - RNA, 15 nt, Mycobacterium avium subsp. paratuberculosis
gucguucggccagca

SEQ ID NO: 2877025 - RNA, 17 nt, Mycobacterium avium subsp. paratuberculosis
gucguucggccagcacc

SEQ ID NO: 2877026 - RNA, 16 nt, Mycobacterium avium subsp. paratuberculosis
gucguucuccagcccu

SEQ ID NO: 2877027 - RNA, 22 nt, Mycobacterium avium subsp. paratuberculosis
gucguucucgggggcgggcacc

SEQ ID NO: 2877028 - RNA, 18 nt, Mycobacterium avium subsp. paratuberculosis
gucguugaacgcgcgggu

SEQ ID NO: 2877029 - RNA, 22 nt, Mycobacterium avium subsp. paratuberculosis
gucguugaacgcgcgggugcgg

SEQ ID NO: 2877030 - RNA, 17 nt, Mycobacterium avium subsp. paratuberculosis
gucguugacgcccuccu

SEQ ID NO: 2877031 - RNA, 13 nt, Mycobacterium avium subsp. paratuberculosis
gucguugacgcug

SEQ ID NO: 2877032 - RNA, 14 nt, Mycobacterium avium subsp. paratuberculosis
gucguugacgcugg

SEQ ID NO: 2877033 - RNA, 19 nt, Mycobacterium avium subsp. paratuberculosis
gucguugagcacacccagc

SEQ ID NO: 2877034 - RNA, 24 nt, Mycobacterium avium subsp. paratuberculosis
gucguugagcacacccagcgagcc

SEQ ID NO: 2877035 - RNA, 13 nt, Mycobacterium avium subsp. paratuberculosis
gucguugaucagg

SEQ ID NO: 2877036 - RNA, 14 nt, Mycobacterium avium subsp. paratuberculosis
gucguugcacacca

SEQ ID NO: 2877037 - RNA, 15 nt, Mycobacterium avium subsp. paratuberculosis
gucguugcacacccg

SEQ ID NO: 2877038 - RNA, 18 nt, Mycobacterium avium subsp. paratuberculosis
gucguugcacacccggug

SEQ ID NO: 2877039 - RNA, 20 nt, Mycobacterium avium subsp. paratuberculosis
gucguugcacacccggugcg

SEQ ID NO: 2877040 - RNA, 16 nt, Mycobacterium avium subsp. paratuberculosis
gucguugcccgccagc

SEQ ID NO: 2877041 - RNA, 20 nt, Mycobacterium avium subsp. paratuberculosis
gucguugcccgccagcaugg

SEQ ID NO: 2877042 - RNA, 22 nt, Mycobacterium avium subsp. paratuberculosis
gucguugcccugaacgucuugg

SEQ ID NO: 2877043 - RNA, 15 nt, Mycobacterium avium subsp. paratuberculosis
gucguugccggugcc

SEQ ID NO: 2877044 - RNA, 15 nt, Mycobacterium avium subsp. paratuberculosis
gucguugcgggcggc

SEQ ID NO: 2877045 - RNA, 17 nt, Mycobacterium avium subsp. paratuberculosis
gucguugcgggcggcgc

SEQ ID NO: 2877046 - RNA, 20 nt, Mycobacterium avium subsp. paratuberculosis
gucguuggcgccguccgcgg

SEQ ID NO: 2877047 - RNA, 16 nt, Mycobacterium avium subsp. paratuberculosis
gucguuggcggcggug

SEQ ID NO: 2877048 - RNA, 17 nt, Mycobacterium avium subsp. paratuberculosis
gucguuggcggcggugg

SEQ ID NO: 2877049 - RNA, 18 nt, Mycobacterium avium subsp. paratuberculosis
gucguuggcggcgguggg

SEQ ID NO: 2877050 - RNA, 12 nt, Mycobacterium avium subsp. paratuberculosis
gucguuggugaa

SEQ ID NO: 2877051 - RNA, 19 nt, Mycobacterium avium subsp. paratuberculosis
gucguuggugcgcaccagc

SEQ ID NO: 2877052 - RNA, 15 nt, Mycobacterium avium subsp. paratuberculosis
gucguuggugucgaa

SEQ ID NO: 2877053 - RNA, 14 nt, Mycobacterium avium subsp. paratuberculosis
gucguuguccagcg

SEQ ID NO: 2877054 - RNA, 19 nt, Mycobacterium avium subsp. paratuberculosis
gucguugugggccagcgcg

SEQ ID NO: 2877055 - RNA, 14 nt, Mycobacterium avium subsp. paratuberculosis
gucguuugguggug

SEQ ID NO: 2877056 - RNA, 16 nt, Mycobacterium avium subsp. paratuberculosis
gucuacuuggccagcu

SEQ ID NO: 2877057 - RNA, 18 nt, Mycobacterium avium subsp. paratuberculosis
gucuagaucuccaggcuc

SEQ ID NO: 2877058 - RNA, 22 nt, Mycobacterium avium subsp. paratuberculosis
gucuagaucuccaggcucgaca

SEQ ID NO: 2877059 - RNA, 15 nt, Mycobacterium avium subsp. paratuberculosis
gucuagccgccgagc

SEQ ID NO: 2877060 - RNA, 22 nt, Mycobacterium avium subsp. paratuberculosis
gucuagcggccuaggacgccgc

SEQ ID NO: 2877061 - RNA, 21 nt, Mycobacterium avium subsp. paratuberculosis
gucucaaucuucuccgcggcc

SEQ ID NO: 2877062 - RNA, 16 nt, Mycobacterium avium subsp. paratuberculosis
gucucagcgcccgccc

SEQ ID NO: 2877063 - RNA, 20 nt, Mycobacterium avium subsp. paratuberculosis
gucucaggaauuugcggccc

SEQ ID NO: 2877064 - RNA, 21 nt, Mycobacterium avium subsp. paratuberculosis
gucucagucggccaccgcgau

SEQ ID NO: 2877065 - RNA, 14 nt, Mycobacterium avium subsp. paratuberculosis
gucucaucccgccg

SEQ ID NO: 2877066 - RNA, 15 nt, Mycobacterium avium subsp. paratuberculosis
gucucaucccgccga

SEQ ID NO: 2877067 - RNA, 21 nt, Mycobacterium avium subsp. paratuberculosis
gucuccaugucgucggcggac

SEQ ID NO: 2877068 - RNA, 14 nt, Mycobacterium avium subsp. paratuberculosis
gucucccccgauca

SEQ ID NO: 2877069 - RNA, 18 nt, Mycobacterium avium subsp. paratuberculosis
gucucccccgaucagcgu

SEQ ID NO: 2877070 - RNA, 12 nt, Mycobacterium avium subsp. paratuberculosis
gucucccgggcg

SEQ ID NO: 2877071 - RNA, 16 nt, Mycobacterium avium subsp. paratuberculosis
gucucccgggcggucg

SEQ ID NO: 2877072 - RNA, 13 nt, Mycobacterium avium subsp. paratuberculosis
gucuccgcgcagc

SEQ ID NO: 2877073 - RNA, 23 nt, Mycobacterium avium subsp. paratuberculosis
gucuccggccccgagccgacgau

SEQ ID NO: 2877074 - RNA, 14 nt, Mycobacterium avium subsp. paratuberculosis
gucuccggcgcggu

SEQ ID NO: 2877075 - RNA, 17 nt, Mycobacterium avium subsp. paratuberculosis
gucuccggcgcgguugc

SEQ ID NO: 2877076 - RNA, 13 nt, Mycobacterium avium subsp. paratuberculosis
gucuccggcggca

SEQ ID NO: 2877077 - RNA, 19 nt, Mycobacterium avium subsp. paratuberculosis
gucuccgggcugugggcgc

SEQ ID NO: 2877078 - RNA, 19 nt, Mycobacterium avium subsp. paratuberculosis
gucuccguagcccugcagg

SEQ ID NO: 2877079 - RNA, 15 nt, Mycobacterium avium subsp. paratuberculosis
gucuccucgaccagc

SEQ ID NO: 2877080 - RNA, 21 nt, Mycobacterium avium subsp. paratuberculosis
gucuccucgaccagcgcgccg

SEQ ID NO: 2877081 - RNA, 15 nt, Mycobacterium avium subsp. paratuberculosis
gucuccucgaccgcc

SEQ ID NO: 2877082 - RNA, 16 nt, Mycobacterium avium subsp. paratuberculosis
gucuccuggccgccgu

SEQ ID NO: 2877083 - RNA, 22 nt, Mycobacterium avium subsp. paratuberculosis
gucucgaacacgccgucguggg

SEQ ID NO: 2877084 - RNA, 15 nt, Mycobacterium avium subsp. paratuberculosis
gucucgaaccgggcg

SEQ ID NO: 2877085 - RNA, 16 nt, Mycobacterium avium subsp. paratuberculosis
gucucgaaccgggcgg

SEQ ID NO: 2877086 - RNA, 19 nt, Mycobacterium avium subsp. paratuberculosis
gucucgaaccgggcgguga

SEQ ID NO: 2877087 - RNA, 20 nt, Mycobacterium avium subsp. paratuberculosis
gucucgaaccgucuagcggc

SEQ ID NO: 2877088 - RNA, 15 nt, Mycobacterium avium subsp. paratuberculosis
gucucgacaccggcg

SEQ ID NO: 2877089 - RNA, 17 nt, Mycobacterium avium subsp. paratuberculosis
gucucgacaccggcggu

SEQ ID NO: 2877090 - RNA, 18 nt, Mycobacterium avium subsp. paratuberculosis
gucucgacaccggcgguc

SEQ ID NO: 2877091 - RNA, 19 nt, Mycobacterium avium subsp. paratuberculosis
gucucgaccacccggcggg

SEQ ID NO: 2877092 - RNA, 20 nt, Mycobacterium avium subsp. paratuberculosis
gucucgaccacccggcgggc

SEQ ID NO: 2877093 - RNA, 23 nt, Mycobacterium avium subsp. paratuberculosis
gucucgaccacccggcgggccag

SEQ ID NO: 2877094 - RNA, 14 nt, Mycobacterium avium subsp. paratuberculosis
gucucgacccgggc

SEQ ID NO: 2877095 - RNA, 19 nt, Mycobacterium avium subsp. paratuberculosis
gucucgaccgcggcgccga

SEQ ID NO: 2877096 - RNA, 12 nt, Mycobacterium avium subsp. paratuberculosis
gucucgacggcg

SEQ ID NO: 2877097 - RNA, 14 nt, Mycobacterium avium subsp. paratuberculosis
gucucgacggcgcc

SEQ ID NO: 2877098 - RNA, 15 nt, Mycobacterium avium subsp. paratuberculosis
gucucgacggcgccg

SEQ ID NO: 2877099 - RNA, 16 nt, Mycobacterium avium subsp. paratuberculosis
gucucgacggcgccga

SEQ ID NO: 2877100 - RNA, 15 nt, Mycobacterium avium subsp. paratuberculosis
gucucgagccggcgc

SEQ ID NO: 2877101 - RNA, 19 nt, Mycobacterium avium subsp. paratuberculosis
gucucgagccggcgcacuc

SEQ ID NO: 2877102 - RNA, 15 nt, Mycobacterium avium subsp. paratuberculosis
gucucgaucgacgac

SEQ ID NO: 2877103 - RNA, 16 nt, Mycobacterium avium subsp. paratuberculosis
gucucgaucugcacca

SEQ ID NO: 2877104 - RNA, 20 nt, Mycobacterium avium subsp. paratuberculosis
gucucgaugcacggucggcc

SEQ ID NO: 2877105 - RNA, 15 nt, Mycobacterium avium subsp. paratuberculosis
gucucgcaccugccg

SEQ ID NO: 2877106 - RNA, 12 nt, Mycobacterium avium subsp. paratuberculosis
gucucgcccacc

SEQ ID NO: 2877107 - RNA, 16 nt, Mycobacterium avium subsp. paratuberculosis
gucucgcccaccuugg

SEQ ID NO: 2877108 - RNA, 22 nt, Mycobacterium avium subsp. paratuberculosis
gucucgcccaccuuggcgucga

SEQ ID NO: 2877109 - RNA, 16 nt, Mycobacterium avium subsp. paratuberculosis
gucucgcgcagcacga

SEQ ID NO: 2877110 - RNA, 19 nt, Mycobacterium avium subsp. paratuberculosis
gucucggaccgguaggcgc

SEQ ID NO: 2877111 - RNA, 22 nt, Mycobacterium avium subsp. paratuberculosis
gucucggaccgguaggcgcacc

SEQ ID NO: 2877112 - RNA, 24 nt, Mycobacterium avium subsp. paratuberculosis
gucucggaccgguaggcgcaccgc

SEQ ID NO: 2877113 - RNA, 16 nt, Mycobacterium avium subsp. paratuberculosis
gucucggagcgguguc

SEQ ID NO: 2877114 - RNA, 15 nt, Mycobacterium avium subsp. paratuberculosis
gucucggccagccgg

SEQ ID NO: 2877115 - RNA, 16 nt, Mycobacterium avium subsp. paratuberculosis
gucucggccagccggu

SEQ ID NO: 2877116 - RNA, 18 nt, Mycobacterium avium subsp. paratuberculosis
gucucggccgcggugcgu

SEQ ID NO: 2877117 - RNA, 19 nt, Mycobacterium avium subsp. paratuberculosis
gucucggcgccgucgccgg

SEQ ID NO: 2877118 - RNA, 13 nt, Mycobacterium avium subsp. paratuberculosis
gucucggcggccg

SEQ ID NO: 2877119 - RNA, 14 nt, Mycobacterium avium subsp. paratuberculosis
gucucggcggccga

SEQ ID NO: 2877120 - RNA, 21 nt, Mycobacterium avium subsp. paratuberculosis
gucucggcggccgagcgcacc

SEQ ID NO: 2877121 - RNA, 14 nt, Mycobacterium avium subsp. paratuberculosis
gucucggcggcgcc

SEQ ID NO: 2877122 - RNA, 17 nt, Mycobacterium avium subsp. paratuberculosis
gucucggcggcgcccag

SEQ ID NO: 2877123 - RNA, 12 nt, Mycobacterium avium subsp. paratuberculosis
gucucggcgucu

SEQ ID NO: 2877124 - RNA, 21 nt, Mycobacterium avium subsp. paratuberculosis
gucucggcgucucggcgucuc

SEQ ID NO: 2877125 - RNA, 20 nt, Mycobacterium avium subsp. paratuberculosis
gucucgggcaccacgccgac

SEQ ID NO: 2877126 - RNA, 18 nt, Mycobacterium avium subsp. paratuberculosis
gucucgggcagcagcacc

SEQ ID NO: 2877127 - RNA, 16 nt, Mycobacterium avium subsp. paratuberculosis
gucucggucgcggcgu

SEQ ID NO: 2877128 - RNA, 17 nt, Mycobacterium avium subsp. paratuberculosis
gucucgguggagaacca

SEQ ID NO: 2877129 - RNA, 20 nt, Mycobacterium avium subsp. paratuberculosis
gucucggugucggacuuguc

SEQ ID NO: 2877130 - RNA, 15 nt, Mycobacterium avium subsp. paratuberculosis
gucucgucggccgcg

SEQ ID NO: 2877131 - RNA, 21 nt, Mycobacterium avium subsp. paratuberculosis
gucucgucggccgcgacgacc

SEQ ID NO: 2877132 - RNA, 15 nt, Mycobacterium avium subsp. paratuberculosis
gucucguugugcacc

SEQ ID NO: 2877133 - RNA, 20 nt, Mycobacterium avium subsp. paratuberculosis
gucucguugugcaccggcac

SEQ ID NO: 2877134 - RNA, 22 nt, Mycobacterium avium subsp. paratuberculosis
gucucuggccugauugacggcc

SEQ ID NO: 2877135 - RNA, 19 nt, Mycobacterium avium subsp. paratuberculosis
gucugaaaugccgggccgg

SEQ ID NO: 2877136 - RNA, 13 nt, Mycobacterium avium subsp. paratuberculosis
gucugaccccccg

SEQ ID NO: 2877137 - RNA, 18 nt, Mycobacterium avium subsp. paratuberculosis
gucugaccccccgacgcc

SEQ ID NO: 2877138 - RNA, 20 nt, Mycobacterium avium subsp. paratuberculosis
gucugaccccccgacgccga

SEQ ID NO: 2877139 - RNA, 21 nt, Mycobacterium avium subsp. paratuberculosis
gucugaccccccgacgccgac

SEQ ID NO: 2877140 - RNA, 14 nt, Mycobacterium avium subsp. paratuberculosis
gucugaccucgcgc

SEQ ID NO: 2877141 - RNA, 17 nt, Mycobacterium avium subsp. paratuberculosis
gucugaccucgcgccgc

SEQ ID NO: 2877142 - RNA, 21 nt, Mycobacterium avium subsp. paratuberculosis
gucugaccucgcgccgcgauc

SEQ ID NO: 2877143 - RNA, 14 nt, Mycobacterium avium subsp. paratuberculosis
gucugagcccgggc

SEQ ID NO: 2877144 - RNA, 18 nt, Mycobacterium avium subsp. paratuberculosis
gucugagcccgggcaggc

SEQ ID NO: 2877145 - RNA, 15 nt, Mycobacterium avium subsp. paratuberculosis
gucugaucgcccagc

SEQ ID NO: 2877146 - RNA, 16 nt, Mycobacterium avium subsp. paratuberculosis
gucugaucgcccagca

SEQ ID NO: 2877147 - RNA, 18 nt, Mycobacterium avium subsp. paratuberculosis
gucugaucgcccagcacc

SEQ ID NO: 2877148 - RNA, 21 nt, Mycobacterium avium subsp. paratuberculosis
gucugaucgcccagcaccgcg

SEQ ID NO: 2877149 - RNA, 17 nt, Mycobacterium avium subsp. paratuberculosis
gucugcacgaugccgac

SEQ ID NO: 2877150 - RNA, 21 nt, Mycobacterium avium subsp. paratuberculosis
gucugcagcagccgcugcugg

SEQ ID NO: 2877151 - RNA, 16 nt, Mycobacterium avium subsp. paratuberculosis
gucugcaggucguagu

SEQ ID NO: 2877152 - RNA, 20 nt, Mycobacterium avium subsp. paratuberculosis
gucugcauccggaaccgggc

SEQ ID NO: 2877153 - RNA, 15 nt, Mycobacterium avium subsp. paratuberculosis
gucugccacgcccac

SEQ ID NO: 2877154 - RNA, 16 nt, Mycobacterium avium subsp. paratuberculosis
gucugccacgcccacc

SEQ ID NO: 2877155 - RNA, 18 nt, Mycobacterium avium subsp. paratuberculosis
gucugccagaacggcggc

SEQ ID NO: 2877156 - RNA, 12 nt, Mycobacterium avium subsp. paratuberculosis
gucugcccgccg

SEQ ID NO: 2877157 - RNA, 19 nt, Mycobacterium avium subsp. paratuberculosis
gucugcccgccgccgaugc

SEQ ID NO: 2877158 - RNA, 22 nt, Mycobacterium avium subsp. paratuberculosis
gucugcccgccgccgaugcuga

SEQ ID NO: 2877159 - RNA, 13 nt, Mycobacterium avium subsp. paratuberculosis
gucugccuggcga

SEQ ID NO: 2877160 - RNA, 15 nt, Mycobacterium avium subsp. paratuberculosis
gucugcgccagcucc

SEQ ID NO: 2877161 - RNA, 22 nt, Mycobacterium avium subsp. paratuberculosis
gucugcgccagcuccagcagcc

SEQ ID NO: 2877162 - RNA, 22 nt, Mycobacterium avium subsp. paratuberculosis
gucugcgccagcugggugguca

SEQ ID NO: 2877163 - RNA, 15 nt, Mycobacterium avium subsp. paratuberculosis
gucugcgcccgaucg

SEQ ID NO: 2877164 - RNA, 21 nt, Mycobacterium avium subsp. paratuberculosis
gucugcgcccgaucggcguga

SEQ ID NO: 2877165 - RNA, 14 nt, Mycobacterium avium subsp. paratuberculosis
gucugcgccggcgg

SEQ ID NO: 2877166 - RNA, 14 nt, Mycobacterium avium subsp. paratuberculosis
gucugcgccucgau

SEQ ID NO: 2877167 - RNA, 16 nt, Mycobacterium avium subsp. paratuberculosis
gucugcgccucgauca

SEQ ID NO: 2877168 - RNA, 22 nt, Mycobacterium avium subsp. paratuberculosis
gucugcgcgagcagaucgcgga

SEQ ID NO: 2877169 - RNA, 14 nt, Mycobacterium avium subsp. paratuberculosis
gucugcggccgcga

SEQ ID NO: 2877170 - RNA, 15 nt, Mycobacterium avium subsp. paratuberculosis
gucugcggccgcgac

SEQ ID NO: 2877171 - RNA, 15 nt, Mycobacterium avium subsp. paratuberculosis
gucugcggccggggc

SEQ ID NO: 2877172 - RNA, 17 nt, Mycobacterium avium subsp. paratuberculosis
gucugcggccggggcag

SEQ ID NO: 2877173 - RNA, 21 nt, Mycobacterium avium subsp. paratuberculosis
gucugcgggaagcccaccgcg

SEQ ID NO: 2877174 - RNA, 16 nt, Mycobacterium avium subsp. paratuberculosis
gucugcggugcgccca

SEQ ID NO: 2877175 - RNA, 19 nt, Mycobacterium avium subsp. paratuberculosis
gucugcucccaggacggcg

SEQ ID NO: 2877176 - RNA, 21 nt, Mycobacterium avium subsp. paratuberculosis
gucugcuccccguugaucuug

SEQ ID NO: 2877177 - RNA, 13 nt, Mycobacterium avium subsp. paratuberculosis
gucugcucgccag

SEQ ID NO: 2877178 - RNA, 22 nt, Mycobacterium avium subsp. paratuberculosis
gucugcucgccagacucacggc

SEQ ID NO: 2877179 - RNA, 14 nt, Mycobacterium avium subsp. paratuberculosis
gucugcucgccggc

SEQ ID NO: 2877180 - RNA, 15 nt, Mycobacterium avium subsp. paratuberculosis
gucugcucgccggcu

SEQ ID NO: 2877181 - RNA, 14 nt, Mycobacterium avium subsp. paratuberculosis
gucugcucgccguc

SEQ ID NO: 2877182 - RNA, 15 nt, Mycobacterium avium subsp. paratuberculosis
gucugcucgccguca

SEQ ID NO: 2877183 - RNA, 12 nt, Mycobacterium avium subsp. paratuberculosis
gucugcucgcgc

SEQ ID NO: 2877184 - RNA, 14 nt, Mycobacterium avium subsp. paratuberculosis
gucugcucggcggc

SEQ ID NO: 2877185 - RNA, 15 nt, Mycobacterium avium subsp. paratuberculosis
gucugcucggcggcu

SEQ ID NO: 2877186 - RNA, 13 nt, Mycobacterium avium subsp. paratuberculosis
gucugcuggcccg

SEQ ID NO: 2877187 - RNA, 23 nt, Mycobacterium avium subsp. paratuberculosis
gucugcuuugccuuagcccggcc

SEQ ID NO: 2877188 - RNA, 13 nt, Mycobacterium avium subsp. paratuberculosis
gucuggcagccgg

SEQ ID NO: 2877189 - RNA, 22 nt, Mycobacterium avium subsp. paratuberculosis
gucuggcagccggccggcaggu

SEQ ID NO: 2877190 - RNA, 19 nt, Mycobacterium avium subsp. paratuberculosis
gucuggccaccgaagccga

SEQ ID NO: 2877191 - RNA, 11 nt, Mycobacterium avium subsp. paratuberculosis
gucuggccccg

SEQ ID NO: 2877192 - RNA, 13 nt, Mycobacterium avium subsp. paratuberculosis
gucuggccccguc

SEQ ID NO: 2877193 - RNA, 16 nt, Mycobacterium avium subsp. paratuberculosis
gucuggccccgucguc

SEQ ID NO: 2877194 - RNA, 21 nt, Mycobacterium avium subsp. paratuberculosis
gucuggcggguguucagcccc

SEQ ID NO: 2877195 - RNA, 19 nt, Mycobacterium avium subsp. paratuberculosis
gucuggcucggcaccagag

SEQ ID NO: 2877196 - RNA, 14 nt, Mycobacterium avium subsp. paratuberculosis
gucugggaggcggc

SEQ ID NO: 2877197 - RNA, 17 nt, Mycobacterium avium subsp. paratuberculosis
gucugggccgccgagca

SEQ ID NO: 2877198 - RNA, 22 nt, Mycobacterium avium subsp. paratuberculosis
gucugggccgccgagcagauca

SEQ ID NO: 2877199 - RNA, 20 nt, Mycobacterium avium subsp. paratuberculosis
gucugguuggccggcggguu

SEQ ID NO: 2877200 - RNA, 17 nt, Mycobacterium avium subsp. paratuberculosis
gucugucgcgcgaacag

SEQ ID NO: 2877201 - RNA, 21 nt, Mycobacterium avium subsp. paratuberculosis
gucugugaccacggucacagc

SEQ ID NO: 2877202 - RNA, 21 nt, Mycobacterium avium subsp. paratuberculosis
gucuuaucuaucuucggcggg

SEQ ID NO: 2877203 - RNA, 18 nt, Mycobacterium avium subsp. paratuberculosis
gucuucagcccgcgcaug

SEQ ID NO: 2877204 - RNA, 13 nt, Mycobacterium avium subsp. paratuberculosis
gucuucgaccgca

SEQ ID NO: 2877205 - RNA, 12 nt, Mycobacterium avium subsp. paratuberculosis
gucuucgcgguc

SEQ ID NO: 2877206 - RNA, 21 nt, Mycobacterium avium subsp. paratuberculosis
gucuucggggauguagccgcc

SEQ ID NO: 2877207 - RNA, 14 nt, Mycobacterium avium subsp. paratuberculosis
gucuucggggccgc

SEQ ID NO: 2877208 - RNA, 17 nt, Mycobacterium avium subsp. paratuberculosis
gucuucggggccgccgu

SEQ ID NO: 2877209 - RNA, 20 nt, Mycobacterium avium subsp. paratuberculosis
gucuucggggccgccgucgg

SEQ ID NO: 2877210 - RNA, 14 nt, Mycobacterium avium subsp. paratuberculosis
gucuucggucgcga

SEQ ID NO: 2877211 - RNA, 19 nt, Mycobacterium avium subsp. paratuberculosis
gucuucggugucgcacagc

SEQ ID NO: 2877212 - RNA, 17 nt, Mycobacterium avium subsp. paratuberculosis
gucuucucggccaggcu

SEQ ID NO: 2877213 - RNA, 15 nt, Mycobacterium avium subsp. paratuberculosis
gucuucuuggccgcg

SEQ ID NO: 2877214 - RNA, 17 nt, Mycobacterium avium subsp. paratuberculosis
gucuucuuggccgcgcc

SEQ ID NO: 2877215 - RNA, 21 nt, Mycobacterium avium subsp. paratuberculosis
gucuucuuggccgcgccgccg

SEQ ID NO: 2877216 - RNA, 18 nt, Mycobacterium avium subsp. paratuberculosis
gucuugacgaacuccugc

SEQ ID NO: 2877217 - RNA, 20 nt, Mycobacterium avium subsp. paratuberculosis
gucuugaggaugacggggug

SEQ ID NO: 2877218 - RNA, 19 nt, Mycobacterium avium subsp. paratuberculosis
gucuugaucaggucgccga

SEQ ID NO: 2877219 - RNA, 18 nt, Mycobacterium avium subsp. paratuberculosis
gucuugaucucggcggcg

SEQ ID NO: 2877220 - RNA, 20 nt, Mycobacterium avium subsp. paratuberculosis
gucuugccggcuuccucgcg

SEQ ID NO: 2877221 - RNA, 12 nt, Mycobacterium avium subsp. paratuberculosis
gucuugcggccg

SEQ ID NO: 2877222 - RNA, 15 nt, Mycobacterium avium subsp. paratuberculosis
gucuugcggccguca

SEQ ID NO: 2877223 - RNA, 14 nt, Mycobacterium avium subsp. paratuberculosis
gucuugcugggugg

SEQ ID NO: 2877224 - RNA, 16 nt, Mycobacterium avium subsp. paratuberculosis
gucuuggccaggcccu

SEQ ID NO: 2877225 - RNA, 10 nt, Mycobacterium avium subsp. paratuberculosis
gucuuggccu

SEQ ID NO: 2877226 - RNA, 12 nt, Mycobacterium avium subsp. paratuberculosis
gucuuggcggcc

SEQ ID NO: 2877227 - RNA, 17 nt, Mycobacterium avium subsp. paratuberculosis
gucuuggucucgccgau

SEQ ID NO: 2877228 - RNA, 20 nt, Mycobacterium avium subsp. paratuberculosis
gucuuguagucgaccacccg

SEQ ID NO: 2877229 - RNA, 22 nt, Mycobacterium avium subsp. paratuberculosis
gucuugucggggaagggcgcgu

SEQ ID NO: 2877230 - RNA, 15 nt, Mycobacterium avium subsp. paratuberculosis
gucuuguugaccuuc

SEQ ID NO: 2877231 - RNA, 17 nt, Mycobacterium avium subsp. paratuberculosis
gucuuguuggucagccu

SEQ ID NO: 2877232 - RNA, 22 nt, Mycobacterium avium subsp. paratuberculosis
gugaaacacaaacucgcccaau

SEQ ID NO: 2877233 - RNA, 12 nt, Mycobacterium avium subsp. paratuberculosis
gugaaaccggcg

SEQ ID NO: 2877234 - RNA, 21 nt, Mycobacterium avium subsp. paratuberculosis
gugaaacuaacuucacgcucg

SEQ ID NO: 2877235 - RNA, 21 nt, Mycobacterium avium subsp. paratuberculosis
gugaaacuagcuucacgcucg

SEQ ID NO: 2877236 - RNA, 15 nt, Mycobacterium avium subsp. paratuberculosis
gugaacaccccgcgg

SEQ ID NO: 2877237 - RNA, 17 nt, Mycobacterium avium subsp. paratuberculosis
gugaacaccccgcggga

SEQ ID NO: 2877238 - RNA, 12 nt, Mycobacterium avium subsp. paratuberculosis
gugaacagcagc

SEQ ID NO: 2877239 - RNA, 15 nt, Mycobacterium avium subsp. paratuberculosis
gugaacagcgcccgg

SEQ ID NO: 2877240 - RNA, 21 nt, Mycobacterium avium subsp. paratuberculosis
gugaacagguaggcggcgccg

SEQ ID NO: 2877241 - RNA, 13 nt, Mycobacterium avium subsp. paratuberculosis
gugaacgaggccg

SEQ ID NO: 2877242 - RNA, 16 nt, Mycobacterium avium subsp. paratuberculosis
gugaacgaggccgcgc

SEQ ID NO: 2877243 - RNA, 18 nt, Mycobacterium avium subsp. paratuberculosis
gugaacgaggccgcgccg

SEQ ID NO: 2877244 - RNA, 11 nt, Mycobacterium avium subsp. paratuberculosis
gugaacgccgg

SEQ ID NO: 2877245 - RNA, 13 nt, Mycobacterium avium subsp. paratuberculosis
gugaacgccggug

SEQ ID NO: 2877246 - RNA, 13 nt, Mycobacterium avium subsp. paratuberculosis
gugaacgccucgg

SEQ ID NO: 2877247 - RNA, 19 nt, Mycobacterium avium subsp. paratuberculosis
gugaacgccucgggccggc

SEQ ID NO: 2877248 - RNA, 13 nt, Mycobacterium avium subsp. paratuberculosis
gugaacgcgucgg

SEQ ID NO: 2877249 - RNA, 14 nt, Mycobacterium avium subsp. paratuberculosis
gugaacgcgucggu

SEQ ID NO: 2877250 - RNA, 19 nt, Mycobacterium avium subsp. paratuberculosis
gugaacgggucaauugcca

SEQ ID NO: 2877251 - RNA, 18 nt, Mycobacterium avium subsp. paratuberculosis
gugaacuccgggcccacc

SEQ ID NO: 2877252 - RNA, 16 nt, Mycobacterium avium subsp. paratuberculosis
gugaacuccgucucgc

SEQ ID NO: 2877253 - RNA, 14 nt, Mycobacterium avium subsp. paratuberculosis
gugaacucgccgau

SEQ ID NO: 2877254 - RNA, 21 nt, Mycobacterium avium subsp. paratuberculosis
gugaacuuaacuucacgcucg

SEQ ID NO: 2877255 - RNA, 23 nt, Mycobacterium avium subsp. paratuberculosis
gugaacuuaacuucacgcucggc

SEQ ID NO: 2877256 - RNA, 18 nt, Mycobacterium avium subsp. paratuberculosis
gugaagaucagcgcgucg

SEQ ID NO: 2877257 - RNA, 18 nt, Mycobacterium avium subsp. paratuberculosis
gugaagaucgcccgccgc

SEQ ID NO: 2877258 - RNA, 19 nt, Mycobacterium avium subsp. paratuberculosis
gugaagcccagcgcguuga

SEQ ID NO: 2877259 - RNA, 14 nt, Mycobacterium avium subsp. paratuberculosis
gugaagccgguggg

SEQ ID NO: 2877260 - RNA, 16 nt, Mycobacterium avium subsp. paratuberculosis
gugaagccguugucga

SEQ ID NO: 2877261 - RNA, 23 nt, Mycobacterium avium subsp. paratuberculosis
gugaagcggcgcgggucgcgguu

SEQ ID NO: 2877262 - RNA, 15 nt, Mycobacterium avium subsp. paratuberculosis
gugaagcuaguuuca

SEQ ID NO: 2877263 - RNA, 16 nt, Mycobacterium avium subsp. paratuberculosis
gugaagcuaguuucac

SEQ ID NO: 2877264 - RNA, 20 nt, Mycobacterium avium subsp. paratuberculosis
gugaagcugccgaccaggaa

SEQ ID NO: 2877265 - RNA, 14 nt, Mycobacterium avium subsp. paratuberculosis
gugaaggcggccac

SEQ ID NO: 2877266 - RNA, 15 nt, Mycobacterium avium subsp. paratuberculosis
gugaagggcccgccg

SEQ ID NO: 2877267 - RNA, 18 nt, Mycobacterium avium subsp. paratuberculosis
gugaagggcccgccggug

SEQ ID NO: 2877268 - RNA, 12 nt, Mycobacterium avium subsp. paratuberculosis
gugaaggggucc

SEQ ID NO: 2877269 - RNA, 15 nt, Mycobacterium avium subsp. paratuberculosis
gugaaggugcccucc

SEQ ID NO: 2877270 - RNA, 18 nt, Mycobacterium avium subsp. paratuberculosis
gugaaggugcccuccucg

SEQ ID NO: 2877271 - RNA, 22 nt, Mycobacterium avium subsp. paratuberculosis
gugaaggugcccuccucgccgg

SEQ ID NO: 2877272 - RNA, 22 nt, Mycobacterium avium subsp. paratuberculosis
gugaagucaacgcacucauggg

SEQ ID NO: 2877273 - RNA, 21 nt, Mycobacterium avium subsp. paratuberculosis
gugaaguccaugaacggcagc

SEQ ID NO: 2877274 - RNA, 22 nt, Mycobacterium avium subsp. paratuberculosis
gugaagucggugcccagcgcga

SEQ ID NO: 2877275 - RNA, 19 nt, Mycobacterium avium subsp. paratuberculosis
gugaagucguccagcgucg

SEQ ID NO: 2877276 - RNA, 15 nt, Mycobacterium avium subsp. paratuberculosis
gugaagugccggucc

SEQ ID NO: 2877277 - RNA, 15 nt, Mycobacterium avium subsp. paratuberculosis
gugaaguuaguuuca

SEQ ID NO: 2877278 - RNA, 19 nt, Mycobacterium avium subsp. paratuberculosis
gugaaguucuccagcacga

SEQ ID NO: 2877279 - RNA, 16 nt, Mycobacterium avium subsp. paratuberculosis
gugaaguugccgguca

SEQ ID NO: 2877280 - RNA, 21 nt, Mycobacterium avium subsp. paratuberculosis
gugaauaccacugcgcgcccg

SEQ ID NO: 2877281 - RNA, 14 nt, Mycobacterium avium subsp. paratuberculosis
gugaauccagccgu

SEQ ID NO: 2877282 - RNA, 18 nt, Mycobacterium avium subsp. paratuberculosis
gugaauccagccgugcgg

SEQ ID NO: 2877283 - RNA, 17 nt, Mycobacterium avium subsp. paratuberculosis
gugaauccucagcacgg

SEQ ID NO: 2877284 - RNA, 20 nt, Mycobacterium avium subsp. paratuberculosis
gugaaugggcugcgcgucga

SEQ ID NO: 2877285 - RNA, 21 nt, Mycobacterium avium subsp. paratuberculosis
gugaauggguguaacgcgucg

SEQ ID NO: 2877286 - RNA, 22 nt, Mycobacterium avium subsp. paratuberculosis
gugaauggguguaacgcgucga

SEQ ID NO: 2877287 - RNA, 20 nt, Mycobacterium avium subsp. paratuberculosis
gugaaugucguagcggucgg

SEQ ID NO: 2877288 - RNA, 14 nt, Mycobacterium avium subsp. paratuberculosis
gugaauucaucguc

SEQ ID NO: 2877289 - RNA, 18 nt, Mycobacterium avium subsp. paratuberculosis
gugacaaagaucacagcg

SEQ ID NO: 2877290 - RNA, 15 nt, Mycobacterium avium subsp. paratuberculosis
gugacaacgguggug

SEQ ID NO: 2877291 - RNA, 17 nt, Mycobacterium avium subsp. paratuberculosis
gugacaagccggcgucg

SEQ ID NO: 2877292 - RNA, 18 nt, Mycobacterium avium subsp. paratuberculosis
gugacaagccggcgucga

SEQ ID NO: 2877293 - RNA, 19 nt, Mycobacterium avium subsp. paratuberculosis
gugacacucggucaccggu

SEQ ID NO: 2877294 - RNA, 20 nt, Mycobacterium avium subsp. paratuberculosis
gugacacucggucaccggug

SEQ ID NO: 2877295 - RNA, 13 nt, Mycobacterium avium subsp. paratuberculosis
gugacaggggcag

SEQ ID NO: 2877296 - RNA, 15 nt, Mycobacterium avium subsp. paratuberculosis
gugacaggggcagca

SEQ ID NO: 2877297 - RNA, 16 nt, Mycobacterium avium subsp. paratuberculosis
gugacaggggcagcag

SEQ ID NO: 2877298 - RNA, 18 nt, Mycobacterium avium subsp. paratuberculosis
gugacaggggcagcagca

SEQ ID NO: 2877299 - RNA, 14 nt, Mycobacterium avium subsp. paratuberculosis
gugacaucgccacc

SEQ ID NO: 2877300 - RNA, 15 nt, Mycobacterium avium subsp. paratuberculosis
gugacaugcccgggc

SEQ ID NO: 2877301 - RNA, 16 nt, Mycobacterium avium subsp. paratuberculosis
gugacaugcccgggcu

SEQ ID NO: 2877302 - RNA, 23 nt, Mycobacterium avium subsp. paratuberculosis
gugacaugcccgggcucgcacuc

SEQ ID NO: 2877303 - RNA, 15 nt, Mycobacterium avium subsp. paratuberculosis
gugaccaaugcggug

SEQ ID NO: 2877304 - RNA, 16 nt, Mycobacterium avium subsp. paratuberculosis
gugaccaaugcgguga

SEQ ID NO: 2877305 - RNA, 14 nt, Mycobacterium avium subsp. paratuberculosis
gugaccacgccgug

SEQ ID NO: 2877306 - RNA, 16 nt, Mycobacterium avium subsp. paratuberculosis
gugaccacgccgugcc

SEQ ID NO: 2877307 - RNA, 12 nt, Mycobacterium avium subsp. paratuberculosis
gugaccacgcug

SEQ ID NO: 2877308 - RNA, 19 nt, Mycobacterium avium subsp. paratuberculosis
gugaccacgcugagcaacc

SEQ ID NO: 2877309 - RNA, 17 nt, Mycobacterium avium subsp. paratuberculosis
gugaccacggucacagc

SEQ ID NO: 2877310 - RNA, 14 nt, Mycobacterium avium subsp. paratuberculosis
gugaccacggucgg

SEQ ID NO: 2877311 - RNA, 20 nt, Mycobacterium avium subsp. paratuberculosis
gugaccagaaucuucgccuc

SEQ ID NO: 2877312 - RNA, 21 nt, Mycobacterium avium subsp. paratuberculosis
gugaccagccacauguucucc

SEQ ID NO: 2877313 - RNA, 13 nt, Mycobacterium avium subsp. paratuberculosis
gugaccagcgccc

SEQ ID NO: 2877314 - RNA, 13 nt, Mycobacterium avium subsp. paratuberculosis
gugaccagcguga

SEQ ID NO: 2877315 - RNA, 15 nt, Mycobacterium avium subsp. paratuberculosis
gugaccagcgugacg

SEQ ID NO: 2877316 - RNA, 16 nt, Mycobacterium avium subsp. paratuberculosis
gugaccaggcuugccc

SEQ ID NO: 2877317 - RNA, 17 nt, Mycobacterium avium subsp. paratuberculosis
gugaccagugcagagcg

SEQ ID NO: 2877318 - RNA, 19 nt, Mycobacterium avium subsp. paratuberculosis
gugaccaucgggucgucgg

SEQ ID NO: 2877319 - RNA, 21 nt, Mycobacterium avium subsp. paratuberculosis
gugaccaucgggucgucggcg

SEQ ID NO: 2877320 - RNA, 13 nt, Mycobacterium avium subsp. paratuberculosis
gugaccccggcga

SEQ ID NO: 2877321 - RNA, 14 nt, Mycobacterium avium subsp. paratuberculosis
gugaccccggcgac

SEQ ID NO: 2877322 - RNA, 19 nt, Mycobacterium avium subsp. paratuberculosis
gugaccccguugcacaggc

SEQ ID NO: 2877323 - RNA, 19 nt, Mycobacterium avium subsp. paratuberculosis
gugacccgccgugaccggc

SEQ ID NO: 2877324 - RNA, 15 nt, Mycobacterium avium subsp. paratuberculosis
gugacccgcucgggc

SEQ ID NO: 2877325 - RNA, 23 nt, Mycobacterium avium subsp. paratuberculosis
gugacccggaccgggugaccggc

SEQ ID NO: 2877326 - RNA, 13 nt, Mycobacterium avium subsp. paratuberculosis
gugacccggccgu

SEQ ID NO: 2877327 - RNA, 18 nt, Mycobacterium avium subsp. paratuberculosis
gugacccugccgucaccg

SEQ ID NO: 2877328 - RNA, 22 nt, Mycobacterium avium subsp. paratuberculosis
gugacccugccgucaccggcca

SEQ ID NO: 2877329 - RNA, 19 nt, Mycobacterium avium subsp. paratuberculosis
gugaccgacgacgugacga

SEQ ID NO: 2877330 - RNA, 23 nt, Mycobacterium avium subsp. paratuberculosis
gugaccgaggccgcccgcuccug

SEQ ID NO: 2877331 - RNA, 16 nt, Mycobacterium avium subsp. paratuberculosis
gugaccgagucgucgc

SEQ ID NO: 2877332 - RNA, 20 nt, Mycobacterium avium subsp. paratuberculosis
gugaccgagucgucgcgcac

SEQ ID NO: 2877333 - RNA, 21 nt, Mycobacterium avium subsp. paratuberculosis
gugaccgagucgucgcgcacc

SEQ ID NO: 2877334 - RNA, 22 nt, Mycobacterium avium subsp. paratuberculosis
gugaccgagucgucgcgcacca

SEQ ID NO: 2877335 - RNA, 15 nt, Mycobacterium avium subsp. paratuberculosis
gugaccgccagcacc

SEQ ID NO: 2877336 - RNA, 16 nt, Mycobacterium avium subsp. paratuberculosis
gugaccgccagcaccg

SEQ ID NO: 2877337 - RNA, 19 nt, Mycobacterium avium subsp. paratuberculosis
gugaccgccagcaccgcgg

SEQ ID NO: 2877338 - RNA, 22 nt, Mycobacterium avium subsp. paratuberculosis
gugaccgcccgcucgacggccg

SEQ ID NO: 2877339 - RNA, 20 nt, Mycobacterium avium subsp. paratuberculosis
gugaccgccgccauccgcgc

SEQ ID NO: 2877340 - RNA, 22 nt, Mycobacterium avium subsp. paratuberculosis
gugaccgccgccauccgcgccg

SEQ ID NO: 2877341 - RNA, 18 nt, Mycobacterium avium subsp. paratuberculosis
gugaccgccuuggcgcgc

SEQ ID NO: 2877342 - RNA, 16 nt, Mycobacterium avium subsp. paratuberculosis
gugaccgcgacgcugc

SEQ ID NO: 2877343 - RNA, 13 nt, Mycobacterium avium subsp. paratuberculosis
gugaccgcgccgc

SEQ ID NO: 2877344 - RNA, 16 nt, Mycobacterium avium subsp. paratuberculosis
gugaccgcgccgcggg

SEQ ID NO: 2877345 - RNA, 14 nt, Mycobacterium avium subsp. paratuberculosis
gugaccgcgccggu

SEQ ID NO: 2877346 - RNA, 19 nt, Mycobacterium avium subsp. paratuberculosis
gugaccgcggccucgucga

SEQ ID NO: 2877347 - RNA, 17 nt, Mycobacterium avium subsp. paratuberculosis
gugaccggaucggccag

SEQ ID NO: 2877348 - RNA, 23 nt, Mycobacterium avium subsp. paratuberculosis
gugaccggaucggccagcagguc

SEQ ID NO: 2877349 - RNA, 13 nt, Mycobacterium avium subsp. paratuberculosis
gugaccggcgccg

SEQ ID NO: 2877350 - RNA, 15 nt, Mycobacterium avium subsp. paratuberculosis
gugaccggcgccggg

SEQ ID NO: 2877351 - RNA, 18 nt, Mycobacterium avium subsp. paratuberculosis
gugaccggcgccgggucg

SEQ ID NO: 2877352 - RNA, 12 nt, Mycobacterium avium subsp. paratuberculosis
gugaccggcgcg

SEQ ID NO: 2877353 - RNA, 13 nt, Mycobacterium avium subsp. paratuberculosis
gugaccggcgcgc

SEQ ID NO: 2877354 - RNA, 13 nt, Mycobacterium avium subsp. paratuberculosis
gugaccggcggcc

SEQ ID NO: 2877355 - RNA, 21 nt, Mycobacterium avium subsp. paratuberculosis
gugaccggcggccagcgagga

SEQ ID NO: 2877356 - RNA, 14 nt, Mycobacterium avium subsp. paratuberculosis
gugaccggcggugu

SEQ ID NO: 2877357 - RNA, 21 nt, Mycobacterium avium subsp. paratuberculosis
gugaccggcggugucggugcc

SEQ ID NO: 2877358 - RNA, 17 nt, Mycobacterium avium subsp. paratuberculosis
gugaccggcucgagcag

SEQ ID NO: 2877359 - RNA, 14 nt, Mycobacterium avium subsp. paratuberculosis
gugaccggcugcuc

SEQ ID NO: 2877360 - RNA, 23 nt, Mycobacterium avium subsp. paratuberculosis
gugaccggggucggcgcccucgg

SEQ ID NO: 2877361 - RNA, 17 nt, Mycobacterium avium subsp. paratuberculosis
gugaccguacucguggg

SEQ ID NO: 2877362 - RNA, 20 nt, Mycobacterium avium subsp. paratuberculosis
gugaccgucacccccggcgc

SEQ ID NO: 2877363 - RNA, 21 nt, Mycobacterium avium subsp. paratuberculosis
gugaccgucacccccggcgcg

SEQ ID NO: 2877364 - RNA, 14 nt, Mycobacterium avium subsp. paratuberculosis
gugaccgucgccga

SEQ ID NO: 2877365 - RNA, 15 nt, Mycobacterium avium subsp. paratuberculosis
gugaccgucgccgac

SEQ ID NO: 2877366 - RNA, 16 nt, Mycobacterium avium subsp. paratuberculosis
gugaccgucgccgacc

SEQ ID NO: 2877367 - RNA, 17 nt, Mycobacterium avium subsp. paratuberculosis
gugaccgucgccgacca

SEQ ID NO: 2877368 - RNA, 15 nt, Mycobacterium avium subsp. paratuberculosis
gugaccucgaagaug

SEQ ID NO: 2877369 - RNA, 14 nt, Mycobacterium avium subsp. paratuberculosis
gugaccucgagcag

SEQ ID NO: 2877370 - RNA, 16 nt, Mycobacterium avium subsp. paratuberculosis
gugaccucgagcagcg

SEQ ID NO: 2877371 - RNA, 17 nt, Mycobacterium avium subsp. paratuberculosis
gugaccucgagcagcgc

SEQ ID NO: 2877372 - RNA, 18 nt, Mycobacterium avium subsp. paratuberculosis
gugaccucgagcagcgcg

SEQ ID NO: 2877373 - RNA, 22 nt, Mycobacterium avium subsp. paratuberculosis
gugaccucgagcagcgcgcgcu

SEQ ID NO: 2877374 - RNA, 23 nt, Mycobacterium avium subsp. paratuberculosis
gugaccucgagcagcgcgcgcuu

SEQ ID NO: 2877375 - RNA, 18 nt, Mycobacterium avium subsp. paratuberculosis
gugaccucgucgggcgcc

SEQ ID NO: 2877376 - RNA, 22 nt, Mycobacterium avium subsp. paratuberculosis
gugaccucgucgggcgccagcc

SEQ ID NO: 2877377 - RNA, 13 nt, Mycobacterium avium subsp. paratuberculosis
gugaccugcagcg

SEQ ID NO: 2877378 - RNA, 16 nt, Mycobacterium avium subsp. paratuberculosis
gugaccugcagcgccu

SEQ ID NO: 2877379 - RNA, 16 nt, Mycobacterium avium subsp. paratuberculosis
gugaccuugcgggcgg

SEQ ID NO: 2877380 - RNA, 19 nt, Mycobacterium avium subsp. paratuberculosis
gugaccuugcgggcgguca

SEQ ID NO: 2877381 - RNA, 18 nt, Mycobacterium avium subsp. paratuberculosis
gugacgaacaucgacgac

SEQ ID NO: 2877382 - RNA, 19 nt, Mycobacterium avium subsp. paratuberculosis
gugacgaacccgccgcggc

SEQ ID NO: 2877383 - RNA, 23 nt, Mycobacterium avium subsp. paratuberculosis
gugacgaacccgccgcggccgaa

SEQ ID NO: 2877384 - RNA, 18 nt, Mycobacterium avium subsp. paratuberculosis
gugacgaacucaagggcg

SEQ ID NO: 2877385 - RNA, 13 nt, Mycobacterium avium subsp. paratuberculosis
gugacgaccggca

SEQ ID NO: 2877386 - RNA, 13 nt, Mycobacterium avium subsp. paratuberculosis
gugacgaccuggu

SEQ ID NO: 2877387 - RNA, 22 nt, Mycobacterium avium subsp. paratuberculosis
gugacgaccuggucgccgccgu

SEQ ID NO: 2877388 - RNA, 21 nt, Mycobacterium avium subsp. paratuberculosis
gugacgaggcccacgaaccgg

SEQ ID NO: 2877389 - RNA, 18 nt, Mycobacterium avium subsp. paratuberculosis
gugacgauccacagcgcg

SEQ ID NO: 2877390 - RNA, 19 nt, Mycobacterium avium subsp. paratuberculosis
gugacgauccggucgauga

SEQ ID NO: 2877391 - RNA, 22 nt, Mycobacterium avium subsp. paratuberculosis
gugacgaucuggcgcaucagcg

SEQ ID NO: 2877392 - RNA, 17 nt, Mycobacterium avium subsp. paratuberculosis
gugacgaugacgauggu

SEQ ID NO: 2877393 - RNA, 21 nt, Mycobacterium avium subsp. paratuberculosis
gugacgaugaugucggccggc

SEQ ID NO: 2877394 - RNA, 16 nt, Mycobacterium avium subsp. paratuberculosis
gugacgcccggcgccg

SEQ ID NO: 2877395 - RNA, 20 nt, Mycobacterium avium subsp. paratuberculosis
gugacgcccggcgccggcgg

SEQ ID NO: 2877396 - RNA, 13 nt, Mycobacterium avium subsp. paratuberculosis
gugacgcccgucc

SEQ ID NO: 2877397 - RNA, 14 nt, Mycobacterium avium subsp. paratuberculosis
gugacgccgacgua

SEQ ID NO: 2877398 - RNA, 13 nt, Mycobacterium avium subsp. paratuberculosis
gugacgccgcacg

SEQ ID NO: 2877399 - RNA, 18 nt, Mycobacterium avium subsp. paratuberculosis
gugacgccgcucggccag

SEQ ID NO: 2877400 - RNA, 22 nt, Mycobacterium avium subsp. paratuberculosis
gugacgccgcuguccucgucgg

SEQ ID NO: 2877401 - RNA, 13 nt, Mycobacterium avium subsp. paratuberculosis
gugacgccgggcc

SEQ ID NO: 2877402 - RNA, 23 nt, Mycobacterium avium subsp. paratuberculosis
gugacgccgggccgccgcggcca

SEQ ID NO: 2877403 - RNA, 13 nt, Mycobacterium avium subsp. paratuberculosis
gugacgccugcgg

SEQ ID NO: 2877404 - RNA, 15 nt, Mycobacterium avium subsp. paratuberculosis
gugacgccugcggcc

SEQ ID NO: 2877405 - RNA, 16 nt, Mycobacterium avium subsp. paratuberculosis
gugacgccugcggccc

SEQ ID NO: 2877406 - RNA, 19 nt, Mycobacterium avium subsp. paratuberculosis
gugacgccugcggcccagc

SEQ ID NO: 2877407 - RNA, 22 nt, Mycobacterium avium subsp. paratuberculosis
gugacgccugcggcccagcgua

SEQ ID NO: 2877408 - RNA, 22 nt, Mycobacterium avium subsp. paratuberculosis
gugacgcgaagucgccgcccgg

SEQ ID NO: 2877409 - RNA, 14 nt, Mycobacterium avium subsp. paratuberculosis
gugacgcgccggcc

SEQ ID NO: 2877410 - RNA, 14 nt, Mycobacterium avium subsp. paratuberculosis
gugacgcggcgucg

SEQ ID NO: 2877411 - RNA, 16 nt, Mycobacterium avium subsp. paratuberculosis
gugacgcggcgucggg

SEQ ID NO: 2877412 - RNA, 14 nt, Mycobacterium avium subsp. paratuberculosis
gugacgcgggaccg

SEQ ID NO: 2877413 - RNA, 18 nt, Mycobacterium avium subsp. paratuberculosis
gugacgcgggaccgggcc

SEQ ID NO: 2877414 - RNA, 18 nt, Mycobacterium avium subsp. paratuberculosis
gugacgcucacccggccc

SEQ ID NO: 2877415 - RNA, 17 nt, Mycobacterium avium subsp. paratuberculosis
gugacgcucgacggccg

SEQ ID NO: 2877416 - RNA, 19 nt, Mycobacterium avium subsp. paratuberculosis
gugacgcucgacggccggc

SEQ ID NO: 2877417 - RNA, 22 nt, Mycobacterium avium subsp. paratuberculosis
gugacgcucgacggccggcguc

SEQ ID NO: 2877418 - RNA, 13 nt, Mycobacterium avium subsp. paratuberculosis
gugacgcucgcgg

SEQ ID NO: 2877419 - RNA, 14 nt, Mycobacterium avium subsp. paratuberculosis
gugacgcucgcgug

SEQ ID NO: 2877420 - RNA, 23 nt, Mycobacterium avium subsp. paratuberculosis
gugacgcucgcguggccugggcg

SEQ ID NO: 2877421 - RNA, 14 nt, Mycobacterium avium subsp. paratuberculosis
gugacgcucggccu

SEQ ID NO: 2877422 - RNA, 16 nt, Mycobacterium avium subsp. paratuberculosis
gugacgcucggccuca

SEQ ID NO: 2877423 - RNA, 23 nt, Mycobacterium avium subsp. paratuberculosis
gugacgcucggccucaggcgucg

SEQ ID NO: 2877424 - RNA, 19 nt, Mycobacterium avium subsp. paratuberculosis
gugacgcucggcgccgcgg

SEQ ID NO: 2877425 - RNA, 23 nt, Mycobacterium avium subsp. paratuberculosis
gugacgcucgggcuucggcguca

SEQ ID NO: 2877426 - RNA, 17 nt, Mycobacterium avium subsp. paratuberculosis
gugacgcugaccugugc

SEQ ID NO: 2877427 - RNA, 20 nt, Mycobacterium avium subsp. paratuberculosis
gugacggaguuggaucgccg

SEQ ID NO: 2877428 - RNA, 23 nt, Mycobacterium avium subsp. paratuberculosis
gugacggaguuggaucgccgcaa

SEQ ID NO: 2877429 - RNA, 21 nt, Mycobacterium avium subsp. paratuberculosis
gugacggauguggucggccac

SEQ ID NO: 2877430 - RNA, 15 nt, Mycobacterium avium subsp. paratuberculosis
gugacggcaucggcg

SEQ ID NO: 2877431 - RNA, 16 nt, Mycobacterium avium subsp. paratuberculosis
gugacggcaucggcgc

SEQ ID NO: 2877432 - RNA, 19 nt, Mycobacterium avium subsp. paratuberculosis
gugacggcaucggcgcccu

SEQ ID NO: 2877433 - RNA, 14 nt, Mycobacterium avium subsp. paratuberculosis
gugacggccgcggc

SEQ ID NO: 2877434 - RNA, 15 nt, Mycobacterium avium subsp. paratuberculosis
gugacggccgcggcg

SEQ ID NO: 2877435 - RNA, 16 nt, Mycobacterium avium subsp. paratuberculosis
gugacggccgcggcgc

SEQ ID NO: 2877436 - RNA, 18 nt, Mycobacterium avium subsp. paratuberculosis
gugacggccgcggcgcgg

SEQ ID NO: 2877437 - RNA, 23 nt, Mycobacterium avium subsp. paratuberculosis
gugacggccgcggcgcggcccgg

SEQ ID NO: 2877438 - RNA, 14 nt, Mycobacterium avium subsp. paratuberculosis
gugacggccgugau

SEQ ID NO: 2877439 - RNA, 20 nt, Mycobacterium avium subsp. paratuberculosis
gugacggccgugaugccggg

SEQ ID NO: 2877440 - RNA, 22 nt, Mycobacterium avium subsp. paratuberculosis
gugacggccgugaugccgggca

SEQ ID NO: 2877441 - RNA, 13 nt, Mycobacterium avium subsp. paratuberculosis
gugacggccuccc

SEQ ID NO: 2877442 - RNA, 15 nt, Mycobacterium avium subsp. paratuberculosis
gugacggcggggcgg

SEQ ID NO: 2877443 - RNA, 12 nt, Mycobacterium avium subsp. paratuberculosis
gugacggcgucg

SEQ ID NO: 2877444 - RNA, 16 nt, Mycobacterium avium subsp. paratuberculosis
gugacggcgucggcga

SEQ ID NO: 2877445 - RNA, 16 nt, Mycobacterium avium subsp. paratuberculosis
gugacggguuggucgg

SEQ ID NO: 2877446 - RNA, 19 nt, Mycobacterium avium subsp. paratuberculosis
gugacggguuggucggcgc

SEQ ID NO: 2877447 - RNA, 21 nt, Mycobacterium avium subsp. paratuberculosis
gugacggguuggucggcgcgg

SEQ ID NO: 2877448 - RNA, 19 nt, Mycobacterium avium subsp. paratuberculosis
gugacggucacggugacgg

SEQ ID NO: 2877449 - RNA, 13 nt, Mycobacterium avium subsp. paratuberculosis
gugacggucaggg

SEQ ID NO: 2877450 - RNA, 16 nt, Mycobacterium avium subsp. paratuberculosis
gugacggucaugccga

SEQ ID NO: 2877451 - RNA, 18 nt, Mycobacterium avium subsp. paratuberculosis
gugacggucgaccucgag

SEQ ID NO: 2877452 - RNA, 22 nt, Mycobacterium avium subsp. paratuberculosis
gugacgguggcguccucgacgg

SEQ ID NO: 2877453 - RNA, 17 nt, Mycobacterium avium subsp. paratuberculosis
gugacguaagugucgug

SEQ ID NO: 2877454 - RNA, 16 nt, Mycobacterium avium subsp. paratuberculosis
gugacguacgggcuga

SEQ ID NO: 2877455 - RNA, 13 nt, Mycobacterium avium subsp. paratuberculosis
gugacgucgccga

SEQ ID NO: 2877456 - RNA, 15 nt, Mycobacterium avium subsp. paratuberculosis
gugacgucgcgccgc

SEQ ID NO: 2877457 - RNA, 19 nt, Mycobacterium avium subsp. paratuberculosis
gugacgucgcgccgcucgg

SEQ ID NO: 2877458 - RNA, 24 nt, Mycobacterium avium subsp. paratuberculosis
gugacgucgcgccgcucggccagc

SEQ ID NO: 2877459 - RNA, 13 nt, Mycobacterium avium subsp. paratuberculosis
gugacgucgcgcg

SEQ ID NO: 2877460 - RNA, 14 nt, Mycobacterium avium subsp. paratuberculosis
gugacgucgcgcgg

SEQ ID NO: 2877461 - RNA, 15 nt, Mycobacterium avium subsp. paratuberculosis
gugacgucgcgcggg

SEQ ID NO: 2877462 - RNA, 16 nt, Mycobacterium avium subsp. paratuberculosis
gugacgugcaccugca

SEQ ID NO: 2877463 - RNA, 12 nt, Mycobacterium avium subsp. paratuberculosis
gugacgugcccc

SEQ ID NO: 2877464 - RNA, 23 nt, Mycobacterium avium subsp. paratuberculosis
gugacguggcggccgucgcgcac

SEQ ID NO: 2877465 - RNA, 14 nt, Mycobacterium avium subsp. paratuberculosis
gugacguucggcca

SEQ ID NO: 2877466 - RNA, 20 nt, Mycobacterium avium subsp. paratuberculosis
gugacuccuccucggccagc

SEQ ID NO: 2877467 - RNA, 19 nt, Mycobacterium avium subsp. paratuberculosis
gugagaaaagcgaccagcg

SEQ ID NO: 2877468 - RNA, 21 nt, Mycobacterium avium subsp. paratuberculosis
gugagaaaagcgaccagcgcg

SEQ ID NO: 2877469 - RNA, 22 nt, Mycobacterium avium subsp. paratuberculosis
gugagaaaagcgaccagcgcgc

SEQ ID NO: 2877470 - RNA, 20 nt, Mycobacterium avium subsp. paratuberculosis
gugagacggccagcagcacc

SEQ ID NO: 2877471 - RNA, 23 nt, Mycobacterium avium subsp. paratuberculosis
gugagcaacagcgcuucgcgcug

SEQ ID NO: 2877472 - RNA, 15 nt, Mycobacterium avium subsp. paratuberculosis
gugagcaacgccagc

SEQ ID NO: 2877473 - RNA, 15 nt, Mycobacterium avium subsp. paratuberculosis
gugagcaccgccguc

SEQ ID NO: 2877474 - RNA, 16 nt, Mycobacterium avium subsp. paratuberculosis
gugagcaccgccgucc

SEQ ID NO: 2877475 - RNA, 21 nt, Mycobacterium avium subsp. paratuberculosis
gugagcaccggaucgaccaac

SEQ ID NO: 2877476 - RNA, 12 nt, Mycobacterium avium subsp. paratuberculosis
gugagcaccguu

SEQ ID NO: 2877477 - RNA, 20 nt, Mycobacterium avium subsp. paratuberculosis
gugagcacgaccgccagcag

SEQ ID NO: 2877478 - RNA, 15 nt, Mycobacterium avium subsp. paratuberculosis
gugagcagcaugccg

SEQ ID NO: 2877479 - RNA, 13 nt, Mycobacterium avium subsp. paratuberculosis
gugagcagcucgg

SEQ ID NO: 2877480 - RNA, 19 nt, Mycobacterium avium subsp. paratuberculosis
gugagcagggccagcggca

SEQ ID NO: 2877481 - RNA, 16 nt, Mycobacterium avium subsp. paratuberculosis
gugagcaucgggcgca

SEQ ID NO: 2877482 - RNA, 22 nt, Mycobacterium avium subsp. paratuberculosis
gugagcccgaugcuggccaucg

SEQ ID NO: 2877483 - RNA, 16 nt, Mycobacterium avium subsp. paratuberculosis
gugagccgccacagcg

SEQ ID NO: 2877484 - RNA, 20 nt, Mycobacterium avium subsp. paratuberculosis
gugagccgccacagcgccuc

SEQ ID NO: 2877485 - RNA, 12 nt, Mycobacterium avium subsp. paratuberculosis
gugagccggucg

SEQ ID NO: 2877486 - RNA, 20 nt, Mycobacterium avium subsp. paratuberculosis
gugagccggucgaacgccag

SEQ ID NO: 2877487 - RNA, 19 nt, Mycobacterium avium subsp. paratuberculosis
gugagccucagggcgcgcu

SEQ ID NO: 2877488 - RNA, 21 nt, Mycobacterium avium subsp. paratuberculosis
gugagccucagggcgcgcugu

SEQ ID NO: 2877489 - RNA, 22 nt, Mycobacterium avium subsp. paratuberculosis
gugagcgacaccaggucgaggu

SEQ ID NO: 2877490 - RNA, 13 nt, Mycobacterium avium subsp. paratuberculosis
gugagcgccaccc

SEQ ID NO: 2877491 - RNA, 14 nt, Mycobacterium avium subsp. paratuberculosis
gugagcgcgccggc

SEQ ID NO: 2877492 - RNA, 19 nt, Mycobacterium avium subsp. paratuberculosis
gugagcgcgccggcccgau

SEQ ID NO: 2877493 - RNA, 12 nt, Mycobacterium avium subsp. paratuberculosis
gugagcgcgucg

SEQ ID NO: 2877494 - RNA, 23 nt, Mycobacterium avium subsp. paratuberculosis
gugagcggccgcagcgcaucgcc

SEQ ID NO: 2877495 - RNA, 19 nt, Mycobacterium avium subsp. paratuberculosis
gugagcgggaacgcgucga

SEQ ID NO: 2877496 - RNA, 14 nt, Mycobacterium avium subsp. paratuberculosis
gugagcugaucgcg

SEQ ID NO: 2877497 - RNA, 17 nt, Mycobacterium avium subsp. paratuberculosis
gugagcuggccgcgcag

SEQ ID NO: 2877498 - RNA, 18 nt, Mycobacterium avium subsp. paratuberculosis
gugaggacgaggcgagua

SEQ ID NO: 2877499 - RNA, 16 nt, Mycobacterium avium subsp. paratuberculosis
gugaggacgcccggcg

SEQ ID NO: 2877500 - RNA, 20 nt, Mycobacterium avium subsp. paratuberculosis
gugaggacgcccggcgagug

SEQ ID NO: 2877501 - RNA, 19 nt, Mycobacterium avium subsp. paratuberculosis
gugaggcacccgcugcacc

SEQ ID NO: 2877502 - RNA, 20 nt, Mycobacterium avium subsp. paratuberculosis
gugaggcacccgcugcacca

SEQ ID NO: 2877503 - RNA, 15 nt, Mycobacterium avium subsp. paratuberculosis
gugaggccagcaccc

SEQ ID NO: 2877504 - RNA, 15 nt, Mycobacterium avium subsp. paratuberculosis
gugaggccaggcguu

SEQ ID NO: 2877505 - RNA, 12 nt, Mycobacterium avium subsp. paratuberculosis
gugaggcccggc

SEQ ID NO: 2877506 - RNA, 13 nt, Mycobacterium avium subsp. paratuberculosis
gugaggcccggcg

SEQ ID NO: 2877507 - RNA, 14 nt, Mycobacterium avium subsp. paratuberculosis
gugaggcccggcgu

SEQ ID NO: 2877508 - RNA, 15 nt, Mycobacterium avium subsp. paratuberculosis
gugaggccgaggcga

SEQ ID NO: 2877509 - RNA, 22 nt, Mycobacterium avium subsp. paratuberculosis
gugaggccgaggcgagugagga

SEQ ID NO: 2877510 - RNA, 13 nt, Mycobacterium avium subsp. paratuberculosis
gugaggcgcgccg

SEQ ID NO: 2877511 - RNA, 15 nt, Mycobacterium avium subsp. paratuberculosis
gugaggcgcgccggu

SEQ ID NO: 2877512 - RNA, 19 nt, Mycobacterium avium subsp. paratuberculosis
gugaggcguuggcccgcac

SEQ ID NO: 2877513 - RNA, 15 nt, Mycobacterium avium subsp. paratuberculosis
gugagggaacgccga

SEQ ID NO: 2877514 - RNA, 14 nt, Mycobacterium avium subsp. paratuberculosis
gugagggaccucca

SEQ ID NO: 2877515 - RNA, 22 nt, Mycobacterium avium subsp. paratuberculosis
gugaggggauccagcggcggcc

SEQ ID NO: 2877516 - RNA, 15 nt, Mycobacterium avium subsp. paratuberculosis
gugaggggcgcgcgc

SEQ ID NO: 2877517 - RNA, 23 nt, Mycobacterium avium subsp. paratuberculosis
gugagguggcguagucgucgauc

SEQ ID NO: 2877518 - RNA, 16 nt, Mycobacterium avium subsp. paratuberculosis
gugagguggcugggcg

SEQ ID NO: 2877519 - RNA, 16 nt, Mycobacterium avium subsp. paratuberculosis
gugaguucgucggcga

SEQ ID NO: 2877520 - RNA, 19 nt, Mycobacterium avium subsp. paratuberculosis
gugaguucgucggcgaucg

SEQ ID NO: 2877521 - RNA, 19 nt, Mycobacterium avium subsp. paratuberculosis
gugauacaggagggccagg

SEQ ID NO: 2877522 - RNA, 22 nt, Mycobacterium avium subsp. paratuberculosis
gugauacaggagggccagggcu

SEQ ID NO: 2877523 - RNA, 20 nt, Mycobacterium avium subsp. paratuberculosis
gugauaccggcccagcgcgg

SEQ ID NO: 2877524 - RNA, 21 nt, Mycobacterium avium subsp. paratuberculosis
gugauagaucaucccggccac

SEQ ID NO: 2877525 - RNA, 23 nt, Mycobacterium avium subsp. paratuberculosis
gugauagaucaucccggccaccc

SEQ ID NO: 2877526 - RNA, 17 nt, Mycobacterium avium subsp. paratuberculosis
gugauagcggcguaccg

SEQ ID NO: 2877527 - RNA, 22 nt, Mycobacterium avium subsp. paratuberculosis
gugauaggccucguggaacacc

SEQ ID NO: 2877528 - RNA, 21 nt, Mycobacterium avium subsp. paratuberculosis
gugauaggggcagaccaggac

SEQ ID NO: 2877529 - RNA, 17 nt, Mycobacterium avium subsp. paratuberculosis
gugauaguggucgucgu

SEQ ID NO: 2877530 - RNA, 21 nt, Mycobacterium avium subsp. paratuberculosis
gugauaucccuugccgccgaa

SEQ ID NO: 2877531 - RNA, 21 nt, Mycobacterium avium subsp. paratuberculosis
gugaucaacgcggacacggcc

SEQ ID NO: 2877532 - RNA, 21 nt, Mycobacterium avium subsp. paratuberculosis
gugaucaccaugaucagcgcc

SEQ ID NO: 2877533 - RNA, 16 nt, Mycobacterium avium subsp. paratuberculosis
gugaucacccagccgu

SEQ ID NO: 2877534 - RNA, 15 nt, Mycobacterium avium subsp. paratuberculosis
gugaucacccgccgg

SEQ ID NO: 2877535 - RNA, 13 nt, Mycobacterium avium subsp. paratuberculosis
gugaucagcagca

SEQ ID NO: 2877536 - RNA, 17 nt, Mycobacterium avium subsp. paratuberculosis
gugaucagcagcagguc

SEQ ID NO: 2877537 - RNA, 19 nt, Mycobacterium avium subsp. paratuberculosis
gugaucagcagcagguccu

SEQ ID NO: 2877538 - RNA, 16 nt, Mycobacterium avium subsp. paratuberculosis
gugaucaggcccucgu

SEQ ID NO: 2877539 - RNA, 19 nt, Mycobacterium avium subsp. paratuberculosis
gugaucaggcccucgucgg

SEQ ID NO: 2877540 - RNA, 20 nt, Mycobacterium avium subsp. paratuberculosis
gugaucaggcccucgucggc

SEQ ID NO: 2877541 - RNA, 22 nt, Mycobacterium avium subsp. paratuberculosis
gugaucaggcccucgucggcga

SEQ ID NO: 2877542 - RNA, 21 nt, Mycobacterium avium subsp. paratuberculosis
gugaucagggucccggucagc

SEQ ID NO: 2877543 - RNA, 13 nt, Mycobacterium avium subsp. paratuberculosis
gugauccacgcgg

SEQ ID NO: 2877544 - RNA, 17 nt, Mycobacterium avium subsp. paratuberculosis
gugauccacuccagcac

SEQ ID NO: 2877545 - RNA, 23 nt, Mycobacterium avium subsp. paratuberculosis
gugauccagcccugcucggccag

SEQ ID NO: 2877546 - RNA, 18 nt, Mycobacterium avium subsp. paratuberculosis
gugaucccaggaacgcgc

SEQ ID NO: 2877547 - RNA, 17 nt, Mycobacterium avium subsp. paratuberculosis
gugaucccgaugccgcg

SEQ ID NO: 2877548 - RNA, 22 nt, Mycobacterium avium subsp. paratuberculosis
gugaucccgaugccgcgcaggc

SEQ ID NO: 2877549 - RNA, 13 nt, Mycobacterium avium subsp. paratuberculosis
gugauccgcccgg

SEQ ID NO: 2877550 - RNA, 17 nt, Mycobacterium avium subsp. paratuberculosis
gugauccgcccggcccg

SEQ ID NO: 2877551 - RNA, 18 nt, Mycobacterium avium subsp. paratuberculosis
gugauccggaaugcggug

SEQ ID NO: 2877552 - RNA, 15 nt, Mycobacterium avium subsp. paratuberculosis
gugauccggugccac

SEQ ID NO: 2877553 - RNA, 19 nt, Mycobacterium avium subsp. paratuberculosis
gugauccggugccacgcgg

SEQ ID NO: 2877554 - RNA, 21 nt, Mycobacterium avium subsp. paratuberculosis
gugauccucgucuccggcggc

SEQ ID NO: 2877555 - RNA, 13 nt, Mycobacterium avium subsp. paratuberculosis
gugaucgccacca

SEQ ID NO: 2877556 - RNA, 14 nt, Mycobacterium avium subsp. paratuberculosis
gugaucgccaccac

SEQ ID NO: 2877557 - RNA, 16 nt, Mycobacterium avium subsp. paratuberculosis
gugaucgccaccacca

SEQ ID NO: 2877558 - RNA, 15 nt, Mycobacterium avium subsp. paratuberculosis
gugaucgccacggcg

SEQ ID NO: 2877559 - RNA, 22 nt, Mycobacterium avium subsp. paratuberculosis
gugaucgccacggcggugucgg

SEQ ID NO: 2877560 - RNA, 13 nt, Mycobacterium avium subsp. paratuberculosis
gugaucgccagcc

SEQ ID NO: 2877561 - RNA, 20 nt, Mycobacterium avium subsp. paratuberculosis
gugaucgccagcccggcgua

SEQ ID NO: 2877562 - RNA, 12 nt, Mycobacterium avium subsp. paratuberculosis
gugaucgccgac

SEQ ID NO: 2877563 - RNA, 15 nt, Mycobacterium avium subsp. paratuberculosis
gugaucgccgacguc

SEQ ID NO: 2877564 - RNA, 19 nt, Mycobacterium avium subsp. paratuberculosis
gugaucgccucgaccaggc

SEQ ID NO: 2877565 - RNA, 20 nt, Mycobacterium avium subsp. paratuberculosis
gugaucgcgaacgcgccggu

SEQ ID NO: 2877566 - RNA, 21 nt, Mycobacterium avium subsp. paratuberculosis
gugaucgcgaacgcgccggug

SEQ ID NO: 2877567 - RNA, 22 nt, Mycobacterium avium subsp. paratuberculosis
gugaucgcgaacgcgccgguga

SEQ ID NO: 2877568 - RNA, 20 nt, Mycobacterium avium subsp. paratuberculosis
gugaucgcggcccgcggggc

SEQ ID NO: 2877569 - RNA, 16 nt, Mycobacterium avium subsp. paratuberculosis
gugaucgcggcgcugc

SEQ ID NO: 2877570 - RNA, 13 nt, Mycobacterium avium subsp. paratuberculosis
gugaucgcggcgg

SEQ ID NO: 2877571 - RNA, 16 nt, Mycobacterium avium subsp. paratuberculosis
gugaucgcgguggccg

SEQ ID NO: 2877572 - RNA, 15 nt, Mycobacterium avium subsp. paratuberculosis
gugaucgcgguggcu

SEQ ID NO: 2877573 - RNA, 13 nt, Mycobacterium avium subsp. paratuberculosis
gugaucgcgucaa

SEQ ID NO: 2877574 - RNA, 22 nt, Mycobacterium avium subsp. paratuberculosis
gugaucgcgucaaccaccggca

SEQ ID NO: 2877575 - RNA, 18 nt, Mycobacterium avium subsp. paratuberculosis
gugaucgcugacgccguu

SEQ ID NO: 2877576 - RNA, 14 nt, Mycobacterium avium subsp. paratuberculosis
gugaucggccagcc

SEQ ID NO: 2877577 - RNA, 14 nt, Mycobacterium avium subsp. paratuberculosis
gugaucggccaggc

SEQ ID NO: 2877578 - RNA, 23 nt, Mycobacterium avium subsp. paratuberculosis
gugaucggccaggcgcccagcac

SEQ ID NO: 2877579 - RNA, 20 nt, Mycobacterium avium subsp. paratuberculosis
gugaucggcggccaccagcc

SEQ ID NO: 2877580 - RNA, 16 nt, Mycobacterium avium subsp. paratuberculosis
gugaucggcggccugc

SEQ ID NO: 2877581 - RNA, 18 nt, Mycobacterium avium subsp. paratuberculosis
gugaucggcggccugcgg

SEQ ID NO: 2877582 - RNA, 21 nt, Mycobacterium avium subsp. paratuberculosis
gugaucggcggccugcggcgg

SEQ ID NO: 2877583 - RNA, 17 nt, Mycobacterium avium subsp. paratuberculosis
gugaucggucugccugg

SEQ ID NO: 2877584 - RNA, 17 nt, Mycobacterium avium subsp. paratuberculosis
gugaucucaccggcggc

SEQ ID NO: 2877585 - RNA, 19 nt, Mycobacterium avium subsp. paratuberculosis
gugaucucaccggcggcgg

SEQ ID NO: 2877586 - RNA, 20 nt, Mycobacterium avium subsp. paratuberculosis
gugaucucaccggcggcggc

SEQ ID NO: 2877587 - RNA, 22 nt, Mycobacterium avium subsp. paratuberculosis
gugaucucaccggcggcggccu

SEQ ID NO: 2877588 - RNA, 16 nt, Mycobacterium avium subsp. paratuberculosis
gugaucucccgugcgg

SEQ ID NO: 2877589 - RNA, 21 nt, Mycobacterium avium subsp. paratuberculosis
gugaucucccgugcgguccac

SEQ ID NO: 2877590 - RNA, 21 nt, Mycobacterium avium subsp. paratuberculosis
gugaucucgccgagcacaccg

SEQ ID NO: 2877591 - RNA, 15 nt, Mycobacterium avium subsp. paratuberculosis
gugaucucgccgcgg

SEQ ID NO: 2877592 - RNA, 18 nt, Mycobacterium avium subsp. paratuberculosis
gugaucucgccgcggugg

SEQ ID NO: 2877593 - RNA, 21 nt, Mycobacterium avium subsp. paratuberculosis
gugaucucgucggcggcggcc

SEQ ID NO: 2877594 - RNA, 17 nt, Mycobacterium avium subsp. paratuberculosis
gugaucucgugccgcac

SEQ ID NO: 2877595 - RNA, 23 nt, Mycobacterium avium subsp. paratuberculosis
gugaucucgugccgcacccgauc

SEQ ID NO: 2877596 - RNA, 16 nt, Mycobacterium avium subsp. paratuberculosis
gugaucugcaccagcg

SEQ ID NO: 2877597 - RNA, 17 nt, Mycobacterium avium subsp. paratuberculosis
gugaucuggucggccag

SEQ ID NO: 2877598 - RNA, 18 nt, Mycobacterium avium subsp. paratuberculosis
gugaucuggucggccagc

SEQ ID NO: 2877599 - RNA, 21 nt, Mycobacterium avium subsp. paratuberculosis
gugaucuggugggcgggcacc

SEQ ID NO: 2877600 - RNA, 17 nt, Mycobacterium avium subsp. paratuberculosis
gugaucuucgugcucau

SEQ ID NO: 2877601 - RNA, 13 nt, Mycobacterium avium subsp. paratuberculosis
gugaucuuggccu

SEQ ID NO: 2877602 - RNA, 23 nt, Mycobacterium avium subsp. paratuberculosis
gugaugaaaaccgggcccucguc

SEQ ID NO: 2877603 - RNA, 13 nt, Mycobacterium avium subsp. paratuberculosis
gugaugaccugga

SEQ ID NO: 2877604 - RNA, 15 nt, Mycobacterium avium subsp. paratuberculosis
gugaugacggcggcg

SEQ ID NO: 2877605 - RNA, 16 nt, Mycobacterium avium subsp. paratuberculosis
gugaugacggcggcgg

SEQ ID NO: 2877606 - RNA, 18 nt, Mycobacterium avium subsp. paratuberculosis
gugaugacguagucgucc

SEQ ID NO: 2877607 - RNA, 17 nt, Mycobacterium avium subsp. paratuberculosis
gugaugacgucgcccac

SEQ ID NO: 2877608 - RNA, 18 nt, Mycobacterium avium subsp. paratuberculosis
gugaugaggucgcgaccg

SEQ ID NO: 2877609 - RNA, 13 nt, Mycobacterium avium subsp. paratuberculosis
gugaugaucgccg

SEQ ID NO: 2877610 - RNA, 16 nt, Mycobacterium avium subsp. paratuberculosis
gugaugcacccggacg

SEQ ID NO: 2877611 - RNA, 21 nt, Mycobacterium avium subsp. paratuberculosis
gugaugcagcagguugcggug

SEQ ID NO: 2877612 - RNA, 17 nt, Mycobacterium avium subsp. paratuberculosis
gugaugcagcugaaggu

SEQ ID NO: 2877613 - RNA, 23 nt, Mycobacterium avium subsp. paratuberculosis
gugaugcagugguugagcagcag

SEQ ID NO: 2877614 - RNA, 19 nt, Mycobacterium avium subsp. paratuberculosis
gugaugccggcauccucgg

SEQ ID NO: 2877615 - RNA, 15 nt, Mycobacterium avium subsp. paratuberculosis
gugaugccggccagc

SEQ ID NO: 2877616 - RNA, 21 nt, Mycobacterium avium subsp. paratuberculosis
gugaugccggccagccgcgcg

SEQ ID NO: 2877617 - RNA, 15 nt, Mycobacterium avium subsp. paratuberculosis
gugaugccggcggua

SEQ ID NO: 2877618 - RNA, 22 nt, Mycobacterium avium subsp. paratuberculosis
gugaugccggcgguaccgccga

SEQ ID NO: 2877619 - RNA, 23 nt, Mycobacterium avium subsp. paratuberculosis
gugaugccguccagcaacgccga

SEQ ID NO: 2877620 - RNA, 17 nt, Mycobacterium avium subsp. paratuberculosis
gugaugccguggucggc

SEQ ID NO: 2877621 - RNA, 15 nt, Mycobacterium avium subsp. paratuberculosis
gugaugcgccggcgg

SEQ ID NO: 2877622 - RNA, 17 nt, Mycobacterium avium subsp. paratuberculosis
gugaugcgcgccgacga

SEQ ID NO: 2877623 - RNA, 22 nt, Mycobacterium avium subsp. paratuberculosis
gugaugcggaugcccgccggcg

SEQ ID NO: 2877624 - RNA, 21 nt, Mycobacterium avium subsp. paratuberculosis
gugaugcggcccgacccgguc

SEQ ID NO: 2877625 - RNA, 23 nt, Mycobacterium avium subsp. paratuberculosis
gugaugcggcccgacccggucag

SEQ ID NO: 2877626 - RNA, 18 nt, Mycobacterium avium subsp. paratuberculosis
gugaugcggucggcgcgg

SEQ ID NO: 2877627 - RNA, 21 nt, Mycobacterium avium subsp. paratuberculosis
gugaugcggucggcgcggggc

SEQ ID NO: 2877628 - RNA, 23 nt, Mycobacterium avium subsp. paratuberculosis
gugauggacaucuccggcacguu

SEQ ID NO: 2877629 - RNA, 13 nt, Mycobacterium avium subsp. paratuberculosis
gugauggccaucu

SEQ ID NO: 2877630 - RNA, 14 nt, Mycobacterium avium subsp. paratuberculosis
gugauggccgccgc

SEQ ID NO: 2877631 - RNA, 15 nt, Mycobacterium avium subsp. paratuberculosis
gugaugggcagcgcc

SEQ ID NO: 2877632 - RNA, 16 nt, Mycobacterium avium subsp. paratuberculosis
gugaugggcagcgccc

SEQ ID NO: 2877633 - RNA, 19 nt, Mycobacterium avium subsp. paratuberculosis
gugauggucaccgugucgg

SEQ ID NO: 2877634 - RNA, 14 nt, Mycobacterium avium subsp. paratuberculosis
gugauggucgucgu

SEQ ID NO: 2877635 - RNA, 19 nt, Mycobacterium avium subsp. paratuberculosis
gugauggucucccgggcgg

SEQ ID NO: 2877636 - RNA, 22 nt, Mycobacterium avium subsp. paratuberculosis
gugauggucucccgggcggucg

SEQ ID NO: 2877637 - RNA, 20 nt, Mycobacterium avium subsp. paratuberculosis
gugaugucacccucgaggcc

SEQ ID NO: 2877638 - RNA, 19 nt, Mycobacterium avium subsp. paratuberculosis
gugaugucgacgucgucga

SEQ ID NO: 2877639 - RNA, 22 nt, Mycobacterium avium subsp. paratuberculosis
gugaugucgacgucgucgaccc

SEQ ID NO: 2877640 - RNA, 13 nt, Mycobacterium avium subsp. paratuberculosis
gugaugucgccga

SEQ ID NO: 2877641 - RNA, 17 nt, Mycobacterium avium subsp. paratuberculosis
gugaugucgccggcggc

SEQ ID NO: 2877642 - RNA, 13 nt, Mycobacterium avium subsp. paratuberculosis
gugaugucgguga

SEQ ID NO: 2877643 - RNA, 17 nt, Mycobacterium avium subsp. paratuberculosis
gugauguuggccgcgac

SEQ ID NO: 2877644 - RNA, 13 nt, Mycobacterium avium subsp. paratuberculosis
gugauguugucga

SEQ ID NO: 2877645 - RNA, 17 nt, Mycobacterium avium subsp. paratuberculosis
gugauuaggcaguucga

SEQ ID NO: 2877646 - RNA, 17 nt, Mycobacterium avium subsp. paratuberculosis
gugcaaaagcauccggc

SEQ ID NO: 2877647 - RNA, 19 nt, Mycobacterium avium subsp. paratuberculosis
gugcaaaccggaccgccgc

SEQ ID NO: 2877648 - RNA, 13 nt, Mycobacterium avium subsp. paratuberculosis
gugcaacaccgaa

SEQ ID NO: 2877649 - RNA, 19 nt, Mycobacterium avium subsp. paratuberculosis
gugcaacacucgagcgcgc

SEQ ID NO: 2877650 - RNA, 15 nt, Mycobacterium avium subsp. paratuberculosis
gugcaacgccgccga

SEQ ID NO: 2877651 - RNA, 19 nt, Mycobacterium avium subsp. paratuberculosis
gugcaacucccgcgccgcg

SEQ ID NO: 2877652 - RNA, 22 nt, Mycobacterium avium subsp. paratuberculosis
gugcaacucccgcgccgcggcc

SEQ ID NO: 2877653 - RNA, 20 nt, Mycobacterium avium subsp. paratuberculosis
gugcaacugcguggccgugu

SEQ ID NO: 2877654 - RNA, 17 nt, Mycobacterium avium subsp. paratuberculosis
gugcaagcucgccagga

SEQ ID NO: 2877655 - RNA, 18 nt, Mycobacterium avium subsp. paratuberculosis
gugcaaggccugcgccuu

SEQ ID NO: 2877656 - RNA, 14 nt, Mycobacterium avium subsp. paratuberculosis
gugcaaggcgaugc

SEQ ID NO: 2877657 - RNA, 15 nt, Mycobacterium avium subsp. paratuberculosis
gugcaaggcgaugcc

SEQ ID NO: 2877658 - RNA, 14 nt, Mycobacterium avium subsp. paratuberculosis
gugcacaccggccu

SEQ ID NO: 2877659 - RNA, 16 nt, Mycobacterium avium subsp. paratuberculosis
gugcaccaacacgucg

SEQ ID NO: 2877660 - RNA, 15 nt, Mycobacterium avium subsp. paratuberculosis
gugcaccaccgugcc

SEQ ID NO: 2877661 - RNA, 19 nt, Mycobacterium avium subsp. paratuberculosis
gugcaccagcgauccggcg

SEQ ID NO: 2877662 - RNA, 12 nt, Mycobacterium avium subsp. paratuberculosis
gugcaccaggua

SEQ ID NO: 2877663 - RNA, 17 nt, Mycobacterium avium subsp. paratuberculosis
gugcacccacgccagcc

SEQ ID NO: 2877664 - RNA, 23 nt, Mycobacterium avium subsp. paratuberculosis
gugcacccgaugcucgaugcgca

SEQ ID NO: 2877665 - RNA, 15 nt, Mycobacterium avium subsp. paratuberculosis
gugcacccgcggcgc

SEQ ID NO: 2877666 - RNA, 17 nt, Mycobacterium avium subsp. paratuberculosis
gugcacccgcggcgcga

SEQ ID NO: 2877667 - RNA, 20 nt, Mycobacterium avium subsp. paratuberculosis
gugcacccgguucugggcgg

SEQ ID NO: 2877668 - RNA, 14 nt, Mycobacterium avium subsp. paratuberculosis
gugcaccgccagcg

SEQ ID NO: 2877669 - RNA, 18 nt, Mycobacterium avium subsp. paratuberculosis
gugcaccgccagcgcggc

SEQ ID NO: 2877670 - RNA, 21 nt, Mycobacterium avium subsp. paratuberculosis
gugcaccgccagcgcggcggc

SEQ ID NO: 2877671 - RNA, 23 nt, Mycobacterium avium subsp. paratuberculosis
gugcaccgccagcgcggcggcgc

SEQ ID NO: 2877672 - RNA, 15 nt, Mycobacterium avium subsp. paratuberculosis
gugcaccgcccgcgc

SEQ ID NO: 2877673 - RNA, 13 nt, Mycobacterium avium subsp. paratuberculosis
gugcaccgcgcgc

SEQ ID NO: 2877674 - RNA, 14 nt, Mycobacterium avium subsp. paratuberculosis
gugcaccgcgcgca

SEQ ID NO: 2877675 - RNA, 13 nt, Mycobacterium avium subsp. paratuberculosis
gugcaccgcggcc

SEQ ID NO: 2877676 - RNA, 23 nt, Mycobacterium avium subsp. paratuberculosis
gugcaccgcggccaacccgggcg

SEQ ID NO: 2877677 - RNA, 20 nt, Mycobacterium avium subsp. paratuberculosis
gugcaccgcggcgcgcaucg

SEQ ID NO: 2877678 - RNA, 22 nt, Mycobacterium avium subsp. paratuberculosis
gugcaccgcggcgcgcaucgcc

SEQ ID NO: 2877679 - RNA, 21 nt, Mycobacterium avium subsp. paratuberculosis
gugcaccggcacgucgagcuc

SEQ ID NO: 2877680 - RNA, 13 nt, Mycobacterium avium subsp. paratuberculosis
gugcaccggcgag

SEQ ID NO: 2877681 - RNA, 19 nt, Mycobacterium avium subsp. paratuberculosis
gugcaccgucgccggcggg

SEQ ID NO: 2877682 - RNA, 14 nt, Mycobacterium avium subsp. paratuberculosis
gugcaccgugguga

SEQ ID NO: 2877683 - RNA, 14 nt, Mycobacterium avium subsp. paratuberculosis
gugcaccucgacga

SEQ ID NO: 2877684 - RNA, 15 nt, Mycobacterium avium subsp. paratuberculosis
gugcaccucgacgaa

SEQ ID NO: 2877685 - RNA, 18 nt, Mycobacterium avium subsp. paratuberculosis
gugcaccugagucugggu

SEQ ID NO: 2877686 - RNA, 15 nt, Mycobacterium avium subsp. paratuberculosis
gugcaccugcagccg

SEQ ID NO: 2877687 - RNA, 22 nt, Mycobacterium avium subsp. paratuberculosis
gugcaccugugaggcaccgaac

SEQ ID NO: 2877688 - RNA, 20 nt, Mycobacterium avium subsp. paratuberculosis
gugcaccuuggucagcuccc

SEQ ID NO: 2877689 - RNA, 16 nt, Mycobacterium avium subsp. paratuberculosis
gugcacgaacgcggcc

SEQ ID NO: 2877690 - RNA, 17 nt, Mycobacterium avium subsp. paratuberculosis
gugcacgaacgcggcca

SEQ ID NO: 2877691 - RNA, 18 nt, Mycobacterium avium subsp. paratuberculosis
gugcacgaacgcggccag

SEQ ID NO: 2877692 - RNA, 15 nt, Mycobacterium avium subsp. paratuberculosis
gugcacgaacggcac

SEQ ID NO: 2877693 - RNA, 14 nt, Mycobacterium avium subsp. paratuberculosis
gugcacgagcgucg

SEQ ID NO: 2877694 - RNA, 19 nt, Mycobacterium avium subsp. paratuberculosis
gugcacgagcgucgugcgg

SEQ ID NO: 2877695 - RNA, 13 nt, Mycobacterium avium subsp. paratuberculosis
gugcacgaucgcg

SEQ ID NO: 2877696 - RNA, 20 nt, Mycobacterium avium subsp. paratuberculosis
gugcacgaucgcggugacgc

SEQ ID NO: 2877697 - RNA, 17 nt, Mycobacterium avium subsp. paratuberculosis
gugcacgauggacaggu

SEQ ID NO: 2877698 - RNA, 19 nt, Mycobacterium avium subsp. paratuberculosis
gugcacgccgagcagcacc

SEQ ID NO: 2877699 - RNA, 20 nt, Mycobacterium avium subsp. paratuberculosis
gugcacgccgaggcgugccg

SEQ ID NO: 2877700 - RNA, 22 nt, Mycobacterium avium subsp. paratuberculosis
gugcacgccgaggcgugccgcu

SEQ ID NO: 2877701 - RNA, 20 nt, Mycobacterium avium subsp. paratuberculosis
gugcacgccguggcggcggg

SEQ ID NO: 2877702 - RNA, 17 nt, Mycobacterium avium subsp. paratuberculosis
gugcacgcucggcgcga

SEQ ID NO: 2877703 - RNA, 15 nt, Mycobacterium avium subsp. paratuberculosis
gugcacgcucggcgg

SEQ ID NO: 2877704 - RNA, 18 nt, Mycobacterium avium subsp. paratuberculosis
gugcacggacagcucacc

SEQ ID NO: 2877705 - RNA, 23 nt, Mycobacterium avium subsp. paratuberculosis
gugcacggccaacugcaucgcca

SEQ ID NO: 2877706 - RNA, 17 nt, Mycobacterium avium subsp. paratuberculosis
gugcacggucagcucgc

SEQ ID NO: 2877707 - RNA, 18 nt, Mycobacterium avium subsp. paratuberculosis
gugcacggucagcucgcg

SEQ ID NO: 2877708 - RNA, 19 nt, Mycobacterium avium subsp. paratuberculosis
gugcacggucagcucgcgc

SEQ ID NO: 2877709 - RNA, 20 nt, Mycobacterium avium subsp. paratuberculosis
gugcacggucagcucgcgcc

SEQ ID NO: 2877710 - RNA, 23 nt, Mycobacterium avium subsp. paratuberculosis
gugcacggucagcucgcgcccgg

SEQ ID NO: 2877711 - RNA, 20 nt, Mycobacterium avium subsp. paratuberculosis
gugcacgugcaggugcggca

SEQ ID NO: 2877712 - RNA, 15 nt, Mycobacterium avium subsp. paratuberculosis
gugcacucagggcga

SEQ ID NO: 2877713 - RNA, 16 nt, Mycobacterium avium subsp. paratuberculosis
gugcacucagggcgau

SEQ ID NO: 2877714 - RNA, 13 nt, Mycobacterium avium subsp. paratuberculosis
gugcacucggcga

SEQ ID NO: 2877715 - RNA, 14 nt, Mycobacterium avium subsp. paratuberculosis
gugcacucggcgau

SEQ ID NO: 2877716 - RNA, 14 nt, Mycobacterium avium subsp. paratuberculosis
gugcagaacagcac

SEQ ID NO: 2877717 - RNA, 23 nt, Mycobacterium avium subsp. paratuberculosis
gugcagacaaccggugugccugg

SEQ ID NO: 2877718 - RNA, 16 nt, Mycobacterium avium subsp. paratuberculosis
gugcagaccccggcgu

SEQ ID NO: 2877719 - RNA, 17 nt, Mycobacterium avium subsp. paratuberculosis
gugcagaccccggcguc

SEQ ID NO: 2877720 - RNA, 21 nt, Mycobacterium avium subsp. paratuberculosis
gugcagaccggacagcugggc

SEQ ID NO: 2877721 - RNA, 18 nt, Mycobacterium avium subsp. paratuberculosis
gugcagacgugacgugcc

SEQ ID NO: 2877722 - RNA, 22 nt, Mycobacterium avium subsp. paratuberculosis
gugcagauagguggucucccag

SEQ ID NO: 2877723 - RNA, 23 nt, Mycobacterium avium subsp. paratuberculosis
gugcagauagguggucucccaga

SEQ ID NO: 2877724 - RNA, 22 nt, Mycobacterium avium subsp. paratuberculosis
gugcagaucguccaucgcgucg

SEQ ID NO: 2877725 - RNA, 20 nt, Mycobacterium avium subsp. paratuberculosis
gugcagcaccacgaacgcug

SEQ ID NO: 2877726 - RNA, 13 nt, Mycobacterium avium subsp. paratuberculosis
gugcagcaccgcc

SEQ ID NO: 2877727 - RNA, 16 nt, Mycobacterium avium subsp. paratuberculosis
gugcagcaccgccagc

SEQ ID NO: 2877728 - RNA, 17 nt, Mycobacterium avium subsp. paratuberculosis
gugcagcaccgccagca

SEQ ID NO: 2877729 - RNA, 18 nt, Mycobacterium avium subsp. paratuberculosis
gugcagcaccgccagcau

SEQ ID NO: 2877730 - RNA, 14 nt, Mycobacterium avium subsp. paratuberculosis
gugcagcacgccgc

SEQ ID NO: 2877731 - RNA, 19 nt, Mycobacterium avium subsp. paratuberculosis
gugcagcacgccgcggaag

SEQ ID NO: 2877732 - RNA, 17 nt, Mycobacterium avium subsp. paratuberculosis
gugcagcacgugcgcgg

SEQ ID NO: 2877733 - RNA, 18 nt, Mycobacterium avium subsp. paratuberculosis
gugcagcacgugcgcggg

SEQ ID NO: 2877734 - RNA, 15 nt, Mycobacterium avium subsp. paratuberculosis
gugcagcagcagcca

SEQ ID NO: 2877735 - RNA, 16 nt, Mycobacterium avium subsp. paratuberculosis
gugcagcagcagccac

SEQ ID NO: 2877736 - RNA, 17 nt, Mycobacterium avium subsp. paratuberculosis
gugcagcagcagccacg

SEQ ID NO: 2877737 - RNA, 22 nt, Mycobacterium avium subsp. paratuberculosis
gugcagcagcagccacgccagc

SEQ ID NO: 2877738 - RNA, 23 nt, Mycobacterium avium subsp. paratuberculosis
gugcagcagcagccacgccagcc

SEQ ID NO: 2877739 - RNA, 12 nt, Mycobacterium avium subsp. paratuberculosis
gugcagcagcgc

SEQ ID NO: 2877740 - RNA, 17 nt, Mycobacterium avium subsp. paratuberculosis
gugcagcagcgccgcga

SEQ ID NO: 2877741 - RNA, 13 nt, Mycobacterium avium subsp. paratuberculosis
gugcagcagcucg

SEQ ID NO: 2877742 - RNA, 20 nt, Mycobacterium avium subsp. paratuberculosis
gugcagcaguuccggagcgc

SEQ ID NO: 2877743 - RNA, 22 nt, Mycobacterium avium subsp. paratuberculosis
gugcagcaguuccggagcgcgg

SEQ ID NO: 2877744 - RNA, 17 nt, Mycobacterium avium subsp. paratuberculosis
gugcagccacccgucgg

SEQ ID NO: 2877745 - RNA, 13 nt, Mycobacterium avium subsp. paratuberculosis
gugcagccccgca

SEQ ID NO: 2877746 - RNA, 22 nt, Mycobacterium avium subsp. paratuberculosis
gugcagccgaagaacuggcuga

SEQ ID NO: 2877747 - RNA, 13 nt, Mycobacterium avium subsp. paratuberculosis
gugcagccggcgg

SEQ ID NO: 2877748 - RNA, 15 nt, Mycobacterium avium subsp. paratuberculosis
gugcagccggcggcg

SEQ ID NO: 2877749 - RNA, 15 nt, Mycobacterium avium subsp. paratuberculosis
gugcagccgggccug

SEQ ID NO: 2877750 - RNA, 13 nt, Mycobacterium avium subsp. paratuberculosis
gugcagccgggcg

SEQ ID NO: 2877751 - RNA, 17 nt, Mycobacterium avium subsp. paratuberculosis
gugcagccgggcggcgc

SEQ ID NO: 2877752 - RNA, 22 nt, Mycobacterium avium subsp. paratuberculosis
gugcagccgggcggcgccgaac

SEQ ID NO: 2877753 - RNA, 12 nt, Mycobacterium avium subsp. paratuberculosis
gugcagcgccag

SEQ ID NO: 2877754 - RNA, 14 nt, Mycobacterium avium subsp. paratuberculosis
gugcagcgccagca

SEQ ID NO: 2877755 - RNA, 17 nt, Mycobacterium avium subsp. paratuberculosis
gugcagcgccagcaccg

SEQ ID NO: 2877756 - RNA, 19 nt, Mycobacterium avium subsp. paratuberculosis
gugcagcgccagcaccggg

SEQ ID NO: 2877757 - RNA, 19 nt, Mycobacterium avium subsp. paratuberculosis
gugcagcgcccagccgagc

SEQ ID NO: 2877758 - RNA, 14 nt, Mycobacterium avium subsp. paratuberculosis
gugcagcgggcugg

SEQ ID NO: 2877759 - RNA, 21 nt, Mycobacterium avium subsp. paratuberculosis
gugcagcuccuugagccgccg

SEQ ID NO: 2877760 - RNA, 22 nt, Mycobacterium avium subsp. paratuberculosis
gugcagcucggugcagaccccg

SEQ ID NO: 2877761 - RNA, 19 nt, Mycobacterium avium subsp. paratuberculosis
gugcaggaugaccgcgucg

SEQ ID NO: 2877762 - RNA, 15 nt, Mycobacterium avium subsp. paratuberculosis
gugcaggccgaacac

SEQ ID NO: 2877763 - RNA, 19 nt, Mycobacterium avium subsp. paratuberculosis
gugcaggccgcggguggcg

SEQ ID NO: 2877764 - RNA, 19 nt, Mycobacterium avium subsp. paratuberculosis
gugcaggcugacgcgaccg

SEQ ID NO: 2877765 - RNA, 17 nt, Mycobacterium avium subsp. paratuberculosis
gugcagggggcgcagcc

SEQ ID NO: 2877766 - RNA, 19 nt, Mycobacterium avium subsp. paratuberculosis
gugcagggggcgcagccga

SEQ ID NO: 2877767 - RNA, 16 nt, Mycobacterium avium subsp. paratuberculosis
gugcagggucagcagc

SEQ ID NO: 2877768 - RNA, 17 nt, Mycobacterium avium subsp. paratuberculosis
gugcagggucagcagca

SEQ ID NO: 2877769 - RNA, 17 nt, Mycobacterium avium subsp. paratuberculosis
gugcaggugcccgucgg

SEQ ID NO: 2877770 - RNA, 18 nt, Mycobacterium avium subsp. paratuberculosis
gugcaggugcccgucggc

SEQ ID NO: 2877771 - RNA, 20 nt, Mycobacterium avium subsp. paratuberculosis
gugcagugcgaucgccguga

SEQ ID NO: 2877772 - RNA, 15 nt, Mycobacterium avium subsp. paratuberculosis
gugcaguucgaugcc

SEQ ID NO: 2877773 - RNA, 17 nt, Mycobacterium avium subsp. paratuberculosis
gugcauccugggcgucg

SEQ ID NO: 2877774 - RNA, 18 nt, Mycobacterium avium subsp. paratuberculosis
gugcauccugggcgucga

SEQ ID NO: 2877775 - RNA, 12 nt, Mycobacterium avium subsp. paratuberculosis
gugcaucgccac

SEQ ID NO: 2877776 - RNA, 15 nt, Mycobacterium avium subsp. paratuberculosis
gugcaucgccaccgu

SEQ ID NO: 2877777 - RNA, 22 nt, Mycobacterium avium subsp. paratuberculosis
gugcaucgccaccgucgucgag

SEQ ID NO: 2877778 - RNA, 15 nt, Mycobacterium avium subsp. paratuberculosis
gugcaucgggcgcuc

SEQ ID NO: 2877779 - RNA, 18 nt, Mycobacterium avium subsp. paratuberculosis
gugcaucgucgcggcggu

SEQ ID NO: 2877780 - RNA, 23 nt, Mycobacterium avium subsp. paratuberculosis
gugcaugccggccuucucgcgca

SEQ ID NO: 2877781 - RNA, 17 nt, Mycobacterium avium subsp. paratuberculosis
gugcaugugcucggcga

SEQ ID NO: 2877782 - RNA, 20 nt, Mycobacterium avium subsp. paratuberculosis
gugcauguggccgucgccga

SEQ ID NO: 2877783 - RNA, 22 nt, Mycobacterium avium subsp. paratuberculosis
gugcauucaggucaccgcgcga

SEQ ID NO: 2877784 - RNA, 17 nt, Mycobacterium avium subsp. paratuberculosis
gugccaacacggcggcg

SEQ ID NO: 2877785 - RNA, 18 nt, Mycobacterium avium subsp. paratuberculosis
gugccaacacggcggcgc

SEQ ID NO: 2877786 - RNA, 20 nt, Mycobacterium avium subsp. paratuberculosis
gugccaacacggcggcgcgc

SEQ ID NO: 2877787 - RNA, 20 nt, Mycobacterium avium subsp. paratuberculosis
gugccaagcguauccggcca

SEQ ID NO: 2877788 - RNA, 22 nt, Mycobacterium avium subsp. paratuberculosis
gugccaagcguauccggccagc

SEQ ID NO: 2877789 - RNA, 23 nt, Mycobacterium avium subsp. paratuberculosis
gugccaagcguauccggccagcc

SEQ ID NO: 2877790 - RNA, 22 nt, Mycobacterium avium subsp. paratuberculosis
gugccaaugaaauucaggccac

SEQ ID NO: 2877791 - RNA, 14 nt, Mycobacterium avium subsp. paratuberculosis
gugccaccaccacg

SEQ ID NO: 2877792 - RNA, 18 nt, Mycobacterium avium subsp. paratuberculosis
gugccaccaccacggcca

SEQ ID NO: 2877793 - RNA, 20 nt, Mycobacterium avium subsp. paratuberculosis
gugccaccaccacggccagg

SEQ ID NO: 2877794 - RNA, 20 nt, Mycobacterium avium subsp. paratuberculosis
gugccaccgccgauggcgac

SEQ ID NO: 2877795 - RNA, 22 nt, Mycobacterium avium subsp. paratuberculosis
gugccaccgcugggcggcgcgg

SEQ ID NO: 2877796 - RNA, 16 nt, Mycobacterium avium subsp. paratuberculosis
gugccacggccgcggc

SEQ ID NO: 2877797 - RNA, 17 nt, Mycobacterium avium subsp. paratuberculosis
gugccacggccgcggcc

SEQ ID NO: 2877798 - RNA, 23 nt, Mycobacterium avium subsp. paratuberculosis
gugccacggccgcggcccggcca

SEQ ID NO: 2877799 - RNA, 17 nt, Mycobacterium avium subsp. paratuberculosis
gugccacggucaggcgc

SEQ ID NO: 2877800 - RNA, 21 nt, Mycobacterium avium subsp. paratuberculosis
gugccacggucaggcgcagcc

SEQ ID NO: 2877801 - RNA, 17 nt, Mycobacterium avium subsp. paratuberculosis
gugccacuggcgccacc

SEQ ID NO: 2877802 - RNA, 19 nt, Mycobacterium avium subsp. paratuberculosis
gugccacuggcgccaccuc

SEQ ID NO: 2877803 - RNA, 18 nt, Mycobacterium avium subsp. paratuberculosis
gugccacuucgacggcag

SEQ ID NO: 2877804 - RNA, 20 nt, Mycobacterium avium subsp. paratuberculosis
gugccacuucgacggcagcg

SEQ ID NO: 2877805 - RNA, 22 nt, Mycobacterium avium subsp. paratuberculosis
gugccacuucgacggcagcggc

SEQ ID NO: 2877806 - RNA, 14 nt, Mycobacterium avium subsp. paratuberculosis
gugccagcaacaca

SEQ ID NO: 2877807 - RNA, 12 nt, Mycobacterium avium subsp. paratuberculosis
gugccagcagcu

SEQ ID NO: 2877808 - RNA, 21 nt, Mycobacterium avium subsp. paratuberculosis
gugccagcccguuguggcggc

SEQ ID NO: 2877809 - RNA, 12 nt, Mycobacterium avium subsp. paratuberculosis
gugccagccgaa

SEQ ID NO: 2877810 - RNA, 14 nt, Mycobacterium avium subsp. paratuberculosis
gugccagccgaagu

SEQ ID NO: 2877811 - RNA, 14 nt, Mycobacterium avium subsp. paratuberculosis
gugccagccggccg

SEQ ID NO: 2877812 - RNA, 15 nt, Mycobacterium avium subsp. paratuberculosis
gugccagccggccgc

SEQ ID NO: 2877813 - RNA, 16 nt, Mycobacterium avium subsp. paratuberculosis
gugccagccggccgcu

SEQ ID NO: 2877814 - RNA, 18 nt, Mycobacterium avium subsp. paratuberculosis
gugccagccggccgcuga

SEQ ID NO: 2877815 - RNA, 14 nt, Mycobacterium avium subsp. paratuberculosis
gugccagccgugcg

SEQ ID NO: 2877816 - RNA, 19 nt, Mycobacterium avium subsp. paratuberculosis
gugccagccgugcggcggc

SEQ ID NO: 2877817 - RNA, 20 nt, Mycobacterium avium subsp. paratuberculosis
gugccagccgugcggcggcg

SEQ ID NO: 2877818 - RNA, 22 nt, Mycobacterium avium subsp. paratuberculosis
gugccagcgcaguucaccgaag

SEQ ID NO: 2877819 - RNA, 13 nt, Mycobacterium avium subsp. paratuberculosis
gugccagggcagc

SEQ ID NO: 2877820 - RNA, 16 nt, Mycobacterium avium subsp. paratuberculosis
gugccagggcagcgcg

SEQ ID NO: 2877821 - RNA, 17 nt, Mycobacterium avium subsp. paratuberculosis
gugccagggcagcgcga

SEQ ID NO: 2877822 - RNA, 22 nt, Mycobacterium avium subsp. paratuberculosis
gugccagggcagcgcgaccagc

SEQ ID NO: 2877823 - RNA, 17 nt, Mycobacterium avium subsp. paratuberculosis
gugccaguaccagcggc

SEQ ID NO: 2877824 - RNA, 19 nt, Mycobacterium avium subsp. paratuberculosis
gugccaguaccagcggccg

SEQ ID NO: 2877825 - RNA, 22 nt, Mycobacterium avium subsp. paratuberculosis
gugccaguaccagcggccgucg

SEQ ID NO: 2877826 - RNA, 15 nt, Mycobacterium avium subsp. paratuberculosis
gugccaucgcuggug

SEQ ID NO: 2877827 - RNA, 16 nt, Mycobacterium avium subsp. paratuberculosis
gugccaucgugggcgc

SEQ ID NO: 2877828 - RNA, 19 nt, Mycobacterium avium subsp. paratuberculosis
gugccaucgugggcgccgu

SEQ ID NO: 2877829 - RNA, 21 nt, Mycobacterium avium subsp. paratuberculosis
gugccaucgugggcgccgucg

SEQ ID NO: 2877830 - RNA, 18 nt, Mycobacterium avium subsp. paratuberculosis
gugcccaacacgccccga

SEQ ID NO: 2877831 - RNA, 12 nt, Mycobacterium avium subsp. paratuberculosis
gugcccaccagc

SEQ ID NO: 2877832 - RNA, 20 nt, Mycobacterium avium subsp. paratuberculosis
gugcccaccagccggccggc

SEQ ID NO: 2877833 - RNA, 16 nt, Mycobacterium avium subsp. paratuberculosis
gugcccaccgggcagc

SEQ ID NO: 2877834 - RNA, 22 nt, Mycobacterium avium subsp. paratuberculosis
gugcccaccgggcagccgcaca

SEQ ID NO: 2877835 - RNA, 18 nt, Mycobacterium avium subsp. paratuberculosis
gugcccagcaccgccggc

SEQ ID NO: 2877836 - RNA, 22 nt, Mycobacterium avium subsp. paratuberculosis
gugcccagcaccgccggcgccg

SEQ ID NO: 2877837 - RNA, 15 nt, Mycobacterium avium subsp. paratuberculosis
gugcccagcacgacg

SEQ ID NO: 2877838 - RNA, 18 nt, Mycobacterium avium subsp. paratuberculosis
gugcccagcacgacgccg

SEQ ID NO: 2877839 - RNA, 14 nt, Mycobacterium avium subsp. paratuberculosis
gugcccagccaggc

SEQ ID NO: 2877840 - RNA, 19 nt, Mycobacterium avium subsp. paratuberculosis
gugcccagccaggccgccg

SEQ ID NO: 2877841 - RNA, 15 nt, Mycobacterium avium subsp. paratuberculosis
gugcccagcccgcgc

SEQ ID NO: 2877842 - RNA, 15 nt, Mycobacterium avium subsp. paratuberculosis
gugcccagccgcagg

SEQ ID NO: 2877843 - RNA, 12 nt, Mycobacterium avium subsp. paratuberculosis
gugcccagcgcg

SEQ ID NO: 2877844 - RNA, 16 nt, Mycobacterium avium subsp. paratuberculosis
gugcccagcgcgaggu

SEQ ID NO: 2877845 - RNA, 16 nt, Mycobacterium avium subsp. paratuberculosis
gugcccaucgacccgu

SEQ ID NO: 2877846 - RNA, 13 nt, Mycobacterium avium subsp. paratuberculosis
gugccccacgcca

SEQ ID NO: 2877847 - RNA, 14 nt, Mycobacterium avium subsp. paratuberculosis
gugccccacgccau

SEQ ID NO: 2877848 - RNA, 22 nt, Mycobacterium avium subsp. paratuberculosis
gugccccacgccaugugccggc

SEQ ID NO: 2877849 - RNA, 15 nt, Mycobacterium avium subsp. paratuberculosis
gugcccccgcccggc

SEQ ID NO: 2877850 - RNA, 12 nt, Mycobacterium avium subsp. paratuberculosis
gugccccgccgu

SEQ ID NO: 2877851 - RNA, 22 nt, Mycobacterium avium subsp. paratuberculosis
gugccccgccguuucagcagcg

SEQ ID NO: 2877852 - RNA, 23 nt, Mycobacterium avium subsp. paratuberculosis
gugccccgccguuucagcagcgc

SEQ ID NO: 2877853 - RNA, 23 nt, Mycobacterium avium subsp. paratuberculosis
gugccccgcgaccgcagcaggcg

SEQ ID NO: 2877854 - RNA, 22 nt, Mycobacterium avium subsp. paratuberculosis
gugccccgcuggaucccgguga

SEQ ID NO: 2877855 - RNA, 18 nt, Mycobacterium avium subsp. paratuberculosis
gugccccguccggcgcca

SEQ ID NO: 2877856 - RNA, 16 nt, Mycobacterium avium subsp. paratuberculosis
gugccccucgacccga

SEQ ID NO: 2877857 - RNA, 14 nt, Mycobacterium avium subsp. paratuberculosis
gugcccgacggcgc

SEQ ID NO: 2877858 - RNA, 16 nt, Mycobacterium avium subsp. paratuberculosis
gugcccgagaucaccg

SEQ ID NO: 2877859 - RNA, 19 nt, Mycobacterium avium subsp. paratuberculosis
gugcccgagaucaccggcu

SEQ ID NO: 2877860 - RNA, 19 nt, Mycobacterium avium subsp. paratuberculosis
gugcccgaucucgucggug

SEQ ID NO: 2877861 - RNA, 20 nt, Mycobacterium avium subsp. paratuberculosis
gugcccgaucucgucgguga

SEQ ID NO: 2877862 - RNA, 22 nt, Mycobacterium avium subsp. paratuberculosis
gugcccgauuggaagagggcca

SEQ ID NO: 2877863 - RNA, 15 nt, Mycobacterium avium subsp. paratuberculosis
gugcccgcagcauca

SEQ ID NO: 2877864 - RNA, 15 nt, Mycobacterium avium subsp. paratuberculosis
gugcccgcaucgccg

SEQ ID NO: 2877865 - RNA, 13 nt, Mycobacterium avium subsp. paratuberculosis
gugcccgcccagc

SEQ ID NO: 2877866 - RNA, 16 nt, Mycobacterium avium subsp. paratuberculosis
gugcccgcccagcugc

SEQ ID NO: 2877867 - RNA, 17 nt, Mycobacterium avium subsp. paratuberculosis
gugcccgccgaccagga

SEQ ID NO: 2877868 - RNA, 13 nt, Mycobacterium avium subsp. paratuberculosis
gugcccgccgcga

SEQ ID NO: 2877869 - RNA, 13 nt, Mycobacterium avium subsp. paratuberculosis
gugcccgccucgc

SEQ ID NO: 2877870 - RNA, 20 nt, Mycobacterium avium subsp. paratuberculosis
gugcccgccucgcagcgaca

SEQ ID NO: 2877871 - RNA, 21 nt, Mycobacterium avium subsp. paratuberculosis
gugcccgcgggacacggcggc

SEQ ID NO: 2877872 - RNA, 22 nt, Mycobacterium avium subsp. paratuberculosis
gugcccgcgggacacggcggcg

SEQ ID NO: 2877873 - RNA, 15 nt, Mycobacterium avium subsp. paratuberculosis
gugcccggaacggcg

SEQ ID NO: 2877874 - RNA, 21 nt, Mycobacterium avium subsp. paratuberculosis
gugcccggaacggcgggcccg

SEQ ID NO: 2877875 - RNA, 17 nt, Mycobacterium avium subsp. paratuberculosis
gugcccggaucgccgaa

SEQ ID NO: 2877876 - RNA, 12 nt, Mycobacterium avium subsp. paratuberculosis
gugcccggccag

SEQ ID NO: 2877877 - RNA, 13 nt, Mycobacterium avium subsp. paratuberculosis
gugcccggccagc

SEQ ID NO: 2877878 - RNA, 14 nt, Mycobacterium avium subsp. paratuberculosis
gugcccggcccagg

SEQ ID NO: 2877879 - RNA, 11 nt, Mycobacterium avium subsp. paratuberculosis
gugcccggcgc

SEQ ID NO: 2877880 - RNA, 14 nt, Mycobacterium avium subsp. paratuberculosis
gugcccggcgcaca

SEQ ID NO: 2877881 - RNA, 14 nt, Mycobacterium avium subsp. paratuberculosis
gugcccggcgcccu

SEQ ID NO: 2877882 - RNA, 13 nt, Mycobacterium avium subsp. paratuberculosis
gugcccggcgccg

SEQ ID NO: 2877883 - RNA, 20 nt, Mycobacterium avium subsp. paratuberculosis
gugcccggcgccgaccaggc

SEQ ID NO: 2877884 - RNA, 22 nt, Mycobacterium avium subsp. paratuberculosis
gugcccggcgccgaccaggcuc

SEQ ID NO: 2877885 - RNA, 16 nt, Mycobacterium avium subsp. paratuberculosis
gugcccggcugggcgc

SEQ ID NO: 2877886 - RNA, 13 nt, Mycobacterium avium subsp. paratuberculosis
gugcccgggcccg

SEQ ID NO: 2877887 - RNA, 17 nt, Mycobacterium avium subsp. paratuberculosis
gugcccgggccgcagcu

SEQ ID NO: 2877888 - RNA, 20 nt, Mycobacterium avium subsp. paratuberculosis
gugcccgggccgcagcucgc

SEQ ID NO: 2877889 - RNA, 12 nt, Mycobacterium avium subsp. paratuberculosis
gugcccgggucg

SEQ ID NO: 2877890 - RNA, 21 nt, Mycobacterium avium subsp. paratuberculosis
gugcccgggucgugcggcggc

SEQ ID NO: 2877891 - RNA, 16 nt, Mycobacterium avium subsp. paratuberculosis
gugcccgucggcaacg

SEQ ID NO: 2877892 - RNA, 19 nt, Mycobacterium avium subsp. paratuberculosis
gugcccgucggcaacgccg

SEQ ID NO: 2877893 - RNA, 18 nt, Mycobacterium avium subsp. paratuberculosis
gugcccgucggccucggc

SEQ ID NO: 2877894 - RNA, 19 nt, Mycobacterium avium subsp. paratuberculosis
gugcccguugcccgaucag

SEQ ID NO: 2877895 - RNA, 17 nt, Mycobacterium avium subsp. paratuberculosis
gugcccuccucgccgga

SEQ ID NO: 2877896 - RNA, 20 nt, Mycobacterium avium subsp. paratuberculosis
gugcccuuccccggcggccg

SEQ ID NO: 2877897 - RNA, 14 nt, Mycobacterium avium subsp. paratuberculosis
gugccgaacagcga

SEQ ID NO: 2877898 - RNA, 16 nt, Mycobacterium avium subsp. paratuberculosis
gugccgaacagcgacg

SEQ ID NO: 2877899 - RNA, 14 nt, Mycobacterium avium subsp. paratuberculosis
gugccgaagcgcca

SEQ ID NO: 2877900 - RNA, 22 nt, Mycobacterium avium subsp. paratuberculosis
gugccgaagcgccacggggcgc

SEQ ID NO: 2877901 - RNA, 22 nt, Mycobacterium avium subsp. paratuberculosis
gugccgaagcgccgcaugcccu

SEQ ID NO: 2877902 - RNA, 23 nt, Mycobacterium avium subsp. paratuberculosis
gugccgaagggcaaccgcagcau

SEQ ID NO: 2877903 - RNA, 14 nt, Mycobacterium avium subsp. paratuberculosis
gugccgaccagccg

SEQ ID NO: 2877904 - RNA, 23 nt, Mycobacterium avium subsp. paratuberculosis
gugccgacgaccucgucgucgau

SEQ ID NO: 2877905 - RNA, 19 nt, Mycobacterium avium subsp. paratuberculosis
gugccgacgagcucgccgc

SEQ ID NO: 2877906 - RNA, 22 nt, Mycobacterium avium subsp. paratuberculosis
gugccgacgauccgggcgcccu

SEQ ID NO: 2877907 - RNA, 14 nt, Mycobacterium avium subsp. paratuberculosis
gugccgacggugcg

SEQ ID NO: 2877908 - RNA, 15 nt, Mycobacterium avium subsp. paratuberculosis
gugccgacggugcgu

SEQ ID NO: 2877909 - RNA, 13 nt, Mycobacterium avium subsp. paratuberculosis
gugccgagcacgc

SEQ ID NO: 2877910 - RNA, 15 nt, Mycobacterium avium subsp. paratuberculosis
gugccgagcacgcgg

SEQ ID NO: 2877911 - RNA, 18 nt, Mycobacterium avium subsp. paratuberculosis
gugccgagcacgcggccg

SEQ ID NO: 2877912 - RNA, 19 nt, Mycobacterium avium subsp. paratuberculosis
gugccgagcacgcggccgc

SEQ ID NO: 2877913 - RNA, 17 nt, Mycobacterium avium subsp. paratuberculosis
gugccgagcccgccggc

SEQ ID NO: 2877914 - RNA, 13 nt, Mycobacterium avium subsp. paratuberculosis
gugccgagcgcgc

SEQ ID NO: 2877915 - RNA, 14 nt, Mycobacterium avium subsp. paratuberculosis
gugccgagcgcgcu

SEQ ID NO: 2877916 - RNA, 23 nt, Mycobacterium avium subsp. paratuberculosis
gugccgaguucgaccucggugau

SEQ ID NO: 2877917 - RNA, 14 nt, Mycobacterium avium subsp. paratuberculosis
gugccgaucaccuc

SEQ ID NO: 2877918 - RNA, 15 nt, Mycobacterium avium subsp. paratuberculosis
gugccgaucgagacc

SEQ ID NO: 2877919 - RNA, 16 nt, Mycobacterium avium subsp. paratuberculosis
gugccgaucgagacca

SEQ ID NO: 2877920 - RNA, 14 nt, Mycobacterium avium subsp. paratuberculosis
gugccgauggccac

SEQ ID NO: 2877921 - RNA, 16 nt, Mycobacterium avium subsp. paratuberculosis
gugccgauggccaccg

SEQ ID NO: 2877922 - RNA, 21 nt, Mycobacterium avium subsp. paratuberculosis
gugccgauguaggacaggucg

SEQ ID NO: 2877923 - RNA, 14 nt, Mycobacterium avium subsp. paratuberculosis
gugccgcaccagca

SEQ ID NO: 2877924 - RNA, 15 nt, Mycobacterium avium subsp. paratuberculosis
gugccgcagccgucc

SEQ ID NO: 2877925 - RNA, 17 nt, Mycobacterium avium subsp. paratuberculosis
gugccgcagcggcggca

SEQ ID NO: 2877926 - RNA, 14 nt, Mycobacterium avium subsp. paratuberculosis
gugccgcagcucga

SEQ ID NO: 2877927 - RNA, 17 nt, Mycobacterium avium subsp. paratuberculosis
gugccgcagcucgauca

SEQ ID NO: 2877928 - RNA, 13 nt, Mycobacterium avium subsp. paratuberculosis
gugccgcaggcga

SEQ ID NO: 2877929 - RNA, 14 nt, Mycobacterium avium subsp. paratuberculosis
gugccgcaggcgaa

SEQ ID NO: 2877930 - RNA, 17 nt, Mycobacterium avium subsp. paratuberculosis
gugccgcaggugguggg

SEQ ID NO: 2877931 - RNA, 18 nt, Mycobacterium avium subsp. paratuberculosis
gugccgcagugccggcgc

SEQ ID NO: 2877932 - RNA, 15 nt, Mycobacterium avium subsp. paratuberculosis
gugccgcccaacgac

SEQ ID NO: 2877933 - RNA, 19 nt, Mycobacterium avium subsp. paratuberculosis
gugccgcccaacgacgucg

SEQ ID NO: 2877934 - RNA, 23 nt, Mycobacterium avium subsp. paratuberculosis
gugccgcccaacgacgucggcgu

SEQ ID NO: 2877935 - RNA, 14 nt, Mycobacterium avium subsp. paratuberculosis
gugccgcccggacc

SEQ ID NO: 2877936 - RNA, 19 nt, Mycobacterium avium subsp. paratuberculosis
gugccgcccggaccgcggu

SEQ ID NO: 2877937 - RNA, 14 nt, Mycobacterium avium subsp. paratuberculosis
gugccgcccgucgc

SEQ ID NO: 2877938 - RNA, 22 nt, Mycobacterium avium subsp. paratuberculosis
gugccgcccgucgccuccugcu

SEQ ID NO: 2877939 - RNA, 16 nt, Mycobacterium avium subsp. paratuberculosis
gugccgccgaugacgg

SEQ ID NO: 2877940 - RNA, 19 nt, Mycobacterium avium subsp. paratuberculosis
gugccgccgaugacggcgc

SEQ ID NO: 2877941 - RNA, 13 nt, Mycobacterium avium subsp. paratuberculosis
gugccgccgcccg

SEQ ID NO: 2877942 - RNA, 12 nt, Mycobacterium avium subsp. paratuberculosis
gugccgccggcg

SEQ ID NO: 2877943 - RNA, 14 nt, Mycobacterium avium subsp. paratuberculosis
gugccgccggcgau

SEQ ID NO: 2877944 - RNA, 16 nt, Mycobacterium avium subsp. paratuberculosis
gugccgccggcgaucu

SEQ ID NO: 2877945 - RNA, 22 nt, Mycobacterium avium subsp. paratuberculosis
gugccgccggcgaucucgucgc

SEQ ID NO: 2877946 - RNA, 13 nt, Mycobacterium avium subsp. paratuberculosis
gugccgccggcgc

SEQ ID NO: 2877947 - RNA, 18 nt, Mycobacterium avium subsp. paratuberculosis
gugccgccgggcaccucg

SEQ ID NO: 2877948 - RNA, 13 nt, Mycobacterium avium subsp. paratuberculosis
gugccgccgggga

SEQ ID NO: 2877949 - RNA, 15 nt, Mycobacterium avium subsp. paratuberculosis
gugccgccggugaac

SEQ ID NO: 2877950 - RNA, 15 nt, Mycobacterium avium subsp. paratuberculosis
gugccgccgucgacg

SEQ ID NO: 2877951 - RNA, 13 nt, Mycobacterium avium subsp. paratuberculosis
gugccgccgugcg

SEQ ID NO: 2877952 - RNA, 13 nt, Mycobacterium avium subsp. paratuberculosis
gugccgccguugc

SEQ ID NO: 2877953 - RNA, 22 nt, Mycobacterium avium subsp. paratuberculosis
gugccgccuugguagaugcguu

SEQ ID NO: 2877954 - RNA, 19 nt, Mycobacterium avium subsp. paratuberculosis
gugccgcgaugcccgccgg

SEQ ID NO: 2877955 - RNA, 20 nt, Mycobacterium avium subsp. paratuberculosis
gugccgcgaugcccgccggc

SEQ ID NO: 2877956 - RNA, 16 nt, Mycobacterium avium subsp. paratuberculosis
gugccgcgcaccaccu

SEQ ID NO: 2877957 - RNA, 17 nt, Mycobacterium avium subsp. paratuberculosis
gugccgcgcaccaccuc

SEQ ID NO: 2877958 - RNA, 14 nt, Mycobacterium avium subsp. paratuberculosis
gugccgcgcagcac

SEQ ID NO: 2877959 - RNA, 15 nt, Mycobacterium avium subsp. paratuberculosis
gugccgcgcggcggu

SEQ ID NO: 2877960 - RNA, 17 nt, Mycobacterium avium subsp. paratuberculosis
gugccgcgcggcgguga

SEQ ID NO: 2877961 - RNA, 12 nt, Mycobacterium avium subsp. paratuberculosis
gugccgcggcgg

SEQ ID NO: 2877962 - RNA, 15 nt, Mycobacterium avium subsp. paratuberculosis
gugccgcggcggcgc

SEQ ID NO: 2877963 - RNA, 17 nt, Mycobacterium avium subsp. paratuberculosis
gugccgcggcggcgccg

SEQ ID NO: 2877964 - RNA, 19 nt, Mycobacterium avium subsp. paratuberculosis
gugccgcggugcggcccgc

SEQ ID NO: 2877965 - RNA, 22 nt, Mycobacterium avium subsp. paratuberculosis
gugccgcggugcggcccgcggc

SEQ ID NO: 2877966 - RNA, 21 nt, Mycobacterium avium subsp. paratuberculosis
gugccgcugcauccgcagcac

SEQ ID NO: 2877967 - RNA, 18 nt, Mycobacterium avium subsp. paratuberculosis
gugccgcugcccgccgcg

SEQ ID NO: 2877968 - RNA, 23 nt, Mycobacterium avium subsp. paratuberculosis
gugccgcugggagcacgugauga

SEQ ID NO: 2877969 - RNA, 20 nt, Mycobacterium avium subsp. paratuberculosis
gugccgcugguaggcggcgc

SEQ ID NO: 2877970 - RNA, 13 nt, Mycobacterium avium subsp. paratuberculosis
gugccggaagcgg

SEQ ID NO: 2877971 - RNA, 19 nt, Mycobacterium avium subsp. paratuberculosis
gugccggaaguucucgccg

SEQ ID NO: 2877972 - RNA, 16 nt, Mycobacterium avium subsp. paratuberculosis
gugccggaccgcgcgg

SEQ ID NO: 2877973 - RNA, 20 nt, Mycobacterium avium subsp. paratuberculosis
gugccggaccgcgcgggcca

SEQ ID NO: 2877974 - RNA, 13 nt, Mycobacterium avium subsp. paratuberculosis
gugccggaggcgg

SEQ ID NO: 2877975 - RNA, 17 nt, Mycobacterium avium subsp. paratuberculosis
gugccggaugcggucga

SEQ ID NO: 2877976 - RNA, 14 nt, Mycobacterium avium subsp. paratuberculosis
gugccggcagcccg

SEQ ID NO: 2877977 - RNA, 15 nt, Mycobacterium avium subsp. paratuberculosis
gugccggcagcccgg

SEQ ID NO: 2877978 - RNA, 16 nt, Mycobacterium avium subsp. paratuberculosis
gugccggccaccggcg

SEQ ID NO: 2877979 - RNA, 23 nt, Mycobacterium avium subsp. paratuberculosis
gugccggccaccggcgcgacggc

SEQ ID NO: 2877980 - RNA, 15 nt, Mycobacterium avium subsp. paratuberculosis
gugccggccagaucg

SEQ ID NO: 2877981 - RNA, 16 nt, Mycobacterium avium subsp. paratuberculosis
gugccggccagaucga

SEQ ID NO: 2877982 - RNA, 20 nt, Mycobacterium avium subsp. paratuberculosis
gugccggccagaucgacgcc

SEQ ID NO: 2877983 - RNA, 21 nt, Mycobacterium avium subsp. paratuberculosis
gugccggccagcucgccgccg

SEQ ID NO: 2877984 - RNA, 15 nt, Mycobacterium avium subsp. paratuberculosis
gugccggcccggcgg

SEQ ID NO: 2877985 - RNA, 16 nt, Mycobacterium avium subsp. paratuberculosis
gugccggcccggcggg

SEQ ID NO: 2877986 - RNA, 12 nt, Mycobacterium avium subsp. paratuberculosis
gugccggccggg

SEQ ID NO: 2877987 - RNA, 13 nt, Mycobacterium avium subsp. paratuberculosis
gugccggccgggu

SEQ ID NO: 2877988 - RNA, 15 nt, Mycobacterium avium subsp. paratuberculosis
gugccggccgggucg

SEQ ID NO: 2877989 - RNA, 16 nt, Mycobacterium avium subsp. paratuberculosis
gugccggccgggucga

SEQ ID NO: 2877990 - RNA, 14 nt, Mycobacterium avium subsp. paratuberculosis
gugccggccggucg

SEQ ID NO: 2877991 - RNA, 16 nt, Mycobacterium avium subsp. paratuberculosis
gugccggccucgucgg

SEQ ID NO: 2877992 - RNA, 14 nt, Mycobacterium avium subsp. paratuberculosis
gugccggcgaaccu

SEQ ID NO: 2877993 - RNA, 13 nt, Mycobacterium avium subsp. paratuberculosis
gugccggcgagug

SEQ ID NO: 2877994 - RNA, 20 nt, Mycobacterium avium subsp. paratuberculosis
gugccggcgagugcgaauca

SEQ ID NO: 2877995 - RNA, 17 nt, Mycobacterium avium subsp. paratuberculosis
gugccggcgcaccgcgu

SEQ ID NO: 2877996 - RNA, 19 nt, Mycobacterium avium subsp. paratuberculosis
gugccggcgcaccgcgucg

SEQ ID NO: 2877997 - RNA, 17 nt, Mycobacterium avium subsp. paratuberculosis
gugccggcgcucgucgu

SEQ ID NO: 2877998 - RNA, 12 nt, Mycobacterium avium subsp. paratuberculosis
gugccggcggcg

SEQ ID NO: 2877999 - RNA, 14 nt, Mycobacterium avium subsp. paratuberculosis
gugccggcggcgcg

SEQ ID NO: 2878000 - RNA, 14 nt, Mycobacterium avium subsp. paratuberculosis
gugccggcggcgga

SEQ ID NO: 2878001 - RNA, 14 nt, Mycobacterium avium subsp. paratuberculosis
gugccggcucggcg

SEQ ID NO: 2878002 - RNA, 18 nt, Mycobacterium avium subsp. paratuberculosis
gugccgggccagcugcuc

SEQ ID NO: 2878003 - RNA, 14 nt, Mycobacterium avium subsp. paratuberculosis
gugccgggccaggu

SEQ ID NO: 2878004 - RNA, 22 nt, Mycobacterium avium subsp. paratuberculosis
gugccgggcgguacgcgccgcg

SEQ ID NO: 2878005 - RNA, 23 nt, Mycobacterium avium subsp. paratuberculosis
gugccgggcgguacgcgccgcgc

SEQ ID NO: 2878006 - RNA, 17 nt, Mycobacterium avium subsp. paratuberculosis
gugccgggggccgagca

SEQ ID NO: 2878007 - RNA, 19 nt, Mycobacterium avium subsp. paratuberculosis
gugccgggucgcagcggca

SEQ ID NO: 2878008 - RNA, 20 nt, Mycobacterium avium subsp. paratuberculosis
gugccgggucgcagcggcac

SEQ ID NO: 2878009 - RNA, 21 nt, Mycobacterium avium subsp. paratuberculosis
gugccgggucgcagcggcacg

SEQ ID NO: 2878010 - RNA, 22 nt, Mycobacterium avium subsp. paratuberculosis
gugccgggugcugaacgccugc

SEQ ID NO: 2878011 - RNA, 16 nt, Mycobacterium avium subsp. paratuberculosis
gugccgguccagccgc

SEQ ID NO: 2878012 - RNA, 23 nt, Mycobacterium avium subsp. paratuberculosis
gugccgguccagccgccgcgugg

SEQ ID NO: 2878013 - RNA, 14 nt, Mycobacterium avium subsp. paratuberculosis
gugccggugaugaa

SEQ ID NO: 2878014 - RNA, 21 nt, Mycobacterium avium subsp. paratuberculosis
gugccgguguugccgacggcg

SEQ ID NO: 2878015 - RNA, 14 nt, Mycobacterium avium subsp. paratuberculosis
gugccgucacgccc

SEQ ID NO: 2878016 - RNA, 14 nt, Mycobacterium avium subsp. paratuberculosis
gugccguccagcuc

SEQ ID NO: 2878017 - RNA, 16 nt, Mycobacterium avium subsp. paratuberculosis
gugccguccagcuccg

SEQ ID NO: 2878018 - RNA, 20 nt, Mycobacterium avium subsp. paratuberculosis
gugccguccagcuccgccga

SEQ ID NO: 2878019 - RNA, 16 nt, Mycobacterium avium subsp. paratuberculosis
gugccguccucggccg

SEQ ID NO: 2878020 - RNA, 18 nt, Mycobacterium avium subsp. paratuberculosis
gugccgucgaucgcccgc

SEQ ID NO: 2878021 - RNA, 12 nt, Mycobacterium avium subsp. paratuberculosis
gugccgucgcgg

SEQ ID NO: 2878022 - RNA, 12 nt, Mycobacterium avium subsp. paratuberculosis
gugccgucggcg

SEQ ID NO: 2878023 - RNA, 15 nt, Mycobacterium avium subsp. paratuberculosis
gugccgucggcgucg

SEQ ID NO: 2878024 - RNA, 16 nt, Mycobacterium avium subsp. paratuberculosis
gugccgucggcgucga

SEQ ID NO: 2878025 - RNA, 20 nt, Mycobacterium avium subsp. paratuberculosis
gugccgucggcgucgacgac

SEQ ID NO: 2878026 - RNA, 19 nt, Mycobacterium avium subsp. paratuberculosis
gugccguggucggugcccu

SEQ ID NO: 2878027 - RNA, 15 nt, Mycobacterium avium subsp. paratuberculosis
gugccguugaccacg

SEQ ID NO: 2878028 - RNA, 18 nt, Mycobacterium avium subsp. paratuberculosis
gugccguugaccacgccc

SEQ ID NO: 2878029 - RNA, 22 nt, Mycobacterium avium subsp. paratuberculosis
gugccguugaucagggcggcgc

SEQ ID NO: 2878030 - RNA, 21 nt, Mycobacterium avium subsp. paratuberculosis
gugccucgccacugggcgucg

SEQ ID NO: 2878031 - RNA, 14 nt, Mycobacterium avium subsp. paratuberculosis
gugccucgcgcauc

SEQ ID NO: 2878032 - RNA, 14 nt, Mycobacterium avium subsp. paratuberculosis
gugccugcgggccc

SEQ ID NO: 2878033 - RNA, 18 nt, Mycobacterium avium subsp. paratuberculosis
gugccugcgggcccagcu

SEQ ID NO: 2878034 - RNA, 17 nt, Mycobacterium avium subsp. paratuberculosis
gugccuggcccagacag

SEQ ID NO: 2878035 - RNA, 23 nt, Mycobacterium avium subsp. paratuberculosis
gugccuggcccagacaggccggc

SEQ ID NO: 2878036 - RNA, 21 nt, Mycobacterium avium subsp. paratuberculosis
gugccugggugcgcggcgccg

SEQ ID NO: 2878037 - RNA, 15 nt, Mycobacterium avium subsp. paratuberculosis
gugccuuacgccggg

SEQ ID NO: 2878038 - RNA, 18 nt, Mycobacterium avium subsp. paratuberculosis
gugcgaaacucaccgcgu

SEQ ID NO: 2878039 - RNA, 20 nt, Mycobacterium avium subsp. paratuberculosis
gugcgaacagccacgguccu

SEQ ID NO: 2878040 - RNA, 14 nt, Mycobacterium avium subsp. paratuberculosis
gugcgaaucgccuu

SEQ ID NO: 2878041 - RNA, 13 nt, Mycobacterium avium subsp. paratuberculosis
gugcgacgcccac

SEQ ID NO: 2878042 - RNA, 14 nt, Mycobacterium avium subsp. paratuberculosis
gugcgacgcccacu

SEQ ID NO: 2878043 - RNA, 14 nt, Mycobacterium avium subsp. paratuberculosis
gugcgacgccgcgc

SEQ ID NO: 2878044 - RNA, 14 nt, Mycobacterium avium subsp. paratuberculosis
gugcgacggcgucg

SEQ ID NO: 2878045 - RNA, 16 nt, Mycobacterium avium subsp. paratuberculosis
gugcgacggcgucggc

SEQ ID NO: 2878046 - RNA, 12 nt, Mycobacterium avium subsp. paratuberculosis
gugcgacggcuc

SEQ ID NO: 2878047 - RNA, 15 nt, Mycobacterium avium subsp. paratuberculosis
gugcgacuugguggc

SEQ ID NO: 2878048 - RNA, 21 nt, Mycobacterium avium subsp. paratuberculosis
gugcgagaaaaucgcccgcga

SEQ ID NO: 2878049 - RNA, 22 nt, Mycobacterium avium subsp. paratuberculosis
gugcgagaaaaucgcccgcgaa

SEQ ID NO: 2878050 - RNA, 14 nt, Mycobacterium avium subsp. paratuberculosis
gugcgagccaccuc

SEQ ID NO: 2878051 - RNA, 16 nt, Mycobacterium avium subsp. paratuberculosis
gugcgagccaccucga

SEQ ID NO: 2878052 - RNA, 21 nt, Mycobacterium avium subsp. paratuberculosis
gugcgagccaccucgaucagc

SEQ ID NO: 2878053 - RNA, 23 nt, Mycobacterium avium subsp. paratuberculosis
gugcgagccaccucgaucagcgg

SEQ ID NO: 2878054 - RNA, 14 nt, Mycobacterium avium subsp. paratuberculosis
gugcgagccgagca

SEQ ID NO: 2878055 - RNA, 13 nt, Mycobacterium avium subsp. paratuberculosis
gugcgaucgccgu

SEQ ID NO: 2878056 - RNA, 15 nt, Mycobacterium avium subsp. paratuberculosis
gugcgaucgccguga

SEQ ID NO: 2878057 - RNA, 19 nt, Mycobacterium avium subsp. paratuberculosis
gugcgauggcaacgccggu

SEQ ID NO: 2878058 - RNA, 13 nt, Mycobacterium avium subsp. paratuberculosis
gugcgcaccagca

SEQ ID NO: 2878059 - RNA, 16 nt, Mycobacterium avium subsp. paratuberculosis
gugcgcaccagcaggu

SEQ ID NO: 2878060 - RNA, 13 nt, Mycobacterium avium subsp. paratuberculosis
gugcgcaccgaca

SEQ ID NO: 2878061 - RNA, 17 nt, Mycobacterium avium subsp. paratuberculosis
gugcgcacgaacggcgc

SEQ ID NO: 2878062 - RNA, 13 nt, Mycobacterium avium subsp. paratuberculosis
gugcgcagccguc

SEQ ID NO: 2878063 - RNA, 12 nt, Mycobacterium avium subsp. paratuberculosis
gugcgcagcgcg

SEQ ID NO: 2878064 - RNA, 19 nt, Mycobacterium avium subsp. paratuberculosis
gugcgcagcgcgucgucgg

SEQ ID NO: 2878065 - RNA, 13 nt, Mycobacterium avium subsp. paratuberculosis
gugcgcaggcggc

SEQ ID NO: 2878066 - RNA, 15 nt, Mycobacterium avium subsp. paratuberculosis
gugcgcaggcggcgc

SEQ ID NO: 2878067 - RNA, 19 nt, Mycobacterium avium subsp. paratuberculosis
gugcgcaggcggcgcgcag

SEQ ID NO: 2878068 - RNA, 17 nt, Mycobacterium avium subsp. paratuberculosis
gugcgcagucgcugguc

SEQ ID NO: 2878069 - RNA, 19 nt, Mycobacterium avium subsp. paratuberculosis
gugcgcagucgcuggucga

SEQ ID NO: 2878070 - RNA, 21 nt, Mycobacterium avium subsp. paratuberculosis
gugcgcaguucgggaucgucg

SEQ ID NO: 2878071 - RNA, 16 nt, Mycobacterium avium subsp. paratuberculosis
gugcgcaucggcgacg

SEQ ID NO: 2878072 - RNA, 18 nt, Mycobacterium avium subsp. paratuberculosis
gugcgcaucggcgacgcc

SEQ ID NO: 2878073 - RNA, 16 nt, Mycobacterium avium subsp. paratuberculosis
gugcgcauucggcgac

SEQ ID NO: 2878074 - RNA, 14 nt, Mycobacterium avium subsp. paratuberculosis
gugcgccacgcccg

SEQ ID NO: 2878075 - RNA, 15 nt, Mycobacterium avium subsp. paratuberculosis
gugcgccacgcccgc

SEQ ID NO: 2878076 - RNA, 19 nt, Mycobacterium avium subsp. paratuberculosis
gugcgccacgcccgcagcg

SEQ ID NO: 2878077 - RNA, 14 nt, Mycobacterium avium subsp. paratuberculosis
gugcgccagaucag

SEQ ID NO: 2878078 - RNA, 16 nt, Mycobacterium avium subsp. paratuberculosis
gugcgccagaucagcg

SEQ ID NO: 2878079 - RNA, 17 nt, Mycobacterium avium subsp. paratuberculosis
gugcgccagcgaccgca

SEQ ID NO: 2878080 - RNA, 23 nt, Mycobacterium avium subsp. paratuberculosis
gugcgccagcgaccgcaggucga

SEQ ID NO: 2878081 - RNA, 15 nt, Mycobacterium avium subsp. paratuberculosis
gugcgccagcgugaa

SEQ ID NO: 2878082 - RNA, 17 nt, Mycobacterium avium subsp. paratuberculosis
gugcgccaggcaggcgg

SEQ ID NO: 2878083 - RNA, 21 nt, Mycobacterium avium subsp. paratuberculosis
gugcgccaggcaggcggccag

SEQ ID NO: 2878084 - RNA, 20 nt, Mycobacterium avium subsp. paratuberculosis
gugcgccauguccggcaggc

SEQ ID NO: 2878085 - RNA, 17 nt, Mycobacterium avium subsp. paratuberculosis
gugcgcccauccggcgc

SEQ ID NO: 2878086 - RNA, 19 nt, Mycobacterium avium subsp. paratuberculosis
gugcgcccauccggcgccg

SEQ ID NO: 2878087 - RNA, 15 nt, Mycobacterium avium subsp. paratuberculosis
gugcgccccacggcg

SEQ ID NO: 2878088 - RNA, 16 nt, Mycobacterium avium subsp. paratuberculosis
gugcgccccacggcgc

SEQ ID NO: 2878089 - RNA, 18 nt, Mycobacterium avium subsp. paratuberculosis
gugcgccccacggcgcgu

SEQ ID NO: 2878090 - RNA, 12 nt, Mycobacterium avium subsp. paratuberculosis
gugcgcccgacg

SEQ ID NO: 2878091 - RNA, 13 nt, Mycobacterium avium subsp. paratuberculosis
gugcgcccgacgc

SEQ ID NO: 2878092 - RNA, 18 nt, Mycobacterium avium subsp. paratuberculosis
gugcgcccgacgccggac

SEQ ID NO: 2878093 - RNA, 20 nt, Mycobacterium avium subsp. paratuberculosis
gugcgcccgacgccggaccc

SEQ ID NO: 2878094 - RNA, 19 nt, Mycobacterium avium subsp. paratuberculosis
gugcgcccgcgaucaacac

SEQ ID NO: 2878095 - RNA, 15 nt, Mycobacterium avium subsp. paratuberculosis
gugcgcccggccagc

SEQ ID NO: 2878096 - RNA, 15 nt, Mycobacterium avium subsp. paratuberculosis
gugcgcccgucgucg

SEQ ID NO: 2878097 - RNA, 16 nt, Mycobacterium avium subsp. paratuberculosis
gugcgccgaccgcgau

SEQ ID NO: 2878098 - RNA, 14 nt, Mycobacterium avium subsp. paratuberculosis
gugcgccgcccaca

SEQ ID NO: 2878099 - RNA, 14 nt, Mycobacterium avium subsp. paratuberculosis
gugcgccgccgcgu

SEQ ID NO: 2878100 - RNA, 11 nt, Mycobacterium avium subsp. paratuberculosis
gugcgccgcgg

SEQ ID NO: 2878101 - RNA, 17 nt, Mycobacterium avium subsp. paratuberculosis
gugcgccgcggcggcuc

SEQ ID NO: 2878102 - RNA, 11 nt, Mycobacterium avium subsp. paratuberculosis
gugcgccggca

SEQ ID NO: 2878103 - RNA, 13 nt, Mycobacterium avium subsp. paratuberculosis
gugcgccggcagc

SEQ ID NO: 2878104 - RNA, 13 nt, Mycobacterium avium subsp. paratuberculosis
gugcgccggcggu

SEQ ID NO: 2878105 - RNA, 23 nt, Mycobacterium avium subsp. paratuberculosis
gugcgccggcggugcggcggggu

SEQ ID NO: 2878106 - RNA, 18 nt, Mycobacterium avium subsp. paratuberculosis
gugcgccgggucgcggug

SEQ ID NO: 2878107 - RNA, 18 nt, Mycobacterium avium subsp. paratuberculosis
gugcgccgugcagcacgc

SEQ ID NO: 2878108 - RNA, 21 nt, Mycobacterium avium subsp. paratuberculosis
gugcgccucgaucaacgccgg

SEQ ID NO: 2878109 - RNA, 20 nt, Mycobacterium avium subsp. paratuberculosis
gugcgccuugccgucgagca

SEQ ID NO: 2878110 - RNA, 24 nt, Mycobacterium avium subsp. paratuberculosis
gugcgcgacgaauugcagauccag

SEQ ID NO: 2878111 - RNA, 18 nt, Mycobacterium avium subsp. paratuberculosis
gugcgcgaguaggcgaag

SEQ ID NO: 2878112 - RNA, 18 nt, Mycobacterium avium subsp. paratuberculosis
gugcgcgauggcgugccg

SEQ ID NO: 2878113 - RNA, 22 nt, Mycobacterium avium subsp. paratuberculosis
gugcgcgauggcgugccggcgc

SEQ ID NO: 2878114 - RNA, 17 nt, Mycobacterium avium subsp. paratuberculosis
gugcgcgccgaccgcga

SEQ ID NO: 2878115 - RNA, 20 nt, Mycobacterium avium subsp. paratuberculosis
gugcgcgccgaccgcgagca

SEQ ID NO: 2878116 - RNA, 12 nt, Mycobacterium avium subsp. paratuberculosis
gugcgcgccgca

SEQ ID NO: 2878117 - RNA, 13 nt, Mycobacterium avium subsp. paratuberculosis
gugcgcgcgcacc

SEQ ID NO: 2878118 - RNA, 16 nt, Mycobacterium avium subsp. paratuberculosis
gugcgcgcgcaccuga

SEQ ID NO: 2878119 - RNA, 13 nt, Mycobacterium avium subsp. paratuberculosis
gugcgcgcgcgcu

SEQ ID NO: 2878120 - RNA, 19 nt, Mycobacterium avium subsp. paratuberculosis
gugcgcgcgcgcucggcgu

SEQ ID NO: 2878121 - RNA, 21 nt, Mycobacterium avium subsp. paratuberculosis
gugcgcgcgcgcucggcguug

SEQ ID NO: 2878122 - RNA, 14 nt, Mycobacterium avium subsp. paratuberculosis
gugcgcgcuggccg

SEQ ID NO: 2878123 - RNA, 14 nt, Mycobacterium avium subsp. paratuberculosis
gugcgcgcuggugc

SEQ ID NO: 2878124 - RNA, 13 nt, Mycobacterium avium subsp. paratuberculosis
gugcgcggcgaag

SEQ ID NO: 2878125 - RNA, 14 nt, Mycobacterium avium subsp. paratuberculosis
gugcgcggcgagcg

SEQ ID NO: 2878126 - RNA, 13 nt, Mycobacterium avium subsp. paratuberculosis
gugcgcgggaacg

SEQ ID NO: 2878127 - RNA, 15 nt, Mycobacterium avium subsp. paratuberculosis
gugcgcgggaacgau

SEQ ID NO: 2878128 - RNA, 20 nt, Mycobacterium avium subsp. paratuberculosis
gugcgcgggaacgaucggcu

SEQ ID NO: 2878129 - RNA, 23 nt, Mycobacterium avium subsp. paratuberculosis
gugcgcgggaacgaucggcucca

SEQ ID NO: 2878130 - RNA, 14 nt, Mycobacterium avium subsp. paratuberculosis
gugcgcgggcgaaa

SEQ ID NO: 2878131 - RNA, 16 nt, Mycobacterium avium subsp. paratuberculosis
gugcgcgggcgcccgu

SEQ ID NO: 2878132 - RNA, 20 nt, Mycobacterium avium subsp. paratuberculosis
gugcgcgggguggcgccggc

SEQ ID NO: 2878133 - RNA, 16 nt, Mycobacterium avium subsp. paratuberculosis
gugcgcggucagcgcg

SEQ ID NO: 2878134 - RNA, 21 nt, Mycobacterium avium subsp. paratuberculosis
gugcgcgucagccgucgucgu

SEQ ID NO: 2878135 - RNA, 19 nt, Mycobacterium avium subsp. paratuberculosis
gugcgcgucgacaccccgc

SEQ ID NO: 2878136 - RNA, 13 nt, Mycobacterium avium subsp. paratuberculosis
gugcgcgucgcgg

SEQ ID NO: 2878137 - RNA, 14 nt, Mycobacterium avium subsp. paratuberculosis
gugcgcgucgcggu

SEQ ID NO: 2878138 - RNA, 16 nt, Mycobacterium avium subsp. paratuberculosis
gugcgcgucgcggugg

SEQ ID NO: 2878139 - RNA, 13 nt, Mycobacterium avium subsp. paratuberculosis
gugcgcuccucga

SEQ ID NO: 2878140 - RNA, 19 nt, Mycobacterium avium subsp. paratuberculosis
gugcgcucgaccucggcgg

SEQ ID NO: 2878141 - RNA, 16 nt, Mycobacterium avium subsp. paratuberculosis
gugcgcucgacggccu

SEQ ID NO: 2878142 - RNA, 20 nt, Mycobacterium avium subsp. paratuberculosis
gugcgcucgugaccggcggu

SEQ ID NO: 2878143 - RNA, 19 nt, Mycobacterium avium subsp. paratuberculosis
gugcgcugcagcgagaccu

SEQ ID NO: 2878144 - RNA, 16 nt, Mycobacterium avium subsp. paratuberculosis
gugcgcuguggugacg

SEQ ID NO: 2878145 - RNA, 20 nt, Mycobacterium avium subsp. paratuberculosis
gugcgcuugggucgccgggu

SEQ ID NO: 2878146 - RNA, 16 nt, Mycobacterium avium subsp. paratuberculosis
gugcgcuugucggcgu

SEQ ID NO: 2878147 - RNA, 18 nt, Mycobacterium avium subsp. paratuberculosis
gugcgcuugucggcgugg

SEQ ID NO: 2878148 - RNA, 14 nt, Mycobacterium avium subsp. paratuberculosis
gugcggaacaccgc

SEQ ID NO: 2878149 - RNA, 15 nt, Mycobacterium avium subsp. paratuberculosis
gugcggaacaccgcc

SEQ ID NO: 2878150 - RNA, 21 nt, Mycobacterium avium subsp. paratuberculosis
gugcggaaggcccccggcucg

SEQ ID NO: 2878151 - RNA, 18 nt, Mycobacterium avium subsp. paratuberculosis
gugcggacggucgccgac

SEQ ID NO: 2878152 - RNA, 23 nt, Mycobacterium avium subsp. paratuberculosis
gugcggaugaagugcgccagcga

SEQ ID NO: 2878153 - RNA, 23 nt, Mycobacterium avium subsp. paratuberculosis
gugcggaugcugaccaaggccga

SEQ ID NO: 2878154 - RNA, 16 nt, Mycobacterium avium subsp. paratuberculosis
gugcggauggccccgg

SEQ ID NO: 2878155 - RNA, 20 nt, Mycobacterium avium subsp. paratuberculosis
gugcggcaacccgaucgccg

SEQ ID NO: 2878156 - RNA, 17 nt, Mycobacterium avium subsp. paratuberculosis
gugcggcaccuccagcc

SEQ ID NO: 2878157 - RNA, 23 nt, Mycobacterium avium subsp. paratuberculosis
gugcggcacgauggacgcccaac

SEQ ID NO: 2878158 - RNA, 16 nt, Mycobacterium avium subsp. paratuberculosis
gugcggcacgccgcag

SEQ ID NO: 2878159 - RNA, 16 nt, Mycobacterium avium subsp. paratuberculosis
gugcggcagcucggcg

SEQ ID NO: 2878160 - RNA, 17 nt, Mycobacterium avium subsp. paratuberculosis
gugcggcagcucggcgg

SEQ ID NO: 2878161 - RNA, 19 nt, Mycobacterium avium subsp. paratuberculosis
gugcggcagcucggcggcc

SEQ ID NO: 2878162 - RNA, 15 nt, Mycobacterium avium subsp. paratuberculosis
gugcggccagcgcag

SEQ ID NO: 2878163 - RNA, 17 nt, Mycobacterium avium subsp. paratuberculosis
gugcggccagcgcaggu

SEQ ID NO: 2878164 - RNA, 13 nt, Mycobacterium avium subsp. paratuberculosis
gugcggcccgccg

SEQ ID NO: 2878165 - RNA, 14 nt, Mycobacterium avium subsp. paratuberculosis
gugcggcccgccgg

SEQ ID NO: 2878166 - RNA, 13 nt, Mycobacterium avium subsp. paratuberculosis
gugcggcccgcgg

SEQ ID NO: 2878167 - RNA, 22 nt, Mycobacterium avium subsp. paratuberculosis
gugcggcccgcggcaucgucgg

SEQ ID NO: 2878168 - RNA, 22 nt, Mycobacterium avium subsp. paratuberculosis
gugcggccgcauuuggcguaac

SEQ ID NO: 2878169 - RNA, 15 nt, Mycobacterium avium subsp. paratuberculosis
gugcggccgcgaucg

SEQ ID NO: 2878170 - RNA, 18 nt, Mycobacterium avium subsp. paratuberculosis
gugcggccgcgaucgcca

SEQ ID NO: 2878171 - RNA, 19 nt, Mycobacterium avium subsp. paratuberculosis
gugcggcgccgcccggcga

SEQ ID NO: 2878172 - RNA, 14 nt, Mycobacterium avium subsp. paratuberculosis
gugcggcgcggcgg

SEQ ID NO: 2878173 - RNA, 21 nt, Mycobacterium avium subsp. paratuberculosis
gugcggcgcggugcgccgaca

SEQ ID NO: 2878174 - RNA, 15 nt, Mycobacterium avium subsp. paratuberculosis
gugcggcgcucggug

SEQ ID NO: 2878175 - RNA, 17 nt, Mycobacterium avium subsp. paratuberculosis
gugcggcgcugccggcg

SEQ ID NO: 2878176 - RNA, 19 nt, Mycobacterium avium subsp. paratuberculosis
gugcggcgcugccggcgca

SEQ ID NO: 2878177 - RNA, 13 nt, Mycobacterium avium subsp. paratuberculosis
gugcggcggcggc

SEQ ID NO: 2878178 - RNA, 13 nt, Mycobacterium avium subsp. paratuberculosis
gugcggcggcucg

SEQ ID NO: 2878179 - RNA, 16 nt, Mycobacterium avium subsp. paratuberculosis
gugcggcggggccucg

SEQ ID NO: 2878180 - RNA, 13 nt, Mycobacterium avium subsp. paratuberculosis
gugcggcggugac

SEQ ID NO: 2878181 - RNA, 19 nt, Mycobacterium avium subsp. paratuberculosis
gugcggcguucggugcccg

SEQ ID NO: 2878182 - RNA, 20 nt, Mycobacterium avium subsp. paratuberculosis
gugcggcguucggugcccgg

SEQ ID NO: 2878183 - RNA, 18 nt, Mycobacterium avium subsp. paratuberculosis
gugcggcuugcccguucg

SEQ ID NO: 2878184 - RNA, 20 nt, Mycobacterium avium subsp. paratuberculosis
gugcggcuugcccguucgau

SEQ ID NO: 2878185 - RNA, 18 nt, Mycobacterium avium subsp. paratuberculosis
gugcgggaugccgagcag

SEQ ID NO: 2878186 - RNA, 21 nt, Mycobacterium avium subsp. paratuberculosis
gugcgggcaucggcuggucgg

SEQ ID NO: 2878187 - RNA, 14 nt, Mycobacterium avium subsp. paratuberculosis
gugcgggccagcac

SEQ ID NO: 2878188 - RNA, 15 nt, Mycobacterium avium subsp. paratuberculosis
gugcgggccagcacg

SEQ ID NO: 2878189 - RNA, 17 nt, Mycobacterium avium subsp. paratuberculosis
gugcgggccagcagccg

SEQ ID NO: 2878190 - RNA, 19 nt, Mycobacterium avium subsp. paratuberculosis
gugcgggccagcagccgcg

SEQ ID NO: 2878191 - RNA, 23 nt, Mycobacterium avium subsp. paratuberculosis
gugcgggcguccuugaccagcug

SEQ ID NO: 2878192 - RNA, 15 nt, Mycobacterium avium subsp. paratuberculosis
gugcgggcuccgcac

SEQ ID NO: 2878193 - RNA, 23 nt, Mycobacterium avium subsp. paratuberculosis
gugcgggcucgauguugaucgcc

SEQ ID NO: 2878194 - RNA, 15 nt, Mycobacterium avium subsp. paratuberculosis
gugcgggcugcacca

SEQ ID NO: 2878195 - RNA, 21 nt, Mycobacterium avium subsp. paratuberculosis
gugcgggcugcaccagggcgu

SEQ ID NO: 2878196 - RNA, 23 nt, Mycobacterium avium subsp. paratuberculosis
gugcgggcugcaccagggcgucg

SEQ ID NO: 2878197 - RNA, 23 nt, Mycobacterium avium subsp. paratuberculosis
gugcggggccucgucgccgcggu

SEQ ID NO: 2878198 - RNA, 15 nt, Mycobacterium avium subsp. paratuberculosis
gugcgggucgcgcgg

SEQ ID NO: 2878199 - RNA, 22 nt, Mycobacterium avium subsp. paratuberculosis
gugcgggucgguggugaucgcg

SEQ ID NO: 2878200 - RNA, 18 nt, Mycobacterium avium subsp. paratuberculosis
gugcgggugaggccaggc

SEQ ID NO: 2878201 - RNA, 16 nt, Mycobacterium avium subsp. paratuberculosis
gugcgggugccgaaca

SEQ ID NO: 2878202 - RNA, 17 nt, Mycobacterium avium subsp. paratuberculosis
gugcgggugcggccggu

SEQ ID NO: 2878203 - RNA, 16 nt, Mycobacterium avium subsp. paratuberculosis
gugcggguguccgagc

SEQ ID NO: 2878204 - RNA, 18 nt, Mycobacterium avium subsp. paratuberculosis
gugcggguuggcgccggu

SEQ ID NO: 2878205 - RNA, 17 nt, Mycobacterium avium subsp. paratuberculosis
gugcgguaggugccggc

SEQ ID NO: 2878206 - RNA, 20 nt, Mycobacterium avium subsp. paratuberculosis
gugcgguaggugccggccgc

SEQ ID NO: 2878207 - RNA, 15 nt, Mycobacterium avium subsp. paratuberculosis
gugcggucagcuccc

SEQ ID NO: 2878208 - RNA, 15 nt, Mycobacterium avium subsp. paratuberculosis
gugcggucccggucg

SEQ ID NO: 2878209 - RNA, 17 nt, Mycobacterium avium subsp. paratuberculosis
gugcggucgaugacgcc

SEQ ID NO: 2878210 - RNA, 21 nt, Mycobacterium avium subsp. paratuberculosis
gugcggucgaugacgccgcgc

SEQ ID NO: 2878211 - RNA, 12 nt, Mycobacterium avium subsp. paratuberculosis
gugcggucgcgc

SEQ ID NO: 2878212 - RNA, 13 nt, Mycobacterium avium subsp. paratuberculosis
gugcggucgcgca

SEQ ID NO: 2878213 - RNA, 15 nt, Mycobacterium avium subsp. paratuberculosis
gugcggucgcgggac

SEQ ID NO: 2878214 - RNA, 16 nt, Mycobacterium avium subsp. paratuberculosis
gugcggucgcgggaca

SEQ ID NO: 2878215 - RNA, 15 nt, Mycobacterium avium subsp. paratuberculosis
gugcggucggcgacg

SEQ ID NO: 2878216 - RNA, 13 nt, Mycobacterium avium subsp. paratuberculosis
gugcggucggcgu

SEQ ID NO: 2878217 - RNA, 22 nt, Mycobacterium avium subsp. paratuberculosis
gugcggucggcgucguacagca

SEQ ID NO: 2878218 - RNA, 17 nt, Mycobacterium avium subsp. paratuberculosis
gugcggugcaccgcggc

SEQ ID NO: 2878219 - RNA, 15 nt, Mycobacterium avium subsp. paratuberculosis
gugcggugcgccgca

SEQ ID NO: 2878220 - RNA, 15 nt, Mycobacterium avium subsp. paratuberculosis
gugcggugcggccgc

SEQ ID NO: 2878221 - RNA, 16 nt, Mycobacterium avium subsp. paratuberculosis
gugcggugcggccgcg

SEQ ID NO: 2878222 - RNA, 18 nt, Mycobacterium avium subsp. paratuberculosis
gugcggugcggccgcgca

SEQ ID NO: 2878223 - RNA, 16 nt, Mycobacterium avium subsp. paratuberculosis
gugcgguggucggcgu

SEQ ID NO: 2878224 - RNA, 12 nt, Mycobacterium avium subsp. paratuberculosis
gugcggugucau

SEQ ID NO: 2878225 - RNA, 15 nt, Mycobacterium avium subsp. paratuberculosis
gugcgguucacgcgg

SEQ ID NO: 2878226 - RNA, 17 nt, Mycobacterium avium subsp. paratuberculosis
gugcgguucacgcggcu

SEQ ID NO: 2878227 - RNA, 18 nt, Mycobacterium avium subsp. paratuberculosis
gugcgguucacgcggcug

SEQ ID NO: 2878228 - RNA, 17 nt, Mycobacterium avium subsp. paratuberculosis
gugcgguugagcaccag

SEQ ID NO: 2878229 - RNA, 18 nt, Mycobacterium avium subsp. paratuberculosis
gugcgguuggcccgcggc

SEQ ID NO: 2878230 - RNA, 20 nt, Mycobacterium avium subsp. paratuberculosis
gugcgguuggcccgcggcgc

SEQ ID NO: 2878231 - RNA, 19 nt, Mycobacterium avium subsp. paratuberculosis
gugcgucacgcuggugacg

SEQ ID NO: 2878232 - RNA, 17 nt, Mycobacterium avium subsp. paratuberculosis
gugcgucagaaccgggg

SEQ ID NO: 2878233 - RNA, 18 nt, Mycobacterium avium subsp. paratuberculosis
gugcgucagaaccggggc

SEQ ID NO: 2878234 - RNA, 19 nt, Mycobacterium avium subsp. paratuberculosis
gugcgucagaaccggggcc

SEQ ID NO: 2878235 - RNA, 23 nt, Mycobacterium avium subsp. paratuberculosis
gugcgucagaaccggggccagca

SEQ ID NO: 2878236 - RNA, 15 nt, Mycobacterium avium subsp. paratuberculosis
gugcgucaucgcgcu

SEQ ID NO: 2878237 - RNA, 12 nt, Mycobacterium avium subsp. paratuberculosis
gugcguccagac

SEQ ID NO: 2878238 - RNA, 22 nt, Mycobacterium avium subsp. paratuberculosis
gugcguccagaccggccggggc

SEQ ID NO: 2878239 - RNA, 20 nt, Mycobacterium avium subsp. paratuberculosis
gugcguccaggacucggggu

SEQ ID NO: 2878240 - RNA, 16 nt, Mycobacterium avium subsp. paratuberculosis
gugcgucuuuucccac

SEQ ID NO: 2878241 - RNA, 14 nt, Mycobacterium avium subsp. paratuberculosis
gugcgugaccugcu

SEQ ID NO: 2878242 - RNA, 15 nt, Mycobacterium avium subsp. paratuberculosis
gugcgugaccugcug

SEQ ID NO: 2878243 - RNA, 16 nt, Mycobacterium avium subsp. paratuberculosis
gugcgugaccugcugg

SEQ ID NO: 2878244 - RNA, 22 nt, Mycobacterium avium subsp. paratuberculosis
gugcgugacgggcugauccgcg

SEQ ID NO: 2878245 - RNA, 20 nt, Mycobacterium avium subsp. paratuberculosis
gugcgugaugaccagggccu

SEQ ID NO: 2878246 - RNA, 14 nt, Mycobacterium avium subsp. paratuberculosis
gugcgugccagcag

SEQ ID NO: 2878247 - RNA, 16 nt, Mycobacterium avium subsp. paratuberculosis
gugcgugccagcagcu

SEQ ID NO: 2878248 - RNA, 21 nt, Mycobacterium avium subsp. paratuberculosis
gugcgugccagcagcucgugg

SEQ ID NO: 2878249 - RNA, 12 nt, Mycobacterium avium subsp. paratuberculosis
gugcgugcgcuc

SEQ ID NO: 2878250 - RNA, 16 nt, Mycobacterium avium subsp. paratuberculosis
gugcgugguggggccg

SEQ ID NO: 2878251 - RNA, 20 nt, Mycobacterium avium subsp. paratuberculosis
gugcgugucacuacccgcga

SEQ ID NO: 2878252 - RNA, 20 nt, Mycobacterium avium subsp. paratuberculosis
gugcguuccagguccgcggu

SEQ ID NO: 2878253 - RNA, 14 nt, Mycobacterium avium subsp. paratuberculosis
gugcguucgcguuc

SEQ ID NO: 2878254 - RNA, 19 nt, Mycobacterium avium subsp. paratuberculosis
gugcguuuucggucguagu

SEQ ID NO: 2878255 - RNA, 16 nt, Mycobacterium avium subsp. paratuberculosis
gugcuacugccgacgc

SEQ ID NO: 2878256 - RNA, 15 nt, Mycobacterium avium subsp. paratuberculosis
gugcuagcgagcggg

SEQ ID NO: 2878257 - RNA, 14 nt, Mycobacterium avium subsp. paratuberculosis
gugcucagccgcac

SEQ ID NO: 2878258 - RNA, 16 nt, Mycobacterium avium subsp. paratuberculosis
gugcucagccgcacgg

SEQ ID NO: 2878259 - RNA, 20 nt, Mycobacterium avium subsp. paratuberculosis
gugcucaucuacgucgucgc

SEQ ID NO: 2878260 - RNA, 22 nt, Mycobacterium avium subsp. paratuberculosis
gugcucaucuacgucgucgccg

SEQ ID NO: 2878261 - RNA, 17 nt, Mycobacterium avium subsp. paratuberculosis
gugcuccagcaggcgcg

SEQ ID NO: 2878262 - RNA, 14 nt, Mycobacterium avium subsp. paratuberculosis
gugcucccagcuca

SEQ ID NO: 2878263 - RNA, 23 nt, Mycobacterium avium subsp. paratuberculosis
gugcucccagcucagacugccga

SEQ ID NO: 2878264 - RNA, 18 nt, Mycobacterium avium subsp. paratuberculosis
gugcucccccggaccugc

SEQ ID NO: 2878265 - RNA, 15 nt, Mycobacterium avium subsp. paratuberculosis
gugcucccgccgaga

SEQ ID NO: 2878266 - RNA, 19 nt, Mycobacterium avium subsp. paratuberculosis
gugcucgacggcacccggc

SEQ ID NO: 2878267 - RNA, 15 nt, Mycobacterium avium subsp. paratuberculosis
gugcucgagcucggc

SEQ ID NO: 2878268 - RNA, 13 nt, Mycobacterium avium subsp. paratuberculosis
gugcucgaucgcg

SEQ ID NO: 2878269 - RNA, 15 nt, Mycobacterium avium subsp. paratuberculosis
gugcucgaucggcgc

SEQ ID NO: 2878270 - RNA, 16 nt, Mycobacterium avium subsp. paratuberculosis
gugcucgaucggcgcg

SEQ ID NO: 2878271 - RNA, 15 nt, Mycobacterium avium subsp. paratuberculosis
gugcucgauggccag

SEQ ID NO: 2878272 - RNA, 20 nt, Mycobacterium avium subsp. paratuberculosis
gugcucgauggccagcgcgu

SEQ ID NO: 2878273 - RNA, 15 nt, Mycobacterium avium subsp. paratuberculosis
gugcucgccggcgcg

SEQ ID NO: 2878274 - RNA, 16 nt, Mycobacterium avium subsp. paratuberculosis
gugcucgccggcgcgg

SEQ ID NO: 2878275 - RNA, 22 nt, Mycobacterium avium subsp. paratuberculosis
gugcucgccggcgcggaacagc

SEQ ID NO: 2878276 - RNA, 14 nt, Mycobacterium avium subsp. paratuberculosis
gugcucgcgcagca

SEQ ID NO: 2878277 - RNA, 14 nt, Mycobacterium avium subsp. paratuberculosis
gugcucgcgccggg

SEQ ID NO: 2878278 - RNA, 16 nt, Mycobacterium avium subsp. paratuberculosis
gugcucgcgccgggcg

SEQ ID NO: 2878279 - RNA, 18 nt, Mycobacterium avium subsp. paratuberculosis
gugcucgcgccgggcggc

SEQ ID NO: 2878280 - RNA, 12 nt, Mycobacterium avium subsp. paratuberculosis
gugcucgcgcuc

SEQ ID NO: 2878281 - RNA, 19 nt, Mycobacterium avium subsp. paratuberculosis
gugcucggccacgacgcgc

SEQ ID NO: 2878282 - RNA, 20 nt, Mycobacterium avium subsp. paratuberculosis
gugcucggccacgacgcgcc

SEQ ID NO: 2878283 - RNA, 15 nt, Mycobacterium avium subsp. paratuberculosis
gugcucggcgagcac

SEQ ID NO: 2878284 - RNA, 21 nt, Mycobacterium avium subsp. paratuberculosis
gugcucggcgagcaccgugcc

SEQ ID NO: 2878285 - RNA, 15 nt, Mycobacterium avium subsp. paratuberculosis
gugcucggcgcgcgg

SEQ ID NO: 2878286 - RNA, 16 nt, Mycobacterium avium subsp. paratuberculosis
gugcucggcgcgcggg

SEQ ID NO: 2878287 - RNA, 14 nt, Mycobacterium avium subsp. paratuberculosis
gugcucggcggccg

SEQ ID NO: 2878288 - RNA, 15 nt, Mycobacterium avium subsp. paratuberculosis
gugcucggcggcggg

SEQ ID NO: 2878289 - RNA, 19 nt, Mycobacterium avium subsp. paratuberculosis
gugcucggcgucccgcgcc

SEQ ID NO: 2878290 - RNA, 20 nt, Mycobacterium avium subsp. paratuberculosis
gugcucggcgucccgcgcca

SEQ ID NO: 2878291 - RNA, 19 nt, Mycobacterium avium subsp. paratuberculosis
gugcucgggagugacguug

SEQ ID NO: 2878292 - RNA, 15 nt, Mycobacterium avium subsp. paratuberculosis
gugcucggugaucca

SEQ ID NO: 2878293 - RNA, 20 nt, Mycobacterium avium subsp. paratuberculosis
gugcucggugauccacgcgg

SEQ ID NO: 2878294 - RNA, 22 nt, Mycobacterium avium subsp. paratuberculosis
gugcucgucgagcauccggcgc

SEQ ID NO: 2878295 - RNA, 23 nt, Mycobacterium avium subsp. paratuberculosis
gugcucgucgagcauccggcgca

SEQ ID NO: 2878296 - RNA, 15 nt, Mycobacterium avium subsp. paratuberculosis
gugcucgucgcggag

SEQ ID NO: 2878297 - RNA, 17 nt, Mycobacterium avium subsp. paratuberculosis
gugcucgucgcggagga

SEQ ID NO: 2878298 - RNA, 14 nt, Mycobacterium avium subsp. paratuberculosis
gugcucgucggcgg

SEQ ID NO: 2878299 - RNA, 19 nt, Mycobacterium avium subsp. paratuberculosis
gugcucgucggcgggcacc

SEQ ID NO: 2878300 - RNA, 17 nt, Mycobacterium avium subsp. paratuberculosis
gugcucuugacggccgc

SEQ ID NO: 2878301 - RNA, 17 nt, Mycobacterium avium subsp. paratuberculosis
gugcucuuggugguggu

SEQ ID NO: 2878302 - RNA, 23 nt, Mycobacterium avium subsp. paratuberculosis
gugcugaacgccugccggcgccg

SEQ ID NO: 2878303 - RNA, 16 nt, Mycobacterium avium subsp. paratuberculosis
gugcugacccagcgcg

SEQ ID NO: 2878304 - RNA, 17 nt, Mycobacterium avium subsp. paratuberculosis
gugcugacccagcgcgg

SEQ ID NO: 2878305 - RNA, 20 nt, Mycobacterium avium subsp. paratuberculosis
gugcugacccagcgcggggg

SEQ ID NO: 2878306 - RNA, 15 nt, Mycobacterium avium subsp. paratuberculosis
gugcugacccggucg

SEQ ID NO: 2878307 - RNA, 15 nt, Mycobacterium avium subsp. paratuberculosis
gugcugacgucgucg

SEQ ID NO: 2878308 - RNA, 16 nt, Mycobacterium avium subsp. paratuberculosis
gugcugacgucgucgc

SEQ ID NO: 2878309 - RNA, 15 nt, Mycobacterium avium subsp. paratuberculosis
gugcugauccacgcc

SEQ ID NO: 2878310 - RNA, 24 nt, Mycobacterium avium subsp. paratuberculosis
gugcugcagaccgaacgucacggc

SEQ ID NO: 2878311 - RNA, 21 nt, Mycobacterium avium subsp. paratuberculosis
gugcugcagauccgcucgccg

SEQ ID NO: 2878312 - RNA, 14 nt, Mycobacterium avium subsp. paratuberculosis
gugcugcagcgcga

SEQ ID NO: 2878313 - RNA, 22 nt, Mycobacterium avium subsp. paratuberculosis
gugcugcagcgcgaggcgcagu

SEQ ID NO: 2878314 - RNA, 23 nt, Mycobacterium avium subsp. paratuberculosis
gugcugcagguugauccggaucc

SEQ ID NO: 2878315 - RNA, 15 nt, Mycobacterium avium subsp. paratuberculosis
gugcugcccggcgcg

SEQ ID NO: 2878316 - RNA, 16 nt, Mycobacterium avium subsp. paratuberculosis
gugcugcccggcgcgg

SEQ ID NO: 2878317 - RNA, 19 nt, Mycobacterium avium subsp. paratuberculosis
gugcugcccggcgcggaca

SEQ ID NO: 2878318 - RNA, 14 nt, Mycobacterium avium subsp. paratuberculosis
gugcugccggccgg

SEQ ID NO: 2878319 - RNA, 17 nt, Mycobacterium avium subsp. paratuberculosis
gugcugccgugccgauu

SEQ ID NO: 2878320 - RNA, 13 nt, Mycobacterium avium subsp. paratuberculosis
gugcugccugccg

SEQ ID NO: 2878321 - RNA, 17 nt, Mycobacterium avium subsp. paratuberculosis
gugcugcgcagcagcgc

SEQ ID NO: 2878322 - RNA, 18 nt, Mycobacterium avium subsp. paratuberculosis
gugcugcucgagggccuc

SEQ ID NO: 2878323 - RNA, 23 nt, Mycobacterium avium subsp. paratuberculosis
gugcuggacggcccgacgacgcc

SEQ ID NO: 2878324 - RNA, 18 nt, Mycobacterium avium subsp. paratuberculosis
gugcuggccaccacgggu

SEQ ID NO: 2878325 - RNA, 13 nt, Mycobacterium avium subsp. paratuberculosis
gugcuggccagca

SEQ ID NO: 2878326 - RNA, 19 nt, Mycobacterium avium subsp. paratuberculosis
gugcuggccagcaccagcg

SEQ ID NO: 2878327 - RNA, 21 nt, Mycobacterium avium subsp. paratuberculosis
gugcuggccagcaccagcgcg

SEQ ID NO: 2878328 - RNA, 14 nt, Mycobacterium avium subsp. paratuberculosis
gugcugggccacga

SEQ ID NO: 2878329 - RNA, 14 nt, Mycobacterium avium subsp. paratuberculosis
gugcugggccgggc

SEQ ID NO: 2878330 - RNA, 14 nt, Mycobacterium avium subsp. paratuberculosis
gugcugggcggacg

SEQ ID NO: 2878331 - RNA, 21 nt, Mycobacterium avium subsp. paratuberculosis
gugcugggcggauccgcgugg

SEQ ID NO: 2878332 - RNA, 16 nt, Mycobacterium avium subsp. paratuberculosis
gugcuggggguggcgu

SEQ ID NO: 2878333 - RNA, 18 nt, Mycobacterium avium subsp. paratuberculosis
gugcuggggguggcgucg

SEQ ID NO: 2878334 - RNA, 23 nt, Mycobacterium avium subsp. paratuberculosis
gugcuggucaugccgucgacgac

SEQ ID NO: 2878335 - RNA, 13 nt, Mycobacterium avium subsp. paratuberculosis
gugcugucgucgc

SEQ ID NO: 2878336 - RNA, 19 nt, Mycobacterium avium subsp. paratuberculosis
gugcugucgucgcccugac

SEQ ID NO: 2878337 - RNA, 20 nt, Mycobacterium avium subsp. paratuberculosis
gugcugucgucgcccugaca

SEQ ID NO: 2878338 - RNA, 22 nt, Mycobacterium avium subsp. paratuberculosis
gugcugugagcuuccugccaac

SEQ ID NO: 2878339 - RNA, 14 nt, Mycobacterium avium subsp. paratuberculosis
gugcugugcugccu

SEQ ID NO: 2878340 - RNA, 22 nt, Mycobacterium avium subsp. paratuberculosis
gugcuguggaacacgucggcga

SEQ ID NO: 2878341 - RNA, 23 nt, Mycobacterium avium subsp. paratuberculosis
gugcuguggaacacgucggcgau

SEQ ID NO: 2878342 - RNA, 19 nt, Mycobacterium avium subsp. paratuberculosis
gugcuguugcaggugcgcg

SEQ ID NO: 2878343 - RNA, 17 nt, Mycobacterium avium subsp. paratuberculosis
gugcuuccauucacggu

SEQ ID NO: 2878344 - RNA, 22 nt, Mycobacterium avium subsp. paratuberculosis
gugcuucuugaagaaccgggaa

SEQ ID NO: 2878345 - RNA, 15 nt, Mycobacterium avium subsp. paratuberculosis
gugcuugaacgccgc

SEQ ID NO: 2878346 - RNA, 21 nt, Mycobacterium avium subsp. paratuberculosis
gugcuugaacgccgcccccgc

SEQ ID NO: 2878347 - RNA, 23 nt, Mycobacterium avium subsp. paratuberculosis
gugcuugcccgacgagucgccgu

SEQ ID NO: 2878348 - RNA, 20 nt, Mycobacterium avium subsp. paratuberculosis
gugcuugccgaugucggcgu

SEQ ID NO: 2878349 - RNA, 17 nt, Mycobacterium avium subsp. paratuberculosis
gugcuuggccagcucgg

SEQ ID NO: 2878350 - RNA, 20 nt, Mycobacterium avium subsp. paratuberculosis
guggaaauugcugaccauga

SEQ ID NO: 2878351 - RNA, 22 nt, Mycobacterium avium subsp. paratuberculosis
guggaacaccgcgcugagcagg

SEQ ID NO: 2878352 - RNA, 10 nt, Mycobacterium avium subsp. paratuberculosis
guggaacacg

SEQ ID NO: 2878353 - RNA, 21 nt, Mycobacterium avium subsp. paratuberculosis
guggaacacgcccagcgccgc

SEQ ID NO: 2878354 - RNA, 20 nt, Mycobacterium avium subsp. paratuberculosis
guggaacaguucggugcggg

SEQ ID NO: 2878355 - RNA, 13 nt, Mycobacterium avium subsp. paratuberculosis
guggaacaucucc

SEQ ID NO: 2878356 - RNA, 15 nt, Mycobacterium avium subsp. paratuberculosis
guggaacaucuccag

SEQ ID NO: 2878357 - RNA, 20 nt, Mycobacterium avium subsp. paratuberculosis
guggaacaucuccagcgcgg

SEQ ID NO: 2878358 - RNA, 14 nt, Mycobacterium avium subsp. paratuberculosis
guggaagauguugc

SEQ ID NO: 2878359 - RNA, 21 nt, Mycobacterium avium subsp. paratuberculosis
guggaagccgcgaucggcgug

SEQ ID NO: 2878360 - RNA, 17 nt, Mycobacterium avium subsp. paratuberculosis
guggaaggcgccggcgc

SEQ ID NO: 2878361 - RNA, 19 nt, Mycobacterium avium subsp. paratuberculosis
guggaaggcgccggcgcgg

SEQ ID NO: 2878362 - RNA, 20 nt, Mycobacterium avium subsp. paratuberculosis
guggaaggcgccggcgcggg

SEQ ID NO: 2878363 - RNA, 20 nt, Mycobacterium avium subsp. paratuberculosis
guggaagggccccggcaucg

SEQ ID NO: 2878364 - RNA, 16 nt, Mycobacterium avium subsp. paratuberculosis
guggaauucuggccga

SEQ ID NO: 2878365 - RNA, 23 nt, Mycobacterium avium subsp. paratuberculosis
guggaauucuggccgaccgccgc

SEQ ID NO: 2878366 - RNA, 18 nt, Mycobacterium avium subsp. paratuberculosis
guggacaacuccuggauc

SEQ ID NO: 2878367 - RNA, 16 nt, Mycobacterium avium subsp. paratuberculosis
guggacaccgcaccca

SEQ ID NO: 2878368 - RNA, 13 nt, Mycobacterium avium subsp. paratuberculosis
guggacaccgcga

SEQ ID NO: 2878369 - RNA, 17 nt, Mycobacterium avium subsp. paratuberculosis
guggacagaugccagac

SEQ ID NO: 2878370 - RNA, 20 nt, Mycobacterium avium subsp. paratuberculosis
guggacagaugccagacgaa

SEQ ID NO: 2878371 - RNA, 14 nt, Mycobacterium avium subsp. paratuberculosis
guggacagcgcgac

SEQ ID NO: 2878372 - RNA, 16 nt, Mycobacterium avium subsp. paratuberculosis
guggacagguagcggu

SEQ ID NO: 2878373 - RNA, 15 nt, Mycobacterium avium subsp. paratuberculosis
guggacccgccccga

SEQ ID NO: 2878374 - RNA, 23 nt, Mycobacterium avium subsp. paratuberculosis
guggacccgccccgacagcaacg

SEQ ID NO: 2878375 - RNA, 15 nt, Mycobacterium avium subsp. paratuberculosis
guggaccgcgcaguc

SEQ ID NO: 2878376 - RNA, 18 nt, Mycobacterium avium subsp. paratuberculosis
guggacgaacgcggcgaa

SEQ ID NO: 2878377 - RNA, 17 nt, Mycobacterium avium subsp. paratuberculosis
guggacgagcagccgca

SEQ ID NO: 2878378 - RNA, 20 nt, Mycobacterium avium subsp. paratuberculosis
guggacgagucccaugggcu

SEQ ID NO: 2878379 - RNA, 23 nt, Mycobacterium avium subsp. paratuberculosis
guggacgaugcggggccggcggc

SEQ ID NO: 2878380 - RNA, 22 nt, Mycobacterium avium subsp. paratuberculosis
guggacgcgaccaggcccagcg

SEQ ID NO: 2878381 - RNA, 17 nt, Mycobacterium avium subsp. paratuberculosis
guggacgcggucgccgc

SEQ ID NO: 2878382 - RNA, 16 nt, Mycobacterium avium subsp. paratuberculosis
guggacggucagcgcg

SEQ ID NO: 2878383 - RNA, 20 nt, Mycobacterium avium subsp. paratuberculosis
guggacggucagcgcgccgu

SEQ ID NO: 2878384 - RNA, 21 nt, Mycobacterium avium subsp. paratuberculosis
guggacggucagcgcgccguc

SEQ ID NO: 2878385 - RNA, 21 nt, Mycobacterium avium subsp. paratuberculosis
guggacgucaggccguagcgg

SEQ ID NO: 2878386 - RNA, 22 nt, Mycobacterium avium subsp. paratuberculosis
guggacgucguuuuccagccgg

SEQ ID NO: 2878387 - RNA, 16 nt, Mycobacterium avium subsp. paratuberculosis
guggacuccagcacca

SEQ ID NO: 2878388 - RNA, 18 nt, Mycobacterium avium subsp. paratuberculosis
guggacuccagcaccagc

SEQ ID NO: 2878389 - RNA, 19 nt, Mycobacterium avium subsp. paratuberculosis
guggacuccagcaccagca

SEQ ID NO: 2878390 - RNA, 22 nt, Mycobacterium avium subsp. paratuberculosis
guggacuccagcaccagcacgg

SEQ ID NO: 2878391 - RNA, 18 nt, Mycobacterium avium subsp. paratuberculosis
guggagauggccagcacc

SEQ ID NO: 2878392 - RNA, 16 nt, Mycobacterium avium subsp. paratuberculosis
guggagcacagcacgg

SEQ ID NO: 2878393 - RNA, 16 nt, Mycobacterium avium subsp. paratuberculosis
guggagcgcggcaugc

SEQ ID NO: 2878394 - RNA, 15 nt, Mycobacterium avium subsp. paratuberculosis
guggagcggcccagc

SEQ ID NO: 2878395 - RNA, 19 nt, Mycobacterium avium subsp. paratuberculosis
guggauauuucgcggccga

SEQ ID NO: 2878396 - RNA, 21 nt, Mycobacterium avium subsp. paratuberculosis
guggaucaccaucacgucgcg

SEQ ID NO: 2878397 - RNA, 14 nt, Mycobacterium avium subsp. paratuberculosis
guggaucggcccga

SEQ ID NO: 2878398 - RNA, 17 nt, Mycobacterium avium subsp. paratuberculosis
guggaucuccagcagcu

SEQ ID NO: 2878399 - RNA, 21 nt, Mycobacterium avium subsp. paratuberculosis
guggaucucgaacggcccggu

SEQ ID NO: 2878400 - RNA, 14 nt, Mycobacterium avium subsp. paratuberculosis
guggaugacgcagc

SEQ ID NO: 2878401 - RNA, 18 nt, Mycobacterium avium subsp. paratuberculosis
guggaugaugccggcggu

SEQ ID NO: 2878402 - RNA, 14 nt, Mycobacterium avium subsp. paratuberculosis
guggauggccggcc

SEQ ID NO: 2878403 - RNA, 17 nt, Mycobacterium avium subsp. paratuberculosis
guggauggccggccggg

SEQ ID NO: 2878404 - RNA, 17 nt, Mycobacterium avium subsp. paratuberculosis
guggauggucaccgggg

SEQ ID NO: 2878405 - RNA, 15 nt, Mycobacterium avium subsp. paratuberculosis
guggcaacgugccac

SEQ ID NO: 2878406 - RNA, 16 nt, Mycobacterium avium subsp. paratuberculosis
guggcaccccgcgccg

SEQ ID NO: 2878407 - RNA, 20 nt, Mycobacterium avium subsp. paratuberculosis
guggcaccccgcgccgggcg

SEQ ID NO: 2878408 - RNA, 13 nt, Mycobacterium avium subsp. paratuberculosis
guggcacccgggu

SEQ ID NO: 2878409 - RNA, 19 nt, Mycobacterium avium subsp. paratuberculosis
guggcagcggacccggucg

SEQ ID NO: 2878410 - RNA, 13 nt, Mycobacterium avium subsp. paratuberculosis
guggcaggaagcg

SEQ ID NO: 2878411 - RNA, 12 nt, Mycobacterium avium subsp. paratuberculosis
guggcaggcacg

SEQ ID NO: 2878412 - RNA, 20 nt, Mycobacterium avium subsp. paratuberculosis
guggcaggccaucagcccgg

SEQ ID NO: 2878413 - RNA, 12 nt, Mycobacterium avium subsp. paratuberculosis
guggcagggcca

SEQ ID NO: 2878414 - RNA, 16 nt, Mycobacterium avium subsp. paratuberculosis
guggcagggccagcag

SEQ ID NO: 2878415 - RNA, 20 nt, Mycobacterium avium subsp. paratuberculosis
guggcagggccagcagcccg

SEQ ID NO: 2878416 - RNA, 21 nt, Mycobacterium avium subsp. paratuberculosis
guggccaaaaagugccggacc

SEQ ID NO: 2878417 - RNA, 15 nt, Mycobacterium avium subsp. paratuberculosis
guggccaccgaugcc

SEQ ID NO: 2878418 - RNA, 23 nt, Mycobacterium avium subsp. paratuberculosis
guggccaccgaugcccgacaccg

SEQ ID NO: 2878419 - RNA, 13 nt, Mycobacterium avium subsp. paratuberculosis
guggccaccgcga

SEQ ID NO: 2878420 - RNA, 18 nt, Mycobacterium avium subsp. paratuberculosis
guggccaccgcgacgccc

SEQ ID NO: 2878421 - RNA, 21 nt, Mycobacterium avium subsp. paratuberculosis
guggccaccuuggacaggccc

SEQ ID NO: 2878422 - RNA, 18 nt, Mycobacterium avium subsp. paratuberculosis
guggccacggcguugacc

SEQ ID NO: 2878423 - RNA, 23 nt, Mycobacterium avium subsp. paratuberculosis
guggccagcaccacguccgcggu

SEQ ID NO: 2878424 - RNA, 15 nt, Mycobacterium avium subsp. paratuberculosis
guggccagcaccagc

SEQ ID NO: 2878425 - RNA, 16 nt, Mycobacterium avium subsp. paratuberculosis
guggccagcaccgcgu

SEQ ID NO: 2878426 - RNA, 18 nt, Mycobacterium avium subsp. paratuberculosis
guggccagcaccgcgucg

SEQ ID NO: 2878427 - RNA, 18 nt, Mycobacterium avium subsp. paratuberculosis
guggccagcacgaucggg

SEQ ID NO: 2878428 - RNA, 11 nt, Mycobacterium avium subsp. paratuberculosis
guggccagcag

SEQ ID NO: 2878429 - RNA, 14 nt, Mycobacterium avium subsp. paratuberculosis
guggccagcgccag

SEQ ID NO: 2878430 - RNA, 20 nt, Mycobacterium avium subsp. paratuberculosis
guggccagcuucaccggucg

SEQ ID NO: 2878431 - RNA, 18 nt, Mycobacterium avium subsp. paratuberculosis
guggccaguucgucgcgc

SEQ ID NO: 2878432 - RNA, 20 nt, Mycobacterium avium subsp. paratuberculosis
guggccaguucgucgcgcga

SEQ ID NO: 2878433 - RNA, 24 nt, Mycobacterium avium subsp. paratuberculosis
guggccaguucgucgcgcgacugg

SEQ ID NO: 2878434 - RNA, 19 nt, Mycobacterium avium subsp. paratuberculosis
guggccaucgcggccccca

SEQ ID NO: 2878435 - RNA, 22 nt, Mycobacterium avium subsp. paratuberculosis
guggcccacgggaugcggcacg

SEQ ID NO: 2878436 - RNA, 12 nt, Mycobacterium avium subsp. paratuberculosis
guggcccagccg

SEQ ID NO: 2878437 - RNA, 14 nt, Mycobacterium avium subsp. paratuberculosis
guggcccagccgcu

SEQ ID NO: 2878438 - RNA, 16 nt, Mycobacterium avium subsp. paratuberculosis
guggcccagccgcuga

SEQ ID NO: 2878439 - RNA, 15 nt, Mycobacterium avium subsp. paratuberculosis
guggcccagccggcc

SEQ ID NO: 2878440 - RNA, 19 nt, Mycobacterium avium subsp. paratuberculosis
guggcccagccggccgacg

SEQ ID NO: 2878441 - RNA, 13 nt, Mycobacterium avium subsp. paratuberculosis
guggcccaggccg

SEQ ID NO: 2878442 - RNA, 16 nt, Mycobacterium avium subsp. paratuberculosis
guggcccaggccggcg

SEQ ID NO: 2878443 - RNA, 17 nt, Mycobacterium avium subsp. paratuberculosis
guggcccauguggccug

SEQ ID NO: 2878444 - RNA, 19 nt, Mycobacterium avium subsp. paratuberculosis
guggccccacgggccaugu

SEQ ID NO: 2878445 - RNA, 20 nt, Mycobacterium avium subsp. paratuberculosis
guggccccagcccgggggug

SEQ ID NO: 2878446 - RNA, 15 nt, Mycobacterium avium subsp. paratuberculosis
guggcccccaccacg

SEQ ID NO: 2878447 - RNA, 16 nt, Mycobacterium avium subsp. paratuberculosis
guggcccccaccacga

SEQ ID NO: 2878448 - RNA, 20 nt, Mycobacterium avium subsp. paratuberculosis
guggccccucauugggaccg

SEQ ID NO: 2878449 - RNA, 13 nt, Mycobacterium avium subsp. paratuberculosis
guggcccgacccg

SEQ ID NO: 2878450 - RNA, 13 nt, Mycobacterium avium subsp. paratuberculosis
guggcccgccacg

SEQ ID NO: 2878451 - RNA, 18 nt, Mycobacterium avium subsp. paratuberculosis
guggcccgccacgugcgg

SEQ ID NO: 2878452 - RNA, 13 nt, Mycobacterium avium subsp. paratuberculosis
guggcccgcccag

SEQ ID NO: 2878453 - RNA, 14 nt, Mycobacterium avium subsp. paratuberculosis
guggcccgcccagc

SEQ ID NO: 2878454 - RNA, 16 nt, Mycobacterium avium subsp. paratuberculosis
guggcccgcccgggca

SEQ ID NO: 2878455 - RNA, 16 nt, Mycobacterium avium subsp. paratuberculosis
guggcccgcgcgcuga

SEQ ID NO: 2878456 - RNA, 20 nt, Mycobacterium avium subsp. paratuberculosis
guggcccggauggccgggca

SEQ ID NO: 2878457 - RNA, 22 nt, Mycobacterium avium subsp. paratuberculosis
guggcccggauggccgggcagg

SEQ ID NO: 2878458 - RNA, 23 nt, Mycobacterium avium subsp. paratuberculosis
guggcccggauggccgggcaggc

SEQ ID NO: 2878459 - RNA, 18 nt, Mycobacterium avium subsp. paratuberculosis
guggcccgguacagcgcc

SEQ ID NO: 2878460 - RNA, 22 nt, Mycobacterium avium subsp. paratuberculosis
guggcccgguacagcgccgcgg

SEQ ID NO: 2878461 - RNA, 14 nt, Mycobacterium avium subsp. paratuberculosis
guggcccggucgga

SEQ ID NO: 2878462 - RNA, 17 nt, Mycobacterium avium subsp. paratuberculosis
guggccgaaccgcucgu

SEQ ID NO: 2878463 - RNA, 21 nt, Mycobacterium avium subsp. paratuberculosis
guggccgaaccgcucgucggg

SEQ ID NO: 2878464 - RNA, 19 nt, Mycobacterium avium subsp. paratuberculosis
guggccgaacgggucggcg

SEQ ID NO: 2878465 - RNA, 20 nt, Mycobacterium avium subsp. paratuberculosis
guggccgaacgggucggcga

SEQ ID NO: 2878466 - RNA, 22 nt, Mycobacterium avium subsp. paratuberculosis
guggccgaacgggucggcgacc

SEQ ID NO: 2878467 - RNA, 13 nt, Mycobacterium avium subsp. paratuberculosis
guggccgaccgac

SEQ ID NO: 2878468 - RNA, 22 nt, Mycobacterium avium subsp. paratuberculosis
guggccgaccgacaguucggcg

SEQ ID NO: 2878469 - RNA, 23 nt, Mycobacterium avium subsp. paratuberculosis
guggccgaccgacaguucggcgc

SEQ ID NO: 2878470 - RNA, 23 nt, Mycobacterium avium subsp. paratuberculosis
guggccgaggauggggucgcggg

SEQ ID NO: 2878471 - RNA, 14 nt, Mycobacterium avium subsp. paratuberculosis
guggccgaucagcg

SEQ ID NO: 2878472 - RNA, 17 nt, Mycobacterium avium subsp. paratuberculosis
guggccgaucagcggcg

SEQ ID NO: 2878473 - RNA, 18 nt, Mycobacterium avium subsp. paratuberculosis
guggccgaucagcggcgg

SEQ ID NO: 2878474 - RNA, 20 nt, Mycobacterium avium subsp. paratuberculosis
guggccgaucagcggcgggc

SEQ ID NO: 2878475 - RNA, 11 nt, Mycobacterium avium subsp. paratuberculosis
guggccgccac

SEQ ID NO: 2878476 - RNA, 12 nt, Mycobacterium avium subsp. paratuberculosis
guggccgccacc

SEQ ID NO: 2878477 - RNA, 13 nt, Mycobacterium avium subsp. paratuberculosis
guggccgccacca

SEQ ID NO: 2878478 - RNA, 15 nt, Mycobacterium avium subsp. paratuberculosis
guggccgccaccaac

SEQ ID NO: 2878479 - RNA, 23 nt, Mycobacterium avium subsp. paratuberculosis
guggccgccaccaacaucgacgu

SEQ ID NO: 2878480 - RNA, 16 nt, Mycobacterium avium subsp. paratuberculosis
guggccgccaccaggc

SEQ ID NO: 2878481 - RNA, 22 nt, Mycobacterium avium subsp. paratuberculosis
guggccgccaccaggcugaacg

SEQ ID NO: 2878482 - RNA, 21 nt, Mycobacterium avium subsp. paratuberculosis
guggccgccagcaccucgcgg

SEQ ID NO: 2878483 - RNA, 23 nt, Mycobacterium avium subsp. paratuberculosis
guggccgcgaaaauaccgccggc

SEQ ID NO: 2878484 - RNA, 14 nt, Mycobacterium avium subsp. paratuberculosis
guggccgcgaagau

SEQ ID NO: 2878485 - RNA, 13 nt, Mycobacterium avium subsp. paratuberculosis
guggccgcgcugg

SEQ ID NO: 2878486 - RNA, 20 nt, Mycobacterium avium subsp. paratuberculosis
guggccgcggcggcccggcg

SEQ ID NO: 2878487 - RNA, 22 nt, Mycobacterium avium subsp. paratuberculosis
guggccgcggcggcccggcguc

SEQ ID NO: 2878488 - RNA, 13 nt, Mycobacterium avium subsp. paratuberculosis
guggccgcgucga

SEQ ID NO: 2878489 - RNA, 14 nt, Mycobacterium avium subsp. paratuberculosis
guggccgcgucgac

SEQ ID NO: 2878490 - RNA, 18 nt, Mycobacterium avium subsp. paratuberculosis
guggccgcgucgaccagc

SEQ ID NO: 2878491 - RNA, 21 nt, Mycobacterium avium subsp. paratuberculosis
guggccgcgucgaccagccgg

SEQ ID NO: 2878492 - RNA, 17 nt, Mycobacterium avium subsp. paratuberculosis
guggccgcuuuccaccc

SEQ ID NO: 2878493 - RNA, 19 nt, Mycobacterium avium subsp. paratuberculosis
guggccgcuuuccaccccg

SEQ ID NO: 2878494 - RNA, 22 nt, Mycobacterium avium subsp. paratuberculosis
guggccgcuuuccaccccggcg

SEQ ID NO: 2878495 - RNA, 14 nt, Mycobacterium avium subsp. paratuberculosis
guggccggccagca

SEQ ID NO: 2878496 - RNA, 16 nt, Mycobacterium avium subsp. paratuberculosis
guggccggccagcaca

SEQ ID NO: 2878497 - RNA, 13 nt, Mycobacterium avium subsp. paratuberculosis
guggccggcgucc

SEQ ID NO: 2878498 - RNA, 16 nt, Mycobacterium avium subsp. paratuberculosis
guggccggcguccagg

SEQ ID NO: 2878499 - RNA, 19 nt, Mycobacterium avium subsp. paratuberculosis
guggccgggucgccgucga

SEQ ID NO: 2878500 - RNA, 21 nt, Mycobacterium avium subsp. paratuberculosis
guggccgguaucgggucaccg

SEQ ID NO: 2878501 - RNA, 13 nt, Mycobacterium avium subsp. paratuberculosis
guggccggugggc

SEQ ID NO: 2878502 - RNA, 20 nt, Mycobacterium avium subsp. paratuberculosis
guggccggugggcggcgccc

SEQ ID NO: 2878503 - RNA, 17 nt, Mycobacterium avium subsp. paratuberculosis
guggccguaaccgccgu

SEQ ID NO: 2878504 - RNA, 19 nt, Mycobacterium avium subsp. paratuberculosis
guggccgucacgcuggcgu

SEQ ID NO: 2878505 - RNA, 20 nt, Mycobacterium avium subsp. paratuberculosis
guggccgucacgcuggcgug

SEQ ID NO: 2878506 - RNA, 12 nt, Mycobacterium avium subsp. paratuberculosis
guggccgucgcc

SEQ ID NO: 2878507 - RNA, 13 nt, Mycobacterium avium subsp. paratuberculosis
guggccgucgccu

SEQ ID NO: 2878508 - RNA, 16 nt, Mycobacterium avium subsp. paratuberculosis
guggccgucucgucgg

SEQ ID NO: 2878509 - RNA, 18 nt, Mycobacterium avium subsp. paratuberculosis
guggccgugaugcgcaag

SEQ ID NO: 2878510 - RNA, 21 nt, Mycobacterium avium subsp. paratuberculosis
guggccguugaucgagcaccg

SEQ ID NO: 2878511 - RNA, 22 nt, Mycobacterium avium subsp. paratuberculosis
guggccucccccuugccgguga

SEQ ID NO: 2878512 - RNA, 23 nt, Mycobacterium avium subsp. paratuberculosis
guggccucccgguagaucgccgg

SEQ ID NO: 2878513 - RNA, 13 nt, Mycobacterium avium subsp. paratuberculosis
guggccucggcgc

SEQ ID NO: 2878514 - RNA, 15 nt, Mycobacterium avium subsp. paratuberculosis
guggccucggcgcug

SEQ ID NO: 2878515 - RNA, 21 nt, Mycobacterium avium subsp. paratuberculosis
guggccucgggggugaaggcg

SEQ ID NO: 2878516 - RNA, 14 nt, Mycobacterium avium subsp. paratuberculosis
guggccugcccggc

SEQ ID NO: 2878517 - RNA, 15 nt, Mycobacterium avium subsp. paratuberculosis
guggccugcccggcg

SEQ ID NO: 2878518 - RNA, 16 nt, Mycobacterium avium subsp. paratuberculosis
guggccugcccggcgg

SEQ ID NO: 2878519 - RNA, 15 nt, Mycobacterium avium subsp. paratuberculosis
guggccugggcgacc

SEQ ID NO: 2878520 - RNA, 16 nt, Mycobacterium avium subsp. paratuberculosis
guggccugggcgacca

SEQ ID NO: 2878521 - RNA, 15 nt, Mycobacterium avium subsp. paratuberculosis
guggccuggucggcg

SEQ ID NO: 2878522 - RNA, 22 nt, Mycobacterium avium subsp. paratuberculosis
guggccuugacgacggccaccg

SEQ ID NO: 2878523 - RNA, 21 nt, Mycobacterium avium subsp. paratuberculosis
guggccuugcugauccccagc

SEQ ID NO: 2878524 - RNA, 16 nt, Mycobacterium avium subsp. paratuberculosis
guggccuuggccacca

SEQ ID NO: 2878525 - RNA, 19 nt, Mycobacterium avium subsp. paratuberculosis
guggccuuguggucgaucc

SEQ ID NO: 2878526 - RNA, 22 nt, Mycobacterium avium subsp. paratuberculosis
guggccuuguggucgaucccgc

SEQ ID NO: 2878527 - RNA, 15 nt, Mycobacterium avium subsp. paratuberculosis
guggcgaacagcggg

SEQ ID NO: 2878528 - RNA, 21 nt, Mycobacterium avium subsp. paratuberculosis
guggcgaacgcgaccugcauc

SEQ ID NO: 2878529 - RNA, 15 nt, Mycobacterium avium subsp. paratuberculosis
guggcgaacggguga

SEQ ID NO: 2878530 - RNA, 21 nt, Mycobacterium avium subsp. paratuberculosis
guggcgaacugcaccagcacg

SEQ ID NO: 2878531 - RNA, 22 nt, Mycobacterium avium subsp. paratuberculosis
guggcgaacugcaccagcacga

SEQ ID NO: 2878532 - RNA, 18 nt, Mycobacterium avium subsp. paratuberculosis
guggcgaagcacgaccac

SEQ ID NO: 2878533 - RNA, 19 nt, Mycobacterium avium subsp. paratuberculosis
guggcgaagcacgaccaca

SEQ ID NO: 2878534 - RNA, 18 nt, Mycobacterium avium subsp. paratuberculosis
guggcgacaacaggcgac

SEQ ID NO: 2878535 - RNA, 19 nt, Mycobacterium avium subsp. paratuberculosis
guggcgacgaaccuggcug

SEQ ID NO: 2878536 - RNA, 15 nt, Mycobacterium avium subsp. paratuberculosis
guggcgacgacgccg

SEQ ID NO: 2878537 - RNA, 19 nt, Mycobacterium avium subsp. paratuberculosis
guggcgacgacgccgaucc

SEQ ID NO: 2878538 - RNA, 15 nt, Mycobacterium avium subsp. paratuberculosis
guggcgaucaccgcg

SEQ ID NO: 2878539 - RNA, 22 nt, Mycobacterium avium subsp. paratuberculosis
guggcgaugaggaacgucucgg

SEQ ID NO: 2878540 - RNA, 16 nt, Mycobacterium avium subsp. paratuberculosis
guggcgauggugcugc

SEQ ID NO: 2878541 - RNA, 13 nt, Mycobacterium avium subsp. paratuberculosis
guggcgcacaacc

SEQ ID NO: 2878542 - RNA, 21 nt, Mycobacterium avium subsp. paratuberculosis
guggcgcacagaucgucucgg

SEQ ID NO: 2878543 - RNA, 17 nt, Mycobacterium avium subsp. paratuberculosis
guggcgcacgcugcugg

SEQ ID NO: 2878544 - RNA, 23 nt, Mycobacterium avium subsp. paratuberculosis
guggcgcaucaccuucugcgucg

SEQ ID NO: 2878545 - RNA, 15 nt, Mycobacterium avium subsp. paratuberculosis
guggcgcccgcggug

SEQ ID NO: 2878546 - RNA, 22 nt, Mycobacterium avium subsp. paratuberculosis
guggcgcccggagcugucggug

SEQ ID NO: 2878547 - RNA, 11 nt, Mycobacterium avium subsp. paratuberculosis
guggcgccgcg

SEQ ID NO: 2878548 - RNA, 12 nt, Mycobacterium avium subsp. paratuberculosis
guggcgccgcgc

SEQ ID NO: 2878549 - RNA, 14 nt, Mycobacterium avium subsp. paratuberculosis
guggcgccgcgcag

SEQ ID NO: 2878550 - RNA, 17 nt, Mycobacterium avium subsp. paratuberculosis
guggcgccgcgcagcca

SEQ ID NO: 2878551 - RNA, 13 nt, Mycobacterium avium subsp. paratuberculosis
guggcgccgcggu

SEQ ID NO: 2878552 - RNA, 12 nt, Mycobacterium avium subsp. paratuberculosis
guggcgccggca

SEQ ID NO: 2878553 - RNA, 15 nt, Mycobacterium avium subsp. paratuberculosis
guggcgccggcaucg

SEQ ID NO: 2878554 - RNA, 16 nt, Mycobacterium avium subsp. paratuberculosis
guggcgccggcaucga

SEQ ID NO: 2878555 - RNA, 12 nt, Mycobacterium avium subsp. paratuberculosis
guggcgccggcc

SEQ ID NO: 2878556 - RNA, 14 nt, Mycobacterium avium subsp. paratuberculosis
guggcgccggccag

SEQ ID NO: 2878557 - RNA, 19 nt, Mycobacterium avium subsp. paratuberculosis
guggcgccggccagcacca

SEQ ID NO: 2878558 - RNA, 13 nt, Mycobacterium avium subsp. paratuberculosis
guggcgccggcgc

SEQ ID NO: 2878559 - RNA, 14 nt, Mycobacterium avium subsp. paratuberculosis
guggcgccggcgcg

SEQ ID NO: 2878560 - RNA, 23 nt, Mycobacterium avium subsp. paratuberculosis
guggcgccgguaggcgcggguga

SEQ ID NO: 2878561 - RNA, 13 nt, Mycobacterium avium subsp. paratuberculosis
guggcgccgugca

SEQ ID NO: 2878562 - RNA, 20 nt, Mycobacterium avium subsp. paratuberculosis
guggcgccuccgcccgggug

SEQ ID NO: 2878563 - RNA, 13 nt, Mycobacterium avium subsp. paratuberculosis
guggcgcgacgcg

SEQ ID NO: 2878564 - RNA, 16 nt, Mycobacterium avium subsp. paratuberculosis
guggcgcgacgcggga

SEQ ID NO: 2878565 - RNA, 14 nt, Mycobacterium avium subsp. paratuberculosis
guggcgcucagcgg

SEQ ID NO: 2878566 - RNA, 16 nt, Mycobacterium avium subsp. paratuberculosis
guggcgcucagcggca

SEQ ID NO: 2878567 - RNA, 19 nt, Mycobacterium avium subsp. paratuberculosis
guggcgcucagcggcagcg

SEQ ID NO: 2878568 - RNA, 23 nt, Mycobacterium avium subsp. paratuberculosis
guggcggccaccaugccggcguc

SEQ ID NO: 2878569 - RNA, 17 nt, Mycobacterium avium subsp. paratuberculosis
guggcggccacgaucgc

SEQ ID NO: 2878570 - RNA, 20 nt, Mycobacterium avium subsp. paratuberculosis
guggcggccaggccggcgac

SEQ ID NO: 2878571 - RNA, 19 nt, Mycobacterium avium subsp. paratuberculosis
guggcggcccaauucguag

SEQ ID NO: 2878572 - RNA, 18 nt, Mycobacterium avium subsp. paratuberculosis
guggcggcccgaccagcg

SEQ ID NO: 2878573 - RNA, 13 nt, Mycobacterium avium subsp. paratuberculosis
guggcggccgggg

SEQ ID NO: 2878574 - RNA, 16 nt, Mycobacterium avium subsp. paratuberculosis
guggcggccgucgcgc

SEQ ID NO: 2878575 - RNA, 17 nt, Mycobacterium avium subsp. paratuberculosis
guggcggccgucgcgca

SEQ ID NO: 2878576 - RNA, 14 nt, Mycobacterium avium subsp. paratuberculosis
guggcggcgaggaa

SEQ ID NO: 2878577 - RNA, 19 nt, Mycobacterium avium subsp. paratuberculosis
guggcggcgaugucgucga

SEQ ID NO: 2878578 - RNA, 15 nt, Mycobacterium avium subsp. paratuberculosis
guggcggcgccggau

SEQ ID NO: 2878579 - RNA, 23 nt, Mycobacterium avium subsp. paratuberculosis
guggcggcgccggaugccagcag

SEQ ID NO: 2878580 - RNA, 23 nt, Mycobacterium avium subsp. paratuberculosis
guggcggcgggccagcucgucga

SEQ ID NO: 2878581 - RNA, 11 nt, Mycobacterium avium subsp. paratuberculosis
guggcggcggu

SEQ ID NO: 2878582 - RNA, 16 nt, Mycobacterium avium subsp. paratuberculosis
guggcgggccaggcgg

SEQ ID NO: 2878583 - RNA, 19 nt, Mycobacterium avium subsp. paratuberculosis
guggcgggggagccgugca

SEQ ID NO: 2878584 - RNA, 13 nt, Mycobacterium avium subsp. paratuberculosis
guggcgguggcca

SEQ ID NO: 2878585 - RNA, 16 nt, Mycobacterium avium subsp. paratuberculosis
guggcgguggcggcga

SEQ ID NO: 2878586 - RNA, 15 nt, Mycobacterium avium subsp. paratuberculosis
guggcguagucggug

SEQ ID NO: 2878587 - RNA, 16 nt, Mycobacterium avium subsp. paratuberculosis
guggcguccagaugcc

SEQ ID NO: 2878588 - RNA, 16 nt, Mycobacterium avium subsp. paratuberculosis
guggcguccucgacgg

SEQ ID NO: 2878589 - RNA, 13 nt, Mycobacterium avium subsp. paratuberculosis
guggcgucgacgg

SEQ ID NO: 2878590 - RNA, 14 nt, Mycobacterium avium subsp. paratuberculosis
guggcgucgacggg

SEQ ID NO: 2878591 - RNA, 12 nt, Mycobacterium avium subsp. paratuberculosis
guggcgucgaug

SEQ ID NO: 2878592 - RNA, 19 nt, Mycobacterium avium subsp. paratuberculosis
guggcgucgaugccgauca

SEQ ID NO: 2878593 - RNA, 22 nt, Mycobacterium avium subsp. paratuberculosis
guggcgucgaugccgaucacgg

SEQ ID NO: 2878594 - RNA, 15 nt, Mycobacterium avium subsp. paratuberculosis
guggcgucgccgccg

SEQ ID NO: 2878595 - RNA, 21 nt, Mycobacterium avium subsp. paratuberculosis
guggcgucggcgcgcaccgcg

SEQ ID NO: 2878596 - RNA, 13 nt, Mycobacterium avium subsp. paratuberculosis
guggcgucggcgg

SEQ ID NO: 2878597 - RNA, 14 nt, Mycobacterium avium subsp. paratuberculosis
guggcgucggcggc

SEQ ID NO: 2878598 - RNA, 16 nt, Mycobacterium avium subsp. paratuberculosis
guggcgucggcggccu

SEQ ID NO: 2878599 - RNA, 20 nt, Mycobacterium avium subsp. paratuberculosis
guggcgucggcggccugcuc

SEQ ID NO: 2878600 - RNA, 15 nt, Mycobacterium avium subsp. paratuberculosis
guggcgucggcgucg

SEQ ID NO: 2878601 - RNA, 16 nt, Mycobacterium avium subsp. paratuberculosis
guggcgucggcgucga

SEQ ID NO: 2878602 - RNA, 13 nt, Mycobacterium avium subsp. paratuberculosis
guggcgucgguga

SEQ ID NO: 2878603 - RNA, 15 nt, Mycobacterium avium subsp. paratuberculosis
guggcgucggugaug

SEQ ID NO: 2878604 - RNA, 18 nt, Mycobacterium avium subsp. paratuberculosis
guggcgucggugaugccg

SEQ ID NO: 2878605 - RNA, 13 nt, Mycobacterium avium subsp. paratuberculosis
guggcgugccggg

SEQ ID NO: 2878606 - RNA, 14 nt, Mycobacterium avium subsp. paratuberculosis
guggcgugccgggc

SEQ ID NO: 2878607 - RNA, 22 nt, Mycobacterium avium subsp. paratuberculosis
guggcgugcggccucggcaccg

SEQ ID NO: 2878608 - RNA, 21 nt, Mycobacterium avium subsp. paratuberculosis
guggcguucacaguaggcggc

SEQ ID NO: 2878609 - RNA, 22 nt, Mycobacterium avium subsp. paratuberculosis
guggcguucacaguaggcggcu

SEQ ID NO: 2878610 - RNA, 15 nt, Mycobacterium avium subsp. paratuberculosis
guggcguucgaugcc

SEQ ID NO: 2878611 - RNA, 20 nt, Mycobacterium avium subsp. paratuberculosis
guggcguucgaugcccugcc

SEQ ID NO: 2878612 - RNA, 13 nt, Mycobacterium avium subsp. paratuberculosis
guggcguuggcga

SEQ ID NO: 2878613 - RNA, 14 nt, Mycobacterium avium subsp. paratuberculosis
guggcucagcggca

SEQ ID NO: 2878614 - RNA, 16 nt, Mycobacterium avium subsp. paratuberculosis
guggcucagcggcagg

SEQ ID NO: 2878615 - RNA, 19 nt, Mycobacterium avium subsp. paratuberculosis
guggcucagcggcaggugc

SEQ ID NO: 2878616 - RNA, 16 nt, Mycobacterium avium subsp. paratuberculosis
guggcucggcccgccg

SEQ ID NO: 2878617 - RNA, 19 nt, Mycobacterium avium subsp. paratuberculosis
guggcugaacagcgcgccg

SEQ ID NO: 2878618 - RNA, 21 nt, Mycobacterium avium subsp. paratuberculosis
guggcugaacagcgcgccgaa

SEQ ID NO: 2878619 - RNA, 16 nt, Mycobacterium avium subsp. paratuberculosis
guggcugaccgacggc

SEQ ID NO: 2878620 - RNA, 23 nt, Mycobacterium avium subsp. paratuberculosis
guggcugaggccgccccggccgc

SEQ ID NO: 2878621 - RNA, 22 nt, Mycobacterium avium subsp. paratuberculosis
guggcugcacgucacgggccag

SEQ ID NO: 2878622 - RNA, 23 nt, Mycobacterium avium subsp. paratuberculosis
guggcugucggggaccguccccg

SEQ ID NO: 2878623 - RNA, 13 nt, Mycobacterium avium subsp. paratuberculosis
guggcugucgggu

SEQ ID NO: 2878624 - RNA, 16 nt, Mycobacterium avium subsp. paratuberculosis
guggcuugaucgcacc

SEQ ID NO: 2878625 - RNA, 20 nt, Mycobacterium avium subsp. paratuberculosis
guggcuuuggucgccagcac

SEQ ID NO: 2878626 - RNA, 15 nt, Mycobacterium avium subsp. paratuberculosis
gugggacugggcgcc

SEQ ID NO: 2878627 - RNA, 23 nt, Mycobacterium avium subsp. paratuberculosis
gugggcaacacgucguccggcgc

SEQ ID NO: 2878628 - RNA, 16 nt, Mycobacterium avium subsp. paratuberculosis
gugggcaccagcagcg

SEQ ID NO: 2878629 - RNA, 19 nt, Mycobacterium avium subsp. paratuberculosis
gugggcaccagcagcgcga

SEQ ID NO: 2878630 - RNA, 16 nt, Mycobacterium avium subsp. paratuberculosis
gugggcaccccgauca

SEQ ID NO: 2878631 - RNA, 15 nt, Mycobacterium avium subsp. paratuberculosis
gugggcagaugcccg

SEQ ID NO: 2878632 - RNA, 16 nt, Mycobacterium avium subsp. paratuberculosis
gugggcagccggcaac

SEQ ID NO: 2878633 - RNA, 13 nt, Mycobacterium avium subsp. paratuberculosis
gugggcagcgcgg

SEQ ID NO: 2878634 - RNA, 16 nt, Mycobacterium avium subsp. paratuberculosis
gugggcagcucggugg

SEQ ID NO: 2878635 - RNA, 16 nt, Mycobacterium avium subsp. paratuberculosis
gugggcagcucgucgg

SEQ ID NO: 2878636 - RNA, 23 nt, Mycobacterium avium subsp. paratuberculosis
gugggccaccacguacuccugcg

SEQ ID NO: 2878637 - RNA, 14 nt, Mycobacterium avium subsp. paratuberculosis
gugggccagcgcgg

SEQ ID NO: 2878638 - RNA, 15 nt, Mycobacterium avium subsp. paratuberculosis
gugggccagcgcggu

SEQ ID NO: 2878639 - RNA, 16 nt, Mycobacterium avium subsp. paratuberculosis
gugggccagcgcggug

SEQ ID NO: 2878640 - RNA, 13 nt, Mycobacterium avium subsp. paratuberculosis
gugggccagucga

SEQ ID NO: 2878641 - RNA, 14 nt, Mycobacterium avium subsp. paratuberculosis
gugggccagucgaa

SEQ ID NO: 2878642 - RNA, 22 nt, Mycobacterium avium subsp. paratuberculosis
gugggccaucgccaggaaccac

SEQ ID NO: 2878643 - RNA, 14 nt, Mycobacterium avium subsp. paratuberculosis
gugggccaucggca

SEQ ID NO: 2878644 - RNA, 21 nt, Mycobacterium avium subsp. paratuberculosis
gugggcccgccgucgaccacg

SEQ ID NO: 2878645 - RNA, 17 nt, Mycobacterium avium subsp. paratuberculosis
gugggccgcaccuggca

SEQ ID NO: 2878646 - RNA, 14 nt, Mycobacterium avium subsp. paratuberculosis
gugggccgccgcgg

SEQ ID NO: 2878647 - RNA, 19 nt, Mycobacterium avium subsp. paratuberculosis
gugggccgccgcggcggca

SEQ ID NO: 2878648 - RNA, 13 nt, Mycobacterium avium subsp. paratuberculosis
gugggcgaacagc

SEQ ID NO: 2878649 - RNA, 17 nt, Mycobacterium avium subsp. paratuberculosis
gugggcgaacgaggccg

SEQ ID NO: 2878650 - RNA, 22 nt, Mycobacterium avium subsp. paratuberculosis
gugggcgauccgcaggccgucg

SEQ ID NO: 2878651 - RNA, 13 nt, Mycobacterium avium subsp. paratuberculosis
gugggcgauggcg

SEQ ID NO: 2878652 - RNA, 17 nt, Mycobacterium avium subsp. paratuberculosis
gugggcgauggcggcgu

SEQ ID NO: 2878653 - RNA, 14 nt, Mycobacterium avium subsp. paratuberculosis
gugggcgcagggcc

SEQ ID NO: 2878654 - RNA, 17 nt, Mycobacterium avium subsp. paratuberculosis
gugggcgcagggccgcu

SEQ ID NO: 2878655 - RNA, 19 nt, Mycobacterium avium subsp. paratuberculosis
gugggcgcauaaaccuggu

SEQ ID NO: 2878656 - RNA, 15 nt, Mycobacterium avium subsp. paratuberculosis
gugggcgcccgcggc

SEQ ID NO: 2878657 - RNA, 16 nt, Mycobacterium avium subsp. paratuberculosis
gugggcgccggcguca

SEQ ID NO: 2878658 - RNA, 16 nt, Mycobacterium avium subsp. paratuberculosis
gugggcgccgucgccg

SEQ ID NO: 2878659 - RNA, 22 nt, Mycobacterium avium subsp. paratuberculosis
gugggcgccgucgccgccguga

SEQ ID NO: 2878660 - RNA, 17 nt, Mycobacterium avium subsp. paratuberculosis
gugggcgcgcagcacca

SEQ ID NO: 2878661 - RNA, 14 nt, Mycobacterium avium subsp. paratuberculosis
gugggcgcuggucc

SEQ ID NO: 2878662 - RNA, 11 nt, Mycobacterium avium subsp. paratuberculosis
gugggcggcca

SEQ ID NO: 2878663 - RNA, 23 nt, Mycobacterium avium subsp. paratuberculosis
gugggcggccaccaacggcagca

SEQ ID NO: 2878664 - RNA, 11 nt, Mycobacterium avium subsp. paratuberculosis
gugggcggcgc

SEQ ID NO: 2878665 - RNA, 15 nt, Mycobacterium avium subsp. paratuberculosis
gugggcggcgcccga

SEQ ID NO: 2878666 - RNA, 16 nt, Mycobacterium avium subsp. paratuberculosis
gugggcggcgcccgac

SEQ ID NO: 2878667 - RNA, 13 nt, Mycobacterium avium subsp. paratuberculosis
gugggcggcggga

SEQ ID NO: 2878668 - RNA, 22 nt, Mycobacterium avium subsp. paratuberculosis
gugggcggugcgcagucgcugg

SEQ ID NO: 2878669 - RNA, 23 nt, Mycobacterium avium subsp. paratuberculosis
gugggcggugcgcagucgcuggu

SEQ ID NO: 2878670 - RNA, 16 nt, Mycobacterium avium subsp. paratuberculosis
gugggcguacgggcgg

SEQ ID NO: 2878671 - RNA, 13 nt, Mycobacterium avium subsp. paratuberculosis
gugggcgucgugg

SEQ ID NO: 2878672 - RNA, 22 nt, Mycobacterium avium subsp. paratuberculosis
gugggcgucguggucgacgccg

SEQ ID NO: 2878673 - RNA, 16 nt, Mycobacterium avium subsp. paratuberculosis
gugggcgugcaggccg

SEQ ID NO: 2878674 - RNA, 17 nt, Mycobacterium avium subsp. paratuberculosis
gugggcgugcaggccgc

SEQ ID NO: 2878675 - RNA, 15 nt, Mycobacterium avium subsp. paratuberculosis
gugggcgugccggau

SEQ ID NO: 2878676 - RNA, 16 nt, Mycobacterium avium subsp. paratuberculosis
gugggcgugccgggau

SEQ ID NO: 2878677 - RNA, 15 nt, Mycobacterium avium subsp. paratuberculosis
gugggcucgcccggg

SEQ ID NO: 2878678 - RNA, 15 nt, Mycobacterium avium subsp. paratuberculosis
gugggcucggcgccg

SEQ ID NO: 2878679 - RNA, 12 nt, Mycobacterium avium subsp. paratuberculosis
gugggcugcauc

SEQ ID NO: 2878680 - RNA, 20 nt, Mycobacterium avium subsp. paratuberculosis
gugggcugcaucuccagccg

SEQ ID NO: 2878681 - RNA, 21 nt, Mycobacterium avium subsp. paratuberculosis
gugggcugcaucuccagccgc

SEQ ID NO: 2878682 - RNA, 16 nt, Mycobacterium avium subsp. paratuberculosis
gugggcuuagcggggu

SEQ ID NO: 2878683 - RNA, 22 nt, Mycobacterium avium subsp. paratuberculosis
guggggaucaggaugacgccgc

SEQ ID NO: 2878684 - RNA, 13 nt, Mycobacterium avium subsp. paratuberculosis
guggggcaccaga

SEQ ID NO: 2878685 - RNA, 16 nt, Mycobacterium avium subsp. paratuberculosis
guggggccgaagccga

SEQ ID NO: 2878686 - RNA, 15 nt, Mycobacterium avium subsp. paratuberculosis
guggggcuggccgca

SEQ ID NO: 2878687 - RNA, 17 nt, Mycobacterium avium subsp. paratuberculosis
guggggcuggccgcacg

SEQ ID NO: 2878688 - RNA, 18 nt, Mycobacterium avium subsp. paratuberculosis
guggggcuggccgcacgg

SEQ ID NO: 2878689 - RNA, 14 nt, Mycobacterium avium subsp. paratuberculosis
gugggggccaggcg

SEQ ID NO: 2878690 - RNA, 16 nt, Mycobacterium avium subsp. paratuberculosis
gugggggucuggucgg

SEQ ID NO: 2878691 - RNA, 13 nt, Mycobacterium avium subsp. paratuberculosis
gugggguggugga

SEQ ID NO: 2878692 - RNA, 14 nt, Mycobacterium avium subsp. paratuberculosis
gugggguucccggc

SEQ ID NO: 2878693 - RNA, 16 nt, Mycobacterium avium subsp. paratuberculosis
guggguauccgccgcc

SEQ ID NO: 2878694 - RNA, 22 nt, Mycobacterium avium subsp. paratuberculosis
guggguauccgccgccagcgcc

SEQ ID NO: 2878695 - RNA, 12 nt, Mycobacterium avium subsp. paratuberculosis
gugggucgacag

SEQ ID NO: 2878696 - RNA, 20 nt, Mycobacterium avium subsp. paratuberculosis
gugggugccgacgagcucgc

SEQ ID NO: 2878697 - RNA, 20 nt, Mycobacterium avium subsp. paratuberculosis
guggguggagacguaccagc

SEQ ID NO: 2878698 - RNA, 18 nt, Mycobacterium avium subsp. paratuberculosis
gugggugucgaaaccgcc

SEQ ID NO: 2878699 - RNA, 14 nt, Mycobacterium avium subsp. paratuberculosis
gugggugucggcga

SEQ ID NO: 2878700 - RNA, 17 nt, Mycobacterium avium subsp. paratuberculosis
guggguuccgccgucga

SEQ ID NO: 2878701 - RNA, 19 nt, Mycobacterium avium subsp. paratuberculosis
gugguaaacgcuucuccgc

SEQ ID NO: 2878702 - RNA, 17 nt, Mycobacterium avium subsp. paratuberculosis
gugguaccggcgccagg

SEQ ID NO: 2878703 - RNA, 15 nt, Mycobacterium avium subsp. paratuberculosis
gugguagacgccgga

SEQ ID NO: 2878704 - RNA, 14 nt, Mycobacterium avium subsp. paratuberculosis
guggucaccaccac

SEQ ID NO: 2878705 - RNA, 22 nt, Mycobacterium avium subsp. paratuberculosis
guggucaccaccaccaguucca

SEQ ID NO: 2878706 - RNA, 13 nt, Mycobacterium avium subsp. paratuberculosis
guggucaccgugu

SEQ ID NO: 2878707 - RNA, 19 nt, Mycobacterium avium subsp. paratuberculosis
guggucagcggcgccaccg

SEQ ID NO: 2878708 - RNA, 16 nt, Mycobacterium avium subsp. paratuberculosis
guggucagcgucucgc

SEQ ID NO: 2878709 - RNA, 18 nt, Mycobacterium avium subsp. paratuberculosis
guggucagcgucucgccg

SEQ ID NO: 2878710 - RNA, 17 nt, Mycobacterium avium subsp. paratuberculosis
guggucagcgucucggc

SEQ ID NO: 2878711 - RNA, 15 nt, Mycobacterium avium subsp. paratuberculosis
guggucaggcccagg

SEQ ID NO: 2878712 - RNA, 18 nt, Mycobacterium avium subsp. paratuberculosis
guggucaggcccaggcga

SEQ ID NO: 2878713 - RNA, 18 nt, Mycobacterium avium subsp. paratuberculosis
gugguccaccgccgcgcc

SEQ ID NO: 2878714 - RNA, 11 nt, Mycobacterium avium subsp. paratuberculosis
gugguccaggc

SEQ ID NO: 2878715 - RNA, 18 nt, Mycobacterium avium subsp. paratuberculosis
gugguccaggcgccgggu

SEQ ID NO: 2878716 - RNA, 18 nt, Mycobacterium avium subsp. paratuberculosis
guggucccaggaccacuc

SEQ ID NO: 2878717 - RNA, 13 nt, Mycobacterium avium subsp. paratuberculosis
gugguccucguca

SEQ ID NO: 2878718 - RNA, 13 nt, Mycobacterium avium subsp. paratuberculosis
gugguccuggcgg

SEQ ID NO: 2878719 - RNA, 15 nt, Mycobacterium avium subsp. paratuberculosis
gugguccuggcggug

SEQ ID NO: 2878720 - RNA, 17 nt, Mycobacterium avium subsp. paratuberculosis
gugguccuggcgguggc

SEQ ID NO: 2878721 - RNA, 19 nt, Mycobacterium avium subsp. paratuberculosis
guggucgaacuggcgcacc

SEQ ID NO: 2878722 - RNA, 17 nt, Mycobacterium avium subsp. paratuberculosis
guggucgacgagcccgc

SEQ ID NO: 2878723 - RNA, 20 nt, Mycobacterium avium subsp. paratuberculosis
guggucgacgagcccgcgcc

SEQ ID NO: 2878724 - RNA, 13 nt, Mycobacterium avium subsp. paratuberculosis
guggucgacgccg

SEQ ID NO: 2878725 - RNA, 14 nt, Mycobacterium avium subsp. paratuberculosis
guggucgacgcgcc

SEQ ID NO: 2878726 - RNA, 19 nt, Mycobacterium avium subsp. paratuberculosis
guggucgaugaacucgcgg

SEQ ID NO: 2878727 - RNA, 22 nt, Mycobacterium avium subsp. paratuberculosis
guggucgaugaacucgcgggcg

SEQ ID NO: 2878728 - RNA, 19 nt, Mycobacterium avium subsp. paratuberculosis
guggucgaugcccgcgccg

SEQ ID NO: 2878729 - RNA, 18 nt, Mycobacterium avium subsp. paratuberculosis
guggucgcugaccuucuu

SEQ ID NO: 2878730 - RNA, 14 nt, Mycobacterium avium subsp. paratuberculosis
guggucggcagcac

SEQ ID NO: 2878731 - RNA, 21 nt, Mycobacterium avium subsp. paratuberculosis
guggucggcagcaccggcagc

SEQ ID NO: 2878732 - RNA, 19 nt, Mycobacterium avium subsp. paratuberculosis
guggucggccacgacgcgg

SEQ ID NO: 2878733 - RNA, 22 nt, Mycobacterium avium subsp. paratuberculosis
guggucggcgaacgcccggucg

SEQ ID NO: 2878734 - RNA, 23 nt, Mycobacterium avium subsp. paratuberculosis
guggucggcgaugcgcaccauca

SEQ ID NO: 2878735 - RNA, 13 nt, Mycobacterium avium subsp. paratuberculosis
guggucggcgcgg

SEQ ID NO: 2878736 - RNA, 22 nt, Mycobacterium avium subsp. paratuberculosis
guggucgggcaugccggccggc

SEQ ID NO: 2878737 - RNA, 19 nt, Mycobacterium avium subsp. paratuberculosis
guggucgguagggucgggu

SEQ ID NO: 2878738 - RNA, 13 nt, Mycobacterium avium subsp. paratuberculosis
guggucgucgacg

SEQ ID NO: 2878739 - RNA, 23 nt, Mycobacterium avium subsp. paratuberculosis
guggucgucgacgagcccgccgg

SEQ ID NO: 2878740 - RNA, 19 nt, Mycobacterium avium subsp. paratuberculosis
guggucuccuggccgccgu

SEQ ID NO: 2878741 - RNA, 22 nt, Mycobacterium avium subsp. paratuberculosis
guggucuccuggccgccgugca

SEQ ID NO: 2878742 - RNA, 19 nt, Mycobacterium avium subsp. paratuberculosis
guggucucgcaccugccgu

SEQ ID NO: 2878743 - RNA, 22 nt, Mycobacterium avium subsp. paratuberculosis
guggucucgcaccugccgucga

SEQ ID NO: 2878744 - RNA, 21 nt, Mycobacterium avium subsp. paratuberculosis
guggucucguacaaggugaug

SEQ ID NO: 2878745 - RNA, 19 nt, Mycobacterium avium subsp. paratuberculosis
guggucugaccccccgacg

SEQ ID NO: 2878746 - RNA, 21 nt, Mycobacterium avium subsp. paratuberculosis
guggucugccagaacggcggc

SEQ ID NO: 2878747 - RNA, 13 nt, Mycobacterium avium subsp. paratuberculosis
guggugacccgca

SEQ ID NO: 2878748 - RNA, 21 nt, Mycobacterium avium subsp. paratuberculosis
guggugacccgcaacucgggc

SEQ ID NO: 2878749 - RNA, 14 nt, Mycobacterium avium subsp. paratuberculosis
guggugacccggac

SEQ ID NO: 2878750 - RNA, 16 nt, Mycobacterium avium subsp. paratuberculosis
guggugacccggaccg

SEQ ID NO: 2878751 - RNA, 19 nt, Mycobacterium avium subsp. paratuberculosis
guggugaccguacucgugg

SEQ ID NO: 2878752 - RNA, 16 nt, Mycobacterium avium subsp. paratuberculosis
guggugagacccugga

SEQ ID NO: 2878753 - RNA, 12 nt, Mycobacterium avium subsp. paratuberculosis
guggugaucgcc

SEQ ID NO: 2878754 - RNA, 16 nt, Mycobacterium avium subsp. paratuberculosis
guggugaucgccgcgg

SEQ ID NO: 2878755 - RNA, 13 nt, Mycobacterium avium subsp. paratuberculosis
guggugaucgcgg

SEQ ID NO: 2878756 - RNA, 15 nt, Mycobacterium avium subsp. paratuberculosis
guggugaucgcggcg

SEQ ID NO: 2878757 - RNA, 13 nt, Mycobacterium avium subsp. paratuberculosis
guggugcaccgcc

SEQ ID NO: 2878758 - RNA, 14 nt, Mycobacterium avium subsp. paratuberculosis
guggugcacgaacg

SEQ ID NO: 2878759 - RNA, 17 nt, Mycobacterium avium subsp. paratuberculosis
guggugcccccgcccgg

SEQ ID NO: 2878760 - RNA, 16 nt, Mycobacterium avium subsp. paratuberculosis
guggugccgccgucga

SEQ ID NO: 2878761 - RNA, 23 nt, Mycobacterium avium subsp. paratuberculosis
guggugccggaaguucucgccgu

SEQ ID NO: 2878762 - RNA, 16 nt, Mycobacterium avium subsp. paratuberculosis
guggugccgucgcgcu

SEQ ID NO: 2878763 - RNA, 20 nt, Mycobacterium avium subsp. paratuberculosis
guggugcgcccgucgguggg

SEQ ID NO: 2878764 - RNA, 16 nt, Mycobacterium avium subsp. paratuberculosis
guggugcggugcaccg

SEQ ID NO: 2878765 - RNA, 18 nt, Mycobacterium avium subsp. paratuberculosis
guggugcucgccccgccc

SEQ ID NO: 2878766 - RNA, 19 nt, Mycobacterium avium subsp. paratuberculosis
guggugcugauguccuugu

SEQ ID NO: 2878767 - RNA, 22 nt, Mycobacterium avium subsp. paratuberculosis
gugguggaaggugacgucgccg

SEQ ID NO: 2878768 - RNA, 23 nt, Mycobacterium avium subsp. paratuberculosis
gugguggaaggugacgucgccga

SEQ ID NO: 2878769 - RNA, 22 nt, Mycobacterium avium subsp. paratuberculosis
gugguggacaacuccuggaucc

SEQ ID NO: 2878770 - RNA, 13 nt, Mycobacterium avium subsp. paratuberculosis
gugguggcgaaca

SEQ ID NO: 2878771 - RNA, 16 nt, Mycobacterium avium subsp. paratuberculosis
gugguggcguggugga

SEQ ID NO: 2878772 - RNA, 19 nt, Mycobacterium avium subsp. paratuberculosis
guggugggcgaacagcagc

SEQ ID NO: 2878773 - RNA, 20 nt, Mycobacterium avium subsp. paratuberculosis
guggugggcgaacagcagca

SEQ ID NO: 2878774 - RNA, 22 nt, Mycobacterium avium subsp. paratuberculosis
guggugggcgcgaagguggcgc

SEQ ID NO: 2878775 - RNA, 23 nt, Mycobacterium avium subsp. paratuberculosis
guggugggguccgcaggcgaagg

SEQ ID NO: 2878776 - RNA, 14 nt, Mycobacterium avium subsp. paratuberculosis
gugguggucgucga

SEQ ID NO: 2878777 - RNA, 23 nt, Mycobacterium avium subsp. paratuberculosis
gugguggucgucgacgagcccgc

SEQ ID NO: 2878778 - RNA, 13 nt, Mycobacterium avium subsp. paratuberculosis
gugguggucucga

SEQ ID NO: 2878779 - RNA, 13 nt, Mycobacterium avium subsp. paratuberculosis
gugguggugccca

SEQ ID NO: 2878780 - RNA, 15 nt, Mycobacterium avium subsp. paratuberculosis
gugguggugcggacg

SEQ ID NO: 2878781 - RNA, 14 nt, Mycobacterium avium subsp. paratuberculosis
guggugguggugcc

SEQ ID NO: 2878782 - RNA, 14 nt, Mycobacterium avium subsp. paratuberculosis
guggugucgaaguc

SEQ ID NO: 2878783 - RNA, 11 nt, Mycobacterium avium subsp. paratuberculosis
guggugucgac

SEQ ID NO: 2878784 - RNA, 13 nt, Mycobacterium avium subsp. paratuberculosis
guggugugcaagg

SEQ ID NO: 2878785 - RNA, 21 nt, Mycobacterium avium subsp. paratuberculosis
gugguguucuggaugcccagg

SEQ ID NO: 2878786 - RNA, 16 nt, Mycobacterium avium subsp. paratuberculosis
gugguugagcagcaga

SEQ ID NO: 2878787 - RNA, 22 nt, Mycobacterium avium subsp. paratuberculosis
gugguugagcagcagaccgccg

SEQ ID NO: 2878788 - RNA, 14 nt, Mycobacterium avium subsp. paratuberculosis
gugguugccccagc

SEQ ID NO: 2878789 - RNA, 18 nt, Mycobacterium avium subsp. paratuberculosis
guguaacaacucgccgga

SEQ ID NO: 2878790 - RNA, 19 nt, Mycobacterium avium subsp. paratuberculosis
guguaaccguggcaggcga

SEQ ID NO: 2878791 - RNA, 17 nt, Mycobacterium avium subsp. paratuberculosis
guguaacgcgucgacgg

SEQ ID NO: 2878792 - RNA, 15 nt, Mycobacterium avium subsp. paratuberculosis
guguacacagggcgg

SEQ ID NO: 2878793 - RNA, 16 nt, Mycobacterium avium subsp. paratuberculosis
guguacucggcgucgc

SEQ ID NO: 2878794 - RNA, 22 nt, Mycobacterium avium subsp. paratuberculosis
guguacucggcgucgccgagcu

SEQ ID NO: 2878795 - RNA, 17 nt, Mycobacterium avium subsp. paratuberculosis
guguagagcaccucgau

SEQ ID NO: 2878796 - RNA, 23 nt, Mycobacterium avium subsp. paratuberculosis
guguaggccgcgcuggccagcgu

SEQ ID NO: 2878797 - RNA, 14 nt, Mycobacterium avium subsp. paratuberculosis
guguaggcggccac

SEQ ID NO: 2878798 - RNA, 14 nt, Mycobacterium avium subsp. paratuberculosis
guguaggcguggca

SEQ ID NO: 2878799 - RNA, 16 nt, Mycobacterium avium subsp. paratuberculosis
guguagggcaacacga

SEQ ID NO: 2878800 - RNA, 22 nt, Mycobacterium avium subsp. paratuberculosis
guguagggcaacacgaccagga

SEQ ID NO: 2878801 - RNA, 22 nt, Mycobacterium avium subsp. paratuberculosis
guguaguccaggucgaucucgg

SEQ ID NO: 2878802 - RNA, 15 nt, Mycobacterium avium subsp. paratuberculosis
gugucaaccaggucg

SEQ ID NO: 2878803 - RNA, 15 nt, Mycobacterium avium subsp. paratuberculosis
gugucaccgacgcca

SEQ ID NO: 2878804 - RNA, 16 nt, Mycobacterium avium subsp. paratuberculosis
gugucaccgacgccag

SEQ ID NO: 2878805 - RNA, 13 nt, Mycobacterium avium subsp. paratuberculosis
gugucacgcuggc

SEQ ID NO: 2878806 - RNA, 16 nt, Mycobacterium avium subsp. paratuberculosis
gugucacgcuggcgug

SEQ ID NO: 2878807 - RNA, 19 nt, Mycobacterium avium subsp. paratuberculosis
gugucacguccacgccgcg

SEQ ID NO: 2878808 - RNA, 20 nt, Mycobacterium avium subsp. paratuberculosis
gugucacguccacgccgcgg

SEQ ID NO: 2878809 - RNA, 21 nt, Mycobacterium avium subsp. paratuberculosis
gugucacguccacgccgcggg

SEQ ID NO: 2878810 - RNA, 22 nt, Mycobacterium avium subsp. paratuberculosis
gugucacuacccgcgauggcac

SEQ ID NO: 2878811 - RNA, 16 nt, Mycobacterium avium subsp. paratuberculosis
gugucaggaucgccgg

SEQ ID NO: 2878812 - RNA, 15 nt, Mycobacterium avium subsp. paratuberculosis
gugucaggucggcga

SEQ ID NO: 2878813 - RNA, 18 nt, Mycobacterium avium subsp. paratuberculosis
gugucaggucggcgaugg

SEQ ID NO: 2878814 - RNA, 20 nt, Mycobacterium avium subsp. paratuberculosis
gugucaucuccguguugauc

SEQ ID NO: 2878815 - RNA, 17 nt, Mycobacterium avium subsp. paratuberculosis
guguccacgucgcccag

SEQ ID NO: 2878816 - RNA, 20 nt, Mycobacterium avium subsp. paratuberculosis
guguccagaacucggcggcg

SEQ ID NO: 2878817 - RNA, 22 nt, Mycobacterium avium subsp. paratuberculosis
guguccagaacucggcggcggu

SEQ ID NO: 2878818 - RNA, 14 nt, Mycobacterium avium subsp. paratuberculosis
guguccagccgcac

SEQ ID NO: 2878819 - RNA, 22 nt, Mycobacterium avium subsp. paratuberculosis
guguccagcggguugucgucgu

SEQ ID NO: 2878820 - RNA, 13 nt, Mycobacterium avium subsp. paratuberculosis
gugucccagcgcc

SEQ ID NO: 2878821 - RNA, 14 nt, Mycobacterium avium subsp. paratuberculosis
gugucccagcgcca

SEQ ID NO: 2878822 - RNA, 14 nt, Mycobacterium avium subsp. paratuberculosis
gugucccggcgccc

SEQ ID NO: 2878823 - RNA, 13 nt, Mycobacterium avium subsp. paratuberculosis
guguccgacgccg

SEQ ID NO: 2878824 - RNA, 17 nt, Mycobacterium avium subsp. paratuberculosis
guguccgacgccgucga

SEQ ID NO: 2878825 - RNA, 14 nt, Mycobacterium avium subsp. paratuberculosis
guguccgagcgggc

SEQ ID NO: 2878826 - RNA, 15 nt, Mycobacterium avium subsp. paratuberculosis
guguccgaugacgag

SEQ ID NO: 2878827 - RNA, 17 nt, Mycobacterium avium subsp. paratuberculosis
guguccgcggcgucggg

SEQ ID NO: 2878828 - RNA, 11 nt, Mycobacterium avium subsp. paratuberculosis
guguccggccc

SEQ ID NO: 2878829 - RNA, 13 nt, Mycobacterium avium subsp. paratuberculosis
guguccggcccga

SEQ ID NO: 2878830 - RNA, 21 nt, Mycobacterium avium subsp. paratuberculosis
guguccggcccgaugcggacc

SEQ ID NO: 2878831 - RNA, 14 nt, Mycobacterium avium subsp. paratuberculosis
guguccgggcccga

SEQ ID NO: 2878832 - RNA, 15 nt, Mycobacterium avium subsp. paratuberculosis
guguccgggcgccca

SEQ ID NO: 2878833 - RNA, 16 nt, Mycobacterium avium subsp. paratuberculosis
guguccgggcgcccag

SEQ ID NO: 2878834 - RNA, 18 nt, Mycobacterium avium subsp. paratuberculosis
guguccgucgccggaggc

SEQ ID NO: 2878835 - RNA, 15 nt, Mycobacterium avium subsp. paratuberculosis
guguccuugcgcacc

SEQ ID NO: 2878836 - RNA, 13 nt, Mycobacterium avium subsp. paratuberculosis
gugucgaacagca

SEQ ID NO: 2878837 - RNA, 14 nt, Mycobacterium avium subsp. paratuberculosis
gugucgaacagcag

SEQ ID NO: 2878838 - RNA, 17 nt, Mycobacterium avium subsp. paratuberculosis
gugucgaacagcaggcc

SEQ ID NO: 2878839 - RNA, 20 nt, Mycobacterium avium subsp. paratuberculosis
gugucgaacagcaggcccag

SEQ ID NO: 2878840 - RNA, 23 nt, Mycobacterium avium subsp. paratuberculosis
gugucgaacagguuugagcgugc

SEQ ID NO: 2878841 - RNA, 19 nt, Mycobacterium avium subsp. paratuberculosis
gugucgaagaccggugcgc

SEQ ID NO: 2878842 - RNA, 21 nt, Mycobacterium avium subsp. paratuberculosis
gugucgaagaccggugcgcgc

SEQ ID NO: 2878843 - RNA, 18 nt, Mycobacterium avium subsp. paratuberculosis
gugucgaagacgguccgc

SEQ ID NO: 2878844 - RNA, 22 nt, Mycobacterium avium subsp. paratuberculosis
gugucgaagcugcgcagccgug

SEQ ID NO: 2878845 - RNA, 20 nt, Mycobacterium avium subsp. paratuberculosis
gugucgacccaggucgaguu

SEQ ID NO: 2878846 - RNA, 20 nt, Mycobacterium avium subsp. paratuberculosis
gugucgagcacgucgacgcc

SEQ ID NO: 2878847 - RNA, 23 nt, Mycobacterium avium subsp. paratuberculosis
gugucgagcacgucgacgccggu

SEQ ID NO: 2878848 - RNA, 21 nt, Mycobacterium avium subsp. paratuberculosis
gugucgcacugcuucgggucg

SEQ ID NO: 2878849 - RNA, 22 nt, Mycobacterium avium subsp. paratuberculosis
gugucgcccagcugggccagcg

SEQ ID NO: 2878850 - RNA, 23 nt, Mycobacterium avium subsp. paratuberculosis
gugucgcccagcugggccagcgc

SEQ ID NO: 2878851 - RNA, 20 nt, Mycobacterium avium subsp. paratuberculosis
gugucgcccguggcccacgg

SEQ ID NO: 2878852 - RNA, 15 nt, Mycobacterium avium subsp. paratuberculosis
gugucgcccucgcgc

SEQ ID NO: 2878853 - RNA, 13 nt, Mycobacterium avium subsp. paratuberculosis
gugucgcccucgg

SEQ ID NO: 2878854 - RNA, 19 nt, Mycobacterium avium subsp. paratuberculosis
gugucgcuguaggccagcc

SEQ ID NO: 2878855 - RNA, 20 nt, Mycobacterium avium subsp. paratuberculosis
gugucgcuguaggccagccc

SEQ ID NO: 2878856 - RNA, 18 nt, Mycobacterium avium subsp. paratuberculosis
gugucggaaucggcgccg

SEQ ID NO: 2878857 - RNA, 11 nt, Mycobacterium avium subsp. paratuberculosis
gugucggcgaa

SEQ ID NO: 2878858 - RNA, 21 nt, Mycobacterium avium subsp. paratuberculosis
gugucggcgaaggugccccgc

SEQ ID NO: 2878859 - RNA, 13 nt, Mycobacterium avium subsp. paratuberculosis
gugucggcgcccc

SEQ ID NO: 2878860 - RNA, 13 nt, Mycobacterium avium subsp. paratuberculosis
gugucggcgggcg

SEQ ID NO: 2878861 - RNA, 14 nt, Mycobacterium avium subsp. paratuberculosis
gugucggcggggcc

SEQ ID NO: 2878862 - RNA, 13 nt, Mycobacterium avium subsp. paratuberculosis
gugucggcgucga

SEQ ID NO: 2878863 - RNA, 21 nt, Mycobacterium avium subsp. paratuberculosis
gugucggggucggcgccgcgc

SEQ ID NO: 2878864 - RNA, 21 nt, Mycobacterium avium subsp. paratuberculosis
gugucgggguggugggcgcga

SEQ ID NO: 2878865 - RNA, 23 nt, Mycobacterium avium subsp. paratuberculosis
gugucgggugguuuugcgucugc

SEQ ID NO: 2878866 - RNA, 16 nt, Mycobacterium avium subsp. paratuberculosis
gugucggugcccaggu

SEQ ID NO: 2878867 - RNA, 18 nt, Mycobacterium avium subsp. paratuberculosis
gugucggugcccaggucg

SEQ ID NO: 2878868 - RNA, 19 nt, Mycobacterium avium subsp. paratuberculosis
gugucggugccgagcacgc

SEQ ID NO: 2878869 - RNA, 16 nt, Mycobacterium avium subsp. paratuberculosis
gugucguagacgacgu

SEQ ID NO: 2878870 - RNA, 21 nt, Mycobacterium avium subsp. paratuberculosis
gugucguaguugcgcgccgau

SEQ ID NO: 2878871 - RNA, 13 nt, Mycobacterium avium subsp. paratuberculosis
gugucgucgcgca

SEQ ID NO: 2878872 - RNA, 13 nt, Mycobacterium avium subsp. paratuberculosis
gugucgucgucgc

SEQ ID NO: 2878873 - RNA, 21 nt, Mycobacterium avium subsp. paratuberculosis
gugucguggcgugccgggcgg

SEQ ID NO: 2878874 - RNA, 17 nt, Mycobacterium avium subsp. paratuberculosis
gugucuuucucgaugac

SEQ ID NO: 2878875 - RNA, 20 nt, Mycobacterium avium subsp. paratuberculosis
gugugauucgggucagaccg

SEQ ID NO: 2878876 - RNA, 14 nt, Mycobacterium avium subsp. paratuberculosis
gugugcaaggcgau

SEQ ID NO: 2878877 - RNA, 16 nt, Mycobacterium avium subsp. paratuberculosis
gugugcagcagcucgg

SEQ ID NO: 2878878 - RNA, 14 nt, Mycobacterium avium subsp. paratuberculosis
gugugcagccaccc

SEQ ID NO: 2878879 - RNA, 18 nt, Mycobacterium avium subsp. paratuberculosis
gugugcagccagguggug

SEQ ID NO: 2878880 - RNA, 13 nt, Mycobacterium avium subsp. paratuberculosis
gugugcaggccga

SEQ ID NO: 2878881 - RNA, 15 nt, Mycobacterium avium subsp. paratuberculosis
gugugcccagcacga

SEQ ID NO: 2878882 - RNA, 12 nt, Mycobacterium avium subsp. paratuberculosis
gugugcccgccc

SEQ ID NO: 2878883 - RNA, 19 nt, Mycobacterium avium subsp. paratuberculosis
gugugccgcugcauccgca

SEQ ID NO: 2878884 - RNA, 14 nt, Mycobacterium avium subsp. paratuberculosis
gugugccgcuggua

SEQ ID NO: 2878885 - RNA, 20 nt, Mycobacterium avium subsp. paratuberculosis
gugugccgcugguaggcggc

SEQ ID NO: 2878886 - RNA, 18 nt, Mycobacterium avium subsp. paratuberculosis
gugugcgcaucggcgacg

SEQ ID NO: 2878887 - RNA, 21 nt, Mycobacterium avium subsp. paratuberculosis
gugugcgguucacgcggcugg

SEQ ID NO: 2878888 - RNA, 18 nt, Mycobacterium avium subsp. paratuberculosis
gugugcugacccagcgcg

SEQ ID NO: 2878889 - RNA, 15 nt, Mycobacterium avium subsp. paratuberculosis
gugugcuggccagca

SEQ ID NO: 2878890 - RNA, 15 nt, Mycobacterium avium subsp. paratuberculosis
guguggacggcgagu

SEQ ID NO: 2878891 - RNA, 16 nt, Mycobacterium avium subsp. paratuberculosis
guguggcacccgggug

SEQ ID NO: 2878892 - RNA, 18 nt, Mycobacterium avium subsp. paratuberculosis
guguggcccugcgucauc

SEQ ID NO: 2878893 - RNA, 22 nt, Mycobacterium avium subsp. paratuberculosis
guguggccgcccucgcugccgc

SEQ ID NO: 2878894 - RNA, 13 nt, Mycobacterium avium subsp. paratuberculosis
guguggccgcggc

SEQ ID NO: 2878895 - RNA, 17 nt, Mycobacterium avium subsp. paratuberculosis
guguggccgcgguggug

SEQ ID NO: 2878896 - RNA, 13 nt, Mycobacterium avium subsp. paratuberculosis
guguggcgcacgc

SEQ ID NO: 2878897 - RNA, 14 nt, Mycobacterium avium subsp. paratuberculosis
guguggcgcugaug

SEQ ID NO: 2878898 - RNA, 20 nt, Mycobacterium avium subsp. paratuberculosis
guguggcucgugggaaugcg

SEQ ID NO: 2878899 - RNA, 14 nt, Mycobacterium avium subsp. paratuberculosis
gugugggcgcccgc

SEQ ID NO: 2878900 - RNA, 19 nt, Mycobacterium avium subsp. paratuberculosis
gugugggcggacugcccga

SEQ ID NO: 2878901 - RNA, 19 nt, Mycobacterium avium subsp. paratuberculosis
guguggggaauccgguggg

SEQ ID NO: 2878902 - RNA, 21 nt, Mycobacterium avium subsp. paratuberculosis
guguggggaauccgguggggu

SEQ ID NO: 2878903 - RNA, 21 nt, Mycobacterium avium subsp. paratuberculosis
gugugguacagcgccagcggc

SEQ ID NO: 2878904 - RNA, 13 nt, Mycobacterium avium subsp. paratuberculosis
guguggugccggg

SEQ ID NO: 2878905 - RNA, 23 nt, Mycobacterium avium subsp. paratuberculosis
guguucagccccucguccaggug

SEQ ID NO: 2878906 - RNA, 14 nt, Mycobacterium avium subsp. paratuberculosis
guguucgagggcgc

SEQ ID NO: 2878907 - RNA, 15 nt, Mycobacterium avium subsp. paratuberculosis
guguucggcgccagc

SEQ ID NO: 2878908 - RNA, 17 nt, Mycobacterium avium subsp. paratuberculosis
guguucggcgccagccg

SEQ ID NO: 2878909 - RNA, 19 nt, Mycobacterium avium subsp. paratuberculosis
guguucgggucgguggcga

SEQ ID NO: 2878910 - RNA, 21 nt, Mycobacterium avium subsp. paratuberculosis
guguucgguggagcgcggcau

SEQ ID NO: 2878911 - RNA, 19 nt, Mycobacterium avium subsp. paratuberculosis
guguucuggaugcccaggg

SEQ ID NO: 2878912 - RNA, 16 nt, Mycobacterium avium subsp. paratuberculosis
guguugagcucgcggc

SEQ ID NO: 2878913 - RNA, 19 nt, Mycobacterium avium subsp. paratuberculosis
guguugaucucgucgauga

SEQ ID NO: 2878914 - RNA, 16 nt, Mycobacterium avium subsp. paratuberculosis
guguugccgacggcgc

SEQ ID NO: 2878915 - RNA, 19 nt, Mycobacterium avium subsp. paratuberculosis
guguugccgacggcgccgg

SEQ ID NO: 2878916 - RNA, 13 nt, Mycobacterium avium subsp. paratuberculosis
guguugcgcaccc

SEQ ID NO: 2878917 - RNA, 13 nt, Mycobacterium avium subsp. paratuberculosis
guguugcgcagcg

SEQ ID NO: 2878918 - RNA, 19 nt, Mycobacterium avium subsp. paratuberculosis
guguugcggcagggccacc

SEQ ID NO: 2878919 - RNA, 20 nt, Mycobacterium avium subsp. paratuberculosis
guguuguaggagcugccggc

SEQ ID NO: 2878920 - RNA, 19 nt, Mycobacterium avium subsp. paratuberculosis
guguuguccgagccgccca

SEQ ID NO: 2878921 - RNA, 23 nt, Mycobacterium avium subsp. paratuberculosis
guguuguccgguaggccggccgc

SEQ ID NO: 2878922 - RNA, 16 nt, Mycobacterium avium subsp. paratuberculosis
guguugucgugccggg

SEQ ID NO: 2878923 - RNA, 22 nt, Mycobacterium avium subsp. paratuberculosis
guguugucgugccgggugaugc

SEQ ID NO: 2878924 - RNA, 22 nt, Mycobacterium avium subsp. paratuberculosis
guguuguucauccccagcacgg

SEQ ID NO: 2878925 - RNA, 19 nt, Mycobacterium avium subsp. paratuberculosis
guuaaccgaagcggcccga

SEQ ID NO: 2878926 - RNA, 14 nt, Mycobacterium avium subsp. paratuberculosis
guuacgguagcacu

SEQ ID NO: 2878927 - RNA, 20 nt, Mycobacterium avium subsp. paratuberculosis
guuaggcauccugcuggccg

SEQ ID NO: 2878928 - RNA, 16 nt, Mycobacterium avium subsp. paratuberculosis
guuagggcgaccacca

SEQ ID NO: 2878929 - RNA, 17 nt, Mycobacterium avium subsp. paratuberculosis
guuagggcgucaggcgc

SEQ ID NO: 2878930 - RNA, 11 nt, Mycobacterium avium subsp. paratuberculosis
guuaguuucac

SEQ ID NO: 2878931 - RNA, 17 nt, Mycobacterium avium subsp. paratuberculosis
guucaacgcgccgaugc

SEQ ID NO: 2878932 - RNA, 14 nt, Mycobacterium avium subsp. paratuberculosis
guucaagccgccga

SEQ ID NO: 2878933 - RNA, 15 nt, Mycobacterium avium subsp. paratuberculosis
guucaagccggcgug

SEQ ID NO: 2878934 - RNA, 14 nt, Mycobacterium avium subsp. paratuberculosis
guucaccaccgcgc

SEQ ID NO: 2878935 - RNA, 15 nt, Mycobacterium avium subsp. paratuberculosis
guucaccaccgcgcu

SEQ ID NO: 2878936 - RNA, 21 nt, Mycobacterium avium subsp. paratuberculosis
guucaccaccgcgcugcgcgc

SEQ ID NO: 2878937 - RNA, 20 nt, Mycobacterium avium subsp. paratuberculosis
guucaccaccggagcggcgg

SEQ ID NO: 2878938 - RNA, 13 nt, Mycobacterium avium subsp. paratuberculosis
guucaccagcggg

SEQ ID NO: 2878939 - RNA, 20 nt, Mycobacterium avium subsp. paratuberculosis
guucaccccgaucaacaccg

SEQ ID NO: 2878940 - RNA, 21 nt, Mycobacterium avium subsp. paratuberculosis
guucaccccguugagcagcgg

SEQ ID NO: 2878941 - RNA, 17 nt, Mycobacterium avium subsp. paratuberculosis
guucacccgcgcccgca

SEQ ID NO: 2878942 - RNA, 18 nt, Mycobacterium avium subsp. paratuberculosis
guucacccgcgcccgcau

SEQ ID NO: 2878943 - RNA, 19 nt, Mycobacterium avium subsp. paratuberculosis
guucacccuggcgaaccgc

SEQ ID NO: 2878944 - RNA, 22 nt, Mycobacterium avium subsp. paratuberculosis
guucacccuggcgaaccgcggc

SEQ ID NO: 2878945 - RNA, 14 nt, Mycobacterium avium subsp. paratuberculosis
guucaccgccacca

SEQ ID NO: 2878946 - RNA, 19 nt, Mycobacterium avium subsp. paratuberculosis
guucaccgccaccagcagg

SEQ ID NO: 2878947 - RNA, 15 nt, Mycobacterium avium subsp. paratuberculosis
guucaccgcgccggg

SEQ ID NO: 2878948 - RNA, 23 nt, Mycobacterium avium subsp. paratuberculosis
guucaccgcgccgggcaccacca

SEQ ID NO: 2878949 - RNA, 14 nt, Mycobacterium avium subsp. paratuberculosis
guucaccggcguca

SEQ ID NO: 2878950 - RNA, 17 nt, Mycobacterium avium subsp. paratuberculosis
guucaccucuucgggca

SEQ ID NO: 2878951 - RNA, 15 nt, Mycobacterium avium subsp. paratuberculosis
guucacgcggcuggc

SEQ ID NO: 2878952 - RNA, 18 nt, Mycobacterium avium subsp. paratuberculosis
guucagaagucgcccgcg

SEQ ID NO: 2878953 - RNA, 18 nt, Mycobacterium avium subsp. paratuberculosis
guucagcagccggcagac

SEQ ID NO: 2878954 - RNA, 16 nt, Mycobacterium avium subsp. paratuberculosis
guucagccugaugccg

SEQ ID NO: 2878955 - RNA, 22 nt, Mycobacterium avium subsp. paratuberculosis
guucagcgacuugccgccggcg

SEQ ID NO: 2878956 - RNA, 19 nt, Mycobacterium avium subsp. paratuberculosis
guucagcgcgcgggagcgc

SEQ ID NO: 2878957 - RNA, 16 nt, Mycobacterium avium subsp. paratuberculosis
guucagcgcggccacc

SEQ ID NO: 2878958 - RNA, 22 nt, Mycobacterium avium subsp. paratuberculosis
guucagcgcggccaccuccagc

SEQ ID NO: 2878959 - RNA, 14 nt, Mycobacterium avium subsp. paratuberculosis
guucagcugcagcc

SEQ ID NO: 2878960 - RNA, 15 nt, Mycobacterium avium subsp. paratuberculosis
guucagcugcagccg

SEQ ID NO: 2878961 - RNA, 18 nt, Mycobacterium avium subsp. paratuberculosis
guucagcugcagccggcc

SEQ ID NO: 2878962 - RNA, 19 nt, Mycobacterium avium subsp. paratuberculosis
guucagcugcagccggccg

SEQ ID NO: 2878963 - RNA, 20 nt, Mycobacterium avium subsp. paratuberculosis
guucagggugcguuccaggu

SEQ ID NO: 2878964 - RNA, 16 nt, Mycobacterium avium subsp. paratuberculosis
guucauccacucggcc

SEQ ID NO: 2878965 - RNA, 20 nt, Mycobacterium avium subsp. paratuberculosis
guucauccacucggccacca

SEQ ID NO: 2878966 - RNA, 11 nt, Mycobacterium avium subsp. paratuberculosis
guucaugaucg

SEQ ID NO: 2878967 - RNA, 17 nt, Mycobacterium avium subsp. paratuberculosis
guucaugaucggcagga

SEQ ID NO: 2878968 - RNA, 17 nt, Mycobacterium avium subsp. paratuberculosis
guucauguagcagcgcg

SEQ ID NO: 2878969 - RNA, 16 nt, Mycobacterium avium subsp. paratuberculosis
guucauucagcaccuu

SEQ ID NO: 2878970 - RNA, 16 nt, Mycobacterium avium subsp. paratuberculosis
guuccaacaacuucga

SEQ ID NO: 2878971 - RNA, 20 nt, Mycobacterium avium subsp. paratuberculosis
guuccaacaacuucgagcag

SEQ ID NO: 2878972 - RNA, 22 nt, Mycobacterium avium subsp. paratuberculosis
guuccaaccaccguggccccag

SEQ ID NO: 2878973 - RNA, 23 nt, Mycobacterium avium subsp. paratuberculosis
guuccacaucagguugaccaggu

SEQ ID NO: 2878974 - RNA, 16 nt, Mycobacterium avium subsp. paratuberculosis
guuccaccagcggccg

SEQ ID NO: 2878975 - RNA, 15 nt, Mycobacterium avium subsp. paratuberculosis
guuccaccgggccgc

SEQ ID NO: 2878976 - RNA, 19 nt, Mycobacterium avium subsp. paratuberculosis
guuccacgugucggcgucg

SEQ ID NO: 2878977 - RNA, 14 nt, Mycobacterium avium subsp. paratuberculosis
guuccagaaccggc

SEQ ID NO: 2878978 - RNA, 23 nt, Mycobacterium avium subsp. paratuberculosis
guuccagcacccggcccacgccg

SEQ ID NO: 2878979 - RNA, 15 nt, Mycobacterium avium subsp. paratuberculosis
guuccagccgaucgc

SEQ ID NO: 2878980 - RNA, 14 nt, Mycobacterium avium subsp. paratuberculosis
guuccagccgugcu

SEQ ID NO: 2878981 - RNA, 22 nt, Mycobacterium avium subsp. paratuberculosis
guuccagcuccguccaccggca

SEQ ID NO: 2878982 - RNA, 19 nt, Mycobacterium avium subsp. paratuberculosis
guuccagguccgcgguggu

SEQ ID NO: 2878983 - RNA, 23 nt, Mycobacterium avium subsp. paratuberculosis
guuccaggugugccgcugguagg

SEQ ID NO: 2878984 - RNA, 17 nt, Mycobacterium avium subsp. paratuberculosis
guuccaucagcgcccgc

SEQ ID NO: 2878985 - RNA, 18 nt, Mycobacterium avium subsp. paratuberculosis
guuccaucgggcccagca

SEQ ID NO: 2878986 - RNA, 20 nt, Mycobacterium avium subsp. paratuberculosis
guuccaucgggcccagcagc

SEQ ID NO: 2878987 - RNA, 13 nt, Mycobacterium avium subsp. paratuberculosis
guuccccggccga

SEQ ID NO: 2878988 - RNA, 22 nt, Mycobacterium avium subsp. paratuberculosis
guuccccgggcgagcgucgccg

SEQ ID NO: 2878989 - RNA, 20 nt, Mycobacterium avium subsp. paratuberculosis
guucccgacagcucgcgcug

SEQ ID NO: 2878990 - RNA, 21 nt, Mycobacterium avium subsp. paratuberculosis
guucccggcagaacgacgcca

SEQ ID NO: 2878991 - RNA, 23 nt, Mycobacterium avium subsp. paratuberculosis
guucccggcagaacgacgccagu

SEQ ID NO: 2878992 - RNA, 13 nt, Mycobacterium avium subsp. paratuberculosis
guucccggccggu

SEQ ID NO: 2878993 - RNA, 20 nt, Mycobacterium avium subsp. paratuberculosis
guuccgaacgugcagcuucc

SEQ ID NO: 2878994 - RNA, 22 nt, Mycobacterium avium subsp. paratuberculosis
guuccgaugaagaacaccccga

SEQ ID NO: 2878995 - RNA, 13 nt, Mycobacterium avium subsp. paratuberculosis
guuccgcgucggc

SEQ ID NO: 2878996 - RNA, 16 nt, Mycobacterium avium subsp. paratuberculosis
guuccgguuggccagg

SEQ ID NO: 2878997 - RNA, 18 nt, Mycobacterium avium subsp. paratuberculosis
guuccgucgaacagcggg

SEQ ID NO: 2878998 - RNA, 14 nt, Mycobacterium avium subsp. paratuberculosis
guuccucgacggcg

SEQ ID NO: 2878999 - RNA, 18 nt, Mycobacterium avium subsp. paratuberculosis
guuccucgacguaggcca

SEQ ID NO: 2879000 - RNA, 14 nt, Mycobacterium avium subsp. paratuberculosis
guuccugcgaccgc

SEQ ID NO: 2879001 - RNA, 17 nt, Mycobacterium avium subsp. paratuberculosis
guuccugcgaccgccgc

SEQ ID NO: 2879002 - RNA, 19 nt, Mycobacterium avium subsp. paratuberculosis
guuccuugauccggccgcg

SEQ ID NO: 2879003 - RNA, 17 nt, Mycobacterium avium subsp. paratuberculosis
guuccuugcgcagcacc

SEQ ID NO: 2879004 - RNA, 23 nt, Mycobacterium avium subsp. paratuberculosis
guuccuugcgcagcaccuugccg

SEQ ID NO: 2879005 - RNA, 21 nt, Mycobacterium avium subsp. paratuberculosis
guucgaccccaacccgaaggu

SEQ ID NO: 2879006 - RNA, 16 nt, Mycobacterium avium subsp. paratuberculosis
guucgaccuccacccg

SEQ ID NO: 2879007 - RNA, 18 nt, Mycobacterium avium subsp. paratuberculosis
guucgaccuccacccgcu

SEQ ID NO: 2879008 - RNA, 21 nt, Mycobacterium avium subsp. paratuberculosis
guucgaccuccacgagccggu

SEQ ID NO: 2879009 - RNA, 14 nt, Mycobacterium avium subsp. paratuberculosis
guucgaccucggug

SEQ ID NO: 2879010 - RNA, 15 nt, Mycobacterium avium subsp. paratuberculosis
guucgaccucgguga

SEQ ID NO: 2879011 - RNA, 14 nt, Mycobacterium avium subsp. paratuberculosis
guucgacgccggug

SEQ ID NO: 2879012 - RNA, 17 nt, Mycobacterium avium subsp. paratuberculosis
guucgacgccucggugc

SEQ ID NO: 2879013 - RNA, 19 nt, Mycobacterium avium subsp. paratuberculosis
guucgacgccucggugcgg

SEQ ID NO: 2879014 - RNA, 18 nt, Mycobacterium avium subsp. paratuberculosis
guucgacguagcccgccg

SEQ ID NO: 2879015 - RNA, 19 nt, Mycobacterium avium subsp. paratuberculosis
guucgacgugaucuggucg

SEQ ID NO: 2879016 - RNA, 23 nt, Mycobacterium avium subsp. paratuberculosis
guucgagaguuugcccucgucga

SEQ ID NO: 2879017 - RNA, 17 nt, Mycobacterium avium subsp. paratuberculosis
guucgagaugcguucgg

SEQ ID NO: 2879018 - RNA, 18 nt, Mycobacterium avium subsp. paratuberculosis
guucgagcgccgcggcca

SEQ ID NO: 2879019 - RNA, 19 nt, Mycobacterium avium subsp. paratuberculosis
guucgagcgccgcggccac

SEQ ID NO: 2879020 - RNA, 15 nt, Mycobacterium avium subsp. paratuberculosis
guucgagcgccggac

SEQ ID NO: 2879021 - RNA, 23 nt, Mycobacterium avium subsp. paratuberculosis
guucgaguccugguaccccagca

SEQ ID NO: 2879022 - RNA, 16 nt, Mycobacterium avium subsp. paratuberculosis
guucgagucggccacg

SEQ ID NO: 2879023 - RNA, 17 nt, Mycobacterium avium subsp. paratuberculosis
guucgaguucgucgacc

SEQ ID NO: 2879024 - RNA, 17 nt, Mycobacterium avium subsp. paratuberculosis
guucgauaccguccgcg

SEQ ID NO: 2879025 - RNA, 16 nt, Mycobacterium avium subsp. paratuberculosis
guucgauccgccggug

SEQ ID NO: 2879026 - RNA, 17 nt, Mycobacterium avium subsp. paratuberculosis
guucgaucuccucggcg

SEQ ID NO: 2879027 - RNA, 15 nt, Mycobacterium avium subsp. paratuberculosis
guucgaugacgucgc

SEQ ID NO: 2879028 - RNA, 17 nt, Mycobacterium avium subsp. paratuberculosis
guucgaugacgucgcgc

SEQ ID NO: 2879029 - RNA, 18 nt, Mycobacterium avium subsp. paratuberculosis
guucgaugacgucgcgcu

SEQ ID NO: 2879030 - RNA, 15 nt, Mycobacterium avium subsp. paratuberculosis
guucgaugccgauga

SEQ ID NO: 2879031 - RNA, 18 nt, Mycobacterium avium subsp. paratuberculosis
guucgaugcgcucggcga

SEQ ID NO: 2879032 - RNA, 16 nt, Mycobacterium avium subsp. paratuberculosis
guucgaugucggccag

SEQ ID NO: 2879033 - RNA, 23 nt, Mycobacterium avium subsp. paratuberculosis
guucgaugucggccagcgcggcg

SEQ ID NO: 2879034 - RNA, 20 nt, Mycobacterium avium subsp. paratuberculosis
guucgcaccccaccgacagc

SEQ ID NO: 2879035 - RNA, 15 nt, Mycobacterium avium subsp. paratuberculosis
guucgccaccacggu

SEQ ID NO: 2879036 - RNA, 15 nt, Mycobacterium avium subsp. paratuberculosis
guucgccagcaugcg

SEQ ID NO: 2879037 - RNA, 21 nt, Mycobacterium avium subsp. paratuberculosis
guucgcccgcagcacgcccgu

SEQ ID NO: 2879038 - RNA, 23 nt, Mycobacterium avium subsp. paratuberculosis
guucgcccuccccggccagcacg

SEQ ID NO: 2879039 - RNA, 14 nt, Mycobacterium avium subsp. paratuberculosis
guucgcccuggccg

SEQ ID NO: 2879040 - RNA, 17 nt, Mycobacterium avium subsp. paratuberculosis
guucgccgccagcacgu

SEQ ID NO: 2879041 - RNA, 19 nt, Mycobacterium avium subsp. paratuberculosis
guucgccgccagcacguga

SEQ ID NO: 2879042 - RNA, 13 nt, Mycobacterium avium subsp. paratuberculosis
guucgccggcgac

SEQ ID NO: 2879043 - RNA, 23 nt, Mycobacterium avium subsp. paratuberculosis
guucgccggcguagaccagcgac

SEQ ID NO: 2879044 - RNA, 21 nt, Mycobacterium avium subsp. paratuberculosis
guucgccgguaccgccggcca

SEQ ID NO: 2879045 - RNA, 13 nt, Mycobacterium avium subsp. paratuberculosis
guucgccggugac

SEQ ID NO: 2879046 - RNA, 15 nt, Mycobacterium avium subsp. paratuberculosis
guucgccgucgcggg

SEQ ID NO: 2879047 - RNA, 18 nt, Mycobacterium avium subsp. paratuberculosis
guucgcgcacgcuggccg

SEQ ID NO: 2879048 - RNA, 19 nt, Mycobacterium avium subsp. paratuberculosis
guucgcgcacgcuggccgg

SEQ ID NO: 2879049 - RNA, 19 nt, Mycobacterium avium subsp. paratuberculosis
guucgcgcagccaccgccc

SEQ ID NO: 2879050 - RNA, 12 nt, Mycobacterium avium subsp. paratuberculosis
guucgcgcagcu

SEQ ID NO: 2879051 - RNA, 13 nt, Mycobacterium avium subsp. paratuberculosis
guucgcgccgaga

SEQ ID NO: 2879052 - RNA, 13 nt, Mycobacterium avium subsp. paratuberculosis
guucgcgccgaug

SEQ ID NO: 2879053 - RNA, 15 nt, Mycobacterium avium subsp. paratuberculosis
guucgcggcgcacgu

SEQ ID NO: 2879054 - RNA, 14 nt, Mycobacterium avium subsp. paratuberculosis
guucgcggcgcagc

SEQ ID NO: 2879055 - RNA, 18 nt, Mycobacterium avium subsp. paratuberculosis
guucgcggcgcagcacgg

SEQ ID NO: 2879056 - RNA, 15 nt, Mycobacterium avium subsp. paratuberculosis
guucgcggcuggccg

SEQ ID NO: 2879057 - RNA, 16 nt, Mycobacterium avium subsp. paratuberculosis
guucgcggcuggccgc

SEQ ID NO: 2879058 - RNA, 20 nt, Mycobacterium avium subsp. paratuberculosis
guucgcggugggcucgucga

SEQ ID NO: 2879059 - RNA, 20 nt, Mycobacterium avium subsp. paratuberculosis
guucgcgguugaugaucuug

SEQ ID NO: 2879060 - RNA, 22 nt, Mycobacterium avium subsp. paratuberculosis
guucgcguugagcgucgccacc

SEQ ID NO: 2879061 - RNA, 19 nt, Mycobacterium avium subsp. paratuberculosis
guucgcugcccucggucgc

SEQ ID NO: 2879062 - RNA, 21 nt, Mycobacterium avium subsp. paratuberculosis
guucgcugcccucggucgccg

SEQ ID NO: 2879063 - RNA, 22 nt, Mycobacterium avium subsp. paratuberculosis
guucgcugcccucggucgccga

SEQ ID NO: 2879064 - RNA, 15 nt, Mycobacterium avium subsp. paratuberculosis
guucgcuggcggcca

SEQ ID NO: 2879065 - RNA, 17 nt, Mycobacterium avium subsp. paratuberculosis
guucgcuggcggggcgu

SEQ ID NO: 2879066 - RNA, 23 nt, Mycobacterium avium subsp. paratuberculosis
guucgcuggcggggcgugcccgg

SEQ ID NO: 2879067 - RNA, 19 nt, Mycobacterium avium subsp. paratuberculosis
guucgcuuucgccgggcgu

SEQ ID NO: 2879068 - RNA, 21 nt, Mycobacterium avium subsp. paratuberculosis
guucgcuuucgccgggcguca

SEQ ID NO: 2879069 - RNA, 17 nt, Mycobacterium avium subsp. paratuberculosis
guucggacaccucggcc

SEQ ID NO: 2879070 - RNA, 15 nt, Mycobacterium avium subsp. paratuberculosis
guucggacacggcgc

SEQ ID NO: 2879071 - RNA, 19 nt, Mycobacterium avium subsp. paratuberculosis
guucggacacggcgccgug

SEQ ID NO: 2879072 - RNA, 21 nt, Mycobacterium avium subsp. paratuberculosis
guucggacacggcgccgugcg

SEQ ID NO: 2879073 - RNA, 17 nt, Mycobacterium avium subsp. paratuberculosis
guucggcaucucggccg

SEQ ID NO: 2879074 - RNA, 22 nt, Mycobacterium avium subsp. paratuberculosis
guucggccaauuccucagcccg

SEQ ID NO: 2879075 - RNA, 14 nt, Mycobacterium avium subsp. paratuberculosis
guucggccaccgcg

SEQ ID NO: 2879076 - RNA, 19 nt, Mycobacterium avium subsp. paratuberculosis
guucggccaccgcguccgc

SEQ ID NO: 2879077 - RNA, 18 nt, Mycobacterium avium subsp. paratuberculosis
guucggccagcgccgcca

SEQ ID NO: 2879078 - RNA, 23 nt, Mycobacterium avium subsp. paratuberculosis
guucggccagcgccgccagccgc

SEQ ID NO: 2879079 - RNA, 14 nt, Mycobacterium avium subsp. paratuberculosis
guucggccagcgcg

SEQ ID NO: 2879080 - RNA, 17 nt, Mycobacterium avium subsp. paratuberculosis
guucggccagcgcggug

SEQ ID NO: 2879081 - RNA, 18 nt, Mycobacterium avium subsp. paratuberculosis
guucggccagcgcggugu

SEQ ID NO: 2879082 - RNA, 21 nt, Mycobacterium avium subsp. paratuberculosis
guucggcgacgcugguggccu

SEQ ID NO: 2879083 - RNA, 22 nt, Mycobacterium avium subsp. paratuberculosis
guucggcgacgcugguggccug

SEQ ID NO: 2879084 - RNA, 13 nt, Mycobacterium avium subsp. paratuberculosis
guucggcgccagc

SEQ ID NO: 2879085 - RNA, 17 nt, Mycobacterium avium subsp. paratuberculosis
guucggcgccagccgca

SEQ ID NO: 2879086 - RNA, 22 nt, Mycobacterium avium subsp. paratuberculosis
guucggcgccagccgcaccgcg

SEQ ID NO: 2879087 - RNA, 22 nt, Mycobacterium avium subsp. paratuberculosis
guucggcgcggaucgucaccga

SEQ ID NO: 2879088 - RNA, 17 nt, Mycobacterium avium subsp. paratuberculosis
guucggcggcgcggccc

SEQ ID NO: 2879089 - RNA, 13 nt, Mycobacterium avium subsp. paratuberculosis
guucggcgggccu

SEQ ID NO: 2879090 - RNA, 14 nt, Mycobacterium avium subsp. paratuberculosis
guucggcgucgaaa

SEQ ID NO: 2879091 - RNA, 17 nt, Mycobacterium avium subsp. paratuberculosis
guucgggaaccuggccg

SEQ ID NO: 2879092 - RNA, 18 nt, Mycobacterium avium subsp. paratuberculosis
guucgggauccucgccgc

SEQ ID NO: 2879093 - RNA, 22 nt, Mycobacterium avium subsp. paratuberculosis
guucgggauccucgccgcgggc

SEQ ID NO: 2879094 - RNA, 19 nt, Mycobacterium avium subsp. paratuberculosis
guucgggaucggcgcccac

SEQ ID NO: 2879095 - RNA, 15 nt, Mycobacterium avium subsp. paratuberculosis
guucgggaucgucgc

SEQ ID NO: 2879096 - RNA, 21 nt, Mycobacterium avium subsp. paratuberculosis
guucgggcagauggucgccga

SEQ ID NO: 2879097 - RNA, 20 nt, Mycobacterium avium subsp. paratuberculosis
guucggguagacgaucaccg

SEQ ID NO: 2879098 - RNA, 16 nt, Mycobacterium avium subsp. paratuberculosis
guucgggucgguggcg

SEQ ID NO: 2879099 - RNA, 15 nt, Mycobacterium avium subsp. paratuberculosis
guucggucagcacga

SEQ ID NO: 2879100 - RNA, 17 nt, Mycobacterium avium subsp. paratuberculosis
guucggucagcacgaca

SEQ ID NO: 2879101 - RNA, 13 nt, Mycobacterium avium subsp. paratuberculosis
guucggugcacgg

SEQ ID NO: 2879102 - RNA, 16 nt, Mycobacterium avium subsp. paratuberculosis
guucggugcacggcgc

SEQ ID NO: 2879103 - RNA, 19 nt, Mycobacterium avium subsp. paratuberculosis
guucggugcacggcgccac

SEQ ID NO: 2879104 - RNA, 15 nt, Mycobacterium avium subsp. paratuberculosis
guucggugcccgggg

SEQ ID NO: 2879105 - RNA, 16 nt, Mycobacterium avium subsp. paratuberculosis
guucggugcgggucac

SEQ ID NO: 2879106 - RNA, 15 nt, Mycobacterium avium subsp. paratuberculosis
guucgguggccccgg

SEQ ID NO: 2879107 - RNA, 14 nt, Mycobacterium avium subsp. paratuberculosis
guucgguggggccg

SEQ ID NO: 2879108 - RNA, 18 nt, Mycobacterium avium subsp. paratuberculosis
guucgguggggccgccgu

SEQ ID NO: 2879109 - RNA, 20 nt, Mycobacterium avium subsp. paratuberculosis
guucgucaacgccccggucg

SEQ ID NO: 2879110 - RNA, 14 nt, Mycobacterium avium subsp. paratuberculosis
guucguccagcccg

SEQ ID NO: 2879111 - RNA, 13 nt, Mycobacterium avium subsp. paratuberculosis
guucgucccgcgc

SEQ ID NO: 2879112 - RNA, 16 nt, Mycobacterium avium subsp. paratuberculosis
guucguccgugcugcc

SEQ ID NO: 2879113 - RNA, 19 nt, Mycobacterium avium subsp. paratuberculosis
guucguccgugcugccggc

SEQ ID NO: 2879114 - RNA, 23 nt, Mycobacterium avium subsp. paratuberculosis
guucgucgaguucgcggcgcagc

SEQ ID NO: 2879115 - RNA, 14 nt, Mycobacterium avium subsp. paratuberculosis
guucgucgccggug

SEQ ID NO: 2879116 - RNA, 15 nt, Mycobacterium avium subsp. paratuberculosis
guucgucgccgguga

SEQ ID NO: 2879117 - RNA, 16 nt, Mycobacterium avium subsp. paratuberculosis
guucgucgcggcggcc

SEQ ID NO: 2879118 - RNA, 22 nt, Mycobacterium avium subsp. paratuberculosis
guucgucgcggcggcccgucgc

SEQ ID NO: 2879119 - RNA, 13 nt, Mycobacterium avium subsp. paratuberculosis
guucgucggcgau

SEQ ID NO: 2879120 - RNA, 12 nt, Mycobacterium avium subsp. paratuberculosis
guucgucgucgc

SEQ ID NO: 2879121 - RNA, 21 nt, Mycobacterium avium subsp. paratuberculosis
guucgucgucgcgcaggucgg

SEQ ID NO: 2879122 - RNA, 13 nt, Mycobacterium avium subsp. paratuberculosis
guucgugagcggu

SEQ ID NO: 2879123 - RNA, 18 nt, Mycobacterium avium subsp. paratuberculosis
guucgugagcgguggcca

SEQ ID NO: 2879124 - RNA, 14 nt, Mycobacterium avium subsp. paratuberculosis
guucguugcgccgc

SEQ ID NO: 2879125 - RNA, 16 nt, Mycobacterium avium subsp. paratuberculosis
guucguugcgccgcca

SEQ ID NO: 2879126 - RNA, 18 nt, Mycobacterium avium subsp. paratuberculosis
guucguugcgccgccagg

SEQ ID NO: 2879127 - RNA, 13 nt, Mycobacterium avium subsp. paratuberculosis
guucuccaccgcg

SEQ ID NO: 2879128 - RNA, 12 nt, Mycobacterium avium subsp. paratuberculosis
guucuccagcac

SEQ ID NO: 2879129 - RNA, 13 nt, Mycobacterium avium subsp. paratuberculosis
guucuccagcacc

SEQ ID NO: 2879130 - RNA, 16 nt, Mycobacterium avium subsp. paratuberculosis
guucuccagcacccgc

SEQ ID NO: 2879131 - RNA, 23 nt, Mycobacterium avium subsp. paratuberculosis
guucuccagcacgaaggccgccg

SEQ ID NO: 2879132 - RNA, 13 nt, Mycobacterium avium subsp. paratuberculosis
guucuccccgccg

SEQ ID NO: 2879133 - RNA, 21 nt, Mycobacterium avium subsp. paratuberculosis
guucuccgaggcguccuccuc

SEQ ID NO: 2879134 - RNA, 14 nt, Mycobacterium avium subsp. paratuberculosis
guucuccucgucgc

SEQ ID NO: 2879135 - RNA, 16 nt, Mycobacterium avium subsp. paratuberculosis
guucuccucgucgcgg

SEQ ID NO: 2879136 - RNA, 17 nt, Mycobacterium avium subsp. paratuberculosis
guucucgagcccgaucu

SEQ ID NO: 2879137 - RNA, 21 nt, Mycobacterium avium subsp. paratuberculosis
guucucgcacccggucaggua

SEQ ID NO: 2879138 - RNA, 17 nt, Mycobacterium avium subsp. paratuberculosis
guucucgcgcaggucac

SEQ ID NO: 2879139 - RNA, 16 nt, Mycobacterium avium subsp. paratuberculosis
guucucgcggcggccg

SEQ ID NO: 2879140 - RNA, 23 nt, Mycobacterium avium subsp. paratuberculosis
guucucggaguaguuccggcggu

SEQ ID NO: 2879141 - RNA, 21 nt, Mycobacterium avium subsp. paratuberculosis
guucugauacaccacccggug

SEQ ID NO: 2879142 - RNA, 14 nt, Mycobacterium avium subsp. paratuberculosis
guucugcaccagcu

SEQ ID NO: 2879143 - RNA, 20 nt, Mycobacterium avium subsp. paratuberculosis
guucugcacguccucgucgg

SEQ ID NO: 2879144 - RNA, 13 nt, Mycobacterium avium subsp. paratuberculosis
guucugcacgugg

SEQ ID NO: 2879145 - RNA, 17 nt, Mycobacterium avium subsp. paratuberculosis
guucugcucgaaggcaa

SEQ ID NO: 2879146 - RNA, 19 nt, Mycobacterium avium subsp. paratuberculosis
guucugcucgaucucggcc

SEQ ID NO: 2879147 - RNA, 19 nt, Mycobacterium avium subsp. paratuberculosis
guucugggcgggcucgagc

SEQ ID NO: 2879148 - RNA, 17 nt, Mycobacterium avium subsp. paratuberculosis
guucugguaggcggccg

SEQ ID NO: 2879149 - RNA, 17 nt, Mycobacterium avium subsp. paratuberculosis
guucuucgaccacgcgc

SEQ ID NO: 2879150 - RNA, 22 nt, Mycobacterium avium subsp. paratuberculosis
guucuucgucagguucgaggug

SEQ ID NO: 2879151 - RNA, 19 nt, Mycobacterium avium subsp. paratuberculosis
guucuucugcgcgaugucg

SEQ ID NO: 2879152 - RNA, 23 nt, Mycobacterium avium subsp. paratuberculosis
guugaacgacaucaccaccgccg

SEQ ID NO: 2879153 - RNA, 19 nt, Mycobacterium avium subsp. paratuberculosis
guugaacggcaccccgcgg

SEQ ID NO: 2879154 - RNA, 13 nt, Mycobacterium avium subsp. paratuberculosis
guugaagcuggcc

SEQ ID NO: 2879155 - RNA, 16 nt, Mycobacterium avium subsp. paratuberculosis
guugaaguccggcggu

SEQ ID NO: 2879156 - RNA, 17 nt, Mycobacterium avium subsp. paratuberculosis
guugaagucuucggcca

SEQ ID NO: 2879157 - RNA, 11 nt, Mycobacterium avium subsp. paratuberculosis
guugaccacca

SEQ ID NO: 2879158 - RNA, 14 nt, Mycobacterium avium subsp. paratuberculosis
guugaccaccagcg

SEQ ID NO: 2879159 - RNA, 15 nt, Mycobacterium avium subsp. paratuberculosis
guugaccaccagcgu

SEQ ID NO: 2879160 - RNA, 18 nt, Mycobacterium avium subsp. paratuberculosis
guugaccaccagguaggc

SEQ ID NO: 2879161 - RNA, 16 nt, Mycobacterium avium subsp. paratuberculosis
guugaccaggugggcg

SEQ ID NO: 2879162 - RNA, 22 nt, Mycobacterium avium subsp. paratuberculosis
guugaccccgacggcgccgcgg

SEQ ID NO: 2879163 - RNA, 17 nt, Mycobacterium avium subsp. paratuberculosis
guugaccgacgccucca

SEQ ID NO: 2879164 - RNA, 22 nt, Mycobacterium avium subsp. paratuberculosis
guugaccgccgacaccaccgcg

SEQ ID NO: 2879165 - RNA, 21 nt, Mycobacterium avium subsp. paratuberculosis
guugaccgcgaagguggcacg

SEQ ID NO: 2879166 - RNA, 20 nt, Mycobacterium avium subsp. paratuberculosis
guugaccgggccgcugguga

SEQ ID NO: 2879167 - RNA, 20 nt, Mycobacterium avium subsp. paratuberculosis
guugaccguugcgccccaga

SEQ ID NO: 2879168 - RNA, 17 nt, Mycobacterium avium subsp. paratuberculosis
guugaccuugaccagcu

SEQ ID NO: 2879169 - RNA, 22 nt, Mycobacterium avium subsp. paratuberculosis
guugaccuugucgaaggugauc

SEQ ID NO: 2879170 - RNA, 12 nt, Mycobacterium avium subsp. paratuberculosis
guugacgcccuc

SEQ ID NO: 2879171 - RNA, 16 nt, Mycobacterium avium subsp. paratuberculosis
guugacgcccuccugg

SEQ ID NO: 2879172 - RNA, 13 nt, Mycobacterium avium subsp. paratuberculosis
guugacgccgaug

SEQ ID NO: 2879173 - RNA, 20 nt, Mycobacterium avium subsp. paratuberculosis
guugacgccgaugcgguuga

SEQ ID NO: 2879174 - RNA, 18 nt, Mycobacterium avium subsp. paratuberculosis
guugacgcugggcggcga

SEQ ID NO: 2879175 - RNA, 16 nt, Mycobacterium avium subsp. paratuberculosis
guugacgggccgcggc

SEQ ID NO: 2879176 - RNA, 17 nt, Mycobacterium avium subsp. paratuberculosis
guugacggugaccggcg

SEQ ID NO: 2879177 - RNA, 14 nt, Mycobacterium avium subsp. paratuberculosis
guugacguccgcgg

SEQ ID NO: 2879178 - RNA, 15 nt, Mycobacterium avium subsp. paratuberculosis
guugacguccgcggg

SEQ ID NO: 2879179 - RNA, 18 nt, Mycobacterium avium subsp. paratuberculosis
guugacgugcaccggcga

SEQ ID NO: 2879180 - RNA, 20 nt, Mycobacterium avium subsp. paratuberculosis
guugacgugcaccggcgagu

SEQ ID NO: 2879181 - RNA, 21 nt, Mycobacterium avium subsp. paratuberculosis
guugacguugaucgcgccgau

SEQ ID NO: 2879182 - RNA, 22 nt, Mycobacterium avium subsp. paratuberculosis
guugagcacaaagccggucacg

SEQ ID NO: 2879183 - RNA, 23 nt, Mycobacterium avium subsp. paratuberculosis
guugagcacacacaggucgcccg

SEQ ID NO: 2879184 - RNA, 17 nt, Mycobacterium avium subsp. paratuberculosis
guugagcacacccagcg

SEQ ID NO: 2879185 - RNA, 16 nt, Mycobacterium avium subsp. paratuberculosis
guugagcaccagcccg

SEQ ID NO: 2879186 - RNA, 13 nt, Mycobacterium avium subsp. paratuberculosis
guugagcaccgca

SEQ ID NO: 2879187 - RNA, 17 nt, Mycobacterium avium subsp. paratuberculosis
guugagcacgcccgcga

SEQ ID NO: 2879188 - RNA, 19 nt, Mycobacterium avium subsp. paratuberculosis
guugagcagauccugcagc

SEQ ID NO: 2879189 - RNA, 20 nt, Mycobacterium avium subsp. paratuberculosis
guugagcagcagaccgccgg

SEQ ID NO: 2879190 - RNA, 22 nt, Mycobacterium avium subsp. paratuberculosis
guugagcagcagaccgccggug

SEQ ID NO: 2879191 - RNA, 19 nt, Mycobacterium avium subsp. paratuberculosis
guugagcccggaccggccg

SEQ ID NO: 2879192 - RNA, 23 nt, Mycobacterium avium subsp. paratuberculosis
guugagcguggcagcggucggcg

SEQ ID NO: 2879193 - RNA, 23 nt, Mycobacterium avium subsp. paratuberculosis
guugaggaucugcacgucggcgg

SEQ ID NO: 2879194 - RNA, 14 nt, Mycobacterium avium subsp. paratuberculosis
guugaggcggcggc

SEQ ID NO: 2879195 - RNA, 15 nt, Mycobacterium avium subsp. paratuberculosis
guugaggcggcggcg

SEQ ID NO: 2879196 - RNA, 14 nt, Mycobacterium avium subsp. paratuberculosis
guugagugcgccgu

SEQ ID NO: 2879197 - RNA, 19 nt, Mycobacterium avium subsp. paratuberculosis
guugauaggucacgccggg

SEQ ID NO: 2879198 - RNA, 19 nt, Mycobacterium avium subsp. paratuberculosis
guugaucacgggcacaccg

SEQ ID NO: 2879199 - RNA, 22 nt, Mycobacterium avium subsp. paratuberculosis
guugaucacgggcacaccgucg

SEQ ID NO: 2879200 - RNA, 21 nt, Mycobacterium avium subsp. paratuberculosis
guugaucacguguccgucgcc

SEQ ID NO: 2879201 - RNA, 13 nt, Mycobacterium avium subsp. paratuberculosis
guugaucagcgcc

SEQ ID NO: 2879202 - RNA, 16 nt, Mycobacterium avium subsp. paratuberculosis
guugaucagggcggcg

SEQ ID NO: 2879203 - RNA, 19 nt, Mycobacterium avium subsp. paratuberculosis
guugaucaugucgaugccg

SEQ ID NO: 2879204 - RNA, 20 nt, Mycobacterium avium subsp. paratuberculosis
guugauccagcggcgcaccg

SEQ ID NO: 2879205 - RNA, 13 nt, Mycobacterium avium subsp. paratuberculosis
guugauccgcgcg

SEQ ID NO: 2879206 - RNA, 15 nt, Mycobacterium avium subsp. paratuberculosis
guugaucgagcaccg

SEQ ID NO: 2879207 - RNA, 19 nt, Mycobacterium avium subsp. paratuberculosis
guugaucgagcaccgggcg

SEQ ID NO: 2879208 - RNA, 14 nt, Mycobacterium avium subsp. paratuberculosis
guugaucucgucga

SEQ ID NO: 2879209 - RNA, 17 nt, Mycobacterium avium subsp. paratuberculosis
guugaucucgucgauga

SEQ ID NO: 2879210 - RNA, 21 nt, Mycobacterium avium subsp. paratuberculosis
guugaucucgucgaugacgau

SEQ ID NO: 2879211 - RNA, 20 nt, Mycobacterium avium subsp. paratuberculosis
guugaugaagaccuggccgg

SEQ ID NO: 2879212 - RNA, 15 nt, Mycobacterium avium subsp. paratuberculosis
guugaugaucgccga

SEQ ID NO: 2879213 - RNA, 14 nt, Mycobacterium avium subsp. paratuberculosis
guugaugccgugcg

SEQ ID NO: 2879214 - RNA, 14 nt, Mycobacterium avium subsp. paratuberculosis
guugaugcgcaccg

SEQ ID NO: 2879215 - RNA, 16 nt, Mycobacterium avium subsp. paratuberculosis
guugaugcgcaccgcg

SEQ ID NO: 2879216 - RNA, 24 nt, Mycobacterium avium subsp. paratuberculosis
guugaugcgcaccgcggcgugcgc

SEQ ID NO: 2879217 - RNA, 15 nt, Mycobacterium avium subsp. paratuberculosis
guugaugucgcgcgg

SEQ ID NO: 2879218 - RNA, 16 nt, Mycobacterium avium subsp. paratuberculosis
guugaugucggccagg

SEQ ID NO: 2879219 - RNA, 16 nt, Mycobacterium avium subsp. paratuberculosis
guugcaaucucgucgg

SEQ ID NO: 2879220 - RNA, 23 nt, Mycobacterium avium subsp. paratuberculosis
guugcaccgcgauggcccgcgcg

SEQ ID NO: 2879221 - RNA, 15 nt, Mycobacterium avium subsp. paratuberculosis
guugcaccggcaccg

SEQ ID NO: 2879222 - RNA, 18 nt, Mycobacterium avium subsp. paratuberculosis
guugcaccggcaccgcgg

SEQ ID NO: 2879223 - RNA, 17 nt, Mycobacterium avium subsp. paratuberculosis
guugcacggucuggugg

SEQ ID NO: 2879224 - RNA, 18 nt, Mycobacterium avium subsp. paratuberculosis
guugcacggucugguggc

SEQ ID NO: 2879225 - RNA, 18 nt, Mycobacterium avium subsp. paratuberculosis
guugcacuuucggcagcu

SEQ ID NO: 2879226 - RNA, 18 nt, Mycobacterium avium subsp. paratuberculosis
guugcagcacaacggccu

SEQ ID NO: 2879227 - RNA, 14 nt, Mycobacterium avium subsp. paratuberculosis
guugcagcgccgcg

SEQ ID NO: 2879228 - RNA, 15 nt, Mycobacterium avium subsp. paratuberculosis
guugcagcgccgcgg

SEQ ID NO: 2879229 - RNA, 17 nt, Mycobacterium avium subsp. paratuberculosis
guugcaggcgcccagga

SEQ ID NO: 2879230 - RNA, 12 nt, Mycobacterium avium subsp. paratuberculosis
guugcaggcgga

SEQ ID NO: 2879231 - RNA, 16 nt, Mycobacterium avium subsp. paratuberculosis
guugcaggcggaccug

SEQ ID NO: 2879232 - RNA, 17 nt, Mycobacterium avium subsp. paratuberculosis
guugcaggugcgcgguc

SEQ ID NO: 2879233 - RNA, 18 nt, Mycobacterium avium subsp. paratuberculosis
guugcauuucggcguccu

SEQ ID NO: 2879234 - RNA, 22 nt, Mycobacterium avium subsp. paratuberculosis
guugccaacaccagggugucga

SEQ ID NO: 2879235 - RNA, 13 nt, Mycobacterium avium subsp. paratuberculosis
guugccagccggu

SEQ ID NO: 2879236 - RNA, 23 nt, Mycobacterium avium subsp. paratuberculosis
guugcccaggaaguagccggcca

SEQ ID NO: 2879237 - RNA, 14 nt, Mycobacterium avium subsp. paratuberculosis
guugccccaaaacg

SEQ ID NO: 2879238 - RNA, 13 nt, Mycobacterium avium subsp. paratuberculosis
guugccccacccc

SEQ ID NO: 2879239 - RNA, 20 nt, Mycobacterium avium subsp. paratuberculosis
guugccccaccccggacggc

SEQ ID NO: 2879240 - RNA, 13 nt, Mycobacterium avium subsp. paratuberculosis
guugcccgccgcg

SEQ ID NO: 2879241 - RNA, 14 nt, Mycobacterium avium subsp. paratuberculosis
guugcccgccgcgg

SEQ ID NO: 2879242 - RNA, 18 nt, Mycobacterium avium subsp. paratuberculosis
guugcccgguuccgcgac

SEQ ID NO: 2879243 - RNA, 22 nt, Mycobacterium avium subsp. paratuberculosis
guugcccgucgccuccgagaug

SEQ ID NO: 2879244 - RNA, 18 nt, Mycobacterium avium subsp. paratuberculosis
guugccgacggcgccggu

SEQ ID NO: 2879245 - RNA, 17 nt, Mycobacterium avium subsp. paratuberculosis
guugccgaguaccgacg

SEQ ID NO: 2879246 - RNA, 15 nt, Mycobacterium avium subsp. paratuberculosis
guugccgcacaccgc

SEQ ID NO: 2879247 - RNA, 17 nt, Mycobacterium avium subsp. paratuberculosis
guugccgcacaccgcgc

SEQ ID NO: 2879248 - RNA, 18 nt, Mycobacterium avium subsp. paratuberculosis
guugccgcacaccgcgca

SEQ ID NO: 2879249 - RNA, 19 nt, Mycobacterium avium subsp. paratuberculosis
guugccgcacaccgcgcag

SEQ ID NO: 2879250 - RNA, 17 nt, Mycobacterium avium subsp. paratuberculosis
guugccgccgcgcgcgg

SEQ ID NO: 2879251 - RNA, 15 nt, Mycobacterium avium subsp. paratuberculosis
guugccgccggcgcc

SEQ ID NO: 2879252 - RNA, 16 nt, Mycobacterium avium subsp. paratuberculosis
guugccgccggcgccc

SEQ ID NO: 2879253 - RNA, 16 nt, Mycobacterium avium subsp. paratuberculosis
guugccgcgcgcccgc

SEQ ID NO: 2879254 - RNA, 19 nt, Mycobacterium avium subsp. paratuberculosis
guugccgcgcgcccgcggc

SEQ ID NO: 2879255 - RNA, 15 nt, Mycobacterium avium subsp. paratuberculosis
guugccgcuggucag

SEQ ID NO: 2879256 - RNA, 20 nt, Mycobacterium avium subsp. paratuberculosis
guugccggacaccuggaguc

SEQ ID NO: 2879257 - RNA, 13 nt, Mycobacterium avium subsp. paratuberculosis
guugccggcccgc

SEQ ID NO: 2879258 - RNA, 14 nt, Mycobacterium avium subsp. paratuberculosis
guugccggcccgca

SEQ ID NO: 2879259 - RNA, 15 nt, Mycobacterium avium subsp. paratuberculosis
guugccggcccgcag

SEQ ID NO: 2879260 - RNA, 16 nt, Mycobacterium avium subsp. paratuberculosis
guugccggcccgcagc

SEQ ID NO: 2879261 - RNA, 18 nt, Mycobacterium avium subsp. paratuberculosis
guugccggcccgcagcgc

SEQ ID NO: 2879262 - RNA, 20 nt, Mycobacterium avium subsp. paratuberculosis
guugccggcggcgaagccgg

SEQ ID NO: 2879263 - RNA, 15 nt, Mycobacterium avium subsp. paratuberculosis
guugccggguaucga

SEQ ID NO: 2879264 - RNA, 14 nt, Mycobacterium avium subsp. paratuberculosis
guugccggucucga

SEQ ID NO: 2879265 - RNA, 19 nt, Mycobacterium avium subsp. paratuberculosis
guugccgugcugggacagc

SEQ ID NO: 2879266 - RNA, 21 nt, Mycobacterium avium subsp. paratuberculosis
guugccgugggggucgacccg

SEQ ID NO: 2879267 - RNA, 22 nt, Mycobacterium avium subsp. paratuberculosis
guugccgugggggucgacccgc

SEQ ID NO: 2879268 - RNA, 15 nt, Mycobacterium avium subsp. paratuberculosis
guugccucggccagc

SEQ ID NO: 2879269 - RNA, 18 nt, Mycobacterium avium subsp. paratuberculosis
guugccuuuccgcgcggc

SEQ ID NO: 2879270 - RNA, 17 nt, Mycobacterium avium subsp. paratuberculosis
guugcgaccccgccguc

SEQ ID NO: 2879271 - RNA, 19 nt, Mycobacterium avium subsp. paratuberculosis
guugcgaccccgccgucga

SEQ ID NO: 2879272 - RNA, 20 nt, Mycobacterium avium subsp. paratuberculosis
guugcgaccccgccgucgac

SEQ ID NO: 2879273 - RNA, 21 nt, Mycobacterium avium subsp. paratuberculosis
guugcgagucaucgccacccg

SEQ ID NO: 2879274 - RNA, 14 nt, Mycobacterium avium subsp. paratuberculosis
guugcgcagcagcc

SEQ ID NO: 2879275 - RNA, 16 nt, Mycobacterium avium subsp. paratuberculosis
guugcgcagccgggcg

SEQ ID NO: 2879276 - RNA, 15 nt, Mycobacterium avium subsp. paratuberculosis
guugcgcagcgucuc

SEQ ID NO: 2879277 - RNA, 16 nt, Mycobacterium avium subsp. paratuberculosis
guugcgccagcaccga

SEQ ID NO: 2879278 - RNA, 20 nt, Mycobacterium avium subsp. paratuberculosis
guugcgccagcaccgacagc

SEQ ID NO: 2879279 - RNA, 13 nt, Mycobacterium avium subsp. paratuberculosis
guugcgccagcag

SEQ ID NO: 2879280 - RNA, 20 nt, Mycobacterium avium subsp. paratuberculosis
guugcgccgaggucaccgcg

SEQ ID NO: 2879281 - RNA, 17 nt, Mycobacterium avium subsp. paratuberculosis
guugcgccgcaacggcg

SEQ ID NO: 2879282 - RNA, 19 nt, Mycobacterium avium subsp. paratuberculosis
guugcgccgcgagcgcagc

SEQ ID NO: 2879283 - RNA, 20 nt, Mycobacterium avium subsp. paratuberculosis
guugcgccgcgagcgcagca

SEQ ID NO: 2879284 - RNA, 13 nt, Mycobacterium avium subsp. paratuberculosis
guugcgcgccgau

SEQ ID NO: 2879285 - RNA, 16 nt, Mycobacterium avium subsp. paratuberculosis
guugcgcggaaugcuc

SEQ ID NO: 2879286 - RNA, 16 nt, Mycobacterium avium subsp. paratuberculosis
guugcgcggaccggcg

SEQ ID NO: 2879287 - RNA, 13 nt, Mycobacterium avium subsp. paratuberculosis
guugcgcggcggc

SEQ ID NO: 2879288 - RNA, 14 nt, Mycobacterium avium subsp. paratuberculosis
guugcgcggcggcc

SEQ ID NO: 2879289 - RNA, 13 nt, Mycobacterium avium subsp. paratuberculosis
guugcgcgggaag

SEQ ID NO: 2879290 - RNA, 19 nt, Mycobacterium avium subsp. paratuberculosis
guugcgcgggaagccgccg

SEQ ID NO: 2879291 - RNA, 21 nt, Mycobacterium avium subsp. paratuberculosis
guugcgcgggaagccgccgcc

SEQ ID NO: 2879292 - RNA, 18 nt, Mycobacterium avium subsp. paratuberculosis
guugcgcucuguuggccg

SEQ ID NO: 2879293 - RNA, 14 nt, Mycobacterium avium subsp. paratuberculosis
guugcggcaccggc

SEQ ID NO: 2879294 - RNA, 15 nt, Mycobacterium avium subsp. paratuberculosis
guugcggcaccggcg

SEQ ID NO: 2879295 - RNA, 17 nt, Mycobacterium avium subsp. paratuberculosis
guugcggcaccggcgaa

SEQ ID NO: 2879296 - RNA, 21 nt, Mycobacterium avium subsp. paratuberculosis
guugcggcagggccaccguca

SEQ ID NO: 2879297 - RNA, 19 nt, Mycobacterium avium subsp. paratuberculosis
guugcggccccgccagcag

SEQ ID NO: 2879298 - RNA, 14 nt, Mycobacterium avium subsp. paratuberculosis
guugcggccggcca

SEQ ID NO: 2879299 - RNA, 15 nt, Mycobacterium avium subsp. paratuberculosis
guugcggccggcggu

SEQ ID NO: 2879300 - RNA, 12 nt, Mycobacterium avium subsp. paratuberculosis
guugcggcggcc

SEQ ID NO: 2879301 - RNA, 14 nt, Mycobacterium avium subsp. paratuberculosis
guugcggcggccgg

SEQ ID NO: 2879302 - RNA, 15 nt, Mycobacterium avium subsp. paratuberculosis
guugcgggccaggca

SEQ ID NO: 2879303 - RNA, 17 nt, Mycobacterium avium subsp. paratuberculosis
guugcgggccaggucga

SEQ ID NO: 2879304 - RNA, 13 nt, Mycobacterium avium subsp. paratuberculosis
guugcggguggag

SEQ ID NO: 2879305 - RNA, 19 nt, Mycobacterium avium subsp. paratuberculosis
guugcggguggcggccggg

SEQ ID NO: 2879306 - RNA, 18 nt, Mycobacterium avium subsp. paratuberculosis
guugcgggugucgccggu

SEQ ID NO: 2879307 - RNA, 20 nt, Mycobacterium avium subsp. paratuberculosis
guugcgguacaucccgccgg

SEQ ID NO: 2879308 - RNA, 14 nt, Mycobacterium avium subsp. paratuberculosis
guugcgguccagga

SEQ ID NO: 2879309 - RNA, 20 nt, Mycobacterium avium subsp. paratuberculosis
guugcggugcucgucgagca

SEQ ID NO: 2879310 - RNA, 13 nt, Mycobacterium avium subsp. paratuberculosis
guugcgguggccg

SEQ ID NO: 2879311 - RNA, 14 nt, Mycobacterium avium subsp. paratuberculosis
guugcgucccgcgc

SEQ ID NO: 2879312 - RNA, 20 nt, Mycobacterium avium subsp. paratuberculosis
guugcgucccgcgccggagu

SEQ ID NO: 2879313 - RNA, 14 nt, Mycobacterium avium subsp. paratuberculosis
guugcgugcagccg

SEQ ID NO: 2879314 - RNA, 21 nt, Mycobacterium avium subsp. paratuberculosis
guugcguuccagcauccggca

SEQ ID NO: 2879315 - RNA, 15 nt, Mycobacterium avium subsp. paratuberculosis
guugcucggcggccc

SEQ ID NO: 2879316 - RNA, 16 nt, Mycobacterium avium subsp. paratuberculosis
guugcucggggcucgc

SEQ ID NO: 2879317 - RNA, 20 nt, Mycobacterium avium subsp. paratuberculosis
guugcucggggcucgcggug

SEQ ID NO: 2879318 - RNA, 21 nt, Mycobacterium avium subsp. paratuberculosis
guugcucggggcucgcggugu

SEQ ID NO: 2879319 - RNA, 15 nt, Mycobacterium avium subsp. paratuberculosis
guugcucgggugacg

SEQ ID NO: 2879320 - RNA, 19 nt, Mycobacterium avium subsp. paratuberculosis
guugcugagccgccgagcc

SEQ ID NO: 2879321 - RNA, 20 nt, Mycobacterium avium subsp. paratuberculosis
guugcuggcgucguuggcgc

SEQ ID NO: 2879322 - RNA, 14 nt, Mycobacterium avium subsp. paratuberculosis
guuggaaggggucg

SEQ ID NO: 2879323 - RNA, 15 nt, Mycobacterium avium subsp. paratuberculosis
guuggacaugaagcc

SEQ ID NO: 2879324 - RNA, 20 nt, Mycobacterium avium subsp. paratuberculosis
guuggacaugaagcccccgu

SEQ ID NO: 2879325 - RNA, 15 nt, Mycobacterium avium subsp. paratuberculosis
guuggacgcccgcuc

SEQ ID NO: 2879326 - RNA, 17 nt, Mycobacterium avium subsp. paratuberculosis
guuggacgcccgcucga

SEQ ID NO: 2879327 - RNA, 22 nt, Mycobacterium avium subsp. paratuberculosis
guuggagccgaccagcgcgauc

SEQ ID NO: 2879328 - RNA, 15 nt, Mycobacterium avium subsp. paratuberculosis
guuggagccguccgg

SEQ ID NO: 2879329 - RNA, 15 nt, Mycobacterium avium subsp. paratuberculosis
guuggcaggcccggu

SEQ ID NO: 2879330 - RNA, 13 nt, Mycobacterium avium subsp. paratuberculosis
guuggccaccggg

SEQ ID NO: 2879331 - RNA, 23 nt, Mycobacterium avium subsp. paratuberculosis
guuggccagauacuccucgguga

SEQ ID NO: 2879332 - RNA, 15 nt, Mycobacterium avium subsp. paratuberculosis
guuggccagaugccc

SEQ ID NO: 2879333 - RNA, 16 nt, Mycobacterium avium subsp. paratuberculosis
guuggccagaugcccg

SEQ ID NO: 2879334 - RNA, 18 nt, Mycobacterium avium subsp. paratuberculosis
guuggccagcgccuccag

SEQ ID NO: 2879335 - RNA, 14 nt, Mycobacterium avium subsp. paratuberculosis
guuggccagcucgg

SEQ ID NO: 2879336 - RNA, 20 nt, Mycobacterium avium subsp. paratuberculosis
guuggccagcucggccaucc

SEQ ID NO: 2879337 - RNA, 16 nt, Mycobacterium avium subsp. paratuberculosis
guuggccagguggccg

SEQ ID NO: 2879338 - RNA, 20 nt, Mycobacterium avium subsp. paratuberculosis
guuggcccgcaccacccagc

SEQ ID NO: 2879339 - RNA, 23 nt, Mycobacterium avium subsp. paratuberculosis
guuggcccgcaccacccagcccu

SEQ ID NO: 2879340 - RNA, 14 nt, Mycobacterium avium subsp. paratuberculosis
guuggcccgcggcg

SEQ ID NO: 2879341 - RNA, 18 nt, Mycobacterium avium subsp. paratuberculosis
guuggcccgcggcgcccg

SEQ ID NO: 2879342 - RNA, 19 nt, Mycobacterium avium subsp. paratuberculosis
guuggcccugcucuucgcg

SEQ ID NO: 2879343 - RNA, 15 nt, Mycobacterium avium subsp. paratuberculosis
guuggcccuucgacc

SEQ ID NO: 2879344 - RNA, 21 nt, Mycobacterium avium subsp. paratuberculosis
guuggcccuucgaccucgagu

SEQ ID NO: 2879345 - RNA, 20 nt, Mycobacterium avium subsp. paratuberculosis
guuggccgagcagccgggcc

SEQ ID NO: 2879346 - RNA, 21 nt, Mycobacterium avium subsp. paratuberculosis
guuggccgagcagccgggcca

SEQ ID NO: 2879347 - RNA, 19 nt, Mycobacterium avium subsp. paratuberculosis
guuggccgccaagugcggu

SEQ ID NO: 2879348 - RNA, 21 nt, Mycobacterium avium subsp. paratuberculosis
guuggccgccacgaugcugau

SEQ ID NO: 2879349 - RNA, 14 nt, Mycobacterium avium subsp. paratuberculosis
guuggccgccgccu

SEQ ID NO: 2879350 - RNA, 16 nt, Mycobacterium avium subsp. paratuberculosis
guuggccgcgacgccg

SEQ ID NO: 2879351 - RNA, 19 nt, Mycobacterium avium subsp. paratuberculosis
guuggccgcgacgccgccg

SEQ ID NO: 2879352 - RNA, 20 nt, Mycobacterium avium subsp. paratuberculosis
guuggccgcgacgccgccgc

SEQ ID NO: 2879353 - RNA, 19 nt, Mycobacterium avium subsp. paratuberculosis
guuggccggaaucgcggga

SEQ ID NO: 2879354 - RNA, 15 nt, Mycobacterium avium subsp. paratuberculosis
guuggccggcccgcc

SEQ ID NO: 2879355 - RNA, 13 nt, Mycobacterium avium subsp. paratuberculosis
guuggccggcggg

SEQ ID NO: 2879356 - RNA, 20 nt, Mycobacterium avium subsp. paratuberculosis
guuggccggcuucucggcgu

SEQ ID NO: 2879357 - RNA, 14 nt, Mycobacterium avium subsp. paratuberculosis
guuggccgucgaac

SEQ ID NO: 2879358 - RNA, 14 nt, Mycobacterium avium subsp. paratuberculosis
guuggccgucgcgu

SEQ ID NO: 2879359 - RNA, 14 nt, Mycobacterium avium subsp. paratuberculosis
guuggccgucgcug

SEQ ID NO: 2879360 - RNA, 15 nt, Mycobacterium avium subsp. paratuberculosis
guuggccuccagguu

SEQ ID NO: 2879361 - RNA, 16 nt, Mycobacterium avium subsp. paratuberculosis
guuggccugcgcgacc

SEQ ID NO: 2879362 - RNA, 18 nt, Mycobacterium avium subsp. paratuberculosis
guuggcgaagucaucgag

SEQ ID NO: 2879363 - RNA, 21 nt, Mycobacterium avium subsp. paratuberculosis
guuggcgaagucaucgagaug

SEQ ID NO: 2879364 - RNA, 18 nt, Mycobacterium avium subsp. paratuberculosis
guuggcgacgacggcgga

SEQ ID NO: 2879365 - RNA, 22 nt, Mycobacterium avium subsp. paratuberculosis
guuggcgacggcgcuguggccg

SEQ ID NO: 2879366 - RNA, 23 nt, Mycobacterium avium subsp. paratuberculosis
guuggcgacggugcaugcgcugg

SEQ ID NO: 2879367 - RNA, 13 nt, Mycobacterium avium subsp. paratuberculosis
guuggcgccgguc

SEQ ID NO: 2879368 - RNA, 17 nt, Mycobacterium avium subsp. paratuberculosis
guuggcgccguccgcgg

SEQ ID NO: 2879369 - RNA, 21 nt, Mycobacterium avium subsp. paratuberculosis
guuggcgccguccgcggcggc

SEQ ID NO: 2879370 - RNA, 16 nt, Mycobacterium avium subsp. paratuberculosis
guuggcggccagcgcg

SEQ ID NO: 2879371 - RNA, 20 nt, Mycobacterium avium subsp. paratuberculosis
guuggcggccagcgcgccgc

SEQ ID NO: 2879372 - RNA, 14 nt, Mycobacterium avium subsp. paratuberculosis
guuggcggccgggu

SEQ ID NO: 2879373 - RNA, 12 nt, Mycobacterium avium subsp. paratuberculosis
guuggcggcggc

SEQ ID NO: 2879374 - RNA, 16 nt, Mycobacterium avium subsp. paratuberculosis
guuggcggcggcccgc

SEQ ID NO: 2879375 - RNA, 18 nt, Mycobacterium avium subsp. paratuberculosis
guuggcggcggcccgcgc

SEQ ID NO: 2879376 - RNA, 15 nt, Mycobacterium avium subsp. paratuberculosis
guuggcggcgguggg

SEQ ID NO: 2879377 - RNA, 20 nt, Mycobacterium avium subsp. paratuberculosis
guuggcggcgucgucgccgu

SEQ ID NO: 2879378 - RNA, 14 nt, Mycobacterium avium subsp. paratuberculosis
guuggcgucgggca

SEQ ID NO: 2879379 - RNA, 14 nt, Mycobacterium avium subsp. paratuberculosis
guuggcgucgucgg

SEQ ID NO: 2879380 - RNA, 20 nt, Mycobacterium avium subsp. paratuberculosis
guuggcuuuucgggccggcc

SEQ ID NO: 2879381 - RNA, 11 nt, Mycobacterium avium subsp. paratuberculosis
guugggcagcu

SEQ ID NO: 2879382 - RNA, 17 nt, Mycobacterium avium subsp. paratuberculosis
guugggcagcucggcgg

SEQ ID NO: 2879383 - RNA, 23 nt, Mycobacterium avium subsp. paratuberculosis
guugggccagcggcgccggguca

SEQ ID NO: 2879384 - RNA, 14 nt, Mycobacterium avium subsp. paratuberculosis
guugggccaggccu

SEQ ID NO: 2879385 - RNA, 15 nt, Mycobacterium avium subsp. paratuberculosis
guugggcgccagcag

SEQ ID NO: 2879386 - RNA, 17 nt, Mycobacterium avium subsp. paratuberculosis
guugggcgccagcagca

SEQ ID NO: 2879387 - RNA, 16 nt, Mycobacterium avium subsp. paratuberculosis
guugggcgccugcggu

SEQ ID NO: 2879388 - RNA, 21 nt, Mycobacterium avium subsp. paratuberculosis
guugggcgggaucgcggcggu

SEQ ID NO: 2879389 - RNA, 22 nt, Mycobacterium avium subsp. paratuberculosis
guuggggccgauguucaccccg

SEQ ID NO: 2879390 - RNA, 14 nt, Mycobacterium avium subsp. paratuberculosis
guuggggccgcgga

SEQ ID NO: 2879391 - RNA, 16 nt, Mycobacterium avium subsp. paratuberculosis
guugguaagcgacgag

SEQ ID NO: 2879392 - RNA, 18 nt, Mycobacterium avium subsp. paratuberculosis
guuggucaccaggucgcg

SEQ ID NO: 2879393 - RNA, 19 nt, Mycobacterium avium subsp. paratuberculosis
guuggucaccaggucgcgg

SEQ ID NO: 2879394 - RNA, 21 nt, Mycobacterium avium subsp. paratuberculosis
guuggucaccaucagcggcuc

SEQ ID NO: 2879395 - RNA, 19 nt, Mycobacterium avium subsp. paratuberculosis
guuggucggagccgucggu

SEQ ID NO: 2879396 - RNA, 14 nt, Mycobacterium avium subsp. paratuberculosis
guuggucggcgcgg

SEQ ID NO: 2879397 - RNA, 16 nt, Mycobacterium avium subsp. paratuberculosis
guuggucuguggucgg

SEQ ID NO: 2879398 - RNA, 23 nt, Mycobacterium avium subsp. paratuberculosis
guuggugaacagguaggcggcgc

SEQ ID NO: 2879399 - RNA, 17 nt, Mycobacterium avium subsp. paratuberculosis
guuggugacgcucaccc

SEQ ID NO: 2879400 - RNA, 14 nt, Mycobacterium avium subsp. paratuberculosis
guuggugccgcuga

SEQ ID NO: 2879401 - RNA, 11 nt, Mycobacterium avium subsp. paratuberculosis
guuggugcggg

SEQ ID NO: 2879402 - RNA, 13 nt, Mycobacterium avium subsp. paratuberculosis
guuggugcggggu

SEQ ID NO: 2879403 - RNA, 20 nt, Mycobacterium avium subsp. paratuberculosis
guuggugcggugcaucgucg

SEQ ID NO: 2879404 - RNA, 23 nt, Mycobacterium avium subsp. paratuberculosis
guuggugcggugcaucgucgcgg

SEQ ID NO: 2879405 - RNA, 15 nt, Mycobacterium avium subsp. paratuberculosis
guuggugcgguguca

SEQ ID NO: 2879406 - RNA, 15 nt, Mycobacterium avium subsp. paratuberculosis
guuggugcugggcac

SEQ ID NO: 2879407 - RNA, 12 nt, Mycobacterium avium subsp. paratuberculosis
guugguggucga

SEQ ID NO: 2879408 - RNA, 18 nt, Mycobacterium avium subsp. paratuberculosis
guugguguccacccgcgc

SEQ ID NO: 2879409 - RNA, 21 nt, Mycobacterium avium subsp. paratuberculosis
guuguagcaggcggugguggg

SEQ ID NO: 2879410 - RNA, 23 nt, Mycobacterium avium subsp. paratuberculosis
guugucagccacucgccgugaga

SEQ ID NO: 2879411 - RNA, 18 nt, Mycobacterium avium subsp. paratuberculosis
guuguccacccccgcggu

SEQ ID NO: 2879412 - RNA, 14 nt, Mycobacterium avium subsp. paratuberculosis
guuguccagcagcg

SEQ ID NO: 2879413 - RNA, 22 nt, Mycobacterium avium subsp. paratuberculosis
guuguccagccggugcaccacg

SEQ ID NO: 2879414 - RNA, 22 nt, Mycobacterium avium subsp. paratuberculosis
guugucccgggcgaacgucggg

SEQ ID NO: 2879415 - RNA, 14 nt, Mycobacterium avium subsp. paratuberculosis
guuguccgaccagg

SEQ ID NO: 2879416 - RNA, 15 nt, Mycobacterium avium subsp. paratuberculosis
guuguccgaccagga

SEQ ID NO: 2879417 - RNA, 15 nt, Mycobacterium avium subsp. paratuberculosis
guuguccggaacacc

SEQ ID NO: 2879418 - RNA, 16 nt, Mycobacterium avium subsp. paratuberculosis
guugucgagcaccgcg

SEQ ID NO: 2879419 - RNA, 20 nt, Mycobacterium avium subsp. paratuberculosis
guugucgagcaccgcgauca

SEQ ID NO: 2879420 - RNA, 18 nt, Mycobacterium avium subsp. paratuberculosis
guugucgccgcgccagcc

SEQ ID NO: 2879421 - RNA, 14 nt, Mycobacterium avium subsp. paratuberculosis
guugucgcugaacg

SEQ ID NO: 2879422 - RNA, 15 nt, Mycobacterium avium subsp. paratuberculosis
guugucggcgacggc

SEQ ID NO: 2879423 - RNA, 16 nt, Mycobacterium avium subsp. paratuberculosis
guugucggcgacggcg

SEQ ID NO: 2879424 - RNA, 23 nt, Mycobacterium avium subsp. paratuberculosis
guugucggcguccuugcccgagg

SEQ ID NO: 2879425 - RNA, 17 nt, Mycobacterium avium subsp. paratuberculosis
guugucggucaggcacu

SEQ ID NO: 2879426 - RNA, 23 nt, Mycobacterium avium subsp. paratuberculosis
guugucggucaggcacucgauca

SEQ ID NO: 2879427 - RNA, 20 nt, Mycobacterium avium subsp. paratuberculosis
guugucgucgccggccgcgg

SEQ ID NO: 2879428 - RNA, 19 nt, Mycobacterium avium subsp. paratuberculosis
guugucgucgggcaccacg

SEQ ID NO: 2879429 - RNA, 22 nt, Mycobacterium avium subsp. paratuberculosis
guugucgucgggcaccacggcg

SEQ ID NO: 2879430 - RNA, 19 nt, Mycobacterium avium subsp. paratuberculosis
guugucguucuccccgcgg

SEQ ID NO: 2879431 - RNA, 23 nt, Mycobacterium avium subsp. paratuberculosis
guugugaauccagccgugcggcu

SEQ ID NO: 2879432 - RNA, 14 nt, Mycobacterium avium subsp. paratuberculosis
guugugcaccggca

SEQ ID NO: 2879433 - RNA, 23 nt, Mycobacterium avium subsp. paratuberculosis
guugugcauguggccgucgccga

SEQ ID NO: 2879434 - RNA, 13 nt, Mycobacterium avium subsp. paratuberculosis
guugugccaccgc

SEQ ID NO: 2879435 - RNA, 21 nt, Mycobacterium avium subsp. paratuberculosis
guugugccaccgccgauggcg

SEQ ID NO: 2879436 - RNA, 14 nt, Mycobacterium avium subsp. paratuberculosis
guugugcucgucga

SEQ ID NO: 2879437 - RNA, 14 nt, Mycobacterium avium subsp. paratuberculosis
guugugcugcaccg

SEQ ID NO: 2879438 - RNA, 14 nt, Mycobacterium avium subsp. paratuberculosis
guuguggcggccag

SEQ ID NO: 2879439 - RNA, 16 nt, Mycobacterium avium subsp. paratuberculosis
guuguggcggccagcg

SEQ ID NO: 2879440 - RNA, 19 nt, Mycobacterium avium subsp. paratuberculosis
guuguggugcacgaacggc

SEQ ID NO: 2879441 - RNA, 13 nt, Mycobacterium avium subsp. paratuberculosis
guuguucaccggc

SEQ ID NO: 2879442 - RNA, 23 nt, Mycobacterium avium subsp. paratuberculosis
guuguugcgcgggaagccgccgc

SEQ ID NO: 2879443 - RNA, 13 nt, Mycobacterium avium subsp. paratuberculosis
guuguuggcggug

SEQ ID NO: 2879444 - RNA, 14 nt, Mycobacterium avium subsp. paratuberculosis
guuucaccgccguc

SEQ ID NO: 2879445 - RNA, 19 nt, Mycobacterium avium subsp. paratuberculosis
guuucaccgugcgcgcgca

SEQ ID NO: 2879446 - RNA, 17 nt, Mycobacterium avium subsp. paratuberculosis
guuucacguucgcgguc

SEQ ID NO: 2879447 - RNA, 17 nt, Mycobacterium avium subsp. paratuberculosis
guuucagguggcgcccg

SEQ ID NO: 2879448 - RNA, 16 nt, Mycobacterium avium subsp. paratuberculosis
guuuccaguccggcgc

SEQ ID NO: 2879449 - RNA, 21 nt, Mycobacterium avium subsp. paratuberculosis
guuuccaguccggcgcccggc

SEQ ID NO: 2879450 - RNA, 14 nt, Mycobacterium avium subsp. paratuberculosis
guuuccccagcccg

SEQ ID NO: 2879451 - RNA, 14 nt, Mycobacterium avium subsp. paratuberculosis
guuucccgucgggg

SEQ ID NO: 2879452 - RNA, 16 nt, Mycobacterium avium subsp. paratuberculosis
guuuccguccggcgac

SEQ ID NO: 2879453 - RNA, 20 nt, Mycobacterium avium subsp. paratuberculosis
guuuccguccggcgacaugc

SEQ ID NO: 2879454 - RNA, 19 nt, Mycobacterium avium subsp. paratuberculosis
guuuccuggugcaccaggu

SEQ ID NO: 2879455 - RNA, 21 nt, Mycobacterium avium subsp. paratuberculosis
guuucgaacugggucugccgc

SEQ ID NO: 2879456 - RNA, 16 nt, Mycobacterium avium subsp. paratuberculosis
guuucgcucgucggcg

SEQ ID NO: 2879457 - RNA, 21 nt, Mycobacterium avium subsp. paratuberculosis
guuucggaguggaacagccgg

SEQ ID NO: 2879458 - RNA, 22 nt, Mycobacterium avium subsp. paratuberculosis
guuucggaguggaacagccgga

SEQ ID NO: 2879459 - RNA, 17 nt, Mycobacterium avium subsp. paratuberculosis
guuucggccggccccgc

SEQ ID NO: 2879460 - RNA, 22 nt, Mycobacterium avium subsp. paratuberculosis
guuucggggguaaaccgccagc

SEQ ID NO: 2879461 - RNA, 14 nt, Mycobacterium avium subsp. paratuberculosis
guuucgguccaggu

SEQ ID NO: 2879462 - RNA, 21 nt, Mycobacterium avium subsp. paratuberculosis
guuucgugugguacagcgcca

SEQ ID NO: 2879463 - RNA, 20 nt, Mycobacterium avium subsp. paratuberculosis
guuucuccacccccuacgcc

SEQ ID NO: 2879464 - RNA, 17 nt, Mycobacterium avium subsp. paratuberculosis
guuucugccggccgccg

SEQ ID NO: 2879465 - RNA, 20 nt, Mycobacterium avium subsp. paratuberculosis
guuucuuugaucucaucguc

SEQ ID NO: 2879466 - RNA, 14 nt, Mycobacterium avium subsp. paratuberculosis
guuugaggcccacg

SEQ ID NO: 2879467 - RNA, 14 nt, Mycobacterium avium subsp. paratuberculosis
guuugcccucgucg

SEQ ID NO: 2879468 - RNA, 11 nt, Mycobacterium avium subsp. paratuberculosis
guuugcgccgg

SEQ ID NO: 2879469 - RNA, 23 nt, Mycobacterium avium subsp. paratuberculosis
guuugcgccggcuccaccgcgcc

SEQ ID NO: 2879470 - RNA, 13 nt, Mycobacterium avium subsp. paratuberculosis
guuuggccagcac

SEQ ID NO: 2879471 - RNA, 12 nt, Mycobacterium avium subsp. paratuberculosis
guuuggccgcgc

SEQ ID NO: 2879472 - RNA, 20 nt, Mycobacterium avium subsp. paratuberculosis
guuuggccgcgcagcucggg

SEQ ID NO: 2879473 - RNA, 19 nt, Mycobacterium avium subsp. paratuberculosis
guuuggccugaaccagcuc

SEQ ID NO: 2879474 - RNA, 12 nt, Mycobacterium avium subsp. paratuberculosis
guuuggcgccgc

SEQ ID NO: 2879475 - RNA, 18 nt, Mycobacterium avium subsp. paratuberculosis
guuuggcugucgcgcuga

SEQ ID NO: 2879476 - RNA, 15 nt, Mycobacterium avium subsp. paratuberculosis
guuuggggaugcgca

SEQ ID NO: 2879477 - RNA, 16 nt, Mycobacterium avium subsp. paratuberculosis
guuuggucagcgcccc

SEQ ID NO: 2879478 - RNA, 18 nt, Mycobacterium avium subsp. paratuberculosis
guuuggucagcgcccccg

SEQ ID NO: 2879479 - RNA, 15 nt, Mycobacterium avium subsp. paratuberculosis
guuuguccugcucgg

SEQ ID NO: 2879480 - RNA, 16 nt, Mycobacterium avium subsp. paratuberculosis
guuuguccugcucggc

SEQ ID NO: 2879481 - RNA, 22 nt, Mycobacterium avium subsp. paratuberculosis
guuuucggcgcgcagcucgcgc

SEQ ID NO: 2879482 - RNA, 15 nt, Mycobacterium avium subsp. paratuberculosis
guuuugaugccgccg

SEQ ID NO: 2879483 - RNA, 13 nt, Mycobacterium avium subsp. paratuberculosis
guuuugcggaucg

SEQ ID NO: 2879484 - RNA, 16 nt, Mycobacterium avium subsp. paratuberculosis
guuuugcggcccugca

SEQ ID NO: 2879485 - RNA, 22 nt, Mycobacterium avium subsp. paratuberculosis
guuuuguugaccguugcgcccc

SEQ ID NO: 2879486 - RNA, 13 nt, Mycobacterium avium subsp. paratuberculosis
guuuuucugcucu

SEQ ID NO: 2879487 - RNA, 13 nt, Mycobacterium avium subsp. paratuberculosis
uaaaccagcagcg

SEQ ID NO: 2879488 - RNA, 16 nt, Mycobacterium avium subsp. paratuberculosis
uaaaccgccagcagcg

SEQ ID NO: 2879489 - RNA, 17 nt, Mycobacterium avium subsp. paratuberculosis
uaaaccgccagcagcgc

SEQ ID NO: 2879490 - RNA, 14 nt, Mycobacterium avium subsp. paratuberculosis
uaaagccaccagcg

SEQ ID NO: 2879491 - RNA, 14 nt, Mycobacterium avium subsp. paratuberculosis
uaaaggaugucgcc

SEQ ID NO: 2879492 - RNA, 21 nt, Mycobacterium avium subsp. paratuberculosis
uaaaggaugucgccgcagauc

SEQ ID NO: 2879493 - RNA, 14 nt, Mycobacterium avium subsp. paratuberculosis
uaaccaccggugac

SEQ ID NO: 2879494 - RNA, 13 nt, Mycobacterium avium subsp. paratuberculosis
uaacccaccccga

SEQ ID NO: 2879495 - RNA, 18 nt, Mycobacterium avium subsp. paratuberculosis
uaaccgaagcggcccgag

SEQ ID NO: 2879496 - RNA, 14 nt, Mycobacterium avium subsp. paratuberculosis
uaaccgcgcggcgc

SEQ ID NO: 2879497 - RNA, 23 nt, Mycobacterium avium subsp. paratuberculosis
uaaccgggcaguuccuugcgcag

SEQ ID NO: 2879498 - RNA, 13 nt, Mycobacterium avium subsp. paratuberculosis
uaaccucggcggc

SEQ ID NO: 2879499 - RNA, 20 nt, Mycobacterium avium subsp. paratuberculosis
uaaccucggcggcggcgcgc

SEQ ID NO: 2879500 - RNA, 22 nt, Mycobacterium avium subsp. paratuberculosis
uaacgaguaggcggcuccgauc

SEQ ID NO: 2879501 - RNA, 23 nt, Mycobacterium avium subsp. paratuberculosis
uaacggaauucgggugcggcgug

SEQ ID NO: 2879502 - RNA, 16 nt, Mycobacterium avium subsp. paratuberculosis
uaacgguaggcgcggu

SEQ ID NO: 2879503 - RNA, 14 nt, Mycobacterium avium subsp. paratuberculosis
uaacgugcccggcc

SEQ ID NO: 2879504 - RNA, 18 nt, Mycobacterium avium subsp. paratuberculosis
uaacucggccuucgccuc

SEQ ID NO: 2879505 - RNA, 14 nt, Mycobacterium avium subsp. paratuberculosis
uaacuucacgcucg

SEQ ID NO: 2879506 - RNA, 15 nt, Mycobacterium avium subsp. paratuberculosis
uaacuucacgcucgg

SEQ ID NO: 2879507 - RNA, 19 nt, Mycobacterium avium subsp. paratuberculosis
uaagccauggcggcccgcg

SEQ ID NO: 2879508 - RNA, 22 nt, Mycobacterium avium subsp. paratuberculosis
uaagccggcgucgggaccgucg

SEQ ID NO: 2879509 - RNA, 15 nt, Mycobacterium avium subsp. paratuberculosis
uaagcgacgagguga

SEQ ID NO: 2879510 - RNA, 17 nt, Mycobacterium avium subsp. paratuberculosis
uaaggccgaggcgagug

SEQ ID NO: 2879511 - RNA, 20 nt, Mycobacterium avium subsp. paratuberculosis
uaaggccgaggcgagugagg

SEQ ID NO: 2879512 - RNA, 21 nt, Mycobacterium avium subsp. paratuberculosis
uaaggcgaauaaggggguaga

SEQ ID NO: 2879513 - RNA, 16 nt, Mycobacterium avium subsp. paratuberculosis
uaagucgaugccgccc

SEQ ID NO: 2879514 - RNA, 17 nt, Mycobacterium avium subsp. paratuberculosis
uaagucgaugccgcccc

SEQ ID NO: 2879515 - RNA, 16 nt, Mycobacterium avium subsp. paratuberculosis
uaaguggcgccgcggu

SEQ ID NO: 2879516 - RNA, 16 nt, Mycobacterium avium subsp. paratuberculosis
uaaucgaaggccaggu

SEQ ID NO: 2879517 - RNA, 13 nt, Mycobacterium avium subsp. paratuberculosis
uaaucggcggugg

SEQ ID NO: 2879518 - RNA, 22 nt, Mycobacterium avium subsp. paratuberculosis
uaauucguuguuggcggugguu

SEQ ID NO: 2879519 - RNA, 18 nt, Mycobacterium avium subsp. paratuberculosis
uacaaagccggucuuggg

SEQ ID NO: 2879520 - RNA, 19 nt, Mycobacterium avium subsp. paratuberculosis
uacaaggugauggcccgcu

SEQ ID NO: 2879521 - RNA, 22 nt, Mycobacterium avium subsp. paratuberculosis
uacaagugaugaccuggauagg

SEQ ID NO: 2879522 - RNA, 19 nt, Mycobacterium avium subsp. paratuberculosis
uacacagcccccacgcucg

SEQ ID NO: 2879523 - RNA, 14 nt, Mycobacterium avium subsp. paratuberculosis
uacacauagcccau

SEQ ID NO: 2879524 - RNA, 15 nt, Mycobacterium avium subsp. paratuberculosis
uacacauagcccauc

SEQ ID NO: 2879525 - RNA, 13 nt, Mycobacterium avium subsp. paratuberculosis
uacaccacccggu

SEQ ID NO: 2879526 - RNA, 21 nt, Mycobacterium avium subsp. paratuberculosis
uacaccaccgcggcgaugauc

SEQ ID NO: 2879527 - RNA, 20 nt, Mycobacterium avium subsp. paratuberculosis
uacaccagggugccgccggg

SEQ ID NO: 2879528 - RNA, 14 nt, Mycobacterium avium subsp. paratuberculosis
uacaccccaccgga

SEQ ID NO: 2879529 - RNA, 22 nt, Mycobacterium avium subsp. paratuberculosis
uacaccgggaucggggugccgc

SEQ ID NO: 2879530 - RNA, 18 nt, Mycobacterium avium subsp. paratuberculosis
uacaccgguugcgccgag

SEQ ID NO: 2879531 - RNA, 18 nt, Mycobacterium avium subsp. paratuberculosis
uacaccugccgcacaccg

SEQ ID NO: 2879532 - RNA, 19 nt, Mycobacterium avium subsp. paratuberculosis
uacacggcccgcggcacgc

SEQ ID NO: 2879533 - RNA, 18 nt, Mycobacterium avium subsp. paratuberculosis
uacacguagcgguccagc

SEQ ID NO: 2879534 - RNA, 13 nt, Mycobacterium avium subsp. paratuberculosis
uacagcaccgccg

SEQ ID NO: 2879535 - RNA, 14 nt, Mycobacterium avium subsp. paratuberculosis
uacagcaccgccgc

SEQ ID NO: 2879536 - RNA, 16 nt, Mycobacterium avium subsp. paratuberculosis
uacagcaccgccgcgg

SEQ ID NO: 2879537 - RNA, 19 nt, Mycobacterium avium subsp. paratuberculosis
uacagccagcccguggcca

SEQ ID NO: 2879538 - RNA, 15 nt, Mycobacterium avium subsp. paratuberculosis
uacagcgacuccagc

SEQ ID NO: 2879539 - RNA, 19 nt, Mycobacterium avium subsp. paratuberculosis
uacagcgacuccagcgcga

SEQ ID NO: 2879540 - RNA, 14 nt, Mycobacterium avium subsp. paratuberculosis
uacagcgccagcgg

SEQ ID NO: 2879541 - RNA, 12 nt, Mycobacterium avium subsp. paratuberculosis
uacagcggcgcg

SEQ ID NO: 2879542 - RNA, 19 nt, Mycobacterium avium subsp. paratuberculosis
uacagcggcgcgcgccgca

SEQ ID NO: 2879543 - RNA, 20 nt, Mycobacterium avium subsp. paratuberculosis
uacagcgucagcaucgccgu

SEQ ID NO: 2879544 - RNA, 14 nt, Mycobacterium avium subsp. paratuberculosis
uacaggugcagcag

SEQ ID NO: 2879545 - RNA, 15 nt, Mycobacterium avium subsp. paratuberculosis
uacaucguucccugc

SEQ ID NO: 2879546 - RNA, 20 nt, Mycobacterium avium subsp. paratuberculosis
uacaucguucccugcgcggc

SEQ ID NO: 2879547 - RNA, 23 nt, Mycobacterium avium subsp. paratuberculosis
uacaucguucccugcgcggcgau

SEQ ID NO: 2879548 - RNA, 17 nt, Mycobacterium avium subsp. paratuberculosis
uaccacgccgucgacga

SEQ ID NO: 2879549 - RNA, 18 nt, Mycobacterium avium subsp. paratuberculosis
uaccacugcgcgcccgag

SEQ ID NO: 2879550 - RNA, 15 nt, Mycobacterium avium subsp. paratuberculosis
uaccagaucgagcug

SEQ ID NO: 2879551 - RNA, 15 nt, Mycobacterium avium subsp. paratuberculosis
uaccagccgcggacg

SEQ ID NO: 2879552 - RNA, 15 nt, Mycobacterium avium subsp. paratuberculosis
uaccagcgcucgacg

SEQ ID NO: 2879553 - RNA, 16 nt, Mycobacterium avium subsp. paratuberculosis
uaccagcgcucgacga

SEQ ID NO: 2879554 - RNA, 17 nt, Mycobacterium avium subsp. paratuberculosis
uaccagcgcucgacgag

SEQ ID NO: 2879555 - RNA, 20 nt, Mycobacterium avium subsp. paratuberculosis
uaccagcugcccaccagcag

SEQ ID NO: 2879556 - RNA, 21 nt, Mycobacterium avium subsp. paratuberculosis
uaccagcugcccaccagcagg

SEQ ID NO: 2879557 - RNA, 13 nt, Mycobacterium avium subsp. paratuberculosis
uaccaggcgacgu

SEQ ID NO: 2879558 - RNA, 16 nt, Mycobacterium avium subsp. paratuberculosis
uaccagggcagcgccu

SEQ ID NO: 2879559 - RNA, 14 nt, Mycobacterium avium subsp. paratuberculosis
uaccauugcgccgg

SEQ ID NO: 2879560 - RNA, 16 nt, Mycobacterium avium subsp. paratuberculosis
uaccccagcaaaaccc

SEQ ID NO: 2879561 - RNA, 13 nt, Mycobacterium avium subsp. paratuberculosis
uacccccgcacgc

SEQ ID NO: 2879562 - RNA, 16 nt, Mycobacterium avium subsp. paratuberculosis
uacccgaacccagcgc

SEQ ID NO: 2879563 - RNA, 14 nt, Mycobacterium avium subsp. paratuberculosis
uacccgaccagcac

SEQ ID NO: 2879564 - RNA, 16 nt, Mycobacterium avium subsp. paratuberculosis
uacccgaccagcaccg

SEQ ID NO: 2879565 - RNA, 18 nt, Mycobacterium avium subsp. paratuberculosis
uacccgaccagcaccgcg

SEQ ID NO: 2879566 - RNA, 16 nt, Mycobacterium avium subsp. paratuberculosis
uacccgcccagcacca

SEQ ID NO: 2879567 - RNA, 23 nt, Mycobacterium avium subsp. paratuberculosis
uacccgccgcaccucgccggccg

SEQ ID NO: 2879568 - RNA, 18 nt, Mycobacterium avium subsp. paratuberculosis
uacccgcgauggcacaca

SEQ ID NO: 2879569 - RNA, 13 nt, Mycobacterium avium subsp. paratuberculosis
uacccgcgcggcg

SEQ ID NO: 2879570 - RNA, 18 nt, Mycobacterium avium subsp. paratuberculosis
uacccgcgcggcgcaggu

SEQ ID NO: 2879571 - RNA, 19 nt, Mycobacterium avium subsp. paratuberculosis
uacccggcgaaccgggaca

SEQ ID NO: 2879572 - RNA, 15 nt, Mycobacterium avium subsp. paratuberculosis
uacccguccagcgcg

SEQ ID NO: 2879573 - RNA, 16 nt, Mycobacterium avium subsp. paratuberculosis
uacccguccagcgcga

SEQ ID NO: 2879574 - RNA, 14 nt, Mycobacterium avium subsp. paratuberculosis
uacccguugcgccc

SEQ ID NO: 2879575 - RNA, 16 nt, Mycobacterium avium subsp. paratuberculosis
uacccuccgggcggca

SEQ ID NO: 2879576 - RNA, 18 nt, Mycobacterium avium subsp. paratuberculosis
uacccuucggccggcagc

SEQ ID NO: 2879577 - RNA, 16 nt, Mycobacterium avium subsp. paratuberculosis
uaccgaggaugaccgc

SEQ ID NO: 2879578 - RNA, 21 nt, Mycobacterium avium subsp. paratuberculosis
uaccgaugaccaccgcugugg

SEQ ID NO: 2879579 - RNA, 17 nt, Mycobacterium avium subsp. paratuberculosis
uaccgcaacaccgaaag

SEQ ID NO: 2879580 - RNA, 15 nt, Mycobacterium avium subsp. paratuberculosis
uaccgcccgcgcugg

SEQ ID NO: 2879581 - RNA, 14 nt, Mycobacterium avium subsp. paratuberculosis
uaccgccggccgcg

SEQ ID NO: 2879582 - RNA, 13 nt, Mycobacterium avium subsp. paratuberculosis
uaccgccucgcca

SEQ ID NO: 2879583 - RNA, 14 nt, Mycobacterium avium subsp. paratuberculosis
uaccgccucgccag

SEQ ID NO: 2879584 - RNA, 16 nt, Mycobacterium avium subsp. paratuberculosis
uaccgcggcggcgucg

SEQ ID NO: 2879585 - RNA, 19 nt, Mycobacterium avium subsp. paratuberculosis
uaccgcggcggcgucgacc

SEQ ID NO: 2879586 - RNA, 18 nt, Mycobacterium avium subsp. paratuberculosis
uaccggcagcaggugcac

SEQ ID NO: 2879587 - RNA, 20 nt, Mycobacterium avium subsp. paratuberculosis
uaccggcagcaggugcacca

SEQ ID NO: 2879588 - RNA, 21 nt, Mycobacterium avium subsp. paratuberculosis
uaccggcccagcgcgguguac

SEQ ID NO: 2879589 - RNA, 12 nt, Mycobacterium avium subsp. paratuberculosis
uaccggccggcc

SEQ ID NO: 2879590 - RNA, 14 nt, Mycobacterium avium subsp. paratuberculosis
uaccggccggccgc

SEQ ID NO: 2879591 - RNA, 17 nt, Mycobacterium avium subsp. paratuberculosis
uaccggccggccgccug

SEQ ID NO: 2879592 - RNA, 17 nt, Mycobacterium avium subsp. paratuberculosis
uaccggccggcgcggcg

SEQ ID NO: 2879593 - RNA, 15 nt, Mycobacterium avium subsp. paratuberculosis
uaccggguggccagc

SEQ ID NO: 2879594 - RNA, 18 nt, Mycobacterium avium subsp. paratuberculosis
uaccggguggccagcacc

SEQ ID NO: 2879595 - RNA, 20 nt, Mycobacterium avium subsp. paratuberculosis
uaccggguggccagcaccag

SEQ ID NO: 2879596 - RNA, 21 nt, Mycobacterium avium subsp. paratuberculosis
uaccggguggccagcaccagc

SEQ ID NO: 2879597 - RNA, 16 nt, Mycobacterium avium subsp. paratuberculosis
uaccgguacagcgacu

SEQ ID NO: 2879598 - RNA, 24 nt, Mycobacterium avium subsp. paratuberculosis
uaccggugcacgagcgucgugcgg

SEQ ID NO: 2879599 - RNA, 15 nt, Mycobacterium avium subsp. paratuberculosis
uaccgguugcccggu

SEQ ID NO: 2879600 - RNA, 23 nt, Mycobacterium avium subsp. paratuberculosis
uaccgguugcccgguuccgcgac

SEQ ID NO: 2879601 - RNA, 21 nt, Mycobacterium avium subsp. paratuberculosis
uaccugaccagcggcgcgccg

SEQ ID NO: 2879602 - RNA, 21 nt, Mycobacterium avium subsp. paratuberculosis
uaccugcguccgauaccagcc

SEQ ID NO: 2879603 - RNA, 20 nt, Mycobacterium avium subsp. paratuberculosis
uacgacguccgggccgccuc

SEQ ID NO: 2879604 - RNA, 16 nt, Mycobacterium avium subsp. paratuberculosis
uacgcacccgacacgc

SEQ ID NO: 2879605 - RNA, 18 nt, Mycobacterium avium subsp. paratuberculosis
uacgccagaugcgccgcg

SEQ ID NO: 2879606 - RNA, 16 nt, Mycobacterium avium subsp. paratuberculosis
uacgccaucagcacca

SEQ ID NO: 2879607 - RNA, 18 nt, Mycobacterium avium subsp. paratuberculosis
uacgcccgaucccgggcc

SEQ ID NO: 2879608 - RNA, 19 nt, Mycobacterium avium subsp. paratuberculosis
uacgcccgaucccgggccg

SEQ ID NO: 2879609 - RNA, 20 nt, Mycobacterium avium subsp. paratuberculosis
uacgccgacgucaggguggc

SEQ ID NO: 2879610 - RNA, 16 nt, Mycobacterium avium subsp. paratuberculosis
uacgccgccuugacgc

SEQ ID NO: 2879611 - RNA, 18 nt, Mycobacterium avium subsp. paratuberculosis
uacgccgccuugacgccg

SEQ ID NO: 2879612 - RNA, 18 nt, Mycobacterium avium subsp. paratuberculosis
uacgccucaccccagcgc

SEQ ID NO: 2879613 - RNA, 23 nt, Mycobacterium avium subsp. paratuberculosis
uacgcgacgaaccgccacacguc

SEQ ID NO: 2879614 - RNA, 14 nt, Mycobacterium avium subsp. paratuberculosis
uacgcgagcugcuu

SEQ ID NO: 2879615 - RNA, 20 nt, Mycobacterium avium subsp. paratuberculosis
uacgcgauggcggcgcgcuc

SEQ ID NO: 2879616 - RNA, 20 nt, Mycobacterium avium subsp. paratuberculosis
uacgcgccggccagccggcu

SEQ ID NO: 2879617 - RNA, 20 nt, Mycobacterium avium subsp. paratuberculosis
uacgcgccggccugucaacg

SEQ ID NO: 2879618 - RNA, 11 nt, Mycobacterium avium subsp. paratuberculosis
uacgcgcugcc

SEQ ID NO: 2879619 - RNA, 14 nt, Mycobacterium avium subsp. paratuberculosis
uacgcggcuggcgg

SEQ ID NO: 2879620 - RNA, 21 nt, Mycobacterium avium subsp. paratuberculosis
uacgcgguucgugcgcaacga

SEQ ID NO: 2879621 - RNA, 15 nt, Mycobacterium avium subsp. paratuberculosis
uacgcugcgcgaccu

SEQ ID NO: 2879622 - RNA, 18 nt, Mycobacterium avium subsp. paratuberculosis
uacgcuguggggcccacu

SEQ ID NO: 2879623 - RNA, 18 nt, Mycobacterium avium subsp. paratuberculosis
uacggacgcauccacggc

SEQ ID NO: 2879624 - RNA, 13 nt, Mycobacterium avium subsp. paratuberculosis
uacggaugccccu

SEQ ID NO: 2879625 - RNA, 15 nt, Mycobacterium avium subsp. paratuberculosis
uacggcggcucgggg

SEQ ID NO: 2879626 - RNA, 20 nt, Mycobacterium avium subsp. paratuberculosis
uacggcgggccggcgccggu

SEQ ID NO: 2879627 - RNA, 19 nt, Mycobacterium avium subsp. paratuberculosis
uacggcgggugcgacggca

SEQ ID NO: 2879628 - RNA, 22 nt, Mycobacterium avium subsp. paratuberculosis
uacggcucaacggccggcgccg

SEQ ID NO: 2879629 - RNA, 17 nt, Mycobacterium avium subsp. paratuberculosis
uacggcucguggguggu

SEQ ID NO: 2879630 - RNA, 15 nt, Mycobacterium avium subsp. paratuberculosis
uacgggcgcagcgcc

SEQ ID NO: 2879631 - RNA, 15 nt, Mycobacterium avium subsp. paratuberculosis
uacgucacggugacg

SEQ ID NO: 2879632 - RNA, 14 nt, Mycobacterium avium subsp. paratuberculosis
uacgucgucgccgg

SEQ ID NO: 2879633 - RNA, 19 nt, Mycobacterium avium subsp. paratuberculosis
uacgugcucccgccgagau

SEQ ID NO: 2879634 - RNA, 16 nt, Mycobacterium avium subsp. paratuberculosis
uacucaaaccgggccu

SEQ ID NO: 2879635 - RNA, 21 nt, Mycobacterium avium subsp. paratuberculosis
uacuccgguaccacgccgucg

SEQ ID NO: 2879636 - RNA, 13 nt, Mycobacterium avium subsp. paratuberculosis
uacuccucgcggu

SEQ ID NO: 2879637 - RNA, 14 nt, Mycobacterium avium subsp. paratuberculosis
uacucggacgccgg

SEQ ID NO: 2879638 - RNA, 18 nt, Mycobacterium avium subsp. paratuberculosis
uacucggacgccggcagc

SEQ ID NO: 2879639 - RNA, 22 nt, Mycobacterium avium subsp. paratuberculosis
uacucggacgccggcagccgcu

SEQ ID NO: 2879640 - RNA, 20 nt, Mycobacterium avium subsp. paratuberculosis
uacucgggcaacgcgccggc

SEQ ID NO: 2879641 - RNA, 19 nt, Mycobacterium avium subsp. paratuberculosis
uacucgguguagagcaccu

SEQ ID NO: 2879642 - RNA, 21 nt, Mycobacterium avium subsp. paratuberculosis
uacugccgcugcuuugucuca

SEQ ID NO: 2879643 - RNA, 14 nt, Mycobacterium avium subsp. paratuberculosis
uacugcucgacgua

SEQ ID NO: 2879644 - RNA, 17 nt, Mycobacterium avium subsp. paratuberculosis
uacugcucggcgcggcu

SEQ ID NO: 2879645 - RNA, 14 nt, Mycobacterium avium subsp. paratuberculosis
uacugcuugccgcc

SEQ ID NO: 2879646 - RNA, 13 nt, Mycobacterium avium subsp. paratuberculosis
uacuggcgccggu

SEQ ID NO: 2879647 - RNA, 17 nt, Mycobacterium avium subsp. paratuberculosis
uacugggcguggucgcc

SEQ ID NO: 2879648 - RNA, 16 nt, Mycobacterium avium subsp. paratuberculosis
uacuucgucagcagcg

SEQ ID NO: 2879649 - RNA, 18 nt, Mycobacterium avium subsp. paratuberculosis
uacuugcguugcgcggcg

SEQ ID NO: 2879650 - RNA, 15 nt, Mycobacterium avium subsp. paratuberculosis
uacuugcuggcgcug

SEQ ID NO: 2879651 - RNA, 21 nt, Mycobacterium avium subsp. paratuberculosis
uagaaccaacgcggcgccggu

SEQ ID NO: 2879652 - RNA, 13 nt, Mycobacterium avium subsp. paratuberculosis
uagaacgacgaca

SEQ ID NO: 2879653 - RNA, 16 nt, Mycobacterium avium subsp. paratuberculosis
uagaagcucagcugcu

SEQ ID NO: 2879654 - RNA, 14 nt, Mycobacterium avium subsp. paratuberculosis
uagaaggcgccguc

SEQ ID NO: 2879655 - RNA, 17 nt, Mycobacterium avium subsp. paratuberculosis
uagacagcguggucgcg

SEQ ID NO: 2879656 - RNA, 22 nt, Mycobacterium avium subsp. paratuberculosis
uagacagcguggucgcgcagca

SEQ ID NO: 2879657 - RNA, 13 nt, Mycobacterium avium subsp. paratuberculosis
uagacccacagcu

SEQ ID NO: 2879658 - RNA, 19 nt, Mycobacterium avium subsp. paratuberculosis
uagacccacagcugccggc

SEQ ID NO: 2879659 - RNA, 22 nt, Mycobacterium avium subsp. paratuberculosis
uagacccggggguccagggugc

SEQ ID NO: 2879660 - RNA, 21 nt, Mycobacterium avium subsp. paratuberculosis
uagaccucuugggacuggaug

SEQ ID NO: 2879661 - RNA, 16 nt, Mycobacterium avium subsp. paratuberculosis
uagaccuugaccaccg

SEQ ID NO: 2879662 - RNA, 14 nt, Mycobacterium avium subsp. paratuberculosis
uagacgacgggcag

SEQ ID NO: 2879663 - RNA, 19 nt, Mycobacterium avium subsp. paratuberculosis
uagacgacgggcaggguga

SEQ ID NO: 2879664 - RNA, 23 nt, Mycobacterium avium subsp. paratuberculosis
uagacgacgucgaccgcgccggg

SEQ ID NO: 2879665 - RNA, 15 nt, Mycobacterium avium subsp. paratuberculosis
uagacgaucaccggc

SEQ ID NO: 2879666 - RNA, 16 nt, Mycobacterium avium subsp. paratuberculosis
uagacgaugcccagcc

SEQ ID NO: 2879667 - RNA, 14 nt, Mycobacterium avium subsp. paratuberculosis
uagacggcaugccg

SEQ ID NO: 2879668 - RNA, 18 nt, Mycobacterium avium subsp. paratuberculosis
uagacguagugcagccgc

SEQ ID NO: 2879669 - RNA, 13 nt, Mycobacterium avium subsp. paratuberculosis
uagacguucuccc

SEQ ID NO: 2879670 - RNA, 21 nt, Mycobacterium avium subsp. paratuberculosis
uagagcaggaccgagccgcgc

SEQ ID NO: 2879671 - RNA, 22 nt, Mycobacterium avium subsp. paratuberculosis
uagagcaguucgaugcgcucgg

SEQ ID NO: 2879672 - RNA, 24 nt, Mycobacterium avium subsp. paratuberculosis
uagagccgcugcacgcguugcagc

SEQ ID NO: 2879673 - RNA, 17 nt, Mycobacterium avium subsp. paratuberculosis
uagagcgggauccccac

SEQ ID NO: 2879674 - RNA, 21 nt, Mycobacterium avium subsp. paratuberculosis
uagagcgggaucugcgccgcc

SEQ ID NO: 2879675 - RNA, 16 nt, Mycobacterium avium subsp. paratuberculosis
uagagcuggugggcca

SEQ ID NO: 2879676 - RNA, 19 nt, Mycobacterium avium subsp. paratuberculosis
uagagcuggugggccaucg

SEQ ID NO: 2879677 - RNA, 17 nt, Mycobacterium avium subsp. paratuberculosis
uagaggccgcggaucgc

SEQ ID NO: 2879678 - RNA, 20 nt, Mycobacterium avium subsp. paratuberculosis
uagaggcggcgaccgcgacg

SEQ ID NO: 2879679 - RNA, 16 nt, Mycobacterium avium subsp. paratuberculosis
uagaggugcagcgggc

SEQ ID NO: 2879680 - RNA, 20 nt, Mycobacterium avium subsp. paratuberculosis
uagauaagcggauugaccag

SEQ ID NO: 2879681 - RNA, 20 nt, Mycobacterium avium subsp. paratuberculosis
uagaucaucccggccacccc

SEQ ID NO: 2879682 - RNA, 22 nt, Mycobacterium avium subsp. paratuberculosis
uagaucgccggaucgagcaccc

SEQ ID NO: 2879683 - RNA, 19 nt, Mycobacterium avium subsp. paratuberculosis
uagaugagccgcagccggg

SEQ ID NO: 2879684 - RNA, 21 nt, Mycobacterium avium subsp. paratuberculosis
uagaugcggcccagcccggcc

SEQ ID NO: 2879685 - RNA, 21 nt, Mycobacterium avium subsp. paratuberculosis
uagaugcguuccaggugugcc

SEQ ID NO: 2879686 - RNA, 17 nt, Mycobacterium avium subsp. paratuberculosis
uagauguugcggccggc

SEQ ID NO: 2879687 - RNA, 16 nt, Mycobacterium avium subsp. paratuberculosis
uagcacuuucgcggca

SEQ ID NO: 2879688 - RNA, 15 nt, Mycobacterium avium subsp. paratuberculosis
uagcagcgcggcuug

SEQ ID NO: 2879689 - RNA, 18 nt, Mycobacterium avium subsp. paratuberculosis
uagcagcgucugcgcccc

SEQ ID NO: 2879690 - RNA, 19 nt, Mycobacterium avium subsp. paratuberculosis
uagccaucagaacgcccgc

SEQ ID NO: 2879691 - RNA, 11 nt, Mycobacterium avium subsp. paratuberculosis
uagcccagcca

SEQ ID NO: 2879692 - RNA, 13 nt, Mycobacterium avium subsp. paratuberculosis
uagcccagcgcgu

SEQ ID NO: 2879693 - RNA, 23 nt, Mycobacterium avium subsp. paratuberculosis
uagcccagcgcguugcggccguc

SEQ ID NO: 2879694 - RNA, 14 nt, Mycobacterium avium subsp. paratuberculosis
uagcccagcguggu

SEQ ID NO: 2879695 - RNA, 22 nt, Mycobacterium avium subsp. paratuberculosis
uagcccaggauucccgaccccg

SEQ ID NO: 2879696 - RNA, 18 nt, Mycobacterium avium subsp. paratuberculosis
uagcccaucagcacgccc

SEQ ID NO: 2879697 - RNA, 20 nt, Mycobacterium avium subsp. paratuberculosis
uagcccaucagcacgcccuc

SEQ ID NO: 2879698 - RNA, 23 nt, Mycobacterium avium subsp. paratuberculosis
uagcccaucagcacgcccucguc

SEQ ID NO: 2879699 - RNA, 14 nt, Mycobacterium avium subsp. paratuberculosis
uagccccucccacc

SEQ ID NO: 2879700 - RNA, 21 nt, Mycobacterium avium subsp. paratuberculosis
uagcccgacgggcgugccggc

SEQ ID NO: 2879701 - RNA, 13 nt, Mycobacterium avium subsp. paratuberculosis
uagcccgccgcgg

SEQ ID NO: 2879702 - RNA, 14 nt, Mycobacterium avium subsp. paratuberculosis
uagcccgccgcggc

SEQ ID NO: 2879703 - RNA, 21 nt, Mycobacterium avium subsp. paratuberculosis
uagcccgucgacgggccacca

SEQ ID NO: 2879704 - RNA, 18 nt, Mycobacterium avium subsp. paratuberculosis
uagcccuaccggcucggc

SEQ ID NO: 2879705 - RNA, 15 nt, Mycobacterium avium subsp. paratuberculosis
uagccgaagccgccg

SEQ ID NO: 2879706 - RNA, 13 nt, Mycobacterium avium subsp. paratuberculosis
uagccgaccaacg

SEQ ID NO: 2879707 - RNA, 20 nt, Mycobacterium avium subsp. paratuberculosis
uagccgaccaacgggcggcg

SEQ ID NO: 2879708 - RNA, 14 nt, Mycobacterium avium subsp. paratuberculosis
uagccgaccgaccc

SEQ ID NO: 2879709 - RNA, 20 nt, Mycobacterium avium subsp. paratuberculosis
uagccgaccgacccggccag

SEQ ID NO: 2879710 - RNA, 21 nt, Mycobacterium avium subsp. paratuberculosis
uagccgaccgacccggccagc

SEQ ID NO: 2879711 - RNA, 24 nt, Mycobacterium avium subsp. paratuberculosis
uagccgaccgacccggccagcggc

SEQ ID NO: 2879712 - RNA, 14 nt, Mycobacterium avium subsp. paratuberculosis
uagccgaccuugac

SEQ ID NO: 2879713 - RNA, 17 nt, Mycobacterium avium subsp. paratuberculosis
uagccgaccuugaccca

SEQ ID NO: 2879714 - RNA, 20 nt, Mycobacterium avium subsp. paratuberculosis
uagccgcccugcccgucggg

SEQ ID NO: 2879715 - RNA, 16 nt, Mycobacterium avium subsp. paratuberculosis
uagccgccgagcguca

SEQ ID NO: 2879716 - RNA, 21 nt, Mycobacterium avium subsp. paratuberculosis
uagccgccgagcgucacgcua

SEQ ID NO: 2879717 - RNA, 11 nt, Mycobacterium avium subsp. paratuberculosis
uagccgccgua

SEQ ID NO: 2879718 - RNA, 14 nt, Mycobacterium avium subsp. paratuberculosis
uagccgcgccgcgg

SEQ ID NO: 2879719 - RNA, 22 nt, Mycobacterium avium subsp. paratuberculosis
uagccgcucgcccagcgcggcg

SEQ ID NO: 2879720 - RNA, 22 nt, Mycobacterium avium subsp. paratuberculosis
uagccggaccgcuugacgccgc

SEQ ID NO: 2879721 - RNA, 12 nt, Mycobacterium avium subsp. paratuberculosis
uagccggcacgc

SEQ ID NO: 2879722 - RNA, 13 nt, Mycobacterium avium subsp. paratuberculosis
uagccggccagcg

SEQ ID NO: 2879723 - RNA, 23 nt, Mycobacterium avium subsp. paratuberculosis
uagccggccagcgucgcgccgcc

SEQ ID NO: 2879724 - RNA, 13 nt, Mycobacterium avium subsp. paratuberculosis
uagccggccagcu

SEQ ID NO: 2879725 - RNA, 16 nt, Mycobacterium avium subsp. paratuberculosis
uagccggccagcucga

SEQ ID NO: 2879726 - RNA, 22 nt, Mycobacterium avium subsp. paratuberculosis
uagccggcccgcagccagcgca

SEQ ID NO: 2879727 - RNA, 14 nt, Mycobacterium avium subsp. paratuberculosis
uagccggccgcguc

SEQ ID NO: 2879728 - RNA, 21 nt, Mycobacterium avium subsp. paratuberculosis
uagccggccgcgucgccgacc

SEQ ID NO: 2879729 - RNA, 14 nt, Mycobacterium avium subsp. paratuberculosis
uagccggcgaucgu

SEQ ID NO: 2879730 - RNA, 17 nt, Mycobacterium avium subsp. paratuberculosis
uagccggcgguggccau

SEQ ID NO: 2879731 - RNA, 17 nt, Mycobacterium avium subsp. paratuberculosis
uagccggggacggugca

SEQ ID NO: 2879732 - RNA, 20 nt, Mycobacterium avium subsp. paratuberculosis
uagccggggacggugcagcc

SEQ ID NO: 2879733 - RNA, 19 nt, Mycobacterium avium subsp. paratuberculosis
uagccgguauccauccgcc

SEQ ID NO: 2879734 - RNA, 17 nt, Mycobacterium avium subsp. paratuberculosis
uagccgguccuggccaa

SEQ ID NO: 2879735 - RNA, 16 nt, Mycobacterium avium subsp. paratuberculosis
uagccggucggcccgc

SEQ ID NO: 2879736 - RNA, 18 nt, Mycobacterium avium subsp. paratuberculosis
uagccggugaucgcggcg

SEQ ID NO: 2879737 - RNA, 19 nt, Mycobacterium avium subsp. paratuberculosis
uagccggugaucgcggcgc

SEQ ID NO: 2879738 - RNA, 20 nt, Mycobacterium avium subsp. paratuberculosis
uagccggugaucgcggcgcu

SEQ ID NO: 2879739 - RNA, 19 nt, Mycobacterium avium subsp. paratuberculosis
uagccgucgaaacggcugc

SEQ ID NO: 2879740 - RNA, 20 nt, Mycobacterium avium subsp. paratuberculosis
uagccgucgaaacggcugcu

SEQ ID NO: 2879741 - RNA, 13 nt, Mycobacterium avium subsp. paratuberculosis
uagccgucggcgg

SEQ ID NO: 2879742 - RNA, 15 nt, Mycobacterium avium subsp. paratuberculosis
uagccgucggcggag

SEQ ID NO: 2879743 - RNA, 19 nt, Mycobacterium avium subsp. paratuberculosis
uagccgucggcggagguca

SEQ ID NO: 2879744 - RNA, 17 nt, Mycobacterium avium subsp. paratuberculosis
uagccgucggcggccuu

SEQ ID NO: 2879745 - RNA, 20 nt, Mycobacterium avium subsp. paratuberculosis
uagccucgccagccguccug

SEQ ID NO: 2879746 - RNA, 14 nt, Mycobacterium avium subsp. paratuberculosis
uagccuuggccgca

SEQ ID NO: 2879747 - RNA, 22 nt, Mycobacterium avium subsp. paratuberculosis
uagccuuugccgugcucggcgg

SEQ ID NO: 2879748 - RNA, 16 nt, Mycobacterium avium subsp. paratuberculosis
uagcgagcgggcacgc

SEQ ID NO: 2879749 - RNA, 19 nt, Mycobacterium avium subsp. paratuberculosis
uagcgagugccggccagcu

SEQ ID NO: 2879750 - RNA, 21 nt, Mycobacterium avium subsp. paratuberculosis
uagcgagugccggccagcucg

SEQ ID NO: 2879751 - RNA, 16 nt, Mycobacterium avium subsp. paratuberculosis
uagcgcaacaccgaaa

SEQ ID NO: 2879752 - RNA, 16 nt, Mycobacterium avium subsp. paratuberculosis
uagcgcaccggucagc

SEQ ID NO: 2879753 - RNA, 14 nt, Mycobacterium avium subsp. paratuberculosis
uagcgcagcaccag

SEQ ID NO: 2879754 - RNA, 16 nt, Mycobacterium avium subsp. paratuberculosis
uagcgcagcaccaggc

SEQ ID NO: 2879755 - RNA, 19 nt, Mycobacterium avium subsp. paratuberculosis
uagcgcagcaucacgucgg

SEQ ID NO: 2879756 - RNA, 23 nt, Mycobacterium avium subsp. paratuberculosis
uagcgcaucagcucuucgacgau

SEQ ID NO: 2879757 - RNA, 20 nt, Mycobacterium avium subsp. paratuberculosis
uagcgcaugaugcccaggcc

SEQ ID NO: 2879758 - RNA, 19 nt, Mycobacterium avium subsp. paratuberculosis
uagcgcauguaggacaccc

SEQ ID NO: 2879759 - RNA, 22 nt, Mycobacterium avium subsp. paratuberculosis
uagcgcauguaggacaccccgg

SEQ ID NO: 2879760 - RNA, 15 nt, Mycobacterium avium subsp. paratuberculosis
uagcgccgccggggc

SEQ ID NO: 2879761 - RNA, 15 nt, Mycobacterium avium subsp. paratuberculosis
uagcgccgcucggcc

SEQ ID NO: 2879762 - RNA, 21 nt, Mycobacterium avium subsp. paratuberculosis
uagcgccgguaggccgcgccg

SEQ ID NO: 2879763 - RNA, 12 nt, Mycobacterium avium subsp. paratuberculosis
uagcgcgccggg

SEQ ID NO: 2879764 - RNA, 19 nt, Mycobacterium avium subsp. paratuberculosis
uagcgcgcgaaggcucgcc

SEQ ID NO: 2879765 - RNA, 13 nt, Mycobacterium avium subsp. paratuberculosis
uagcgcuggguga

SEQ ID NO: 2879766 - RNA, 18 nt, Mycobacterium avium subsp. paratuberculosis
uagcggaagcugccguug

SEQ ID NO: 2879767 - RNA, 15 nt, Mycobacterium avium subsp. paratuberculosis
uagcggacgacggcc

SEQ ID NO: 2879768 - RNA, 18 nt, Mycobacterium avium subsp. paratuberculosis
uagcggacgacggccagc

SEQ ID NO: 2879769 - RNA, 20 nt, Mycobacterium avium subsp. paratuberculosis
uagcggaucaggucggucac

SEQ ID NO: 2879770 - RNA, 15 nt, Mycobacterium avium subsp. paratuberculosis
uagcggauggcgacg

SEQ ID NO: 2879771 - RNA, 17 nt, Mycobacterium avium subsp. paratuberculosis
uagcggauggcgacggc

SEQ ID NO: 2879772 - RNA, 19 nt, Mycobacterium avium subsp. paratuberculosis
uagcggcagauggucucga

SEQ ID NO: 2879773 - RNA, 14 nt, Mycobacterium avium subsp. paratuberculosis
uagcggccgcacgc

SEQ ID NO: 2879774 - RNA, 12 nt, Mycobacterium avium subsp. paratuberculosis
uagcggccgcgg

SEQ ID NO: 2879775 - RNA, 13 nt, Mycobacterium avium subsp. paratuberculosis
uagcggccgcgga

SEQ ID NO: 2879776 - RNA, 21 nt, Mycobacterium avium subsp. paratuberculosis
uagcggcgcaccuggcgcagc

SEQ ID NO: 2879777 - RNA, 15 nt, Mycobacterium avium subsp. paratuberculosis
uagcggcgccaccgg

SEQ ID NO: 2879778 - RNA, 17 nt, Mycobacterium avium subsp. paratuberculosis
uagcggcguaccgcggc

SEQ ID NO: 2879779 - RNA, 17 nt, Mycobacterium avium subsp. paratuberculosis
uagcggcucgccaccuc

SEQ ID NO: 2879780 - RNA, 18 nt, Mycobacterium avium subsp. paratuberculosis
uagcggcugaccgagcgg

SEQ ID NO: 2879781 - RNA, 17 nt, Mycobacterium avium subsp. paratuberculosis
uagcgguccauccagcg

SEQ ID NO: 2879782 - RNA, 21 nt, Mycobacterium avium subsp. paratuberculosis
uagcgguccauccagcgccgc

SEQ ID NO: 2879783 - RNA, 23 nt, Mycobacterium avium subsp. paratuberculosis
uagcgguccauccagcgccgcag

SEQ ID NO: 2879784 - RNA, 14 nt, Mycobacterium avium subsp. paratuberculosis
uagcguccgcccac

SEQ ID NO: 2879785 - RNA, 15 nt, Mycobacterium avium subsp. paratuberculosis
uagcgugacgcucgc

SEQ ID NO: 2879786 - RNA, 16 nt, Mycobacterium avium subsp. paratuberculosis
uagcgugcgcccgacg

SEQ ID NO: 2879787 - RNA, 12 nt, Mycobacterium avium subsp. paratuberculosis
uagcguggguuc

SEQ ID NO: 2879788 - RNA, 14 nt, Mycobacterium avium subsp. paratuberculosis
uagcucagccacgc

SEQ ID NO: 2879789 - RNA, 17 nt, Mycobacterium avium subsp. paratuberculosis
uagcucagccacgccgg

SEQ ID NO: 2879790 - RNA, 14 nt, Mycobacterium avium subsp. paratuberculosis
uagcucgccgcggc

SEQ ID NO: 2879791 - RNA, 14 nt, Mycobacterium avium subsp. paratuberculosis
uagcucgcgccgac

SEQ ID NO: 2879792 - RNA, 14 nt, Mycobacterium avium subsp. paratuberculosis
uagcugagcagcag

SEQ ID NO: 2879793 - RNA, 14 nt, Mycobacterium avium subsp. paratuberculosis
uagcuucacgcucg

SEQ ID NO: 2879794 - RNA, 15 nt, Mycobacterium avium subsp. paratuberculosis
uagcuucacgcucgg

SEQ ID NO: 2879795 - RNA, 18 nt, Mycobacterium avium subsp. paratuberculosis
uagcuucacgcucggcgc

SEQ ID NO: 2879796 - RNA, 20 nt, Mycobacterium avium subsp. paratuberculosis
uaggacaccgaacccggauc

SEQ ID NO: 2879797 - RNA, 12 nt, Mycobacterium avium subsp. paratuberculosis
uaggacagcacc

SEQ ID NO: 2879798 - RNA, 13 nt, Mycobacterium avium subsp. paratuberculosis
uaggacagcagcc

SEQ ID NO: 2879799 - RNA, 14 nt, Mycobacterium avium subsp. paratuberculosis
uaggacccggcgag

SEQ ID NO: 2879800 - RNA, 21 nt, Mycobacterium avium subsp. paratuberculosis
uaggaccggaugaaggacugg

SEQ ID NO: 2879801 - RNA, 17 nt, Mycobacterium avium subsp. paratuberculosis
uaggacgccgcaccgca

SEQ ID NO: 2879802 - RNA, 14 nt, Mycobacterium avium subsp. paratuberculosis
uaggagcugccggc

SEQ ID NO: 2879803 - RNA, 16 nt, Mycobacterium avium subsp. paratuberculosis
uaggaguagcaggcau

SEQ ID NO: 2879804 - RNA, 20 nt, Mycobacterium avium subsp. paratuberculosis
uaggcauccugcuggccggg

SEQ ID NO: 2879805 - RNA, 13 nt, Mycobacterium avium subsp. paratuberculosis
uaggccagcagcg

SEQ ID NO: 2879806 - RNA, 14 nt, Mycobacterium avium subsp. paratuberculosis
uaggccagcccggc

SEQ ID NO: 2879807 - RNA, 19 nt, Mycobacterium avium subsp. paratuberculosis
uaggccagcccggcgugca

SEQ ID NO: 2879808 - RNA, 21 nt, Mycobacterium avium subsp. paratuberculosis
uaggccagcccggcgugcagg

SEQ ID NO: 2879809 - RNA, 19 nt, Mycobacterium avium subsp. paratuberculosis
uaggccagguucaggcuga

SEQ ID NO: 2879810 - RNA, 18 nt, Mycobacterium avium subsp. paratuberculosis
uaggcccaguccugcagc

SEQ ID NO: 2879811 - RNA, 19 nt, Mycobacterium avium subsp. paratuberculosis
uaggcccaguccugcagcu

SEQ ID NO: 2879812 - RNA, 15 nt, Mycobacterium avium subsp. paratuberculosis
uaggccgccgcgacc

SEQ ID NO: 2879813 - RNA, 17 nt, Mycobacterium avium subsp. paratuberculosis
uaggccgcgcuggccag

SEQ ID NO: 2879814 - RNA, 22 nt, Mycobacterium avium subsp. paratuberculosis
uaggccgcguagcucgccgcgg

SEQ ID NO: 2879815 - RNA, 17 nt, Mycobacterium avium subsp. paratuberculosis
uaggcgaggaccgagau

SEQ ID NO: 2879816 - RNA, 11 nt, Mycobacterium avium subsp. paratuberculosis
uaggcgaucgg

SEQ ID NO: 2879817 - RNA, 15 nt, Mycobacterium avium subsp. paratuberculosis
uaggcgaucgggaac

SEQ ID NO: 2879818 - RNA, 17 nt, Mycobacterium avium subsp. paratuberculosis
uaggcgaucgggaacag

SEQ ID NO: 2879819 - RNA, 16 nt, Mycobacterium avium subsp. paratuberculosis
uaggcgaugucgacgu

SEQ ID NO: 2879820 - RNA, 15 nt, Mycobacterium avium subsp. paratuberculosis
uaggcgccgccgcgc

SEQ ID NO: 2879821 - RNA, 18 nt, Mycobacterium avium subsp. paratuberculosis
uaggcgcgggugauuucg

SEQ ID NO: 2879822 - RNA, 13 nt, Mycobacterium avium subsp. paratuberculosis
uaggcggccagca

SEQ ID NO: 2879823 - RNA, 16 nt, Mycobacterium avium subsp. paratuberculosis
uaggcggccagcagca

SEQ ID NO: 2879824 - RNA, 18 nt, Mycobacterium avium subsp. paratuberculosis
uaggcggccagcagcacc

SEQ ID NO: 2879825 - RNA, 19 nt, Mycobacterium avium subsp. paratuberculosis
uaggcggccagcagcacca

SEQ ID NO: 2879826 - RNA, 23 nt, Mycobacterium avium subsp. paratuberculosis
uaggcggcgagauuggccucggc

SEQ ID NO: 2879827 - RNA, 22 nt, Mycobacterium avium subsp. paratuberculosis
uaggcgucgaacgggccgggca

SEQ ID NO: 2879828 - RNA, 19 nt, Mycobacterium avium subsp. paratuberculosis
uagggcaacacgaccagga

SEQ ID NO: 2879829 - RNA, 22 nt, Mycobacterium avium subsp. paratuberculosis
uagggcagccacaucugguugc

SEQ ID NO: 2879830 - RNA, 14 nt, Mycobacterium avium subsp. paratuberculosis
uagggcccacgcuc

SEQ ID NO: 2879831 - RNA, 14 nt, Mycobacterium avium subsp. paratuberculosis
uagggcgaccacca

SEQ ID NO: 2879832 - RNA, 23 nt, Mycobacterium avium subsp. paratuberculosis
uagggcgagcucguucucggcga

SEQ ID NO: 2879833 - RNA, 14 nt, Mycobacterium avium subsp. paratuberculosis
uagggguccuccag

SEQ ID NO: 2879834 - RNA, 16 nt, Mycobacterium avium subsp. paratuberculosis
uagggucgggugcggc

SEQ ID NO: 2879835 - RNA, 22 nt, Mycobacterium avium subsp. paratuberculosis
uaggguucgccgauguccccgc

SEQ ID NO: 2879836 - RNA, 17 nt, Mycobacterium avium subsp. paratuberculosis
uaggucaacccgcucag

SEQ ID NO: 2879837 - RNA, 14 nt, Mycobacterium avium subsp. paratuberculosis
uaggucacccgguc

SEQ ID NO: 2879838 - RNA, 19 nt, Mycobacterium avium subsp. paratuberculosis
uaggucaucagcgacguca

SEQ ID NO: 2879839 - RNA, 20 nt, Mycobacterium avium subsp. paratuberculosis
uagguccggcgcgaccaggu

SEQ ID NO: 2879840 - RNA, 14 nt, Mycobacterium avium subsp. paratuberculosis
uaggucguggcgcc

SEQ ID NO: 2879841 - RNA, 15 nt, Mycobacterium avium subsp. paratuberculosis
uaggucguggcgccg

SEQ ID NO: 2879842 - RNA, 22 nt, Mycobacterium avium subsp. paratuberculosis
uaggugcccgggucgugcggcg

SEQ ID NO: 2879843 - RNA, 13 nt, Mycobacterium avium subsp. paratuberculosis
uaggugccggccg

SEQ ID NO: 2879844 - RNA, 16 nt, Mycobacterium avium subsp. paratuberculosis
uagguggccagccggg

SEQ ID NO: 2879845 - RNA, 20 nt, Mycobacterium avium subsp. paratuberculosis
uagguggccagccgggcgac

SEQ ID NO: 2879846 - RNA, 14 nt, Mycobacterium avium subsp. paratuberculosis
uaggugugcagcca

SEQ ID NO: 2879847 - RNA, 16 nt, Mycobacterium avium subsp. paratuberculosis
uaggugugcagccagg

SEQ ID NO: 2879848 - RNA, 15 nt, Mycobacterium avium subsp. paratuberculosis
uaguacgaccgcgac

SEQ ID NO: 2879849 - RNA, 22 nt, Mycobacterium avium subsp. paratuberculosis
uaguagccggggacggugcagc

SEQ ID NO: 2879850 - RNA, 23 nt, Mycobacterium avium subsp. paratuberculosis
uaguagccggggacggugcagcc

SEQ ID NO: 2879851 - RNA, 14 nt, Mycobacterium avium subsp. paratuberculosis
uaguagcgccacau

SEQ ID NO: 2879852 - RNA, 19 nt, Mycobacterium avium subsp. paratuberculosis
uaguccagggugucgucgu

SEQ ID NO: 2879853 - RNA, 20 nt, Mycobacterium avium subsp. paratuberculosis
uaguccgacgauccgggccg

SEQ ID NO: 2879854 - RNA, 21 nt, Mycobacterium avium subsp. paratuberculosis
uaguccgacuucgcgugccgc

SEQ ID NO: 2879855 - RNA, 15 nt, Mycobacterium avium subsp. paratuberculosis
uaguccggccagucc

SEQ ID NO: 2879856 - RNA, 20 nt, Mycobacterium avium subsp. paratuberculosis
uagucgaccgggaucgugug

SEQ ID NO: 2879857 - RNA, 18 nt, Mycobacterium avium subsp. paratuberculosis
uagucgcccagcagcccg

SEQ ID NO: 2879858 - RNA, 23 nt, Mycobacterium avium subsp. paratuberculosis
uagucgcgcagcugcgccgcguc

SEQ ID NO: 2879859 - RNA, 14 nt, Mycobacterium avium subsp. paratuberculosis
uagucgcucggcgg

SEQ ID NO: 2879860 - RNA, 14 nt, Mycobacterium avium subsp. paratuberculosis
uagucggcccaggc

SEQ ID NO: 2879861 - RNA, 17 nt, Mycobacterium avium subsp. paratuberculosis
uagucggcgaucagcuc

SEQ ID NO: 2879862 - RNA, 14 nt, Mycobacterium avium subsp. paratuberculosis
uagucggcgccgac

SEQ ID NO: 2879863 - RNA, 14 nt, Mycobacterium avium subsp. paratuberculosis
uagucggcgucggc

SEQ ID NO: 2879864 - RNA, 13 nt, Mycobacterium avium subsp. paratuberculosis
uagucggugcagu

SEQ ID NO: 2879865 - RNA, 14 nt, Mycobacterium avium subsp. paratuberculosis
uagucgucgaccgc

SEQ ID NO: 2879866 - RNA, 17 nt, Mycobacterium avium subsp. paratuberculosis
uagugcagccgcccguc

SEQ ID NO: 2879867 - RNA, 22 nt, Mycobacterium avium subsp. paratuberculosis
uagugcauguagcggucguaga

SEQ ID NO: 2879868 - RNA, 13 nt, Mycobacterium avium subsp. paratuberculosis
uaguggucgucgu

SEQ ID NO: 2879869 - RNA, 20 nt, Mycobacterium avium subsp. paratuberculosis
uaguggugcaggugcccguc

SEQ ID NO: 2879870 - RNA, 18 nt, Mycobacterium avium subsp. paratuberculosis
uaguucugcuugagccgc

SEQ ID NO: 2879871 - RNA, 15 nt, Mycobacterium avium subsp. paratuberculosis
uaguugcgcgccgau

SEQ ID NO: 2879872 - RNA, 15 nt, Mycobacterium avium subsp. paratuberculosis
uauacacgccuggac

SEQ ID NO: 2879873 - RNA, 15 nt, Mycobacterium avium subsp. paratuberculosis
uauaggugagaaaag

SEQ ID NO: 2879874 - RNA, 13 nt, Mycobacterium avium subsp. paratuberculosis
uaucccaucagug

SEQ ID NO: 2879875 - RNA, 22 nt, Mycobacterium avium subsp. paratuberculosis
uaucccaucagugcggcccgcc

SEQ ID NO: 2879876 - RNA, 13 nt, Mycobacterium avium subsp. paratuberculosis
uaucgagcaccag

SEQ ID NO: 2879877 - RNA, 19 nt, Mycobacterium avium subsp. paratuberculosis
uaucgagguaggccaccgg

SEQ ID NO: 2879878 - RNA, 18 nt, Mycobacterium avium subsp. paratuberculosis
uaugcccgccgcgucagc

SEQ ID NO: 2879879 - RNA, 13 nt, Mycobacterium avium subsp. paratuberculosis
uaugcccgggccg

SEQ ID NO: 2879880 - RNA, 12 nt, Mycobacterium avium subsp. paratuberculosis
uaugcgcccggg

SEQ ID NO: 2879881 - RNA, 13 nt, Mycobacterium avium subsp. paratuberculosis
uauggcaucgcca

SEQ ID NO: 2879882 - RNA, 13 nt, Mycobacterium avium subsp. paratuberculosis
uaugucggugcgg

SEQ ID NO: 2879883 - RNA, 18 nt, Mycobacterium avium subsp. paratuberculosis
uaugucggugcggcgggc

SEQ ID NO: 2879884 - RNA, 12 nt, Mycobacterium avium subsp. paratuberculosis
uauucgcccacc

SEQ ID NO: 2879885 - RNA, 15 nt, Mycobacterium avium subsp. paratuberculosis
uauucgucaccccac

SEQ ID NO: 2879886 - RNA, 20 nt, Mycobacterium avium subsp. paratuberculosis
ucaaaaaccccgcucccauc

SEQ ID NO: 2879887 - RNA, 23 nt, Mycobacterium avium subsp. paratuberculosis
ucaaaccgggccugcgcgccgau

SEQ ID NO: 2879888 - RNA, 21 nt, Mycobacterium avium subsp. paratuberculosis
ucaacaccgccagcaccgcca

SEQ ID NO: 2879889 - RNA, 14 nt, Mycobacterium avium subsp. paratuberculosis
ucaacaggcccagc

SEQ ID NO: 2879890 - RNA, 17 nt, Mycobacterium avium subsp. paratuberculosis
ucaaccaccggcaucgg

SEQ ID NO: 2879891 - RNA, 15 nt, Mycobacterium avium subsp. paratuberculosis
ucaacccgagcaccg

SEQ ID NO: 2879892 - RNA, 16 nt, Mycobacterium avium subsp. paratuberculosis
ucaacccgagcaccgg

SEQ ID NO: 2879893 - RNA, 23 nt, Mycobacterium avium subsp. paratuberculosis
ucaacccgagcaccgggccgaag

SEQ ID NO: 2879894 - RNA, 22 nt, Mycobacterium avium subsp. paratuberculosis
ucaacccgcucaggucggccgc

SEQ ID NO: 2879895 - RNA, 14 nt, Mycobacterium avium subsp. paratuberculosis
ucaacccgucgcgg

SEQ ID NO: 2879896 - RNA, 16 nt, Mycobacterium avium subsp. paratuberculosis
ucaacccgucgcgggu

SEQ ID NO: 2879897 - RNA, 20 nt, Mycobacterium avium subsp. paratuberculosis
ucaaccgauuucggccagcc

SEQ ID NO: 2879898 - RNA, 14 nt, Mycobacterium avium subsp. paratuberculosis
ucaaccgcccagcg

SEQ ID NO: 2879899 - RNA, 23 nt, Mycobacterium avium subsp. paratuberculosis
ucaaccgguagaagaugcgccgg

SEQ ID NO: 2879900 - RNA, 20 nt, Mycobacterium avium subsp. paratuberculosis
ucaacgccgggucgacgccg

SEQ ID NO: 2879901 - RNA, 14 nt, Mycobacterium avium subsp. paratuberculosis
ucaacgcgccgaac

SEQ ID NO: 2879902 - RNA, 15 nt, Mycobacterium avium subsp. paratuberculosis
ucaacgcgccgaaca

SEQ ID NO: 2879903 - RNA, 22 nt, Mycobacterium avium subsp. paratuberculosis
ucaacggccaaccgcccggcgc

SEQ ID NO: 2879904 - RNA, 18 nt, Mycobacterium avium subsp. paratuberculosis
ucaacggccggcgccgcc

SEQ ID NO: 2879905 - RNA, 19 nt, Mycobacterium avium subsp. paratuberculosis
ucaacggccggcgccgccg

SEQ ID NO: 2879906 - RNA, 20 nt, Mycobacterium avium subsp. paratuberculosis
ucaacggccggcgccgccgg

SEQ ID NO: 2879907 - RNA, 19 nt, Mycobacterium avium subsp. paratuberculosis
ucaacgugauacgccgacg

SEQ ID NO: 2879908 - RNA, 16 nt, Mycobacterium avium subsp. paratuberculosis
ucaacucgucgggggu

SEQ ID NO: 2879909 - RNA, 15 nt, Mycobacterium avium subsp. paratuberculosis
ucaacuugcgcgacg

SEQ ID NO: 2879910 - RNA, 19 nt, Mycobacterium avium subsp. paratuberculosis
ucaagaacgaaucgucgcc

SEQ ID NO: 2879911 - RNA, 15 nt, Mycobacterium avium subsp. paratuberculosis
ucaagauaccggccg

SEQ ID NO: 2879912 - RNA, 17 nt, Mycobacterium avium subsp. paratuberculosis
ucaagauaccggccggc

SEQ ID NO: 2879913 - RNA, 18 nt, Mycobacterium avium subsp. paratuberculosis
ucaagauaccggccggcg

SEQ ID NO: 2879914 - RNA, 15 nt, Mycobacterium avium subsp. paratuberculosis
ucaagauggugugca

SEQ ID NO: 2879915 - RNA, 14 nt, Mycobacterium avium subsp. paratuberculosis
ucaagccgccgauc

SEQ ID NO: 2879916 - RNA, 15 nt, Mycobacterium avium subsp. paratuberculosis
ucaagccggccagca

SEQ ID NO: 2879917 - RNA, 15 nt, Mycobacterium avium subsp. paratuberculosis
ucaagcgcuuucgcc

SEQ ID NO: 2879918 - RNA, 19 nt, Mycobacterium avium subsp. paratuberculosis
ucaagcgcuuucgccgaau

SEQ ID NO: 2879919 - RNA, 13 nt, Mycobacterium avium subsp. paratuberculosis
ucaaggugcugaa

SEQ ID NO: 2879920 - RNA, 13 nt, Mycobacterium avium subsp. paratuberculosis
ucaaguccgcgag

SEQ ID NO: 2879921 - RNA, 14 nt, Mycobacterium avium subsp. paratuberculosis
ucaaguccucccaa

SEQ ID NO: 2879922 - RNA, 17 nt, Mycobacterium avium subsp. paratuberculosis
ucaaugccgcagccgau

SEQ ID NO: 2879923 - RNA, 23 nt, Mycobacterium avium subsp. paratuberculosis
ucaaugguguagcucagccacgc

SEQ ID NO: 2879924 - RNA, 21 nt, Mycobacterium avium subsp. paratuberculosis
ucaauucgaagcccgugccga

SEQ ID NO: 2879925 - RNA, 16 nt, Mycobacterium avium subsp. paratuberculosis
ucaauugccacagccg

SEQ ID NO: 2879926 - RNA, 18 nt, Mycobacterium avium subsp. paratuberculosis
ucaauugccacagccggu

SEQ ID NO: 2879927 - RNA, 14 nt, Mycobacterium avium subsp. paratuberculosis
ucacacccucggcc

SEQ ID NO: 2879928 - RNA, 18 nt, Mycobacterium avium subsp. paratuberculosis
ucacaccgcggccagcgc

SEQ ID NO: 2879929 - RNA, 20 nt, Mycobacterium avium subsp. paratuberculosis
ucacaccgcggccagcgcgc

SEQ ID NO: 2879930 - RNA, 21 nt, Mycobacterium avium subsp. paratuberculosis
ucacaccgcugagguaguccc

SEQ ID NO: 2879931 - RNA, 20 nt, Mycobacterium avium subsp. paratuberculosis
ucacagcgacaacgggccgc

SEQ ID NO: 2879932 - RNA, 14 nt, Mycobacterium avium subsp. paratuberculosis
ucacagcgcggcgg

SEQ ID NO: 2879933 - RNA, 15 nt, Mycobacterium avium subsp. paratuberculosis
ucacagcgcggcggu

SEQ ID NO: 2879934 - RNA, 19 nt, Mycobacterium avium subsp. paratuberculosis
ucacagcgcggcggugagc

SEQ ID NO: 2879935 - RNA, 23 nt, Mycobacterium avium subsp. paratuberculosis
ucacagcgcggcggugagccgcc

SEQ ID NO: 2879936 - RNA, 20 nt, Mycobacterium avium subsp. paratuberculosis
ucacagcucaccugcgugcc

SEQ ID NO: 2879937 - RNA, 19 nt, Mycobacterium avium subsp. paratuberculosis
ucacaggugacgacgcucu

SEQ ID NO: 2879938 - RNA, 23 nt, Mycobacterium avium subsp. paratuberculosis
ucacaucggacaucggcagcagg

SEQ ID NO: 2879939 - RNA, 23 nt, Mycobacterium avium subsp. paratuberculosis
ucacaugggcgcguuggccggcu

SEQ ID NO: 2879940 - RNA, 23 nt, Mycobacterium avium subsp. paratuberculosis
ucaccaaauagccgucggcggcc

SEQ ID NO: 2879941 - RNA, 18 nt, Mycobacterium avium subsp. paratuberculosis
ucaccaaccgcucggcga

SEQ ID NO: 2879942 - RNA, 20 nt, Mycobacterium avium subsp. paratuberculosis
ucaccaaccgcucggcgauc

SEQ ID NO: 2879943 - RNA, 13 nt, Mycobacterium avium subsp. paratuberculosis
ucaccaagcgcga

SEQ ID NO: 2879944 - RNA, 12 nt, Mycobacterium avium subsp. paratuberculosis
ucaccaaggcga

SEQ ID NO: 2879945 - RNA, 18 nt, Mycobacterium avium subsp. paratuberculosis
ucaccaaugcgccggcgg

SEQ ID NO: 2879946 - RNA, 19 nt, Mycobacterium avium subsp. paratuberculosis
ucaccaaugcgccggcggc

SEQ ID NO: 2879947 - RNA, 15 nt, Mycobacterium avium subsp. paratuberculosis
ucaccaccaacgcca

SEQ ID NO: 2879948 - RNA, 18 nt, Mycobacterium avium subsp. paratuberculosis
ucaccaccaccaguucca

SEQ ID NO: 2879949 - RNA, 16 nt, Mycobacterium avium subsp. paratuberculosis
ucaccaccaccgccgu

SEQ ID NO: 2879950 - RNA, 17 nt, Mycobacterium avium subsp. paratuberculosis
ucaccaccccggugccg

SEQ ID NO: 2879951 - RNA, 22 nt, Mycobacterium avium subsp. paratuberculosis
ucaccaccccggugccgcagug

SEQ ID NO: 2879952 - RNA, 15 nt, Mycobacterium avium subsp. paratuberculosis
ucaccaccgagccgg

SEQ ID NO: 2879953 - RNA, 13 nt, Mycobacterium avium subsp. paratuberculosis
ucaccaccgcgcu

SEQ ID NO: 2879954 - RNA, 20 nt, Mycobacterium avium subsp. paratuberculosis
ucaccaccgggucgucgcgg

SEQ ID NO: 2879955 - RNA, 17 nt, Mycobacterium avium subsp. paratuberculosis
ucaccacgauccaaccg

SEQ ID NO: 2879956 - RNA, 22 nt, Mycobacterium avium subsp. paratuberculosis
ucaccacgcuguagggccacca

SEQ ID NO: 2879957 - RNA, 18 nt, Mycobacterium avium subsp. paratuberculosis
ucaccacggucaccccga

SEQ ID NO: 2879958 - RNA, 16 nt, Mycobacterium avium subsp. paratuberculosis
ucaccacggucagggc

SEQ ID NO: 2879959 - RNA, 20 nt, Mycobacterium avium subsp. paratuberculosis
ucaccacggucagggccagc

SEQ ID NO: 2879960 - RNA, 21 nt, Mycobacterium avium subsp. paratuberculosis
ucaccacggucagggccagca

SEQ ID NO: 2879961 - RNA, 16 nt, Mycobacterium avium subsp. paratuberculosis
ucaccacgguggccgc

SEQ ID NO: 2879962 - RNA, 17 nt, Mycobacterium avium subsp. paratuberculosis
ucaccacgguggccgcg

SEQ ID NO: 2879963 - RNA, 12 nt, Mycobacterium avium subsp. paratuberculosis
ucaccagcgcgg

SEQ ID NO: 2879964 - RNA, 13 nt, Mycobacterium avium subsp. paratuberculosis
ucaccagcgcggu

SEQ ID NO: 2879965 - RNA, 15 nt, Mycobacterium avium subsp. paratuberculosis
ucaccagcggcccgc

SEQ ID NO: 2879966 - RNA, 16 nt, Mycobacterium avium subsp. paratuberculosis
ucaccagcggcugcag

SEQ ID NO: 2879967 - RNA, 21 nt, Mycobacterium avium subsp. paratuberculosis
ucaccagcggcugcagcagau

SEQ ID NO: 2879968 - RNA, 20 nt, Mycobacterium avium subsp. paratuberculosis
ucaccagcucccacgacgac

SEQ ID NO: 2879969 - RNA, 21 nt, Mycobacterium avium subsp. paratuberculosis
ucaccagcugucccagugcgu

SEQ ID NO: 2879970 - RNA, 19 nt, Mycobacterium avium subsp. paratuberculosis
ucaccaggcugcucggcgg

SEQ ID NO: 2879971 - RNA, 23 nt, Mycobacterium avium subsp. paratuberculosis
ucaccagggugccccgcgaccgc

SEQ ID NO: 2879972 - RNA, 20 nt, Mycobacterium avium subsp. paratuberculosis
ucaccaguuucacgucggcg

SEQ ID NO: 2879973 - RNA, 11 nt, Mycobacterium avium subsp. paratuberculosis
ucaccaucagc

SEQ ID NO: 2879974 - RNA, 21 nt, Mycobacterium avium subsp. paratuberculosis
ucaccaucagcaccgccucgg

SEQ ID NO: 2879975 - RNA, 13 nt, Mycobacterium avium subsp. paratuberculosis
ucaccaucagcgg

SEQ ID NO: 2879976 - RNA, 19 nt, Mycobacterium avium subsp. paratuberculosis
ucaccaucagcggcucgcg

SEQ ID NO: 2879977 - RNA, 19 nt, Mycobacterium avium subsp. paratuberculosis
ucaccaugaucagcgccgu

SEQ ID NO: 2879978 - RNA, 15 nt, Mycobacterium avium subsp. paratuberculosis
ucacccacggccaca

SEQ ID NO: 2879979 - RNA, 21 nt, Mycobacterium avium subsp. paratuberculosis
ucacccacuggcggccggccg

SEQ ID NO: 2879980 - RNA, 17 nt, Mycobacterium avium subsp. paratuberculosis
ucacccagaucgcccgg

SEQ ID NO: 2879981 - RNA, 22 nt, Mycobacterium avium subsp. paratuberculosis
ucacccagaucgcccgggcggc

SEQ ID NO: 2879982 - RNA, 18 nt, Mycobacterium avium subsp. paratuberculosis
ucacccaugauggugggc

SEQ ID NO: 2879983 - RNA, 17 nt, Mycobacterium avium subsp. paratuberculosis
ucaccccagcgcgacca

SEQ ID NO: 2879984 - RNA, 13 nt, Mycobacterium avium subsp. paratuberculosis
ucacccccaccca

SEQ ID NO: 2879985 - RNA, 15 nt, Mycobacterium avium subsp. paratuberculosis
ucacccccgacaccg

SEQ ID NO: 2879986 - RNA, 16 nt, Mycobacterium avium subsp. paratuberculosis
ucaccccgacggagac

SEQ ID NO: 2879987 - RNA, 23 nt, Mycobacterium avium subsp. paratuberculosis
ucaccccgacggagacgacgacg

SEQ ID NO: 2879988 - RNA, 20 nt, Mycobacterium avium subsp. paratuberculosis
ucaccccgaguucggccaga

SEQ ID NO: 2879989 - RNA, 14 nt, Mycobacterium avium subsp. paratuberculosis
ucaccccgcccagc

SEQ ID NO: 2879990 - RNA, 15 nt, Mycobacterium avium subsp. paratuberculosis
ucaccccgcccagcg

SEQ ID NO: 2879991 - RNA, 11 nt, Mycobacterium avium subsp. paratuberculosis
ucaccccggcc

SEQ ID NO: 2879992 - RNA, 15 nt, Mycobacterium avium subsp. paratuberculosis
ucaccccggccaggg

SEQ ID NO: 2879993 - RNA, 15 nt, Mycobacterium avium subsp. paratuberculosis
ucaccccggccauca

SEQ ID NO: 2879994 - RNA, 15 nt, Mycobacterium avium subsp. paratuberculosis
ucaccccggcgcgga

SEQ ID NO: 2879995 - RNA, 17 nt, Mycobacterium avium subsp. paratuberculosis
ucaccccggcgcggaac

SEQ ID NO: 2879996 - RNA, 14 nt, Mycobacterium avium subsp. paratuberculosis
ucacccgcagcccg

SEQ ID NO: 2879997 - RNA, 17 nt, Mycobacterium avium subsp. paratuberculosis
ucacccgcagcccgacc

SEQ ID NO: 2879998 - RNA, 19 nt, Mycobacterium avium subsp. paratuberculosis
ucacccgccggguggccgc

SEQ ID NO: 2879999 - RNA, 15 nt, Mycobacterium avium subsp. paratuberculosis
ucacccggcccaccg

SEQ ID NO: 2880000 - RNA, 16 nt, Mycobacterium avium subsp. paratuberculosis
ucacccggcccaccgg

SEQ ID NO: 2880001 - RNA, 17 nt, Mycobacterium avium subsp. paratuberculosis
ucacccggcccaccggc

SEQ ID NO: 2880002 - RNA, 18 nt, Mycobacterium avium subsp. paratuberculosis
ucacccggcccaccggcc

SEQ ID NO: 2880003 - RNA, 16 nt, Mycobacterium avium subsp. paratuberculosis
ucacccggcccccgag

SEQ ID NO: 2880004 - RNA, 12 nt, Mycobacterium avium subsp. paratuberculosis
ucacccggcgcg

SEQ ID NO: 2880005 - RNA, 15 nt, Mycobacterium avium subsp. paratuberculosis
ucacccggcgcgcgg

SEQ ID NO: 2880006 - RNA, 15 nt, Mycobacterium avium subsp. paratuberculosis
ucacccggcggcacc

SEQ ID NO: 2880007 - RNA, 16 nt, Mycobacterium avium subsp. paratuberculosis
ucacccggcuggccgc

SEQ ID NO: 2880008 - RNA, 18 nt, Mycobacterium avium subsp. paratuberculosis
ucacccgguugagcaccg

SEQ ID NO: 2880009 - RNA, 19 nt, Mycobacterium avium subsp. paratuberculosis
ucacccgguugagcaccgc

SEQ ID NO: 2880010 - RNA, 21 nt, Mycobacterium avium subsp. paratuberculosis
ucacccgugggccgaccggcc

SEQ ID NO: 2880011 - RNA, 22 nt, Mycobacterium avium subsp. paratuberculosis
ucacccgugggccgaccggccg

SEQ ID NO: 2880012 - RNA, 15 nt, Mycobacterium avium subsp. paratuberculosis
ucacccucggcgucc

SEQ ID NO: 2880013 - RNA, 15 nt, Mycobacterium avium subsp. paratuberculosis
ucacccuggaacuug

SEQ ID NO: 2880014 - RNA, 17 nt, Mycobacterium avium subsp. paratuberculosis
ucacccuggcgaaccgc

SEQ ID NO: 2880015 - RNA, 16 nt, Mycobacterium avium subsp. paratuberculosis
ucaccgaacgcgaugu

SEQ ID NO: 2880016 - RNA, 19 nt, Mycobacterium avium subsp. paratuberculosis
ucaccgaaguccgccaggg

SEQ ID NO: 2880017 - RNA, 22 nt, Mycobacterium avium subsp. paratuberculosis
ucaccgacaagggccgggcgcu

SEQ ID NO: 2880018 - RNA, 22 nt, Mycobacterium avium subsp. paratuberculosis
ucaccgaccccucggcggccgu

SEQ ID NO: 2880019 - RNA, 18 nt, Mycobacterium avium subsp. paratuberculosis
ucaccgagauggccacca

SEQ ID NO: 2880020 - RNA, 20 nt, Mycobacterium avium subsp. paratuberculosis
ucaccgagauggccaccauc

SEQ ID NO: 2880021 - RNA, 15 nt, Mycobacterium avium subsp. paratuberculosis
ucaccgagaugguga

SEQ ID NO: 2880022 - RNA, 16 nt, Mycobacterium avium subsp. paratuberculosis
ucaccgagcggccguc

SEQ ID NO: 2880023 - RNA, 16 nt, Mycobacterium avium subsp. paratuberculosis
ucaccgagcugggccg

SEQ ID NO: 2880024 - RNA, 14 nt, Mycobacterium avium subsp. paratuberculosis
ucaccgcaccgacg

SEQ ID NO: 2880025 - RNA, 19 nt, Mycobacterium avium subsp. paratuberculosis
ucaccgcaucgaaccgccg

SEQ ID NO: 2880026 - RNA, 14 nt, Mycobacterium avium subsp. paratuberculosis
ucaccgccaccagc

SEQ ID NO: 2880027 - RNA, 19 nt, Mycobacterium avium subsp. paratuberculosis
ucaccgccaccagcaggcc

SEQ ID NO: 2880028 - RNA, 13 nt, Mycobacterium avium subsp. paratuberculosis
ucaccgccagcgc

SEQ ID NO: 2880029 - RNA, 18 nt, Mycobacterium avium subsp. paratuberculosis
ucaccgccaggaccaccc

SEQ ID NO: 2880030 - RNA, 12 nt, Mycobacterium avium subsp. paratuberculosis
ucaccgcccacg

SEQ ID NO: 2880031 - RNA, 15 nt, Mycobacterium avium subsp. paratuberculosis
ucaccgccgagccgc

SEQ ID NO: 2880032 - RNA, 15 nt, Mycobacterium avium subsp. paratuberculosis
ucaccgccgagggcc

SEQ ID NO: 2880033 - RNA, 22 nt, Mycobacterium avium subsp. paratuberculosis
ucaccgccgagggcccgggcag

SEQ ID NO: 2880034 - RNA, 14 nt, Mycobacterium avium subsp. paratuberculosis
ucaccgccgucccg

SEQ ID NO: 2880035 - RNA, 16 nt, Mycobacterium avium subsp. paratuberculosis
ucaccgccuccuggcu

SEQ ID NO: 2880036 - RNA, 13 nt, Mycobacterium avium subsp. paratuberculosis
ucaccgcgacgac

SEQ ID NO: 2880037 - RNA, 13 nt, Mycobacterium avium subsp. paratuberculosis
ucaccgcgccggu

SEQ ID NO: 2880038 - RNA, 23 nt, Mycobacterium avium subsp. paratuberculosis
ucaccgcgcgaagucccacugcc

SEQ ID NO: 2880039 - RNA, 19 nt, Mycobacterium avium subsp. paratuberculosis
ucaccgcgcuugccgcgac

SEQ ID NO: 2880040 - RNA, 13 nt, Mycobacterium avium subsp. paratuberculosis
ucaccgcggccac

SEQ ID NO: 2880041 - RNA, 15 nt, Mycobacterium avium subsp. paratuberculosis
ucaccgcggccacca

SEQ ID NO: 2880042 - RNA, 13 nt, Mycobacterium avium subsp. paratuberculosis
ucaccgcggcgag

SEQ ID NO: 2880043 - RNA, 20 nt, Mycobacterium avium subsp. paratuberculosis
ucaccgcgggaauggccgcg

SEQ ID NO: 2880044 - RNA, 22 nt, Mycobacterium avium subsp. paratuberculosis
ucaccgcgggaauggccgcgcc

SEQ ID NO: 2880045 - RNA, 23 nt, Mycobacterium avium subsp. paratuberculosis
ucaccgcgggaauggccgcgccg

SEQ ID NO: 2880046 - RNA, 15 nt, Mycobacterium avium subsp. paratuberculosis
ucaccgcgggcgcgc

SEQ ID NO: 2880047 - RNA, 18 nt, Mycobacterium avium subsp. paratuberculosis
ucaccgcgggcgcgccgu

SEQ ID NO: 2880048 - RNA, 14 nt, Mycobacterium avium subsp. paratuberculosis
ucaccgcggggugc

SEQ ID NO: 2880049 - RNA, 20 nt, Mycobacterium avium subsp. paratuberculosis
ucaccgcggggugcccggcg

SEQ ID NO: 2880050 - RNA, 18 nt, Mycobacterium avium subsp. paratuberculosis
ucaccgcguagcgccgcc

SEQ ID NO: 2880051 - RNA, 17 nt, Mycobacterium avium subsp. paratuberculosis
ucaccgcgucagcagcg

SEQ ID NO: 2880052 - RNA, 23 nt, Mycobacterium avium subsp. paratuberculosis
ucaccgcgucagcagcgcgacgc

SEQ ID NO: 2880053 - RNA, 14 nt, Mycobacterium avium subsp. paratuberculosis
ucaccgcgucggcc

SEQ ID NO: 2880054 - RNA, 16 nt, Mycobacterium avium subsp. paratuberculosis
ucaccgcugccacggu

SEQ ID NO: 2880055 - RNA, 16 nt, Mycobacterium avium subsp. paratuberculosis
ucaccggaccggccag

SEQ ID NO: 2880056 - RNA, 17 nt, Mycobacterium avium subsp. paratuberculosis
ucaccggaccggccagc

SEQ ID NO: 2880057 - RNA, 21 nt, Mycobacterium avium subsp. paratuberculosis
ucaccggaccggccagcagcc

SEQ ID NO: 2880058 - RNA, 23 nt, Mycobacterium avium subsp. paratuberculosis
ucaccggaccggccagcagccgc

SEQ ID NO: 2880059 - RNA, 20 nt, Mycobacterium avium subsp. paratuberculosis
ucaccggagagcaacaccuc

SEQ ID NO: 2880060 - RNA, 22 nt, Mycobacterium avium subsp. paratuberculosis
ucaccggagagcaacaccucgg

SEQ ID NO: 2880061 - RNA, 17 nt, Mycobacterium avium subsp. paratuberculosis
ucaccggaugcaccggc

SEQ ID NO: 2880062 - RNA, 18 nt, Mycobacterium avium subsp. paratuberculosis
ucaccggaugcaccggca

SEQ ID NO: 2880063 - RNA, 19 nt, Mycobacterium avium subsp. paratuberculosis
ucaccggaugcaccggcag

SEQ ID NO: 2880064 - RNA, 20 nt, Mycobacterium avium subsp. paratuberculosis
ucaccggaugcaccggcagc

SEQ ID NO: 2880065 - RNA, 22 nt, Mycobacterium avium subsp. paratuberculosis
ucaccggaugcacgugcaccgc

SEQ ID NO: 2880066 - RNA, 18 nt, Mycobacterium avium subsp. paratuberculosis
ucaccggcacgugcgggu

SEQ ID NO: 2880067 - RNA, 20 nt, Mycobacterium avium subsp. paratuberculosis
ucaccggcagcagcgcgucg

SEQ ID NO: 2880068 - RNA, 21 nt, Mycobacterium avium subsp. paratuberculosis
ucaccggcagcagcgcgucgu

SEQ ID NO: 2880069 - RNA, 14 nt, Mycobacterium avium subsp. paratuberculosis
ucaccggcaggcgg

SEQ ID NO: 2880070 - RNA, 13 nt, Mycobacterium avium subsp. paratuberculosis
ucaccggccaggg

SEQ ID NO: 2880071 - RNA, 19 nt, Mycobacterium avium subsp. paratuberculosis
ucaccggccagggccgccg

SEQ ID NO: 2880072 - RNA, 14 nt, Mycobacterium avium subsp. paratuberculosis
ucaccggccgagcc

SEQ ID NO: 2880073 - RNA, 14 nt, Mycobacterium avium subsp. paratuberculosis
ucaccggcguggug

SEQ ID NO: 2880074 - RNA, 13 nt, Mycobacterium avium subsp. paratuberculosis
ucaccggcucgcg

SEQ ID NO: 2880075 - RNA, 17 nt, Mycobacterium avium subsp. paratuberculosis
ucaccggcuuggcggug

SEQ ID NO: 2880076 - RNA, 17 nt, Mycobacterium avium subsp. paratuberculosis
ucaccgggacgggggug

SEQ ID NO: 2880077 - RNA, 21 nt, Mycobacterium avium subsp. paratuberculosis
ucaccgggauggugaccagcg

SEQ ID NO: 2880078 - RNA, 14 nt, Mycobacterium avium subsp. paratuberculosis
ucaccgggcggccg

SEQ ID NO: 2880079 - RNA, 13 nt, Mycobacterium avium subsp. paratuberculosis
ucaccgggcucgg

SEQ ID NO: 2880080 - RNA, 19 nt, Mycobacterium avium subsp. paratuberculosis
ucaccgggugaugucgccg

SEQ ID NO: 2880081 - RNA, 22 nt, Mycobacterium avium subsp. paratuberculosis
ucaccgguccggucacgcccgg

SEQ ID NO: 2880082 - RNA, 13 nt, Mycobacterium avium subsp. paratuberculosis
ucaccggucgcgu

SEQ ID NO: 2880083 - RNA, 16 nt, Mycobacterium avium subsp. paratuberculosis
ucaccgguggccgcgu

SEQ ID NO: 2880084 - RNA, 18 nt, Mycobacterium avium subsp. paratuberculosis
ucaccgguggccgcgucg

SEQ ID NO: 2880085 - RNA, 17 nt, Mycobacterium avium subsp. paratuberculosis
ucaccggugucacgcug

SEQ ID NO: 2880086 - RNA, 18 nt, Mycobacterium avium subsp. paratuberculosis
ucaccggugucacgcugg

SEQ ID NO: 2880087 - RNA, 20 nt, Mycobacterium avium subsp. paratuberculosis
ucaccggugucacgcuggcg

SEQ ID NO: 2880088 - RNA, 17 nt, Mycobacterium avium subsp. paratuberculosis
ucaccgucagggugacg

SEQ ID NO: 2880089 - RNA, 19 nt, Mycobacterium avium subsp. paratuberculosis
ucaccgucagggugacgug

SEQ ID NO: 2880090 - RNA, 15 nt, Mycobacterium avium subsp. paratuberculosis
ucaccgucgcgguca

SEQ ID NO: 2880091 - RNA, 21 nt, Mycobacterium avium subsp. paratuberculosis
ucaccgucguacucgaccgcg

SEQ ID NO: 2880092 - RNA, 19 nt, Mycobacterium avium subsp. paratuberculosis
ucaccgugaucgccaccac

SEQ ID NO: 2880093 - RNA, 19 nt, Mycobacterium avium subsp. paratuberculosis
ucaccgugcgcgcgcaccu

SEQ ID NO: 2880094 - RNA, 13 nt, Mycobacterium avium subsp. paratuberculosis
ucaccguggcggg

SEQ ID NO: 2880095 - RNA, 17 nt, Mycobacterium avium subsp. paratuberculosis
ucaccgugggcggcgcg

SEQ ID NO: 2880096 - RNA, 21 nt, Mycobacterium avium subsp. paratuberculosis
ucaccgugggcggcgcgaucg

SEQ ID NO: 2880097 - RNA, 23 nt, Mycobacterium avium subsp. paratuberculosis
ucaccguggugugcccgcgggcc

SEQ ID NO: 2880098 - RNA, 14 nt, Mycobacterium avium subsp. paratuberculosis
ucaccgugucggcg

SEQ ID NO: 2880099 - RNA, 16 nt, Mycobacterium avium subsp. paratuberculosis
ucaccgugucggcggg

SEQ ID NO: 2880100 - RNA, 21 nt, Mycobacterium avium subsp. paratuberculosis
ucaccucaucgcccagccggc

SEQ ID NO: 2880101 - RNA, 17 nt, Mycobacterium avium subsp. paratuberculosis
ucaccuccuuggccagg

SEQ ID NO: 2880102 - RNA, 18 nt, Mycobacterium avium subsp. paratuberculosis
ucaccuccuuggccaggc

SEQ ID NO: 2880103 - RNA, 22 nt, Mycobacterium avium subsp. paratuberculosis
ucaccuccuuggccaggcgggc

SEQ ID NO: 2880104 - RNA, 14 nt, Mycobacterium avium subsp. paratuberculosis
ucaccucgccggcc

SEQ ID NO: 2880105 - RNA, 15 nt, Mycobacterium avium subsp. paratuberculosis
ucaccucgccggccg

SEQ ID NO: 2880106 - RNA, 16 nt, Mycobacterium avium subsp. paratuberculosis
ucaccucgccggccgg

SEQ ID NO: 2880107 - RNA, 20 nt, Mycobacterium avium subsp. paratuberculosis
ucaccucgccggccgggcgg

SEQ ID NO: 2880108 - RNA, 17 nt, Mycobacterium avium subsp. paratuberculosis
ucaccucgcugacgucg

SEQ ID NO: 2880109 - RNA, 23 nt, Mycobacterium avium subsp. paratuberculosis
ucaccucggugaugucgacgucg

SEQ ID NO: 2880110 - RNA, 23 nt, Mycobacterium avium subsp. paratuberculosis
ucaccucgucgauccccacgucg

SEQ ID NO: 2880111 - RNA, 19 nt, Mycobacterium avium subsp. paratuberculosis
ucaccugacagacccgauc

SEQ ID NO: 2880112 - RNA, 21 nt, Mycobacterium avium subsp. paratuberculosis
ucaccugcggcccgucgccgu

SEQ ID NO: 2880113 - RNA, 13 nt, Mycobacterium avium subsp. paratuberculosis
ucaccugcgugcc

SEQ ID NO: 2880114 - RNA, 18 nt, Mycobacterium avium subsp. paratuberculosis
ucaccugcguugcggcac

SEQ ID NO: 2880115 - RNA, 22 nt, Mycobacterium avium subsp. paratuberculosis
ucaccugcguugcggcacaggc

SEQ ID NO: 2880116 - RNA, 20 nt, Mycobacterium avium subsp. paratuberculosis
ucaccuggugcucgcgcucg

SEQ ID NO: 2880117 - RNA, 20 nt, Mycobacterium avium subsp. paratuberculosis
ucaccuucugcgcgccgucg

SEQ ID NO: 2880118 - RNA, 21 nt, Mycobacterium avium subsp. paratuberculosis
ucaccuucugcgcgccgucgg

SEQ ID NO: 2880119 - RNA, 24 nt, Mycobacterium avium subsp. paratuberculosis
ucaccuucugcgcgccgucggcgu

SEQ ID NO: 2880120 - RNA, 16 nt, Mycobacterium avium subsp. paratuberculosis
ucaccuucugcgucgg

SEQ ID NO: 2880121 - RNA, 17 nt, Mycobacterium avium subsp. paratuberculosis
ucaccuucugcgucggc

SEQ ID NO: 2880122 - RNA, 18 nt, Mycobacterium avium subsp. paratuberculosis
ucaccuucugcgucggcu

SEQ ID NO: 2880123 - RNA, 23 nt, Mycobacterium avium subsp. paratuberculosis
ucaccuucugcgucggcuugacu

SEQ ID NO: 2880124 - RNA, 16 nt, Mycobacterium avium subsp. paratuberculosis
ucaccuugcggccggc

SEQ ID NO: 2880125 - RNA, 23 nt, Mycobacterium avium subsp. paratuberculosis
ucaccuugcggccggcggcgucg

SEQ ID NO: 2880126 - RNA, 21 nt, Mycobacterium avium subsp. paratuberculosis
ucaccuugucgcugaccaccg

SEQ ID NO: 2880127 - RNA, 19 nt, Mycobacterium avium subsp. paratuberculosis
ucacgaacuccuugacccg

SEQ ID NO: 2880128 - RNA, 14 nt, Mycobacterium avium subsp. paratuberculosis
ucacgaagaaguau

SEQ ID NO: 2880129 - RNA, 22 nt, Mycobacterium avium subsp. paratuberculosis
ucacgaagaaguauucgccguc

SEQ ID NO: 2880130 - RNA, 17 nt, Mycobacterium avium subsp. paratuberculosis
ucacgaagugcccggcg

SEQ ID NO: 2880131 - RNA, 23 nt, Mycobacterium avium subsp. paratuberculosis
ucacgaagugcccggcgccggac

SEQ ID NO: 2880132 - RNA, 20 nt, Mycobacterium avium subsp. paratuberculosis
ucacgaaguugaucgcggcg

SEQ ID NO: 2880133 - RNA, 21 nt, Mycobacterium avium subsp. paratuberculosis
ucacgaaguugaucgcggcgg

SEQ ID NO: 2880134 - RNA, 15 nt, Mycobacterium avium subsp. paratuberculosis
ucacgaccggcagca

SEQ ID NO: 2880135 - RNA, 14 nt, Mycobacterium avium subsp. paratuberculosis
ucacgacgcgaccg

SEQ ID NO: 2880136 - RNA, 16 nt, Mycobacterium avium subsp. paratuberculosis
ucacgacgcgaccgag

SEQ ID NO: 2880137 - RNA, 19 nt, Mycobacterium avium subsp. paratuberculosis
ucacgacggucacggccgc

SEQ ID NO: 2880138 - RNA, 15 nt, Mycobacterium avium subsp. paratuberculosis
ucacgagcuccagcu

SEQ ID NO: 2880139 - RNA, 20 nt, Mycobacterium avium subsp. paratuberculosis
ucacgagcuccagcuaggag

SEQ ID NO: 2880140 - RNA, 19 nt, Mycobacterium avium subsp. paratuberculosis
ucacgaggccgggcuggcg

SEQ ID NO: 2880141 - RNA, 22 nt, Mycobacterium avium subsp. paratuberculosis
ucacgaggccgggcuggcgcug

SEQ ID NO: 2880142 - RNA, 18 nt, Mycobacterium avium subsp. paratuberculosis
ucacgcagaacucgucgc

SEQ ID NO: 2880143 - RNA, 19 nt, Mycobacterium avium subsp. paratuberculosis
ucacgcagaacucgucgcc

SEQ ID NO: 2880144 - RNA, 20 nt, Mycobacterium avium subsp. paratuberculosis
ucacgcagaacucgucgcca

SEQ ID NO: 2880145 - RNA, 19 nt, Mycobacterium avium subsp. paratuberculosis
ucacgcaucagggccagcc

SEQ ID NO: 2880146 - RNA, 20 nt, Mycobacterium avium subsp. paratuberculosis
ucacgcaucagggccagccg

SEQ ID NO: 2880147 - RNA, 15 nt, Mycobacterium avium subsp. paratuberculosis
ucacgccagcgugac

SEQ ID NO: 2880148 - RNA, 16 nt, Mycobacterium avium subsp. paratuberculosis
ucacgccagcgugacg

SEQ ID NO: 2880149 - RNA, 20 nt, Mycobacterium avium subsp. paratuberculosis
ucacgccagcgugacgcccg

SEQ ID NO: 2880150 - RNA, 21 nt, Mycobacterium avium subsp. paratuberculosis
ucacgccagcgugacgcccgg

SEQ ID NO: 2880151 - RNA, 23 nt, Mycobacterium avium subsp. paratuberculosis
ucacgccagcgugacgcccggcg

SEQ ID NO: 2880152 - RNA, 19 nt, Mycobacterium avium subsp. paratuberculosis
ucacgccagcgugacgccg

SEQ ID NO: 2880153 - RNA, 22 nt, Mycobacterium avium subsp. paratuberculosis
ucacgccagcgugacgccgggc

SEQ ID NO: 2880154 - RNA, 20 nt, Mycobacterium avium subsp. paratuberculosis
ucacgccagcgugacgcucg

SEQ ID NO: 2880155 - RNA, 22 nt, Mycobacterium avium subsp. paratuberculosis
ucacgccaguguggccgcggcg

SEQ ID NO: 2880156 - RNA, 16 nt, Mycobacterium avium subsp. paratuberculosis
ucacgccccaggcgcc

SEQ ID NO: 2880157 - RNA, 19 nt, Mycobacterium avium subsp. paratuberculosis
ucacgccccagguuccggu

SEQ ID NO: 2880158 - RNA, 14 nt, Mycobacterium avium subsp. paratuberculosis
ucacgccccggcgu

SEQ ID NO: 2880159 - RNA, 21 nt, Mycobacterium avium subsp. paratuberculosis
ucacgcccggggugaugccgg

SEQ ID NO: 2880160 - RNA, 19 nt, Mycobacterium avium subsp. paratuberculosis
ucacgcccguugacgccca

SEQ ID NO: 2880161 - RNA, 21 nt, Mycobacterium avium subsp. paratuberculosis
ucacgccgccggggcgcagau

SEQ ID NO: 2880162 - RNA, 17 nt, Mycobacterium avium subsp. paratuberculosis
ucacgccgcgcccgucg

SEQ ID NO: 2880163 - RNA, 20 nt, Mycobacterium avium subsp. paratuberculosis
ucacgccggugagcacgacc

SEQ ID NO: 2880164 - RNA, 19 nt, Mycobacterium avium subsp. paratuberculosis
ucacgccguauucgccgac

SEQ ID NO: 2880165 - RNA, 16 nt, Mycobacterium avium subsp. paratuberculosis
ucacgcggcgggaacg

SEQ ID NO: 2880166 - RNA, 16 nt, Mycobacterium avium subsp. paratuberculosis
ucacgcggcuggcccg

SEQ ID NO: 2880167 - RNA, 18 nt, Mycobacterium avium subsp. paratuberculosis
ucacgcggcuggcccggc

SEQ ID NO: 2880168 - RNA, 15 nt, Mycobacterium avium subsp. paratuberculosis
ucacgcuagcgugac

SEQ ID NO: 2880169 - RNA, 13 nt, Mycobacterium avium subsp. paratuberculosis
ucacgcucggcag

SEQ ID NO: 2880170 - RNA, 14 nt, Mycobacterium avium subsp. paratuberculosis
ucacgcucggcagg

SEQ ID NO: 2880171 - RNA, 15 nt, Mycobacterium avium subsp. paratuberculosis
ucacgcucggcaggc

SEQ ID NO: 2880172 - RNA, 19 nt, Mycobacterium avium subsp. paratuberculosis
ucacgcucggccaggguga

SEQ ID NO: 2880173 - RNA, 13 nt, Mycobacterium avium subsp. paratuberculosis
ucacgcucggcga

SEQ ID NO: 2880174 - RNA, 16 nt, Mycobacterium avium subsp. paratuberculosis
ucacgcucggcgagca

SEQ ID NO: 2880175 - RNA, 17 nt, Mycobacterium avium subsp. paratuberculosis
ucacgcucggcgccgag

SEQ ID NO: 2880176 - RNA, 14 nt, Mycobacterium avium subsp. paratuberculosis
ucacgcucggcggg

SEQ ID NO: 2880177 - RNA, 19 nt, Mycobacterium avium subsp. paratuberculosis
ucacgcugaucgaccgguu

SEQ ID NO: 2880178 - RNA, 17 nt, Mycobacterium avium subsp. paratuberculosis
ucacgcuggcgugacgc

SEQ ID NO: 2880179 - RNA, 21 nt, Mycobacterium avium subsp. paratuberculosis
ucacgcuggcgugacgcucgc

SEQ ID NO: 2880180 - RNA, 15 nt, Mycobacterium avium subsp. paratuberculosis
ucacggacagccggc

SEQ ID NO: 2880181 - RNA, 18 nt, Mycobacterium avium subsp. paratuberculosis
ucacggauacccgcggcc

SEQ ID NO: 2880182 - RNA, 19 nt, Mycobacterium avium subsp. paratuberculosis
ucacggauacccgcggccu

SEQ ID NO: 2880183 - RNA, 18 nt, Mycobacterium avium subsp. paratuberculosis
ucacggccgccagcagca

SEQ ID NO: 2880184 - RNA, 23 nt, Mycobacterium avium subsp. paratuberculosis
ucacggccgccagcagcacggca

SEQ ID NO: 2880185 - RNA, 21 nt, Mycobacterium avium subsp. paratuberculosis
ucacggcgaggauggcgauca

SEQ ID NO: 2880186 - RNA, 12 nt, Mycobacterium avium subsp. paratuberculosis
ucacggcgcgau

SEQ ID NO: 2880187 - RNA, 17 nt, Mycobacterium avium subsp. paratuberculosis
ucacggcggcagcgcgg

SEQ ID NO: 2880188 - RNA, 11 nt, Mycobacterium avium subsp. paratuberculosis
ucacggcgggu

SEQ ID NO: 2880189 - RNA, 12 nt, Mycobacterium avium subsp. paratuberculosis
ucacggcgucgg

SEQ ID NO: 2880190 - RNA, 17 nt, Mycobacterium avium subsp. paratuberculosis
ucacggcgucggcgucg

SEQ ID NO: 2880191 - RNA, 21 nt, Mycobacterium avium subsp. paratuberculosis
ucacggcguugaccgggccgc

SEQ ID NO: 2880192 - RNA, 18 nt, Mycobacterium avium subsp. paratuberculosis
ucacggcugccgaccucg

SEQ ID NO: 2880193 - RNA, 13 nt, Mycobacterium avium subsp. paratuberculosis
ucacgggccaggc

SEQ ID NO: 2880194 - RNA, 17 nt, Mycobacterium avium subsp. paratuberculosis
ucacgggucucagcgcc

SEQ ID NO: 2880195 - RNA, 15 nt, Mycobacterium avium subsp. paratuberculosis
ucacggucggcgucc

SEQ ID NO: 2880196 - RNA, 21 nt, Mycobacterium avium subsp. paratuberculosis
ucacggucggcguccagcgcg

SEQ ID NO: 2880197 - RNA, 22 nt, Mycobacterium avium subsp. paratuberculosis
ucacggugacgguuuuggucug

SEQ ID NO: 2880198 - RNA, 18 nt, Mycobacterium avium subsp. paratuberculosis
ucacggugucggcgguga

SEQ ID NO: 2880199 - RNA, 19 nt, Mycobacterium avium subsp. paratuberculosis
ucacgguguuguucaccgg

SEQ ID NO: 2880200 - RNA, 20 nt, Mycobacterium avium subsp. paratuberculosis
ucacgguguuguucaccggc

SEQ ID NO: 2880201 - RNA, 13 nt, Mycobacterium avium subsp. paratuberculosis
ucacguagcucag

SEQ ID NO: 2880202 - RNA, 20 nt, Mycobacterium avium subsp. paratuberculosis
ucacguagucgaccgggauc

SEQ ID NO: 2880203 - RNA, 23 nt, Mycobacterium avium subsp. paratuberculosis
ucacguagugcuucuugaagaac

SEQ ID NO: 2880204 - RNA, 19 nt, Mycobacterium avium subsp. paratuberculosis
ucacguccacgccgcggga

SEQ ID NO: 2880205 - RNA, 17 nt, Mycobacterium avium subsp. paratuberculosis
ucacguccuuggugacg

SEQ ID NO: 2880206 - RNA, 19 nt, Mycobacterium avium subsp. paratuberculosis
ucacguccuuggugacggc

SEQ ID NO: 2880207 - RNA, 16 nt, Mycobacterium avium subsp. paratuberculosis
ucacgucgacggccgc

SEQ ID NO: 2880208 - RNA, 13 nt, Mycobacterium avium subsp. paratuberculosis
ucacgucgagcgg

SEQ ID NO: 2880209 - RNA, 15 nt, Mycobacterium avium subsp. paratuberculosis
ucacgucgagcggcc

SEQ ID NO: 2880210 - RNA, 20 nt, Mycobacterium avium subsp. paratuberculosis
ucacgucgagcggcccgucg

SEQ ID NO: 2880211 - RNA, 19 nt, Mycobacterium avium subsp. paratuberculosis
ucacgucgaucacgccgcc

SEQ ID NO: 2880212 - RNA, 15 nt, Mycobacterium avium subsp. paratuberculosis
ucacgucggcgaugg

SEQ ID NO: 2880213 - RNA, 16 nt, Mycobacterium avium subsp. paratuberculosis
ucacgucggcgauggc

SEQ ID NO: 2880214 - RNA, 16 nt, Mycobacterium avium subsp. paratuberculosis
ucacgucggcguagcg

SEQ ID NO: 2880215 - RNA, 23 nt, Mycobacterium avium subsp. paratuberculosis
ucacgucguugagcacacccagc

SEQ ID NO: 2880216 - RNA, 22 nt, Mycobacterium avium subsp. paratuberculosis
ucacgugcuggcgcuugcguuc

SEQ ID NO: 2880217 - RNA, 18 nt, Mycobacterium avium subsp. paratuberculosis
ucacguguccgucgccgg

SEQ ID NO: 2880218 - RNA, 19 nt, Mycobacterium avium subsp. paratuberculosis
ucacguucggcgagugagg

SEQ ID NO: 2880219 - RNA, 15 nt, Mycobacterium avium subsp. paratuberculosis
ucacguucggcgggc

SEQ ID NO: 2880220 - RNA, 21 nt, Mycobacterium avium subsp. paratuberculosis
ucacguugauccgaugcaggg

SEQ ID NO: 2880221 - RNA, 18 nt, Mycobacterium avium subsp. paratuberculosis
ucacguugaugaucgccg

SEQ ID NO: 2880222 - RNA, 23 nt, Mycobacterium avium subsp. paratuberculosis
ucacuacccgcgauggcacacag

SEQ ID NO: 2880223 - RNA, 14 nt, Mycobacterium avium subsp. paratuberculosis
ucacuaucgacaac

SEQ ID NO: 2880224 - RNA, 19 nt, Mycobacterium avium subsp. paratuberculosis
ucacuccagcggcggcccu

SEQ ID NO: 2880225 - RNA, 22 nt, Mycobacterium avium subsp. paratuberculosis
ucacucgaccuucgagccgccg

SEQ ID NO: 2880226 - RNA, 19 nt, Mycobacterium avium subsp. paratuberculosis
ucacucgucuugcagccgg

SEQ ID NO: 2880227 - RNA, 16 nt, Mycobacterium avium subsp. paratuberculosis
ucacucuggcgugacg

SEQ ID NO: 2880228 - RNA, 16 nt, Mycobacterium avium subsp. paratuberculosis
ucacugcacgcacggc

SEQ ID NO: 2880229 - RNA, 22 nt, Mycobacterium avium subsp. paratuberculosis
ucacugcccagccaucugcuga

SEQ ID NO: 2880230 - RNA, 14 nt, Mycobacterium avium subsp. paratuberculosis
ucacuuccgcggca

SEQ ID NO: 2880231 - RNA, 16 nt, Mycobacterium avium subsp. paratuberculosis
ucagaaccggggccag

SEQ ID NO: 2880232 - RNA, 17 nt, Mycobacterium avium subsp. paratuberculosis
ucagaaccggggccagc

SEQ ID NO: 2880233 - RNA, 19 nt, Mycobacterium avium subsp. paratuberculosis
ucagaaccggggccagcac

SEQ ID NO: 2880234 - RNA, 18 nt, Mycobacterium avium subsp. paratuberculosis
ucagaccauggcgcggcg

SEQ ID NO: 2880235 - RNA, 19 nt, Mycobacterium avium subsp. paratuberculosis
ucagaccauggcgcggcgg

SEQ ID NO: 2880236 - RNA, 22 nt, Mycobacterium avium subsp. paratuberculosis
ucagaccccguaccagcgcucg

SEQ ID NO: 2880237 - RNA, 18 nt, Mycobacterium avium subsp. paratuberculosis
ucagacccugugggucga

SEQ ID NO: 2880238 - RNA, 24 nt, Mycobacterium avium subsp. paratuberculosis
ucagagcagcgccugcugccagga

SEQ ID NO: 2880239 - RNA, 20 nt, Mycobacterium avium subsp. paratuberculosis
ucagagcccgaacacgggcg

SEQ ID NO: 2880240 - RNA, 23 nt, Mycobacterium avium subsp. paratuberculosis
ucagcaacagcucuugaaucggu

SEQ ID NO: 2880241 - RNA, 20 nt, Mycobacterium avium subsp. paratuberculosis
ucagcaacccgaaagccccc

SEQ ID NO: 2880242 - RNA, 16 nt, Mycobacterium avium subsp. paratuberculosis
ucagcaacccgccgag

SEQ ID NO: 2880243 - RNA, 15 nt, Mycobacterium avium subsp. paratuberculosis
ucagcaccacaucgg

SEQ ID NO: 2880244 - RNA, 22 nt, Mycobacterium avium subsp. paratuberculosis
ucagcaccacguugcgcccggc

SEQ ID NO: 2880245 - RNA, 13 nt, Mycobacterium avium subsp. paratuberculosis
ucagcaccaggug

SEQ ID NO: 2880246 - RNA, 15 nt, Mycobacterium avium subsp. paratuberculosis
ucagcaccgacgcgg

SEQ ID NO: 2880247 - RNA, 20 nt, Mycobacterium avium subsp. paratuberculosis
ucagcaccgacgcggcgacc

SEQ ID NO: 2880248 - RNA, 16 nt, Mycobacterium avium subsp. paratuberculosis
ucagcaccgccucggc

SEQ ID NO: 2880249 - RNA, 17 nt, Mycobacterium avium subsp. paratuberculosis
ucagcaccgccucggcc

SEQ ID NO: 2880250 - RNA, 20 nt, Mycobacterium avium subsp. paratuberculosis
ucagcaccgccucggccacc

SEQ ID NO: 2880251 - RNA, 24 nt, Mycobacterium avium subsp. paratuberculosis
ucagcaccgcgaacaucgccagca

SEQ ID NO: 2880252 - RNA, 18 nt, Mycobacterium avium subsp. paratuberculosis
ucagcaccgcgcggcggu

SEQ ID NO: 2880253 - RNA, 16 nt, Mycobacterium avium subsp. paratuberculosis
ucagcaccgcggagga

SEQ ID NO: 2880254 - RNA, 14 nt, Mycobacterium avium subsp. paratuberculosis
ucagcaccggcgug

SEQ ID NO: 2880255 - RNA, 15 nt, Mycobacterium avium subsp. paratuberculosis
ucagcaccgucaccg

SEQ ID NO: 2880256 - RNA, 17 nt, Mycobacterium avium subsp. paratuberculosis
ucagcaccgucaccgcc

SEQ ID NO: 2880257 - RNA, 22 nt, Mycobacterium avium subsp. paratuberculosis
ucagcaccguccacagccggcg

SEQ ID NO: 2880258 - RNA, 17 nt, Mycobacterium avium subsp. paratuberculosis
ucagcaccgugggcccg

SEQ ID NO: 2880259 - RNA, 20 nt, Mycobacterium avium subsp. paratuberculosis
ucagcaccuuccaucgacgc

SEQ ID NO: 2880260 - RNA, 13 nt, Mycobacterium avium subsp. paratuberculosis
ucagcacggccgc

SEQ ID NO: 2880261 - RNA, 17 nt, Mycobacterium avium subsp. paratuberculosis
ucagcacggccgcggcc

SEQ ID NO: 2880262 - RNA, 23 nt, Mycobacterium avium subsp. paratuberculosis
ucagcacgucggucagcgagcgg

SEQ ID NO: 2880263 - RNA, 18 nt, Mycobacterium avium subsp. paratuberculosis
ucagcacuucauggucgu

SEQ ID NO: 2880264 - RNA, 22 nt, Mycobacterium avium subsp. paratuberculosis
ucagcagaugcgcgucgcggcg

SEQ ID NO: 2880265 - RNA, 23 nt, Mycobacterium avium subsp. paratuberculosis
ucagcagaugcgcgucgcggcgc

SEQ ID NO: 2880266 - RNA, 15 nt, Mycobacterium avium subsp. paratuberculosis
ucagcagcacccggg

SEQ ID NO: 2880267 - RNA, 17 nt, Mycobacterium avium subsp. paratuberculosis
ucagcagcacccgggcc

SEQ ID NO: 2880268 - RNA, 18 nt, Mycobacterium avium subsp. paratuberculosis
ucagcagcacccgggccu

SEQ ID NO: 2880269 - RNA, 15 nt, Mycobacterium avium subsp. paratuberculosis
ucagcagcacccggu

SEQ ID NO: 2880270 - RNA, 21 nt, Mycobacterium avium subsp. paratuberculosis
ucagcagcacccggucgccgg

SEQ ID NO: 2880271 - RNA, 14 nt, Mycobacterium avium subsp. paratuberculosis
ucagcagcaccugg

SEQ ID NO: 2880272 - RNA, 14 nt, Mycobacterium avium subsp. paratuberculosis
ucagcagcagcgcc

SEQ ID NO: 2880273 - RNA, 13 nt, Mycobacterium avium subsp. paratuberculosis
ucagcagccggca

SEQ ID NO: 2880274 - RNA, 19 nt, Mycobacterium avium subsp. paratuberculosis
ucagcagccggcagacgaa

SEQ ID NO: 2880275 - RNA, 12 nt, Mycobacterium avium subsp. paratuberculosis
ucagcagcgcga

SEQ ID NO: 2880276 - RNA, 14 nt, Mycobacterium avium subsp. paratuberculosis
ucagcagcgcgacg

SEQ ID NO: 2880277 - RNA, 13 nt, Mycobacterium avium subsp. paratuberculosis
ucagcagcgcggc

SEQ ID NO: 2880278 - RNA, 14 nt, Mycobacterium avium subsp. paratuberculosis
ucagcagcgcggcc

SEQ ID NO: 2880279 - RNA, 21 nt, Mycobacterium avium subsp. paratuberculosis
ucagcagcgucugcgccagcu

SEQ ID NO: 2880280 - RNA, 18 nt, Mycobacterium avium subsp. paratuberculosis
ucagcagcuugaucgccg

SEQ ID NO: 2880281 - RNA, 16 nt, Mycobacterium avium subsp. paratuberculosis
ucagcaggaccaggcc

SEQ ID NO: 2880282 - RNA, 19 nt, Mycobacterium avium subsp. paratuberculosis
ucagcaggcccucggccag

SEQ ID NO: 2880283 - RNA, 20 nt, Mycobacterium avium subsp. paratuberculosis
ucagcaggcccucggccagc

SEQ ID NO: 2880284 - RNA, 15 nt, Mycobacterium avium subsp. paratuberculosis
ucagcaggcgccgca

SEQ ID NO: 2880285 - RNA, 22 nt, Mycobacterium avium subsp. paratuberculosis
ucagcagggcggcaccgaucgg

SEQ ID NO: 2880286 - RNA, 17 nt, Mycobacterium avium subsp. paratuberculosis
ucagcagggugacgucg

SEQ ID NO: 2880287 - RNA, 16 nt, Mycobacterium avium subsp. paratuberculosis
ucagcagguugauccg

SEQ ID NO: 2880288 - RNA, 20 nt, Mycobacterium avium subsp. paratuberculosis
ucagcagugccccguccggc

SEQ ID NO: 2880289 - RNA, 17 nt, Mycobacterium avium subsp. paratuberculosis
ucagcaguuuggucaug

SEQ ID NO: 2880290 - RNA, 21 nt, Mycobacterium avium subsp. paratuberculosis
ucagcauccgcaacgugcgcc

SEQ ID NO: 2880291 - RNA, 20 nt, Mycobacterium avium subsp. paratuberculosis
ucagcaucggguagaucucc

SEQ ID NO: 2880292 - RNA, 16 nt, Mycobacterium avium subsp. paratuberculosis
ucagcaugucgcccgc

SEQ ID NO: 2880293 - RNA, 17 nt, Mycobacterium avium subsp. paratuberculosis
ucagcaugucgcccgcg

SEQ ID NO: 2880294 - RNA, 17 nt, Mycobacterium avium subsp. paratuberculosis
ucagccacaccgccggc

SEQ ID NO: 2880295 - RNA, 20 nt, Mycobacterium avium subsp. paratuberculosis
ucagccacaccgccggcgcg

SEQ ID NO: 2880296 - RNA, 16 nt, Mycobacterium avium subsp. paratuberculosis
ucagccacgccggcac

SEQ ID NO: 2880297 - RNA, 17 nt, Mycobacterium avium subsp. paratuberculosis
ucagccacgccggcaca

SEQ ID NO: 2880298 - RNA, 18 nt, Mycobacterium avium subsp. paratuberculosis
ucagccacgccggcacac

SEQ ID NO: 2880299 - RNA, 20 nt, Mycobacterium avium subsp. paratuberculosis
ucagccacgccggcacaccg

SEQ ID NO: 2880300 - RNA, 16 nt, Mycobacterium avium subsp. paratuberculosis
ucagccacgggcgguc

SEQ ID NO: 2880301 - RNA, 22 nt, Mycobacterium avium subsp. paratuberculosis
ucagccacgggcggucggacgc

SEQ ID NO: 2880302 - RNA, 22 nt, Mycobacterium avium subsp. paratuberculosis
ucagccagaucgaggccagcgc

SEQ ID NO: 2880303 - RNA, 19 nt, Mycobacterium avium subsp. paratuberculosis
ucagccagguguagaccac

SEQ ID NO: 2880304 - RNA, 20 nt, Mycobacterium avium subsp. paratuberculosis
ucagccagguguagaccacg

SEQ ID NO: 2880305 - RNA, 21 nt, Mycobacterium avium subsp. paratuberculosis
ucagccaguugaucagcccga

SEQ ID NO: 2880306 - RNA, 17 nt, Mycobacterium avium subsp. paratuberculosis
ucagcccccaccgcgcc

SEQ ID NO: 2880307 - RNA, 23 nt, Mycobacterium avium subsp. paratuberculosis
ucagccccgaguccacgacgucc

SEQ ID NO: 2880308 - RNA, 19 nt, Mycobacterium avium subsp. paratuberculosis
ucagccccucggggcugcg

SEQ ID NO: 2880309 - RNA, 20 nt, Mycobacterium avium subsp. paratuberculosis
ucagcccgauucagccggcg

SEQ ID NO: 2880310 - RNA, 14 nt, Mycobacterium avium subsp. paratuberculosis
ucagcccgcccacc

SEQ ID NO: 2880311 - RNA, 21 nt, Mycobacterium avium subsp. paratuberculosis
ucagcccgcccuuggccgcgg

SEQ ID NO: 2880312 - RNA, 12 nt, Mycobacterium avium subsp. paratuberculosis
ucagcccgcguc

SEQ ID NO: 2880313 - RNA, 18 nt, Mycobacterium avium subsp. paratuberculosis
ucagcccgcgucgcgcag

SEQ ID NO: 2880314 - RNA, 22 nt, Mycobacterium avium subsp. paratuberculosis
ucagcccggaaaaccccacccc

SEQ ID NO: 2880315 - RNA, 14 nt, Mycobacterium avium subsp. paratuberculosis
ucagcccggcccgc

SEQ ID NO: 2880316 - RNA, 22 nt, Mycobacterium avium subsp. paratuberculosis
ucagcccggcgcucaccgcgau

SEQ ID NO: 2880317 - RNA, 23 nt, Mycobacterium avium subsp. paratuberculosis
ucagcccggcgcucaccgcgaug

SEQ ID NO: 2880318 - RNA, 22 nt, Mycobacterium avium subsp. paratuberculosis
ucagcccggcgcugcgcccggu

SEQ ID NO: 2880319 - RNA, 19 nt, Mycobacterium avium subsp. paratuberculosis
ucagcccggcguccugcag

SEQ ID NO: 2880320 - RNA, 22 nt, Mycobacterium avium subsp. paratuberculosis
ucagcccgggauggaucgaguu

SEQ ID NO: 2880321 - RNA, 14 nt, Mycobacterium avium subsp. paratuberculosis
ucagcccggugacg

SEQ ID NO: 2880322 - RNA, 16 nt, Mycobacterium avium subsp. paratuberculosis
ucagccgaagccggcg

SEQ ID NO: 2880323 - RNA, 17 nt, Mycobacterium avium subsp. paratuberculosis
ucagccgaagccggcgc

SEQ ID NO: 2880324 - RNA, 14 nt, Mycobacterium avium subsp. paratuberculosis
ucagccgagccggg

SEQ ID NO: 2880325 - RNA, 21 nt, Mycobacterium avium subsp. paratuberculosis
ucagccgauacaugugccgau

SEQ ID NO: 2880326 - RNA, 14 nt, Mycobacterium avium subsp. paratuberculosis
ucagccgcaccagg

SEQ ID NO: 2880327 - RNA, 16 nt, Mycobacterium avium subsp. paratuberculosis
ucagccgcccgaucau

SEQ ID NO: 2880328 - RNA, 16 nt, Mycobacterium avium subsp. paratuberculosis
ucagccgccgucgcgc

SEQ ID NO: 2880329 - RNA, 21 nt, Mycobacterium avium subsp. paratuberculosis
ucagccgccgucgcgccagga

SEQ ID NO: 2880330 - RNA, 16 nt, Mycobacterium avium subsp. paratuberculosis
ucagccgcgacagccg

SEQ ID NO: 2880331 - RNA, 22 nt, Mycobacterium avium subsp. paratuberculosis
ucagccgcgacagccgcccggc

SEQ ID NO: 2880332 - RNA, 17 nt, Mycobacterium avium subsp. paratuberculosis
ucagccgcggcggcagc

SEQ ID NO: 2880333 - RNA, 21 nt, Mycobacterium avium subsp. paratuberculosis
ucagccgcggcggcagcaccc

SEQ ID NO: 2880334 - RNA, 22 nt, Mycobacterium avium subsp. paratuberculosis
ucagccgcggcggcagcacccg

SEQ ID NO: 2880335 - RNA, 18 nt, Mycobacterium avium subsp. paratuberculosis
ucagccggcgggcgcucg

SEQ ID NO: 2880336 - RNA, 14 nt, Mycobacterium avium subsp. paratuberculosis
ucagccggcucggu

SEQ ID NO: 2880337 - RNA, 22 nt, Mycobacterium avium subsp. paratuberculosis
ucagccggcucgguaugcggcg

SEQ ID NO: 2880338 - RNA, 15 nt, Mycobacterium avium subsp. paratuberculosis
ucagccgggccagcc

SEQ ID NO: 2880339 - RNA, 15 nt, Mycobacterium avium subsp. paratuberculosis
ucagccgggcggccu

SEQ ID NO: 2880340 - RNA, 18 nt, Mycobacterium avium subsp. paratuberculosis
ucagccggguagcgccgc

SEQ ID NO: 2880341 - RNA, 23 nt, Mycobacterium avium subsp. paratuberculosis
ucagccugccuccacgucaccga

SEQ ID NO: 2880342 - RNA, 22 nt, Mycobacterium avium subsp. paratuberculosis
ucagcgaaggcaugggcgugcc

SEQ ID NO: 2880343 - RNA, 21 nt, Mycobacterium avium subsp. paratuberculosis
ucagcgacgagagcggaucgg

SEQ ID NO: 2880344 - RNA, 16 nt, Mycobacterium avium subsp. paratuberculosis
ucagcgacggcccgcc

SEQ ID NO: 2880345 - RNA, 17 nt, Mycobacterium avium subsp. paratuberculosis
ucagcgacggcccgccg

SEQ ID NO: 2880346 - RNA, 19 nt, Mycobacterium avium subsp. paratuberculosis
ucagcgacggcccgccgga

SEQ ID NO: 2880347 - RNA, 18 nt, Mycobacterium avium subsp. paratuberculosis
ucagcgacgucaggucga

SEQ ID NO: 2880348 - RNA, 23 nt, Mycobacterium avium subsp. paratuberculosis
ucagcgacgucaggucgaccggc

SEQ ID NO: 2880349 - RNA, 18 nt, Mycobacterium avium subsp. paratuberculosis
ucagcgacuugccgccgg

SEQ ID NO: 2880350 - RNA, 20 nt, Mycobacterium avium subsp. paratuberculosis
ucagcgacuugccgccggcg

SEQ ID NO: 2880351 - RNA, 21 nt, Mycobacterium avium subsp. paratuberculosis
ucagcgagcgguuggcgacgc

SEQ ID NO: 2880352 - RNA, 12 nt, Mycobacterium avium subsp. paratuberculosis
ucagcgaggcgu

SEQ ID NO: 2880353 - RNA, 23 nt, Mycobacterium avium subsp. paratuberculosis
ucagcgaggcguagcugcaggcg

SEQ ID NO: 2880354 - RNA, 22 nt, Mycobacterium avium subsp. paratuberculosis
ucagcgauugcggccgccggcc

SEQ ID NO: 2880355 - RNA, 23 nt, Mycobacterium avium subsp. paratuberculosis
ucagcgcauccucauagccggcc

SEQ ID NO: 2880356 - RNA, 20 nt, Mycobacterium avium subsp. paratuberculosis
ucagcgccaccagcaccggg

SEQ ID NO: 2880357 - RNA, 22 nt, Mycobacterium avium subsp. paratuberculosis
ucagcgccagcaacacccagcc

SEQ ID NO: 2880358 - RNA, 13 nt, Mycobacterium avium subsp. paratuberculosis
ucagcgcccagga

SEQ ID NO: 2880359 - RNA, 16 nt, Mycobacterium avium subsp. paratuberculosis
ucagcgcccaggauga

SEQ ID NO: 2880360 - RNA, 21 nt, Mycobacterium avium subsp. paratuberculosis
ucagcgcccaggaugacgccg

SEQ ID NO: 2880361 - RNA, 22 nt, Mycobacterium avium subsp. paratuberculosis
ucagcgcccaggaugacgccga

SEQ ID NO: 2880362 - RNA, 18 nt, Mycobacterium avium subsp. paratuberculosis
ucagcgcccgcccggccc

SEQ ID NO: 2880363 - RNA, 22 nt, Mycobacterium avium subsp. paratuberculosis
ucagcgcccgcccggcccggcg

SEQ ID NO: 2880364 - RNA, 14 nt, Mycobacterium avium subsp. paratuberculosis
ucagcgccgcccgc

SEQ ID NO: 2880365 - RNA, 21 nt, Mycobacterium avium subsp. paratuberculosis
ucagcgccgucuccucgacca

SEQ ID NO: 2880366 - RNA, 13 nt, Mycobacterium avium subsp. paratuberculosis
ucagcgcgacauc

SEQ ID NO: 2880367 - RNA, 18 nt, Mycobacterium avium subsp. paratuberculosis
ucagcgcgacaucgccgg

SEQ ID NO: 2880368 - RNA, 12 nt, Mycobacterium avium subsp. paratuberculosis
ucagcgcgaccu

SEQ ID NO: 2880369 - RNA, 17 nt, Mycobacterium avium subsp. paratuberculosis
ucagcgcgaccucggug

SEQ ID NO: 2880370 - RNA, 20 nt, Mycobacterium avium subsp. paratuberculosis
ucagcgcgaccucgguggug

SEQ ID NO: 2880371 - RNA, 19 nt, Mycobacterium avium subsp. paratuberculosis
ucagcgcgacgugccggcg

SEQ ID NO: 2880372 - RNA, 23 nt, Mycobacterium avium subsp. paratuberculosis
ucagcgcgacgugccggcgaugg

SEQ ID NO: 2880373 - RNA, 15 nt, Mycobacterium avium subsp. paratuberculosis
ucagcgcgcacagcg

SEQ ID NO: 2880374 - RNA, 16 nt, Mycobacterium avium subsp. paratuberculosis
ucagcgcgcacagcgc

SEQ ID NO: 2880375 - RNA, 13 nt, Mycobacterium avium subsp. paratuberculosis
ucagcgcgccgcc

SEQ ID NO: 2880376 - RNA, 23 nt, Mycobacterium avium subsp. paratuberculosis
ucagcgcggccacaccgaucagc

SEQ ID NO: 2880377 - RNA, 22 nt, Mycobacterium avium subsp. paratuberculosis
ucagcgcggccaccuccagccc

SEQ ID NO: 2880378 - RNA, 23 nt, Mycobacterium avium subsp. paratuberculosis
ucagcgcggccaccuccagcccg

SEQ ID NO: 2880379 - RNA, 21 nt, Mycobacterium avium subsp. paratuberculosis
ucagcgcggcccgcggcguca

SEQ ID NO: 2880380 - RNA, 17 nt, Mycobacterium avium subsp. paratuberculosis
ucagcgcggcgggccag

SEQ ID NO: 2880381 - RNA, 15 nt, Mycobacterium avium subsp. paratuberculosis
ucagcgcgggccagc

SEQ ID NO: 2880382 - RNA, 16 nt, Mycobacterium avium subsp. paratuberculosis
ucagcgcgggccagca

SEQ ID NO: 2880383 - RNA, 19 nt, Mycobacterium avium subsp. paratuberculosis
ucagcgcggucagcccgcc

SEQ ID NO: 2880384 - RNA, 21 nt, Mycobacterium avium subsp. paratuberculosis
ucagcgcguccaaccgcggac

SEQ ID NO: 2880385 - RNA, 12 nt, Mycobacterium avium subsp. paratuberculosis
ucagcgcgucgg

SEQ ID NO: 2880386 - RNA, 16 nt, Mycobacterium avium subsp. paratuberculosis
ucagcgcgucggcgac

SEQ ID NO: 2880387 - RNA, 21 nt, Mycobacterium avium subsp. paratuberculosis
ucagcgcgugaccccggcgac

SEQ ID NO: 2880388 - RNA, 17 nt, Mycobacterium avium subsp. paratuberculosis
ucagcgcuccuggccgg

SEQ ID NO: 2880389 - RNA, 15 nt, Mycobacterium avium subsp. paratuberculosis
ucagcgcuuccagcg

SEQ ID NO: 2880390 - RNA, 19 nt, Mycobacterium avium subsp. paratuberculosis
ucagcgcuuccagcgcggc

SEQ ID NO: 2880391 - RNA, 20 nt, Mycobacterium avium subsp. paratuberculosis
ucagcgcuuccagcgcggcg

SEQ ID NO: 2880392 - RNA, 22 nt, Mycobacterium avium subsp. paratuberculosis
ucagcgcuuccagcgcggcgau

SEQ ID NO: 2880393 - RNA, 19 nt, Mycobacterium avium subsp. paratuberculosis
ucagcggaaccgacaccuc

SEQ ID NO: 2880394 - RNA, 22 nt, Mycobacterium avium subsp. paratuberculosis
ucagcggagugaccgccagcac

SEQ ID NO: 2880395 - RNA, 23 nt, Mycobacterium avium subsp. paratuberculosis
ucagcggagugaccgccagcacc

SEQ ID NO: 2880396 - RNA, 17 nt, Mycobacterium avium subsp. paratuberculosis
ucagcggauagaggcgg

SEQ ID NO: 2880397 - RNA, 19 nt, Mycobacterium avium subsp. paratuberculosis
ucagcggauagaggcggcg

SEQ ID NO: 2880398 - RNA, 20 nt, Mycobacterium avium subsp. paratuberculosis
ucagcggauagaggcggcgc

SEQ ID NO: 2880399 - RNA, 20 nt, Mycobacterium avium subsp. paratuberculosis
ucagcggcaacacgccggcg

SEQ ID NO: 2880400 - RNA, 16 nt, Mycobacterium avium subsp. paratuberculosis
ucagcggcaccgucac

SEQ ID NO: 2880401 - RNA, 10 nt, Mycobacterium avium subsp. paratuberculosis
ucagcggcag

SEQ ID NO: 2880402 - RNA, 23 nt, Mycobacterium avium subsp. paratuberculosis
ucagcggcagcgucgccagccgc

SEQ ID NO: 2880403 - RNA, 15 nt, Mycobacterium avium subsp. paratuberculosis
ucagcggcaggugcg

SEQ ID NO: 2880404 - RNA, 22 nt, Mycobacterium avium subsp. paratuberculosis
ucagcggcaucgaggaccggcg

SEQ ID NO: 2880405 - RNA, 15 nt, Mycobacterium avium subsp. paratuberculosis
ucagcggccagccca

SEQ ID NO: 2880406 - RNA, 23 nt, Mycobacterium avium subsp. paratuberculosis
ucagcggccaucgccgccaucgc

SEQ ID NO: 2880407 - RNA, 19 nt, Mycobacterium avium subsp. paratuberculosis
ucagcggcccgaucaccag

SEQ ID NO: 2880408 - RNA, 21 nt, Mycobacterium avium subsp. paratuberculosis
ucagcggcccgaucaccaggc

SEQ ID NO: 2880409 - RNA, 19 nt, Mycobacterium avium subsp. paratuberculosis
ucagcggccucggaagggc

SEQ ID NO: 2880410 - RNA, 15 nt, Mycobacterium avium subsp. paratuberculosis
ucagcggcgccaccg

SEQ ID NO: 2880411 - RNA, 12 nt, Mycobacterium avium subsp. paratuberculosis
ucagcggcgggc

SEQ ID NO: 2880412 - RNA, 21 nt, Mycobacterium avium subsp. paratuberculosis
ucagcggcgucaggaugguga

SEQ ID NO: 2880413 - RNA, 12 nt, Mycobacterium avium subsp. paratuberculosis
ucagcggcgugc

SEQ ID NO: 2880414 - RNA, 13 nt, Mycobacterium avium subsp. paratuberculosis
ucagcgggcgcag

SEQ ID NO: 2880415 - RNA, 15 nt, Mycobacterium avium subsp. paratuberculosis
ucagcgggcgcagcu

SEQ ID NO: 2880416 - RNA, 16 nt, Mycobacterium avium subsp. paratuberculosis
ucagcgggcggccagc

SEQ ID NO: 2880417 - RNA, 19 nt, Mycobacterium avium subsp. paratuberculosis
ucagcgggcggccagccgc

SEQ ID NO: 2880418 - RNA, 18 nt, Mycobacterium avium subsp. paratuberculosis
ucagcgggcuguccgcgu

SEQ ID NO: 2880419 - RNA, 18 nt, Mycobacterium avium subsp. paratuberculosis
ucagcgucagcaccgcga

SEQ ID NO: 2880420 - RNA, 13 nt, Mycobacterium avium subsp. paratuberculosis
ucagcguccacga

SEQ ID NO: 2880421 - RNA, 18 nt, Mycobacterium avium subsp. paratuberculosis
ucagcguccaguccggcg

SEQ ID NO: 2880422 - RNA, 20 nt, Mycobacterium avium subsp. paratuberculosis
ucagcgucgccaauccggcg

SEQ ID NO: 2880423 - RNA, 18 nt, Mycobacterium avium subsp. paratuberculosis
ucagcgucucgccgggga

SEQ ID NO: 2880424 - RNA, 20 nt, Mycobacterium avium subsp. paratuberculosis
ucagcgucucgccggggaac

SEQ ID NO: 2880425 - RNA, 15 nt, Mycobacterium avium subsp. paratuberculosis
ucagcgucucggcga

SEQ ID NO: 2880426 - RNA, 19 nt, Mycobacterium avium subsp. paratuberculosis
ucagcgucucggcgaucag

SEQ ID NO: 2880427 - RNA, 15 nt, Mycobacterium avium subsp. paratuberculosis
ucagcguggcgucgg

SEQ ID NO: 2880428 - RNA, 20 nt, Mycobacterium avium subsp. paratuberculosis
ucagcguggcgucggcgcgc

SEQ ID NO: 2880429 - RNA, 22 nt, Mycobacterium avium subsp. paratuberculosis
ucagcguggcgucggcgcgcac

SEQ ID NO: 2880430 - RNA, 14 nt, Mycobacterium avium subsp. paratuberculosis
ucagcguggucagc

SEQ ID NO: 2880431 - RNA, 17 nt, Mycobacterium avium subsp. paratuberculosis
ucagcguguuggacgcc

SEQ ID NO: 2880432 - RNA, 18 nt, Mycobacterium avium subsp. paratuberculosis
ucagcguguuggacgccc

SEQ ID NO: 2880433 - RNA, 21 nt, Mycobacterium avium subsp. paratuberculosis
ucagcguguuggacgcccgcu

SEQ ID NO: 2880434 - RNA, 23 nt, Mycobacterium avium subsp. paratuberculosis
ucagcguguuggacgcccgcucg

SEQ ID NO: 2880435 - RNA, 15 nt, Mycobacterium avium subsp. paratuberculosis
ucagcguucacgucg

SEQ ID NO: 2880436 - RNA, 19 nt, Mycobacterium avium subsp. paratuberculosis
ucagcguucacgucgauca

SEQ ID NO: 2880437 - RNA, 20 nt, Mycobacterium avium subsp. paratuberculosis
ucagcguuccggcggccggc

SEQ ID NO: 2880438 - RNA, 15 nt, Mycobacterium avium subsp. paratuberculosis
ucagcuccaccugcg

SEQ ID NO: 2880439 - RNA, 21 nt, Mycobacterium avium subsp. paratuberculosis
ucagcucccccgacaccgcca

SEQ ID NO: 2880440 - RNA, 22 nt, Mycobacterium avium subsp. paratuberculosis
ucagcucgaaaagcuucuugcu

SEQ ID NO: 2880441 - RNA, 19 nt, Mycobacterium avium subsp. paratuberculosis
ucagcucgaaggugcccgc

SEQ ID NO: 2880442 - RNA, 16 nt, Mycobacterium avium subsp. paratuberculosis
ucagcucgaucgccgc

SEQ ID NO: 2880443 - RNA, 16 nt, Mycobacterium avium subsp. paratuberculosis
ucagcucgauggugcc

SEQ ID NO: 2880444 - RNA, 15 nt, Mycobacterium avium subsp. paratuberculosis
ucagcucgccguccg

SEQ ID NO: 2880445 - RNA, 12 nt, Mycobacterium avium subsp. paratuberculosis
ucagcucggcgg

SEQ ID NO: 2880446 - RNA, 15 nt, Mycobacterium avium subsp. paratuberculosis
ucagcucggcggccu

SEQ ID NO: 2880447 - RNA, 15 nt, Mycobacterium avium subsp. paratuberculosis
ucagcucguggcggg

SEQ ID NO: 2880448 - RNA, 23 nt, Mycobacterium avium subsp. paratuberculosis
ucagcucuucgacgauguuggcg

SEQ ID NO: 2880449 - RNA, 21 nt, Mycobacterium avium subsp. paratuberculosis
ucagcucuucgauggccaucg

SEQ ID NO: 2880450 - RNA, 23 nt, Mycobacterium avium subsp. paratuberculosis
ucagcugaacggugcccgccgau

SEQ ID NO: 2880451 - RNA, 14 nt, Mycobacterium avium subsp. paratuberculosis
ucagcugcagccgg

SEQ ID NO: 2880452 - RNA, 17 nt, Mycobacterium avium subsp. paratuberculosis
ucagcugcagccggccg

SEQ ID NO: 2880453 - RNA, 19 nt, Mycobacterium avium subsp. paratuberculosis
ucagcugcagccggccggc

SEQ ID NO: 2880454 - RNA, 15 nt, Mycobacterium avium subsp. paratuberculosis
ucagcugcccggagu

SEQ ID NO: 2880455 - RNA, 14 nt, Mycobacterium avium subsp. paratuberculosis
ucagcugccguccg

SEQ ID NO: 2880456 - RNA, 14 nt, Mycobacterium avium subsp. paratuberculosis
ucagcugcucggcc

SEQ ID NO: 2880457 - RNA, 18 nt, Mycobacterium avium subsp. paratuberculosis
ucagcugcugcgcggcgg

SEQ ID NO: 2880458 - RNA, 14 nt, Mycobacterium avium subsp. paratuberculosis
ucagcuggugcaga

SEQ ID NO: 2880459 - RNA, 22 nt, Mycobacterium avium subsp. paratuberculosis
ucagcuucaugcccuuggcccg

SEQ ID NO: 2880460 - RNA, 17 nt, Mycobacterium avium subsp. paratuberculosis
ucagcuuggagccgagc

SEQ ID NO: 2880461 - RNA, 18 nt, Mycobacterium avium subsp. paratuberculosis
ucaggaacaccgagccgg

SEQ ID NO: 2880462 - RNA, 12 nt, Mycobacterium avium subsp. paratuberculosis
ucaggaacccga

SEQ ID NO: 2880463 - RNA, 13 nt, Mycobacterium avium subsp. paratuberculosis
ucaggaacccggc

SEQ ID NO: 2880464 - RNA, 20 nt, Mycobacterium avium subsp. paratuberculosis
ucaggaacccggcccggaac

SEQ ID NO: 2880465 - RNA, 23 nt, Mycobacterium avium subsp. paratuberculosis
ucaggaccucgaagcagccuucu

SEQ ID NO: 2880466 - RNA, 20 nt, Mycobacterium avium subsp. paratuberculosis
ucaggaucgacgucgacuga

SEQ ID NO: 2880467 - RNA, 19 nt, Mycobacterium avium subsp. paratuberculosis
ucaggaucgacuccgggug

SEQ ID NO: 2880468 - RNA, 21 nt, Mycobacterium avium subsp. paratuberculosis
ucaggaucgacuccgggugga

SEQ ID NO: 2880469 - RNA, 15 nt, Mycobacterium avium subsp. paratuberculosis
ucaggaugacgccgc

SEQ ID NO: 2880470 - RNA, 18 nt, Mycobacterium avium subsp. paratuberculosis
ucaggaugcccgggccgu

SEQ ID NO: 2880471 - RNA, 12 nt, Mycobacterium avium subsp. paratuberculosis
ucaggcccagcg

SEQ ID NO: 2880472 - RNA, 16 nt, Mycobacterium avium subsp. paratuberculosis
ucaggcccagcgaggc

SEQ ID NO: 2880473 - RNA, 18 nt, Mycobacterium avium subsp. paratuberculosis
ucaggcccagcgaggcgg

SEQ ID NO: 2880474 - RNA, 15 nt, Mycobacterium avium subsp. paratuberculosis
ucaggcccaggcgac

SEQ ID NO: 2880475 - RNA, 20 nt, Mycobacterium avium subsp. paratuberculosis
ucaggccccacccgcagugc

SEQ ID NO: 2880476 - RNA, 18 nt, Mycobacterium avium subsp. paratuberculosis
ucaggcccucaucgucga

SEQ ID NO: 2880477 - RNA, 20 nt, Mycobacterium avium subsp. paratuberculosis
ucaggcccuugccccaccac

SEQ ID NO: 2880478 - RNA, 15 nt, Mycobacterium avium subsp. paratuberculosis
ucaggccggccacca

SEQ ID NO: 2880479 - RNA, 19 nt, Mycobacterium avium subsp. paratuberculosis
ucaggccggccugccaccg

SEQ ID NO: 2880480 - RNA, 14 nt, Mycobacterium avium subsp. paratuberculosis
ucaggccggcgccg

SEQ ID NO: 2880481 - RNA, 14 nt, Mycobacterium avium subsp. paratuberculosis
ucaggccguagcgg

SEQ ID NO: 2880482 - RNA, 17 nt, Mycobacterium avium subsp. paratuberculosis
ucaggccguagcggcuc

SEQ ID NO: 2880483 - RNA, 21 nt, Mycobacterium avium subsp. paratuberculosis
ucaggccgucucgagccggcg

SEQ ID NO: 2880484 - RNA, 22 nt, Mycobacterium avium subsp. paratuberculosis
ucaggccgucucgagccggcgc

SEQ ID NO: 2880485 - RNA, 19 nt, Mycobacterium avium subsp. paratuberculosis
ucaggccgugaucggccag

SEQ ID NO: 2880486 - RNA, 23 nt, Mycobacterium avium subsp. paratuberculosis
ucaggccgugcacgaacagggug

SEQ ID NO: 2880487 - RNA, 17 nt, Mycobacterium avium subsp. paratuberculosis
ucaggcgagcacccgga

SEQ ID NO: 2880488 - RNA, 12 nt, Mycobacterium avium subsp. paratuberculosis
ucaggcgcagcc

SEQ ID NO: 2880489 - RNA, 17 nt, Mycobacterium avium subsp. paratuberculosis
ucaggcgcagccagcgg

SEQ ID NO: 2880490 - RNA, 19 nt, Mycobacterium avium subsp. paratuberculosis
ucaggcgcagccagcgguc

SEQ ID NO: 2880491 - RNA, 15 nt, Mycobacterium avium subsp. paratuberculosis
ucaggcgcagcccga

SEQ ID NO: 2880492 - RNA, 19 nt, Mycobacterium avium subsp. paratuberculosis
ucaggcgcagcccgagcgg

SEQ ID NO: 2880493 - RNA, 15 nt, Mycobacterium avium subsp. paratuberculosis
ucaggcgcugggugc

SEQ ID NO: 2880494 - RNA, 12 nt, Mycobacterium avium subsp. paratuberculosis
ucaggcggucga

SEQ ID NO: 2880495 - RNA, 19 nt, Mycobacterium avium subsp. paratuberculosis
ucaggcggucgaacgcggc

SEQ ID NO: 2880496 - RNA, 23 nt, Mycobacterium avium subsp. paratuberculosis
ucaggcggucgaacgcggcgccg

SEQ ID NO: 2880497 - RNA, 19 nt, Mycobacterium avium subsp. paratuberculosis
ucaggcguccgcaagcacc

SEQ ID NO: 2880498 - RNA, 18 nt, Mycobacterium avium subsp. paratuberculosis
ucagggagcugcccgcac

SEQ ID NO: 2880499 - RNA, 21 nt, Mycobacterium avium subsp. paratuberculosis
ucagggagcugcccgcacugg

SEQ ID NO: 2880500 - RNA, 17 nt, Mycobacterium avium subsp. paratuberculosis
ucagggcccacagcagc

SEQ ID NO: 2880501 - RNA, 20 nt, Mycobacterium avium subsp. paratuberculosis
ucagggcgacuccggcgccg

SEQ ID NO: 2880502 - RNA, 15 nt, Mycobacterium avium subsp. paratuberculosis
ucagggcgcucauca

SEQ ID NO: 2880503 - RNA, 16 nt, Mycobacterium avium subsp. paratuberculosis
ucagggcggugcggug

SEQ ID NO: 2880504 - RNA, 18 nt, Mycobacterium avium subsp. paratuberculosis
ucagggcggugcggugcg

SEQ ID NO: 2880505 - RNA, 23 nt, Mycobacterium avium subsp. paratuberculosis
ucagggcggugcggugcgccgca

SEQ ID NO: 2880506 - RNA, 23 nt, Mycobacterium avium subsp. paratuberculosis
ucagggcucgcaaccgucuuggc

SEQ ID NO: 2880507 - RNA, 16 nt, Mycobacterium avium subsp. paratuberculosis
ucaggggugccagccg

SEQ ID NO: 2880508 - RNA, 20 nt, Mycobacterium avium subsp. paratuberculosis
ucaggggugccagccgugcg

SEQ ID NO: 2880509 - RNA, 17 nt, Mycobacterium avium subsp. paratuberculosis
ucaggggugggcgacga

SEQ ID NO: 2880510 - RNA, 21 nt, Mycobacterium avium subsp. paratuberculosis
ucagggugcaggcccgggcgg

SEQ ID NO: 2880511 - RNA, 19 nt, Mycobacterium avium subsp. paratuberculosis
ucagggugcucagccgcac

SEQ ID NO: 2880512 - RNA, 23 nt, Mycobacterium avium subsp. paratuberculosis
ucaggguggugcccccgcccggc

SEQ ID NO: 2880513 - RNA, 21 nt, Mycobacterium avium subsp. paratuberculosis
ucagggugucgaacagcaggc

SEQ ID NO: 2880514 - RNA, 18 nt, Mycobacterium avium subsp. paratuberculosis
ucagggugugacggaucc

SEQ ID NO: 2880515 - RNA, 20 nt, Mycobacterium avium subsp. paratuberculosis
ucaggguguuguccgagccg

SEQ ID NO: 2880516 - RNA, 22 nt, Mycobacterium avium subsp. paratuberculosis
ucagguaccgguuccgggcgac

SEQ ID NO: 2880517 - RNA, 14 nt, Mycobacterium avium subsp. paratuberculosis
ucagguaggcgucg

SEQ ID NO: 2880518 - RNA, 12 nt, Mycobacterium avium subsp. paratuberculosis
ucagguagugca

SEQ ID NO: 2880519 - RNA, 14 nt, Mycobacterium avium subsp. paratuberculosis
ucagguaucucuga

SEQ ID NO: 2880520 - RNA, 14 nt, Mycobacterium avium subsp. paratuberculosis
ucaggucaccgagc

SEQ ID NO: 2880521 - RNA, 18 nt, Mycobacterium avium subsp. paratuberculosis
ucaggucaguucagguug

SEQ ID NO: 2880522 - RNA, 21 nt, Mycobacterium avium subsp. paratuberculosis
ucagguccuugcgcgccgcga

SEQ ID NO: 2880523 - RNA, 22 nt, Mycobacterium avium subsp. paratuberculosis
ucagguccuugcgcgccgcgac

SEQ ID NO: 2880524 - RNA, 13 nt, Mycobacterium avium subsp. paratuberculosis
ucaggucgaagcc

SEQ ID NO: 2880525 - RNA, 18 nt, Mycobacterium avium subsp. paratuberculosis
ucaggucgaagcccgccg

SEQ ID NO: 2880526 - RNA, 18 nt, Mycobacterium avium subsp. paratuberculosis
ucaggucgaucagcgguc

SEQ ID NO: 2880527 - RNA, 22 nt, Mycobacterium avium subsp. paratuberculosis
ucaggucgauggucugcccgcc

SEQ ID NO: 2880528 - RNA, 23 nt, Mycobacterium avium subsp. paratuberculosis
ucaggucgccgauccagccgucg

SEQ ID NO: 2880529 - RNA, 17 nt, Mycobacterium avium subsp. paratuberculosis
ucaggucgcugcgcucg

SEQ ID NO: 2880530 - RNA, 23 nt, Mycobacterium avium subsp. paratuberculosis
ucaggucgcugcgcucgccgucg

SEQ ID NO: 2880531 - RNA, 15 nt, Mycobacterium avium subsp. paratuberculosis
ucaggucggccgcgg

SEQ ID NO: 2880532 - RNA, 16 nt, Mycobacterium avium subsp. paratuberculosis
ucaggucggccgcggc

SEQ ID NO: 2880533 - RNA, 13 nt, Mycobacterium avium subsp. paratuberculosis
ucaggucggcgau

SEQ ID NO: 2880534 - RNA, 18 nt, Mycobacterium avium subsp. paratuberculosis
ucaggucggugccgcggc

SEQ ID NO: 2880535 - RNA, 24 nt, Mycobacterium avium subsp. paratuberculosis
ucaggucuccguugucgaggucgg

SEQ ID NO: 2880536 - RNA, 16 nt, Mycobacterium avium subsp. paratuberculosis
ucaggugcgacgccca

SEQ ID NO: 2880537 - RNA, 19 nt, Mycobacterium avium subsp. paratuberculosis
ucagguggcgucggcgucg

SEQ ID NO: 2880538 - RNA, 23 nt, Mycobacterium avium subsp. paratuberculosis
ucagguggggcaggaacgccuug

SEQ ID NO: 2880539 - RNA, 16 nt, Mycobacterium avium subsp. paratuberculosis
ucagguucgccacgau

SEQ ID NO: 2880540 - RNA, 15 nt, Mycobacterium avium subsp. paratuberculosis
ucagguugacgccga

SEQ ID NO: 2880541 - RNA, 15 nt, Mycobacterium avium subsp. paratuberculosis
ucagguugcgcagca

SEQ ID NO: 2880542 - RNA, 17 nt, Mycobacterium avium subsp. paratuberculosis
ucaguaccggcgaugcc

SEQ ID NO: 2880543 - RNA, 24 nt, Mycobacterium avium subsp. paratuberculosis
ucaguaccggcgaugccagcgcac

SEQ ID NO: 2880544 - RNA, 14 nt, Mycobacterium avium subsp. paratuberculosis
ucaguccagcuccc

SEQ ID NO: 2880545 - RNA, 20 nt, Mycobacterium avium subsp. paratuberculosis
ucaguccgacgcgacggucg

SEQ ID NO: 2880546 - RNA, 14 nt, Mycobacterium avium subsp. paratuberculosis
ucaguccgccccga

SEQ ID NO: 2880547 - RNA, 21 nt, Mycobacterium avium subsp. paratuberculosis
ucagucgaagaugucgcggcg

SEQ ID NO: 2880548 - RNA, 23 nt, Mycobacterium avium subsp. paratuberculosis
ucagucgaagaugucgcggcgca

SEQ ID NO: 2880549 - RNA, 20 nt, Mycobacterium avium subsp. paratuberculosis
ucagucgaucuugcgccaga

SEQ ID NO: 2880550 - RNA, 21 nt, Mycobacterium avium subsp. paratuberculosis
ucagucgaucuugcgccagau

SEQ ID NO: 2880551 - RNA, 14 nt, Mycobacterium avium subsp. paratuberculosis
ucagucgcgccgcc

SEQ ID NO: 2880552 - RNA, 16 nt, Mycobacterium avium subsp. paratuberculosis
ucagugaccagugcag

SEQ ID NO: 2880553 - RNA, 19 nt, Mycobacterium avium subsp. paratuberculosis
ucagugaccagugcagagc

SEQ ID NO: 2880554 - RNA, 20 nt, Mycobacterium avium subsp. paratuberculosis
ucagugaccagugcagagcg

SEQ ID NO: 2880555 - RNA, 21 nt, Mycobacterium avium subsp. paratuberculosis
ucagugaccgcacgaucaggg

SEQ ID NO: 2880556 - RNA, 15 nt, Mycobacterium avium subsp. paratuberculosis
ucagugcacgcucgg

SEQ ID NO: 2880557 - RNA, 16 nt, Mycobacterium avium subsp. paratuberculosis
ucagugcacgcucggc

SEQ ID NO: 2880558 - RNA, 21 nt, Mycobacterium avium subsp. paratuberculosis
ucagugccgcgccaacgaggc

SEQ ID NO: 2880559 - RNA, 15 nt, Mycobacterium avium subsp. paratuberculosis
ucagugcgagaaaau

SEQ ID NO: 2880560 - RNA, 15 nt, Mycobacterium avium subsp. paratuberculosis
ucagugcgggcaucg

SEQ ID NO: 2880561 - RNA, 16 nt, Mycobacterium avium subsp. paratuberculosis
ucagugcgggcaucgg

SEQ ID NO: 2880562 - RNA, 20 nt, Mycobacterium avium subsp. paratuberculosis
ucaguuccuugauccggccg

SEQ ID NO: 2880563 - RNA, 15 nt, Mycobacterium avium subsp. paratuberculosis
ucaguucgcggcgca

SEQ ID NO: 2880564 - RNA, 16 nt, Mycobacterium avium subsp. paratuberculosis
ucaguucgcggcgcac

SEQ ID NO: 2880565 - RNA, 20 nt, Mycobacterium avium subsp. paratuberculosis
ucaguuggucgaugucggug

SEQ ID NO: 2880566 - RNA, 15 nt, Mycobacterium avium subsp. paratuberculosis
ucauaccagugcccg

SEQ ID NO: 2880567 - RNA, 20 nt, Mycobacterium avium subsp. paratuberculosis
ucauaccagugcccgagcac

SEQ ID NO: 2880568 - RNA, 13 nt, Mycobacterium avium subsp. paratuberculosis
ucauaggccgcgc

SEQ ID NO: 2880569 - RNA, 21 nt, Mycobacterium avium subsp. paratuberculosis
ucauauugguucgcucgucuu

SEQ ID NO: 2880570 - RNA, 16 nt, Mycobacterium avium subsp. paratuberculosis
ucaucaccaccgccgc

SEQ ID NO: 2880571 - RNA, 14 nt, Mycobacterium avium subsp. paratuberculosis
ucaucaccggcgcg

SEQ ID NO: 2880572 - RNA, 16 nt, Mycobacterium avium subsp. paratuberculosis
ucaucaccggcgcgcc

SEQ ID NO: 2880573 - RNA, 18 nt, Mycobacterium avium subsp. paratuberculosis
ucaucacgugcuggcgcu

SEQ ID NO: 2880574 - RNA, 16 nt, Mycobacterium avium subsp. paratuberculosis
ucauccacucggccac

SEQ ID NO: 2880575 - RNA, 20 nt, Mycobacterium avium subsp. paratuberculosis
ucauccacucggccaccaug

SEQ ID NO: 2880576 - RNA, 12 nt, Mycobacterium avium subsp. paratuberculosis
ucauccagguga

SEQ ID NO: 2880577 - RNA, 17 nt, Mycobacterium avium subsp. paratuberculosis
ucauccaggugaacagc

SEQ ID NO: 2880578 - RNA, 18 nt, Mycobacterium avium subsp. paratuberculosis
ucauccaggugaacagca

SEQ ID NO: 2880579 - RNA, 19 nt, Mycobacterium avium subsp. paratuberculosis
ucauccaggugaacagcag

SEQ ID NO: 2880580 - RNA, 20 nt, Mycobacterium avium subsp. paratuberculosis
ucauccccaucucgagcagg

SEQ ID NO: 2880581 - RNA, 21 nt, Mycobacterium avium subsp. paratuberculosis
ucaucccccgcagcuucugca

SEQ ID NO: 2880582 - RNA, 19 nt, Mycobacterium avium subsp. paratuberculosis
ucauccccgcggccacccc

SEQ ID NO: 2880583 - RNA, 13 nt, Mycobacterium avium subsp. paratuberculosis
ucaucccggccac

SEQ ID NO: 2880584 - RNA, 23 nt, Mycobacterium avium subsp. paratuberculosis
ucaucccggccaccccgcagaac

SEQ ID NO: 2880585 - RNA, 16 nt, Mycobacterium avium subsp. paratuberculosis
ucaucccuagcgugcc

SEQ ID NO: 2880586 - RNA, 21 nt, Mycobacterium avium subsp. paratuberculosis
ucauccggcugcccugggagg

SEQ ID NO: 2880587 - RNA, 16 nt, Mycobacterium avium subsp. paratuberculosis
ucauccgucgcccgcg

SEQ ID NO: 2880588 - RNA, 15 nt, Mycobacterium avium subsp. paratuberculosis
ucauccucgccgcgc

SEQ ID NO: 2880589 - RNA, 23 nt, Mycobacterium avium subsp. paratuberculosis
ucaucgacaccgaacccaccagc

SEQ ID NO: 2880590 - RNA, 12 nt, Mycobacterium avium subsp. paratuberculosis
ucaucgacgucg

SEQ ID NO: 2880591 - RNA, 20 nt, Mycobacterium avium subsp. paratuberculosis
ucaucgacucgaagaaccgc

SEQ ID NO: 2880592 - RNA, 23 nt, Mycobacterium avium subsp. paratuberculosis
ucaucgagcaguagacgccgccg

SEQ ID NO: 2880593 - RNA, 19 nt, Mycobacterium avium subsp. paratuberculosis
ucaucgagccgagcaccgg

SEQ ID NO: 2880594 - RNA, 22 nt, Mycobacterium avium subsp. paratuberculosis
ucaucgaggucgaaccacgcgg

SEQ ID NO: 2880595 - RNA, 22 nt, Mycobacterium avium subsp. paratuberculosis
ucaucgaucggguggcccaauc

SEQ ID NO: 2880596 - RNA, 17 nt, Mycobacterium avium subsp. paratuberculosis
ucaucgcgcuggggugc

SEQ ID NO: 2880597 - RNA, 17 nt, Mycobacterium avium subsp. paratuberculosis
ucaucggcggaagcuca

SEQ ID NO: 2880598 - RNA, 20 nt, Mycobacterium avium subsp. paratuberculosis
ucaucgggcccgacgacgau

SEQ ID NO: 2880599 - RNA, 17 nt, Mycobacterium avium subsp. paratuberculosis
ucaucgguuugaccacg

SEQ ID NO: 2880600 - RNA, 19 nt, Mycobacterium avium subsp. paratuberculosis
ucaucgguuugaccacggc

SEQ ID NO: 2880601 - RNA, 20 nt, Mycobacterium avium subsp. paratuberculosis
ucaucguccacaccgggaag

SEQ ID NO: 2880602 - RNA, 14 nt, Mycobacterium avium subsp. paratuberculosis
ucaucgucgacccg

SEQ ID NO: 2880603 - RNA, 23 nt, Mycobacterium avium subsp. paratuberculosis
ucaucgugacgcgaagucgccgc

SEQ ID NO: 2880604 - RNA, 16 nt, Mycobacterium avium subsp. paratuberculosis
ucaucguggacaggag

SEQ ID NO: 2880605 - RNA, 12 nt, Mycobacterium avium subsp. paratuberculosis
ucaucguggcgc

SEQ ID NO: 2880606 - RNA, 19 nt, Mycobacterium avium subsp. paratuberculosis
ucaucguggcgcgacgcgg

SEQ ID NO: 2880607 - RNA, 19 nt, Mycobacterium avium subsp. paratuberculosis
ucaucuacgucgucgccgg

SEQ ID NO: 2880608 - RNA, 17 nt, Mycobacterium avium subsp. paratuberculosis
ucaucucggcgaaguag

SEQ ID NO: 2880609 - RNA, 20 nt, Mycobacterium avium subsp. paratuberculosis
ucaucucggcgaaguagcgg

SEQ ID NO: 2880610 - RNA, 19 nt, Mycobacterium avium subsp. paratuberculosis
ucaucuggaacauggccuu

SEQ ID NO: 2880611 - RNA, 14 nt, Mycobacterium avium subsp. paratuberculosis
ucaugauccggaag

SEQ ID NO: 2880612 - RNA, 19 nt, Mycobacterium avium subsp. paratuberculosis
ucaugaucggcaggauccg

SEQ ID NO: 2880613 - RNA, 17 nt, Mycobacterium avium subsp. paratuberculosis
ucaugcacggcgcuggc

SEQ ID NO: 2880614 - RNA, 14 nt, Mycobacterium avium subsp. paratuberculosis
ucaugcccaccauc

SEQ ID NO: 2880615 - RNA, 21 nt, Mycobacterium avium subsp. paratuberculosis
ucaugcccaccaucccgccgc

SEQ ID NO: 2880616 - RNA, 18 nt, Mycobacterium avium subsp. paratuberculosis
ucaugccgcccaucaccc

SEQ ID NO: 2880617 - RNA, 22 nt, Mycobacterium avium subsp. paratuberculosis
ucaugccggcgaacucgcggcg

SEQ ID NO: 2880618 - RNA, 19 nt, Mycobacterium avium subsp. paratuberculosis
ucaugccguaaguggcgcc

SEQ ID NO: 2880619 - RNA, 16 nt, Mycobacterium avium subsp. paratuberculosis
ucaugccgucgacgac

SEQ ID NO: 2880620 - RNA, 18 nt, Mycobacterium avium subsp. paratuberculosis
ucaugcgcgucauggccg

SEQ ID NO: 2880621 - RNA, 22 nt, Mycobacterium avium subsp. paratuberculosis
ucaugcguuugccgucgagggg

SEQ ID NO: 2880622 - RNA, 13 nt, Mycobacterium avium subsp. paratuberculosis
ucauggacagcca

SEQ ID NO: 2880623 - RNA, 15 nt, Mycobacterium avium subsp. paratuberculosis
ucauggacagccacc

SEQ ID NO: 2880624 - RNA, 14 nt, Mycobacterium avium subsp. paratuberculosis
ucauggcgaccgcg

SEQ ID NO: 2880625 - RNA, 16 nt, Mycobacterium avium subsp. paratuberculosis
ucauggcgcugcgcga

SEQ ID NO: 2880626 - RNA, 17 nt, Mycobacterium avium subsp. paratuberculosis
ucaugguggcggcgccg

SEQ ID NO: 2880627 - RNA, 21 nt, Mycobacterium avium subsp. paratuberculosis
ucaugguguuccaccagcggc

SEQ ID NO: 2880628 - RNA, 22 nt, Mycobacterium avium subsp. paratuberculosis
ucaugguguuccaccagcggcc

SEQ ID NO: 2880629 - RNA, 16 nt, Mycobacterium avium subsp. paratuberculosis
ucauguaccggucgua

SEQ ID NO: 2880630 - RNA, 18 nt, Mycobacterium avium subsp. paratuberculosis
ucauguaccggucguaga

SEQ ID NO: 2880631 - RNA, 15 nt, Mycobacterium avium subsp. paratuberculosis
ucauguagcgcuggu

SEQ ID NO: 2880632 - RNA, 24 nt, Mycobacterium avium subsp. paratuberculosis
ucaugucgaagaagcggccgacga

SEQ ID NO: 2880633 - RNA, 16 nt, Mycobacterium avium subsp. paratuberculosis
ucauuccgccgcgccc

SEQ ID NO: 2880634 - RNA, 19 nt, Mycobacterium avium subsp. paratuberculosis
ucauuccgccgcgcccguc

SEQ ID NO: 2880635 - RNA, 19 nt, Mycobacterium avium subsp. paratuberculosis
ucauugagccgcucgccgg

SEQ ID NO: 2880636 - RNA, 20 nt, Mycobacterium avium subsp. paratuberculosis
uccaaaaacugcgcgucgga

SEQ ID NO: 2880637 - RNA, 18 nt, Mycobacterium avium subsp. paratuberculosis
uccaaccaccguggcccc

SEQ ID NO: 2880638 - RNA, 13 nt, Mycobacterium avium subsp. paratuberculosis
uccaacgcggcca

SEQ ID NO: 2880639 - RNA, 18 nt, Mycobacterium avium subsp. paratuberculosis
uccaacgggcucagcacc

SEQ ID NO: 2880640 - RNA, 18 nt, Mycobacterium avium subsp. paratuberculosis
uccaacguggguggcccc

SEQ ID NO: 2880641 - RNA, 17 nt, Mycobacterium avium subsp. paratuberculosis
uccaaggagaaggccgc

SEQ ID NO: 2880642 - RNA, 15 nt, Mycobacterium avium subsp. paratuberculosis
uccaauacggcccgg

SEQ ID NO: 2880643 - RNA, 16 nt, Mycobacterium avium subsp. paratuberculosis
uccaaugcgcccuggu

SEQ ID NO: 2880644 - RNA, 13 nt, Mycobacterium avium subsp. paratuberculosis
uccacaaccagcg

SEQ ID NO: 2880645 - RNA, 14 nt, Mycobacterium avium subsp. paratuberculosis
uccacacggcaggc

SEQ ID NO: 2880646 - RNA, 15 nt, Mycobacterium avium subsp. paratuberculosis
uccacagccggcggc

SEQ ID NO: 2880647 - RNA, 15 nt, Mycobacterium avium subsp. paratuberculosis
uccacauacgcggcg

SEQ ID NO: 2880648 - RNA, 15 nt, Mycobacterium avium subsp. paratuberculosis
uccacaucagguuga

SEQ ID NO: 2880649 - RNA, 22 nt, Mycobacterium avium subsp. paratuberculosis
uccaccaaacgaagugaugcug

SEQ ID NO: 2880650 - RNA, 20 nt, Mycobacterium avium subsp. paratuberculosis
uccaccaaggucuccgggcu

SEQ ID NO: 2880651 - RNA, 17 nt, Mycobacterium avium subsp. paratuberculosis
uccaccaauucgcgcug

SEQ ID NO: 2880652 - RNA, 20 nt, Mycobacterium avium subsp. paratuberculosis
uccaccaauucgcgcugcca

SEQ ID NO: 2880653 - RNA, 21 nt, Mycobacterium avium subsp. paratuberculosis
uccaccaccacacccgcggcc

SEQ ID NO: 2880654 - RNA, 23 nt, Mycobacterium avium subsp. paratuberculosis
uccaccaccacacccgcggccgc

SEQ ID NO: 2880655 - RNA, 12 nt, Mycobacterium avium subsp. paratuberculosis
uccaccaccggc

SEQ ID NO: 2880656 - RNA, 13 nt, Mycobacterium avium subsp. paratuberculosis
uccaccaccggcc

SEQ ID NO: 2880657 - RNA, 15 nt, Mycobacterium avium subsp. paratuberculosis
uccaccaccggccgc

SEQ ID NO: 2880658 - RNA, 15 nt, Mycobacterium avium subsp. paratuberculosis
uccaccaccuggccg

SEQ ID NO: 2880659 - RNA, 18 nt, Mycobacterium avium subsp. paratuberculosis
uccaccagaaguggucga

SEQ ID NO: 2880660 - RNA, 15 nt, Mycobacterium avium subsp. paratuberculosis
uccaccagaucgccc

SEQ ID NO: 2880661 - RNA, 18 nt, Mycobacterium avium subsp. paratuberculosis
uccaccagaucgccccgc

SEQ ID NO: 2880662 - RNA, 13 nt, Mycobacterium avium subsp. paratuberculosis
uccaccagcacgc

SEQ ID NO: 2880663 - RNA, 19 nt, Mycobacterium avium subsp. paratuberculosis
uccaccagcgcggugaugu

SEQ ID NO: 2880664 - RNA, 13 nt, Mycobacterium avium subsp. paratuberculosis
uccaccagcggcc

SEQ ID NO: 2880665 - RNA, 17 nt, Mycobacterium avium subsp. paratuberculosis
uccaccagcggccgucg

SEQ ID NO: 2880666 - RNA, 18 nt, Mycobacterium avium subsp. paratuberculosis
uccaccagcggccgucgc

SEQ ID NO: 2880667 - RNA, 13 nt, Mycobacterium avium subsp. paratuberculosis
uccaccagcucga

SEQ ID NO: 2880668 - RNA, 19 nt, Mycobacterium avium subsp. paratuberculosis
uccaccaggguggccgcca

SEQ ID NO: 2880669 - RNA, 20 nt, Mycobacterium avium subsp. paratuberculosis
uccaccaggguggccgccac

SEQ ID NO: 2880670 - RNA, 12 nt, Mycobacterium avium subsp. paratuberculosis
uccaccagguga

SEQ ID NO: 2880671 - RNA, 19 nt, Mycobacterium avium subsp. paratuberculosis
uccaccaggugaccggccu

SEQ ID NO: 2880672 - RNA, 17 nt, Mycobacterium avium subsp. paratuberculosis
uccaccaguguccgggc

SEQ ID NO: 2880673 - RNA, 20 nt, Mycobacterium avium subsp. paratuberculosis
uccaccaguguccgggcgcc

SEQ ID NO: 2880674 - RNA, 22 nt, Mycobacterium avium subsp. paratuberculosis
uccaccaguguccgggcgccca

SEQ ID NO: 2880675 - RNA, 22 nt, Mycobacterium avium subsp. paratuberculosis
uccaccaucggggugaccguca

SEQ ID NO: 2880676 - RNA, 21 nt, Mycobacterium avium subsp. paratuberculosis
uccaccauggcuuccgccgag

SEQ ID NO: 2880677 - RNA, 23 nt, Mycobacterium avium subsp. paratuberculosis
uccacccccuacgccguggccug

SEQ ID NO: 2880678 - RNA, 22 nt, Mycobacterium avium subsp. paratuberculosis
uccaccccgccaaucaccgcgg

SEQ ID NO: 2880679 - RNA, 14 nt, Mycobacterium avium subsp. paratuberculosis
uccacccggcccac

SEQ ID NO: 2880680 - RNA, 21 nt, Mycobacterium avium subsp. paratuberculosis
uccacccguuccucgacguag

SEQ ID NO: 2880681 - RNA, 22 nt, Mycobacterium avium subsp. paratuberculosis
uccaccgaaaagcccgccgccu

SEQ ID NO: 2880682 - RNA, 13 nt, Mycobacterium avium subsp. paratuberculosis
uccaccgacaggu

SEQ ID NO: 2880683 - RNA, 16 nt, Mycobacterium avium subsp. paratuberculosis
uccaccgacaggucga

SEQ ID NO: 2880684 - RNA, 16 nt, Mycobacterium avium subsp. paratuberculosis
uccaccgagugcggcg

SEQ ID NO: 2880685 - RNA, 20 nt, Mycobacterium avium subsp. paratuberculosis
uccaccgagugcggcgcggu

SEQ ID NO: 2880686 - RNA, 22 nt, Mycobacterium avium subsp. paratuberculosis
uccaccgagugcggcgcggugc

SEQ ID NO: 2880687 - RNA, 21 nt, Mycobacterium avium subsp. paratuberculosis
uccaccgcccggaugccggcg

SEQ ID NO: 2880688 - RNA, 22 nt, Mycobacterium avium subsp. paratuberculosis
uccaccgcccggaugccggcgc

SEQ ID NO: 2880689 - RNA, 12 nt, Mycobacterium avium subsp. paratuberculosis
uccaccgcgccg

SEQ ID NO: 2880690 - RNA, 15 nt, Mycobacterium avium subsp. paratuberculosis
uccaccgcgccgucg

SEQ ID NO: 2880691 - RNA, 15 nt, Mycobacterium avium subsp. paratuberculosis
uccaccgcgcggcca

SEQ ID NO: 2880692 - RNA, 21 nt, Mycobacterium avium subsp. paratuberculosis
uccaccgcgcggccagcggcg

SEQ ID NO: 2880693 - RNA, 18 nt, Mycobacterium avium subsp. paratuberculosis
uccaccgcgcggcgcagu

SEQ ID NO: 2880694 - RNA, 15 nt, Mycobacterium avium subsp. paratuberculosis
uccaccgcggcggcc

SEQ ID NO: 2880695 - RNA, 13 nt, Mycobacterium avium subsp. paratuberculosis
uccaccgcguccu

SEQ ID NO: 2880696 - RNA, 21 nt, Mycobacterium avium subsp. paratuberculosis
uccaccgcguccugcaggcag

SEQ ID NO: 2880697 - RNA, 22 nt, Mycobacterium avium subsp. paratuberculosis
uccaccgcguccugcaggcagg

SEQ ID NO: 2880698 - RNA, 22 nt, Mycobacterium avium subsp. paratuberculosis
uccaccggaaccguuugucccu

SEQ ID NO: 2880699 - RNA, 20 nt, Mycobacterium avium subsp. paratuberculosis
uccaccggcaaucgggacgc

SEQ ID NO: 2880700 - RNA, 22 nt, Mycobacterium avium subsp. paratuberculosis
uccaccggccgauggcccaggc

SEQ ID NO: 2880701 - RNA, 23 nt, Mycobacterium avium subsp. paratuberculosis
uccaccggccgauggcccaggcc

SEQ ID NO: 2880702 - RNA, 14 nt, Mycobacterium avium subsp. paratuberculosis
uccaccgggccgcc

SEQ ID NO: 2880703 - RNA, 15 nt, Mycobacterium avium subsp. paratuberculosis
uccaccgggccgcca

SEQ ID NO: 2880704 - RNA, 22 nt, Mycobacterium avium subsp. paratuberculosis
uccaccgggccgccaucaccgc

SEQ ID NO: 2880705 - RNA, 15 nt, Mycobacterium avium subsp. paratuberculosis
uccaccugcggcacc

SEQ ID NO: 2880706 - RNA, 21 nt, Mycobacterium avium subsp. paratuberculosis
uccaccugcggcaccucggcc

SEQ ID NO: 2880707 - RNA, 15 nt, Mycobacterium avium subsp. paratuberculosis
uccaccuggcugugc

SEQ ID NO: 2880708 - RNA, 16 nt, Mycobacterium avium subsp. paratuberculosis
uccacgaccccggcgg

SEQ ID NO: 2880709 - RNA, 16 nt, Mycobacterium avium subsp. paratuberculosis
uccacgaccuggcggg

SEQ ID NO: 2880710 - RNA, 13 nt, Mycobacterium avium subsp. paratuberculosis
uccacgagccggu

SEQ ID NO: 2880711 - RNA, 20 nt, Mycobacterium avium subsp. paratuberculosis
uccacgaugcccgucacggc

SEQ ID NO: 2880712 - RNA, 18 nt, Mycobacterium avium subsp. paratuberculosis
uccacgaugccgggcacg

SEQ ID NO: 2880713 - RNA, 22 nt, Mycobacterium avium subsp. paratuberculosis
uccacgaugcguugguguagcc

SEQ ID NO: 2880714 - RNA, 17 nt, Mycobacterium avium subsp. paratuberculosis
uccacgauuccucggac

SEQ ID NO: 2880715 - RNA, 13 nt, Mycobacterium avium subsp. paratuberculosis
uccacgcccagcg

SEQ ID NO: 2880716 - RNA, 21 nt, Mycobacterium avium subsp. paratuberculosis
uccacgccgagggcggcggcu

SEQ ID NO: 2880717 - RNA, 15 nt, Mycobacterium avium subsp. paratuberculosis
uccacgccggugacc

SEQ ID NO: 2880718 - RNA, 10 nt, Mycobacterium avium subsp. paratuberculosis
uccacgccgu

SEQ ID NO: 2880719 - RNA, 17 nt, Mycobacterium avium subsp. paratuberculosis
uccacgccguguugacg

SEQ ID NO: 2880720 - RNA, 17 nt, Mycobacterium avium subsp. paratuberculosis
uccacgcguagccgacc

SEQ ID NO: 2880721 - RNA, 19 nt, Mycobacterium avium subsp. paratuberculosis
uccacgcguagccgaccaa

SEQ ID NO: 2880722 - RNA, 13 nt, Mycobacterium avium subsp. paratuberculosis
uccacgcuggcgg

SEQ ID NO: 2880723 - RNA, 16 nt, Mycobacterium avium subsp. paratuberculosis
uccacgcuggcggugu

SEQ ID NO: 2880724 - RNA, 16 nt, Mycobacterium avium subsp. paratuberculosis
uccacggucagcgcgu

SEQ ID NO: 2880725 - RNA, 16 nt, Mycobacterium avium subsp. paratuberculosis
uccacggugcgcaccg

SEQ ID NO: 2880726 - RNA, 16 nt, Mycobacterium avium subsp. paratuberculosis
uccacgucgcccagcg

SEQ ID NO: 2880727 - RNA, 22 nt, Mycobacterium avium subsp. paratuberculosis
uccacgucgcgauagggccggc

SEQ ID NO: 2880728 - RNA, 14 nt, Mycobacterium avium subsp. paratuberculosis
uccacgugcacggc

SEQ ID NO: 2880729 - RNA, 16 nt, Mycobacterium avium subsp. paratuberculosis
uccacgugcacggcgc

SEQ ID NO: 2880730 - RNA, 19 nt, Mycobacterium avium subsp. paratuberculosis
uccacgugcacggcgccgu

SEQ ID NO: 2880731 - RNA, 17 nt, Mycobacterium avium subsp. paratuberculosis
uccacuccagcaccgga

SEQ ID NO: 2880732 - RNA, 22 nt, Mycobacterium avium subsp. paratuberculosis
uccacucccgcgcgcuguccuc

SEQ ID NO: 2880733 - RNA, 14 nt, Mycobacterium avium subsp. paratuberculosis
uccacucgaugucc

SEQ ID NO: 2880734 - RNA, 16 nt, Mycobacterium avium subsp. paratuberculosis
uccacucgucggcggu

SEQ ID NO: 2880735 - RNA, 13 nt, Mycobacterium avium subsp. paratuberculosis
uccagaacucggc

SEQ ID NO: 2880736 - RNA, 15 nt, Mycobacterium avium subsp. paratuberculosis
uccagaacucggcgg

SEQ ID NO: 2880737 - RNA, 19 nt, Mycobacterium avium subsp. paratuberculosis
uccagaacucggcggcggu

SEQ ID NO: 2880738 - RNA, 13 nt, Mycobacterium avium subsp. paratuberculosis
uccagaccggccg

SEQ ID NO: 2880739 - RNA, 22 nt, Mycobacterium avium subsp. paratuberculosis
uccagaccggccggggcgggca

SEQ ID NO: 2880740 - RNA, 15 nt, Mycobacterium avium subsp. paratuberculosis
uccagaccggcggcg

SEQ ID NO: 2880741 - RNA, 23 nt, Mycobacterium avium subsp. paratuberculosis
uccagaccggcggcgaucggcgc

SEQ ID NO: 2880742 - RNA, 15 nt, Mycobacterium avium subsp. paratuberculosis
uccagacgucggcgu

SEQ ID NO: 2880743 - RNA, 17 nt, Mycobacterium avium subsp. paratuberculosis
uccagagcaucagggcg

SEQ ID NO: 2880744 - RNA, 18 nt, Mycobacterium avium subsp. paratuberculosis
uccagaucgccgcccauc

SEQ ID NO: 2880745 - RNA, 19 nt, Mycobacterium avium subsp. paratuberculosis
uccagaucggccagcgcgg

SEQ ID NO: 2880746 - RNA, 19 nt, Mycobacterium avium subsp. paratuberculosis
uccagaucggcgcgcgggg

SEQ ID NO: 2880747 - RNA, 23 nt, Mycobacterium avium subsp. paratuberculosis
uccagaucugucuucgcggucuc

SEQ ID NO: 2880748 - RNA, 22 nt, Mycobacterium avium subsp. paratuberculosis
uccagcaacugcucgaccagcc

SEQ ID NO: 2880749 - RNA, 15 nt, Mycobacterium avium subsp. paratuberculosis
uccagcacccggccc

SEQ ID NO: 2880750 - RNA, 22 nt, Mycobacterium avium subsp. paratuberculosis
uccagcacccggcccacgccgu

SEQ ID NO: 2880751 - RNA, 11 nt, Mycobacterium avium subsp. paratuberculosis
uccagcaccgg

SEQ ID NO: 2880752 - RNA, 13 nt, Mycobacterium avium subsp. paratuberculosis
uccagcaccggcg

SEQ ID NO: 2880753 - RNA, 19 nt, Mycobacterium avium subsp. paratuberculosis
uccagcaccggcgccauga

SEQ ID NO: 2880754 - RNA, 16 nt, Mycobacterium avium subsp. paratuberculosis
uccagcaccugcucga

SEQ ID NO: 2880755 - RNA, 15 nt, Mycobacterium avium subsp. paratuberculosis
uccagcacgucgggg

SEQ ID NO: 2880756 - RNA, 21 nt, Mycobacterium avium subsp. paratuberculosis
uccagcagcccgggcugcagc

SEQ ID NO: 2880757 - RNA, 19 nt, Mycobacterium avium subsp. paratuberculosis
uccagcagcgccagcaccg

SEQ ID NO: 2880758 - RNA, 20 nt, Mycobacterium avium subsp. paratuberculosis
uccagcagcgccagcaccgc

SEQ ID NO: 2880759 - RNA, 22 nt, Mycobacterium avium subsp. paratuberculosis
uccagcagcgccagcaccgccu

SEQ ID NO: 2880760 - RNA, 15 nt, Mycobacterium avium subsp. paratuberculosis
uccagcagcgccggc

SEQ ID NO: 2880761 - RNA, 18 nt, Mycobacterium avium subsp. paratuberculosis
uccagcagcgccggcagc

SEQ ID NO: 2880762 - RNA, 15 nt, Mycobacterium avium subsp. paratuberculosis
uccagcagcggcucg

SEQ ID NO: 2880763 - RNA, 19 nt, Mycobacterium avium subsp. paratuberculosis
uccagcagcuguugcggcg

SEQ ID NO: 2880764 - RNA, 17 nt, Mycobacterium avium subsp. paratuberculosis
uccagcaggcgcgccga

SEQ ID NO: 2880765 - RNA, 18 nt, Mycobacterium avium subsp. paratuberculosis
uccagcaggcgcgccgag

SEQ ID NO: 2880766 - RNA, 14 nt, Mycobacterium avium subsp. paratuberculosis
uccagccacuccac

SEQ ID NO: 2880767 - RNA, 20 nt, Mycobacterium avium subsp. paratuberculosis
uccagccacuccaccaccgg

SEQ ID NO: 2880768 - RNA, 14 nt, Mycobacterium avium subsp. paratuberculosis
uccagccagccgcg

SEQ ID NO: 2880769 - RNA, 12 nt, Mycobacterium avium subsp. paratuberculosis
uccagccagcgc

SEQ ID NO: 2880770 - RNA, 14 nt, Mycobacterium avium subsp. paratuberculosis
uccagccagcgcgc

SEQ ID NO: 2880771 - RNA, 15 nt, Mycobacterium avium subsp. paratuberculosis
uccagccagcgcgcg

SEQ ID NO: 2880772 - RNA, 18 nt, Mycobacterium avium subsp. paratuberculosis
uccagccauucgucgggg

SEQ ID NO: 2880773 - RNA, 21 nt, Mycobacterium avium subsp. paratuberculosis
uccagcccgauguuggccuca

SEQ ID NO: 2880774 - RNA, 20 nt, Mycobacterium avium subsp. paratuberculosis
uccagcccgcgccagcucgg

SEQ ID NO: 2880775 - RNA, 16 nt, Mycobacterium avium subsp. paratuberculosis
uccagcccggcgauga

SEQ ID NO: 2880776 - RNA, 16 nt, Mycobacterium avium subsp. paratuberculosis
uccagccgaucgcggu

SEQ ID NO: 2880777 - RNA, 14 nt, Mycobacterium avium subsp. paratuberculosis
uccagccgccgcgu

SEQ ID NO: 2880778 - RNA, 13 nt, Mycobacterium avium subsp. paratuberculosis
uccagccgccggc

SEQ ID NO: 2880779 - RNA, 15 nt, Mycobacterium avium subsp. paratuberculosis
uccagccgcgcggcc

SEQ ID NO: 2880780 - RNA, 11 nt, Mycobacterium avium subsp. paratuberculosis
uccagccgcuc

SEQ ID NO: 2880781 - RNA, 15 nt, Mycobacterium avium subsp. paratuberculosis
uccagccgcuccgcg

SEQ ID NO: 2880782 - RNA, 14 nt, Mycobacterium avium subsp. paratuberculosis
uccagccggcccgc

SEQ ID NO: 2880783 - RNA, 22 nt, Mycobacterium avium subsp. paratuberculosis
uccagccggcccgcaucgcggc

SEQ ID NO: 2880784 - RNA, 20 nt, Mycobacterium avium subsp. paratuberculosis
uccagccggcggaucgcgug

SEQ ID NO: 2880785 - RNA, 16 nt, Mycobacterium avium subsp. paratuberculosis
uccagccggucgcagg

SEQ ID NO: 2880786 - RNA, 16 nt, Mycobacterium avium subsp. paratuberculosis
uccagccggugcacca

SEQ ID NO: 2880787 - RNA, 12 nt, Mycobacterium avium subsp. paratuberculosis
uccagccgugcg

SEQ ID NO: 2880788 - RNA, 15 nt, Mycobacterium avium subsp. paratuberculosis
uccagccgugcuggg

SEQ ID NO: 2880789 - RNA, 21 nt, Mycobacterium avium subsp. paratuberculosis
uccagccgugggugucggcga

SEQ ID NO: 2880790 - RNA, 22 nt, Mycobacterium avium subsp. paratuberculosis
uccagccguucgcgcacggcgc

SEQ ID NO: 2880791 - RNA, 19 nt, Mycobacterium avium subsp. paratuberculosis
uccagccuugcagccgcug

SEQ ID NO: 2880792 - RNA, 19 nt, Mycobacterium avium subsp. paratuberculosis
uccagcgacaacagcacga

SEQ ID NO: 2880793 - RNA, 18 nt, Mycobacterium avium subsp. paratuberculosis
uccagcgagcccuucgcg

SEQ ID NO: 2880794 - RNA, 13 nt, Mycobacterium avium subsp. paratuberculosis
uccagcgcacaca

SEQ ID NO: 2880795 - RNA, 15 nt, Mycobacterium avium subsp. paratuberculosis
uccagcgccagcgag

SEQ ID NO: 2880796 - RNA, 16 nt, Mycobacterium avium subsp. paratuberculosis
uccagcgccagcgagu

SEQ ID NO: 2880797 - RNA, 15 nt, Mycobacterium avium subsp. paratuberculosis
uccagcgcccgccgc

SEQ ID NO: 2880798 - RNA, 12 nt, Mycobacterium avium subsp. paratuberculosis
uccagcgccgcc

SEQ ID NO: 2880799 - RNA, 15 nt, Mycobacterium avium subsp. paratuberculosis
uccagcgccgccauc

SEQ ID NO: 2880800 - RNA, 17 nt, Mycobacterium avium subsp. paratuberculosis
uccagcgccgccaucgc

SEQ ID NO: 2880801 - RNA, 19 nt, Mycobacterium avium subsp. paratuberculosis
uccagcgccggcaccagca

SEQ ID NO: 2880802 - RNA, 20 nt, Mycobacterium avium subsp. paratuberculosis
uccagcgccggcaccagcag

SEQ ID NO: 2880803 - RNA, 22 nt, Mycobacterium avium subsp. paratuberculosis
uccagcgccggcaccagcagcc

SEQ ID NO: 2880804 - RNA, 14 nt, Mycobacterium avium subsp. paratuberculosis
uccagcgcgccgcu

SEQ ID NO: 2880805 - RNA, 12 nt, Mycobacterium avium subsp. paratuberculosis
uccagcgcggcg

SEQ ID NO: 2880806 - RNA, 16 nt, Mycobacterium avium subsp. paratuberculosis
uccagcgcggcgaucg

SEQ ID NO: 2880807 - RNA, 15 nt, Mycobacterium avium subsp. paratuberculosis
uccagcgcggugagc

SEQ ID NO: 2880808 - RNA, 18 nt, Mycobacterium avium subsp. paratuberculosis
uccagcgcggugagcagc

SEQ ID NO: 2880809 - RNA, 20 nt, Mycobacterium avium subsp. paratuberculosis
uccagcgcggugagcagcau

SEQ ID NO: 2880810 - RNA, 21 nt, Mycobacterium avium subsp. paratuberculosis
uccagcgcguagucggcgucg

SEQ ID NO: 2880811 - RNA, 17 nt, Mycobacterium avium subsp. paratuberculosis
uccagcgcgucgcugcc

SEQ ID NO: 2880812 - RNA, 18 nt, Mycobacterium avium subsp. paratuberculosis
uccagcgcgucgcugccg

SEQ ID NO: 2880813 - RNA, 14 nt, Mycobacterium avium subsp. paratuberculosis
uccagcgcuggccg

SEQ ID NO: 2880814 - RNA, 14 nt, Mycobacterium avium subsp. paratuberculosis
uccagcggcaccgc

SEQ ID NO: 2880815 - RNA, 18 nt, Mycobacterium avium subsp. paratuberculosis
uccagcggcaccgccauc

SEQ ID NO: 2880816 - RNA, 20 nt, Mycobacterium avium subsp. paratuberculosis
uccagcggcaccgccaucgg

SEQ ID NO: 2880817 - RNA, 21 nt, Mycobacterium avium subsp. paratuberculosis
uccagcggccacaccggggcc

SEQ ID NO: 2880818 - RNA, 23 nt, Mycobacterium avium subsp. paratuberculosis
uccagcggccacaccggggccag

SEQ ID NO: 2880819 - RNA, 14 nt, Mycobacterium avium subsp. paratuberculosis
uccagcggccgcag

SEQ ID NO: 2880820 - RNA, 10 nt, Mycobacterium avium subsp. paratuberculosis
uccagcggcg

SEQ ID NO: 2880821 - RNA, 12 nt, Mycobacterium avium subsp. paratuberculosis
uccagcggcgca

SEQ ID NO: 2880822 - RNA, 15 nt, Mycobacterium avium subsp. paratuberculosis
uccagcggguccagc

SEQ ID NO: 2880823 - RNA, 18 nt, Mycobacterium avium subsp. paratuberculosis
uccagcggguugccgcug

SEQ ID NO: 2880824 - RNA, 16 nt, Mycobacterium avium subsp. paratuberculosis
uccagcgucgcggccg

SEQ ID NO: 2880825 - RNA, 20 nt, Mycobacterium avium subsp. paratuberculosis
uccagcgucgcggccgggaa

SEQ ID NO: 2880826 - RNA, 22 nt, Mycobacterium avium subsp. paratuberculosis
uccagcguuuccuggugcacca

SEQ ID NO: 2880827 - RNA, 14 nt, Mycobacterium avium subsp. paratuberculosis
uccagcucagcgcg

SEQ ID NO: 2880828 - RNA, 18 nt, Mycobacterium avium subsp. paratuberculosis
uccagcuccgcggccagc

SEQ ID NO: 2880829 - RNA, 21 nt, Mycobacterium avium subsp. paratuberculosis
uccagcuccguccaccggcac

SEQ ID NO: 2880830 - RNA, 19 nt, Mycobacterium avium subsp. paratuberculosis
uccagcucgcgaagcgcga

SEQ ID NO: 2880831 - RNA, 20 nt, Mycobacterium avium subsp. paratuberculosis
uccagcucgcgaagcgcgau

SEQ ID NO: 2880832 - RNA, 23 nt, Mycobacterium avium subsp. paratuberculosis
uccagcucgcguucgggcccggc

SEQ ID NO: 2880833 - RNA, 14 nt, Mycobacterium avium subsp. paratuberculosis
uccagcugcgcgcc

SEQ ID NO: 2880834 - RNA, 15 nt, Mycobacterium avium subsp. paratuberculosis
uccagcugcgcgccg

SEQ ID NO: 2880835 - RNA, 16 nt, Mycobacterium avium subsp. paratuberculosis
uccagcuggagaggcc

SEQ ID NO: 2880836 - RNA, 20 nt, Mycobacterium avium subsp. paratuberculosis
uccagcuggagaggcccggc

SEQ ID NO: 2880837 - RNA, 19 nt, Mycobacterium avium subsp. paratuberculosis
uccagcuguugacgggccg

SEQ ID NO: 2880838 - RNA, 20 nt, Mycobacterium avium subsp. paratuberculosis
uccagcuguugacgggccgc

SEQ ID NO: 2880839 - RNA, 20 nt, Mycobacterium avium subsp. paratuberculosis
uccagcuugucguagcggcg

SEQ ID NO: 2880840 - RNA, 22 nt, Mycobacterium avium subsp. paratuberculosis
uccagcuugucguagcggcgcc

SEQ ID NO: 2880841 - RNA, 12 nt, Mycobacterium avium subsp. paratuberculosis
uccagcuuugcc

SEQ ID NO: 2880842 - RNA, 15 nt, Mycobacterium avium subsp. paratuberculosis
uccaggaaacggccc

SEQ ID NO: 2880843 - RNA, 23 nt, Mycobacterium avium subsp. paratuberculosis
uccaggaaacggcccaucacguc

SEQ ID NO: 2880844 - RNA, 18 nt, Mycobacterium avium subsp. paratuberculosis
uccaggaauucgggcacc

SEQ ID NO: 2880845 - RNA, 17 nt, Mycobacterium avium subsp. paratuberculosis
uccaggacgaugcgcgc

SEQ ID NO: 2880846 - RNA, 22 nt, Mycobacterium avium subsp. paratuberculosis
uccaggauccgcaccgggcagc

SEQ ID NO: 2880847 - RNA, 22 nt, Mycobacterium avium subsp. paratuberculosis
uccaggaugagcugggcggcgc

SEQ ID NO: 2880848 - RNA, 23 nt, Mycobacterium avium subsp. paratuberculosis
uccaggaugagcugggcggcgcg

SEQ ID NO: 2880849 - RNA, 20 nt, Mycobacterium avium subsp. paratuberculosis
uccaggaugucgacgacacc

SEQ ID NO: 2880850 - RNA, 21 nt, Mycobacterium avium subsp. paratuberculosis
uccaggcaugggaucagcagc

SEQ ID NO: 2880851 - RNA, 16 nt, Mycobacterium avium subsp. paratuberculosis
uccaggccagcaccug

SEQ ID NO: 2880852 - RNA, 15 nt, Mycobacterium avium subsp. paratuberculosis
uccaggccgcugauc

SEQ ID NO: 2880853 - RNA, 16 nt, Mycobacterium avium subsp. paratuberculosis
uccaggcgcaccgcca

SEQ ID NO: 2880854 - RNA, 14 nt, Mycobacterium avium subsp. paratuberculosis
uccaggcgccgggu

SEQ ID NO: 2880855 - RNA, 23 nt, Mycobacterium avium subsp. paratuberculosis
uccaggcucgacaacugcccaau

SEQ ID NO: 2880856 - RNA, 17 nt, Mycobacterium avium subsp. paratuberculosis
uccaggcugaaucccuc

SEQ ID NO: 2880857 - RNA, 20 nt, Mycobacterium avium subsp. paratuberculosis
uccaggguggccagcacgcu

SEQ ID NO: 2880858 - RNA, 23 nt, Mycobacterium avium subsp. paratuberculosis
uccaggguggccagcacgcugcg

SEQ ID NO: 2880859 - RNA, 16 nt, Mycobacterium avium subsp. paratuberculosis
uccagggugucgucgu

SEQ ID NO: 2880860 - RNA, 18 nt, Mycobacterium avium subsp. paratuberculosis
uccaggguucucgcggcg

SEQ ID NO: 2880861 - RNA, 22 nt, Mycobacterium avium subsp. paratuberculosis
uccaggguucucgcggcggccg

SEQ ID NO: 2880862 - RNA, 20 nt, Mycobacterium avium subsp. paratuberculosis
uccagguacacguagcgguc

SEQ ID NO: 2880863 - RNA, 14 nt, Mycobacterium avium subsp. paratuberculosis
uccagguacgcgac

SEQ ID NO: 2880864 - RNA, 21 nt, Mycobacterium avium subsp. paratuberculosis
uccagguagggcacaccggug

SEQ ID NO: 2880865 - RNA, 14 nt, Mycobacterium avium subsp. paratuberculosis
uccagguccgggaa

SEQ ID NO: 2880866 - RNA, 17 nt, Mycobacterium avium subsp. paratuberculosis
uccaggugaacagcagc

SEQ ID NO: 2880867 - RNA, 18 nt, Mycobacterium avium subsp. paratuberculosis
uccaggugaacagcagcc

SEQ ID NO: 2880868 - RNA, 22 nt, Mycobacterium avium subsp. paratuberculosis
uccaggugaacagcagccacga

SEQ ID NO: 2880869 - RNA, 18 nt, Mycobacterium avium subsp. paratuberculosis
uccagguggggcacgggc

SEQ ID NO: 2880870 - RNA, 23 nt, Mycobacterium avium subsp. paratuberculosis
uccagguguaggcguggcaggcc

SEQ ID NO: 2880871 - RNA, 15 nt, Mycobacterium avium subsp. paratuberculosis
uccagguucgccgcc

SEQ ID NO: 2880872 - RNA, 18 nt, Mycobacterium avium subsp. paratuberculosis
uccaguagccgccgggcg

SEQ ID NO: 2880873 - RNA, 16 nt, Mycobacterium avium subsp. paratuberculosis
uccaguccggccguga

SEQ ID NO: 2880874 - RNA, 14 nt, Mycobacterium avium subsp. paratuberculosis
uccagucgcgccga

SEQ ID NO: 2880875 - RNA, 15 nt, Mycobacterium avium subsp. paratuberculosis
uccagucgcgccgag

SEQ ID NO: 2880876 - RNA, 15 nt, Mycobacterium avium subsp. paratuberculosis
uccagucggccguga

SEQ ID NO: 2880877 - RNA, 14 nt, Mycobacterium avium subsp. paratuberculosis
uccagucggcgccg

SEQ ID NO: 2880878 - RNA, 17 nt, Mycobacterium avium subsp. paratuberculosis
uccagucggcgccgaug

SEQ ID NO: 2880879 - RNA, 18 nt, Mycobacterium avium subsp. paratuberculosis
uccagucggcgccgaugc

SEQ ID NO: 2880880 - RNA, 22 nt, Mycobacterium avium subsp. paratuberculosis
uccagugcaguucgaugccgau

SEQ ID NO: 2880881 - RNA, 23 nt, Mycobacterium avium subsp. paratuberculosis
uccaguggcugucgggugccgcc

SEQ ID NO: 2880882 - RNA, 19 nt, Mycobacterium avium subsp. paratuberculosis
uccaguucggccagcgcgg

SEQ ID NO: 2880883 - RNA, 22 nt, Mycobacterium avium subsp. paratuberculosis
uccaguugcgaccccgccgucg

SEQ ID NO: 2880884 - RNA, 14 nt, Mycobacterium avium subsp. paratuberculosis
uccaguugcggcac

SEQ ID NO: 2880885 - RNA, 14 nt, Mycobacterium avium subsp. paratuberculosis
uccaucagcgcccg

SEQ ID NO: 2880886 - RNA, 15 nt, Mycobacterium avium subsp. paratuberculosis
uccaucauggcgcug

SEQ ID NO: 2880887 - RNA, 16 nt, Mycobacterium avium subsp. paratuberculosis
uccaucauggcgcugc

SEQ ID NO: 2880888 - RNA, 22 nt, Mycobacterium avium subsp. paratuberculosis
uccaucauggcgcugcgcgaca

SEQ ID NO: 2880889 - RNA, 17 nt, Mycobacterium avium subsp. paratuberculosis
uccauccagcgccgcag

SEQ ID NO: 2880890 - RNA, 15 nt, Mycobacterium avium subsp. paratuberculosis
uccaucccgcugaag

SEQ ID NO: 2880891 - RNA, 22 nt, Mycobacterium avium subsp. paratuberculosis
uccauccgccagaucgccuggc

SEQ ID NO: 2880892 - RNA, 14 nt, Mycobacterium avium subsp. paratuberculosis
uccauccgccgucg

SEQ ID NO: 2880893 - RNA, 16 nt, Mycobacterium avium subsp. paratuberculosis
uccauccgcuugccgc

SEQ ID NO: 2880894 - RNA, 13 nt, Mycobacterium avium subsp. paratuberculosis
uccauccgggaga

SEQ ID NO: 2880895 - RNA, 20 nt, Mycobacterium avium subsp. paratuberculosis
uccaucgccucgaccagcac

SEQ ID NO: 2880896 - RNA, 19 nt, Mycobacterium avium subsp. paratuberculosis
uccaucgggaccgcgggcg

SEQ ID NO: 2880897 - RNA, 17 nt, Mycobacterium avium subsp. paratuberculosis
uccaucgggcccagcag

SEQ ID NO: 2880898 - RNA, 20 nt, Mycobacterium avium subsp. paratuberculosis
uccaucgggcccagcagccu

SEQ ID NO: 2880899 - RNA, 16 nt, Mycobacterium avium subsp. paratuberculosis
uccaucuccagcuccg

SEQ ID NO: 2880900 - RNA, 15 nt, Mycobacterium avium subsp. paratuberculosis
uccaucugggcgcgc

SEQ ID NO: 2880901 - RNA, 19 nt, Mycobacterium avium subsp. paratuberculosis
uccaucugggcgcgcaccc

SEQ ID NO: 2880902 - RNA, 20 nt, Mycobacterium avium subsp. paratuberculosis
uccaugaaccggucguuggc

SEQ ID NO: 2880903 - RNA, 23 nt, Mycobacterium avium subsp. paratuberculosis
uccaugcccgcccacgggucgcc

SEQ ID NO: 2880904 - RNA, 20 nt, Mycobacterium avium subsp. paratuberculosis
uccaugcuggugccgccgau

SEQ ID NO: 2880905 - RNA, 19 nt, Mycobacterium avium subsp. paratuberculosis
uccauggccuugacgucgg

SEQ ID NO: 2880906 - RNA, 17 nt, Mycobacterium avium subsp. paratuberculosis
uccauggugaacugguu

SEQ ID NO: 2880907 - RNA, 20 nt, Mycobacterium avium subsp. paratuberculosis
uccauguaguucagcagccg

SEQ ID NO: 2880908 - RNA, 22 nt, Mycobacterium avium subsp. paratuberculosis
uccaugucgacgacguugcggg

SEQ ID NO: 2880909 - RNA, 12 nt, Mycobacterium avium subsp. paratuberculosis
uccaugucgucg

SEQ ID NO: 2880910 - RNA, 19 nt, Mycobacterium avium subsp. paratuberculosis
uccaugucgucgagcucga

SEQ ID NO: 2880911 - RNA, 17 nt, Mycobacterium avium subsp. paratuberculosis
ucccaaccccgggcggc

SEQ ID NO: 2880912 - RNA, 18 nt, Mycobacterium avium subsp. paratuberculosis
ucccacaccaccaccgag

SEQ ID NO: 2880913 - RNA, 22 nt, Mycobacterium avium subsp. paratuberculosis
ucccacauucggcgaaccaggc

SEQ ID NO: 2880914 - RNA, 14 nt, Mycobacterium avium subsp. paratuberculosis
ucccaccacggccg

SEQ ID NO: 2880915 - RNA, 23 nt, Mycobacterium avium subsp. paratuberculosis
ucccacguggugaucagcauccg

SEQ ID NO: 2880916 - RNA, 17 nt, Mycobacterium avium subsp. paratuberculosis
ucccacugcccguaguc

SEQ ID NO: 2880917 - RNA, 17 nt, Mycobacterium avium subsp. paratuberculosis
ucccagacccagcaucg

SEQ ID NO: 2880918 - RNA, 16 nt, Mycobacterium avium subsp. paratuberculosis
ucccagacgucgaccu

SEQ ID NO: 2880919 - RNA, 20 nt, Mycobacterium avium subsp. paratuberculosis
ucccagaucguagggcucgg

SEQ ID NO: 2880920 - RNA, 14 nt, Mycobacterium avium subsp. paratuberculosis
ucccagaugcgcga

SEQ ID NO: 2880921 - RNA, 15 nt, Mycobacterium avium subsp. paratuberculosis
ucccagcacagccgu

SEQ ID NO: 2880922 - RNA, 17 nt, Mycobacterium avium subsp. paratuberculosis
ucccagcccggccaguu

SEQ ID NO: 2880923 - RNA, 19 nt, Mycobacterium avium subsp. paratuberculosis
ucccagcccucgucgauga

SEQ ID NO: 2880924 - RNA, 13 nt, Mycobacterium avium subsp. paratuberculosis
ucccagccgccgg

SEQ ID NO: 2880925 - RNA, 15 nt, Mycobacterium avium subsp. paratuberculosis
ucccagccgccggcc

SEQ ID NO: 2880926 - RNA, 21 nt, Mycobacterium avium subsp. paratuberculosis
ucccagccgccggccaccagg

SEQ ID NO: 2880927 - RNA, 18 nt, Mycobacterium avium subsp. paratuberculosis
ucccagcgccacuggcug

SEQ ID NO: 2880928 - RNA, 22 nt, Mycobacterium avium subsp. paratuberculosis
ucccagcgcccgggcgcgugca

SEQ ID NO: 2880929 - RNA, 16 nt, Mycobacterium avium subsp. paratuberculosis
ucccagcggccgaggg

SEQ ID NO: 2880930 - RNA, 23 nt, Mycobacterium avium subsp. paratuberculosis
ucccagcgggacagcaccaccag

SEQ ID NO: 2880931 - RNA, 19 nt, Mycobacterium avium subsp. paratuberculosis
ucccaggaacgcgcccggc

SEQ ID NO: 2880932 - RNA, 15 nt, Mycobacterium avium subsp. paratuberculosis
ucccaggacgcggug

SEQ ID NO: 2880933 - RNA, 17 nt, Mycobacterium avium subsp. paratuberculosis
ucccaggacggcgcggu

SEQ ID NO: 2880934 - RNA, 20 nt, Mycobacterium avium subsp. paratuberculosis
ucccaggauuccgucggcgg

SEQ ID NO: 2880935 - RNA, 12 nt, Mycobacterium avium subsp. paratuberculosis
ucccaggccgcg

SEQ ID NO: 2880936 - RNA, 18 nt, Mycobacterium avium subsp. paratuberculosis
ucccaggcguggucggcg

SEQ ID NO: 2880937 - RNA, 16 nt, Mycobacterium avium subsp. paratuberculosis
ucccaggguugccgca

SEQ ID NO: 2880938 - RNA, 17 nt, Mycobacterium avium subsp. paratuberculosis
ucccaggguuggucgga

SEQ ID NO: 2880939 - RNA, 20 nt, Mycobacterium avium subsp. paratuberculosis
ucccaggugggcgcgcagca

SEQ ID NO: 2880940 - RNA, 20 nt, Mycobacterium avium subsp. paratuberculosis
ucccagugccaguaccagcg

SEQ ID NO: 2880941 - RNA, 20 nt, Mycobacterium avium subsp. paratuberculosis
ucccagugccgcagguggug

SEQ ID NO: 2880942 - RNA, 20 nt, Mycobacterium avium subsp. paratuberculosis
ucccagugcgugaccugcug

SEQ ID NO: 2880943 - RNA, 18 nt, Mycobacterium avium subsp. paratuberculosis
ucccaguucccggcgggc

SEQ ID NO: 2880944 - RNA, 17 nt, Mycobacterium avium subsp. paratuberculosis
ucccauucgugguugcc

SEQ ID NO: 2880945 - RNA, 17 nt, Mycobacterium avium subsp. paratuberculosis
uccccagcacggugaug

SEQ ID NO: 2880946 - RNA, 15 nt, Mycobacterium avium subsp. paratuberculosis
uccccagcggcacga

SEQ ID NO: 2880947 - RNA, 18 nt, Mycobacterium avium subsp. paratuberculosis
uccccagcugggccgcca

SEQ ID NO: 2880948 - RNA, 16 nt, Mycobacterium avium subsp. paratuberculosis
uccccauccgcggcca

SEQ ID NO: 2880949 - RNA, 20 nt, Mycobacterium avium subsp. paratuberculosis
uccccauccgcggccaccgg

SEQ ID NO: 2880950 - RNA, 23 nt, Mycobacterium avium subsp. paratuberculosis
uccccauccgcggccaccgggac

SEQ ID NO: 2880951 - RNA, 17 nt, Mycobacterium avium subsp. paratuberculosis
uccccaucucgagcagg

SEQ ID NO: 2880952 - RNA, 18 nt, Mycobacterium avium subsp. paratuberculosis
ucccccaaaacccggcau

SEQ ID NO: 2880953 - RNA, 13 nt, Mycobacterium avium subsp. paratuberculosis
ucccccacccgca

SEQ ID NO: 2880954 - RNA, 16 nt, Mycobacterium avium subsp. paratuberculosis
ucccccacccgcacgg

SEQ ID NO: 2880955 - RNA, 19 nt, Mycobacterium avium subsp. paratuberculosis
uccccccauacacgggccg

SEQ ID NO: 2880956 - RNA, 15 nt, Mycobacterium avium subsp. paratuberculosis
uccccccgcgccgcc

SEQ ID NO: 2880957 - RNA, 16 nt, Mycobacterium avium subsp. paratuberculosis
uccccccgcgccgccc

SEQ ID NO: 2880958 - RNA, 13 nt, Mycobacterium avium subsp. paratuberculosis
ucccccgacccgc

SEQ ID NO: 2880959 - RNA, 15 nt, Mycobacterium avium subsp. paratuberculosis
ucccccgccgaccgg

SEQ ID NO: 2880960 - RNA, 20 nt, Mycobacterium avium subsp. paratuberculosis
ucccccgccgaccgguccgc

SEQ ID NO: 2880961 - RNA, 18 nt, Mycobacterium avium subsp. paratuberculosis
ucccccggaccugccggc

SEQ ID NO: 2880962 - RNA, 13 nt, Mycobacterium avium subsp. paratuberculosis
ucccccucggcgg

SEQ ID NO: 2880963 - RNA, 17 nt, Mycobacterium avium subsp. paratuberculosis
ucccccuugccggugaa

SEQ ID NO: 2880964 - RNA, 17 nt, Mycobacterium avium subsp. paratuberculosis
uccccgaccacaccggc

SEQ ID NO: 2880965 - RNA, 20 nt, Mycobacterium avium subsp. paratuberculosis
uccccgaccacaccggcgcu

SEQ ID NO: 2880966 - RNA, 21 nt, Mycobacterium avium subsp. paratuberculosis
uccccgaccaucauggccucc

SEQ ID NO: 2880967 - RNA, 19 nt, Mycobacterium avium subsp. paratuberculosis
uccccgcaaacacgagcag

SEQ ID NO: 2880968 - RNA, 16 nt, Mycobacterium avium subsp. paratuberculosis
uccccgccgccgugca

SEQ ID NO: 2880969 - RNA, 16 nt, Mycobacterium avium subsp. paratuberculosis
uccccgccggagauga

SEQ ID NO: 2880970 - RNA, 22 nt, Mycobacterium avium subsp. paratuberculosis
uccccgccgguggcggcgagga

SEQ ID NO: 2880971 - RNA, 20 nt, Mycobacterium avium subsp. paratuberculosis
uccccgcgcccgccgcguac

SEQ ID NO: 2880972 - RNA, 11 nt, Mycobacterium avium subsp. paratuberculosis
uccccgcgccg

SEQ ID NO: 2880973 - RNA, 16 nt, Mycobacterium avium subsp. paratuberculosis
uccccgcgccgggcaa

SEQ ID NO: 2880974 - RNA, 15 nt, Mycobacterium avium subsp. paratuberculosis
uccccgcgcggcucg

SEQ ID NO: 2880975 - RNA, 18 nt, Mycobacterium avium subsp. paratuberculosis
uccccgcgggugacgcug

SEQ ID NO: 2880976 - RNA, 15 nt, Mycobacterium avium subsp. paratuberculosis
uccccgcggugccgc

SEQ ID NO: 2880977 - RNA, 18 nt, Mycobacterium avium subsp. paratuberculosis
uccccgcggugccgcagc

SEQ ID NO: 2880978 - RNA, 16 nt, Mycobacterium avium subsp. paratuberculosis
uccccgcguuggccag

SEQ ID NO: 2880979 - RNA, 18 nt, Mycobacterium avium subsp. paratuberculosis
uccccgcuagccucaacg

SEQ ID NO: 2880980 - RNA, 15 nt, Mycobacterium avium subsp. paratuberculosis
uccccggacagccac

SEQ ID NO: 2880981 - RNA, 15 nt, Mycobacterium avium subsp. paratuberculosis
uccccggccagcacg

SEQ ID NO: 2880982 - RNA, 21 nt, Mycobacterium avium subsp. paratuberculosis
uccccggccggcccgcccggc

SEQ ID NO: 2880983 - RNA, 22 nt, Mycobacterium avium subsp. paratuberculosis
uccccggcgaccacccucacca

SEQ ID NO: 2880984 - RNA, 13 nt, Mycobacterium avium subsp. paratuberculosis
uccccggcggccg

SEQ ID NO: 2880985 - RNA, 21 nt, Mycobacterium avium subsp. paratuberculosis
uccccggcggccggccccggc

SEQ ID NO: 2880986 - RNA, 22 nt, Mycobacterium avium subsp. paratuberculosis
uccccggcgggcucgccggccc

SEQ ID NO: 2880987 - RNA, 14 nt, Mycobacterium avium subsp. paratuberculosis
uccccggcgugggu

SEQ ID NO: 2880988 - RNA, 16 nt, Mycobacterium avium subsp. paratuberculosis
uccccggcgugucgcg

SEQ ID NO: 2880989 - RNA, 16 nt, Mycobacterium avium subsp. paratuberculosis
uccccgggcccagcac

SEQ ID NO: 2880990 - RNA, 22 nt, Mycobacterium avium subsp. paratuberculosis
uccccgggcccagcaccaccac

SEQ ID NO: 2880991 - RNA, 17 nt, Mycobacterium avium subsp. paratuberculosis
uccccgggcgagcgucg

SEQ ID NO: 2880992 - RNA, 21 nt, Mycobacterium avium subsp. paratuberculosis
uccccgggcgugccggacacc

SEQ ID NO: 2880993 - RNA, 18 nt, Mycobacterium avium subsp. paratuberculosis
uccccgguugucgcucag

SEQ ID NO: 2880994 - RNA, 14 nt, Mycobacterium avium subsp. paratuberculosis
uccccguccagccc

SEQ ID NO: 2880995 - RNA, 22 nt, Mycobacterium avium subsp. paratuberculosis
uccccgugcagccgggccugca

SEQ ID NO: 2880996 - RNA, 22 nt, Mycobacterium avium subsp. paratuberculosis
uccccgugcggggccucgucgc

SEQ ID NO: 2880997 - RNA, 20 nt, Mycobacterium avium subsp. paratuberculosis
uccccguugaucuugaccgu

SEQ ID NO: 2880998 - RNA, 12 nt, Mycobacterium avium subsp. paratuberculosis
uccccuuuggcg

SEQ ID NO: 2880999 - RNA, 14 nt, Mycobacterium avium subsp. paratuberculosis
ucccgaacagggcg

SEQ ID NO: 2881000 - RNA, 21 nt, Mycobacterium avium subsp. paratuberculosis
ucccgaacagggcgacggcgg

SEQ ID NO: 2881001 - RNA, 23 nt, Mycobacterium avium subsp. paratuberculosis
ucccgaacagggcgacggcggcg

SEQ ID NO: 2881002 - RNA, 18 nt, Mycobacterium avium subsp. paratuberculosis
ucccgacagcucgcgcug

SEQ ID NO: 2881003 - RNA, 19 nt, Mycobacterium avium subsp. paratuberculosis
ucccgacagggagccgacg

SEQ ID NO: 2881004 - RNA, 13 nt, Mycobacterium avium subsp. paratuberculosis
ucccgaccagcug

SEQ ID NO: 2881005 - RNA, 14 nt, Mycobacterium avium subsp. paratuberculosis
ucccgaccccgcca

SEQ ID NO: 2881006 - RNA, 17 nt, Mycobacterium avium subsp. paratuberculosis
ucccgaccccgccagca

SEQ ID NO: 2881007 - RNA, 19 nt, Mycobacterium avium subsp. paratuberculosis
ucccgaccccgccagcacc

SEQ ID NO: 2881008 - RNA, 12 nt, Mycobacterium avium subsp. paratuberculosis
ucccgacgcggc

SEQ ID NO: 2881009 - RNA, 13 nt, Mycobacterium avium subsp. paratuberculosis
ucccgacgcggcg

SEQ ID NO: 2881010 - RNA, 15 nt, Mycobacterium avium subsp. paratuberculosis
ucccgacgcggcgcg

SEQ ID NO: 2881011 - RNA, 20 nt, Mycobacterium avium subsp. paratuberculosis
ucccgacgcggcgcgacacc

SEQ ID NO: 2881012 - RNA, 23 nt, Mycobacterium avium subsp. paratuberculosis
ucccgacgcugacgaugcggccg

SEQ ID NO: 2881013 - RNA, 16 nt, Mycobacterium avium subsp. paratuberculosis
ucccgacuccucacac

SEQ ID NO: 2881014 - RNA, 18 nt, Mycobacterium avium subsp. paratuberculosis
ucccgagcaucgccgagc

SEQ ID NO: 2881015 - RNA, 15 nt, Mycobacterium avium subsp. paratuberculosis
ucccgaggaugccgc

SEQ ID NO: 2881016 - RNA, 18 nt, Mycobacterium avium subsp. paratuberculosis
ucccgaggaugccgccca

SEQ ID NO: 2881017 - RNA, 20 nt, Mycobacterium avium subsp. paratuberculosis
ucccgaggaugccgcccacc

SEQ ID NO: 2881018 - RNA, 14 nt, Mycobacterium avium subsp. paratuberculosis
ucccgaguggcgcc

SEQ ID NO: 2881019 - RNA, 15 nt, Mycobacterium avium subsp. paratuberculosis
ucccgaguggcgccg

SEQ ID NO: 2881020 - RNA, 17 nt, Mycobacterium avium subsp. paratuberculosis
ucccgaguggcgccguc

SEQ ID NO: 2881021 - RNA, 18 nt, Mycobacterium avium subsp. paratuberculosis
ucccgagugggaccgucg

SEQ ID NO: 2881022 - RNA, 16 nt, Mycobacterium avium subsp. paratuberculosis
ucccgaugccgcgcag

SEQ ID NO: 2881023 - RNA, 14 nt, Mycobacterium avium subsp. paratuberculosis
ucccgaugcggacg

SEQ ID NO: 2881024 - RNA, 14 nt, Mycobacterium avium subsp. paratuberculosis
ucccgaugucggcg

SEQ ID NO: 2881025 - RNA, 15 nt, Mycobacterium avium subsp. paratuberculosis
ucccgaugucggcga

SEQ ID NO: 2881026 - RNA, 20 nt, Mycobacterium avium subsp. paratuberculosis
ucccgcaauugcgccagcag

SEQ ID NO: 2881027 - RNA, 21 nt, Mycobacterium avium subsp. paratuberculosis
ucccgcaauugcgccagcagc

SEQ ID NO: 2881028 - RNA, 22 nt, Mycobacterium avium subsp. paratuberculosis
ucccgcaauugcgccagcagca

SEQ ID NO: 2881029 - RNA, 17 nt, Mycobacterium avium subsp. paratuberculosis
ucccgcaccgccccgca

SEQ ID NO: 2881030 - RNA, 13 nt, Mycobacterium avium subsp. paratuberculosis
ucccgcagccgcg

SEQ ID NO: 2881031 - RNA, 14 nt, Mycobacterium avium subsp. paratuberculosis
ucccgcagccgcga

SEQ ID NO: 2881032 - RNA, 22 nt, Mycobacterium avium subsp. paratuberculosis
ucccgcagcgccagcgcgcccg

SEQ ID NO: 2881033 - RNA, 16 nt, Mycobacterium avium subsp. paratuberculosis
ucccgcccggcgccgg

SEQ ID NO: 2881034 - RNA, 17 nt, Mycobacterium avium subsp. paratuberculosis
ucccgcccggcgccggc

SEQ ID NO: 2881035 - RNA, 18 nt, Mycobacterium avium subsp. paratuberculosis
ucccgcccggcgccggcc

SEQ ID NO: 2881036 - RNA, 19 nt, Mycobacterium avium subsp. paratuberculosis
ucccgcccggcgccggccg

SEQ ID NO: 2881037 - RNA, 20 nt, Mycobacterium avium subsp. paratuberculosis
ucccgcccggcgccggccga

SEQ ID NO: 2881038 - RNA, 22 nt, Mycobacterium avium subsp. paratuberculosis
ucccgcccucaggcguccagca

SEQ ID NO: 2881039 - RNA, 15 nt, Mycobacterium avium subsp. paratuberculosis
ucccgccgaacccgc

SEQ ID NO: 2881040 - RNA, 17 nt, Mycobacterium avium subsp. paratuberculosis
ucccgccgaacccgccc

SEQ ID NO: 2881041 - RNA, 18 nt, Mycobacterium avium subsp. paratuberculosis
ucccgccgagauccaccg

SEQ ID NO: 2881042 - RNA, 23 nt, Mycobacterium avium subsp. paratuberculosis
ucccgccgagauccaccgcgcgg

SEQ ID NO: 2881043 - RNA, 14 nt, Mycobacterium avium subsp. paratuberculosis
ucccgccgccgaac

SEQ ID NO: 2881044 - RNA, 14 nt, Mycobacterium avium subsp. paratuberculosis
ucccgccgccgucg

SEQ ID NO: 2881045 - RNA, 21 nt, Mycobacterium avium subsp. paratuberculosis
ucccgccgccgucgguguagc

SEQ ID NO: 2881046 - RNA, 16 nt, Mycobacterium avium subsp. paratuberculosis
ucccgccggcgaucga

SEQ ID NO: 2881047 - RNA, 17 nt, Mycobacterium avium subsp. paratuberculosis
ucccgccggcgaucgac

SEQ ID NO: 2881048 - RNA, 21 nt, Mycobacterium avium subsp. paratuberculosis
ucccgccggcgaucgacguca

SEQ ID NO: 2881049 - RNA, 21 nt, Mycobacterium avium subsp. paratuberculosis
ucccgcgccgcggccagcgcc

SEQ ID NO: 2881050 - RNA, 18 nt, Mycobacterium avium subsp. paratuberculosis
ucccgcgcgcuguccucg

SEQ ID NO: 2881051 - RNA, 16 nt, Mycobacterium avium subsp. paratuberculosis
ucccgcgcggcgcagg

SEQ ID NO: 2881052 - RNA, 23 nt, Mycobacterium avium subsp. paratuberculosis
ucccgcgcggcgcagggcggccg

SEQ ID NO: 2881053 - RNA, 19 nt, Mycobacterium avium subsp. paratuberculosis
ucccgcgcgggggccgccg

SEQ ID NO: 2881054 - RNA, 18 nt, Mycobacterium avium subsp. paratuberculosis
ucccgcggcagccgggcg

SEQ ID NO: 2881055 - RNA, 15 nt, Mycobacterium avium subsp. paratuberculosis
ucccgcggcggcgcc

SEQ ID NO: 2881056 - RNA, 15 nt, Mycobacterium avium subsp. paratuberculosis
ucccgcgggucgcgg

SEQ ID NO: 2881057 - RNA, 19 nt, Mycobacterium avium subsp. paratuberculosis
ucccgcguauugcacggcg

SEQ ID NO: 2881058 - RNA, 17 nt, Mycobacterium avium subsp. paratuberculosis
ucccgcguggccgccag

SEQ ID NO: 2881059 - RNA, 18 nt, Mycobacterium avium subsp. paratuberculosis
ucccgcuccauggcggcg

SEQ ID NO: 2881060 - RNA, 20 nt, Mycobacterium avium subsp. paratuberculosis
ucccgcuuggcggucugcgc

SEQ ID NO: 2881061 - RNA, 14 nt, Mycobacterium avium subsp. paratuberculosis
ucccggacgcugcg

SEQ ID NO: 2881062 - RNA, 17 nt, Mycobacterium avium subsp. paratuberculosis
ucccggacuccucggug

SEQ ID NO: 2881063 - RNA, 18 nt, Mycobacterium avium subsp. paratuberculosis
ucccggagaacaucagcc

SEQ ID NO: 2881064 - RNA, 14 nt, Mycobacterium avium subsp. paratuberculosis
ucccggagccgucg

SEQ ID NO: 2881065 - RNA, 15 nt, Mycobacterium avium subsp. paratuberculosis
ucccggagccgucgg

SEQ ID NO: 2881066 - RNA, 19 nt, Mycobacterium avium subsp. paratuberculosis
ucccggcaacaccggcggc

SEQ ID NO: 2881067 - RNA, 20 nt, Mycobacterium avium subsp. paratuberculosis
ucccggcaacaccggcggcg

SEQ ID NO: 2881068 - RNA, 13 nt, Mycobacterium avium subsp. paratuberculosis
ucccggcaccacc

SEQ ID NO: 2881069 - RNA, 20 nt, Mycobacterium avium subsp. paratuberculosis
ucccggcaccaccacccccg

SEQ ID NO: 2881070 - RNA, 22 nt, Mycobacterium avium subsp. paratuberculosis
ucccggcagaacgacgccaguu

SEQ ID NO: 2881071 - RNA, 17 nt, Mycobacterium avium subsp. paratuberculosis
ucccggcagaucgcggc

SEQ ID NO: 2881072 - RNA, 19 nt, Mycobacterium avium subsp. paratuberculosis
ucccggcagaucgcggccc

SEQ ID NO: 2881073 - RNA, 21 nt, Mycobacterium avium subsp. paratuberculosis
ucccggcagaucgcggcccgc

SEQ ID NO: 2881074 - RNA, 13 nt, Mycobacterium avium subsp. paratuberculosis
ucccggccacccc

SEQ ID NO: 2881075 - RNA, 23 nt, Mycobacterium avium subsp. paratuberculosis
ucccggccaccccgcagaacacc

SEQ ID NO: 2881076 - RNA, 14 nt, Mycobacterium avium subsp. paratuberculosis
ucccggccacgucg

SEQ ID NO: 2881077 - RNA, 19 nt, Mycobacterium avium subsp. paratuberculosis
ucccggccacgucgaugcc

SEQ ID NO: 2881078 - RNA, 16 nt, Mycobacterium avium subsp. paratuberculosis
ucccggccagcacccg

SEQ ID NO: 2881079 - RNA, 19 nt, Mycobacterium avium subsp. paratuberculosis
ucccggccagcacccgcug

SEQ ID NO: 2881080 - RNA, 13 nt, Mycobacterium avium subsp. paratuberculosis
ucccggcccaugg

SEQ ID NO: 2881081 - RNA, 19 nt, Mycobacterium avium subsp. paratuberculosis
ucccggcccauggcgaaca

SEQ ID NO: 2881082 - RNA, 13 nt, Mycobacterium avium subsp. paratuberculosis
ucccggccgacga

SEQ ID NO: 2881083 - RNA, 14 nt, Mycobacterium avium subsp. paratuberculosis
ucccggccgacgau

SEQ ID NO: 2881084 - RNA, 16 nt, Mycobacterium avium subsp. paratuberculosis
ucccggccgccaaauc

SEQ ID NO: 2881085 - RNA, 13 nt, Mycobacterium avium subsp. paratuberculosis
ucccggccgccgg

SEQ ID NO: 2881086 - RNA, 18 nt, Mycobacterium avium subsp. paratuberculosis
ucccggccgcgacagccg

SEQ ID NO: 2881087 - RNA, 15 nt, Mycobacterium avium subsp. paratuberculosis
ucccggcgagcacgc

SEQ ID NO: 2881088 - RNA, 13 nt, Mycobacterium avium subsp. paratuberculosis
ucccggcgcacca

SEQ ID NO: 2881089 - RNA, 21 nt, Mycobacterium avium subsp. paratuberculosis
ucccggcgccacgccgcgauc

SEQ ID NO: 2881090 - RNA, 13 nt, Mycobacterium avium subsp. paratuberculosis
ucccggcgccgcc

SEQ ID NO: 2881091 - RNA, 23 nt, Mycobacterium avium subsp. paratuberculosis
ucccggcggacccggaggcggcg

SEQ ID NO: 2881092 - RNA, 16 nt, Mycobacterium avium subsp. paratuberculosis
ucccggcggucgccga

SEQ ID NO: 2881093 - RNA, 22 nt, Mycobacterium avium subsp. paratuberculosis
ucccgggacagcccgaacagcu

SEQ ID NO: 2881094 - RNA, 21 nt, Mycobacterium avium subsp. paratuberculosis
ucccgggcccgcugcagcgcc

SEQ ID NO: 2881095 - RNA, 14 nt, Mycobacterium avium subsp. paratuberculosis
ucccgggcgaacgu

SEQ ID NO: 2881096 - RNA, 16 nt, Mycobacterium avium subsp. paratuberculosis
ucccgggcgaacgucg

SEQ ID NO: 2881097 - RNA, 13 nt, Mycobacterium avium subsp. paratuberculosis
ucccgggcgauca

SEQ ID NO: 2881098 - RNA, 22 nt, Mycobacterium avium subsp. paratuberculosis
ucccgggcgaucagcccgccca

SEQ ID NO: 2881099 - RNA, 23 nt, Mycobacterium avium subsp. paratuberculosis
ucccgggcggucgcgucgucggc

SEQ ID NO: 2881100 - RNA, 15 nt, Mycobacterium avium subsp. paratuberculosis
ucccggggacaccgg

SEQ ID NO: 2881101 - RNA, 16 nt, Mycobacterium avium subsp. paratuberculosis
ucccggggcgcgcugg

SEQ ID NO: 2881102 - RNA, 22 nt, Mycobacterium avium subsp. paratuberculosis
ucccggggcucgacaggcagcc

SEQ ID NO: 2881103 - RNA, 15 nt, Mycobacterium avium subsp. paratuberculosis
ucccgggggaagccc

SEQ ID NO: 2881104 - RNA, 23 nt, Mycobacterium avium subsp. paratuberculosis
ucccggguaccucugcgcgagca

SEQ ID NO: 2881105 - RNA, 20 nt, Mycobacterium avium subsp. paratuberculosis
ucccgggugggcagcgcgau

SEQ ID NO: 2881106 - RNA, 21 nt, Mycobacterium avium subsp. paratuberculosis
ucccgguacggcucaacggcc

SEQ ID NO: 2881107 - RNA, 17 nt, Mycobacterium avium subsp. paratuberculosis
ucccgguagagcggcac

SEQ ID NO: 2881108 - RNA, 20 nt, Mycobacterium avium subsp. paratuberculosis
ucccgguagaucgccggauc

SEQ ID NO: 2881109 - RNA, 21 nt, Mycobacterium avium subsp. paratuberculosis
ucccggucagcccccaccgcg

SEQ ID NO: 2881110 - RNA, 18 nt, Mycobacterium avium subsp. paratuberculosis
ucccgguccacggugucg

SEQ ID NO: 2881111 - RNA, 21 nt, Mycobacterium avium subsp. paratuberculosis
ucccgguccacggugucgcug

SEQ ID NO: 2881112 - RNA, 20 nt, Mycobacterium avium subsp. paratuberculosis
ucccggugaugccggcaucc

SEQ ID NO: 2881113 - RNA, 14 nt, Mycobacterium avium subsp. paratuberculosis
ucccggugccgcug

SEQ ID NO: 2881114 - RNA, 15 nt, Mycobacterium avium subsp. paratuberculosis
ucccggugucgccgu

SEQ ID NO: 2881115 - RNA, 17 nt, Mycobacterium avium subsp. paratuberculosis
ucccggugucgccgucg

SEQ ID NO: 2881116 - RNA, 18 nt, Mycobacterium avium subsp. paratuberculosis
ucccgguucccggcacca

SEQ ID NO: 2881117 - RNA, 15 nt, Mycobacterium avium subsp. paratuberculosis
ucccgguugaccccg

SEQ ID NO: 2881118 - RNA, 18 nt, Mycobacterium avium subsp. paratuberculosis
ucccgguugaccccggcc

SEQ ID NO: 2881119 - RNA, 20 nt, Mycobacterium avium subsp. paratuberculosis
ucccguacucgaugccguug

SEQ ID NO: 2881120 - RNA, 14 nt, Mycobacterium avium subsp. paratuberculosis
ucccguagccguag

SEQ ID NO: 2881121 - RNA, 20 nt, Mycobacterium avium subsp. paratuberculosis
ucccgucacggcugccgacc

SEQ ID NO: 2881122 - RNA, 14 nt, Mycobacterium avium subsp. paratuberculosis
ucccgucaggucgc

SEQ ID NO: 2881123 - RNA, 19 nt, Mycobacterium avium subsp. paratuberculosis
ucccguccaucgccgcgca

SEQ ID NO: 2881124 - RNA, 14 nt, Mycobacterium avium subsp. paratuberculosis
ucccguccugggcc

SEQ ID NO: 2881125 - RNA, 16 nt, Mycobacterium avium subsp. paratuberculosis
ucccguccugggccug

SEQ ID NO: 2881126 - RNA, 24 nt, Mycobacterium avium subsp. paratuberculosis
ucccgucgaccaggacgucggccg

SEQ ID NO: 2881127 - RNA, 15 nt, Mycobacterium avium subsp. paratuberculosis
ucccgucgcgacgag

SEQ ID NO: 2881128 - RNA, 20 nt, Mycobacterium avium subsp. paratuberculosis
ucccgucgcgacgagcgggc

SEQ ID NO: 2881129 - RNA, 15 nt, Mycobacterium avium subsp. paratuberculosis
ucccgucggccauca

SEQ ID NO: 2881130 - RNA, 16 nt, Mycobacterium avium subsp. paratuberculosis
ucccgucggccaucag

SEQ ID NO: 2881131 - RNA, 18 nt, Mycobacterium avium subsp. paratuberculosis
ucccgucggccaucagcc

SEQ ID NO: 2881132 - RNA, 19 nt, Mycobacterium avium subsp. paratuberculosis
ucccgucggccaucagccg

SEQ ID NO: 2881133 - RNA, 20 nt, Mycobacterium avium subsp. paratuberculosis
ucccgucggccaucagccgc

SEQ ID NO: 2881134 - RNA, 21 nt, Mycobacterium avium subsp. paratuberculosis
ucccgucggccaucagccgcc

SEQ ID NO: 2881135 - RNA, 21 nt, Mycobacterium avium subsp. paratuberculosis
ucccgucgucggcgccgcgcc

SEQ ID NO: 2881136 - RNA, 22 nt, Mycobacterium avium subsp. paratuberculosis
ucccgucgucggcgccgcgccg

SEQ ID NO: 2881137 - RNA, 12 nt, Mycobacterium avium subsp. paratuberculosis
ucccgucguuga

SEQ ID NO: 2881138 - RNA, 17 nt, Mycobacterium avium subsp. paratuberculosis
ucccgugcgccgcccac

SEQ ID NO: 2881139 - RNA, 21 nt, Mycobacterium avium subsp. paratuberculosis
ucccgugcgccgcccacaccg

SEQ ID NO: 2881140 - RNA, 20 nt, Mycobacterium avium subsp. paratuberculosis
ucccguugcgccgcaacggc

SEQ ID NO: 2881141 - RNA, 12 nt, Mycobacterium avium subsp. paratuberculosis
ucccguugcggu

SEQ ID NO: 2881142 - RNA, 14 nt, Mycobacterium avium subsp. paratuberculosis
ucccguuggcgccg

SEQ ID NO: 2881143 - RNA, 13 nt, Mycobacterium avium subsp. paratuberculosis
ucccguuggucuc

SEQ ID NO: 2881144 - RNA, 21 nt, Mycobacterium avium subsp. paratuberculosis
ucccuagcgugccguccagcu

SEQ ID NO: 2881145 - RNA, 17 nt, Mycobacterium avium subsp. paratuberculosis
ucccugcgcggcgaugc

SEQ ID NO: 2881146 - RNA, 13 nt, Mycobacterium avium subsp. paratuberculosis
ucccugcggcugc

SEQ ID NO: 2881147 - RNA, 21 nt, Mycobacterium avium subsp. paratuberculosis
ucccugcggcugcaucaugcc

SEQ ID NO: 2881148 - RNA, 21 nt, Mycobacterium avium subsp. paratuberculosis
ucccugcucgucgacgcugac

SEQ ID NO: 2881149 - RNA, 15 nt, Mycobacterium avium subsp. paratuberculosis
ucccuggugaccgac

SEQ ID NO: 2881150 - RNA, 22 nt, Mycobacterium avium subsp. paratuberculosis
ucccuguuagggcgaccaccac

SEQ ID NO: 2881151 - RNA, 17 nt, Mycobacterium avium subsp. paratuberculosis
ucccuguucgcgccggu

SEQ ID NO: 2881152 - RNA, 16 nt, Mycobacterium avium subsp. paratuberculosis
ucccuugccgccgaaa

SEQ ID NO: 2881153 - RNA, 16 nt, Mycobacterium avium subsp. paratuberculosis
uccgaaaaacgcgucg

SEQ ID NO: 2881154 - RNA, 19 nt, Mycobacterium avium subsp. paratuberculosis
uccgaaaaacgcgucgcgu

SEQ ID NO: 2881155 - RNA, 19 nt, Mycobacterium avium subsp. paratuberculosis
uccgaacgugcagcuuccg

SEQ ID NO: 2881156 - RNA, 15 nt, Mycobacterium avium subsp. paratuberculosis
uccgaauacgccauc

SEQ ID NO: 2881157 - RNA, 15 nt, Mycobacterium avium subsp. paratuberculosis
uccgaauccagcgcg

SEQ ID NO: 2881158 - RNA, 18 nt, Mycobacterium avium subsp. paratuberculosis
uccgaauccagcgcgccg

SEQ ID NO: 2881159 - RNA, 20 nt, Mycobacterium avium subsp. paratuberculosis
uccgaauccagcgcgccgcu

SEQ ID NO: 2881160 - RNA, 12 nt, Mycobacterium avium subsp. paratuberculosis
uccgacaccacc

SEQ ID NO: 2881161 - RNA, 13 nt, Mycobacterium avium subsp. paratuberculosis
uccgacaccaccu

SEQ ID NO: 2881162 - RNA, 15 nt, Mycobacterium avium subsp. paratuberculosis
uccgacagcccccgc

SEQ ID NO: 2881163 - RNA, 16 nt, Mycobacterium avium subsp. paratuberculosis
uccgacagcccgccca

SEQ ID NO: 2881164 - RNA, 13 nt, Mycobacterium avium subsp. paratuberculosis
uccgacagccgca

SEQ ID NO: 2881165 - RNA, 22 nt, Mycobacterium avium subsp. paratuberculosis
uccgacagccgcaccggcgccg

SEQ ID NO: 2881166 - RNA, 13 nt, Mycobacterium avium subsp. paratuberculosis
uccgacagcgccu

SEQ ID NO: 2881167 - RNA, 14 nt, Mycobacterium avium subsp. paratuberculosis
uccgacagcgccug

SEQ ID NO: 2881168 - RNA, 12 nt, Mycobacterium avium subsp. paratuberculosis
uccgaccagcac

SEQ ID NO: 2881169 - RNA, 20 nt, Mycobacterium avium subsp. paratuberculosis
uccgaccagcacccgggccu

SEQ ID NO: 2881170 - RNA, 14 nt, Mycobacterium avium subsp. paratuberculosis
uccgaccagccggu

SEQ ID NO: 2881171 - RNA, 19 nt, Mycobacterium avium subsp. paratuberculosis
uccgaccgccaccacccgg

SEQ ID NO: 2881172 - RNA, 20 nt, Mycobacterium avium subsp. paratuberculosis
uccgaccgccaccacccggc

SEQ ID NO: 2881173 - RNA, 22 nt, Mycobacterium avium subsp. paratuberculosis
uccgaccgugaagcuaguuuca

SEQ ID NO: 2881174 - RNA, 23 nt, Mycobacterium avium subsp. paratuberculosis
uccgaccgugaagcuaguuucac

SEQ ID NO: 2881175 - RNA, 17 nt, Mycobacterium avium subsp. paratuberculosis
uccgaccguugaccgac

SEQ ID NO: 2881176 - RNA, 18 nt, Mycobacterium avium subsp. paratuberculosis
uccgaccguugaccgacg

SEQ ID NO: 2881177 - RNA, 16 nt, Mycobacterium avium subsp. paratuberculosis
uccgacgagucgacgc

SEQ ID NO: 2881178 - RNA, 18 nt, Mycobacterium avium subsp. paratuberculosis
uccgacgagucgacgcug

SEQ ID NO: 2881179 - RNA, 15 nt, Mycobacterium avium subsp. paratuberculosis
uccgacgcgguggcg

SEQ ID NO: 2881180 - RNA, 18 nt, Mycobacterium avium subsp. paratuberculosis
uccgacgcgguggcgugc

SEQ ID NO: 2881181 - RNA, 23 nt, Mycobacterium avium subsp. paratuberculosis
uccgacgcgguggcgugcucgau

SEQ ID NO: 2881182 - RNA, 13 nt, Mycobacterium avium subsp. paratuberculosis
uccgacggcuggg

SEQ ID NO: 2881183 - RNA, 16 nt, Mycobacterium avium subsp. paratuberculosis
uccgacggcugggugg

SEQ ID NO: 2881184 - RNA, 17 nt, Mycobacterium avium subsp. paratuberculosis
uccgacuuacggcguga

SEQ ID NO: 2881185 - RNA, 17 nt, Mycobacterium avium subsp. paratuberculosis
uccgagauggacagcac

SEQ ID NO: 2881186 - RNA, 23 nt, Mycobacterium avium subsp. paratuberculosis
uccgagcagcagccgcagcggcg

SEQ ID NO: 2881187 - RNA, 21 nt, Mycobacterium avium subsp. paratuberculosis
uccgagcaucggguugccggc

SEQ ID NO: 2881188 - RNA, 12 nt, Mycobacterium avium subsp. paratuberculosis
uccgagccgccc

SEQ ID NO: 2881189 - RNA, 13 nt, Mycobacterium avium subsp. paratuberculosis
uccgagccgccca

SEQ ID NO: 2881190 - RNA, 21 nt, Mycobacterium avium subsp. paratuberculosis
uccgagccggugaugacgucg

SEQ ID NO: 2881191 - RNA, 22 nt, Mycobacterium avium subsp. paratuberculosis
uccgagcgcugcccgugccgca

SEQ ID NO: 2881192 - RNA, 23 nt, Mycobacterium avium subsp. paratuberculosis
uccgagcggcgcaggccggucac

SEQ ID NO: 2881193 - RNA, 18 nt, Mycobacterium avium subsp. paratuberculosis
uccgaggccccgccagau

SEQ ID NO: 2881194 - RNA, 14 nt, Mycobacterium avium subsp. paratuberculosis
uccgaggccgcuga

SEQ ID NO: 2881195 - RNA, 24 nt, Mycobacterium avium subsp. paratuberculosis
uccgaggcgguuccgguggcgcga

SEQ ID NO: 2881196 - RNA, 21 nt, Mycobacterium avium subsp. paratuberculosis
uccgaggcgucagggguuggc

SEQ ID NO: 2881197 - RNA, 18 nt, Mycobacterium avium subsp. paratuberculosis
uccgaggcguccuccucg

SEQ ID NO: 2881198 - RNA, 21 nt, Mycobacterium avium subsp. paratuberculosis
uccgaggcguccuccucgucc

SEQ ID NO: 2881199 - RNA, 13 nt, Mycobacterium avium subsp. paratuberculosis
uccgaggucagcg

SEQ ID NO: 2881200 - RNA, 15 nt, Mycobacterium avium subsp. paratuberculosis
uccgagucggcgucg

SEQ ID NO: 2881201 - RNA, 23 nt, Mycobacterium avium subsp. paratuberculosis
uccgaguugauaggucacgccgg

SEQ ID NO: 2881202 - RNA, 17 nt, Mycobacterium avium subsp. paratuberculosis
uccgaguuggccggcac

SEQ ID NO: 2881203 - RNA, 13 nt, Mycobacterium avium subsp. paratuberculosis
uccgaucagcagc

SEQ ID NO: 2881204 - RNA, 18 nt, Mycobacterium avium subsp. paratuberculosis
uccgaucgcggcccccug

SEQ ID NO: 2881205 - RNA, 18 nt, Mycobacterium avium subsp. paratuberculosis
uccgaucguccggcgcca

SEQ ID NO: 2881206 - RNA, 20 nt, Mycobacterium avium subsp. paratuberculosis
uccgaugaagaacaccccga

SEQ ID NO: 2881207 - RNA, 13 nt, Mycobacterium avium subsp. paratuberculosis
uccgauugcggcg

SEQ ID NO: 2881208 - RNA, 15 nt, Mycobacterium avium subsp. paratuberculosis
uccgauugcggcgca

SEQ ID NO: 2881209 - RNA, 13 nt, Mycobacterium avium subsp. paratuberculosis
uccgcaaccgccg

SEQ ID NO: 2881210 - RNA, 14 nt, Mycobacterium avium subsp. paratuberculosis
uccgcaacgccggc

SEQ ID NO: 2881211 - RNA, 15 nt, Mycobacterium avium subsp. paratuberculosis
uccgcaacgcggcgg

SEQ ID NO: 2881212 - RNA, 16 nt, Mycobacterium avium subsp. paratuberculosis
uccgcaacgcggcggu

SEQ ID NO: 2881213 - RNA, 17 nt, Mycobacterium avium subsp. paratuberculosis
uccgcaacgugcgccgg

SEQ ID NO: 2881214 - RNA, 18 nt, Mycobacterium avium subsp. paratuberculosis
uccgcaacgugcgccggc

SEQ ID NO: 2881215 - RNA, 13 nt, Mycobacterium avium subsp. paratuberculosis
uccgcaccgcgac

SEQ ID NO: 2881216 - RNA, 14 nt, Mycobacterium avium subsp. paratuberculosis
uccgcaccgggcag

SEQ ID NO: 2881217 - RNA, 19 nt, Mycobacterium avium subsp. paratuberculosis
uccgcagauagaucgacgc

SEQ ID NO: 2881218 - RNA, 16 nt, Mycobacterium avium subsp. paratuberculosis
uccgcagccgcugccg

SEQ ID NO: 2881219 - RNA, 21 nt, Mycobacterium avium subsp. paratuberculosis
uccgcagcugaucggggccca

SEQ ID NO: 2881220 - RNA, 20 nt, Mycobacterium avium subsp. paratuberculosis
uccgcaggccgucgccgguc

SEQ ID NO: 2881221 - RNA, 16 nt, Mycobacterium avium subsp. paratuberculosis
uccgcaugucgaagaa

SEQ ID NO: 2881222 - RNA, 19 nt, Mycobacterium avium subsp. paratuberculosis
uccgccacccugcgcaccg

SEQ ID NO: 2881223 - RNA, 20 nt, Mycobacterium avium subsp. paratuberculosis
uccgccaccuccuccggucc

SEQ ID NO: 2881224 - RNA, 21 nt, Mycobacterium avium subsp. paratuberculosis
uccgccaccuccuccgguccg

SEQ ID NO: 2881225 - RNA, 15 nt, Mycobacterium avium subsp. paratuberculosis
uccgccacggcgggg

SEQ ID NO: 2881226 - RNA, 23 nt, Mycobacterium avium subsp. paratuberculosis
uccgccagaucgccuggcagcug

SEQ ID NO: 2881227 - RNA, 18 nt, Mycobacterium avium subsp. paratuberculosis
uccgccagggugccgcug

SEQ ID NO: 2881228 - RNA, 21 nt, Mycobacterium avium subsp. paratuberculosis
uccgccagggugccgcugccc

SEQ ID NO: 2881229 - RNA, 18 nt, Mycobacterium avium subsp. paratuberculosis
uccgcccagacgcgggcg

SEQ ID NO: 2881230 - RNA, 18 nt, Mycobacterium avium subsp. paratuberculosis
uccgccccgagaucccag

SEQ ID NO: 2881231 - RNA, 19 nt, Mycobacterium avium subsp. paratuberculosis
uccgccccgagaucccagc

SEQ ID NO: 2881232 - RNA, 15 nt, Mycobacterium avium subsp. paratuberculosis
uccgccccgcugccg

SEQ ID NO: 2881233 - RNA, 14 nt, Mycobacterium avium subsp. paratuberculosis
uccgcccgccggug

SEQ ID NO: 2881234 - RNA, 14 nt, Mycobacterium avium subsp. paratuberculosis
uccgcccggcccgc

SEQ ID NO: 2881235 - RNA, 11 nt, Mycobacterium avium subsp. paratuberculosis
uccgcccggcg

SEQ ID NO: 2881236 - RNA, 15 nt, Mycobacterium avium subsp. paratuberculosis
uccgcccggcgagca

SEQ ID NO: 2881237 - RNA, 17 nt, Mycobacterium avium subsp. paratuberculosis
uccgccgaaccgaucac

SEQ ID NO: 2881238 - RNA, 16 nt, Mycobacterium avium subsp. paratuberculosis
uccgccgacagcggga

SEQ ID NO: 2881239 - RNA, 23 nt, Mycobacterium avium subsp. paratuberculosis
uccgccgacgauacgugcucccg

SEQ ID NO: 2881240 - RNA, 19 nt, Mycobacterium avium subsp. paratuberculosis
uccgccgagacggcguggc

SEQ ID NO: 2881241 - RNA, 19 nt, Mycobacterium avium subsp. paratuberculosis
uccgccgagucgcgccgcg

SEQ ID NO: 2881242 - RNA, 19 nt, Mycobacterium avium subsp. paratuberculosis
uccgccgcagcggcgccgc

SEQ ID NO: 2881243 - RNA, 15 nt, Mycobacterium avium subsp. paratuberculosis
uccgccgccagcgcc

SEQ ID NO: 2881244 - RNA, 14 nt, Mycobacterium avium subsp. paratuberculosis
uccgccgccggcgg

SEQ ID NO: 2881245 - RNA, 15 nt, Mycobacterium avium subsp. paratuberculosis
uccgccgccgggccu

SEQ ID NO: 2881246 - RNA, 23 nt, Mycobacterium avium subsp. paratuberculosis
uccgccgccgggccuguccagcc

SEQ ID NO: 2881247 - RNA, 12 nt, Mycobacterium avium subsp. paratuberculosis
uccgccgccguc

SEQ ID NO: 2881248 - RNA, 17 nt, Mycobacterium avium subsp. paratuberculosis
uccgccgccgucccacc

SEQ ID NO: 2881249 - RNA, 21 nt, Mycobacterium avium subsp. paratuberculosis
uccgccgcgcccgucgagcgu

SEQ ID NO: 2881250 - RNA, 22 nt, Mycobacterium avium subsp. paratuberculosis
uccgccggagacgacucuucca

SEQ ID NO: 2881251 - RNA, 23 nt, Mycobacterium avium subsp. paratuberculosis
uccgccggagacgacucuuccag

SEQ ID NO: 2881252 - RNA, 12 nt, Mycobacterium avium subsp. paratuberculosis
uccgccggcgaa

SEQ ID NO: 2881253 - RNA, 22 nt, Mycobacterium avium subsp. paratuberculosis
uccgccggcgaagcucgacgau

SEQ ID NO: 2881254 - RNA, 23 nt, Mycobacterium avium subsp. paratuberculosis
uccgccggcgaagcucgacgaug

SEQ ID NO: 2881255 - RNA, 15 nt, Mycobacterium avium subsp. paratuberculosis
uccgccggcggugcg

SEQ ID NO: 2881256 - RNA, 15 nt, Mycobacterium avium subsp. paratuberculosis
uccgccggcuggcgg

SEQ ID NO: 2881257 - RNA, 23 nt, Mycobacterium avium subsp. paratuberculosis
uccgccggcuggcgggcgaucgc

SEQ ID NO: 2881258 - RNA, 21 nt, Mycobacterium avium subsp. paratuberculosis
uccgccgggcggcagcacguc

SEQ ID NO: 2881259 - RNA, 15 nt, Mycobacterium avium subsp. paratuberculosis
uccgccgucgaccac

SEQ ID NO: 2881260 - RNA, 12 nt, Mycobacterium avium subsp. paratuberculosis
uccgccgucgag

SEQ ID NO: 2881261 - RNA, 13 nt, Mycobacterium avium subsp. paratuberculosis
uccgccgucgagu

SEQ ID NO: 2881262 - RNA, 13 nt, Mycobacterium avium subsp. paratuberculosis
uccgccgucgggg

SEQ ID NO: 2881263 - RNA, 18 nt, Mycobacterium avium subsp. paratuberculosis
uccgccuccgaccagccg

SEQ ID NO: 2881264 - RNA, 15 nt, Mycobacterium avium subsp. paratuberculosis
uccgccuucgacgau

SEQ ID NO: 2881265 - RNA, 16 nt, Mycobacterium avium subsp. paratuberculosis
uccgccuucgacgaug

SEQ ID NO: 2881266 - RNA, 20 nt, Mycobacterium avium subsp. paratuberculosis
uccgcgaaauugauagcuuc

SEQ ID NO: 2881267 - RNA, 21 nt, Mycobacterium avium subsp. paratuberculosis
uccgcgaacgggugcggcgcu

SEQ ID NO: 2881268 - RNA, 19 nt, Mycobacterium avium subsp. paratuberculosis
uccgcgacaaggucgaccg

SEQ ID NO: 2881269 - RNA, 21 nt, Mycobacterium avium subsp. paratuberculosis
uccgcgacaaggucgaccgcg

SEQ ID NO: 2881270 - RNA, 22 nt, Mycobacterium avium subsp. paratuberculosis
uccgcgacaaggucgaccgcgc

SEQ ID NO: 2881271 - RNA, 21 nt, Mycobacterium avium subsp. paratuberculosis
uccgcgacaucggcgccgacg

SEQ ID NO: 2881272 - RNA, 14 nt, Mycobacterium avium subsp. paratuberculosis
uccgcgacgacacc

SEQ ID NO: 2881273 - RNA, 15 nt, Mycobacterium avium subsp. paratuberculosis
uccgcgacgacacca

SEQ ID NO: 2881274 - RNA, 20 nt, Mycobacterium avium subsp. paratuberculosis
uccgcgacgacaccaccgug

SEQ ID NO: 2881275 - RNA, 23 nt, Mycobacterium avium subsp. paratuberculosis
uccgcgacgacaccaccgugcug

SEQ ID NO: 2881276 - RNA, 15 nt, Mycobacterium avium subsp. paratuberculosis
uccgcgacgccaaca

SEQ ID NO: 2881277 - RNA, 19 nt, Mycobacterium avium subsp. paratuberculosis
uccgcgacgccagcaccuu

SEQ ID NO: 2881278 - RNA, 22 nt, Mycobacterium avium subsp. paratuberculosis
uccgcgacgcugagcgccaggc

SEQ ID NO: 2881279 - RNA, 15 nt, Mycobacterium avium subsp. paratuberculosis
uccgcgagccgagcc

SEQ ID NO: 2881280 - RNA, 16 nt, Mycobacterium avium subsp. paratuberculosis
uccgcgagccgagccg

SEQ ID NO: 2881281 - RNA, 17 nt, Mycobacterium avium subsp. paratuberculosis
uccgcgagccgagccgg

SEQ ID NO: 2881282 - RNA, 20 nt, Mycobacterium avium subsp. paratuberculosis
uccgcgaggaaucgcggcag

SEQ ID NO: 2881283 - RNA, 16 nt, Mycobacterium avium subsp. paratuberculosis
uccgcgaucagcucgu

SEQ ID NO: 2881284 - RNA, 19 nt, Mycobacterium avium subsp. paratuberculosis
uccgcgaucagcucguggc

SEQ ID NO: 2881285 - RNA, 17 nt, Mycobacterium avium subsp. paratuberculosis
uccgcgauggccuccga

SEQ ID NO: 2881286 - RNA, 23 nt, Mycobacterium avium subsp. paratuberculosis
uccgcgauggccuccgacccguc

SEQ ID NO: 2881287 - RNA, 23 nt, Mycobacterium avium subsp. paratuberculosis
uccgcgcagcgucuugcccagcg

SEQ ID NO: 2881288 - RNA, 18 nt, Mycobacterium avium subsp. paratuberculosis
uccgcgcagggacgggcg

SEQ ID NO: 2881289 - RNA, 21 nt, Mycobacterium avium subsp. paratuberculosis
uccgcgcccuggugcaacacc

SEQ ID NO: 2881290 - RNA, 14 nt, Mycobacterium avium subsp. paratuberculosis
uccgcgccgccgcc

SEQ ID NO: 2881291 - RNA, 21 nt, Mycobacterium avium subsp. paratuberculosis
uccgcgccgcgaugcaacacc

SEQ ID NO: 2881292 - RNA, 22 nt, Mycobacterium avium subsp. paratuberculosis
uccgcgccggcgcaacucgucc

SEQ ID NO: 2881293 - RNA, 20 nt, Mycobacterium avium subsp. paratuberculosis
uccgcgccggucccgcggcg

SEQ ID NO: 2881294 - RNA, 21 nt, Mycobacterium avium subsp. paratuberculosis
uccgcgccggucccgcggcgg

SEQ ID NO: 2881295 - RNA, 23 nt, Mycobacterium avium subsp. paratuberculosis
uccgcgcgagaguaucgccacgc

SEQ ID NO: 2881296 - RNA, 16 nt, Mycobacterium avium subsp. paratuberculosis
uccgcgcgagcgcgcu

SEQ ID NO: 2881297 - RNA, 12 nt, Mycobacterium avium subsp. paratuberculosis
uccgcgcggcca

SEQ ID NO: 2881298 - RNA, 16 nt, Mycobacterium avium subsp. paratuberculosis
uccgcgcggccaccag

SEQ ID NO: 2881299 - RNA, 21 nt, Mycobacterium avium subsp. paratuberculosis
uccgcgcggccaccagcgcgg

SEQ ID NO: 2881300 - RNA, 17 nt, Mycobacterium avium subsp. paratuberculosis
uccgcgcggcgggcccg

SEQ ID NO: 2881301 - RNA, 15 nt, Mycobacterium avium subsp. paratuberculosis
uccgcgcguagugcu

SEQ ID NO: 2881302 - RNA, 12 nt, Mycobacterium avium subsp. paratuberculosis
uccgcgcgucgg

SEQ ID NO: 2881303 - RNA, 20 nt, Mycobacterium avium subsp. paratuberculosis
uccgcgcgucgggcucgcgg

SEQ ID NO: 2881304 - RNA, 14 nt, Mycobacterium avium subsp. paratuberculosis
uccgcgcugaccag

SEQ ID NO: 2881305 - RNA, 14 nt, Mycobacterium avium subsp. paratuberculosis
uccgcgcuggcguu

SEQ ID NO: 2881306 - RNA, 14 nt, Mycobacterium avium subsp. paratuberculosis
uccgcggaacccgu

SEQ ID NO: 2881307 - RNA, 16 nt, Mycobacterium avium subsp. paratuberculosis
uccgcggaggcgagca

SEQ ID NO: 2881308 - RNA, 19 nt, Mycobacterium avium subsp. paratuberculosis
uccgcggaggcgagcagcc

SEQ ID NO: 2881309 - RNA, 19 nt, Mycobacterium avium subsp. paratuberculosis
uccgcggccaccgggaccg

SEQ ID NO: 2881310 - RNA, 22 nt, Mycobacterium avium subsp. paratuberculosis
uccgcggccaccgggaccgucg

SEQ ID NO: 2881311 - RNA, 17 nt, Mycobacterium avium subsp. paratuberculosis
uccgcggccagcucggu

SEQ ID NO: 2881312 - RNA, 12 nt, Mycobacterium avium subsp. paratuberculosis
uccgcggccgcg

SEQ ID NO: 2881313 - RNA, 18 nt, Mycobacterium avium subsp. paratuberculosis
uccgcggccgcgcgcccg

SEQ ID NO: 2881314 - RNA, 14 nt, Mycobacterium avium subsp. paratuberculosis
uccgcggccgcggc

SEQ ID NO: 2881315 - RNA, 17 nt, Mycobacterium avium subsp. paratuberculosis
uccgcggccgcggcgcg

SEQ ID NO: 2881316 - RNA, 19 nt, Mycobacterium avium subsp. paratuberculosis
uccgcggccgcggcgcgca

SEQ ID NO: 2881317 - RNA, 15 nt, Mycobacterium avium subsp. paratuberculosis
uccgcggcgaugacc

SEQ ID NO: 2881318 - RNA, 19 nt, Mycobacterium avium subsp. paratuberculosis
uccgcggcgaugaccggac

SEQ ID NO: 2881319 - RNA, 20 nt, Mycobacterium avium subsp. paratuberculosis
uccgcggcgccguagguggc

SEQ ID NO: 2881320 - RNA, 14 nt, Mycobacterium avium subsp. paratuberculosis
uccgcggcgcgguu

SEQ ID NO: 2881321 - RNA, 20 nt, Mycobacterium avium subsp. paratuberculosis
uccgcggcggccggcgauga

SEQ ID NO: 2881322 - RNA, 13 nt, Mycobacterium avium subsp. paratuberculosis
uccgcggcgggcg

SEQ ID NO: 2881323 - RNA, 14 nt, Mycobacterium avium subsp. paratuberculosis
uccgcgggcagcga

SEQ ID NO: 2881324 - RNA, 16 nt, Mycobacterium avium subsp. paratuberculosis
uccgcgggcguggcgg

SEQ ID NO: 2881325 - RNA, 16 nt, Mycobacterium avium subsp. paratuberculosis
uccgcggucagacgau

SEQ ID NO: 2881326 - RNA, 20 nt, Mycobacterium avium subsp. paratuberculosis
uccgcgguccuccuggauga

SEQ ID NO: 2881327 - RNA, 22 nt, Mycobacterium avium subsp. paratuberculosis
uccgcgguucgaucuccucggc

SEQ ID NO: 2881328 - RNA, 19 nt, Mycobacterium avium subsp. paratuberculosis
uccgcgguuucaccgugcg

SEQ ID NO: 2881329 - RNA, 23 nt, Mycobacterium avium subsp. paratuberculosis
uccgcgguuucaccgugcgcgcg

SEQ ID NO: 2881330 - RNA, 13 nt, Mycobacterium avium subsp. paratuberculosis
uccgcgucggccc

SEQ ID NO: 2881331 - RNA, 18 nt, Mycobacterium avium subsp. paratuberculosis
uccgcgucggcgccggcc

SEQ ID NO: 2881332 - RNA, 17 nt, Mycobacterium avium subsp. paratuberculosis
uccgcgugaaugcccag

SEQ ID NO: 2881333 - RNA, 19 nt, Mycobacterium avium subsp. paratuberculosis
uccgcgugaaugcccagcg

SEQ ID NO: 2881334 - RNA, 19 nt, Mycobacterium avium subsp. paratuberculosis
uccgcgugacaagccggcg

SEQ ID NO: 2881335 - RNA, 13 nt, Mycobacterium avium subsp. paratuberculosis
uccgcguggccga

SEQ ID NO: 2881336 - RNA, 16 nt, Mycobacterium avium subsp. paratuberculosis
uccgcguggccgagga

SEQ ID NO: 2881337 - RNA, 23 nt, Mycobacterium avium subsp. paratuberculosis
uccgcguucgaccuccacgagcc

SEQ ID NO: 2881338 - RNA, 22 nt, Mycobacterium avium subsp. paratuberculosis
uccgcucaacuugaucagcucg

SEQ ID NO: 2881339 - RNA, 23 nt, Mycobacterium avium subsp. paratuberculosis
uccgcucaacuugaucagcucgc

SEQ ID NO: 2881340 - RNA, 13 nt, Mycobacterium avium subsp. paratuberculosis
uccgcuccaccag

SEQ ID NO: 2881341 - RNA, 12 nt, Mycobacterium avium subsp. paratuberculosis
uccgcugaacgg

SEQ ID NO: 2881342 - RNA, 18 nt, Mycobacterium avium subsp. paratuberculosis
uccgcugaugcggccgga

SEQ ID NO: 2881343 - RNA, 17 nt, Mycobacterium avium subsp. paratuberculosis
uccgcuggugcgcgccg

SEQ ID NO: 2881344 - RNA, 18 nt, Mycobacterium avium subsp. paratuberculosis
uccgcuggugcgcgccgg

SEQ ID NO: 2881345 - RNA, 14 nt, Mycobacterium avium subsp. paratuberculosis
uccggaaccgcgcc

SEQ ID NO: 2881346 - RNA, 21 nt, Mycobacterium avium subsp. paratuberculosis
uccggaaccgggcacccggcg

SEQ ID NO: 2881347 - RNA, 13 nt, Mycobacterium avium subsp. paratuberculosis
uccggaacgacgc

SEQ ID NO: 2881348 - RNA, 18 nt, Mycobacterium avium subsp. paratuberculosis
uccggaacgacgcguccg

SEQ ID NO: 2881349 - RNA, 21 nt, Mycobacterium avium subsp. paratuberculosis
uccggacacggccagcgccgu

SEQ ID NO: 2881350 - RNA, 19 nt, Mycobacterium avium subsp. paratuberculosis
uccggacgaccugggcgcc

SEQ ID NO: 2881351 - RNA, 22 nt, Mycobacterium avium subsp. paratuberculosis
uccggacgaccugggcgccguc

SEQ ID NO: 2881352 - RNA, 18 nt, Mycobacterium avium subsp. paratuberculosis
uccggagaucgccccggg

SEQ ID NO: 2881353 - RNA, 15 nt, Mycobacterium avium subsp. paratuberculosis
uccggaggugccggc

SEQ ID NO: 2881354 - RNA, 18 nt, Mycobacterium avium subsp. paratuberculosis
uccggaggugccggccgg

SEQ ID NO: 2881355 - RNA, 19 nt, Mycobacterium avium subsp. paratuberculosis
uccggaggugccggccggu

SEQ ID NO: 2881356 - RNA, 15 nt, Mycobacterium avium subsp. paratuberculosis
uccggauagccgucg

SEQ ID NO: 2881357 - RNA, 22 nt, Mycobacterium avium subsp. paratuberculosis
uccggauagccgucggcggagg

SEQ ID NO: 2881358 - RNA, 21 nt, Mycobacterium avium subsp. paratuberculosis
uccggaucaaccacaccagca

SEQ ID NO: 2881359 - RNA, 22 nt, Mycobacterium avium subsp. paratuberculosis
uccggaucaaccacaccagcau

SEQ ID NO: 2881360 - RNA, 14 nt, Mycobacterium avium subsp. paratuberculosis
uccggaucgggcgg

SEQ ID NO: 2881361 - RNA, 15 nt, Mycobacterium avium subsp. paratuberculosis
uccggaugcggcgcc

SEQ ID NO: 2881362 - RNA, 17 nt, Mycobacterium avium subsp. paratuberculosis
uccggaugcggcgccca

SEQ ID NO: 2881363 - RNA, 18 nt, Mycobacterium avium subsp. paratuberculosis
uccggauggcggucgcgc

SEQ ID NO: 2881364 - RNA, 15 nt, Mycobacterium avium subsp. paratuberculosis
uccggauugccgggc

SEQ ID NO: 2881365 - RNA, 21 nt, Mycobacterium avium subsp. paratuberculosis
uccggcaacgaggccagggcc

SEQ ID NO: 2881366 - RNA, 15 nt, Mycobacterium avium subsp. paratuberculosis
uccggcacccgccag

SEQ ID NO: 2881367 - RNA, 13 nt, Mycobacterium avium subsp. paratuberculosis
uccggcagcgaaa

SEQ ID NO: 2881368 - RNA, 13 nt, Mycobacterium avium subsp. paratuberculosis
uccggcagcgcgc

SEQ ID NO: 2881369 - RNA, 21 nt, Mycobacterium avium subsp. paratuberculosis
uccggcagcgcgcccaggcug

SEQ ID NO: 2881370 - RNA, 14 nt, Mycobacterium avium subsp. paratuberculosis
uccggcagcgcucg

SEQ ID NO: 2881371 - RNA, 15 nt, Mycobacterium avium subsp. paratuberculosis
uccggcaggccgcgg

SEQ ID NO: 2881372 - RNA, 16 nt, Mycobacterium avium subsp. paratuberculosis
uccggcaggcucagca

SEQ ID NO: 2881373 - RNA, 18 nt, Mycobacterium avium subsp. paratuberculosis
uccggcaggcucagcagc

SEQ ID NO: 2881374 - RNA, 19 nt, Mycobacterium avium subsp. paratuberculosis
uccggcaggcucagcagca

SEQ ID NO: 2881375 - RNA, 21 nt, Mycobacterium avium subsp. paratuberculosis
uccggcaggcucagcagcacc

SEQ ID NO: 2881376 - RNA, 23 nt, Mycobacterium avium subsp. paratuberculosis
uccggcaggcucagcagcaccgc

SEQ ID NO: 2881377 - RNA, 17 nt, Mycobacterium avium subsp. paratuberculosis
uccggcaguacgcgccg

SEQ ID NO: 2881378 - RNA, 12 nt, Mycobacterium avium subsp. paratuberculosis
uccggccagcgu

SEQ ID NO: 2881379 - RNA, 18 nt, Mycobacterium avium subsp. paratuberculosis
uccggccaggucgccgcg

SEQ ID NO: 2881380 - RNA, 13 nt, Mycobacterium avium subsp. paratuberculosis
uccggccagucca

SEQ ID NO: 2881381 - RNA, 12 nt, Mycobacterium avium subsp. paratuberculosis
uccggccccgag

SEQ ID NO: 2881382 - RNA, 20 nt, Mycobacterium avium subsp. paratuberculosis
uccggccccgagccgacgau

SEQ ID NO: 2881383 - RNA, 22 nt, Mycobacterium avium subsp. paratuberculosis
uccggccccgagccgacgauga

SEQ ID NO: 2881384 - RNA, 20 nt, Mycobacterium avium subsp. paratuberculosis
uccggccccgcugccguccg

SEQ ID NO: 2881385 - RNA, 17 nt, Mycobacterium avium subsp. paratuberculosis
uccggcccgagcaccac

SEQ ID NO: 2881386 - RNA, 22 nt, Mycobacterium avium subsp. paratuberculosis
uccggcccgaucgcggcgagcu

SEQ ID NO: 2881387 - RNA, 16 nt, Mycobacterium avium subsp. paratuberculosis
uccggcccgcucggcg

SEQ ID NO: 2881388 - RNA, 14 nt, Mycobacterium avium subsp. paratuberculosis
uccggcccggcguc

SEQ ID NO: 2881389 - RNA, 15 nt, Mycobacterium avium subsp. paratuberculosis
uccggcccggcgucg

SEQ ID NO: 2881390 - RNA, 21 nt, Mycobacterium avium subsp. paratuberculosis
uccggcccggggacacccucg

SEQ ID NO: 2881391 - RNA, 12 nt, Mycobacterium avium subsp. paratuberculosis
uccggcccuggu

SEQ ID NO: 2881392 - RNA, 16 nt, Mycobacterium avium subsp. paratuberculosis
uccggcccuggucggc

SEQ ID NO: 2881393 - RNA, 13 nt, Mycobacterium avium subsp. paratuberculosis
uccggccgcgccg

SEQ ID NO: 2881394 - RNA, 14 nt, Mycobacterium avium subsp. paratuberculosis
uccggccgcgccgg

SEQ ID NO: 2881395 - RNA, 22 nt, Mycobacterium avium subsp. paratuberculosis
uccggccgcggaugaccagguc

SEQ ID NO: 2881396 - RNA, 16 nt, Mycobacterium avium subsp. paratuberculosis
uccggccggagaccgc

SEQ ID NO: 2881397 - RNA, 13 nt, Mycobacterium avium subsp. paratuberculosis
uccggccggccgc

SEQ ID NO: 2881398 - RNA, 15 nt, Mycobacterium avium subsp. paratuberculosis
uccggccggccgccg

SEQ ID NO: 2881399 - RNA, 18 nt, Mycobacterium avium subsp. paratuberculosis
uccggccggccgccggcg

SEQ ID NO: 2881400 - RNA, 19 nt, Mycobacterium avium subsp. paratuberculosis
uccggccggccgccggcgg

SEQ ID NO: 2881401 - RNA, 20 nt, Mycobacterium avium subsp. paratuberculosis
uccggccggccgccggcggc

SEQ ID NO: 2881402 - RNA, 18 nt, Mycobacterium avium subsp. paratuberculosis
uccggccggcgaggaacu

SEQ ID NO: 2881403 - RNA, 18 nt, Mycobacterium avium subsp. paratuberculosis
uccggccgucgucgggca

SEQ ID NO: 2881404 - RNA, 23 nt, Mycobacterium avium subsp. paratuberculosis
uccggccgugaugcgccggcggu

SEQ ID NO: 2881405 - RNA, 12 nt, Mycobacterium avium subsp. paratuberculosis
uccggcgacacc

SEQ ID NO: 2881406 - RNA, 13 nt, Mycobacterium avium subsp. paratuberculosis
uccggcgacaccg

SEQ ID NO: 2881407 - RNA, 14 nt, Mycobacterium avium subsp. paratuberculosis
uccggcgcacggcg

SEQ ID NO: 2881408 - RNA, 17 nt, Mycobacterium avium subsp. paratuberculosis
uccggcgccagcccggu

SEQ ID NO: 2881409 - RNA, 18 nt, Mycobacterium avium subsp. paratuberculosis
uccggcgccagcccggug

SEQ ID NO: 2881410 - RNA, 20 nt, Mycobacterium avium subsp. paratuberculosis
uccggcgccagcccggugau

SEQ ID NO: 2881411 - RNA, 14 nt, Mycobacterium avium subsp. paratuberculosis
uccggcgcccgauc

SEQ ID NO: 2881412 - RNA, 21 nt, Mycobacterium avium subsp. paratuberculosis
uccggcgcccgaugaaguacc

SEQ ID NO: 2881413 - RNA, 13 nt, Mycobacterium avium subsp. paratuberculosis
uccggcgcccggc

SEQ ID NO: 2881414 - RNA, 23 nt, Mycobacterium avium subsp. paratuberculosis
uccggcgcccggcuccccgacca

SEQ ID NO: 2881415 - RNA, 13 nt, Mycobacterium avium subsp. paratuberculosis
uccggcgccgacc

SEQ ID NO: 2881416 - RNA, 16 nt, Mycobacterium avium subsp. paratuberculosis
uccggcgccgaccccc

SEQ ID NO: 2881417 - RNA, 17 nt, Mycobacterium avium subsp. paratuberculosis
uccggcgccgacccccg

SEQ ID NO: 2881418 - RNA, 16 nt, Mycobacterium avium subsp. paratuberculosis
uccggcgccgcgggcg

SEQ ID NO: 2881419 - RNA, 22 nt, Mycobacterium avium subsp. paratuberculosis
uccggcgccgcgggcgccguag

SEQ ID NO: 2881420 - RNA, 18 nt, Mycobacterium avium subsp. paratuberculosis
uccggcgccggucagcgg

SEQ ID NO: 2881421 - RNA, 22 nt, Mycobacterium avium subsp. paratuberculosis
uccggcgccggucagcggcaac

SEQ ID NO: 2881422 - RNA, 17 nt, Mycobacterium avium subsp. paratuberculosis
uccggcgcgaccagguu

SEQ ID NO: 2881423 - RNA, 20 nt, Mycobacterium avium subsp. paratuberculosis
uccggcgcgaccagguucuc

SEQ ID NO: 2881424 - RNA, 21 nt, Mycobacterium avium subsp. paratuberculosis
uccggcgcgaccagguucucg

SEQ ID NO: 2881425 - RNA, 22 nt, Mycobacterium avium subsp. paratuberculosis
uccggcgcgcagcaauugacgc

SEQ ID NO: 2881426 - RNA, 14 nt, Mycobacterium avium subsp. paratuberculosis
uccggcgcgccgcg

SEQ ID NO: 2881427 - RNA, 23 nt, Mycobacterium avium subsp. paratuberculosis
uccggcgcguuccaucagcgccc

SEQ ID NO: 2881428 - RNA, 19 nt, Mycobacterium avium subsp. paratuberculosis
uccggcggacccagcuccu

SEQ ID NO: 2881429 - RNA, 15 nt, Mycobacterium avium subsp. paratuberculosis
uccggcggcagccag

SEQ ID NO: 2881430 - RNA, 13 nt, Mycobacterium avium subsp. paratuberculosis
uccggcggccggc

SEQ ID NO: 2881431 - RNA, 15 nt, Mycobacterium avium subsp. paratuberculosis
uccggcggccggcgg

SEQ ID NO: 2881432 - RNA, 20 nt, Mycobacterium avium subsp. paratuberculosis
uccggcggcgcucagcgcgg

SEQ ID NO: 2881433 - RNA, 21 nt, Mycobacterium avium subsp. paratuberculosis
uccggcggcgcucagcgcggc

SEQ ID NO: 2881434 - RNA, 14 nt, Mycobacterium avium subsp. paratuberculosis
uccggcgggccucg

SEQ ID NO: 2881435 - RNA, 15 nt, Mycobacterium avium subsp. paratuberculosis
uccggcgggccucgc

SEQ ID NO: 2881436 - RNA, 22 nt, Mycobacterium avium subsp. paratuberculosis
uccggcgggcgccggucggcgg

SEQ ID NO: 2881437 - RNA, 23 nt, Mycobacterium avium subsp. paratuberculosis
uccggcgggcuggugcgcagccg

SEQ ID NO: 2881438 - RNA, 15 nt, Mycobacterium avium subsp. paratuberculosis
uccggcggucagcac

SEQ ID NO: 2881439 - RNA, 14 nt, Mycobacterium avium subsp. paratuberculosis
uccggcggucgcug

SEQ ID NO: 2881440 - RNA, 20 nt, Mycobacterium avium subsp. paratuberculosis
uccggcggucgcugcagcgg

SEQ ID NO: 2881441 - RNA, 22 nt, Mycobacterium avium subsp. paratuberculosis
uccggcggucgcugcagcggcg

SEQ ID NO: 2881442 - RNA, 20 nt, Mycobacterium avium subsp. paratuberculosis
uccggcguaucuccaccguc

SEQ ID NO: 2881443 - RNA, 14 nt, Mycobacterium avium subsp. paratuberculosis
uccggcguccaccg

SEQ ID NO: 2881444 - RNA, 18 nt, Mycobacterium avium subsp. paratuberculosis
uccggcgucucagucggc

SEQ ID NO: 2881445 - RNA, 14 nt, Mycobacterium avium subsp. paratuberculosis
uccggcuccacagc

SEQ ID NO: 2881446 - RNA, 16 nt, Mycobacterium avium subsp. paratuberculosis
uccggcuccacagcag

SEQ ID NO: 2881447 - RNA, 19 nt, Mycobacterium avium subsp. paratuberculosis
uccggcuccacagcaguuc

SEQ ID NO: 2881448 - RNA, 22 nt, Mycobacterium avium subsp. paratuberculosis
uccggcucugccugcaggaugg

SEQ ID NO: 2881449 - RNA, 18 nt, Mycobacterium avium subsp. paratuberculosis
uccggcugaacgccagca

SEQ ID NO: 2881450 - RNA, 16 nt, Mycobacterium avium subsp. paratuberculosis
uccggcugagcgucgg

SEQ ID NO: 2881451 - RNA, 17 nt, Mycobacterium avium subsp. paratuberculosis
uccgggaggccagcacc

SEQ ID NO: 2881452 - RNA, 18 nt, Mycobacterium avium subsp. paratuberculosis
uccgggcacgcagcggcg

SEQ ID NO: 2881453 - RNA, 19 nt, Mycobacterium avium subsp. paratuberculosis
uccgggccaccaccacggc

SEQ ID NO: 2881454 - RNA, 22 nt, Mycobacterium avium subsp. paratuberculosis
uccgggccaccaccacggccgc

SEQ ID NO: 2881455 - RNA, 14 nt, Mycobacterium avium subsp. paratuberculosis
uccgggccaccguc

SEQ ID NO: 2881456 - RNA, 22 nt, Mycobacterium avium subsp. paratuberculosis
uccgggccaccgucuucggggc

SEQ ID NO: 2881457 - RNA, 14 nt, Mycobacterium avium subsp. paratuberculosis
uccgggcccaccag

SEQ ID NO: 2881458 - RNA, 17 nt, Mycobacterium avium subsp. paratuberculosis
uccgggcccaccagguc

SEQ ID NO: 2881459 - RNA, 11 nt, Mycobacterium avium subsp. paratuberculosis
uccgggccgcc

SEQ ID NO: 2881460 - RNA, 15 nt, Mycobacterium avium subsp. paratuberculosis
uccgggccgccgcgg

SEQ ID NO: 2881461 - RNA, 17 nt, Mycobacterium avium subsp. paratuberculosis
uccgggcgaccccggcc

SEQ ID NO: 2881462 - RNA, 23 nt, Mycobacterium avium subsp. paratuberculosis
uccgggcgccauccgccacccgc

SEQ ID NO: 2881463 - RNA, 23 nt, Mycobacterium avium subsp. paratuberculosis
uccgggcgcccagaagccccggu

SEQ ID NO: 2881464 - RNA, 13 nt, Mycobacterium avium subsp. paratuberculosis
uccgggcgccggu

SEQ ID NO: 2881465 - RNA, 15 nt, Mycobacterium avium subsp. paratuberculosis
uccgggcggcaucgc

SEQ ID NO: 2881466 - RNA, 17 nt, Mycobacterium avium subsp. paratuberculosis
uccgggcggcaucgcgc

SEQ ID NO: 2881467 - RNA, 16 nt, Mycobacterium avium subsp. paratuberculosis
uccgggcggccagccg

SEQ ID NO: 2881468 - RNA, 23 nt, Mycobacterium avium subsp. paratuberculosis
uccgggcggccagccgcgcggcg

SEQ ID NO: 2881469 - RNA, 18 nt, Mycobacterium avium subsp. paratuberculosis
uccgggcguagugcagcu

SEQ ID NO: 2881470 - RNA, 15 nt, Mycobacterium avium subsp. paratuberculosis
uccgggcugaccucg

SEQ ID NO: 2881471 - RNA, 22 nt, Mycobacterium avium subsp. paratuberculosis
uccgggcugaccucgcgcaccg

SEQ ID NO: 2881472 - RNA, 19 nt, Mycobacterium avium subsp. paratuberculosis
uccgggcugugggcgcagg

SEQ ID NO: 2881473 - RNA, 23 nt, Mycobacterium avium subsp. paratuberculosis
uccgggcugugggcgcagggccg

SEQ ID NO: 2881474 - RNA, 20 nt, Mycobacterium avium subsp. paratuberculosis
uccggggaaccgcccuucca

SEQ ID NO: 2881475 - RNA, 23 nt, Mycobacterium avium subsp. paratuberculosis
uccggggaaccgcccuuccagca

SEQ ID NO: 2881476 - RNA, 15 nt, Mycobacterium avium subsp. paratuberculosis
uccggggucacggau

SEQ ID NO: 2881477 - RNA, 14 nt, Mycobacterium avium subsp. paratuberculosis
uccggggucagggc

SEQ ID NO: 2881478 - RNA, 16 nt, Mycobacterium avium subsp. paratuberculosis
uccggggucagggcgc

SEQ ID NO: 2881479 - RNA, 13 nt, Mycobacterium avium subsp. paratuberculosis
uccggggugagca

SEQ ID NO: 2881480 - RNA, 22 nt, Mycobacterium avium subsp. paratuberculosis
uccggggugagcagggccagcg

SEQ ID NO: 2881481 - RNA, 13 nt, Mycobacterium avium subsp. paratuberculosis
uccgggguggccu

SEQ ID NO: 2881482 - RNA, 18 nt, Mycobacterium avium subsp. paratuberculosis
uccggggugggcacgucg

SEQ ID NO: 2881483 - RNA, 18 nt, Mycobacterium avium subsp. paratuberculosis
uccggguaggacaccguc

SEQ ID NO: 2881484 - RNA, 14 nt, Mycobacterium avium subsp. paratuberculosis
uccgggugcgggcu

SEQ ID NO: 2881485 - RNA, 14 nt, Mycobacterium avium subsp. paratuberculosis
uccgggugucgacg

SEQ ID NO: 2881486 - RNA, 16 nt, Mycobacterium avium subsp. paratuberculosis
uccgggugucgacgcc

SEQ ID NO: 2881487 - RNA, 18 nt, Mycobacterium avium subsp. paratuberculosis
uccgggugucgacgccgg

SEQ ID NO: 2881488 - RNA, 20 nt, Mycobacterium avium subsp. paratuberculosis
uccggguucgacgccucggu

SEQ ID NO: 2881489 - RNA, 18 nt, Mycobacterium avium subsp. paratuberculosis
uccgguagaagaccaccu

SEQ ID NO: 2881490 - RNA, 19 nt, Mycobacterium avium subsp. paratuberculosis
uccgguagaagaccaccuc

SEQ ID NO: 2881491 - RNA, 20 nt, Mycobacterium avium subsp. paratuberculosis
uccggucaacgccgcgcgca

SEQ ID NO: 2881492 - RNA, 10 nt, Mycobacterium avium subsp. paratuberculosis
uccggucagc

SEQ ID NO: 2881493 - RNA, 13 nt, Mycobacterium avium subsp. paratuberculosis
uccggucagcacc

SEQ ID NO: 2881494 - RNA, 15 nt, Mycobacterium avium subsp. paratuberculosis
uccggucagcaccgc

SEQ ID NO: 2881495 - RNA, 14 nt, Mycobacterium avium subsp. paratuberculosis
uccggucagcgcca

SEQ ID NO: 2881496 - RNA, 15 nt, Mycobacterium avium subsp. paratuberculosis
uccggucagcgccag

SEQ ID NO: 2881497 - RNA, 19 nt, Mycobacterium avium subsp. paratuberculosis
uccggucagcguggcgucg

SEQ ID NO: 2881498 - RNA, 17 nt, Mycobacterium avium subsp. paratuberculosis
uccgguccacucgucgg

SEQ ID NO: 2881499 - RNA, 20 nt, Mycobacterium avium subsp. paratuberculosis
uccgguccagaucggcgcgc

SEQ ID NO: 2881500 - RNA, 21 nt, Mycobacterium avium subsp. paratuberculosis
uccgguccagaucggcgcgcg

SEQ ID NO: 2881501 - RNA, 16 nt, Mycobacterium avium subsp. paratuberculosis
uccgguccgggcugcg

SEQ ID NO: 2881502 - RNA, 21 nt, Mycobacterium avium subsp. paratuberculosis
uccggucgaucaccucgucga

SEQ ID NO: 2881503 - RNA, 15 nt, Mycobacterium avium subsp. paratuberculosis
uccggucggcgcucg

SEQ ID NO: 2881504 - RNA, 19 nt, Mycobacterium avium subsp. paratuberculosis
uccggucucggucgcggcg

SEQ ID NO: 2881505 - RNA, 17 nt, Mycobacterium avium subsp. paratuberculosis
uccggucugcuccggug

SEQ ID NO: 2881506 - RNA, 21 nt, Mycobacterium avium subsp. paratuberculosis
uccggucuucucggccaggcu

SEQ ID NO: 2881507 - RNA, 19 nt, Mycobacterium avium subsp. paratuberculosis
uccggugaaccgcugacca

SEQ ID NO: 2881508 - RNA, 21 nt, Mycobacterium avium subsp. paratuberculosis
uccggugauugaauggaaugu

SEQ ID NO: 2881509 - RNA, 16 nt, Mycobacterium avium subsp. paratuberculosis
uccggugccacgcggc

SEQ ID NO: 2881510 - RNA, 17 nt, Mycobacterium avium subsp. paratuberculosis
uccggugccacgcggcu

SEQ ID NO: 2881511 - RNA, 19 nt, Mycobacterium avium subsp. paratuberculosis
uccggugccgagcgcgcuu

SEQ ID NO: 2881512 - RNA, 20 nt, Mycobacterium avium subsp. paratuberculosis
uccgguggacuccagcacca

SEQ ID NO: 2881513 - RNA, 14 nt, Mycobacterium avium subsp. paratuberculosis
uccgguucgaccgg

SEQ ID NO: 2881514 - RNA, 16 nt, Mycobacterium avium subsp. paratuberculosis
uccgguucgaccggcg

SEQ ID NO: 2881515 - RNA, 14 nt, Mycobacterium avium subsp. paratuberculosis
uccgguugcaccgc

SEQ ID NO: 2881516 - RNA, 15 nt, Mycobacterium avium subsp. paratuberculosis
uccgguugcggcagc

SEQ ID NO: 2881517 - RNA, 17 nt, Mycobacterium avium subsp. paratuberculosis
uccgguuugcgccggcu

SEQ ID NO: 2881518 - RNA, 17 nt, Mycobacterium avium subsp. paratuberculosis
uccguagugcucggcgu

SEQ ID NO: 2881519 - RNA, 18 nt, Mycobacterium avium subsp. paratuberculosis
uccgucagcgccgcccgc

SEQ ID NO: 2881520 - RNA, 19 nt, Mycobacterium avium subsp. paratuberculosis
uccguccuuggugauuucg

SEQ ID NO: 2881521 - RNA, 22 nt, Mycobacterium avium subsp. paratuberculosis
uccgucgagucggccaccgcgg

SEQ ID NO: 2881522 - RNA, 13 nt, Mycobacterium avium subsp. paratuberculosis
uccgucuuggcca

SEQ ID NO: 2881523 - RNA, 14 nt, Mycobacterium avium subsp. paratuberculosis
uccgucuuggccag

SEQ ID NO: 2881524 - RNA, 17 nt, Mycobacterium avium subsp. paratuberculosis
uccgucuuggccaggcc

SEQ ID NO: 2881525 - RNA, 19 nt, Mycobacterium avium subsp. paratuberculosis
uccgucuuguuggucagcc

SEQ ID NO: 2881526 - RNA, 13 nt, Mycobacterium avium subsp. paratuberculosis
uccgugaccccgg

SEQ ID NO: 2881527 - RNA, 13 nt, Mycobacterium avium subsp. paratuberculosis
uccgugccacggc

SEQ ID NO: 2881528 - RNA, 16 nt, Mycobacterium avium subsp. paratuberculosis
uccgugccacggccgc

SEQ ID NO: 2881529 - RNA, 14 nt, Mycobacterium avium subsp. paratuberculosis
uccgugcugccggc

SEQ ID NO: 2881530 - RNA, 14 nt, Mycobacterium avium subsp. paratuberculosis
uccguuggagguga

SEQ ID NO: 2881531 - RNA, 19 nt, Mycobacterium avium subsp. paratuberculosis
uccguugugccaccgccga

SEQ ID NO: 2881532 - RNA, 21 nt, Mycobacterium avium subsp. paratuberculosis
uccuacggcgggugcgacggc

SEQ ID NO: 2881533 - RNA, 16 nt, Mycobacterium avium subsp. paratuberculosis
uccucagcacggccgc

SEQ ID NO: 2881534 - RNA, 21 nt, Mycobacterium avium subsp. paratuberculosis
uccucagcacggccgcggcca

SEQ ID NO: 2881535 - RNA, 22 nt, Mycobacterium avium subsp. paratuberculosis
uccucauagccggccgcgucgc

SEQ ID NO: 2881536 - RNA, 19 nt, Mycobacterium avium subsp. paratuberculosis
uccuccccgcuggcgccgg

SEQ ID NO: 2881537 - RNA, 19 nt, Mycobacterium avium subsp. paratuberculosis
uccuccucggccagcccca

SEQ ID NO: 2881538 - RNA, 17 nt, Mycobacterium avium subsp. paratuberculosis
uccuccucggcgcggau

SEQ ID NO: 2881539 - RNA, 21 nt, Mycobacterium avium subsp. paratuberculosis
uccuccugcgacggcagcacc

SEQ ID NO: 2881540 - RNA, 16 nt, Mycobacterium avium subsp. paratuberculosis
uccuccugcgccggca

SEQ ID NO: 2881541 - RNA, 19 nt, Mycobacterium avium subsp. paratuberculosis
uccuccuggaugaagugac

SEQ ID NO: 2881542 - RNA, 16 nt, Mycobacterium avium subsp. paratuberculosis
uccucgaaccgcuugc

SEQ ID NO: 2881543 - RNA, 18 nt, Mycobacterium avium subsp. paratuberculosis
uccucgaaccucgcggcg

SEQ ID NO: 2881544 - RNA, 19 nt, Mycobacterium avium subsp. paratuberculosis
uccucgaaccucgcggcgg

SEQ ID NO: 2881545 - RNA, 22 nt, Mycobacterium avium subsp. paratuberculosis
uccucgaagaacgcgucccaca

SEQ ID NO: 2881546 - RNA, 15 nt, Mycobacterium avium subsp. paratuberculosis
uccucgaccacccgc

SEQ ID NO: 2881547 - RNA, 16 nt, Mycobacterium avium subsp. paratuberculosis
uccucgaccagcgcgc

SEQ ID NO: 2881548 - RNA, 21 nt, Mycobacterium avium subsp. paratuberculosis
uccucgaccagcgcgccgccc

SEQ ID NO: 2881549 - RNA, 23 nt, Mycobacterium avium subsp. paratuberculosis
uccucgacggcgaagccggcguc

SEQ ID NO: 2881550 - RNA, 13 nt, Mycobacterium avium subsp. paratuberculosis
uccucgacggugg

SEQ ID NO: 2881551 - RNA, 16 nt, Mycobacterium avium subsp. paratuberculosis
uccucgacguaggcca

SEQ ID NO: 2881552 - RNA, 22 nt, Mycobacterium avium subsp. paratuberculosis
uccucgagagucgcuggcgcgc

SEQ ID NO: 2881553 - RNA, 14 nt, Mycobacterium avium subsp. paratuberculosis
uccucgagcaucuc

SEQ ID NO: 2881554 - RNA, 21 nt, Mycobacterium avium subsp. paratuberculosis
uccucgagccguuugaugccg

SEQ ID NO: 2881555 - RNA, 19 nt, Mycobacterium avium subsp. paratuberculosis
uccucgagcgcgucgacca

SEQ ID NO: 2881556 - RNA, 13 nt, Mycobacterium avium subsp. paratuberculosis
uccucgagcuggc

SEQ ID NO: 2881557 - RNA, 16 nt, Mycobacterium avium subsp. paratuberculosis
uccucgagcuggccgu

SEQ ID NO: 2881558 - RNA, 20 nt, Mycobacterium avium subsp. paratuberculosis
uccucgaucaucgcgucggu

SEQ ID NO: 2881559 - RNA, 17 nt, Mycobacterium avium subsp. paratuberculosis
uccucgaucgacaccuc

SEQ ID NO: 2881560 - RNA, 16 nt, Mycobacterium avium subsp. paratuberculosis
uccucgccgcgccagc

SEQ ID NO: 2881561 - RNA, 20 nt, Mycobacterium avium subsp. paratuberculosis
uccucgccgcgccagcaccu

SEQ ID NO: 2881562 - RNA, 21 nt, Mycobacterium avium subsp. paratuberculosis
uccucgccggagagcccgucg

SEQ ID NO: 2881563 - RNA, 17 nt, Mycobacterium avium subsp. paratuberculosis
uccucgcgccgccacgc

SEQ ID NO: 2881564 - RNA, 18 nt, Mycobacterium avium subsp. paratuberculosis
uccucgcgccgccacgcg

SEQ ID NO: 2881565 - RNA, 21 nt, Mycobacterium avium subsp. paratuberculosis
uccucgcggaacugcucccag

SEQ ID NO: 2881566 - RNA, 20 nt, Mycobacterium avium subsp. paratuberculosis
uccucgcgggcgaucuccag

SEQ ID NO: 2881567 - RNA, 15 nt, Mycobacterium avium subsp. paratuberculosis
uccucgcugccggcc

SEQ ID NO: 2881568 - RNA, 14 nt, Mycobacterium avium subsp. paratuberculosis
uccucggacccgau

SEQ ID NO: 2881569 - RNA, 15 nt, Mycobacterium avium subsp. paratuberculosis
uccucggccagcacc

SEQ ID NO: 2881570 - RNA, 15 nt, Mycobacterium avium subsp. paratuberculosis
uccucggccagcccc

SEQ ID NO: 2881571 - RNA, 13 nt, Mycobacterium avium subsp. paratuberculosis
uccucggccagcg

SEQ ID NO: 2881572 - RNA, 14 nt, Mycobacterium avium subsp. paratuberculosis
uccucggccagcgg

SEQ ID NO: 2881573 - RNA, 17 nt, Mycobacterium avium subsp. paratuberculosis
uccucggccagcgguug

SEQ ID NO: 2881574 - RNA, 21 nt, Mycobacterium avium subsp. paratuberculosis
uccucggccagcucaccggcc

SEQ ID NO: 2881575 - RNA, 21 nt, Mycobacterium avium subsp. paratuberculosis
uccucggccccaaaagccuug

SEQ ID NO: 2881576 - RNA, 13 nt, Mycobacterium avium subsp. paratuberculosis
uccucggcgaugc

SEQ ID NO: 2881577 - RNA, 13 nt, Mycobacterium avium subsp. paratuberculosis
uccucggcgaugu

SEQ ID NO: 2881578 - RNA, 14 nt, Mycobacterium avium subsp. paratuberculosis
uccucggcgcggau

SEQ ID NO: 2881579 - RNA, 19 nt, Mycobacterium avium subsp. paratuberculosis
uccucggcggccucggugc

SEQ ID NO: 2881580 - RNA, 16 nt, Mycobacterium avium subsp. paratuberculosis
uccucggucagcggcg

SEQ ID NO: 2881581 - RNA, 16 nt, Mycobacterium avium subsp. paratuberculosis
uccucggucucgucca

SEQ ID NO: 2881582 - RNA, 17 nt, Mycobacterium avium subsp. paratuberculosis
uccucggugagcguggu

SEQ ID NO: 2881583 - RNA, 17 nt, Mycobacterium avium subsp. paratuberculosis
uccucggugugcugacc

SEQ ID NO: 2881584 - RNA, 18 nt, Mycobacterium avium subsp. paratuberculosis
uccucucggcgccgucca

SEQ ID NO: 2881585 - RNA, 12 nt, Mycobacterium avium subsp. paratuberculosis
uccucugcgcgc

SEQ ID NO: 2881586 - RNA, 17 nt, Mycobacterium avium subsp. paratuberculosis
uccugagguauucgucg

SEQ ID NO: 2881587 - RNA, 13 nt, Mycobacterium avium subsp. paratuberculosis
uccugcaccgagu

SEQ ID NO: 2881588 - RNA, 14 nt, Mycobacterium avium subsp. paratuberculosis
uccugcagcgccgu

SEQ ID NO: 2881589 - RNA, 14 nt, Mycobacterium avium subsp. paratuberculosis
uccugcagcgcggc

SEQ ID NO: 2881590 - RNA, 15 nt, Mycobacterium avium subsp. paratuberculosis
uccugcagcgcggcg

SEQ ID NO: 2881591 - RNA, 16 nt, Mycobacterium avium subsp. paratuberculosis
uccugcagcucgccgg

SEQ ID NO: 2881592 - RNA, 18 nt, Mycobacterium avium subsp. paratuberculosis
uccugcagcucgccggcg

SEQ ID NO: 2881593 - RNA, 21 nt, Mycobacterium avium subsp. paratuberculosis
uccugcagcucgccggcgcgc

SEQ ID NO: 2881594 - RNA, 20 nt, Mycobacterium avium subsp. paratuberculosis
uccugcaggcaggccggcag

SEQ ID NO: 2881595 - RNA, 20 nt, Mycobacterium avium subsp. paratuberculosis
uccugcaggccgagccgccg

SEQ ID NO: 2881596 - RNA, 14 nt, Mycobacterium avium subsp. paratuberculosis
uccugccagcggcg

SEQ ID NO: 2881597 - RNA, 21 nt, Mycobacterium avium subsp. paratuberculosis
uccugcccggucugcggccgc

SEQ ID NO: 2881598 - RNA, 22 nt, Mycobacterium avium subsp. paratuberculosis
uccugcccggucugcggccgcg

SEQ ID NO: 2881599 - RNA, 14 nt, Mycobacterium avium subsp. paratuberculosis
uccugcgaccgccg

SEQ ID NO: 2881600 - RNA, 16 nt, Mycobacterium avium subsp. paratuberculosis
uccugcgacggcagca

SEQ ID NO: 2881601 - RNA, 18 nt, Mycobacterium avium subsp. paratuberculosis
uccugcgcaucgagcugc

SEQ ID NO: 2881602 - RNA, 23 nt, Mycobacterium avium subsp. paratuberculosis
uccugcgccgcggugcgccacgc

SEQ ID NO: 2881603 - RNA, 12 nt, Mycobacterium avium subsp. paratuberculosis
uccugcgcgugc

SEQ ID NO: 2881604 - RNA, 12 nt, Mycobacterium avium subsp. paratuberculosis
uccugcuggccg

SEQ ID NO: 2881605 - RNA, 19 nt, Mycobacterium avium subsp. paratuberculosis
uccugcuggccgggcucga

SEQ ID NO: 2881606 - RNA, 13 nt, Mycobacterium avium subsp. paratuberculosis
uccugcuggcgcu

SEQ ID NO: 2881607 - RNA, 15 nt, Mycobacterium avium subsp. paratuberculosis
uccugcuggcgcugc

SEQ ID NO: 2881608 - RNA, 17 nt, Mycobacterium avium subsp. paratuberculosis
uccugcuggcgcugcca

SEQ ID NO: 2881609 - RNA, 18 nt, Mycobacterium avium subsp. paratuberculosis
uccugcuggcgcugccag

SEQ ID NO: 2881610 - RNA, 15 nt, Mycobacterium avium subsp. paratuberculosis
uccugcuugaccgug

SEQ ID NO: 2881611 - RNA, 21 nt, Mycobacterium avium subsp. paratuberculosis
uccuggaaggacgucaggccg

SEQ ID NO: 2881612 - RNA, 15 nt, Mycobacterium avium subsp. paratuberculosis
uccuggacgucgucg

SEQ ID NO: 2881613 - RNA, 16 nt, Mycobacterium avium subsp. paratuberculosis
uccuggaucagccagu

SEQ ID NO: 2881614 - RNA, 15 nt, Mycobacterium avium subsp. paratuberculosis
uccuggaugaacagc

SEQ ID NO: 2881615 - RNA, 16 nt, Mycobacterium avium subsp. paratuberculosis
uccuggaugaacagca

SEQ ID NO: 2881616 - RNA, 17 nt, Mycobacterium avium subsp. paratuberculosis
uccuggaugaacagcac

SEQ ID NO: 2881617 - RNA, 23 nt, Mycobacterium avium subsp. paratuberculosis
uccuggcccccgccccagcccgg

SEQ ID NO: 2881618 - RNA, 11 nt, Mycobacterium avium subsp. paratuberculosis
uccuggcccuu

SEQ ID NO: 2881619 - RNA, 13 nt, Mycobacterium avium subsp. paratuberculosis
uccuggccgccgu

SEQ ID NO: 2881620 - RNA, 16 nt, Mycobacterium avium subsp. paratuberculosis
uccuggccuggucggc

SEQ ID NO: 2881621 - RNA, 19 nt, Mycobacterium avium subsp. paratuberculosis
uccuggcggguggcgauga

SEQ ID NO: 2881622 - RNA, 13 nt, Mycobacterium avium subsp. paratuberculosis
uccuggcucagga

SEQ ID NO: 2881623 - RNA, 15 nt, Mycobacterium avium subsp. paratuberculosis
uccugggacagccgg

SEQ ID NO: 2881624 - RNA, 14 nt, Mycobacterium avium subsp. paratuberculosis
uccugggccagauc

SEQ ID NO: 2881625 - RNA, 16 nt, Mycobacterium avium subsp. paratuberculosis
uccugggccgggauga

SEQ ID NO: 2881626 - RNA, 13 nt, Mycobacterium avium subsp. paratuberculosis
uccugggccuggc

SEQ ID NO: 2881627 - RNA, 16 nt, Mycobacterium avium subsp. paratuberculosis
uccugggccuggcgcu

SEQ ID NO: 2881628 - RNA, 21 nt, Mycobacterium avium subsp. paratuberculosis
uccuggguaagccaggucacg

SEQ ID NO: 2881629 - RNA, 10 nt, Mycobacterium avium subsp. paratuberculosis
uccuggguga

SEQ ID NO: 2881630 - RNA, 18 nt, Mycobacterium avium subsp. paratuberculosis
uccugggugaguucgucg

SEQ ID NO: 2881631 - RNA, 19 nt, Mycobacterium avium subsp. paratuberculosis
uccugggugaguucgucgg

SEQ ID NO: 2881632 - RNA, 17 nt, Mycobacterium avium subsp. paratuberculosis
uccugguaccccagcaa

SEQ ID NO: 2881633 - RNA, 15 nt, Mycobacterium avium subsp. paratuberculosis
uccugguagucgucg

SEQ ID NO: 2881634 - RNA, 11 nt, Mycobacterium avium subsp. paratuberculosis
uccuggucgcu

SEQ ID NO: 2881635 - RNA, 17 nt, Mycobacterium avium subsp. paratuberculosis
uccugguuucagguggc

SEQ ID NO: 2881636 - RNA, 22 nt, Mycobacterium avium subsp. paratuberculosis
uccugugcaccgugcugugcug

SEQ ID NO: 2881637 - RNA, 15 nt, Mycobacterium avium subsp. paratuberculosis
uccuguuccccggcg

SEQ ID NO: 2881638 - RNA, 19 nt, Mycobacterium avium subsp. paratuberculosis
uccuuaaucgggacguuga

SEQ ID NO: 2881639 - RNA, 20 nt, Mycobacterium avium subsp. paratuberculosis
uccuucuugaacagcgccgg

SEQ ID NO: 2881640 - RNA, 22 nt, Mycobacterium avium subsp. paratuberculosis
uccuugacgaacgacguguuca

SEQ ID NO: 2881641 - RNA, 15 nt, Mycobacterium avium subsp. paratuberculosis
uccuugagccgccgc

SEQ ID NO: 2881642 - RNA, 18 nt, Mycobacterium avium subsp. paratuberculosis
uccuugagccgccgcggc

SEQ ID NO: 2881643 - RNA, 22 nt, Mycobacterium avium subsp. paratuberculosis
uccuugagguagucgcgcagcu

SEQ ID NO: 2881644 - RNA, 17 nt, Mycobacterium avium subsp. paratuberculosis
uccuugcccagcgcggu

SEQ ID NO: 2881645 - RNA, 16 nt, Mycobacterium avium subsp. paratuberculosis
uccuugcggccgccga

SEQ ID NO: 2881646 - RNA, 17 nt, Mycobacterium avium subsp. paratuberculosis
uccuugcggccgccgau

SEQ ID NO: 2881647 - RNA, 13 nt, Mycobacterium avium subsp. paratuberculosis
uccuuggccgcca

SEQ ID NO: 2881648 - RNA, 17 nt, Mycobacterium avium subsp. paratuberculosis
uccuugggcauggugaa

SEQ ID NO: 2881649 - RNA, 18 nt, Mycobacterium avium subsp. paratuberculosis
uccuuggggcugaccucg

SEQ ID NO: 2881650 - RNA, 20 nt, Mycobacterium avium subsp. paratuberculosis
uccuuggggcugaccucgcc

SEQ ID NO: 2881651 - RNA, 22 nt, Mycobacterium avium subsp. paratuberculosis
uccuuggggcugaccucgccgc

SEQ ID NO: 2881652 - RNA, 22 nt, Mycobacterium avium subsp. paratuberculosis
ucgaaaaacccggugccggccg

SEQ ID NO: 2881653 - RNA, 20 nt, Mycobacterium avium subsp. paratuberculosis
ucgaaaagcuucuugcugcc

SEQ ID NO: 2881654 - RNA, 12 nt, Mycobacterium avium subsp. paratuberculosis
ucgaaaccgccc

SEQ ID NO: 2881655 - RNA, 13 nt, Mycobacterium avium subsp. paratuberculosis
ucgaaaccgguca

SEQ ID NO: 2881656 - RNA, 20 nt, Mycobacterium avium subsp. paratuberculosis
ucgaaaccgucuccggcgcg

SEQ ID NO: 2881657 - RNA, 21 nt, Mycobacterium avium subsp. paratuberculosis
ucgaaaccgucuccggcgcgg

SEQ ID NO: 2881658 - RNA, 20 nt, Mycobacterium avium subsp. paratuberculosis
ucgaaacggaugggcgaggg

SEQ ID NO: 2881659 - RNA, 18 nt, Mycobacterium avium subsp. paratuberculosis
ucgaacaacgcggugacc

SEQ ID NO: 2881660 - RNA, 19 nt, Mycobacterium avium subsp. paratuberculosis
ucgaacacgccgucguggg

SEQ ID NO: 2881661 - RNA, 17 nt, Mycobacterium avium subsp. paratuberculosis
ucgaacagcacgccggc

SEQ ID NO: 2881662 - RNA, 18 nt, Mycobacterium avium subsp. paratuberculosis
ucgaacagcacgccggcc

SEQ ID NO: 2881663 - RNA, 22 nt, Mycobacterium avium subsp. paratuberculosis
ucgaacagcacgccggccggcg

SEQ ID NO: 2881664 - RNA, 13 nt, Mycobacterium avium subsp. paratuberculosis
ucgaacagcgcgc

SEQ ID NO: 2881665 - RNA, 18 nt, Mycobacterium avium subsp. paratuberculosis
ucgaacagcgcgcccgac

SEQ ID NO: 2881666 - RNA, 19 nt, Mycobacterium avium subsp. paratuberculosis
ucgaacagcgggcagagcu

SEQ ID NO: 2881667 - RNA, 17 nt, Mycobacterium avium subsp. paratuberculosis
ucgaacaggcuggccag

SEQ ID NO: 2881668 - RNA, 18 nt, Mycobacterium avium subsp. paratuberculosis
ucgaacagggcggcgggc

SEQ ID NO: 2881669 - RNA, 21 nt, Mycobacterium avium subsp. paratuberculosis
ucgaacagguuugagcgugcc

SEQ ID NO: 2881670 - RNA, 20 nt, Mycobacterium avium subsp. paratuberculosis
ucgaacaucacccggcggca

SEQ ID NO: 2881671 - RNA, 16 nt, Mycobacterium avium subsp. paratuberculosis
ucgaacaucggcacgu

SEQ ID NO: 2881672 - RNA, 15 nt, Mycobacterium avium subsp. paratuberculosis
ucgaaccacgcggcg

SEQ ID NO: 2881673 - RNA, 22 nt, Mycobacterium avium subsp. paratuberculosis
ucgaacccgaccccggcgagcg

SEQ ID NO: 2881674 - RNA, 13 nt, Mycobacterium avium subsp. paratuberculosis
ucgaaccgccgcg

SEQ ID NO: 2881675 - RNA, 16 nt, Mycobacterium avium subsp. paratuberculosis
ucgaaccgccgcgcuc

SEQ ID NO: 2881676 - RNA, 18 nt, Mycobacterium avium subsp. paratuberculosis
ucgaaccgcuugcccagc

SEQ ID NO: 2881677 - RNA, 16 nt, Mycobacterium avium subsp. paratuberculosis
ucgaaccgggcgguga

SEQ ID NO: 2881678 - RNA, 16 nt, Mycobacterium avium subsp. paratuberculosis
ucgaaccggggcacca

SEQ ID NO: 2881679 - RNA, 16 nt, Mycobacterium avium subsp. paratuberculosis
ucgaaccucgcggcgg

SEQ ID NO: 2881680 - RNA, 23 nt, Mycobacterium avium subsp. paratuberculosis
ucgaacgccagcgccgcaacggc

SEQ ID NO: 2881681 - RNA, 16 nt, Mycobacterium avium subsp. paratuberculosis
ucgaacgcccgcacca

SEQ ID NO: 2881682 - RNA, 13 nt, Mycobacterium avium subsp. paratuberculosis
ucgaacgcgacga

SEQ ID NO: 2881683 - RNA, 19 nt, Mycobacterium avium subsp. paratuberculosis
ucgaacggcaccucgauca

SEQ ID NO: 2881684 - RNA, 16 nt, Mycobacterium avium subsp. paratuberculosis
ucgaacggcccggacg

SEQ ID NO: 2881685 - RNA, 23 nt, Mycobacterium avium subsp. paratuberculosis
ucgaacggcggaaccgggccgcu

SEQ ID NO: 2881686 - RNA, 20 nt, Mycobacterium avium subsp. paratuberculosis
ucgaacgggccgggcaccgc

SEQ ID NO: 2881687 - RNA, 14 nt, Mycobacterium avium subsp. paratuberculosis
ucgaacucaccggu

SEQ ID NO: 2881688 - RNA, 15 nt, Mycobacterium avium subsp. paratuberculosis
ucgaacucaccggug

SEQ ID NO: 2881689 - RNA, 17 nt, Mycobacterium avium subsp. paratuberculosis
ucgaacugcagccggcc

SEQ ID NO: 2881690 - RNA, 21 nt, Mycobacterium avium subsp. paratuberculosis
ucgaagaagagggcgugacgc

SEQ ID NO: 2881691 - RNA, 18 nt, Mycobacterium avium subsp. paratuberculosis
ucgaagaagcggccgacg

SEQ ID NO: 2881692 - RNA, 12 nt, Mycobacterium avium subsp. paratuberculosis
ucgaagaaguag

SEQ ID NO: 2881693 - RNA, 13 nt, Mycobacterium avium subsp. paratuberculosis
ucgaagaccacga

SEQ ID NO: 2881694 - RNA, 16 nt, Mycobacterium avium subsp. paratuberculosis
ucgaagaccacgaacu

SEQ ID NO: 2881695 - RNA, 17 nt, Mycobacterium avium subsp. paratuberculosis
ucgaagaccacgaacug

SEQ ID NO: 2881696 - RNA, 18 nt, Mycobacterium avium subsp. paratuberculosis
ucgaagaggugcucgacg

SEQ ID NO: 2881697 - RNA, 23 nt, Mycobacterium avium subsp. paratuberculosis
ucgaagaucgccugcagggauuc

SEQ ID NO: 2881698 - RNA, 19 nt, Mycobacterium avium subsp. paratuberculosis
ucgaagauggucgcgccgc

SEQ ID NO: 2881699 - RNA, 21 nt, Mycobacterium avium subsp. paratuberculosis
ucgaagauggucgcgccgcgg

SEQ ID NO: 2881700 - RNA, 15 nt, Mycobacterium avium subsp. paratuberculosis
ucgaagcccgugccg

SEQ ID NO: 2881701 - RNA, 20 nt, Mycobacterium avium subsp. paratuberculosis
ucgaagcccuucaccucggc

SEQ ID NO: 2881702 - RNA, 14 nt, Mycobacterium avium subsp. paratuberculosis
ucgaagccgaucac

SEQ ID NO: 2881703 - RNA, 13 nt, Mycobacterium avium subsp. paratuberculosis
ucgaagccgaucg

SEQ ID NO: 2881704 - RNA, 18 nt, Mycobacterium avium subsp. paratuberculosis
ucgaagccgaucgcggcg

SEQ ID NO: 2881705 - RNA, 17 nt, Mycobacterium avium subsp. paratuberculosis
ucgaagccguggcaggc

SEQ ID NO: 2881706 - RNA, 16 nt, Mycobacterium avium subsp. paratuberculosis
ucgaagcggugcacca

SEQ ID NO: 2881707 - RNA, 18 nt, Mycobacterium avium subsp. paratuberculosis
ucgaagcggugcaccacc

SEQ ID NO: 2881708 - RNA, 15 nt, Mycobacterium avium subsp. paratuberculosis
ucgaaggaggccagc

SEQ ID NO: 2881709 - RNA, 12 nt, Mycobacterium avium subsp. paratuberculosis
ucgaaggccagg

SEQ ID NO: 2881710 - RNA, 13 nt, Mycobacterium avium subsp. paratuberculosis
ucgaaggccaggu

SEQ ID NO: 2881711 - RNA, 14 nt, Mycobacterium avium subsp. paratuberculosis
ucgaaggccgggcu

SEQ ID NO: 2881712 - RNA, 13 nt, Mycobacterium avium subsp. paratuberculosis
ucgaaggccugga

SEQ ID NO: 2881713 - RNA, 21 nt, Mycobacterium avium subsp. paratuberculosis
ucgaaggcgccgauggugacg

SEQ ID NO: 2881714 - RNA, 16 nt, Mycobacterium avium subsp. paratuberculosis
ucgaaggcggccgcga

SEQ ID NO: 2881715 - RNA, 18 nt, Mycobacterium avium subsp. paratuberculosis
ucgaaggcggccgcgagc

SEQ ID NO: 2881716 - RNA, 16 nt, Mycobacterium avium subsp. paratuberculosis
ucgaagggcaucgggu

SEQ ID NO: 2881717 - RNA, 17 nt, Mycobacterium avium subsp. paratuberculosis
ucgaagggcaucggguc

SEQ ID NO: 2881718 - RNA, 19 nt, Mycobacterium avium subsp. paratuberculosis
ucgaaggucugcagcagcc

SEQ ID NO: 2881719 - RNA, 14 nt, Mycobacterium avium subsp. paratuberculosis
ucgaaggugaugaa

SEQ ID NO: 2881720 - RNA, 17 nt, Mycobacterium avium subsp. paratuberculosis
ucgaaguagagccgcug

SEQ ID NO: 2881721 - RNA, 13 nt, Mycobacterium avium subsp. paratuberculosis
ucgaagucgaucc

SEQ ID NO: 2881722 - RNA, 13 nt, Mycobacterium avium subsp. paratuberculosis
ucgaagucgccgg

SEQ ID NO: 2881723 - RNA, 15 nt, Mycobacterium avium subsp. paratuberculosis
ucgaagugacgccgc

SEQ ID NO: 2881724 - RNA, 20 nt, Mycobacterium avium subsp. paratuberculosis
ucgaagugacgccgcucggc

SEQ ID NO: 2881725 - RNA, 15 nt, Mycobacterium avium subsp. paratuberculosis
ucgaauccggcggcg

SEQ ID NO: 2881726 - RNA, 21 nt, Mycobacterium avium subsp. paratuberculosis
ucgaauccggcggcgcucagc

SEQ ID NO: 2881727 - RNA, 20 nt, Mycobacterium avium subsp. paratuberculosis
ucgacaacgcgugaugcagc

SEQ ID NO: 2881728 - RNA, 23 nt, Mycobacterium avium subsp. paratuberculosis
ucgacaccccgcucggccagcgc

SEQ ID NO: 2881729 - RNA, 16 nt, Mycobacterium avium subsp. paratuberculosis
ucgacaccgcacggcc

SEQ ID NO: 2881730 - RNA, 13 nt, Mycobacterium avium subsp. paratuberculosis
ucgacacgccggc

SEQ ID NO: 2881731 - RNA, 18 nt, Mycobacterium avium subsp. paratuberculosis
ucgacacgggccgcgccg

SEQ ID NO: 2881732 - RNA, 16 nt, Mycobacterium avium subsp. paratuberculosis
ucgacacggugaacgu

SEQ ID NO: 2881733 - RNA, 17 nt, Mycobacterium avium subsp. paratuberculosis
ucgacagccggucgcgc

SEQ ID NO: 2881734 - RNA, 17 nt, Mycobacterium avium subsp. paratuberculosis
ucgacaggcagcccggc

SEQ ID NO: 2881735 - RNA, 18 nt, Mycobacterium avium subsp. paratuberculosis
ucgacagguucuuggcgg

SEQ ID NO: 2881736 - RNA, 20 nt, Mycobacterium avium subsp. paratuberculosis
ucgacagguucuuggcggcc

SEQ ID NO: 2881737 - RNA, 23 nt, Mycobacterium avium subsp. paratuberculosis
ucgacagguucuuggcggccugc

SEQ ID NO: 2881738 - RNA, 14 nt, Mycobacterium avium subsp. paratuberculosis
ucgacaugcccggc

SEQ ID NO: 2881739 - RNA, 22 nt, Mycobacterium avium subsp. paratuberculosis
ucgacaugcuguuccagacguc

SEQ ID NO: 2881740 - RNA, 16 nt, Mycobacterium avium subsp. paratuberculosis
ucgaccaacuccaccg

SEQ ID NO: 2881741 - RNA, 22 nt, Mycobacterium avium subsp. paratuberculosis
ucgaccaacuccaccgcccgga

SEQ ID NO: 2881742 - RNA, 22 nt, Mycobacterium avium subsp. paratuberculosis
ucgaccaagacggugggcccgc

SEQ ID NO: 2881743 - RNA, 20 nt, Mycobacterium avium subsp. paratuberculosis
ucgaccacccgcagcucgcc

SEQ ID NO: 2881744 - RNA, 13 nt, Mycobacterium avium subsp. paratuberculosis
ucgaccacccgcu

SEQ ID NO: 2881745 - RNA, 15 nt, Mycobacterium avium subsp. paratuberculosis
ucgaccacccgcugg

SEQ ID NO: 2881746 - RNA, 17 nt, Mycobacterium avium subsp. paratuberculosis
ucgaccacccggcgggc

SEQ ID NO: 2881747 - RNA, 12 nt, Mycobacterium avium subsp. paratuberculosis
ucgaccaccgcc

SEQ ID NO: 2881748 - RNA, 16 nt, Mycobacterium avium subsp. paratuberculosis
ucgaccaccgccggcc

SEQ ID NO: 2881749 - RNA, 17 nt, Mycobacterium avium subsp. paratuberculosis
ucgaccaccgccggccc

SEQ ID NO: 2881750 - RNA, 21 nt, Mycobacterium avium subsp. paratuberculosis
ucgaccaccggguagcccgcg

SEQ ID NO: 2881751 - RNA, 15 nt, Mycobacterium avium subsp. paratuberculosis
ucgaccacgcacacc

SEQ ID NO: 2881752 - RNA, 16 nt, Mycobacterium avium subsp. paratuberculosis
ucgaccacgcacacca

SEQ ID NO: 2881753 - RNA, 22 nt, Mycobacterium avium subsp. paratuberculosis
ucgaccacgcacaccaccgacg

SEQ ID NO: 2881754 - RNA, 15 nt, Mycobacterium avium subsp. paratuberculosis
ucgaccacggccggu

SEQ ID NO: 2881755 - RNA, 18 nt, Mycobacterium avium subsp. paratuberculosis
ucgaccacggccgguccg

SEQ ID NO: 2881756 - RNA, 18 nt, Mycobacterium avium subsp. paratuberculosis
ucgaccagauugcggcac

SEQ ID NO: 2881757 - RNA, 19 nt, Mycobacterium avium subsp. paratuberculosis
ucgaccagcaccgcauccc

SEQ ID NO: 2881758 - RNA, 15 nt, Mycobacterium avium subsp. paratuberculosis
ucgaccagccgcauc

SEQ ID NO: 2881759 - RNA, 14 nt, Mycobacterium avium subsp. paratuberculosis
ucgaccagccggua

SEQ ID NO: 2881760 - RNA, 15 nt, Mycobacterium avium subsp. paratuberculosis
ucgaccagcgccgag

SEQ ID NO: 2881761 - RNA, 24 nt, Mycobacterium avium subsp. paratuberculosis
ucgaccagcgccgagaccagccag

SEQ ID NO: 2881762 - RNA, 19 nt, Mycobacterium avium subsp. paratuberculosis
ucgaccagcgcgccgccca

SEQ ID NO: 2881763 - RNA, 21 nt, Mycobacterium avium subsp. paratuberculosis
ucgaccagcgcgccgcccagc

SEQ ID NO: 2881764 - RNA, 13 nt, Mycobacterium avium subsp. paratuberculosis
ucgaccagcgggc

SEQ ID NO: 2881765 - RNA, 16 nt, Mycobacterium avium subsp. paratuberculosis
ucgaccagcgggcugu

SEQ ID NO: 2881766 - RNA, 16 nt, Mycobacterium avium subsp. paratuberculosis
ucgaccaggacgucgg

SEQ ID NO: 2881767 - RNA, 21 nt, Mycobacterium avium subsp. paratuberculosis
ucgaccaggacgucggccggc

SEQ ID NO: 2881768 - RNA, 21 nt, Mycobacterium avium subsp. paratuberculosis
ucgaccaggcuuggcccgccg

SEQ ID NO: 2881769 - RNA, 16 nt, Mycobacterium avium subsp. paratuberculosis
ucgaccaucugccggc

SEQ ID NO: 2881770 - RNA, 17 nt, Mycobacterium avium subsp. paratuberculosis
ucgaccaucugccggcg

SEQ ID NO: 2881771 - RNA, 17 nt, Mycobacterium avium subsp. paratuberculosis
ucgaccccaacccgaag

SEQ ID NO: 2881772 - RNA, 18 nt, Mycobacterium avium subsp. paratuberculosis
ucgacccccaccgcgaca

SEQ ID NO: 2881773 - RNA, 15 nt, Mycobacterium avium subsp. paratuberculosis
ucgaccccgcccagc

SEQ ID NO: 2881774 - RNA, 21 nt, Mycobacterium avium subsp. paratuberculosis
ucgaccccgcccagcgacucg

SEQ ID NO: 2881775 - RNA, 14 nt, Mycobacterium avium subsp. paratuberculosis
ucgaccccgccggc

SEQ ID NO: 2881776 - RNA, 15 nt, Mycobacterium avium subsp. paratuberculosis
ucgaccccgccggcc

SEQ ID NO: 2881777 - RNA, 16 nt, Mycobacterium avium subsp. paratuberculosis
ucgaccccgccggccc

SEQ ID NO: 2881778 - RNA, 16 nt, Mycobacterium avium subsp. paratuberculosis
ucgacccgcauccgcc

SEQ ID NO: 2881779 - RNA, 23 nt, Mycobacterium avium subsp. paratuberculosis
ucgacccgcauccgccgggcggc

SEQ ID NO: 2881780 - RNA, 15 nt, Mycobacterium avium subsp. paratuberculosis
ucgacccgcggcgcc

SEQ ID NO: 2881781 - RNA, 19 nt, Mycobacterium avium subsp. paratuberculosis
ucgacccgcggcgccgcgg

SEQ ID NO: 2881782 - RNA, 18 nt, Mycobacterium avium subsp. paratuberculosis
ucgacccgcuccccgauc

SEQ ID NO: 2881783 - RNA, 15 nt, Mycobacterium avium subsp. paratuberculosis
ucgacccgcuccgac

SEQ ID NO: 2881784 - RNA, 16 nt, Mycobacterium avium subsp. paratuberculosis
ucgacccgcuccgacg

SEQ ID NO: 2881785 - RNA, 18 nt, Mycobacterium avium subsp. paratuberculosis
ucgacccgcuccgacgcg

SEQ ID NO: 2881786 - RNA, 19 nt, Mycobacterium avium subsp. paratuberculosis
ucgacccgcuccgacgcgg

SEQ ID NO: 2881787 - RNA, 20 nt, Mycobacterium avium subsp. paratuberculosis
ucgacccgcuccgacgcggu

SEQ ID NO: 2881788 - RNA, 16 nt, Mycobacterium avium subsp. paratuberculosis
ucgacccgggccaggu

SEQ ID NO: 2881789 - RNA, 21 nt, Mycobacterium avium subsp. paratuberculosis
ucgacccguuccccggccgac

SEQ ID NO: 2881790 - RNA, 22 nt, Mycobacterium avium subsp. paratuberculosis
ucgacccguuccccggccgacg

SEQ ID NO: 2881791 - RNA, 13 nt, Mycobacterium avium subsp. paratuberculosis
ucgaccgccccgc

SEQ ID NO: 2881792 - RNA, 14 nt, Mycobacterium avium subsp. paratuberculosis
ucgaccgccccgcc

SEQ ID NO: 2881793 - RNA, 15 nt, Mycobacterium avium subsp. paratuberculosis
ucgaccgccgcgucg

SEQ ID NO: 2881794 - RNA, 13 nt, Mycobacterium avium subsp. paratuberculosis
ucgaccgcgacga

SEQ ID NO: 2881795 - RNA, 16 nt, Mycobacterium avium subsp. paratuberculosis
ucgaccgcgcaccggc

SEQ ID NO: 2881796 - RNA, 17 nt, Mycobacterium avium subsp. paratuberculosis
ucgaccgcgcaccggcg

SEQ ID NO: 2881797 - RNA, 12 nt, Mycobacterium avium subsp. paratuberculosis
ucgaccgcgccg

SEQ ID NO: 2881798 - RNA, 14 nt, Mycobacterium avium subsp. paratuberculosis
ucgaccgcgccggg

SEQ ID NO: 2881799 - RNA, 14 nt, Mycobacterium avium subsp. paratuberculosis
ucgaccgcggcgcc

SEQ ID NO: 2881800 - RNA, 19 nt, Mycobacterium avium subsp. paratuberculosis
ucgaccgcggcuccggccg

SEQ ID NO: 2881801 - RNA, 20 nt, Mycobacterium avium subsp. paratuberculosis
ucgaccgcggcuccggccgc

SEQ ID NO: 2881802 - RNA, 14 nt, Mycobacterium avium subsp. paratuberculosis
ucgaccgcgguggc

SEQ ID NO: 2881803 - RNA, 18 nt, Mycobacterium avium subsp. paratuberculosis
ucgaccgcgguggcggug

SEQ ID NO: 2881804 - RNA, 19 nt, Mycobacterium avium subsp. paratuberculosis
ucgaccggcaccagcagcc

SEQ ID NO: 2881805 - RNA, 17 nt, Mycobacterium avium subsp. paratuberculosis
ucgaccggcggaaguag

SEQ ID NO: 2881806 - RNA, 17 nt, Mycobacterium avium subsp. paratuberculosis
ucgaccggcucgccguu

SEQ ID NO: 2881807 - RNA, 13 nt, Mycobacterium avium subsp. paratuberculosis
ucgaccggguccg

SEQ ID NO: 2881808 - RNA, 18 nt, Mycobacterium avium subsp. paratuberculosis
ucgaccggguuggcgcgc

SEQ ID NO: 2881809 - RNA, 21 nt, Mycobacterium avium subsp. paratuberculosis
ucgaccgguucgucaacgccc

SEQ ID NO: 2881810 - RNA, 15 nt, Mycobacterium avium subsp. paratuberculosis
ucgaccgucacgcug

SEQ ID NO: 2881811 - RNA, 20 nt, Mycobacterium avium subsp. paratuberculosis
ucgaccgucacgcuggcgug

SEQ ID NO: 2881812 - RNA, 19 nt, Mycobacterium avium subsp. paratuberculosis
ucgaccgugaggcccggcg

SEQ ID NO: 2881813 - RNA, 18 nt, Mycobacterium avium subsp. paratuberculosis
ucgaccuccacgagccgg

SEQ ID NO: 2881814 - RNA, 21 nt, Mycobacterium avium subsp. paratuberculosis
ucgaccuccacgagccggucg

SEQ ID NO: 2881815 - RNA, 18 nt, Mycobacterium avium subsp. paratuberculosis
ucgaccuccucgaccccg

SEQ ID NO: 2881816 - RNA, 18 nt, Mycobacterium avium subsp. paratuberculosis
ucgaccucgcgcgucacg

SEQ ID NO: 2881817 - RNA, 19 nt, Mycobacterium avium subsp. paratuberculosis
ucgaccucgcgcgucacgc

SEQ ID NO: 2881818 - RNA, 16 nt, Mycobacterium avium subsp. paratuberculosis
ucgaccucggccacca

SEQ ID NO: 2881819 - RNA, 17 nt, Mycobacterium avium subsp. paratuberculosis
ucgaccucggccaccac

SEQ ID NO: 2881820 - RNA, 13 nt, Mycobacterium avium subsp. paratuberculosis
ucgaccucggcgg

SEQ ID NO: 2881821 - RNA, 15 nt, Mycobacterium avium subsp. paratuberculosis
ucgaccucggcggcc

SEQ ID NO: 2881822 - RNA, 16 nt, Mycobacterium avium subsp. paratuberculosis
ucgaccucgucggcgg

SEQ ID NO: 2881823 - RNA, 22 nt, Mycobacterium avium subsp. paratuberculosis
ucgaccucgucggcggcgacgg

SEQ ID NO: 2881824 - RNA, 18 nt, Mycobacterium avium subsp. paratuberculosis
ucgaccucuucggcgccg

SEQ ID NO: 2881825 - RNA, 21 nt, Mycobacterium avium subsp. paratuberculosis
ucgaccugcccgggcccgaug

SEQ ID NO: 2881826 - RNA, 20 nt, Mycobacterium avium subsp. paratuberculosis
ucgaccugcucgucggugac

SEQ ID NO: 2881827 - RNA, 16 nt, Mycobacterium avium subsp. paratuberculosis
ucgaccuucuugucca

SEQ ID NO: 2881828 - RNA, 16 nt, Mycobacterium avium subsp. paratuberculosis
ucgacgaacgcggcgg

SEQ ID NO: 2881829 - RNA, 22 nt, Mycobacterium avium subsp. paratuberculosis
ucgacgaacuuggacggaucgg

SEQ ID NO: 2881830 - RNA, 17 nt, Mycobacterium avium subsp. paratuberculosis
ucgacgaagaaggacgc

SEQ ID NO: 2881831 - RNA, 15 nt, Mycobacterium avium subsp. paratuberculosis
ucgacgacccgaucc

SEQ ID NO: 2881832 - RNA, 22 nt, Mycobacterium avium subsp. paratuberculosis
ucgacgacgaaucccgccucgg

SEQ ID NO: 2881833 - RNA, 13 nt, Mycobacterium avium subsp. paratuberculosis
ucgacgacgccag

SEQ ID NO: 2881834 - RNA, 15 nt, Mycobacterium avium subsp. paratuberculosis
ucgacgacgccagcu

SEQ ID NO: 2881835 - RNA, 18 nt, Mycobacterium avium subsp. paratuberculosis
ucgacgacgccagcugcc

SEQ ID NO: 2881836 - RNA, 18 nt, Mycobacterium avium subsp. paratuberculosis
ucgacgacggcgccgcgu

SEQ ID NO: 2881837 - RNA, 19 nt, Mycobacterium avium subsp. paratuberculosis
ucgacgacggcgccgcguc

SEQ ID NO: 2881838 - RNA, 21 nt, Mycobacterium avium subsp. paratuberculosis
ucgacgacggcgccgcgucgg

SEQ ID NO: 2881839 - RNA, 14 nt, Mycobacterium avium subsp. paratuberculosis
ucgacgacguugcg

SEQ ID NO: 2881840 - RNA, 22 nt, Mycobacterium avium subsp. paratuberculosis
ucgacgacguugcgggccaggu

SEQ ID NO: 2881841 - RNA, 13 nt, Mycobacterium avium subsp. paratuberculosis
ucgacgagcccgc

SEQ ID NO: 2881842 - RNA, 17 nt, Mycobacterium avium subsp. paratuberculosis
ucgacgagcccgccggc

SEQ ID NO: 2881843 - RNA, 19 nt, Mycobacterium avium subsp. paratuberculosis
ucgacgagcccgccggcgg

SEQ ID NO: 2881844 - RNA, 15 nt, Mycobacterium avium subsp. paratuberculosis
ucgacgagcccgcgc

SEQ ID NO: 2881845 - RNA, 18 nt, Mycobacterium avium subsp. paratuberculosis
ucgacgagcccgcgccca

SEQ ID NO: 2881846 - RNA, 19 nt, Mycobacterium avium subsp. paratuberculosis
ucgacgagcccgcgcccau

SEQ ID NO: 2881847 - RNA, 12 nt, Mycobacterium avium subsp. paratuberculosis
ucgacgagccgg

SEQ ID NO: 2881848 - RNA, 15 nt, Mycobacterium avium subsp. paratuberculosis
ucgacgagccgggcc

SEQ ID NO: 2881849 - RNA, 16 nt, Mycobacterium avium subsp. paratuberculosis
ucgacgagccgggcca

SEQ ID NO: 2881850 - RNA, 17 nt, Mycobacterium avium subsp. paratuberculosis
ucgacgagguugucccg

SEQ ID NO: 2881851 - RNA, 21 nt, Mycobacterium avium subsp. paratuberculosis
ucgacgagguugucccgggcg

SEQ ID NO: 2881852 - RNA, 16 nt, Mycobacterium avium subsp. paratuberculosis
ucgacgaucagcacgu

SEQ ID NO: 2881853 - RNA, 23 nt, Mycobacterium avium subsp. paratuberculosis
ucgacgaucucgugggucagcuu

SEQ ID NO: 2881854 - RNA, 20 nt, Mycobacterium avium subsp. paratuberculosis
ucgacgaucuugccgaacag

SEQ ID NO: 2881855 - RNA, 20 nt, Mycobacterium avium subsp. paratuberculosis
ucgacgaugaaauccgggac

SEQ ID NO: 2881856 - RNA, 22 nt, Mycobacterium avium subsp. paratuberculosis
ucgacgaugaaauccgggaccg

SEQ ID NO: 2881857 - RNA, 15 nt, Mycobacterium avium subsp. paratuberculosis
ucgacgaugccguag

SEQ ID NO: 2881858 - RNA, 14 nt, Mycobacterium avium subsp. paratuberculosis
ucgacgaugcgcug

SEQ ID NO: 2881859 - RNA, 13 nt, Mycobacterium avium subsp. paratuberculosis
ucgacgcccugcc

SEQ ID NO: 2881860 - RNA, 17 nt, Mycobacterium avium subsp. paratuberculosis
ucgacgcccugccacag

SEQ ID NO: 2881861 - RNA, 18 nt, Mycobacterium avium subsp. paratuberculosis
ucgacgcccugccacagc

SEQ ID NO: 2881862 - RNA, 22 nt, Mycobacterium avium subsp. paratuberculosis
ucgacgcccuuggcgcccagcg

SEQ ID NO: 2881863 - RNA, 23 nt, Mycobacterium avium subsp. paratuberculosis
ucgacgccgacaucgcggcgauc

SEQ ID NO: 2881864 - RNA, 17 nt, Mycobacterium avium subsp. paratuberculosis
ucgacgccgaccgcggu

SEQ ID NO: 2881865 - RNA, 18 nt, Mycobacterium avium subsp. paratuberculosis
ucgacgccgaccgcgguc

SEQ ID NO: 2881866 - RNA, 17 nt, Mycobacterium avium subsp. paratuberculosis
ucgacgccgauggugac

SEQ ID NO: 2881867 - RNA, 19 nt, Mycobacterium avium subsp. paratuberculosis
ucgacgccgauggugaccu

SEQ ID NO: 2881868 - RNA, 21 nt, Mycobacterium avium subsp. paratuberculosis
ucgacgccgauggugaccucg

SEQ ID NO: 2881869 - RNA, 12 nt, Mycobacterium avium subsp. paratuberculosis
ucgacgccgcgg

SEQ ID NO: 2881870 - RNA, 21 nt, Mycobacterium avium subsp. paratuberculosis
ucgacgccgcgguggccggga

SEQ ID NO: 2881871 - RNA, 14 nt, Mycobacterium avium subsp. paratuberculosis
ucgacgccgcugcc

SEQ ID NO: 2881872 - RNA, 22 nt, Mycobacterium avium subsp. paratuberculosis
ucgacgccggugaaaccggcgc

SEQ ID NO: 2881873 - RNA, 16 nt, Mycobacterium avium subsp. paratuberculosis
ucgacgccgugcugcc

SEQ ID NO: 2881874 - RNA, 16 nt, Mycobacterium avium subsp. paratuberculosis
ucgacgccucggugcg

SEQ ID NO: 2881875 - RNA, 22 nt, Mycobacterium avium subsp. paratuberculosis
ucgacgcgccgcacugcacggc

SEQ ID NO: 2881876 - RNA, 20 nt, Mycobacterium avium subsp. paratuberculosis
ucgacgcggggcggcggcgc

SEQ ID NO: 2881877 - RNA, 15 nt, Mycobacterium avium subsp. paratuberculosis
ucgacgcgugcguca

SEQ ID NO: 2881878 - RNA, 18 nt, Mycobacterium avium subsp. paratuberculosis
ucgacgcguuacacccau

SEQ ID NO: 2881879 - RNA, 14 nt, Mycobacterium avium subsp. paratuberculosis
ucgacgcugaccgu

SEQ ID NO: 2881880 - RNA, 16 nt, Mycobacterium avium subsp. paratuberculosis
ucgacgcugagcaccc

SEQ ID NO: 2881881 - RNA, 22 nt, Mycobacterium avium subsp. paratuberculosis
ucgacgcugagcacccgcccgg

SEQ ID NO: 2881882 - RNA, 23 nt, Mycobacterium avium subsp. paratuberculosis
ucgacgcugagcacccgcccgga

SEQ ID NO: 2881883 - RNA, 18 nt, Mycobacterium avium subsp. paratuberculosis
ucgacgcugagccgcucg

SEQ ID NO: 2881884 - RNA, 19 nt, Mycobacterium avium subsp. paratuberculosis
ucgacgcugcagguggccc

SEQ ID NO: 2881885 - RNA, 21 nt, Mycobacterium avium subsp. paratuberculosis
ucgacgcugugcgccuugccg

SEQ ID NO: 2881886 - RNA, 16 nt, Mycobacterium avium subsp. paratuberculosis
ucgacggagucgucgg

SEQ ID NO: 2881887 - RNA, 18 nt, Mycobacterium avium subsp. paratuberculosis
ucgacggagucgucggcg

SEQ ID NO: 2881888 - RNA, 19 nt, Mycobacterium avium subsp. paratuberculosis
ucgacggagugcgugucac

SEQ ID NO: 2881889 - RNA, 18 nt, Mycobacterium avium subsp. paratuberculosis
ucgacggaucgcccuggc

SEQ ID NO: 2881890 - RNA, 16 nt, Mycobacterium avium subsp. paratuberculosis
ucgacggcacccggcc

SEQ ID NO: 2881891 - RNA, 14 nt, Mycobacterium avium subsp. paratuberculosis
ucgacggcagcgcu

SEQ ID NO: 2881892 - RNA, 17 nt, Mycobacterium avium subsp. paratuberculosis
ucgacggccgcgccgaa

SEQ ID NO: 2881893 - RNA, 12 nt, Mycobacterium avium subsp. paratuberculosis
ucgacggccggc

SEQ ID NO: 2881894 - RNA, 18 nt, Mycobacterium avium subsp. paratuberculosis
ucgacggccggcccugca

SEQ ID NO: 2881895 - RNA, 16 nt, Mycobacterium avium subsp. paratuberculosis
ucgacggcgaagccgg

SEQ ID NO: 2881896 - RNA, 20 nt, Mycobacterium avium subsp. paratuberculosis
ucgacggcgaagccggcguc

SEQ ID NO: 2881897 - RNA, 15 nt, Mycobacterium avium subsp. paratuberculosis
ucgacggcgccgacg

SEQ ID NO: 2881898 - RNA, 13 nt, Mycobacterium avium subsp. paratuberculosis
ucgacggcgccgg

SEQ ID NO: 2881899 - RNA, 15 nt, Mycobacterium avium subsp. paratuberculosis
ucgacggcggugacg

SEQ ID NO: 2881900 - RNA, 13 nt, Mycobacterium avium subsp. paratuberculosis
ucgacggcguggu

SEQ ID NO: 2881901 - RNA, 17 nt, Mycobacterium avium subsp. paratuberculosis
ucgacgggccaccagcg

SEQ ID NO: 2881902 - RNA, 20 nt, Mycobacterium avium subsp. paratuberculosis
ucgacggugaccggcucgag

SEQ ID NO: 2881903 - RNA, 21 nt, Mycobacterium avium subsp. paratuberculosis
ucgacggugaccggcucgagc

SEQ ID NO: 2881904 - RNA, 19 nt, Mycobacterium avium subsp. paratuberculosis
ucgacggugaccucgucgg

SEQ ID NO: 2881905 - RNA, 21 nt, Mycobacterium avium subsp. paratuberculosis
ucgacggugaccucgucgggc

SEQ ID NO: 2881906 - RNA, 16 nt, Mycobacterium avium subsp. paratuberculosis
ucgacggugaucaggg

SEQ ID NO: 2881907 - RNA, 14 nt, Mycobacterium avium subsp. paratuberculosis
ucgacggugcugcc

SEQ ID NO: 2881908 - RNA, 13 nt, Mycobacterium avium subsp. paratuberculosis
ucgacgguggccu

SEQ ID NO: 2881909 - RNA, 15 nt, Mycobacterium avium subsp. paratuberculosis
ucgacgguuugcccg

SEQ ID NO: 2881910 - RNA, 17 nt, Mycobacterium avium subsp. paratuberculosis
ucgacgguuugcccggc

SEQ ID NO: 2881911 - RNA, 20 nt, Mycobacterium avium subsp. paratuberculosis
ucgacgguuugcccggcgau

SEQ ID NO: 2881912 - RNA, 21 nt, Mycobacterium avium subsp. paratuberculosis
ucgacguacaucagcucguca

SEQ ID NO: 2881913 - RNA, 14 nt, Mycobacterium avium subsp. paratuberculosis
ucgacguagcccgc

SEQ ID NO: 2881914 - RNA, 20 nt, Mycobacterium avium subsp. paratuberculosis
ucgacguaggugagcaacgc

SEQ ID NO: 2881915 - RNA, 16 nt, Mycobacterium avium subsp. paratuberculosis
ucgacguaguccggcc

SEQ ID NO: 2881916 - RNA, 15 nt, Mycobacterium avium subsp. paratuberculosis
ucgacguagucgcgc

SEQ ID NO: 2881917 - RNA, 20 nt, Mycobacterium avium subsp. paratuberculosis
ucgacgucaccaccgggucg

SEQ ID NO: 2881918 - RNA, 17 nt, Mycobacterium avium subsp. paratuberculosis
ucgacgucacgacgguc

SEQ ID NO: 2881919 - RNA, 22 nt, Mycobacterium avium subsp. paratuberculosis
ucgacgucacgacggucacggc

SEQ ID NO: 2881920 - RNA, 19 nt, Mycobacterium avium subsp. paratuberculosis
ucgacgucagcucccccga

SEQ ID NO: 2881921 - RNA, 15 nt, Mycobacterium avium subsp. paratuberculosis
ucgacgucauccggc

SEQ ID NO: 2881922 - RNA, 14 nt, Mycobacterium avium subsp. paratuberculosis
ucgacguccaccgg

SEQ ID NO: 2881923 - RNA, 23 nt, Mycobacterium avium subsp. paratuberculosis
ucgacguccaccggauggcgccc

SEQ ID NO: 2881924 - RNA, 17 nt, Mycobacterium avium subsp. paratuberculosis
ucgacguccaggccggc

SEQ ID NO: 2881925 - RNA, 21 nt, Mycobacterium avium subsp. paratuberculosis
ucgacguccaggccggcgccg

SEQ ID NO: 2881926 - RNA, 21 nt, Mycobacterium avium subsp. paratuberculosis
ucgacguccucgaugccgacc

SEQ ID NO: 2881927 - RNA, 18 nt, Mycobacterium avium subsp. paratuberculosis
ucgacguccucgcccggg

SEQ ID NO: 2881928 - RNA, 13 nt, Mycobacterium avium subsp. paratuberculosis
ucgacgucgacgu

SEQ ID NO: 2881929 - RNA, 21 nt, Mycobacterium avium subsp. paratuberculosis
ucgacgucgagaaaggccagc

SEQ ID NO: 2881930 - RNA, 22 nt, Mycobacterium avium subsp. paratuberculosis
ucgacgucgagaaaggccagca

SEQ ID NO: 2881931 - RNA, 16 nt, Mycobacterium avium subsp. paratuberculosis
ucgacgucgagggcgc

SEQ ID NO: 2881932 - RNA, 19 nt, Mycobacterium avium subsp. paratuberculosis
ucgacgucggacgcggccg

SEQ ID NO: 2881933 - RNA, 22 nt, Mycobacterium avium subsp. paratuberculosis
ucgacgucggacgcggccgagc

SEQ ID NO: 2881934 - RNA, 12 nt, Mycobacterium avium subsp. paratuberculosis
ucgacgucgggc

SEQ ID NO: 2881935 - RNA, 13 nt, Mycobacterium avium subsp. paratuberculosis
ucgacgucgucga

SEQ ID NO: 2881936 - RNA, 20 nt, Mycobacterium avium subsp. paratuberculosis
ucgacgugaucuggucggcc

SEQ ID NO: 2881937 - RNA, 14 nt, Mycobacterium avium subsp. paratuberculosis
ucgacgugccguug

SEQ ID NO: 2881938 - RNA, 15 nt, Mycobacterium avium subsp. paratuberculosis
ucgacgugcgcggcg

SEQ ID NO: 2881939 - RNA, 16 nt, Mycobacterium avium subsp. paratuberculosis
ucgacgugcucggcgg

SEQ ID NO: 2881940 - RNA, 17 nt, Mycobacterium avium subsp. paratuberculosis
ucgacgugggcggccac

SEQ ID NO: 2881941 - RNA, 16 nt, Mycobacterium avium subsp. paratuberculosis
ucgacguggugcaccg

SEQ ID NO: 2881942 - RNA, 23 nt, Mycobacterium avium subsp. paratuberculosis
ucgacguggugcaccgccagcgc

SEQ ID NO: 2881943 - RNA, 18 nt, Mycobacterium avium subsp. paratuberculosis
ucgacguucggcgggcag

SEQ ID NO: 2881944 - RNA, 21 nt, Mycobacterium avium subsp. paratuberculosis
ucgacuccaccaccuggccgg

SEQ ID NO: 2881945 - RNA, 13 nt, Mycobacterium avium subsp. paratuberculosis
ucgacuccagcac

SEQ ID NO: 2881946 - RNA, 12 nt, Mycobacterium avium subsp. paratuberculosis
ucgacugcaccg

SEQ ID NO: 2881947 - RNA, 14 nt, Mycobacterium avium subsp. paratuberculosis
ucgacugcaggaac

SEQ ID NO: 2881948 - RNA, 17 nt, Mycobacterium avium subsp. paratuberculosis
ucgacuggaucaucgac

SEQ ID NO: 2881949 - RNA, 15 nt, Mycobacterium avium subsp. paratuberculosis
ucgacugggccaggu

SEQ ID NO: 2881950 - RNA, 21 nt, Mycobacterium avium subsp. paratuberculosis
ucgacugggccaggucgcuga

SEQ ID NO: 2881951 - RNA, 22 nt, Mycobacterium avium subsp. paratuberculosis
ucgagacaccgucgcgcaccca

SEQ ID NO: 2881952 - RNA, 17 nt, Mycobacterium avium subsp. paratuberculosis
ucgagacacgcgccggc

SEQ ID NO: 2881953 - RNA, 18 nt, Mycobacterium avium subsp. paratuberculosis
ucgagacacgcgccggcg

SEQ ID NO: 2881954 - RNA, 19 nt, Mycobacterium avium subsp. paratuberculosis
ucgagaccaugucggccag

SEQ ID NO: 2881955 - RNA, 14 nt, Mycobacterium avium subsp. paratuberculosis
ucgagagccgcauc

SEQ ID NO: 2881956 - RNA, 17 nt, Mycobacterium avium subsp. paratuberculosis
ucgagagccgcaucgca

SEQ ID NO: 2881957 - RNA, 14 nt, Mycobacterium avium subsp. paratuberculosis
ucgagaucagcacc

SEQ ID NO: 2881958 - RNA, 17 nt, Mycobacterium avium subsp. paratuberculosis
ucgagaucagggcgcgc

SEQ ID NO: 2881959 - RNA, 20 nt, Mycobacterium avium subsp. paratuberculosis
ucgagaucagggcgcgcacc

SEQ ID NO: 2881960 - RNA, 15 nt, Mycobacterium avium subsp. paratuberculosis
ucgagaugaccgucg

SEQ ID NO: 2881961 - RNA, 19 nt, Mycobacterium avium subsp. paratuberculosis
ucgagaugcguucggccgc

SEQ ID NO: 2881962 - RNA, 17 nt, Mycobacterium avium subsp. paratuberculosis
ucgagcacacgaucucg

SEQ ID NO: 2881963 - RNA, 14 nt, Mycobacterium avium subsp. paratuberculosis
ucgagcacaucggc

SEQ ID NO: 2881964 - RNA, 15 nt, Mycobacterium avium subsp. paratuberculosis
ucgagcaccacggcc

SEQ ID NO: 2881965 - RNA, 16 nt, Mycobacterium avium subsp. paratuberculosis
ucgagcaccacggccc

SEQ ID NO: 2881966 - RNA, 13 nt, Mycobacterium avium subsp. paratuberculosis
ucgagcaccagca

SEQ ID NO: 2881967 - RNA, 22 nt, Mycobacterium avium subsp. paratuberculosis
ucgagcaccagcgucgacgcgg

SEQ ID NO: 2881968 - RNA, 13 nt, Mycobacterium avium subsp. paratuberculosis
ucgagcacccggc

SEQ ID NO: 2881969 - RNA, 16 nt, Mycobacterium avium subsp. paratuberculosis
ucgagcacccggcggg

SEQ ID NO: 2881970 - RNA, 17 nt, Mycobacterium avium subsp. paratuberculosis
ucgagcacccggcgggg

SEQ ID NO: 2881971 - RNA, 18 nt, Mycobacterium avium subsp. paratuberculosis
ucgagcaccgcgaccacg

SEQ ID NO: 2881972 - RNA, 14 nt, Mycobacterium avium subsp. paratuberculosis
ucgagcaccgcguc

SEQ ID NO: 2881973 - RNA, 14 nt, Mycobacterium avium subsp. paratuberculosis
ucgagcaccggcgg

SEQ ID NO: 2881974 - RNA, 22 nt, Mycobacterium avium subsp. paratuberculosis
ucgagcaccggcuggugcagca

SEQ ID NO: 2881975 - RNA, 18 nt, Mycobacterium avium subsp. paratuberculosis
ucgagcaccgggcgucgg

SEQ ID NO: 2881976 - RNA, 19 nt, Mycobacterium avium subsp. paratuberculosis
ucgagcaccuccagauaga

SEQ ID NO: 2881977 - RNA, 20 nt, Mycobacterium avium subsp. paratuberculosis
ucgagcaccuccagauagag

SEQ ID NO: 2881978 - RNA, 13 nt, Mycobacterium avium subsp. paratuberculosis
ucgagcacgcccu

SEQ ID NO: 2881979 - RNA, 14 nt, Mycobacterium avium subsp. paratuberculosis
ucgagcacgcccug

SEQ ID NO: 2881980 - RNA, 18 nt, Mycobacterium avium subsp. paratuberculosis
ucgagcacgucgacgccg

SEQ ID NO: 2881981 - RNA, 20 nt, Mycobacterium avium subsp. paratuberculosis
ucgagcacgucgacgccggu

SEQ ID NO: 2881982 - RNA, 17 nt, Mycobacterium avium subsp. paratuberculosis
ucgagcacucgcgggac

SEQ ID NO: 2881983 - RNA, 16 nt, Mycobacterium avium subsp. paratuberculosis
ucgagcagcaccaccc

SEQ ID NO: 2881984 - RNA, 19 nt, Mycobacterium avium subsp. paratuberculosis
ucgagcagcagccgccggg

SEQ ID NO: 2881985 - RNA, 20 nt, Mycobacterium avium subsp. paratuberculosis
ucgagcagcagccgccgggc

SEQ ID NO: 2881986 - RNA, 12 nt, Mycobacterium avium subsp. paratuberculosis
ucgagcagccgc

SEQ ID NO: 2881987 - RNA, 13 nt, Mycobacterium avium subsp. paratuberculosis
ucgagcagcgcgc

SEQ ID NO: 2881988 - RNA, 15 nt, Mycobacterium avium subsp. paratuberculosis
ucgagcagcgcgcgc

SEQ ID NO: 2881989 - RNA, 19 nt, Mycobacterium avium subsp. paratuberculosis
ucgagcaggaacagacaca

SEQ ID NO: 2881990 - RNA, 17 nt, Mycobacterium avium subsp. paratuberculosis
ucgagcaguagacgccg

SEQ ID NO: 2881991 - RNA, 20 nt, Mycobacterium avium subsp. paratuberculosis
ucgagcaguagacgccgccg

SEQ ID NO: 2881992 - RNA, 20 nt, Mycobacterium avium subsp. paratuberculosis
ucgagcagugcaucgcugcc

SEQ ID NO: 2881993 - RNA, 23 nt, Mycobacterium avium subsp. paratuberculosis
ucgagcaucacgaacccguggau

SEQ ID NO: 2881994 - RNA, 22 nt, Mycobacterium avium subsp. paratuberculosis
ucgagcaucuccagccggcgaa

SEQ ID NO: 2881995 - RNA, 15 nt, Mycobacterium avium subsp. paratuberculosis
ucgagcaugcgggug

SEQ ID NO: 2881996 - RNA, 18 nt, Mycobacterium avium subsp. paratuberculosis
ucgagccaccacugcgcc

SEQ ID NO: 2881997 - RNA, 21 nt, Mycobacterium avium subsp. paratuberculosis
ucgagccaccacugcgccguc

SEQ ID NO: 2881998 - RNA, 12 nt, Mycobacterium avium subsp. paratuberculosis
ucgagccagcgg

SEQ ID NO: 2881999 - RNA, 19 nt, Mycobacterium avium subsp. paratuberculosis
ucgagccauaaaccggccg

SEQ ID NO: 2882000 - RNA, 15 nt, Mycobacterium avium subsp. paratuberculosis
ucgagcccaccgcgc

SEQ ID NO: 2882001 - RNA, 20 nt, Mycobacterium avium subsp. paratuberculosis
ucgagcccaccgcgcccagc

SEQ ID NO: 2882002 - RNA, 21 nt, Mycobacterium avium subsp. paratuberculosis
ucgagcccaccgcgcccagcc

SEQ ID NO: 2882003 - RNA, 20 nt, Mycobacterium avium subsp. paratuberculosis
ucgagccgagcaccggcagc

SEQ ID NO: 2882004 - RNA, 19 nt, Mycobacterium avium subsp. paratuberculosis
ucgagccgcagucgaucac

SEQ ID NO: 2882005 - RNA, 20 nt, Mycobacterium avium subsp. paratuberculosis
ucgagccgccugcgcgccgu

SEQ ID NO: 2882006 - RNA, 14 nt, Mycobacterium avium subsp. paratuberculosis
ucgagccgcggccc

SEQ ID NO: 2882007 - RNA, 20 nt, Mycobacterium avium subsp. paratuberculosis
ucgagccgcucgcgcaccgg

SEQ ID NO: 2882008 - RNA, 14 nt, Mycobacterium avium subsp. paratuberculosis
ucgagccggccgga

SEQ ID NO: 2882009 - RNA, 20 nt, Mycobacterium avium subsp. paratuberculosis
ucgagccggccgucaggaac

SEQ ID NO: 2882010 - RNA, 19 nt, Mycobacterium avium subsp. paratuberculosis
ucgagccggcgcacucccg

SEQ ID NO: 2882011 - RNA, 18 nt, Mycobacterium avium subsp. paratuberculosis
ucgagccgggcgcgggcg

SEQ ID NO: 2882012 - RNA, 21 nt, Mycobacterium avium subsp. paratuberculosis
ucgagccggugguuuugcggc

SEQ ID NO: 2882013 - RNA, 15 nt, Mycobacterium avium subsp. paratuberculosis
ucgagccuggcgcgc

SEQ ID NO: 2882014 - RNA, 18 nt, Mycobacterium avium subsp. paratuberculosis
ucgagccuggcgcgcaac

SEQ ID NO: 2882015 - RNA, 17 nt, Mycobacterium avium subsp. paratuberculosis
ucgagccuggugauccu

SEQ ID NO: 2882016 - RNA, 12 nt, Mycobacterium avium subsp. paratuberculosis
ucgagcgcaccg

SEQ ID NO: 2882017 - RNA, 14 nt, Mycobacterium avium subsp. paratuberculosis
ucgagcgcaccgcc

SEQ ID NO: 2882018 - RNA, 17 nt, Mycobacterium avium subsp. paratuberculosis
ucgagcgcaccgcccaa

SEQ ID NO: 2882019 - RNA, 14 nt, Mycobacterium avium subsp. paratuberculosis
ucgagcgccgcggc

SEQ ID NO: 2882020 - RNA, 19 nt, Mycobacterium avium subsp. paratuberculosis
ucgagcgccgcggccaccg

SEQ ID NO: 2882021 - RNA, 14 nt, Mycobacterium avium subsp. paratuberculosis
ucgagcgccggacg

SEQ ID NO: 2882022 - RNA, 16 nt, Mycobacterium avium subsp. paratuberculosis
ucgagcgcgucgacca

SEQ ID NO: 2882023 - RNA, 15 nt, Mycobacterium avium subsp. paratuberculosis
ucgagcggcccgucg

SEQ ID NO: 2882024 - RNA, 21 nt, Mycobacterium avium subsp. paratuberculosis
ucgagcggcuugccgccgcag

SEQ ID NO: 2882025 - RNA, 14 nt, Mycobacterium avium subsp. paratuberculosis
ucgagcgggcgggc

SEQ ID NO: 2882026 - RNA, 15 nt, Mycobacterium avium subsp. paratuberculosis
ucgagcgucacgccg

SEQ ID NO: 2882027 - RNA, 17 nt, Mycobacterium avium subsp. paratuberculosis
ucgagcgucacgccgcg

SEQ ID NO: 2882028 - RNA, 18 nt, Mycobacterium avium subsp. paratuberculosis
ucgagcgucacgccgcgc

SEQ ID NO: 2882029 - RNA, 20 nt, Mycobacterium avium subsp. paratuberculosis
ucgagcgucacgccgcgccc

SEQ ID NO: 2882030 - RNA, 15 nt, Mycobacterium avium subsp. paratuberculosis
ucgagcgucacgcug

SEQ ID NO: 2882031 - RNA, 16 nt, Mycobacterium avium subsp. paratuberculosis
ucgagcgucacgcugg

SEQ ID NO: 2882032 - RNA, 20 nt, Mycobacterium avium subsp. paratuberculosis
ucgagcgucauuccgccgcg

SEQ ID NO: 2882033 - RNA, 21 nt, Mycobacterium avium subsp. paratuberculosis
ucgagcgucauuccgccgcgc

SEQ ID NO: 2882034 - RNA, 15 nt, Mycobacterium avium subsp. paratuberculosis
ucgagcgugcccgcg

SEQ ID NO: 2882035 - RNA, 19 nt, Mycobacterium avium subsp. paratuberculosis
ucgagcgugcccgcgccca

SEQ ID NO: 2882036 - RNA, 23 nt, Mycobacterium avium subsp. paratuberculosis
ucgagcuccuccggguccccgcc

SEQ ID NO: 2882037 - RNA, 18 nt, Mycobacterium avium subsp. paratuberculosis
ucgagcuccucggccagc

SEQ ID NO: 2882038 - RNA, 21 nt, Mycobacterium avium subsp. paratuberculosis
ucgagcucggccuugagccgg

SEQ ID NO: 2882039 - RNA, 15 nt, Mycobacterium avium subsp. paratuberculosis
ucgagcucgucgggu

SEQ ID NO: 2882040 - RNA, 14 nt, Mycobacterium avium subsp. paratuberculosis
ucgagcugcacggg

SEQ ID NO: 2882041 - RNA, 16 nt, Mycobacterium avium subsp. paratuberculosis
ucgagcugggcccgcg

SEQ ID NO: 2882042 - RNA, 17 nt, Mycobacterium avium subsp. paratuberculosis
ucgagcuuccgccgagu

SEQ ID NO: 2882043 - RNA, 21 nt, Mycobacterium avium subsp. paratuberculosis
ucgagcuugccgucguugacg

SEQ ID NO: 2882044 - RNA, 18 nt, Mycobacterium avium subsp. paratuberculosis
ucgaggaacuugcgccgg

SEQ ID NO: 2882045 - RNA, 15 nt, Mycobacterium avium subsp. paratuberculosis
ucgaggaauccgguc

SEQ ID NO: 2882046 - RNA, 13 nt, Mycobacterium avium subsp. paratuberculosis
ucgaggacaccgc

SEQ ID NO: 2882047 - RNA, 14 nt, Mycobacterium avium subsp. paratuberculosis
ucgaggaccggcgc

SEQ ID NO: 2882048 - RNA, 16 nt, Mycobacterium avium subsp. paratuberculosis
ucgaggaucgcggcca

SEQ ID NO: 2882049 - RNA, 21 nt, Mycobacterium avium subsp. paratuberculosis
ucgaggaucgcggccacgccc

SEQ ID NO: 2882050 - RNA, 14 nt, Mycobacterium avium subsp. paratuberculosis
ucgaggaucucccg

SEQ ID NO: 2882051 - RNA, 15 nt, Mycobacterium avium subsp. paratuberculosis
ucgaggccagcgcga

SEQ ID NO: 2882052 - RNA, 21 nt, Mycobacterium avium subsp. paratuberculosis
ucgaggccagcgcgaucgccg

SEQ ID NO: 2882053 - RNA, 17 nt, Mycobacterium avium subsp. paratuberculosis
ucgaggcccucgacacc

SEQ ID NO: 2882054 - RNA, 19 nt, Mycobacterium avium subsp. paratuberculosis
ucgaggcccucgacaccgg

SEQ ID NO: 2882055 - RNA, 14 nt, Mycobacterium avium subsp. paratuberculosis
ucgaggccgacgug

SEQ ID NO: 2882056 - RNA, 23 nt, Mycobacterium avium subsp. paratuberculosis
ucgaggccgcgggcguucaucac

SEQ ID NO: 2882057 - RNA, 13 nt, Mycobacterium avium subsp. paratuberculosis
ucgaggccggcca

SEQ ID NO: 2882058 - RNA, 16 nt, Mycobacterium avium subsp. paratuberculosis
ucgaggccggccagcg

SEQ ID NO: 2882059 - RNA, 19 nt, Mycobacterium avium subsp. paratuberculosis
ucgaggccggccagcgggu

SEQ ID NO: 2882060 - RNA, 19 nt, Mycobacterium avium subsp. paratuberculosis
ucgaggccguaucccacca

SEQ ID NO: 2882061 - RNA, 18 nt, Mycobacterium avium subsp. paratuberculosis
ucgaggcgaucaucgccc

SEQ ID NO: 2882062 - RNA, 12 nt, Mycobacterium avium subsp. paratuberculosis
ucgaggcgcugc

SEQ ID NO: 2882063 - RNA, 13 nt, Mycobacterium avium subsp. paratuberculosis
ucgagggccaccg

SEQ ID NO: 2882064 - RNA, 15 nt, Mycobacterium avium subsp. paratuberculosis
ucgagggccaccggc

SEQ ID NO: 2882065 - RNA, 16 nt, Mycobacterium avium subsp. paratuberculosis
ucgagggccuccacca

SEQ ID NO: 2882066 - RNA, 13 nt, Mycobacterium avium subsp. paratuberculosis
ucgagggcgccgu

SEQ ID NO: 2882067 - RNA, 20 nt, Mycobacterium avium subsp. paratuberculosis
ucgagggcguccuuccaacg

SEQ ID NO: 2882068 - RNA, 15 nt, Mycobacterium avium subsp. paratuberculosis
ucgagggcguucgcg

SEQ ID NO: 2882069 - RNA, 22 nt, Mycobacterium avium subsp. paratuberculosis
ucgagggcuaaccaccggugac

SEQ ID NO: 2882070 - RNA, 23 nt, Mycobacterium avium subsp. paratuberculosis
ucgagggcuaaccaccggugacg

SEQ ID NO: 2882071 - RNA, 19 nt, Mycobacterium avium subsp. paratuberculosis
ucgaggggcuuggcgacga

SEQ ID NO: 2882072 - RNA, 16 nt, Mycobacterium avium subsp. paratuberculosis
ucgagggucgccaggc

SEQ ID NO: 2882073 - RNA, 17 nt, Mycobacterium avium subsp. paratuberculosis
ucgagggucgccaggcc

SEQ ID NO: 2882074 - RNA, 21 nt, Mycobacterium avium subsp. paratuberculosis
ucgagguagcgugcgcccgac

SEQ ID NO: 2882075 - RNA, 22 nt, Mycobacterium avium subsp. paratuberculosis
ucgagguagcgugcgcccgacg

SEQ ID NO: 2882076 - RNA, 15 nt, Mycobacterium avium subsp. paratuberculosis
ucgagguaggcgaga

SEQ ID NO: 2882077 - RNA, 15 nt, Mycobacterium avium subsp. paratuberculosis
ucgagguccucggcg

SEQ ID NO: 2882078 - RNA, 14 nt, Mycobacterium avium subsp. paratuberculosis
ucgaggucgccgac

SEQ ID NO: 2882079 - RNA, 16 nt, Mycobacterium avium subsp. paratuberculosis
ucgaggucggugaggc

SEQ ID NO: 2882080 - RNA, 20 nt, Mycobacterium avium subsp. paratuberculosis
ucgaggucggugaggcuggg

SEQ ID NO: 2882081 - RNA, 21 nt, Mycobacterium avium subsp. paratuberculosis
ucgaggugauguuggccgcga

SEQ ID NO: 2882082 - RNA, 15 nt, Mycobacterium avium subsp. paratuberculosis
ucgaguaggcccagu

SEQ ID NO: 2882083 - RNA, 17 nt, Mycobacterium avium subsp. paratuberculosis
ucgaguaggcccagucc

SEQ ID NO: 2882084 - RNA, 21 nt, Mycobacterium avium subsp. paratuberculosis
ucgaguaggcccaguccugca

SEQ ID NO: 2882085 - RNA, 23 nt, Mycobacterium avium subsp. paratuberculosis
ucgaguccguugggggcgccgcg

SEQ ID NO: 2882086 - RNA, 22 nt, Mycobacterium avium subsp. paratuberculosis
ucgaguguguacacagggcggc

SEQ ID NO: 2882087 - RNA, 17 nt, Mycobacterium avium subsp. paratuberculosis
ucgaguuccgcgucggc

SEQ ID NO: 2882088 - RNA, 22 nt, Mycobacterium avium subsp. paratuberculosis
ucgaguucgucgaccagcgggc

SEQ ID NO: 2882089 - RNA, 14 nt, Mycobacterium avium subsp. paratuberculosis
ucgaguuuggccag

SEQ ID NO: 2882090 - RNA, 22 nt, Mycobacterium avium subsp. paratuberculosis
ucgauaaacgguugcgccagug

SEQ ID NO: 2882091 - RNA, 20 nt, Mycobacterium avium subsp. paratuberculosis
ucgauaacgcgcgcgccguc

SEQ ID NO: 2882092 - RNA, 15 nt, Mycobacterium avium subsp. paratuberculosis
ucgauaauggcggcc

SEQ ID NO: 2882093 - RNA, 22 nt, Mycobacterium avium subsp. paratuberculosis
ucgauaauggcggccgccgcga

SEQ ID NO: 2882094 - RNA, 14 nt, Mycobacterium avium subsp. paratuberculosis
ucgaucaacgccgg

SEQ ID NO: 2882095 - RNA, 16 nt, Mycobacterium avium subsp. paratuberculosis
ucgaucaccgggcggc

SEQ ID NO: 2882096 - RNA, 20 nt, Mycobacterium avium subsp. paratuberculosis
ucgaucaccucgaccgugag

SEQ ID NO: 2882097 - RNA, 17 nt, Mycobacterium avium subsp. paratuberculosis
ucgaucaccucgucgag

SEQ ID NO: 2882098 - RNA, 20 nt, Mycobacterium avium subsp. paratuberculosis
ucgaucacgccgccggggcg

SEQ ID NO: 2882099 - RNA, 22 nt, Mycobacterium avium subsp. paratuberculosis
ucgaucagagcgggccgaccgu

SEQ ID NO: 2882100 - RNA, 15 nt, Mycobacterium avium subsp. paratuberculosis
ucgaucagcaccgcc

SEQ ID NO: 2882101 - RNA, 22 nt, Mycobacterium avium subsp. paratuberculosis
ucgaucagccacaccgccggcg

SEQ ID NO: 2882102 - RNA, 17 nt, Mycobacterium avium subsp. paratuberculosis
ucgaucagccgcgacag

SEQ ID NO: 2882103 - RNA, 14 nt, Mycobacterium avium subsp. paratuberculosis
ucgaucagcgcgcc

SEQ ID NO: 2882104 - RNA, 13 nt, Mycobacterium avium subsp. paratuberculosis
ucgaucagcggca

SEQ ID NO: 2882105 - RNA, 22 nt, Mycobacterium avium subsp. paratuberculosis
ucgaucagcggcaucgaggacc

SEQ ID NO: 2882106 - RNA, 16 nt, Mycobacterium avium subsp. paratuberculosis
ucgaucaucuccaccc

SEQ ID NO: 2882107 - RNA, 19 nt, Mycobacterium avium subsp. paratuberculosis
ucgaucaucuccacccggc

SEQ ID NO: 2882108 - RNA, 21 nt, Mycobacterium avium subsp. paratuberculosis
ucgaucauguagcgcugguag

SEQ ID NO: 2882109 - RNA, 15 nt, Mycobacterium avium subsp. paratuberculosis
ucgaucccgccggcg

SEQ ID NO: 2882110 - RNA, 17 nt, Mycobacterium avium subsp. paratuberculosis
ucgaucccgccggcgau

SEQ ID NO: 2882111 - RNA, 19 nt, Mycobacterium avium subsp. paratuberculosis
ucgaucccgccggcgaucg

SEQ ID NO: 2882112 - RNA, 19 nt, Mycobacterium avium subsp. paratuberculosis
ucgaucccgucggccauca

SEQ ID NO: 2882113 - RNA, 17 nt, Mycobacterium avium subsp. paratuberculosis
ucgaucccuuggcggcg

SEQ ID NO: 2882114 - RNA, 17 nt, Mycobacterium avium subsp. paratuberculosis
ucgaucgacgacgccag

SEQ ID NO: 2882115 - RNA, 13 nt, Mycobacterium avium subsp. paratuberculosis
ucgaucgacgccg

SEQ ID NO: 2882116 - RNA, 15 nt, Mycobacterium avium subsp. paratuberculosis
ucgaucgacgccgac

SEQ ID NO: 2882117 - RNA, 13 nt, Mycobacterium avium subsp. paratuberculosis
ucgaucgccaccg

SEQ ID NO: 2882118 - RNA, 23 nt, Mycobacterium avium subsp. paratuberculosis
ucgaucgcccgcuccgcgggcag

SEQ ID NO: 2882119 - RNA, 16 nt, Mycobacterium avium subsp. paratuberculosis
ucgaucgccgcgccca

SEQ ID NO: 2882120 - RNA, 19 nt, Mycobacterium avium subsp. paratuberculosis
ucgaucgccgcgcccagca

SEQ ID NO: 2882121 - RNA, 19 nt, Mycobacterium avium subsp. paratuberculosis
ucgaucgcgaccaccggcc

SEQ ID NO: 2882122 - RNA, 12 nt, Mycobacterium avium subsp. paratuberculosis
ucgaucgcgguc

SEQ ID NO: 2882123 - RNA, 14 nt, Mycobacterium avium subsp. paratuberculosis
ucgaucgcggucac

SEQ ID NO: 2882124 - RNA, 17 nt, Mycobacterium avium subsp. paratuberculosis
ucgaucuccucgcgcgg

SEQ ID NO: 2882125 - RNA, 13 nt, Mycobacterium avium subsp. paratuberculosis
ucgaucuccucgg

SEQ ID NO: 2882126 - RNA, 15 nt, Mycobacterium avium subsp. paratuberculosis
ucgaucucggccagc

SEQ ID NO: 2882127 - RNA, 17 nt, Mycobacterium avium subsp. paratuberculosis
ucgaucucggccagcgg

SEQ ID NO: 2882128 - RNA, 13 nt, Mycobacterium avium subsp. paratuberculosis
ucgaucucgucgc

SEQ ID NO: 2882129 - RNA, 16 nt, Mycobacterium avium subsp. paratuberculosis
ucgaucugcaccagcg

SEQ ID NO: 2882130 - RNA, 17 nt, Mycobacterium avium subsp. paratuberculosis
ucgaucugcagccggcg

SEQ ID NO: 2882131 - RNA, 13 nt, Mycobacterium avium subsp. paratuberculosis
ucgaucugcggca

SEQ ID NO: 2882132 - RNA, 14 nt, Mycobacterium avium subsp. paratuberculosis
ucgaucugcggcac

SEQ ID NO: 2882133 - RNA, 19 nt, Mycobacterium avium subsp. paratuberculosis
ucgaucuggcggacccgcu

SEQ ID NO: 2882134 - RNA, 23 nt, Mycobacterium avium subsp. paratuberculosis
ucgaucugggccaggaucucguc

SEQ ID NO: 2882135 - RNA, 16 nt, Mycobacterium avium subsp. paratuberculosis
ucgaugaaccgcugcu

SEQ ID NO: 2882136 - RNA, 19 nt, Mycobacterium avium subsp. paratuberculosis
ucgaugaacucgcgggcga

SEQ ID NO: 2882137 - RNA, 17 nt, Mycobacterium avium subsp. paratuberculosis
ucgaugaauccgcgcag

SEQ ID NO: 2882138 - RNA, 19 nt, Mycobacterium avium subsp. paratuberculosis
ucgaugaauccgcgcagca

SEQ ID NO: 2882139 - RNA, 21 nt, Mycobacterium avium subsp. paratuberculosis
ucgaugaauccgcgcagcagc

SEQ ID NO: 2882140 - RNA, 14 nt, Mycobacterium avium subsp. paratuberculosis
ucgaugaccucgcg

SEQ ID NO: 2882141 - RNA, 18 nt, Mycobacterium avium subsp. paratuberculosis
ucgaugaccucgcgcagc

SEQ ID NO: 2882142 - RNA, 21 nt, Mycobacterium avium subsp. paratuberculosis
ucgaugaccucgcgcccggcg

SEQ ID NO: 2882143 - RNA, 13 nt, Mycobacterium avium subsp. paratuberculosis
ucgaugacgccgc

SEQ ID NO: 2882144 - RNA, 15 nt, Mycobacterium avium subsp. paratuberculosis
ucgaugacgccgcgc

SEQ ID NO: 2882145 - RNA, 23 nt, Mycobacterium avium subsp. paratuberculosis
ucgaugacgccgcgccgcccggc

SEQ ID NO: 2882146 - RNA, 18 nt, Mycobacterium avium subsp. paratuberculosis
ucgaugcauucguccauc

SEQ ID NO: 2882147 - RNA, 16 nt, Mycobacterium avium subsp. paratuberculosis
ucgaugcccagcgcgc

SEQ ID NO: 2882148 - RNA, 23 nt, Mycobacterium avium subsp. paratuberculosis
ucgaugcccgcguccugcagcgc

SEQ ID NO: 2882149 - RNA, 20 nt, Mycobacterium avium subsp. paratuberculosis
ucgaugcccuagcgguggcg

SEQ ID NO: 2882150 - RNA, 21 nt, Mycobacterium avium subsp. paratuberculosis
ucgaugcccuccagcaccguc

SEQ ID NO: 2882151 - RNA, 20 nt, Mycobacterium avium subsp. paratuberculosis
ucgaugccgaccgacagccg

SEQ ID NO: 2882152 - RNA, 13 nt, Mycobacterium avium subsp. paratuberculosis
ucgaugccggcca

SEQ ID NO: 2882153 - RNA, 17 nt, Mycobacterium avium subsp. paratuberculosis
ucgaugccggccagcgg

SEQ ID NO: 2882154 - RNA, 19 nt, Mycobacterium avium subsp. paratuberculosis
ucgaugccggccagcggcc

SEQ ID NO: 2882155 - RNA, 24 nt, Mycobacterium avium subsp. paratuberculosis
ucgaugccggcgauccgcgcggcg

SEQ ID NO: 2882156 - RNA, 17 nt, Mycobacterium avium subsp. paratuberculosis
ucgaugccgggcauggc

SEQ ID NO: 2882157 - RNA, 21 nt, Mycobacterium avium subsp. paratuberculosis
ucgaugccguagaccagcauc

SEQ ID NO: 2882158 - RNA, 13 nt, Mycobacterium avium subsp. paratuberculosis
ucgaugccgugcc

SEQ ID NO: 2882159 - RNA, 16 nt, Mycobacterium avium subsp. paratuberculosis
ucgaugccguugugca

SEQ ID NO: 2882160 - RNA, 13 nt, Mycobacterium avium subsp. paratuberculosis
ucgaugcgcaccu

SEQ ID NO: 2882161 - RNA, 12 nt, Mycobacterium avium subsp. paratuberculosis
ucgaugcgcgcc

SEQ ID NO: 2882162 - RNA, 19 nt, Mycobacterium avium subsp. paratuberculosis
ucgaugcgcgccaccaggc

SEQ ID NO: 2882163 - RNA, 22 nt, Mycobacterium avium subsp. paratuberculosis
ucgaugcgcgccaccaggcggu

SEQ ID NO: 2882164 - RNA, 14 nt, Mycobacterium avium subsp. paratuberculosis
ucgaugcgcucggc

SEQ ID NO: 2882165 - RNA, 15 nt, Mycobacterium avium subsp. paratuberculosis
ucgaugcgggcccgc

SEQ ID NO: 2882166 - RNA, 18 nt, Mycobacterium avium subsp. paratuberculosis
ucgauggaaggugcugaa

SEQ ID NO: 2882167 - RNA, 22 nt, Mycobacterium avium subsp. paratuberculosis
ucgauggacaggcacucgccca

SEQ ID NO: 2882168 - RNA, 15 nt, Mycobacterium avium subsp. paratuberculosis
ucgauggacagggcg

SEQ ID NO: 2882169 - RNA, 18 nt, Mycobacterium avium subsp. paratuberculosis
ucgauggacagggcgaca

SEQ ID NO: 2882170 - RNA, 21 nt, Mycobacterium avium subsp. paratuberculosis
ucgauggaccggguggugggc

SEQ ID NO: 2882171 - RNA, 14 nt, Mycobacterium avium subsp. paratuberculosis
ucgauggacgccag

SEQ ID NO: 2882172 - RNA, 19 nt, Mycobacterium avium subsp. paratuberculosis
ucgauggacgccagcauga

SEQ ID NO: 2882173 - RNA, 13 nt, Mycobacterium avium subsp. paratuberculosis
ucgauggacgcgg

SEQ ID NO: 2882174 - RNA, 16 nt, Mycobacterium avium subsp. paratuberculosis
ucgauggccaccaggu

SEQ ID NO: 2882175 - RNA, 13 nt, Mycobacterium avium subsp. paratuberculosis
ucgauggccacgc

SEQ ID NO: 2882176 - RNA, 13 nt, Mycobacterium avium subsp. paratuberculosis
ucgauggcccgcu

SEQ ID NO: 2882177 - RNA, 17 nt, Mycobacterium avium subsp. paratuberculosis
ucgauggccucgucgau

SEQ ID NO: 2882178 - RNA, 14 nt, Mycobacterium avium subsp. paratuberculosis
ucgauggcgcggcc

SEQ ID NO: 2882179 - RNA, 12 nt, Mycobacterium avium subsp. paratuberculosis
ucgauggcggcg

SEQ ID NO: 2882180 - RNA, 19 nt, Mycobacterium avium subsp. paratuberculosis
ucgauggcgggcgcgccgg

SEQ ID NO: 2882181 - RNA, 20 nt, Mycobacterium avium subsp. paratuberculosis
ucgauggcgggcgcgccggc

SEQ ID NO: 2882182 - RNA, 21 nt, Mycobacterium avium subsp. paratuberculosis
ucgauggcguagcgggucagc

SEQ ID NO: 2882183 - RNA, 16 nt, Mycobacterium avium subsp. paratuberculosis
ucgauggggauggugc

SEQ ID NO: 2882184 - RNA, 16 nt, Mycobacterium avium subsp. paratuberculosis
ucgauggguucuucga

SEQ ID NO: 2882185 - RNA, 12 nt, Mycobacterium avium subsp. paratuberculosis
ucgauggucugc

SEQ ID NO: 2882186 - RNA, 18 nt, Mycobacterium avium subsp. paratuberculosis
ucgauggucugcccgccg

SEQ ID NO: 2882187 - RNA, 19 nt, Mycobacterium avium subsp. paratuberculosis
ucgaugguguagccgugcc

SEQ ID NO: 2882188 - RNA, 13 nt, Mycobacterium avium subsp. paratuberculosis
ucgaugucgacgc

SEQ ID NO: 2882189 - RNA, 15 nt, Mycobacterium avium subsp. paratuberculosis
ucgaugucgcccggc

SEQ ID NO: 2882190 - RNA, 16 nt, Mycobacterium avium subsp. paratuberculosis
ucgaugucgcccggcg

SEQ ID NO: 2882191 - RNA, 18 nt, Mycobacterium avium subsp. paratuberculosis
ucgaugucgcccggcgcg

SEQ ID NO: 2882192 - RNA, 14 nt, Mycobacterium avium subsp. paratuberculosis
ucgaugucgccggc

SEQ ID NO: 2882193 - RNA, 14 nt, Mycobacterium avium subsp. paratuberculosis
ucgaugucggccag

SEQ ID NO: 2882194 - RNA, 20 nt, Mycobacterium avium subsp. paratuberculosis
ucgaugucggcgaaccaggg

SEQ ID NO: 2882195 - RNA, 12 nt, Mycobacterium avium subsp. paratuberculosis
ucgaugugggcc

SEQ ID NO: 2882196 - RNA, 15 nt, Mycobacterium avium subsp. paratuberculosis
ucgauguugaucgcc

SEQ ID NO: 2882197 - RNA, 12 nt, Mycobacterium avium subsp. paratuberculosis
ucgauugccgcg

SEQ ID NO: 2882198 - RNA, 20 nt, Mycobacterium avium subsp. paratuberculosis
ucgauuucaaggggccgggc

SEQ ID NO: 2882199 - RNA, 23 nt, Mycobacterium avium subsp. paratuberculosis
ucgauuugaugaacacggucgcc

SEQ ID NO: 2882200 - RNA, 19 nt, Mycobacterium avium subsp. paratuberculosis
ucgcaaccagugcacgcuc

SEQ ID NO: 2882201 - RNA, 17 nt, Mycobacterium avium subsp. paratuberculosis
ucgcaagcagagcagcg

SEQ ID NO: 2882202 - RNA, 15 nt, Mycobacterium avium subsp. paratuberculosis
ucgcacaccagcacg

SEQ ID NO: 2882203 - RNA, 17 nt, Mycobacterium avium subsp. paratuberculosis
ucgcacaccagcacggc

SEQ ID NO: 2882204 - RNA, 20 nt, Mycobacterium avium subsp. paratuberculosis
ucgcacaccagcacggcggc

SEQ ID NO: 2882205 - RNA, 19 nt, Mycobacterium avium subsp. paratuberculosis
ucgcacagauacgcgacga

SEQ ID NO: 2882206 - RNA, 14 nt, Mycobacterium avium subsp. paratuberculosis
ucgcacagcaccag

SEQ ID NO: 2882207 - RNA, 19 nt, Mycobacterium avium subsp. paratuberculosis
ucgcacagccgcagcagcc

SEQ ID NO: 2882208 - RNA, 13 nt, Mycobacterium avium subsp. paratuberculosis
ucgcacagccggc

SEQ ID NO: 2882209 - RNA, 16 nt, Mycobacterium avium subsp. paratuberculosis
ucgcacagccggcgcg

SEQ ID NO: 2882210 - RNA, 17 nt, Mycobacterium avium subsp. paratuberculosis
ucgcacagccggcgcgc

SEQ ID NO: 2882211 - RNA, 13 nt, Mycobacterium avium subsp. paratuberculosis
ucgcacaggaugc

SEQ ID NO: 2882212 - RNA, 22 nt, Mycobacterium avium subsp. paratuberculosis
ucgcaccagcgcuuucgcgcac

SEQ ID NO: 2882213 - RNA, 15 nt, Mycobacterium avium subsp. paratuberculosis
ucgcaccccaccgac

SEQ ID NO: 2882214 - RNA, 21 nt, Mycobacterium avium subsp. paratuberculosis
ucgcaccccaccgacagccgg

SEQ ID NO: 2882215 - RNA, 13 nt, Mycobacterium avium subsp. paratuberculosis
ucgcaccgcgagc

SEQ ID NO: 2882216 - RNA, 15 nt, Mycobacterium avium subsp. paratuberculosis
ucgcaccgcgagcag

SEQ ID NO: 2882217 - RNA, 18 nt, Mycobacterium avium subsp. paratuberculosis
ucgcaccgcgagcagacg

SEQ ID NO: 2882218 - RNA, 19 nt, Mycobacterium avium subsp. paratuberculosis
ucgcaccgcgagcagacgc

SEQ ID NO: 2882219 - RNA, 17 nt, Mycobacterium avium subsp. paratuberculosis
ucgcaccgcggcgugga

SEQ ID NO: 2882220 - RNA, 13 nt, Mycobacterium avium subsp. paratuberculosis
ucgcacgccggua

SEQ ID NO: 2882221 - RNA, 19 nt, Mycobacterium avium subsp. paratuberculosis
ucgcacuagguccggcgcg

SEQ ID NO: 2882222 - RNA, 23 nt, Mycobacterium avium subsp. paratuberculosis
ucgcacuagguccggcgcgacca

SEQ ID NO: 2882223 - RNA, 17 nt, Mycobacterium avium subsp. paratuberculosis
ucgcagacguagcacca

SEQ ID NO: 2882224 - RNA, 17 nt, Mycobacterium avium subsp. paratuberculosis
ucgcagaucccgccggc

SEQ ID NO: 2882225 - RNA, 16 nt, Mycobacterium avium subsp. paratuberculosis
ucgcagauggucggga

SEQ ID NO: 2882226 - RNA, 23 nt, Mycobacterium avium subsp. paratuberculosis
ucgcagauggucgggacgucggc

SEQ ID NO: 2882227 - RNA, 12 nt, Mycobacterium avium subsp. paratuberculosis
ucgcagcagcag

SEQ ID NO: 2882228 - RNA, 22 nt, Mycobacterium avium subsp. paratuberculosis
ucgcagcccgggugcgaacagc

SEQ ID NO: 2882229 - RNA, 21 nt, Mycobacterium avium subsp. paratuberculosis
ucgcagcgacaaucggcucgc

SEQ ID NO: 2882230 - RNA, 14 nt, Mycobacterium avium subsp. paratuberculosis
ucgcagcggcacgu

SEQ ID NO: 2882231 - RNA, 15 nt, Mycobacterium avium subsp. paratuberculosis
ucgcaggcagcagca

SEQ ID NO: 2882232 - RNA, 17 nt, Mycobacterium avium subsp. paratuberculosis
ucgcaggcagcagcacc

SEQ ID NO: 2882233 - RNA, 18 nt, Mycobacterium avium subsp. paratuberculosis
ucgcaggcagcagcaccc

SEQ ID NO: 2882234 - RNA, 21 nt, Mycobacterium avium subsp. paratuberculosis
ucgcaggcagcagcaccccga

SEQ ID NO: 2882235 - RNA, 17 nt, Mycobacterium avium subsp. paratuberculosis
ucgcaggcgagccgaca

SEQ ID NO: 2882236 - RNA, 18 nt, Mycobacterium avium subsp. paratuberculosis
ucgcaggcgagccgacag

SEQ ID NO: 2882237 - RNA, 15 nt, Mycobacterium avium subsp. paratuberculosis
ucgcaggcgagccgg

SEQ ID NO: 2882238 - RNA, 22 nt, Mycobacterium avium subsp. paratuberculosis
ucgcaggugccggugacgguca

SEQ ID NO: 2882239 - RNA, 15 nt, Mycobacterium avium subsp. paratuberculosis
ucgcagucgaucagc

SEQ ID NO: 2882240 - RNA, 19 nt, Mycobacterium avium subsp. paratuberculosis
ucgcagucgaucagcgacg

SEQ ID NO: 2882241 - RNA, 18 nt, Mycobacterium avium subsp. paratuberculosis
ucgcagugcccgcccagc

SEQ ID NO: 2882242 - RNA, 19 nt, Mycobacterium avium subsp. paratuberculosis
ucgcagugcccgcccagcu

SEQ ID NO: 2882243 - RNA, 17 nt, Mycobacterium avium subsp. paratuberculosis
ucgcaucagcucggcag

SEQ ID NO: 2882244 - RNA, 18 nt, Mycobacterium avium subsp. paratuberculosis
ucgcaucagcucggcagc

SEQ ID NO: 2882245 - RNA, 18 nt, Mycobacterium avium subsp. paratuberculosis
ucgccaauaaagcgggcc

SEQ ID NO: 2882246 - RNA, 17 nt, Mycobacterium avium subsp. paratuberculosis
ucgccaauccggcgggc

SEQ ID NO: 2882247 - RNA, 19 nt, Mycobacterium avium subsp. paratuberculosis
ucgccaccaccacggggcg

SEQ ID NO: 2882248 - RNA, 22 nt, Mycobacterium avium subsp. paratuberculosis
ucgccaccaccacggggcgggu

SEQ ID NO: 2882249 - RNA, 19 nt, Mycobacterium avium subsp. paratuberculosis
ucgccaccaccagcgggcu

SEQ ID NO: 2882250 - RNA, 16 nt, Mycobacterium avium subsp. paratuberculosis
ucgccaccaccgcgcc

SEQ ID NO: 2882251 - RNA, 22 nt, Mycobacterium avium subsp. paratuberculosis
ucgccaccaccgcgccgucguc

SEQ ID NO: 2882252 - RNA, 13 nt, Mycobacterium avium subsp. paratuberculosis
ucgccaccacggc

SEQ ID NO: 2882253 - RNA, 17 nt, Mycobacterium avium subsp. paratuberculosis
ucgccaccagaccggcg

SEQ ID NO: 2882254 - RNA, 19 nt, Mycobacterium avium subsp. paratuberculosis
ucgccaccagaccggcgaa

SEQ ID NO: 2882255 - RNA, 15 nt, Mycobacterium avium subsp. paratuberculosis
ucgccaccccgcgcc

SEQ ID NO: 2882256 - RNA, 19 nt, Mycobacterium avium subsp. paratuberculosis
ucgccaccccgcgccacgc

SEQ ID NO: 2882257 - RNA, 16 nt, Mycobacterium avium subsp. paratuberculosis
ucgccacccgcaccuc

SEQ ID NO: 2882258 - RNA, 23 nt, Mycobacterium avium subsp. paratuberculosis
ucgccaccgagaucaugccggcg

SEQ ID NO: 2882259 - RNA, 18 nt, Mycobacterium avium subsp. paratuberculosis
ucgccaccgaugcgggcc

SEQ ID NO: 2882260 - RNA, 22 nt, Mycobacterium avium subsp. paratuberculosis
ucgccaccgaugcgggccagga

SEQ ID NO: 2882261 - RNA, 12 nt, Mycobacterium avium subsp. paratuberculosis
ucgccaccgucg

SEQ ID NO: 2882262 - RNA, 15 nt, Mycobacterium avium subsp. paratuberculosis
ucgccaccgucgucg

SEQ ID NO: 2882263 - RNA, 17 nt, Mycobacterium avium subsp. paratuberculosis
ucgccaccgucgucgag

SEQ ID NO: 2882264 - RNA, 22 nt, Mycobacterium avium subsp. paratuberculosis
ucgccaccuggaagcgcaucgc

SEQ ID NO: 2882265 - RNA, 14 nt, Mycobacterium avium subsp. paratuberculosis
ucgccacgaucacc

SEQ ID NO: 2882266 - RNA, 13 nt, Mycobacterium avium subsp. paratuberculosis
ucgccacgccgac

SEQ ID NO: 2882267 - RNA, 14 nt, Mycobacterium avium subsp. paratuberculosis
ucgccacgccgacc

SEQ ID NO: 2882268 - RNA, 15 nt, Mycobacterium avium subsp. paratuberculosis
ucgccacgccgacca

SEQ ID NO: 2882269 - RNA, 16 nt, Mycobacterium avium subsp. paratuberculosis
ucgccacgccgaccag

SEQ ID NO: 2882270 - RNA, 13 nt, Mycobacterium avium subsp. paratuberculosis
ucgccacgccgug

SEQ ID NO: 2882271 - RNA, 16 nt, Mycobacterium avium subsp. paratuberculosis
ucgccacggccggcag

SEQ ID NO: 2882272 - RNA, 21 nt, Mycobacterium avium subsp. paratuberculosis
ucgccacggccggcagcaucg

SEQ ID NO: 2882273 - RNA, 23 nt, Mycobacterium avium subsp. paratuberculosis
ucgccacggcggugucggcggca

SEQ ID NO: 2882274 - RNA, 16 nt, Mycobacterium avium subsp. paratuberculosis
ucgccacucgggcggc

SEQ ID NO: 2882275 - RNA, 19 nt, Mycobacterium avium subsp. paratuberculosis
ucgccacucgggcggccgc

SEQ ID NO: 2882276 - RNA, 20 nt, Mycobacterium avium subsp. paratuberculosis
ucgccacucgggcggccgcg

SEQ ID NO: 2882277 - RNA, 18 nt, Mycobacterium avium subsp. paratuberculosis
ucgccacugggcgucggc

SEQ ID NO: 2882278 - RNA, 20 nt, Mycobacterium avium subsp. paratuberculosis
ucgccagaccgguugcggcg

SEQ ID NO: 2882279 - RNA, 19 nt, Mycobacterium avium subsp. paratuberculosis
ucgccagacucacggcggc

SEQ ID NO: 2882280 - RNA, 20 nt, Mycobacterium avium subsp. paratuberculosis
ucgccagacucacggcggca

SEQ ID NO: 2882281 - RNA, 21 nt, Mycobacterium avium subsp. paratuberculosis
ucgccagacucacggcggcag

SEQ ID NO: 2882282 - RNA, 22 nt, Mycobacterium avium subsp. paratuberculosis
ucgccagacucacggcggcagc

SEQ ID NO: 2882283 - RNA, 21 nt, Mycobacterium avium subsp. paratuberculosis
ucgccagcaacgacccggcca

SEQ ID NO: 2882284 - RNA, 12 nt, Mycobacterium avium subsp. paratuberculosis
ucgccagcacau

SEQ ID NO: 2882285 - RNA, 21 nt, Mycobacterium avium subsp. paratuberculosis
ucgccagccccaccggccacu

SEQ ID NO: 2882286 - RNA, 13 nt, Mycobacterium avium subsp. paratuberculosis
ucgccagcccggc

SEQ ID NO: 2882287 - RNA, 16 nt, Mycobacterium avium subsp. paratuberculosis
ucgccagcccggcgua

SEQ ID NO: 2882288 - RNA, 13 nt, Mycobacterium avium subsp. paratuberculosis
ucgccagccgccg

SEQ ID NO: 2882289 - RNA, 13 nt, Mycobacterium avium subsp. paratuberculosis
ucgccagcgccac

SEQ ID NO: 2882290 - RNA, 15 nt, Mycobacterium avium subsp. paratuberculosis
ucgccagcgccacgc

SEQ ID NO: 2882291 - RNA, 17 nt, Mycobacterium avium subsp. paratuberculosis
ucgccagcgccacgcuc

SEQ ID NO: 2882292 - RNA, 22 nt, Mycobacterium avium subsp. paratuberculosis
ucgccagcgcccccagcggggc

SEQ ID NO: 2882293 - RNA, 12 nt, Mycobacterium avium subsp. paratuberculosis
ucgccagcgcgc

SEQ ID NO: 2882294 - RNA, 14 nt, Mycobacterium avium subsp. paratuberculosis
ucgccagcgcgcag

SEQ ID NO: 2882295 - RNA, 23 nt, Mycobacterium avium subsp. paratuberculosis
ucgccagcgcgcagaacaccacc

SEQ ID NO: 2882296 - RNA, 16 nt, Mycobacterium avium subsp. paratuberculosis
ucgccagcgcgguguc

SEQ ID NO: 2882297 - RNA, 14 nt, Mycobacterium avium subsp. paratuberculosis
ucgccagcgggccg

SEQ ID NO: 2882298 - RNA, 16 nt, Mycobacterium avium subsp. paratuberculosis
ucgccagcgggccgac

SEQ ID NO: 2882299 - RNA, 17 nt, Mycobacterium avium subsp. paratuberculosis
ucgccagcgggccgacc

SEQ ID NO: 2882300 - RNA, 19 nt, Mycobacterium avium subsp. paratuberculosis
ucgccaguccggcgccgac

SEQ ID NO: 2882301 - RNA, 21 nt, Mycobacterium avium subsp. paratuberculosis
ucgccaguccggcgccgaccc

SEQ ID NO: 2882302 - RNA, 14 nt, Mycobacterium avium subsp. paratuberculosis
ucgccaucagcagc

SEQ ID NO: 2882303 - RNA, 15 nt, Mycobacterium avium subsp. paratuberculosis
ucgccaucagcagcg

SEQ ID NO: 2882304 - RNA, 17 nt, Mycobacterium avium subsp. paratuberculosis
ucgccaucagggucuuc

SEQ ID NO: 2882305 - RNA, 12 nt, Mycobacterium avium subsp. paratuberculosis
ucgccaugccgu

SEQ ID NO: 2882306 - RNA, 14 nt, Mycobacterium avium subsp. paratuberculosis
ucgccaugccgucg

SEQ ID NO: 2882307 - RNA, 19 nt, Mycobacterium avium subsp. paratuberculosis
ucgcccaacaacucgacgu

SEQ ID NO: 2882308 - RNA, 20 nt, Mycobacterium avium subsp. paratuberculosis
ucgcccaacaacucgacguu

SEQ ID NO: 2882309 - RNA, 22 nt, Mycobacterium avium subsp. paratuberculosis
ucgcccaacaacucgacguucg

SEQ ID NO: 2882310 - RNA, 16 nt, Mycobacterium avium subsp. paratuberculosis
ucgcccacaccggaug

SEQ ID NO: 2882311 - RNA, 15 nt, Mycobacterium avium subsp. paratuberculosis
ucgcccaccccggcg

SEQ ID NO: 2882312 - RNA, 18 nt, Mycobacterium avium subsp. paratuberculosis
ucgcccacccgcacgccc

SEQ ID NO: 2882313 - RNA, 19 nt, Mycobacterium avium subsp. paratuberculosis
ucgcccacccgcacgcccg

SEQ ID NO: 2882314 - RNA, 20 nt, Mycobacterium avium subsp. paratuberculosis
ucgcccacccgcacgcccgg

SEQ ID NO: 2882315 - RNA, 15 nt, Mycobacterium avium subsp. paratuberculosis
ucgcccacccgccag

SEQ ID NO: 2882316 - RNA, 18 nt, Mycobacterium avium subsp. paratuberculosis
ucgcccacccgccagccc

SEQ ID NO: 2882317 - RNA, 21 nt, Mycobacterium avium subsp. paratuberculosis
ucgcccacccgccagcccgcg

SEQ ID NO: 2882318 - RNA, 13 nt, Mycobacterium avium subsp. paratuberculosis
ucgcccacccggg

SEQ ID NO: 2882319 - RNA, 21 nt, Mycobacterium avium subsp. paratuberculosis
ucgcccacccggggccguccg

SEQ ID NO: 2882320 - RNA, 20 nt, Mycobacterium avium subsp. paratuberculosis
ucgcccaccgacgcggcggc

SEQ ID NO: 2882321 - RNA, 17 nt, Mycobacterium avium subsp. paratuberculosis
ucgcccacgccgguggg

SEQ ID NO: 2882322 - RNA, 23 nt, Mycobacterium avium subsp. paratuberculosis
ucgcccacgccgguggggucggu

SEQ ID NO: 2882323 - RNA, 14 nt, Mycobacterium avium subsp. paratuberculosis
ucgcccagcaccgc

SEQ ID NO: 2882324 - RNA, 17 nt, Mycobacterium avium subsp. paratuberculosis
ucgcccagcaccgcgac

SEQ ID NO: 2882325 - RNA, 14 nt, Mycobacterium avium subsp. paratuberculosis
ucgcccagccggcg

SEQ ID NO: 2882326 - RNA, 16 nt, Mycobacterium avium subsp. paratuberculosis
ucgcccagccggcgga

SEQ ID NO: 2882327 - RNA, 19 nt, Mycobacterium avium subsp. paratuberculosis
ucgcccagcgcagcgccuc

SEQ ID NO: 2882328 - RNA, 21 nt, Mycobacterium avium subsp. paratuberculosis
ucgcccagcgcagcgccucgg

SEQ ID NO: 2882329 - RNA, 22 nt, Mycobacterium avium subsp. paratuberculosis
ucgcccagcgcagcgccucggc

SEQ ID NO: 2882330 - RNA, 15 nt, Mycobacterium avium subsp. paratuberculosis
ggucaucgugaucgc

SEQ ID NO: 2882331 - RNA, 12 nt, Mycobacterium avium subsp. paratuberculosis
ggucaugccgag

SEQ ID NO: 2882332 - RNA, 16 nt, Mycobacterium avium subsp. paratuberculosis
ggucaugccgagccgc

SEQ ID NO: 2882333 - RNA, 16 nt, Mycobacterium avium subsp. paratuberculosis
ggucauggcgaccgcg

SEQ ID NO: 2882334 - RNA, 19 nt, Mycobacterium avium subsp. paratuberculosis
ggucauggcgaccgcgacg

SEQ ID NO: 2882335 - RNA, 14 nt, Mycobacterium avium subsp. paratuberculosis
ggucaugguggcgg

SEQ ID NO: 2882336 - RNA, 16 nt, Mycobacterium avium subsp. paratuberculosis
ggucaugguggcggcg

SEQ ID NO: 2882337 - RNA, 20 nt, Mycobacterium avium subsp. paratuberculosis
ggucauguaccaggcgacgu

SEQ ID NO: 2882338 - RNA, 19 nt, Mycobacterium avium subsp. paratuberculosis
ggucauugaucuccgcggc

SEQ ID NO: 2882339 - RNA, 18 nt, Mycobacterium avium subsp. paratuberculosis
gguccaacguggguggcc

SEQ ID NO: 2882340 - RNA, 13 nt, Mycobacterium avium subsp. paratuberculosis
gguccaccaccac

SEQ ID NO: 2882341 - RNA, 21 nt, Mycobacterium avium subsp. paratuberculosis
gguccaccaccacacccgcgg

SEQ ID NO: 2882342 - RNA, 17 nt, Mycobacterium avium subsp. paratuberculosis
gguccacccgccccgcc

SEQ ID NO: 2882343 - RNA, 16 nt, Mycobacterium avium subsp. paratuberculosis
gguccaccgccgcgcc

SEQ ID NO: 2882344 - RNA, 17 nt, Mycobacterium avium subsp. paratuberculosis
gguccaccgccgcgccg

SEQ ID NO: 2882345 - RNA, 17 nt, Mycobacterium avium subsp. paratuberculosis
gguccaccgcggcggcc

SEQ ID NO: 2882346 - RNA, 18 nt, Mycobacterium avium subsp. paratuberculosis
gguccaccgcggcggcca

SEQ ID NO: 2882347 - RNA, 14 nt, Mycobacterium avium subsp. paratuberculosis
gguccaccggccga

SEQ ID NO: 2882348 - RNA, 17 nt, Mycobacterium avium subsp. paratuberculosis
gguccaccguugucucg

SEQ ID NO: 2882349 - RNA, 20 nt, Mycobacterium avium subsp. paratuberculosis
gguccaccguugucucggcg

SEQ ID NO: 2882350 - RNA, 23 nt, Mycobacterium avium subsp. paratuberculosis
gguccacgcaguguccgaucgcc

SEQ ID NO: 2882351 - RNA, 20 nt, Mycobacterium avium subsp. paratuberculosis
gguccacgccgagggcggcg

SEQ ID NO: 2882352 - RNA, 15 nt, Mycobacterium avium subsp. paratuberculosis
gguccacgguggcgc

SEQ ID NO: 2882353 - RNA, 18 nt, Mycobacterium avium subsp. paratuberculosis
gguccacucgucggcggu

SEQ ID NO: 2882354 - RNA, 19 nt, Mycobacterium avium subsp. paratuberculosis
gguccagaucggcgcgcgg

SEQ ID NO: 2882355 - RNA, 12 nt, Mycobacterium avium subsp. paratuberculosis
gguccagcaccg

SEQ ID NO: 2882356 - RNA, 15 nt, Mycobacterium avium subsp. paratuberculosis
gguccagcaccggcg

SEQ ID NO: 2882357 - RNA, 19 nt, Mycobacterium avium subsp. paratuberculosis
gguccagcaccggcgcccc

SEQ ID NO: 2882358 - RNA, 12 nt, Mycobacterium avium subsp. paratuberculosis
gguccagcccgg

SEQ ID NO: 2882359 - RNA, 15 nt, Mycobacterium avium subsp. paratuberculosis
gguccagccgccggc

SEQ ID NO: 2882360 - RNA, 12 nt, Mycobacterium avium subsp. paratuberculosis
gguccagccgcg

SEQ ID NO: 2882361 - RNA, 16 nt, Mycobacterium avium subsp. paratuberculosis
gguccagccggucgca

SEQ ID NO: 2882362 - RNA, 18 nt, Mycobacterium avium subsp. paratuberculosis
gguccagccggucgcagg

SEQ ID NO: 2882363 - RNA, 14 nt, Mycobacterium avium subsp. paratuberculosis
gguccagcgugcgc

SEQ ID NO: 2882364 - RNA, 17 nt, Mycobacterium avium subsp. paratuberculosis
gguccagcgugcgcggc

SEQ ID NO: 2882365 - RNA, 21 nt, Mycobacterium avium subsp. paratuberculosis
gguccaggaucugcagcacgc

SEQ ID NO: 2882366 - RNA, 15 nt, Mycobacterium avium subsp. paratuberculosis
gguccaggccgcgcc

SEQ ID NO: 2882367 - RNA, 16 nt, Mycobacterium avium subsp. paratuberculosis
gguccaggccgcgccg

SEQ ID NO: 2882368 - RNA, 20 nt, Mycobacterium avium subsp. paratuberculosis
gguccaggcgaccggcccca

SEQ ID NO: 2882369 - RNA, 16 nt, Mycobacterium avium subsp. paratuberculosis
gguccaggcgccgggu

SEQ ID NO: 2882370 - RNA, 20 nt, Mycobacterium avium subsp. paratuberculosis
gguccagggcgggucgucga

SEQ ID NO: 2882371 - RNA, 12 nt, Mycobacterium avium subsp. paratuberculosis
gguccagguggg

SEQ ID NO: 2882372 - RNA, 21 nt, Mycobacterium avium subsp. paratuberculosis
gguccaucuccagcuccgcgg

SEQ ID NO: 2882373 - RNA, 13 nt, Mycobacterium avium subsp. paratuberculosis
gguccauggccuu

SEQ ID NO: 2882374 - RNA, 16 nt, Mycobacterium avium subsp. paratuberculosis
gguccaugugccgcau

SEQ ID NO: 2882375 - RNA, 19 nt, Mycobacterium avium subsp. paratuberculosis
gguccaugugccgcaucug

SEQ ID NO: 2882376 - RNA, 15 nt, Mycobacterium avium subsp. paratuberculosis
ggucccaauccucgc

SEQ ID NO: 2882377 - RNA, 21 nt, Mycobacterium avium subsp. paratuberculosis
ggucccaggcguggucggcgc

SEQ ID NO: 2882378 - RNA, 23 nt, Mycobacterium avium subsp. paratuberculosis
ggucccaggcguggucggcgcgg

SEQ ID NO: 2882379 - RNA, 16 nt, Mycobacterium avium subsp. paratuberculosis
ggucccaggugcuggg

SEQ ID NO: 2882380 - RNA, 19 nt, Mycobacterium avium subsp. paratuberculosis
ggucccaguccccgguuca

SEQ ID NO: 2882381 - RNA, 13 nt, Mycobacterium avium subsp. paratuberculosis
gguccccgcgccc

SEQ ID NO: 2882382 - RNA, 18 nt, Mycobacterium avium subsp. paratuberculosis
gguccccggagucgucga

SEQ ID NO: 2882383 - RNA, 20 nt, Mycobacterium avium subsp. paratuberculosis
gguccccggcgaccacccuc

SEQ ID NO: 2882384 - RNA, 16 nt, Mycobacterium avium subsp. paratuberculosis
gguccccgggcccagc

SEQ ID NO: 2882385 - RNA, 12 nt, Mycobacterium avium subsp. paratuberculosis
ggucccgacgcg

SEQ ID NO: 2882386 - RNA, 11 nt, Mycobacterium avium subsp. paratuberculosis
ggucccgccgg

SEQ ID NO: 2882387 - RNA, 14 nt, Mycobacterium avium subsp. paratuberculosis
ggucccgcggcggc

SEQ ID NO: 2882388 - RNA, 15 nt, Mycobacterium avium subsp. paratuberculosis
ggucccgcggcggcg

SEQ ID NO: 2882389 - RNA, 17 nt, Mycobacterium avium subsp. paratuberculosis
ggucccgcggcggcgcc

SEQ ID NO: 2882390 - RNA, 18 nt, Mycobacterium avium subsp. paratuberculosis
ggucccgcggcggcgcca

SEQ ID NO: 2882391 - RNA, 19 nt, Mycobacterium avium subsp. paratuberculosis
ggucccggcaacaccggcg

SEQ ID NO: 2882392 - RNA, 12 nt, Mycobacterium avium subsp. paratuberculosis
ggucccggccga

SEQ ID NO: 2882393 - RNA, 13 nt, Mycobacterium avium subsp. paratuberculosis
ggucccggccgac

SEQ ID NO: 2882394 - RNA, 13 nt, Mycobacterium avium subsp. paratuberculosis
ggucccggucagg

SEQ ID NO: 2882395 - RNA, 13 nt, Mycobacterium avium subsp. paratuberculosis
ggucccgugcgcc

SEQ ID NO: 2882396 - RNA, 21 nt, Mycobacterium avium subsp. paratuberculosis
ggucccgugcgccgcccacac

SEQ ID NO: 2882397 - RNA, 15 nt, Mycobacterium avium subsp. paratuberculosis
gguccgaccagcacc

SEQ ID NO: 2882398 - RNA, 16 nt, Mycobacterium avium subsp. paratuberculosis
gguccgaccagcaccc

SEQ ID NO: 2882399 - RNA, 15 nt, Mycobacterium avium subsp. paratuberculosis
gguccgaccagcggc

SEQ ID NO: 2882400 - RNA, 16 nt, Mycobacterium avium subsp. paratuberculosis
gguccgaccagcggcc

SEQ ID NO: 2882401 - RNA, 18 nt, Mycobacterium avium subsp. paratuberculosis
gguccgaccagcggccca

SEQ ID NO: 2882402 - RNA, 21 nt, Mycobacterium avium subsp. paratuberculosis
gguccgaccagcggcccaccg

SEQ ID NO: 2882403 - RNA, 15 nt, Mycobacterium avium subsp. paratuberculosis
gguccgaccgccacc

SEQ ID NO: 2882404 - RNA, 19 nt, Mycobacterium avium subsp. paratuberculosis
gguccgaccgccaccaccc

SEQ ID NO: 2882405 - RNA, 20 nt, Mycobacterium avium subsp. paratuberculosis
gguccgaccgccaccacccg

SEQ ID NO: 2882406 - RNA, 20 nt, Mycobacterium avium subsp. paratuberculosis
gguccgaucguccggcgcca

SEQ ID NO: 2882407 - RNA, 15 nt, Mycobacterium avium subsp. paratuberculosis
gguccgauugcccga

SEQ ID NO: 2882408 - RNA, 19 nt, Mycobacterium avium subsp. paratuberculosis
gguccgauugcccgacucc

SEQ ID NO: 2882409 - RNA, 17 nt, Mycobacterium avium subsp. paratuberculosis
gguccgcaacgccggcg

SEQ ID NO: 2882410 - RNA, 22 nt, Mycobacterium avium subsp. paratuberculosis
gguccgcaacgccggcgugcac

SEQ ID NO: 2882411 - RNA, 20 nt, Mycobacterium avium subsp. paratuberculosis
gguccgcaacgcggcgguga

SEQ ID NO: 2882412 - RNA, 15 nt, Mycobacterium avium subsp. paratuberculosis
gguccgcacccgggc

SEQ ID NO: 2882413 - RNA, 18 nt, Mycobacterium avium subsp. paratuberculosis
gguccgcaugucgaagaa

SEQ ID NO: 2882414 - RNA, 14 nt, Mycobacterium avium subsp. paratuberculosis
gguccgcccggacc

SEQ ID NO: 2882415 - RNA, 18 nt, Mycobacterium avium subsp. paratuberculosis
ggucgaccagcuccugga

SEQ ID NO: 2882416 - RNA, 18 nt, Mycobacterium avium subsp. paratuberculosis
ggucgacccgccgcagcc

SEQ ID NO: 2882417 - RNA, 16 nt, Mycobacterium avium subsp. paratuberculosis
ggucgaccgccucgga

SEQ ID NO: 2882418 - RNA, 20 nt, Mycobacterium avium subsp. paratuberculosis
ggucgaccgcgaugguggcg

SEQ ID NO: 2882419 - RNA, 16 nt, Mycobacterium avium subsp. paratuberculosis
ggucgaccgcgcaccg

SEQ ID NO: 2882420 - RNA, 21 nt, Mycobacterium avium subsp. paratuberculosis
ggucgaccgcgcaccggcgcu

SEQ ID NO: 2882421 - RNA, 22 nt, Mycobacterium avium subsp. paratuberculosis
ggucgaccgcgcaccggcgcug

SEQ ID NO: 2882422 - RNA, 15 nt, Mycobacterium avium subsp. paratuberculosis
ggucgacgagcccgc

SEQ ID NO: 2882423 - RNA, 19 nt, Mycobacterium avium subsp. paratuberculosis
ggucgacgagcccgcgccc

SEQ ID NO: 2882424 - RNA, 20 nt, Mycobacterium avium subsp. paratuberculosis
ggucgacgagcccgcgccca

SEQ ID NO: 2882425 - RNA, 14 nt, Mycobacterium avium subsp. paratuberculosis
ggucgacgccgagu

SEQ ID NO: 2882426 - RNA, 19 nt, Mycobacterium avium subsp. paratuberculosis
ggucgacgcgccgcacugc

SEQ ID NO: 2882427 - RNA, 20 nt, Mycobacterium avium subsp. paratuberculosis
ggucgacgcggggcggcggc

SEQ ID NO: 2882428 - RNA, 21 nt, Mycobacterium avium subsp. paratuberculosis
ggucgacgcggggcggcggcg

SEQ ID NO: 2882429 - RNA, 18 nt, Mycobacterium avium subsp. paratuberculosis
ggucgacggaagccgagc

SEQ ID NO: 2882430 - RNA, 22 nt, Mycobacterium avium subsp. paratuberculosis
ggucgacggaagccgagcgguc

SEQ ID NO: 2882431 - RNA, 21 nt, Mycobacterium avium subsp. paratuberculosis
ggucgacgucauccggcugcc

SEQ ID NO: 2882432 - RNA, 17 nt, Mycobacterium avium subsp. paratuberculosis
ggucgacugggccaggu

SEQ ID NO: 2882433 - RNA, 16 nt, Mycobacterium avium subsp. paratuberculosis
ggucgacuggucgucg

SEQ ID NO: 2882434 - RNA, 21 nt, Mycobacterium avium subsp. paratuberculosis
ggucgagacaccgucgcgcac

SEQ ID NO: 2882435 - RNA, 22 nt, Mycobacterium avium subsp. paratuberculosis
ggucgagacaccgucgcgcacc

SEQ ID NO: 2882436 - RNA, 14 nt, Mycobacterium avium subsp. paratuberculosis
ggucgagaucagca

SEQ ID NO: 2882437 - RNA, 17 nt, Mycobacterium avium subsp. paratuberculosis
ggucgagaucagcaccg

SEQ ID NO: 2882438 - RNA, 19 nt, Mycobacterium avium subsp. paratuberculosis
ggucgagaucagcaccggg

SEQ ID NO: 2882439 - RNA, 13 nt, Mycobacterium avium subsp. paratuberculosis
ggucgagccgcag

SEQ ID NO: 2882440 - RNA, 14 nt, Mycobacterium avium subsp. paratuberculosis
ggucgagccgcagu

SEQ ID NO: 2882441 - RNA, 17 nt, Mycobacterium avium subsp. paratuberculosis
ggucgagccuggcgcgc

SEQ ID NO: 2882442 - RNA, 15 nt, Mycobacterium avium subsp. paratuberculosis
ggucgagcggcccgc

SEQ ID NO: 2882443 - RNA, 17 nt, Mycobacterium avium subsp. paratuberculosis
ggucgagcggcccgcac

SEQ ID NO: 2882444 - RNA, 20 nt, Mycobacterium avium subsp. paratuberculosis
ggucgaggcccucgacaccg

SEQ ID NO: 2882445 - RNA, 22 nt, Mycobacterium avium subsp. paratuberculosis
ggucgaggcccucgacaccggu

SEQ ID NO: 2882446 - RNA, 14 nt, Mycobacterium avium subsp. paratuberculosis
ggucgaggccggcc

SEQ ID NO: 2882447 - RNA, 16 nt, Mycobacterium avium subsp. paratuberculosis
ggucgaggccggccag

SEQ ID NO: 2882448 - RNA, 19 nt, Mycobacterium avium subsp. paratuberculosis
ggucgaggccggccagcgg

SEQ ID NO: 2882449 - RNA, 18 nt, Mycobacterium avium subsp. paratuberculosis
ggucgagggcguucgcgg

SEQ ID NO: 2882450 - RNA, 20 nt, Mycobacterium avium subsp. paratuberculosis
ggucgagggcguucgcggug

SEQ ID NO: 2882451 - RNA, 16 nt, Mycobacterium avium subsp. paratuberculosis
ggucgagguccucggc

SEQ ID NO: 2882452 - RNA, 19 nt, Mycobacterium avium subsp. paratuberculosis
ggucgagguccucggcgau

SEQ ID NO: 2882453 - RNA, 15 nt, Mycobacterium avium subsp. paratuberculosis
ggucgaggucgccga

SEQ ID NO: 2882454 - RNA, 16 nt, Mycobacterium avium subsp. paratuberculosis
ggucgaucaccucguc

SEQ ID NO: 2882455 - RNA, 19 nt, Mycobacterium avium subsp. paratuberculosis
ggucgaucaccucgucgag

SEQ ID NO: 2882456 - RNA, 20 nt, Mycobacterium avium subsp. paratuberculosis
ggucgauccacucccgcgcg

SEQ ID NO: 2882457 - RNA, 13 nt, Mycobacterium avium subsp. paratuberculosis
ggucgaucccgcc

SEQ ID NO: 2882458 - RNA, 15 nt, Mycobacterium avium subsp. paratuberculosis
ggucgaucucggcca

SEQ ID NO: 2882459 - RNA, 18 nt, Mycobacterium avium subsp. paratuberculosis
ggucgaucucggccagcg

SEQ ID NO: 2882460 - RNA, 19 nt, Mycobacterium avium subsp. paratuberculosis
ggucgaucucggccagcgg

SEQ ID NO: 2882461 - RNA, 16 nt, Mycobacterium avium subsp. paratuberculosis
ggucgaucucggcgca

SEQ ID NO: 2882462 - RNA, 17 nt, Mycobacterium avium subsp. paratuberculosis
ggucgaucucggcgcag

SEQ ID NO: 2882463 - RNA, 21 nt, Mycobacterium avium subsp. paratuberculosis
ggucgaugacgccgcgccgcc

SEQ ID NO: 2882464 - RNA, 19 nt, Mycobacterium avium subsp. paratuberculosis
ggucgaugaucuggcgguc

SEQ ID NO: 2882465 - RNA, 20 nt, Mycobacterium avium subsp. paratuberculosis
ggucgauggcguagcggguc

SEQ ID NO: 2882466 - RNA, 15 nt, Mycobacterium avium subsp. paratuberculosis
ggucgaugucggcga

SEQ ID NO: 2882467 - RNA, 15 nt, Mycobacterium avium subsp. paratuberculosis
ggucgaugugcgcgc

SEQ ID NO: 2882468 - RNA, 20 nt, Mycobacterium avium subsp. paratuberculosis
ggucgcacaccagcacggcg

SEQ ID NO: 2882469 - RNA, 22 nt, Mycobacterium avium subsp. paratuberculosis
ggucgcacaccagcacggcggc

SEQ ID NO: 2882470 - RNA, 13 nt, Mycobacterium avium subsp. paratuberculosis
ggucgcaggcagc

SEQ ID NO: 2882471 - RNA, 14 nt, Mycobacterium avium subsp. paratuberculosis
ggucgcaggcagca

SEQ ID NO: 2882472 - RNA, 17 nt, Mycobacterium avium subsp. paratuberculosis
ggucgcaggcagcagca

SEQ ID NO: 2882473 - RNA, 16 nt, Mycobacterium avium subsp. paratuberculosis
ggucgccaaacugcgc

SEQ ID NO: 2882474 - RNA, 20 nt, Mycobacterium avium subsp. paratuberculosis
ggucgccaaacugcgcaacc

SEQ ID NO: 2882475 - RNA, 19 nt, Mycobacterium avium subsp. paratuberculosis
ggucgccaccaccagcggg

SEQ ID NO: 2882476 - RNA, 21 nt, Mycobacterium avium subsp. paratuberculosis
ggucgccaccaccagcgggcu

SEQ ID NO: 2882477 - RNA, 14 nt, Mycobacterium avium subsp. paratuberculosis
ggucgccacggccg

SEQ ID NO: 2882478 - RNA, 22 nt, Mycobacterium avium subsp. paratuberculosis
ggucgccacucgggcggccgcg

SEQ ID NO: 2882479 - RNA, 23 nt, Mycobacterium avium subsp. paratuberculosis
ggucgccacucgggcggccgcgg

SEQ ID NO: 2882480 - RNA, 19 nt, Mycobacterium avium subsp. paratuberculosis
ggucgccagcaccgugcug

SEQ ID NO: 2882481 - RNA, 13 nt, Mycobacterium avium subsp. paratuberculosis
ggucgccagcgcc

SEQ ID NO: 2882482 - RNA, 15 nt, Mycobacterium avium subsp. paratuberculosis
ggucgccagcgccac

SEQ ID NO: 2882483 - RNA, 24 nt, Mycobacterium avium subsp. paratuberculosis
ggucgccagcgccacgcucaugcc

SEQ ID NO: 2882484 - RNA, 18 nt, Mycobacterium avium subsp. paratuberculosis
ggucgccaggccaccgca

SEQ ID NO: 2882485 - RNA, 22 nt, Mycobacterium avium subsp. paratuberculosis
ggucgcccaccacgacgacgug

SEQ ID NO: 2882486 - RNA, 17 nt, Mycobacterium avium subsp. paratuberculosis
ggucgccccggccgcgg

SEQ ID NO: 2882487 - RNA, 15 nt, Mycobacterium avium subsp. paratuberculosis
ggucgcccggcucgc

SEQ ID NO: 2882488 - RNA, 11 nt, Mycobacterium avium subsp. paratuberculosis
ggucgcccggg

SEQ ID NO: 2882489 - RNA, 14 nt, Mycobacterium avium subsp. paratuberculosis
ggucgcccucgaag

SEQ ID NO: 2882490 - RNA, 12 nt, Mycobacterium avium subsp. paratuberculosis
ggucgccgaacg

SEQ ID NO: 2882491 - RNA, 19 nt, Mycobacterium avium subsp. paratuberculosis
ggucgccgaacgugcgcgg

SEQ ID NO: 2882492 - RNA, 23 nt, Mycobacterium avium subsp. paratuberculosis
ggucgccgaacgugcgcggcgcg

SEQ ID NO: 2882493 - RNA, 16 nt, Mycobacterium avium subsp. paratuberculosis
ggucgccgaauccggc

SEQ ID NO: 2882494 - RNA, 19 nt, Mycobacterium avium subsp. paratuberculosis
ggucgccgaauccggcggg

SEQ ID NO: 2882495 - RNA, 21 nt, Mycobacterium avium subsp. paratuberculosis
ggucgccgaauccggcgggga

SEQ ID NO: 2882496 - RNA, 13 nt, Mycobacterium avium subsp. paratuberculosis
ggucgccgacgcc

SEQ ID NO: 2882497 - RNA, 20 nt, Mycobacterium avium subsp. paratuberculosis
ggucgccgacgccgucgaug

SEQ ID NO: 2882498 - RNA, 20 nt, Mycobacterium avium subsp. paratuberculosis
ggucgccgacgguggcgaag

SEQ ID NO: 2882499 - RNA, 18 nt, Mycobacterium avium subsp. paratuberculosis
ggucggccagcugcgggu

SEQ ID NO: 2882500 - RNA, 18 nt, Mycobacterium avium subsp. paratuberculosis
ggucggccagggcgugga

SEQ ID NO: 2882501 - RNA, 13 nt, Mycobacterium avium subsp. paratuberculosis
ggucggcccgcuc

SEQ ID NO: 2882502 - RNA, 15 nt, Mycobacterium avium subsp. paratuberculosis
ggucggccgcggccg

SEQ ID NO: 2882503 - RNA, 15 nt, Mycobacterium avium subsp. paratuberculosis
ggucggccgcgugca

SEQ ID NO: 2882504 - RNA, 18 nt, Mycobacterium avium subsp. paratuberculosis
ggucggccgcgugcaccu

SEQ ID NO: 2882505 - RNA, 13 nt, Mycobacterium avium subsp. paratuberculosis
ggucggccggauc

SEQ ID NO: 2882506 - RNA, 14 nt, Mycobacterium avium subsp. paratuberculosis
ggucggccggcagg

SEQ ID NO: 2882507 - RNA, 16 nt, Mycobacterium avium subsp. paratuberculosis
ggucggccggcaggcc

SEQ ID NO: 2882508 - RNA, 14 nt, Mycobacterium avium subsp. paratuberculosis
ggucggccggcggg

SEQ ID NO: 2882509 - RNA, 18 nt, Mycobacterium avium subsp. paratuberculosis
ggucggccuucagcgucc

SEQ ID NO: 2882510 - RNA, 18 nt, Mycobacterium avium subsp. paratuberculosis
ggucggcgaacgcccggu

SEQ ID NO: 2882511 - RNA, 14 nt, Mycobacterium avium subsp. paratuberculosis
ggucggcgaccaug

SEQ ID NO: 2882512 - RNA, 15 nt, Mycobacterium avium subsp. paratuberculosis
ggucggcgacggcgc

SEQ ID NO: 2882513 - RNA, 16 nt, Mycobacterium avium subsp. paratuberculosis
ggucggcgagcagccg

SEQ ID NO: 2882514 - RNA, 21 nt, Mycobacterium avium subsp. paratuberculosis
ggucggcgagcagccgcgccg

SEQ ID NO: 2882515 - RNA, 18 nt, Mycobacterium avium subsp. paratuberculosis
ggucggcgaugcgcacca

SEQ ID NO: 2882516 - RNA, 12 nt, Mycobacterium avium subsp. paratuberculosis
ggucggcgaugg

SEQ ID NO: 2882517 - RNA, 14 nt, Mycobacterium avium subsp. paratuberculosis
ggucggcgcccggc

SEQ ID NO: 2882518 - RNA, 16 nt, Mycobacterium avium subsp. paratuberculosis
ggucggcgccgaucac

SEQ ID NO: 2882519 - RNA, 16 nt, Mycobacterium avium subsp. paratuberculosis
ggucggcgccggccag

SEQ ID NO: 2882520 - RNA, 14 nt, Mycobacterium avium subsp. paratuberculosis
ggucggcgcggcga

SEQ ID NO: 2882521 - RNA, 15 nt, Mycobacterium avium subsp. paratuberculosis
ggucggcgcggggcc

SEQ ID NO: 2882522 - RNA, 16 nt, Mycobacterium avium subsp. paratuberculosis
ggucggcgcggggcca

SEQ ID NO: 2882523 - RNA, 20 nt, Mycobacterium avium subsp. paratuberculosis
ggucggcgcggggccaccag

SEQ ID NO: 2882524 - RNA, 15 nt, Mycobacterium avium subsp. paratuberculosis
ggucggcgcucgcgg

SEQ ID NO: 2882525 - RNA, 17 nt, Mycobacterium avium subsp. paratuberculosis
ggucggcgcucgcgggu

SEQ ID NO: 2882526 - RNA, 18 nt, Mycobacterium avium subsp. paratuberculosis
ggucggcgcucgcgggug

SEQ ID NO: 2882527 - RNA, 18 nt, Mycobacterium avium subsp. paratuberculosis
ggucggcggaggcgaaug

SEQ ID NO: 2882528 - RNA, 18 nt, Mycobacterium avium subsp. paratuberculosis
ggucggcgggagccggcg

SEQ ID NO: 2882529 - RNA, 21 nt, Mycobacterium avium subsp. paratuberculosis
ggucggcgggagccggcggcg

SEQ ID NO: 2882530 - RNA, 23 nt, Mycobacterium avium subsp. paratuberculosis
ggucggcgggagccggcggcggu

SEQ ID NO: 2882531 - RNA, 23 nt, Mycobacterium avium subsp. paratuberculosis
ggucggcggguaugucggcgacc

SEQ ID NO: 2882532 - RNA, 16 nt, Mycobacterium avium subsp. paratuberculosis
ggucggcggucgcggu

SEQ ID NO: 2882533 - RNA, 20 nt, Mycobacterium avium subsp. paratuberculosis
ggucggcgucgggccggggg

SEQ ID NO: 2882534 - RNA, 20 nt, Mycobacterium avium subsp. paratuberculosis
ggucggcgucguacagcagc

SEQ ID NO: 2882535 - RNA, 18 nt, Mycobacterium avium subsp. paratuberculosis
ggucggcuuccagaugcg

SEQ ID NO: 2882536 - RNA, 21 nt, Mycobacterium avium subsp. paratuberculosis
ggucggcuuccagaugcguca

SEQ ID NO: 2882537 - RNA, 21 nt, Mycobacterium avium subsp. paratuberculosis
ggucgggaccgaugccgcuga

SEQ ID NO: 2882538 - RNA, 17 nt, Mycobacterium avium subsp. paratuberculosis
ggucgggacguccgcgc

SEQ ID NO: 2882539 - RNA, 14 nt, Mycobacterium avium subsp. paratuberculosis
ggucgggacgucgg

SEQ ID NO: 2882540 - RNA, 17 nt, Mycobacterium avium subsp. paratuberculosis
ggucgggacgucggcgc

SEQ ID NO: 2882541 - RNA, 22 nt, Mycobacterium avium subsp. paratuberculosis
ggucgggauacucguccucccg

SEQ ID NO: 2882542 - RNA, 18 nt, Mycobacterium avium subsp. paratuberculosis
ggucgggaucugcgguga

SEQ ID NO: 2882543 - RNA, 16 nt, Mycobacterium avium subsp. paratuberculosis
ggucgggcaugccggc

SEQ ID NO: 2882544 - RNA, 18 nt, Mycobacterium avium subsp. paratuberculosis
ggucgggcaugccggccg

SEQ ID NO: 2882545 - RNA, 13 nt, Mycobacterium avium subsp. paratuberculosis
ggucgggccggac

SEQ ID NO: 2882546 - RNA, 14 nt, Mycobacterium avium subsp. paratuberculosis
ggucgggccggaca

SEQ ID NO: 2882547 - RNA, 15 nt, Mycobacterium avium subsp. paratuberculosis
ggucgggccggacag

SEQ ID NO: 2882548 - RNA, 14 nt, Mycobacterium avium subsp. paratuberculosis
ggucgggccggccg

SEQ ID NO: 2882549 - RNA, 16 nt, Mycobacterium avium subsp. paratuberculosis
ggucgggcgcaccacg

SEQ ID NO: 2882550 - RNA, 15 nt, Mycobacterium avium subsp. paratuberculosis
ggucgggguccaggc

SEQ ID NO: 2882551 - RNA, 20 nt, Mycobacterium avium subsp. paratuberculosis
ggucgggguggaucgcccau

SEQ ID NO: 2882552 - RNA, 15 nt, Mycobacterium avium subsp. paratuberculosis
ggucgggucccggca

SEQ ID NO: 2882553 - RNA, 14 nt, Mycobacterium avium subsp. paratuberculosis
ggucgggugcgcuc

SEQ ID NO: 2882554 - RNA, 16 nt, Mycobacterium avium subsp. paratuberculosis
ggucgggugcggcggu

SEQ ID NO: 2882555 - RNA, 20 nt, Mycobacterium avium subsp. paratuberculosis
ggucggguucgcccuccccg

SEQ ID NO: 2882556 - RNA, 17 nt, Mycobacterium avium subsp. paratuberculosis
ggucggucaccgagcuc

SEQ ID NO: 2882557 - RNA, 11 nt, Mycobacterium avium subsp. paratuberculosis
ggucggucagu

SEQ ID NO: 2882558 - RNA, 21 nt, Mycobacterium avium subsp. paratuberculosis
ggucggucagucgcgccgcca

SEQ ID NO: 2882559 - RNA, 17 nt, Mycobacterium avium subsp. paratuberculosis
ggucggugaagugccgg

SEQ ID NO: 2882560 - RNA, 21 nt, Mycobacterium avium subsp. paratuberculosis
ggucggugacaaagaucacag

SEQ ID NO: 2882561 - RNA, 14 nt, Mycobacterium avium subsp. paratuberculosis
ggucggugaccagc

SEQ ID NO: 2882562 - RNA, 17 nt, Mycobacterium avium subsp. paratuberculosis
ggucggugagcuggccg

SEQ ID NO: 2882563 - RNA, 14 nt, Mycobacterium avium subsp. paratuberculosis
ggucggugaggcug

SEQ ID NO: 2882564 - RNA, 23 nt, Mycobacterium avium subsp. paratuberculosis
ggucggugccgcggcgcaccccg

SEQ ID NO: 2882565 - RNA, 15 nt, Mycobacterium avium subsp. paratuberculosis
ggucggugcgcagca

SEQ ID NO: 2882566 - RNA, 14 nt, Mycobacterium avium subsp. paratuberculosis
ggucggugcgcggg

SEQ ID NO: 2882567 - RNA, 12 nt, Mycobacterium avium subsp. paratuberculosis
ggucggugcgga

SEQ ID NO: 2882568 - RNA, 17 nt, Mycobacterium avium subsp. paratuberculosis
ggucggugcggaugcug

SEQ ID NO: 2882569 - RNA, 18 nt, Mycobacterium avium subsp. paratuberculosis
ggucgguggccaccaccg

SEQ ID NO: 2882570 - RNA, 21 nt, Mycobacterium avium subsp. paratuberculosis
ggucgguggcccagccggccg

SEQ ID NO: 2882571 - RNA, 17 nt, Mycobacterium avium subsp. paratuberculosis
ggucgguggugaucgcg

SEQ ID NO: 2882572 - RNA, 23 nt, Mycobacterium avium subsp. paratuberculosis
ggucgguggugaucgcggcggcg

SEQ ID NO: 2882573 - RNA, 17 nt, Mycobacterium avium subsp. paratuberculosis
ggucgguuugcgggcca

SEQ ID NO: 2882574 - RNA, 23 nt, Mycobacterium avium subsp. paratuberculosis
ggucgguuugcgggccagugauc

SEQ ID NO: 2882575 - RNA, 15 nt, Mycobacterium avium subsp. paratuberculosis
ggucguagagcgcga

SEQ ID NO: 2882576 - RNA, 21 nt, Mycobacterium avium subsp. paratuberculosis
ggucguagccgaagccgccgu

SEQ ID NO: 2882577 - RNA, 23 nt, Mycobacterium avium subsp. paratuberculosis
ggucguagccgucgaaacggcug

SEQ ID NO: 2882578 - RNA, 18 nt, Mycobacterium avium subsp. paratuberculosis
ggucguaggccggauccc

SEQ ID NO: 2882579 - RNA, 19 nt, Mycobacterium avium subsp. paratuberculosis
ggucguaguaggugcgcga

SEQ ID NO: 2882580 - RNA, 18 nt, Mycobacterium avium subsp. paratuberculosis
ggucguagucggcccgcc

SEQ ID NO: 2882581 - RNA, 19 nt, Mycobacterium avium subsp. paratuberculosis
ggucguagucggcccgccg

SEQ ID NO: 2882582 - RNA, 23 nt, Mycobacterium avium subsp. paratuberculosis
ggucguagucggcccgccgggcc

SEQ ID NO: 2882583 - RNA, 12 nt, Mycobacterium avium subsp. paratuberculosis
ggucgucgacga

SEQ ID NO: 2882584 - RNA, 20 nt, Mycobacterium avium subsp. paratuberculosis
ggucugcggccgcgacugca

SEQ ID NO: 2882585 - RNA, 17 nt, Mycobacterium avium subsp. paratuberculosis
ggucugcuccccguuga

SEQ ID NO: 2882586 - RNA, 22 nt, Mycobacterium avium subsp. paratuberculosis
ggucuggaugaucgucucggcc

SEQ ID NO: 2882587 - RNA, 20 nt, Mycobacterium avium subsp. paratuberculosis
ggucuggcccggugcgacgc

SEQ ID NO: 2882588 - RNA, 21 nt, Mycobacterium avium subsp. paratuberculosis
ggucuggcccggugcgacgcc

SEQ ID NO: 2882589 - RNA, 15 nt, Mycobacterium avium subsp. paratuberculosis
ggucuggcucggcac

SEQ ID NO: 2882590 - RNA, 14 nt, Mycobacterium avium subsp. paratuberculosis
ggucuggcugguga

SEQ ID NO: 2882591 - RNA, 16 nt, Mycobacterium avium subsp. paratuberculosis
ggucuggcuggugacc

SEQ ID NO: 2882592 - RNA, 14 nt, Mycobacterium avium subsp. paratuberculosis
ggucugggcgaacg

SEQ ID NO: 2882593 - RNA, 12 nt, Mycobacterium avium subsp. paratuberculosis
ggucugguggca

SEQ ID NO: 2882594 - RNA, 13 nt, Mycobacterium avium subsp. paratuberculosis
ggucuguggucgg

SEQ ID NO: 2882595 - RNA, 15 nt, Mycobacterium avium subsp. paratuberculosis
ggucuucggucccgg

SEQ ID NO: 2882596 - RNA, 15 nt, Mycobacterium avium subsp. paratuberculosis
ggucuucggucgcga

SEQ ID NO: 2882597 - RNA, 20 nt, Mycobacterium avium subsp. paratuberculosis
ggucuucucgaagcgcagca

SEQ ID NO: 2882598 - RNA, 14 nt, Mycobacterium avium subsp. paratuberculosis
ggucuucucggcca

SEQ ID NO: 2882599 - RNA, 17 nt, Mycobacterium avium subsp. paratuberculosis
ggucuucucguccgcgc

SEQ ID NO: 2882600 - RNA, 20 nt, Mycobacterium avium subsp. paratuberculosis
ggucuucucguccgcgcugg

SEQ ID NO: 2882601 - RNA, 18 nt, Mycobacterium avium subsp. paratuberculosis
ggucuucuuggcgggcga

SEQ ID NO: 2882602 - RNA, 15 nt, Mycobacterium avium subsp. paratuberculosis
ggucuuggacagcag

SEQ ID NO: 2882603 - RNA, 14 nt, Mycobacterium avium subsp. paratuberculosis
ggucuuggcggcca

SEQ ID NO: 2882604 - RNA, 14 nt, Mycobacterium avium subsp. paratuberculosis
ggucuugucgucgu

SEQ ID NO: 2882605 - RNA, 14 nt, Mycobacterium avium subsp. paratuberculosis
ggucuuucaucgcc

SEQ ID NO: 2882606 - RNA, 19 nt, Mycobacterium avium subsp. paratuberculosis
ggucuuucaucgccccggc

SEQ ID NO: 2882607 - RNA, 23 nt, Mycobacterium avium subsp. paratuberculosis
ggucuuucaucgccccggcgacg

SEQ ID NO: 2882608 - RNA, 13 nt, Mycobacterium avium subsp. paratuberculosis
ggucuuucgucgc

SEQ ID NO: 2882609 - RNA, 15 nt, Mycobacterium avium subsp. paratuberculosis
ggucuuugccggcca

SEQ ID NO: 2882610 - RNA, 16 nt, Mycobacterium avium subsp. paratuberculosis
ggucuuugccggccau

SEQ ID NO: 2882611 - RNA, 14 nt, Mycobacterium avium subsp. paratuberculosis
ggugaacaccccgc

SEQ ID NO: 2882612 - RNA, 16 nt, Mycobacterium avium subsp. paratuberculosis
ggugaacaccccgcgg

SEQ ID NO: 2882613 - RNA, 19 nt, Mycobacterium avium subsp. paratuberculosis
ggugaacacgaacggcgcc

SEQ ID NO: 2882614 - RNA, 21 nt, Mycobacterium avium subsp. paratuberculosis
ggugaacacgaacggcgccuu

SEQ ID NO: 2882615 - RNA, 24 nt, Mycobacterium avium subsp. paratuberculosis
ggugaacccgacguugccgcuggu

SEQ ID NO: 2882616 - RNA, 22 nt, Mycobacterium avium subsp. paratuberculosis
ggugaacgaggccgcgccgugc

SEQ ID NO: 2882617 - RNA, 15 nt, Mycobacterium avium subsp. paratuberculosis
ggugaacgccugcgg

SEQ ID NO: 2882618 - RNA, 23 nt, Mycobacterium avium subsp. paratuberculosis
ggugaacgcgucggucagcggcg

SEQ ID NO: 2882619 - RNA, 16 nt, Mycobacterium avium subsp. paratuberculosis
ggugaacgggccgcac

SEQ ID NO: 2882620 - RNA, 19 nt, Mycobacterium avium subsp. paratuberculosis
ggugaacgggccgcacugc

SEQ ID NO: 2882621 - RNA, 16 nt, Mycobacterium avium subsp. paratuberculosis
ggugaacucgccgauc

SEQ ID NO: 2882622 - RNA, 18 nt, Mycobacterium avium subsp. paratuberculosis
ggugaagaucgcccgccg

SEQ ID NO: 2882623 - RNA, 20 nt, Mycobacterium avium subsp. paratuberculosis
ggugaagcccagcgcguuga

SEQ ID NO: 2882624 - RNA, 16 nt, Mycobacterium avium subsp. paratuberculosis
ggugaagccguagacg

SEQ ID NO: 2882625 - RNA, 19 nt, Mycobacterium avium subsp. paratuberculosis
ggugaagccguugucgagu

SEQ ID NO: 2882626 - RNA, 17 nt, Mycobacterium avium subsp. paratuberculosis
ggugaagcugccgacca

SEQ ID NO: 2882627 - RNA, 20 nt, Mycobacterium avium subsp. paratuberculosis
ggugaaggccuggaugccgc

SEQ ID NO: 2882628 - RNA, 14 nt, Mycobacterium avium subsp. paratuberculosis
ggugaagguccggu

SEQ ID NO: 2882629 - RNA, 14 nt, Mycobacterium avium subsp. paratuberculosis
ggugaaggugcccu

SEQ ID NO: 2882630 - RNA, 22 nt, Mycobacterium avium subsp. paratuberculosis
ggugaaggugcccuccucgccg

SEQ ID NO: 2882631 - RNA, 18 nt, Mycobacterium avium subsp. paratuberculosis
ggugaagucggugcccag

SEQ ID NO: 2882632 - RNA, 21 nt, Mycobacterium avium subsp. paratuberculosis
ggugaagugccgguccagccg

SEQ ID NO: 2882633 - RNA, 16 nt, Mycobacterium avium subsp. paratuberculosis
ggugaaguugccgguc

SEQ ID NO: 2882634 - RNA, 16 nt, Mycobacterium avium subsp. paratuberculosis
ggugaaguuggcggcg

SEQ ID NO: 2882635 - RNA, 15 nt, Mycobacterium avium subsp. paratuberculosis
ggugaaucaccaagc

SEQ ID NO: 2882636 - RNA, 18 nt, Mycobacterium avium subsp. paratuberculosis
ggugacaacggugguggc

SEQ ID NO: 2882637 - RNA, 15 nt, Mycobacterium avium subsp. paratuberculosis
ggugacaugcccggg

SEQ ID NO: 2882638 - RNA, 19 nt, Mycobacterium avium subsp. paratuberculosis
ggugacaugcccgggcucg

SEQ ID NO: 2882639 - RNA, 16 nt, Mycobacterium avium subsp. paratuberculosis
ggugaccaccugcacc

SEQ ID NO: 2882640 - RNA, 20 nt, Mycobacterium avium subsp. paratuberculosis
ggugaccaccugcaccugcg

SEQ ID NO: 2882641 - RNA, 19 nt, Mycobacterium avium subsp. paratuberculosis
ggugaccacgccgugcccg

SEQ ID NO: 2882642 - RNA, 18 nt, Mycobacterium avium subsp. paratuberculosis
ggugaccacggucggcgg

SEQ ID NO: 2882643 - RNA, 16 nt, Mycobacterium avium subsp. paratuberculosis
ggugaccaggcuugcc

SEQ ID NO: 2882644 - RNA, 14 nt, Mycobacterium avium subsp. paratuberculosis
ggugaccaucgggu

SEQ ID NO: 2882645 - RNA, 16 nt, Mycobacterium avium subsp. paratuberculosis
ggugacccaauccggc

SEQ ID NO: 2882646 - RNA, 14 nt, Mycobacterium avium subsp. paratuberculosis
ggugacccggaccg

SEQ ID NO: 2882647 - RNA, 14 nt, Mycobacterium avium subsp. paratuberculosis
ggugacccggccgu

SEQ ID NO: 2882648 - RNA, 16 nt, Mycobacterium avium subsp. paratuberculosis
ggugaccgacgacgug

SEQ ID NO: 2882649 - RNA, 13 nt, Mycobacterium avium subsp. paratuberculosis
ggugaccgcccgc

SEQ ID NO: 2882650 - RNA, 15 nt, Mycobacterium avium subsp. paratuberculosis
ggugaccgcccgcuc

SEQ ID NO: 2882651 - RNA, 22 nt, Mycobacterium avium subsp. paratuberculosis
ggugaccgccgccauccgcgcc

SEQ ID NO: 2882652 - RNA, 22 nt, Mycobacterium avium subsp. paratuberculosis
ggugaccgccucgucgaagguc

SEQ ID NO: 2882653 - RNA, 19 nt, Mycobacterium avium subsp. paratuberculosis
ggugaccgccuuggcgcgc

SEQ ID NO: 2882654 - RNA, 16 nt, Mycobacterium avium subsp. paratuberculosis
ggugaccgcgacgcug

SEQ ID NO: 2882655 - RNA, 17 nt, Mycobacterium avium subsp. paratuberculosis
ggugaccgcgacgcugc

SEQ ID NO: 2882656 - RNA, 19 nt, Mycobacterium avium subsp. paratuberculosis
ggugaccggaucggccagc

SEQ ID NO: 2882657 - RNA, 13 nt, Mycobacterium avium subsp. paratuberculosis
ggugaccggcgag

SEQ ID NO: 2882658 - RNA, 17 nt, Mycobacterium avium subsp. paratuberculosis
ggugaccggcgaggugc

SEQ ID NO: 2882659 - RNA, 14 nt, Mycobacterium avium subsp. paratuberculosis
ggugaccggcgccg

SEQ ID NO: 2882660 - RNA, 17 nt, Mycobacterium avium subsp. paratuberculosis
ggugaccggcgccgggu

SEQ ID NO: 2882661 - RNA, 14 nt, Mycobacterium avium subsp. paratuberculosis
ggugaccggcgcgc

SEQ ID NO: 2882662 - RNA, 15 nt, Mycobacterium avium subsp. paratuberculosis
ggugaccggcgcgca

SEQ ID NO: 2882663 - RNA, 14 nt, Mycobacterium avium subsp. paratuberculosis
ggugaccggcggcc

SEQ ID NO: 2882664 - RNA, 15 nt, Mycobacterium avium subsp. paratuberculosis
ggugaccggcggcca

SEQ ID NO: 2882665 - RNA, 21 nt, Mycobacterium avium subsp. paratuberculosis
ggugaccgucacccccggcgc

SEQ ID NO: 2882666 - RNA, 23 nt, Mycobacterium avium subsp. paratuberculosis
ggugaccgucacccccggcgcga

SEQ ID NO: 2882667 - RNA, 15 nt, Mycobacterium avium subsp. paratuberculosis
ggugaccgucgccga

SEQ ID NO: 2882668 - RNA, 17 nt, Mycobacterium avium subsp. paratuberculosis
ggugaccgucgccgacc

SEQ ID NO: 2882669 - RNA, 15 nt, Mycobacterium avium subsp. paratuberculosis
ggugaucacccgccg

SEQ ID NO: 2882670 - RNA, 20 nt, Mycobacterium avium subsp. paratuberculosis
ggugaucagccccgccucgu

SEQ ID NO: 2882671 - RNA, 15 nt, Mycobacterium avium subsp. paratuberculosis
ggugaucaggcccuc

SEQ ID NO: 2882672 - RNA, 22 nt, Mycobacterium avium subsp. paratuberculosis
ggugauccacuccagcaccgga

SEQ ID NO: 2882673 - RNA, 15 nt, Mycobacterium avium subsp. paratuberculosis
ggugauccagcccug

SEQ ID NO: 2882674 - RNA, 18 nt, Mycobacterium avium subsp. paratuberculosis
ggugaucccgaugccgcg

SEQ ID NO: 2882675 - RNA, 15 nt, Mycobacterium avium subsp. paratuberculosis
ggugauccgcccggc

SEQ ID NO: 2882676 - RNA, 13 nt, Mycobacterium avium subsp. paratuberculosis
ggugauccggggc

SEQ ID NO: 2882677 - RNA, 19 nt, Mycobacterium avium subsp. paratuberculosis
ggugauccggugccacgcg

SEQ ID NO: 2882678 - RNA, 20 nt, Mycobacterium avium subsp. paratuberculosis
ggugauccggugccacgcgg

SEQ ID NO: 2882679 - RNA, 20 nt, Mycobacterium avium subsp. paratuberculosis
ggugauccucgucuccggcg

SEQ ID NO: 2882680 - RNA, 14 nt, Mycobacterium avium subsp. paratuberculosis
ggugaucgaccgga

SEQ ID NO: 2882681 - RNA, 14 nt, Mycobacterium avium subsp. paratuberculosis
ggugaucgccgccc

SEQ ID NO: 2882682 - RNA, 14 nt, Mycobacterium avium subsp. paratuberculosis
ggugaucgccgcgg

SEQ ID NO: 2882683 - RNA, 23 nt, Mycobacterium avium subsp. paratuberculosis
ggugaucgccggaucgccgaggu

SEQ ID NO: 2882684 - RNA, 16 nt, Mycobacterium avium subsp. paratuberculosis
ggugaucgcgaacgcg

SEQ ID NO: 2882685 - RNA, 13 nt, Mycobacterium avium subsp. paratuberculosis
ggugaucgcggcg

SEQ ID NO: 2882686 - RNA, 15 nt, Mycobacterium avium subsp. paratuberculosis
ggugaucgcggcggc

SEQ ID NO: 2882687 - RNA, 17 nt, Mycobacterium avium subsp. paratuberculosis
ggugaucgcggcggcgu

SEQ ID NO: 2882688 - RNA, 17 nt, Mycobacterium avium subsp. paratuberculosis
ggugaucgcgucaacca

SEQ ID NO: 2882689 - RNA, 14 nt, Mycobacterium avium subsp. paratuberculosis
ggugaucggccagg

SEQ ID NO: 2882690 - RNA, 16 nt, Mycobacterium avium subsp. paratuberculosis
ggugaucggccaggcg

SEQ ID NO: 2882691 - RNA, 22 nt, Mycobacterium avium subsp. paratuberculosis
ggugaucggccaggcgcccagc

SEQ ID NO: 2882692 - RNA, 16 nt, Mycobacterium avium subsp. paratuberculosis
ggugaucucaccggcg

SEQ ID NO: 2882693 - RNA, 18 nt, Mycobacterium avium subsp. paratuberculosis
ggugaucucaccggcggc

SEQ ID NO: 2882694 - RNA, 21 nt, Mycobacterium avium subsp. paratuberculosis
ggugaucucaccggcggcggc

SEQ ID NO: 2882695 - RNA, 14 nt, Mycobacterium avium subsp. paratuberculosis
ggugaucucgccga

SEQ ID NO: 2882696 - RNA, 16 nt, Mycobacterium avium subsp. paratuberculosis
ggugaucucgccgagc

SEQ ID NO: 2882697 - RNA, 18 nt, Mycobacterium avium subsp. paratuberculosis
ggugaucucgccgagcac

SEQ ID NO: 2882698 - RNA, 15 nt, Mycobacterium avium subsp. paratuberculosis
ggugaucucgccgcg

SEQ ID NO: 2882699 - RNA, 17 nt, Mycobacterium avium subsp. paratuberculosis
ggugaucucgccgcggu

SEQ ID NO: 2882700 - RNA, 15 nt, Mycobacterium avium subsp. paratuberculosis
ggugaucucgucggc

SEQ ID NO: 2882701 - RNA, 16 nt, Mycobacterium avium subsp. paratuberculosis
ggugaucugcaccagc

SEQ ID NO: 2882702 - RNA, 17 nt, Mycobacterium avium subsp. paratuberculosis
ggugaucugcaccagcg

SEQ ID NO: 2882703 - RNA, 17 nt, Mycobacterium avium subsp. paratuberculosis
ggugaucuugcccagcc

SEQ ID NO: 2882704 - RNA, 23 nt, Mycobacterium avium subsp. paratuberculosis
ggugaucuuggccuccaccggca

SEQ ID NO: 2882705 - RNA, 16 nt, Mycobacterium avium subsp. paratuberculosis
ggugaucuuggugaag

SEQ ID NO: 2882706 - RNA, 14 nt, Mycobacterium avium subsp. paratuberculosis
ggugaugaacgcgc

SEQ ID NO: 2882707 - RNA, 23 nt, Mycobacterium avium subsp. paratuberculosis
ggugaugaacgcgccgucgucgg

SEQ ID NO: 2882708 - RNA, 23 nt, Mycobacterium avium subsp. paratuberculosis
ggugaugaaucgucccgucgacc

SEQ ID NO: 2882709 - RNA, 15 nt, Mycobacterium avium subsp. paratuberculosis
ggugaugacggggcg

SEQ ID NO: 2882710 - RNA, 15 nt, Mycobacterium avium subsp. paratuberculosis
ggugaugacgucgcc

SEQ ID NO: 2882711 - RNA, 16 nt, Mycobacterium avium subsp. paratuberculosis
ggugaugccgagcgcc

SEQ ID NO: 2882712 - RNA, 23 nt, Mycobacterium avium subsp. paratuberculosis
ggugaugccggcauccucggcgc

SEQ ID NO: 2882713 - RNA, 15 nt, Mycobacterium avium subsp. paratuberculosis
ggugaugccggcggu

SEQ ID NO: 2882714 - RNA, 15 nt, Mycobacterium avium subsp. paratuberculosis
ggugaugcgcggcga

SEQ ID NO: 2882715 - RNA, 17 nt, Mycobacterium avium subsp. paratuberculosis
ggugaugcgcggcgacg

SEQ ID NO: 2882716 - RNA, 18 nt, Mycobacterium avium subsp. paratuberculosis
ggugaugcgcggcgacgg

SEQ ID NO: 2882717 - RNA, 20 nt, Mycobacterium avium subsp. paratuberculosis
ggugaugcgcggcgacggcg

SEQ ID NO: 2882718 - RNA, 18 nt, Mycobacterium avium subsp. paratuberculosis
ggugaugcggaugcccgc

SEQ ID NO: 2882719 - RNA, 20 nt, Mycobacterium avium subsp. paratuberculosis
ggugaugcggaugcccgccg

SEQ ID NO: 2882720 - RNA, 22 nt, Mycobacterium avium subsp. paratuberculosis
ggugaugcggaugcccgccggc

SEQ ID NO: 2882721 - RNA, 23 nt, Mycobacterium avium subsp. paratuberculosis
ggugaugcggaugcccgccggcg

SEQ ID NO: 2882722 - RNA, 15 nt, Mycobacterium avium subsp. paratuberculosis
ggugaugcggcccga

SEQ ID NO: 2882723 - RNA, 19 nt, Mycobacterium avium subsp. paratuberculosis
ggugaugcggcccgacccg

SEQ ID NO: 2882724 - RNA, 14 nt, Mycobacterium avium subsp. paratuberculosis
ggugaugcgggugu

SEQ ID NO: 2882725 - RNA, 12 nt, Mycobacterium avium subsp. paratuberculosis
ggugauggacau

SEQ ID NO: 2882726 - RNA, 20 nt, Mycobacterium avium subsp. paratuberculosis
ggugauggacaucuccggca

SEQ ID NO: 2882727 - RNA, 19 nt, Mycobacterium avium subsp. paratuberculosis
ggugauggacggggcgaug

SEQ ID NO: 2882728 - RNA, 15 nt, Mycobacterium avium subsp. paratuberculosis
ggugauggccgccgc

SEQ ID NO: 2882729 - RNA, 20 nt, Mycobacterium avium subsp. paratuberculosis
ggugauggccgccgcaggcg

SEQ ID NO: 2882730 - RNA, 13 nt, Mycobacterium avium subsp. paratuberculosis
ggugauggcgaug

SEQ ID NO: 2882731 - RNA, 15 nt, Mycobacterium avium subsp. paratuberculosis
ggugaugggcagcgc

SEQ ID NO: 2882732 - RNA, 20 nt, Mycobacterium avium subsp. paratuberculosis
ggugaugggcagcgccccgg

SEQ ID NO: 2882733 - RNA, 22 nt, Mycobacterium avium subsp. paratuberculosis
ggugauggucccccugagcugg

SEQ ID NO: 2882734 - RNA, 22 nt, Mycobacterium avium subsp. paratuberculosis
ggugauggugaucucgccgcgg

SEQ ID NO: 2882735 - RNA, 16 nt, Mycobacterium avium subsp. paratuberculosis
ggugaugucgccgacc

SEQ ID NO: 2882736 - RNA, 17 nt, Mycobacterium avium subsp. paratuberculosis
ggugaugucgccggcgg

SEQ ID NO: 2882737 - RNA, 18 nt, Mycobacterium avium subsp. paratuberculosis
ggugaugucgccggcggc

SEQ ID NO: 2882738 - RNA, 19 nt, Mycobacterium avium subsp. paratuberculosis
ggugaugucgccggcggcg

SEQ ID NO: 2882739 - RNA, 14 nt, Mycobacterium avium subsp. paratuberculosis
ggugaugucgcugc

SEQ ID NO: 2882740 - RNA, 16 nt, Mycobacterium avium subsp. paratuberculosis
ggugaugugcggcgcg

SEQ ID NO: 2882741 - RNA, 16 nt, Mycobacterium avium subsp. paratuberculosis
ggugauguuggccgcg

SEQ ID NO: 2882742 - RNA, 18 nt, Mycobacterium avium subsp. paratuberculosis
ggugauucgcgcggcgcc

SEQ ID NO: 2882743 - RNA, 22 nt, Mycobacterium avium subsp. paratuberculosis
ggugauucgcgcggcgcccagg

SEQ ID NO: 2882744 - RNA, 14 nt, Mycobacterium avium subsp. paratuberculosis
ggugauucgugcag

SEQ ID NO: 2882745 - RNA, 22 nt, Mycobacterium avium subsp. paratuberculosis
ggugauuguaggugugcagcca

SEQ ID NO: 2882746 - RNA, 13 nt, Mycobacterium avium subsp. paratuberculosis
ggugcaacaccga

SEQ ID NO: 2882747 - RNA, 11 nt, Mycobacterium avium subsp. paratuberculosis
ggugcaacacu

SEQ ID NO: 2882748 - RNA, 20 nt, Mycobacterium avium subsp. paratuberculosis
ggugcaacacucgagcgcgc

SEQ ID NO: 2882749 - RNA, 21 nt, Mycobacterium avium subsp. paratuberculosis
ggugcaacgugaugccguggu

SEQ ID NO: 2882750 - RNA, 14 nt, Mycobacterium avium subsp. paratuberculosis
ggugcacagcccgu

SEQ ID NO: 2882751 - RNA, 15 nt, Mycobacterium avium subsp. paratuberculosis
ggugcacagcccgug

SEQ ID NO: 2882752 - RNA, 19 nt, Mycobacterium avium subsp. paratuberculosis
ggugcacccgaugcucccg

SEQ ID NO: 2882753 - RNA, 21 nt, Mycobacterium avium subsp. paratuberculosis
ggugcacccgaugcucccggu

SEQ ID NO: 2882754 - RNA, 15 nt, Mycobacterium avium subsp. paratuberculosis
ggugcccugugaggc

SEQ ID NO: 2882755 - RNA, 16 nt, Mycobacterium avium subsp. paratuberculosis
ggugcccugugaggcg

SEQ ID NO: 2882756 - RNA, 23 nt, Mycobacterium avium subsp. paratuberculosis
ggugccgaacacguacagcggcg

SEQ ID NO: 2882757 - RNA, 21 nt, Mycobacterium avium subsp. paratuberculosis
ggugccgaacagcgacgucug

SEQ ID NO: 2882758 - RNA, 13 nt, Mycobacterium avium subsp. paratuberculosis
ggugccgaagcgc

SEQ ID NO: 2882759 - RNA, 13 nt, Mycobacterium avium subsp. paratuberculosis
ggugccgaccugg

SEQ ID NO: 2882760 - RNA, 19 nt, Mycobacterium avium subsp. paratuberculosis
ggugccgaccugggcggcc

SEQ ID NO: 2882761 - RNA, 20 nt, Mycobacterium avium subsp. paratuberculosis
ggugccgaccugggcggcca

SEQ ID NO: 2882762 - RNA, 23 nt, Mycobacterium avium subsp. paratuberculosis
ggugccgacgagcucgccgcugu

SEQ ID NO: 2882763 - RNA, 18 nt, Mycobacterium avium subsp. paratuberculosis
ggugccgacgauccgggc

SEQ ID NO: 2882764 - RNA, 21 nt, Mycobacterium avium subsp. paratuberculosis
ggugccgacgauccgggcgcc

SEQ ID NO: 2882765 - RNA, 14 nt, Mycobacterium avium subsp. paratuberculosis
ggugccgacggugc

SEQ ID NO: 2882766 - RNA, 18 nt, Mycobacterium avium subsp. paratuberculosis
ggugccgacggugcgugc

SEQ ID NO: 2882767 - RNA, 22 nt, Mycobacterium avium subsp. paratuberculosis
ggugccgagcacgcggccgcgc

SEQ ID NO: 2882768 - RNA, 15 nt, Mycobacterium avium subsp. paratuberculosis
ggugccgagcccgcc

SEQ ID NO: 2882769 - RNA, 16 nt, Mycobacterium avium subsp. paratuberculosis
ggugccgagcccgccg

SEQ ID NO: 2882770 - RNA, 22 nt, Mycobacterium avium subsp. paratuberculosis
ggugccgagcccgccggcggcg

SEQ ID NO: 2882771 - RNA, 23 nt, Mycobacterium avium subsp. paratuberculosis
ggugccgagcccgccggcggcga

SEQ ID NO: 2882772 - RNA, 17 nt, Mycobacterium avium subsp. paratuberculosis
ggugccgaguucgaccu

SEQ ID NO: 2882773 - RNA, 20 nt, Mycobacterium avium subsp. paratuberculosis
ggugccgaucaccucgccgg

SEQ ID NO: 2882774 - RNA, 15 nt, Mycobacterium avium subsp. paratuberculosis
ggugccgauccgcac

SEQ ID NO: 2882775 - RNA, 18 nt, Mycobacterium avium subsp. paratuberculosis
ggugccgauccgcaccgg

SEQ ID NO: 2882776 - RNA, 21 nt, Mycobacterium avium subsp. paratuberculosis
ggugccgauccgcaccggacg

SEQ ID NO: 2882777 - RNA, 11 nt, Mycobacterium avium subsp. paratuberculosis
ggugccgcagc

SEQ ID NO: 2882778 - RNA, 17 nt, Mycobacterium avium subsp. paratuberculosis
ggugccgcagccguccc

SEQ ID NO: 2882779 - RNA, 17 nt, Mycobacterium avium subsp. paratuberculosis
ggugccgcagcggcggc

SEQ ID NO: 2882780 - RNA, 18 nt, Mycobacterium avium subsp. paratuberculosis
ggugccgcagcggcggca

SEQ ID NO: 2882781 - RNA, 23 nt, Mycobacterium avium subsp. paratuberculosis
ggugccgcccaacgacgucggcg

SEQ ID NO: 2882782 - RNA, 13 nt, Mycobacterium avium subsp. paratuberculosis
ggugccgcccgga

SEQ ID NO: 2882783 - RNA, 20 nt, Mycobacterium avium subsp. paratuberculosis
ggugccgcccggaggguauu

SEQ ID NO: 2882784 - RNA, 21 nt, Mycobacterium avium subsp. paratuberculosis
ggugccgccgaugacggcgcg

SEQ ID NO: 2882785 - RNA, 15 nt, Mycobacterium avium subsp. paratuberculosis
ggugccgccggcgau

SEQ ID NO: 2882786 - RNA, 16 nt, Mycobacterium avium subsp. paratuberculosis
ggugccgccggcgauc

SEQ ID NO: 2882787 - RNA, 14 nt, Mycobacterium avium subsp. paratuberculosis
ggugccgccgggca

SEQ ID NO: 2882788 - RNA, 14 nt, Mycobacterium avium subsp. paratuberculosis
ggugccgccgggga

SEQ ID NO: 2882789 - RNA, 15 nt, Mycobacterium avium subsp. paratuberculosis
ggugccgccgugcgc

SEQ ID NO: 2882790 - RNA, 18 nt, Mycobacterium avium subsp. paratuberculosis
ggugccgcgaugcccgcc

SEQ ID NO: 2882791 - RNA, 22 nt, Mycobacterium avium subsp. paratuberculosis
ggugccgcgcagcaccgucacc

SEQ ID NO: 2882792 - RNA, 17 nt, Mycobacterium avium subsp. paratuberculosis
ggugccgcgcggcaggu

SEQ ID NO: 2882793 - RNA, 15 nt, Mycobacterium avium subsp. paratuberculosis
ggugccgcguucgga

SEQ ID NO: 2882794 - RNA, 21 nt, Mycobacterium avium subsp. paratuberculosis
ggugccgcguucggaggcuuc

SEQ ID NO: 2882795 - RNA, 15 nt, Mycobacterium avium subsp. paratuberculosis
ggugccgcugcccgc

SEQ ID NO: 2882796 - RNA, 16 nt, Mycobacterium avium subsp. paratuberculosis
ggugccgcugcccgcc

SEQ ID NO: 2882797 - RNA, 17 nt, Mycobacterium avium subsp. paratuberculosis
ggugccgcugcccgccg

SEQ ID NO: 2882798 - RNA, 20 nt, Mycobacterium avium subsp. paratuberculosis
ggugccggaaguucucgccg

SEQ ID NO: 2882799 - RNA, 16 nt, Mycobacterium avium subsp. paratuberculosis
ggugccggaggcggcg

SEQ ID NO: 2882800 - RNA, 12 nt, Mycobacterium avium subsp. paratuberculosis
ggugccggccac

SEQ ID NO: 2882801 - RNA, 18 nt, Mycobacterium avium subsp. paratuberculosis
ggugccggccaccggcgc

SEQ ID NO: 2882802 - RNA, 13 nt, Mycobacterium avium subsp. paratuberculosis
ggugccggccaga

SEQ ID NO: 2882803 - RNA, 19 nt, Mycobacterium avium subsp. paratuberculosis
ggugccggccagaucgacg

SEQ ID NO: 2882804 - RNA, 21 nt, Mycobacterium avium subsp. paratuberculosis
ggugccggccagaucgacgcc

SEQ ID NO: 2882805 - RNA, 16 nt, Mycobacterium avium subsp. paratuberculosis
ggugccggccgggucg

SEQ ID NO: 2882806 - RNA, 17 nt, Mycobacterium avium subsp. paratuberculosis
ggugccggccgggucga

SEQ ID NO: 2882807 - RNA, 14 nt, Mycobacterium avium subsp. paratuberculosis
ggugccggccgguc

SEQ ID NO: 2882808 - RNA, 19 nt, Mycobacterium avium subsp. paratuberculosis
ggugccggccggucgaagg

SEQ ID NO: 2882809 - RNA, 19 nt, Mycobacterium avium subsp. paratuberculosis
ggugccggccucgucggcg

SEQ ID NO: 2882810 - RNA, 14 nt, Mycobacterium avium subsp. paratuberculosis
ggugccgggccagg

SEQ ID NO: 2882811 - RNA, 21 nt, Mycobacterium avium subsp. paratuberculosis
ggugccggugacggucagggu

SEQ ID NO: 2882812 - RNA, 23 nt, Mycobacterium avium subsp. paratuberculosis
ggugccggugauccacuccagca

SEQ ID NO: 2882813 - RNA, 19 nt, Mycobacterium avium subsp. paratuberculosis
ggugccggugaugaacgcg

SEQ ID NO: 2882814 - RNA, 16 nt, Mycobacterium avium subsp. paratuberculosis
ggugccguccgggucg

SEQ ID NO: 2882815 - RNA, 17 nt, Mycobacterium avium subsp. paratuberculosis
ggugccguccgggucgc

SEQ ID NO: 2882816 - RNA, 19 nt, Mycobacterium avium subsp. paratuberculosis
ggugccgucgaucgcccgc

SEQ ID NO: 2882817 - RNA, 15 nt, Mycobacterium avium subsp. paratuberculosis
ggugccgucggcggg

SEQ ID NO: 2882818 - RNA, 23 nt, Mycobacterium avium subsp. paratuberculosis
ggugccguugaucagggcggcgc

SEQ ID NO: 2882819 - RNA, 22 nt, Mycobacterium avium subsp. paratuberculosis
ggugcgaaaauggcugcccggc

SEQ ID NO: 2882820 - RNA, 18 nt, Mycobacterium avium subsp. paratuberculosis
ggugcgaacagccacggu

SEQ ID NO: 2882821 - RNA, 14 nt, Mycobacterium avium subsp. paratuberculosis
ggugcgacgcccac

SEQ ID NO: 2882822 - RNA, 15 nt, Mycobacterium avium subsp. paratuberculosis
ggugcgacgcccacu

SEQ ID NO: 2882823 - RNA, 16 nt, Mycobacterium avium subsp. paratuberculosis
ggugcgacgccgcgca

SEQ ID NO: 2882824 - RNA, 12 nt, Mycobacterium avium subsp. paratuberculosis
ggugcgacggca

SEQ ID NO: 2882825 - RNA, 15 nt, Mycobacterium avium subsp. paratuberculosis
ggugcgagccaccuc

SEQ ID NO: 2882826 - RNA, 23 nt, Mycobacterium avium subsp. paratuberculosis
ggugcgcaauggcgaacaugguc

SEQ ID NO: 2882827 - RNA, 14 nt, Mycobacterium avium subsp. paratuberculosis
ggugcgcaccagca

SEQ ID NO: 2882828 - RNA, 23 nt, Mycobacterium avium subsp. paratuberculosis
ggugcgcaccccguugccgccgg

SEQ ID NO: 2882829 - RNA, 15 nt, Mycobacterium avium subsp. paratuberculosis
ggugcgcacgaucug

SEQ ID NO: 2882830 - RNA, 16 nt, Mycobacterium avium subsp. paratuberculosis
ggugcgcagcccgccg

SEQ ID NO: 2882831 - RNA, 14 nt, Mycobacterium avium subsp. paratuberculosis
ggugcgcagccgcu

SEQ ID NO: 2882832 - RNA, 19 nt, Mycobacterium avium subsp. paratuberculosis
ggugcgcagccgcugcagc

SEQ ID NO: 2882833 - RNA, 14 nt, Mycobacterium avium subsp. paratuberculosis
ggugcgcagccguc

SEQ ID NO: 2882834 - RNA, 15 nt, Mycobacterium avium subsp. paratuberculosis
ggugcgcauggcgug

SEQ ID NO: 2882835 - RNA, 13 nt, Mycobacterium avium subsp. paratuberculosis
ggugcgccacugc

SEQ ID NO: 2882836 - RNA, 14 nt, Mycobacterium avium subsp. paratuberculosis
ggugcgccacugcg

SEQ ID NO: 2882837 - RNA, 16 nt, Mycobacterium avium subsp. paratuberculosis
ggugcgccagaucagc

SEQ ID NO: 2882838 - RNA, 22 nt, Mycobacterium avium subsp. paratuberculosis
ggugcgccagaucagcgugguc

SEQ ID NO: 2882839 - RNA, 22 nt, Mycobacterium avium subsp. paratuberculosis
ggugcgugaugaccagggccuc

SEQ ID NO: 2882840 - RNA, 20 nt, Mycobacterium avium subsp. paratuberculosis
ggugcguuccagguccgcgg

SEQ ID NO: 2882841 - RNA, 18 nt, Mycobacterium avium subsp. paratuberculosis
ggugcucaccccggccag

SEQ ID NO: 2882842 - RNA, 20 nt, Mycobacterium avium subsp. paratuberculosis
ggugcucagguugcgcagca

SEQ ID NO: 2882843 - RNA, 16 nt, Mycobacterium avium subsp. paratuberculosis
ggugcucgacggcacc

SEQ ID NO: 2882844 - RNA, 19 nt, Mycobacterium avium subsp. paratuberculosis
ggugcucgacggcacccgg

SEQ ID NO: 2882845 - RNA, 22 nt, Mycobacterium avium subsp. paratuberculosis
ggugcucgaucggcgcgccgaa

SEQ ID NO: 2882846 - RNA, 13 nt, Mycobacterium avium subsp. paratuberculosis
ggugcucgaugcg

SEQ ID NO: 2882847 - RNA, 14 nt, Mycobacterium avium subsp. paratuberculosis
ggugcucgccccgc

SEQ ID NO: 2882848 - RNA, 15 nt, Mycobacterium avium subsp. paratuberculosis
ggugcucgccccgcc

SEQ ID NO: 2882849 - RNA, 18 nt, Mycobacterium avium subsp. paratuberculosis
ggugcucgccggcgcgga

SEQ ID NO: 2882850 - RNA, 17 nt, Mycobacterium avium subsp. paratuberculosis
ggugcucgcgccgggcg

SEQ ID NO: 2882851 - RNA, 19 nt, Mycobacterium avium subsp. paratuberculosis
ggugcucgcgccgggcggc

SEQ ID NO: 2882852 - RNA, 14 nt, Mycobacterium avium subsp. paratuberculosis
ggugcucggcgcgc

SEQ ID NO: 2882853 - RNA, 16 nt, Mycobacterium avium subsp. paratuberculosis
ggugcucggcgcgcgg

SEQ ID NO: 2882854 - RNA, 14 nt, Mycobacterium avium subsp. paratuberculosis
ggugcucuccugcu

SEQ ID NO: 2882855 - RNA, 20 nt, Mycobacterium avium subsp. paratuberculosis
ggugcucuugacggccgcgg

SEQ ID NO: 2882856 - RNA, 21 nt, Mycobacterium avium subsp. paratuberculosis
ggugcucuugacggccgcggc

SEQ ID NO: 2882857 - RNA, 16 nt, Mycobacterium avium subsp. paratuberculosis
ggugcucuugguggug

SEQ ID NO: 2882858 - RNA, 21 nt, Mycobacterium avium subsp. paratuberculosis
ggugcugaacgccugccggcg

SEQ ID NO: 2882859 - RNA, 23 nt, Mycobacterium avium subsp. paratuberculosis
ggugcugaacgccugccggcgcc

SEQ ID NO: 2882860 - RNA, 20 nt, Mycobacterium avium subsp. paratuberculosis
ggugcugacccggucgcggc

SEQ ID NO: 2882861 - RNA, 23 nt, Mycobacterium avium subsp. paratuberculosis
ggugcugcagauccgcucgccgu

SEQ ID NO: 2882862 - RNA, 13 nt, Mycobacterium avium subsp. paratuberculosis
ggugcugcccggc

SEQ ID NO: 2882863 - RNA, 14 nt, Mycobacterium avium subsp. paratuberculosis
ggugcugcccggcg

SEQ ID NO: 2882864 - RNA, 18 nt, Mycobacterium avium subsp. paratuberculosis
ggugcugcccggcgcgga

SEQ ID NO: 2882865 - RNA, 20 nt, Mycobacterium avium subsp. paratuberculosis
ggugcugcccggcgcggaca

SEQ ID NO: 2882866 - RNA, 14 nt, Mycobacterium avium subsp. paratuberculosis
ggugcugccguugg

SEQ ID NO: 2882867 - RNA, 19 nt, Mycobacterium avium subsp. paratuberculosis
ggugcugccguugggcacg

SEQ ID NO: 2882868 - RNA, 13 nt, Mycobacterium avium subsp. paratuberculosis
ggugcugcggcuc

SEQ ID NO: 2882869 - RNA, 23 nt, Mycobacterium avium subsp. paratuberculosis
ggugcuggcgaugugaucgcggc

SEQ ID NO: 2882870 - RNA, 16 nt, Mycobacterium avium subsp. paratuberculosis
ggugcugggcacccag

SEQ ID NO: 2882871 - RNA, 22 nt, Mycobacterium avium subsp. paratuberculosis
ggugcugggcggauccgcgugg

SEQ ID NO: 2882872 - RNA, 15 nt, Mycobacterium avium subsp. paratuberculosis
ggugcugucgucgcc

SEQ ID NO: 2882873 - RNA, 21 nt, Mycobacterium avium subsp. paratuberculosis
ggugcuucaucccgucguuga

SEQ ID NO: 2882874 - RNA, 15 nt, Mycobacterium avium subsp. paratuberculosis
ggugcuuggucagcg

SEQ ID NO: 2882875 - RNA, 23 nt, Mycobacterium avium subsp. paratuberculosis
ggugcuuggucagcgcggcccgc

SEQ ID NO: 2882876 - RNA, 23 nt, Mycobacterium avium subsp. paratuberculosis
ggugcuuucgcgucugcucgcgg

SEQ ID NO: 2882877 - RNA, 23 nt, Mycobacterium avium subsp. paratuberculosis
ggugcuuuugugucugcucgccu

SEQ ID NO: 2882878 - RNA, 14 nt, Mycobacterium avium subsp. paratuberculosis
ggucacccgcagcc

SEQ ID NO: 2882879 - RNA, 19 nt, Mycobacterium avium subsp. paratuberculosis
ggucacccgcagcccgacc

SEQ ID NO: 2882880 - RNA, 19 nt, Mycobacterium avium subsp. paratuberculosis
ggucacccgguugagcacc

SEQ ID NO: 2882881 - RNA, 22 nt, Mycobacterium avium subsp. paratuberculosis
ggucacccgguugagcaccgca

SEQ ID NO: 2882882 - RNA, 13 nt, Mycobacterium avium subsp. paratuberculosis
ggucacccuccuc

SEQ ID NO: 2882883 - RNA, 19 nt, Mycobacterium avium subsp. paratuberculosis
ggucacccuccucgcggcg

SEQ ID NO: 2882884 - RNA, 14 nt, Mycobacterium avium subsp. paratuberculosis
ggucaccgagcggc

SEQ ID NO: 2882885 - RNA, 20 nt, Mycobacterium avium subsp. paratuberculosis
ggucaccgagcggccgucca

SEQ ID NO: 2882886 - RNA, 13 nt, Mycobacterium avium subsp. paratuberculosis
ggucaccgcgcga

SEQ ID NO: 2882887 - RNA, 14 nt, Mycobacterium avium subsp. paratuberculosis
ggucaccgcgggaa

SEQ ID NO: 2882888 - RNA, 23 nt, Mycobacterium avium subsp. paratuberculosis
ggucaccgcgggaauggccgcgc

SEQ ID NO: 2882889 - RNA, 20 nt, Mycobacterium avium subsp. paratuberculosis
ggucaccggagagcaacacc

SEQ ID NO: 2882890 - RNA, 19 nt, Mycobacterium avium subsp. paratuberculosis
ggucaccggaugcaccggc

SEQ ID NO: 2882891 - RNA, 20 nt, Mycobacterium avium subsp. paratuberculosis
ggucaccggaugcaccggca

SEQ ID NO: 2882892 - RNA, 23 nt, Mycobacterium avium subsp. paratuberculosis
ggucaccggaugcacgugcaccg

SEQ ID NO: 2882893 - RNA, 22 nt, Mycobacterium avium subsp. paratuberculosis
ggucaccggcaggcgguagcgg

SEQ ID NO: 2882894 - RNA, 11 nt, Mycobacterium avium subsp. paratuberculosis
ggucaccggcu

SEQ ID NO: 2882895 - RNA, 11 nt, Mycobacterium avium subsp. paratuberculosis
ggucaccgguc

SEQ ID NO: 2882896 - RNA, 13 nt, Mycobacterium avium subsp. paratuberculosis
ggucaccgugcgg

SEQ ID NO: 2882897 - RNA, 20 nt, Mycobacterium avium subsp. paratuberculosis
ggucaccgugcgggucgcgc

SEQ ID NO: 2882898 - RNA, 13 nt, Mycobacterium avium subsp. paratuberculosis
ggucaccgugucg

SEQ ID NO: 2882899 - RNA, 18 nt, Mycobacterium avium subsp. paratuberculosis
ggucaccgugucggcggg

SEQ ID NO: 2882900 - RNA, 22 nt, Mycobacterium avium subsp. paratuberculosis
ggucaccgugucggcgggcggg

SEQ ID NO: 2882901 - RNA, 19 nt, Mycobacterium avium subsp. paratuberculosis
ggucaccguguuggugacg

SEQ ID NO: 2882902 - RNA, 13 nt, Mycobacterium avium subsp. paratuberculosis
ggucacgcccggg

SEQ ID NO: 2882903 - RNA, 14 nt, Mycobacterium avium subsp. paratuberculosis
ggucacgcccgggu

SEQ ID NO: 2882904 - RNA, 21 nt, Mycobacterium avium subsp. paratuberculosis
ggucacgcccggguacaccga

SEQ ID NO: 2882905 - RNA, 16 nt, Mycobacterium avium subsp. paratuberculosis
ggucacgcuggcguga

SEQ ID NO: 2882906 - RNA, 19 nt, Mycobacterium avium subsp. paratuberculosis
ggucacgcuggcgugacgc

SEQ ID NO: 2882907 - RNA, 14 nt, Mycobacterium avium subsp. paratuberculosis
ggucacggacaggu

SEQ ID NO: 2882908 - RNA, 19 nt, Mycobacterium avium subsp. paratuberculosis
ggucacggauacccgcggc

SEQ ID NO: 2882909 - RNA, 13 nt, Mycobacterium avium subsp. paratuberculosis
ggucacggccgcc

SEQ ID NO: 2882910 - RNA, 16 nt, Mycobacterium avium subsp. paratuberculosis
ggucacggccgccagc

SEQ ID NO: 2882911 - RNA, 17 nt, Mycobacterium avium subsp. paratuberculosis
ggucacggccgccagca

SEQ ID NO: 2882912 - RNA, 21 nt, Mycobacterium avium subsp. paratuberculosis
ggucacggccgccagcagcac

SEQ ID NO: 2882913 - RNA, 15 nt, Mycobacterium avium subsp. paratuberculosis
ggucacggcgucggc

SEQ ID NO: 2882914 - RNA, 21 nt, Mycobacterium avium subsp. paratuberculosis
ggucacggcgucggcgucggg

SEQ ID NO: 2882915 - RNA, 16 nt, Mycobacterium avium subsp. paratuberculosis
ggucacggucuggcug

SEQ ID NO: 2882916 - RNA, 18 nt, Mycobacterium avium subsp. paratuberculosis
ggucacggucuggcuggu

SEQ ID NO: 2882917 - RNA, 19 nt, Mycobacterium avium subsp. paratuberculosis
ggucacgugcacccacgcc

SEQ ID NO: 2882918 - RNA, 22 nt, Mycobacterium avium subsp. paratuberculosis
ggucacgugcacccacgccagc

SEQ ID NO: 2882919 - RNA, 21 nt, Mycobacterium avium subsp. paratuberculosis
ggucagaccgcggcggucgcc

SEQ ID NO: 2882920 - RNA, 20 nt, Mycobacterium avium subsp. paratuberculosis
ggucagagcccgaacacggg

SEQ ID NO: 2882921 - RNA, 22 nt, Mycobacterium avium subsp. paratuberculosis
ggucagagcccgaacacgggcg

SEQ ID NO: 2882922 - RNA, 23 nt, Mycobacterium avium subsp. paratuberculosis
ggucagaucguugaugucggugg

SEQ ID NO: 2882923 - RNA, 13 nt, Mycobacterium avium subsp. paratuberculosis
ggucagcaccacc

SEQ ID NO: 2882924 - RNA, 16 nt, Mycobacterium avium subsp. paratuberculosis
ggucagcacccgcagc

SEQ ID NO: 2882925 - RNA, 18 nt, Mycobacterium avium subsp. paratuberculosis
ggucagcacccgcagccg

SEQ ID NO: 2882926 - RNA, 18 nt, Mycobacterium avium subsp. paratuberculosis
ggucagcaccgcgcggcg

SEQ ID NO: 2882927 - RNA, 16 nt, Mycobacterium avium subsp. paratuberculosis
ggucagcaccggcgug

SEQ ID NO: 2882928 - RNA, 13 nt, Mycobacterium avium subsp. paratuberculosis
ggucagcaccggg

SEQ ID NO: 2882929 - RNA, 16 nt, Mycobacterium avium subsp. paratuberculosis
ggucagcaccggggcc

SEQ ID NO: 2882930 - RNA, 15 nt, Mycobacterium avium subsp. paratuberculosis
ggucagcaccgucac

SEQ ID NO: 2882931 - RNA, 18 nt, Mycobacterium avium subsp. paratuberculosis
ggucagcagcacccgguc

SEQ ID NO: 2882932 - RNA, 23 nt, Mycobacterium avium subsp. paratuberculosis
ggucagcagcacccggucgccgg

SEQ ID NO: 2882933 - RNA, 18 nt, Mycobacterium avium subsp. paratuberculosis
ggucagcagcagcgccuc

SEQ ID NO: 2882934 - RNA, 19 nt, Mycobacterium avium subsp. paratuberculosis
ggucagcaggcgccgcagc

SEQ ID NO: 2882935 - RNA, 15 nt, Mycobacterium avium subsp. paratuberculosis
ggucagccacgggcg

SEQ ID NO: 2882936 - RNA, 18 nt, Mycobacterium avium subsp. paratuberculosis
ggucagccacgggcgguc

SEQ ID NO: 2882937 - RNA, 17 nt, Mycobacterium avium subsp. paratuberculosis
ggucagccgcaccaggu

SEQ ID NO: 2882938 - RNA, 15 nt, Mycobacterium avium subsp. paratuberculosis
ggucagccgcggcgg

SEQ ID NO: 2882939 - RNA, 16 nt, Mycobacterium avium subsp. paratuberculosis
ggucagccgcggcggc

SEQ ID NO: 2882940 - RNA, 16 nt, Mycobacterium avium subsp. paratuberculosis
ggucagccggccugcu

SEQ ID NO: 2882941 - RNA, 16 nt, Mycobacterium avium subsp. paratuberculosis
ggucagccgggcggcc

SEQ ID NO: 2882942 - RNA, 12 nt, Mycobacterium avium subsp. paratuberculosis
gggugacgacca

SEQ ID NO: 2882943 - RNA, 13 nt, Mycobacterium avium subsp. paratuberculosis
gggugacgaucca

SEQ ID NO: 2882944 - RNA, 21 nt, Mycobacterium avium subsp. paratuberculosis
gggugacgauccacagcgcga

SEQ ID NO: 2882945 - RNA, 19 nt, Mycobacterium avium subsp. paratuberculosis
gggugacgcccgucccgcc

SEQ ID NO: 2882946 - RNA, 23 nt, Mycobacterium avium subsp. paratuberculosis
gggugacgcgaaugucgaccacc

SEQ ID NO: 2882947 - RNA, 18 nt, Mycobacterium avium subsp. paratuberculosis
gggugacggucacgguga

SEQ ID NO: 2882948 - RNA, 19 nt, Mycobacterium avium subsp. paratuberculosis
gggugacggucacggugac

SEQ ID NO: 2882949 - RNA, 16 nt, Mycobacterium avium subsp. paratuberculosis
gggugacguggcggcc

SEQ ID NO: 2882950 - RNA, 23 nt, Mycobacterium avium subsp. paratuberculosis
gggugacuucgagccgggcgcgg

SEQ ID NO: 2882951 - RNA, 14 nt, Mycobacterium avium subsp. paratuberculosis
gggugagcaccgcg

SEQ ID NO: 2882952 - RNA, 17 nt, Mycobacterium avium subsp. paratuberculosis
gggugagcagggccagc

SEQ ID NO: 2882953 - RNA, 14 nt, Mycobacterium avium subsp. paratuberculosis
gggugagccggucg

SEQ ID NO: 2882954 - RNA, 18 nt, Mycobacterium avium subsp. paratuberculosis
gggugauaccggcccagc

SEQ ID NO: 2882955 - RNA, 20 nt, Mycobacterium avium subsp. paratuberculosis
gggugaucccgaugccgcgc

SEQ ID NO: 2882956 - RNA, 17 nt, Mycobacterium avium subsp. paratuberculosis
gggugaucgcggcccgc

SEQ ID NO: 2882957 - RNA, 15 nt, Mycobacterium avium subsp. paratuberculosis
gggugaucugcgccg

SEQ ID NO: 2882958 - RNA, 14 nt, Mycobacterium avium subsp. paratuberculosis
gggugaugcagugg

SEQ ID NO: 2882959 - RNA, 17 nt, Mycobacterium avium subsp. paratuberculosis
gggugauggccgccgca

SEQ ID NO: 2882960 - RNA, 21 nt, Mycobacterium avium subsp. paratuberculosis
gggugauggucucccgggcgg

SEQ ID NO: 2882961 - RNA, 16 nt, Mycobacterium avium subsp. paratuberculosis
gggugaugucgcugcc

SEQ ID NO: 2882962 - RNA, 20 nt, Mycobacterium avium subsp. paratuberculosis
gggugaugucgcugccgccg

SEQ ID NO: 2882963 - RNA, 19 nt, Mycobacterium avium subsp. paratuberculosis
gggugauuaggcaguucga

SEQ ID NO: 2882964 - RNA, 19 nt, Mycobacterium avium subsp. paratuberculosis
gggugcagcaccacgaacg

SEQ ID NO: 2882965 - RNA, 15 nt, Mycobacterium avium subsp. paratuberculosis
gggugcaggcccagc

SEQ ID NO: 2882966 - RNA, 17 nt, Mycobacterium avium subsp. paratuberculosis
gggugcaggcccgggcg

SEQ ID NO: 2882967 - RNA, 18 nt, Mycobacterium avium subsp. paratuberculosis
gggugcaggcccgggcgg

SEQ ID NO: 2882968 - RNA, 14 nt, Mycobacterium avium subsp. paratuberculosis
gggugccaaggucg

SEQ ID NO: 2882969 - RNA, 13 nt, Mycobacterium avium subsp. paratuberculosis
gggugcccaccag

SEQ ID NO: 2882970 - RNA, 16 nt, Mycobacterium avium subsp. paratuberculosis
gggugcccaccagcau

SEQ ID NO: 2882971 - RNA, 18 nt, Mycobacterium avium subsp. paratuberculosis
gggugcccaucugcacag

SEQ ID NO: 2882972 - RNA, 17 nt, Mycobacterium avium subsp. paratuberculosis
gggugcccggcugggcg

SEQ ID NO: 2882973 - RNA, 23 nt, Mycobacterium avium subsp. paratuberculosis
gggugcccggcugggcgcgcaac

SEQ ID NO: 2882974 - RNA, 15 nt, Mycobacterium avium subsp. paratuberculosis
gggugcccgggccgc

SEQ ID NO: 2882975 - RNA, 14 nt, Mycobacterium avium subsp. paratuberculosis
gggugccgaccgcg

SEQ ID NO: 2882976 - RNA, 15 nt, Mycobacterium avium subsp. paratuberculosis
gggugccgaccgcgu

SEQ ID NO: 2882977 - RNA, 15 nt, Mycobacterium avium subsp. paratuberculosis
gggugccgacgagcu

SEQ ID NO: 2882978 - RNA, 21 nt, Mycobacterium avium subsp. paratuberculosis
gggugccgacgagcucgccgc

SEQ ID NO: 2882979 - RNA, 21 nt, Mycobacterium avium subsp. paratuberculosis
gggugccgauguaggacaggu

SEQ ID NO: 2882980 - RNA, 20 nt, Mycobacterium avium subsp. paratuberculosis
gggugccgcagcggcggcac

SEQ ID NO: 2882981 - RNA, 15 nt, Mycobacterium avium subsp. paratuberculosis
gggugccgcccaacg

SEQ ID NO: 2882982 - RNA, 17 nt, Mycobacterium avium subsp. paratuberculosis
gggugccgccgggcacc

SEQ ID NO: 2882983 - RNA, 12 nt, Mycobacterium avium subsp. paratuberculosis
gggugccgcggu

SEQ ID NO: 2882984 - RNA, 23 nt, Mycobacterium avium subsp. paratuberculosis
gggugccgcguuccccggcgugg

SEQ ID NO: 2882985 - RNA, 14 nt, Mycobacterium avium subsp. paratuberculosis
gggugccggccacc

SEQ ID NO: 2882986 - RNA, 21 nt, Mycobacterium avium subsp. paratuberculosis
gggugccggccaccggcgcga

SEQ ID NO: 2882987 - RNA, 24 nt, Mycobacterium avium subsp. paratuberculosis
gggugccggccaccggcgcgacgg

SEQ ID NO: 2882988 - RNA, 18 nt, Mycobacterium avium subsp. paratuberculosis
gggugcgaacagccacgg

SEQ ID NO: 2882989 - RNA, 13 nt, Mycobacterium avium subsp. paratuberculosis
gggugcgccacug

SEQ ID NO: 2882990 - RNA, 12 nt, Mycobacterium avium subsp. paratuberculosis
gggugcgccagg

SEQ ID NO: 2882991 - RNA, 15 nt, Mycobacterium avium subsp. paratuberculosis
gggugcgcggcgccg

SEQ ID NO: 2882992 - RNA, 15 nt, Mycobacterium avium subsp. paratuberculosis
gggugcgcgucgcgg

SEQ ID NO: 2882993 - RNA, 19 nt, Mycobacterium avium subsp. paratuberculosis
gggugcgcgucgcggugga

SEQ ID NO: 2882994 - RNA, 16 nt, Mycobacterium avium subsp. paratuberculosis
gggugcgcucaccgca

SEQ ID NO: 2882995 - RNA, 23 nt, Mycobacterium avium subsp. paratuberculosis
gggugcgcucaccgcaucgaacc

SEQ ID NO: 2882996 - RNA, 16 nt, Mycobacterium avium subsp. paratuberculosis
gggugcgcucgacggc

SEQ ID NO: 2882997 - RNA, 21 nt, Mycobacterium avium subsp. paratuberculosis
gggugcgcugcagcgagaccu

SEQ ID NO: 2882998 - RNA, 15 nt, Mycobacterium avium subsp. paratuberculosis
gggugcggccagcgc

SEQ ID NO: 2882999 - RNA, 15 nt, Mycobacterium avium subsp. paratuberculosis
gggugcggcgcugcc

SEQ ID NO: 2883000 - RNA, 15 nt, Mycobacterium avium subsp. paratuberculosis
gggugcgggcugacg

SEQ ID NO: 2883001 - RNA, 16 nt, Mycobacterium avium subsp. paratuberculosis
gggugcgggcugcacc

SEQ ID NO: 2883002 - RNA, 18 nt, Mycobacterium avium subsp. paratuberculosis
gggugcgggugcggccgg

SEQ ID NO: 2883003 - RNA, 19 nt, Mycobacterium avium subsp. paratuberculosis
gggugcgggugcggccggu

SEQ ID NO: 2883004 - RNA, 14 nt, Mycobacterium avium subsp. paratuberculosis
gggugcggucggcg

SEQ ID NO: 2883005 - RNA, 14 nt, Mycobacterium avium subsp. paratuberculosis
gggugcggugcagc

SEQ ID NO: 2883006 - RNA, 18 nt, Mycobacterium avium subsp. paratuberculosis
gggugcgguugagcacca

SEQ ID NO: 2883007 - RNA, 17 nt, Mycobacterium avium subsp. paratuberculosis
gggugcucaccccggcc

SEQ ID NO: 2883008 - RNA, 19 nt, Mycobacterium avium subsp. paratuberculosis
gggugcucaccccggccag

SEQ ID NO: 2883009 - RNA, 21 nt, Mycobacterium avium subsp. paratuberculosis
gggugcucagguugcgcagca

SEQ ID NO: 2883010 - RNA, 20 nt, Mycobacterium avium subsp. paratuberculosis
gggugcucgaucggcgcgcc

SEQ ID NO: 2883011 - RNA, 15 nt, Mycobacterium avium subsp. paratuberculosis
gggugcuggucagca

SEQ ID NO: 2883012 - RNA, 20 nt, Mycobacterium avium subsp. paratuberculosis
gggugcuuucgcgucugcuc

SEQ ID NO: 2883013 - RNA, 22 nt, Mycobacterium avium subsp. paratuberculosis
gggugcuuucgcgucugcucgc

SEQ ID NO: 2883014 - RNA, 13 nt, Mycobacterium avium subsp. paratuberculosis
ggguggacaccgc

SEQ ID NO: 2883015 - RNA, 15 nt, Mycobacterium avium subsp. paratuberculosis
ggguggacaccgcga

SEQ ID NO: 2883016 - RNA, 20 nt, Mycobacterium avium subsp. paratuberculosis
ggguggacaccuuggcggcc

SEQ ID NO: 2883017 - RNA, 21 nt, Mycobacterium avium subsp. paratuberculosis
ggguggacaccuuggcggcca

SEQ ID NO: 2883018 - RNA, 23 nt, Mycobacterium avium subsp. paratuberculosis
ggguggacaccuuggcggccacc

SEQ ID NO: 2883019 - RNA, 16 nt, Mycobacterium avium subsp. paratuberculosis
ggguggacgcccgcga

SEQ ID NO: 2883020 - RNA, 19 nt, Mycobacterium avium subsp. paratuberculosis
ggguggagacguaccagcu

SEQ ID NO: 2883021 - RNA, 22 nt, Mycobacterium avium subsp. paratuberculosis
ggguggaucuugacggcgacgg

SEQ ID NO: 2883022 - RNA, 17 nt, Mycobacterium avium subsp. paratuberculosis
ggguggccagcaccagc

SEQ ID NO: 2883023 - RNA, 14 nt, Mycobacterium avium subsp. paratuberculosis
ggguggccagccag

SEQ ID NO: 2883024 - RNA, 22 nt, Mycobacterium avium subsp. paratuberculosis
ggguggccccagcccgggggug

SEQ ID NO: 2883025 - RNA, 11 nt, Mycobacterium avium subsp. paratuberculosis
ggguggcccgc

SEQ ID NO: 2883026 - RNA, 12 nt, Mycobacterium avium subsp. paratuberculosis
ggguggcccgca

SEQ ID NO: 2883027 - RNA, 12 nt, Mycobacterium avium subsp. paratuberculosis
ggguggcccgcc

SEQ ID NO: 2883028 - RNA, 19 nt, Mycobacterium avium subsp. paratuberculosis
ggguggcccgcccgggcac

SEQ ID NO: 2883029 - RNA, 19 nt, Mycobacterium avium subsp. paratuberculosis
ggguggccgccacguccgg

SEQ ID NO: 2883030 - RNA, 22 nt, Mycobacterium avium subsp. paratuberculosis
ggguggccgccacguccggaug

SEQ ID NO: 2883031 - RNA, 14 nt, Mycobacterium avium subsp. paratuberculosis
ggguggccggccag

SEQ ID NO: 2883032 - RNA, 15 nt, Mycobacterium avium subsp. paratuberculosis
ggguggccggccagc

SEQ ID NO: 2883033 - RNA, 12 nt, Mycobacterium avium subsp. paratuberculosis
ggguggccguga

SEQ ID NO: 2883034 - RNA, 14 nt, Mycobacterium avium subsp. paratuberculosis
ggguggccucgucg

SEQ ID NO: 2883035 - RNA, 19 nt, Mycobacterium avium subsp. paratuberculosis
ggguggccucgucggcgcc

SEQ ID NO: 2883036 - RNA, 20 nt, Mycobacterium avium subsp. paratuberculosis
ggguggccucgucggcgccg

SEQ ID NO: 2883037 - RNA, 16 nt, Mycobacterium avium subsp. paratuberculosis
ggguggccuucaucac

SEQ ID NO: 2883038 - RNA, 16 nt, Mycobacterium avium subsp. paratuberculosis
ggguggcgccggccag

SEQ ID NO: 2883039 - RNA, 17 nt, Mycobacterium avium subsp. paratuberculosis
ggguggcgccggccagc

SEQ ID NO: 2883040 - RNA, 18 nt, Mycobacterium avium subsp. paratuberculosis
ggguggcgccggccagca

SEQ ID NO: 2883041 - RNA, 19 nt, Mycobacterium avium subsp. paratuberculosis
ggguggcgccggccagcac

SEQ ID NO: 2883042 - RNA, 15 nt, Mycobacterium avium subsp. paratuberculosis
ggguggcgucgacgg

SEQ ID NO: 2883043 - RNA, 15 nt, Mycobacterium avium subsp. paratuberculosis
ggguggcgucgccgc

SEQ ID NO: 2883044 - RNA, 12 nt, Mycobacterium avium subsp. paratuberculosis
gggugggcagcc

SEQ ID NO: 2883045 - RNA, 15 nt, Mycobacterium avium subsp. paratuberculosis
gggugggcagcucgg

SEQ ID NO: 2883046 - RNA, 14 nt, Mycobacterium avium subsp. paratuberculosis
gggugggcgacgag

SEQ ID NO: 2883047 - RNA, 16 nt, Mycobacterium avium subsp. paratuberculosis
gggugggcgacgaggu

SEQ ID NO: 2883048 - RNA, 13 nt, Mycobacterium avium subsp. paratuberculosis
gggugggcggcac

SEQ ID NO: 2883049 - RNA, 19 nt, Mycobacterium avium subsp. paratuberculosis
gggugggcggcacaccgcg

SEQ ID NO: 2883050 - RNA, 22 nt, Mycobacterium avium subsp. paratuberculosis
gggugggcucccagucccagca

SEQ ID NO: 2883051 - RNA, 16 nt, Mycobacterium avium subsp. paratuberculosis
ggguggggacgacgcc

SEQ ID NO: 2883052 - RNA, 14 nt, Mycobacterium avium subsp. paratuberculosis
ggguggucaccagc

SEQ ID NO: 2883053 - RNA, 21 nt, Mycobacterium avium subsp. paratuberculosis
ggguggucaccagcgcgguca

SEQ ID NO: 2883054 - RNA, 15 nt, Mycobacterium avium subsp. paratuberculosis
ggguggucaccggca

SEQ ID NO: 2883055 - RNA, 22 nt, Mycobacterium avium subsp. paratuberculosis
ggguggucagcgucucggcgau

SEQ ID NO: 2883056 - RNA, 15 nt, Mycobacterium avium subsp. paratuberculosis
gggugguccacccag

SEQ ID NO: 2883057 - RNA, 16 nt, Mycobacterium avium subsp. paratuberculosis
gggugguccacccaga

SEQ ID NO: 2883058 - RNA, 13 nt, Mycobacterium avium subsp. paratuberculosis
ggguggucugcug

SEQ ID NO: 2883059 - RNA, 20 nt, Mycobacterium avium subsp. paratuberculosis
gggugguggacgucaggccg

SEQ ID NO: 2883060 - RNA, 15 nt, Mycobacterium avium subsp. paratuberculosis
ggguggugggcgcga

SEQ ID NO: 2883061 - RNA, 14 nt, Mycobacterium avium subsp. paratuberculosis
gggugguucguccg

SEQ ID NO: 2883062 - RNA, 13 nt, Mycobacterium avium subsp. paratuberculosis
ggguguaggcguc

SEQ ID NO: 2883063 - RNA, 17 nt, Mycobacterium avium subsp. paratuberculosis
ggguguauucgcccacc

SEQ ID NO: 2883064 - RNA, 14 nt, Mycobacterium avium subsp. paratuberculosis
gggugucagcgcga

SEQ ID NO: 2883065 - RNA, 20 nt, Mycobacterium avium subsp. paratuberculosis
gggugucagcgcgaccucgg

SEQ ID NO: 2883066 - RNA, 18 nt, Mycobacterium avium subsp. paratuberculosis
gggugucaggucggcgau

SEQ ID NO: 2883067 - RNA, 17 nt, Mycobacterium avium subsp. paratuberculosis
ggguguccuugcgcacc

SEQ ID NO: 2883068 - RNA, 22 nt, Mycobacterium avium subsp. paratuberculosis
ggguguccuugcgcaccacguc

SEQ ID NO: 2883069 - RNA, 12 nt, Mycobacterium avium subsp. paratuberculosis
gggugucgagcc

SEQ ID NO: 2883070 - RNA, 23 nt, Mycobacterium avium subsp. paratuberculosis
gggugucgagccaccacugcgcc

SEQ ID NO: 2883071 - RNA, 12 nt, Mycobacterium avium subsp. paratuberculosis
gggugucgauga

SEQ ID NO: 2883072 - RNA, 13 nt, Mycobacterium avium subsp. paratuberculosis
gggugucgaugac

SEQ ID NO: 2883073 - RNA, 13 nt, Mycobacterium avium subsp. paratuberculosis
gggugucggcggg

SEQ ID NO: 2883074 - RNA, 16 nt, Mycobacterium avium subsp. paratuberculosis
gggugugcagcgggau

SEQ ID NO: 2883075 - RNA, 18 nt, Mycobacterium avium subsp. paratuberculosis
gggugugcccgaacgcgc

SEQ ID NO: 2883076 - RNA, 17 nt, Mycobacterium avium subsp. paratuberculosis
gggugugcggcacggcg

SEQ ID NO: 2883077 - RNA, 18 nt, Mycobacterium avium subsp. paratuberculosis
gggugugcucggcggcgc

SEQ ID NO: 2883078 - RNA, 18 nt, Mycobacterium avium subsp. paratuberculosis
ggguguggcgucgaugcc

SEQ ID NO: 2883079 - RNA, 13 nt, Mycobacterium avium subsp. paratuberculosis
ggguguuccccgg

SEQ ID NO: 2883080 - RNA, 21 nt, Mycobacterium avium subsp. paratuberculosis
ggguguuccccgggcgagcgu

SEQ ID NO: 2883081 - RNA, 21 nt, Mycobacterium avium subsp. paratuberculosis
ggguguugcggcagggccacc

SEQ ID NO: 2883082 - RNA, 18 nt, Mycobacterium avium subsp. paratuberculosis
ggguguuguccgagccgc

SEQ ID NO: 2883083 - RNA, 14 nt, Mycobacterium avium subsp. paratuberculosis
ggguguuucggucg

SEQ ID NO: 2883084 - RNA, 20 nt, Mycobacterium avium subsp. paratuberculosis
ggguucaacuccucgaagag

SEQ ID NO: 2883085 - RNA, 19 nt, Mycobacterium avium subsp. paratuberculosis
ggguuccgccgucgaugcg

SEQ ID NO: 2883086 - RNA, 15 nt, Mycobacterium avium subsp. paratuberculosis
ggguuccgguuggcc

SEQ ID NO: 2883087 - RNA, 13 nt, Mycobacterium avium subsp. paratuberculosis
ggguucggcggcg

SEQ ID NO: 2883088 - RNA, 22 nt, Mycobacterium avium subsp. paratuberculosis
ggguucggcggcgcggcccagg

SEQ ID NO: 2883089 - RNA, 19 nt, Mycobacterium avium subsp. paratuberculosis
ggguucggucucggcggcg

SEQ ID NO: 2883090 - RNA, 13 nt, Mycobacterium avium subsp. paratuberculosis
ggguucucgcggc

SEQ ID NO: 2883091 - RNA, 19 nt, Mycobacterium avium subsp. paratuberculosis
ggguucucgcggcggccga

SEQ ID NO: 2883092 - RNA, 16 nt, Mycobacterium avium subsp. paratuberculosis
ggguucuggccguggu

SEQ ID NO: 2883093 - RNA, 21 nt, Mycobacterium avium subsp. paratuberculosis
ggguucuucgaccacgcgcca

SEQ ID NO: 2883094 - RNA, 16 nt, Mycobacterium avium subsp. paratuberculosis
ggguugacccggccgg

SEQ ID NO: 2883095 - RNA, 15 nt, Mycobacterium avium subsp. paratuberculosis
ggguugaccuugacc

SEQ ID NO: 2883096 - RNA, 18 nt, Mycobacterium avium subsp. paratuberculosis
ggguugagcaggucagcc

SEQ ID NO: 2883097 - RNA, 14 nt, Mycobacterium avium subsp. paratuberculosis
ggguugccggcggc

SEQ ID NO: 2883098 - RNA, 17 nt, Mycobacterium avium subsp. paratuberculosis
ggguugccgucgacgaa

SEQ ID NO: 2883099 - RNA, 19 nt, Mycobacterium avium subsp. paratuberculosis
ggguugcgaaagcccaggc

SEQ ID NO: 2883100 - RNA, 16 nt, Mycobacterium avium subsp. paratuberculosis
ggguugcgggccaggc

SEQ ID NO: 2883101 - RNA, 15 nt, Mycobacterium avium subsp. paratuberculosis
ggguuggccagggcg

SEQ ID NO: 2883102 - RNA, 18 nt, Mycobacterium avium subsp. paratuberculosis
ggguuggccagggcggcc

SEQ ID NO: 2883103 - RNA, 16 nt, Mycobacterium avium subsp. paratuberculosis
ggguugggcgccagca

SEQ ID NO: 2883104 - RNA, 12 nt, Mycobacterium avium subsp. paratuberculosis
ggguugggcggc

SEQ ID NO: 2883105 - RNA, 13 nt, Mycobacterium avium subsp. paratuberculosis
ggguuggggccgc

SEQ ID NO: 2883106 - RNA, 19 nt, Mycobacterium avium subsp. paratuberculosis
ggguuguagaacgacgaca

SEQ ID NO: 2883107 - RNA, 19 nt, Mycobacterium avium subsp. paratuberculosis
ggguuguagcaggcggugg

SEQ ID NO: 2883108 - RNA, 18 nt, Mycobacterium avium subsp. paratuberculosis
ggguuuccacgugcacgg

SEQ ID NO: 2883109 - RNA, 22 nt, Mycobacterium avium subsp. paratuberculosis
ggguuuucacgucgagcggccc

SEQ ID NO: 2883110 - RNA, 23 nt, Mycobacterium avium subsp. paratuberculosis
ggguuuuugauugcgcggcgccg

SEQ ID NO: 2883111 - RNA, 14 nt, Mycobacterium avium subsp. paratuberculosis
gguaaaccgccagc

SEQ ID NO: 2883112 - RNA, 15 nt, Mycobacterium avium subsp. paratuberculosis
gguaacccuccggcg

SEQ ID NO: 2883113 - RNA, 13 nt, Mycobacterium avium subsp. paratuberculosis
gguaaccgcccga

SEQ ID NO: 2883114 - RNA, 18 nt, Mycobacterium avium subsp. paratuberculosis
gguaaccgcccgagcaga

SEQ ID NO: 2883115 - RNA, 15 nt, Mycobacterium avium subsp. paratuberculosis
gguaagccaggucac

SEQ ID NO: 2883116 - RNA, 14 nt, Mycobacterium avium subsp. paratuberculosis
gguaagugucgugg

SEQ ID NO: 2883117 - RNA, 15 nt, Mycobacterium avium subsp. paratuberculosis
gguaaugggcgaucg

SEQ ID NO: 2883118 - RNA, 12 nt, Mycobacterium avium subsp. paratuberculosis
gguacaccggcu

SEQ ID NO: 2883119 - RNA, 14 nt, Mycobacterium avium subsp. paratuberculosis
gguacacguggccg

SEQ ID NO: 2883120 - RNA, 15 nt, Mycobacterium avium subsp. paratuberculosis
gguacacguggccga

SEQ ID NO: 2883121 - RNA, 14 nt, Mycobacterium avium subsp. paratuberculosis
gguacagcaccgcc

SEQ ID NO: 2883122 - RNA, 15 nt, Mycobacterium avium subsp. paratuberculosis
gguacagcaccgccg

SEQ ID NO: 2883123 - RNA, 18 nt, Mycobacterium avium subsp. paratuberculosis
gguacagcaccgccgcgg

SEQ ID NO: 2883124 - RNA, 20 nt, Mycobacterium avium subsp. paratuberculosis
gguacagcgacuccagcgcg

SEQ ID NO: 2883125 - RNA, 15 nt, Mycobacterium avium subsp. paratuberculosis
gguacagcgccgcgg

SEQ ID NO: 2883126 - RNA, 20 nt, Mycobacterium avium subsp. paratuberculosis
gguacagcgccgcggccagc

SEQ ID NO: 2883127 - RNA, 14 nt, Mycobacterium avium subsp. paratuberculosis
gguacaggccccac

SEQ ID NO: 2883128 - RNA, 16 nt, Mycobacterium avium subsp. paratuberculosis
gguacagggucaucgc

SEQ ID NO: 2883129 - RNA, 21 nt, Mycobacterium avium subsp. paratuberculosis
gguacagggucaucgcgccgg

SEQ ID NO: 2883130 - RNA, 14 nt, Mycobacterium avium subsp. paratuberculosis
gguacaucgacgcg

SEQ ID NO: 2883131 - RNA, 18 nt, Mycobacterium avium subsp. paratuberculosis
gguacaucgacgcgaccg

SEQ ID NO: 2883132 - RNA, 22 nt, Mycobacterium avium subsp. paratuberculosis
gguacaucguucccugcgcggc

SEQ ID NO: 2883133 - RNA, 13 nt, Mycobacterium avium subsp. paratuberculosis
gguaccacgccgu

SEQ ID NO: 2883134 - RNA, 21 nt, Mycobacterium avium subsp. paratuberculosis
gguaccagggcagcgccucgg

SEQ ID NO: 2883135 - RNA, 13 nt, Mycobacterium avium subsp. paratuberculosis
gguaccccagcaa

SEQ ID NO: 2883136 - RNA, 13 nt, Mycobacterium avium subsp. paratuberculosis
gguacccccgccg

SEQ ID NO: 2883137 - RNA, 14 nt, Mycobacterium avium subsp. paratuberculosis
gguacccccgccgg

SEQ ID NO: 2883138 - RNA, 18 nt, Mycobacterium avium subsp. paratuberculosis
gguacccccgccggggcc

SEQ ID NO: 2883139 - RNA, 19 nt, Mycobacterium avium subsp. paratuberculosis
gguacccgauggugaacca

SEQ ID NO: 2883140 - RNA, 19 nt, Mycobacterium avium subsp. paratuberculosis
gguaccgccgaucgugacg

SEQ ID NO: 2883141 - RNA, 14 nt, Mycobacterium avium subsp. paratuberculosis
gguaccgccggcca

SEQ ID NO: 2883142 - RNA, 16 nt, Mycobacterium avium subsp. paratuberculosis
gguaccgccggccagg

SEQ ID NO: 2883143 - RNA, 17 nt, Mycobacterium avium subsp. paratuberculosis
gguaccggcgccaggcc

SEQ ID NO: 2883144 - RNA, 15 nt, Mycobacterium avium subsp. paratuberculosis
gguaccggcgggcga

SEQ ID NO: 2883145 - RNA, 16 nt, Mycobacterium avium subsp. paratuberculosis
gguaccgguugcccgg

SEQ ID NO: 2883146 - RNA, 14 nt, Mycobacterium avium subsp. paratuberculosis
gguaccucugcgcg

SEQ ID NO: 2883147 - RNA, 19 nt, Mycobacterium avium subsp. paratuberculosis
gguacgccgcgagagugca

SEQ ID NO: 2883148 - RNA, 15 nt, Mycobacterium avium subsp. paratuberculosis
gguacgcgacgggca

SEQ ID NO: 2883149 - RNA, 20 nt, Mycobacterium avium subsp. paratuberculosis
gguacgcgacgggcaugccg

SEQ ID NO: 2883150 - RNA, 22 nt, Mycobacterium avium subsp. paratuberculosis
gguacgcgacgggcaugccguc

SEQ ID NO: 2883151 - RNA, 13 nt, Mycobacterium avium subsp. paratuberculosis
gguacgcggcugg

SEQ ID NO: 2883152 - RNA, 19 nt, Mycobacterium avium subsp. paratuberculosis
gguacggccgacgcccagc

SEQ ID NO: 2883153 - RNA, 12 nt, Mycobacterium avium subsp. paratuberculosis
gguacggcggcc

SEQ ID NO: 2883154 - RNA, 16 nt, Mycobacterium avium subsp. paratuberculosis
gguacggcggccgcgg

SEQ ID NO: 2883155 - RNA, 17 nt, Mycobacterium avium subsp. paratuberculosis
gguacggcggccgcgga

SEQ ID NO: 2883156 - RNA, 20 nt, Mycobacterium avium subsp. paratuberculosis
gguacggcucaacggccggc

SEQ ID NO: 2883157 - RNA, 21 nt, Mycobacterium avium subsp. paratuberculosis
gguacggcucguggguggucu

SEQ ID NO: 2883158 - RNA, 16 nt, Mycobacterium avium subsp. paratuberculosis
gguacggucggccgua

SEQ ID NO: 2883159 - RNA, 12 nt, Mycobacterium avium subsp. paratuberculosis
gguacgugcgcc

SEQ ID NO: 2883160 - RNA, 15 nt, Mycobacterium avium subsp. paratuberculosis
gguacuagccuggca

SEQ ID NO: 2883161 - RNA, 18 nt, Mycobacterium avium subsp. paratuberculosis
gguacucggcggcgggca

SEQ ID NO: 2883162 - RNA, 16 nt, Mycobacterium avium subsp. paratuberculosis
gguacugaucaccgcg

SEQ ID NO: 2883163 - RNA, 18 nt, Mycobacterium avium subsp. paratuberculosis
gguacugaucaccgcgcu

SEQ ID NO: 2883164 - RNA, 17 nt, Mycobacterium avium subsp. paratuberculosis
gguagaaccagcccggc

SEQ ID NO: 2883165 - RNA, 16 nt, Mycobacterium avium subsp. paratuberculosis
gguagaagccgcgacg

SEQ ID NO: 2883166 - RNA, 12 nt, Mycobacterium avium subsp. paratuberculosis
gguagacccggg

SEQ ID NO: 2883167 - RNA, 16 nt, Mycobacterium avium subsp. paratuberculosis
gguagacgaucaccgg

SEQ ID NO: 2883168 - RNA, 13 nt, Mycobacterium avium subsp. paratuberculosis
gguagacgccgga

SEQ ID NO: 2883169 - RNA, 15 nt, Mycobacterium avium subsp. paratuberculosis
gguagacgccggacg

SEQ ID NO: 2883170 - RNA, 17 nt, Mycobacterium avium subsp. paratuberculosis
gguagacgucgggcugg

SEQ ID NO: 2883171 - RNA, 23 nt, Mycobacterium avium subsp. paratuberculosis
gguagacguucuccccgccggag

SEQ ID NO: 2883172 - RNA, 15 nt, Mycobacterium avium subsp. paratuberculosis
gguagagcggcacca

SEQ ID NO: 2883173 - RNA, 22 nt, Mycobacterium avium subsp. paratuberculosis
gguagagcggcaccagguucac

SEQ ID NO: 2883174 - RNA, 14 nt, Mycobacterium avium subsp. paratuberculosis
gguagaggccgcgg

SEQ ID NO: 2883175 - RNA, 15 nt, Mycobacterium avium subsp. paratuberculosis
gguagaggccgcgga

SEQ ID NO: 2883176 - RNA, 18 nt, Mycobacterium avium subsp. paratuberculosis
gguagaggcggcgaccgc

SEQ ID NO: 2883177 - RNA, 19 nt, Mycobacterium avium subsp. paratuberculosis
gguagaggcggcgaccgcg

SEQ ID NO: 2883178 - RNA, 22 nt, Mycobacterium avium subsp. paratuberculosis
gguagaggcggcgaccgcgacg

SEQ ID NO: 2883179 - RNA, 13 nt, Mycobacterium avium subsp. paratuberculosis
gguagaggcgggc

SEQ ID NO: 2883180 - RNA, 16 nt, Mycobacterium avium subsp. paratuberculosis
gguagaucagcgccug

SEQ ID NO: 2883181 - RNA, 18 nt, Mycobacterium avium subsp. paratuberculosis
gguagaucgccagcgccc

SEQ ID NO: 2883182 - RNA, 17 nt, Mycobacterium avium subsp. paratuberculosis
gguagaucgccggaucg

SEQ ID NO: 2883183 - RNA, 21 nt, Mycobacterium avium subsp. paratuberculosis
gguagaucgccggaucgagca

SEQ ID NO: 2883184 - RNA, 21 nt, Mycobacterium avium subsp. paratuberculosis
gguagaugguggccgucggcc

SEQ ID NO: 2883185 - RNA, 11 nt, Mycobacterium avium subsp. paratuberculosis
ggucaccagcu

SEQ ID NO: 2883186 - RNA, 12 nt, Mycobacterium avium subsp. paratuberculosis
ggucaccagcuc

SEQ ID NO: 2883187 - RNA, 17 nt, Mycobacterium avium subsp. paratuberculosis
ggucaccagcucgccga

SEQ ID NO: 2883188 - RNA, 15 nt, Mycobacterium avium subsp. paratuberculosis
ggucaccaggucgcg

SEQ ID NO: 2883189 - RNA, 19 nt, Mycobacterium avium subsp. paratuberculosis
ggucaccaucagcaccgcc

SEQ ID NO: 2883190 - RNA, 24 nt, Mycobacterium avium subsp. paratuberculosis
ggucaccaucagcaccgccucggc

SEQ ID NO: 2883191 - RNA, 19 nt, Mycobacterium avium subsp. paratuberculosis
ggucaccaucagcggcucg

SEQ ID NO: 2883192 - RNA, 22 nt, Mycobacterium avium subsp. paratuberculosis
ggucaccaucagcggcucgcgg

SEQ ID NO: 2883193 - RNA, 15 nt, Mycobacterium avium subsp. paratuberculosis
ggucacccacuggcg

SEQ ID NO: 2883194 - RNA, 18 nt, Mycobacterium avium subsp. paratuberculosis
ggucacccacuggcggcc

SEQ ID NO: 2883195 - RNA, 20 nt, Mycobacterium avium subsp. paratuberculosis
ggucacccacuggcggccgg

SEQ ID NO: 2883196 - RNA, 23 nt, Mycobacterium avium subsp. paratuberculosis
ggucaccccgaguucggccagau

SEQ ID NO: 2883197 - RNA, 17 nt, Mycobacterium avium subsp. paratuberculosis
gggcgcgaucggcaggu

SEQ ID NO: 2883198 - RNA, 22 nt, Mycobacterium avium subsp. paratuberculosis
gggcgcgcacccccuucuccac

SEQ ID NO: 2883199 - RNA, 18 nt, Mycobacterium avium subsp. paratuberculosis
gggcgcgcagaucgucga

SEQ ID NO: 2883200 - RNA, 12 nt, Mycobacterium avium subsp. paratuberculosis
gggcgcgcagcc

SEQ ID NO: 2883201 - RNA, 15 nt, Mycobacterium avium subsp. paratuberculosis
gggcgcgcagccacg

SEQ ID NO: 2883202 - RNA, 17 nt, Mycobacterium avium subsp. paratuberculosis
gggcgcgcaucugcucg

SEQ ID NO: 2883203 - RNA, 21 nt, Mycobacterium avium subsp. paratuberculosis
gggcgcgcaucugcucggcgu

SEQ ID NO: 2883204 - RNA, 23 nt, Mycobacterium avium subsp. paratuberculosis
gggcgcgcccacccgcgccggca

SEQ ID NO: 2883205 - RNA, 14 nt, Mycobacterium avium subsp. paratuberculosis
gggcgcgccggcgc

SEQ ID NO: 2883206 - RNA, 17 nt, Mycobacterium avium subsp. paratuberculosis
gggcgcgccggcgcgca

SEQ ID NO: 2883207 - RNA, 20 nt, Mycobacterium avium subsp. paratuberculosis
gggcgcgccggcgcgcagcc

SEQ ID NO: 2883208 - RNA, 13 nt, Mycobacterium avium subsp. paratuberculosis
gggcgcgcgccgc

SEQ ID NO: 2883209 - RNA, 13 nt, Mycobacterium avium subsp. paratuberculosis
gggcgcgcgcgcc

SEQ ID NO: 2883210 - RNA, 14 nt, Mycobacterium avium subsp. paratuberculosis
gggcgcggaccgca

SEQ ID NO: 2883211 - RNA, 13 nt, Mycobacterium avium subsp. paratuberculosis
gggcgcggccagc

SEQ ID NO: 2883212 - RNA, 14 nt, Mycobacterium avium subsp. paratuberculosis
gggcgcggcgcacc

SEQ ID NO: 2883213 - RNA, 15 nt, Mycobacterium avium subsp. paratuberculosis
gggcgcggcgcaccg

SEQ ID NO: 2883214 - RNA, 17 nt, Mycobacterium avium subsp. paratuberculosis
gggcgcggcgcaccgag

SEQ ID NO: 2883215 - RNA, 13 nt, Mycobacterium avium subsp. paratuberculosis
gggcgcggcggca

SEQ ID NO: 2883216 - RNA, 15 nt, Mycobacterium avium subsp. paratuberculosis
gggcgcggcguagcc

SEQ ID NO: 2883217 - RNA, 13 nt, Mycobacterium avium subsp. paratuberculosis
gggcgcgggccgc

SEQ ID NO: 2883218 - RNA, 15 nt, Mycobacterium avium subsp. paratuberculosis
gggcgcgggccgcgu

SEQ ID NO: 2883219 - RNA, 16 nt, Mycobacterium avium subsp. paratuberculosis
gggcgcgggccgcguc

SEQ ID NO: 2883220 - RNA, 12 nt, Mycobacterium avium subsp. paratuberculosis
gggcgcgggcgg

SEQ ID NO: 2883221 - RNA, 14 nt, Mycobacterium avium subsp. paratuberculosis
gggcgcguccgcgg

SEQ ID NO: 2883222 - RNA, 17 nt, Mycobacterium avium subsp. paratuberculosis
gggcgcguccgcgggcg

SEQ ID NO: 2883223 - RNA, 20 nt, Mycobacterium avium subsp. paratuberculosis
gggcgcguccgcgggcgggg

SEQ ID NO: 2883224 - RNA, 21 nt, Mycobacterium avium subsp. paratuberculosis
gggcgcguccgcgggcggggc

SEQ ID NO: 2883225 - RNA, 23 nt, Mycobacterium avium subsp. paratuberculosis
gggcgcguccgcgggcggggccu

SEQ ID NO: 2883226 - RNA, 22 nt, Mycobacterium avium subsp. paratuberculosis
gggcgcgucguagccggcacgc

SEQ ID NO: 2883227 - RNA, 20 nt, Mycobacterium avium subsp. paratuberculosis
gggcgcgugcacaccggccu

SEQ ID NO: 2883228 - RNA, 21 nt, Mycobacterium avium subsp. paratuberculosis
gggcgcucaucaggcggccgg

SEQ ID NO: 2883229 - RNA, 23 nt, Mycobacterium avium subsp. paratuberculosis
gggcgcucuucgggcugcgcuug

SEQ ID NO: 2883230 - RNA, 18 nt, Mycobacterium avium subsp. paratuberculosis
gggcgcugagcacggugg

SEQ ID NO: 2883231 - RNA, 22 nt, Mycobacterium avium subsp. paratuberculosis
gggcgcugccguccuucucgaa

SEQ ID NO: 2883232 - RNA, 12 nt, Mycobacterium avium subsp. paratuberculosis
gggcgcugcgcg

SEQ ID NO: 2883233 - RNA, 15 nt, Mycobacterium avium subsp. paratuberculosis
gggcggaagucggug

SEQ ID NO: 2883234 - RNA, 21 nt, Mycobacterium avium subsp. paratuberculosis
gggcggaagucggugcccuug

SEQ ID NO: 2883235 - RNA, 14 nt, Mycobacterium avium subsp. paratuberculosis
gggcggacggcacc

SEQ ID NO: 2883236 - RNA, 15 nt, Mycobacterium avium subsp. paratuberculosis
gggcggacggcaccg

SEQ ID NO: 2883237 - RNA, 21 nt, Mycobacterium avium subsp. paratuberculosis
gggcggacgggaccacccgca

SEQ ID NO: 2883238 - RNA, 16 nt, Mycobacterium avium subsp. paratuberculosis
gggcggacugcccgac

SEQ ID NO: 2883239 - RNA, 23 nt, Mycobacterium avium subsp. paratuberculosis
gggcggacugcccgaccgcgccg

SEQ ID NO: 2883240 - RNA, 15 nt, Mycobacterium avium subsp. paratuberculosis
gggcggaugugccug

SEQ ID NO: 2883241 - RNA, 21 nt, Mycobacterium avium subsp. paratuberculosis
gggcggaugugccuggcccag

SEQ ID NO: 2883242 - RNA, 13 nt, Mycobacterium avium subsp. paratuberculosis
gggcggcaccgau

SEQ ID NO: 2883243 - RNA, 13 nt, Mycobacterium avium subsp. paratuberculosis
gggcggcaccgcu

SEQ ID NO: 2883244 - RNA, 18 nt, Mycobacterium avium subsp. paratuberculosis
gggcggcaccgcugccgg

SEQ ID NO: 2883245 - RNA, 22 nt, Mycobacterium avium subsp. paratuberculosis
gggcggcagcagcugcgucggc

SEQ ID NO: 2883246 - RNA, 16 nt, Mycobacterium avium subsp. paratuberculosis
gggcggcagggccagc

SEQ ID NO: 2883247 - RNA, 13 nt, Mycobacterium avium subsp. paratuberculosis
gggcggcaucgcg

SEQ ID NO: 2883248 - RNA, 18 nt, Mycobacterium avium subsp. paratuberculosis
gggcggcaucgcgccgca

SEQ ID NO: 2883249 - RNA, 17 nt, Mycobacterium avium subsp. paratuberculosis
gggcggccaccaacggc

SEQ ID NO: 2883250 - RNA, 21 nt, Mycobacterium avium subsp. paratuberculosis
gggcggccaccaacggcagca

SEQ ID NO: 2883251 - RNA, 13 nt, Mycobacterium avium subsp. paratuberculosis
gggcggccaccgc

SEQ ID NO: 2883252 - RNA, 11 nt, Mycobacterium avium subsp. paratuberculosis
gggcggccagc

SEQ ID NO: 2883253 - RNA, 13 nt, Mycobacterium avium subsp. paratuberculosis
gggcggccagccg

SEQ ID NO: 2883254 - RNA, 18 nt, Mycobacterium avium subsp. paratuberculosis
gggcggccagccgcgcgg

SEQ ID NO: 2883255 - RNA, 20 nt, Mycobacterium avium subsp. paratuberculosis
gggcggccagccgcgcggcg

SEQ ID NO: 2883256 - RNA, 13 nt, Mycobacterium avium subsp. paratuberculosis
gggcggccagcgu

SEQ ID NO: 2883257 - RNA, 21 nt, Mycobacterium avium subsp. paratuberculosis
gggcggccagcguggcgcgcc

SEQ ID NO: 2883258 - RNA, 14 nt, Mycobacterium avium subsp. paratuberculosis
gggcggcccgcauc

SEQ ID NO: 2883259 - RNA, 21 nt, Mycobacterium avium subsp. paratuberculosis
gggcggcccgccucggcggcc

SEQ ID NO: 2883260 - RNA, 13 nt, Mycobacterium avium subsp. paratuberculosis
gggcggcccgggu

SEQ ID NO: 2883261 - RNA, 21 nt, Mycobacterium avium subsp. paratuberculosis
gggcggccgccgggccggcgg

SEQ ID NO: 2883262 - RNA, 23 nt, Mycobacterium avium subsp. paratuberculosis
gggcggccgccgggccggcggcc

SEQ ID NO: 2883263 - RNA, 14 nt, Mycobacterium avium subsp. paratuberculosis
gggcggccggccag

SEQ ID NO: 2883264 - RNA, 15 nt, Mycobacterium avium subsp. paratuberculosis
gggcggccggccagu

SEQ ID NO: 2883265 - RNA, 13 nt, Mycobacterium avium subsp. paratuberculosis
gggcggccgggcc

SEQ ID NO: 2883266 - RNA, 15 nt, Mycobacterium avium subsp. paratuberculosis
gggcggccgggccgc

SEQ ID NO: 2883267 - RNA, 15 nt, Mycobacterium avium subsp. paratuberculosis
gggcggccucggcgu

SEQ ID NO: 2883268 - RNA, 17 nt, Mycobacterium avium subsp. paratuberculosis
gggcggccugcacccag

SEQ ID NO: 2883269 - RNA, 18 nt, Mycobacterium avium subsp. paratuberculosis
gggcggcgaacaccagca

SEQ ID NO: 2883270 - RNA, 19 nt, Mycobacterium avium subsp. paratuberculosis
gggcggcgaacaccagcac

SEQ ID NO: 2883271 - RNA, 21 nt, Mycobacterium avium subsp. paratuberculosis
gggcggcgaacaccagcaccc

SEQ ID NO: 2883272 - RNA, 20 nt, Mycobacterium avium subsp. paratuberculosis
gggcggcgccgaacucggcg

SEQ ID NO: 2883273 - RNA, 19 nt, Mycobacterium avium subsp. paratuberculosis
gggcggcgccgcggcccug

SEQ ID NO: 2883274 - RNA, 14 nt, Mycobacterium avium subsp. paratuberculosis
gggcggcgccggca

SEQ ID NO: 2883275 - RNA, 23 nt, Mycobacterium avium subsp. paratuberculosis
gggcggcgcgaucgucgaccacc

SEQ ID NO: 2883276 - RNA, 18 nt, Mycobacterium avium subsp. paratuberculosis
gggcggcgcgcgccagcg

SEQ ID NO: 2883277 - RNA, 18 nt, Mycobacterium avium subsp. paratuberculosis
gggcggcgcgcugcggcg

SEQ ID NO: 2883278 - RNA, 15 nt, Mycobacterium avium subsp. paratuberculosis
gggcggcgcggcgca

SEQ ID NO: 2883279 - RNA, 17 nt, Mycobacterium avium subsp. paratuberculosis
gggcggcgcggcgcagc

SEQ ID NO: 2883280 - RNA, 18 nt, Mycobacterium avium subsp. paratuberculosis
gggcggcgcggcgcagcg

SEQ ID NO: 2883281 - RNA, 12 nt, Mycobacterium avium subsp. paratuberculosis
gggcggcggcca

SEQ ID NO: 2883282 - RNA, 13 nt, Mycobacterium avium subsp. paratuberculosis
gggcggcggccac

SEQ ID NO: 2883283 - RNA, 14 nt, Mycobacterium avium subsp. paratuberculosis
gggcggcgggacgg

SEQ ID NO: 2883284 - RNA, 16 nt, Mycobacterium avium subsp. paratuberculosis
gggcggcgggcccggc

SEQ ID NO: 2883285 - RNA, 15 nt, Mycobacterium avium subsp. paratuberculosis
gggcggcgggcgaag

SEQ ID NO: 2883286 - RNA, 13 nt, Mycobacterium avium subsp. paratuberculosis
gggcggcgguacc

SEQ ID NO: 2883287 - RNA, 18 nt, Mycobacterium avium subsp. paratuberculosis
gggcggcguccucgacca

SEQ ID NO: 2883288 - RNA, 17 nt, Mycobacterium avium subsp. paratuberculosis
gggcggcgucggcgacg

SEQ ID NO: 2883289 - RNA, 14 nt, Mycobacterium avium subsp. paratuberculosis
gggcgggcacccgg

SEQ ID NO: 2883290 - RNA, 15 nt, Mycobacterium avium subsp. paratuberculosis
gggcgggcagcacca

SEQ ID NO: 2883291 - RNA, 13 nt, Mycobacterium avium subsp. paratuberculosis
gggcgggccccac

SEQ ID NO: 2883292 - RNA, 12 nt, Mycobacterium avium subsp. paratuberculosis
gggcgggccgca

SEQ ID NO: 2883293 - RNA, 13 nt, Mycobacterium avium subsp. paratuberculosis
gggcgggccgcag

SEQ ID NO: 2883294 - RNA, 15 nt, Mycobacterium avium subsp. paratuberculosis
gggcgggccgcagca

SEQ ID NO: 2883295 - RNA, 12 nt, Mycobacterium avium subsp. paratuberculosis
gggcgggcucga

SEQ ID NO: 2883296 - RNA, 14 nt, Mycobacterium avium subsp. paratuberculosis
gggcgggcugcggg

SEQ ID NO: 2883297 - RNA, 13 nt, Mycobacterium avium subsp. paratuberculosis
gggcggggcagca

SEQ ID NO: 2883298 - RNA, 16 nt, Mycobacterium avium subsp. paratuberculosis
gggcggggggcgagcc

SEQ ID NO: 2883299 - RNA, 13 nt, Mycobacterium avium subsp. paratuberculosis
gggcgggguggcc

SEQ ID NO: 2883300 - RNA, 19 nt, Mycobacterium avium subsp. paratuberculosis
gggcggggugugcggcacg

SEQ ID NO: 2883301 - RNA, 14 nt, Mycobacterium avium subsp. paratuberculosis
gggcgggucgucga

SEQ ID NO: 2883302 - RNA, 12 nt, Mycobacterium avium subsp. paratuberculosis
gggcggguggau

SEQ ID NO: 2883303 - RNA, 19 nt, Mycobacterium avium subsp. paratuberculosis
gggcgguccaccgacgcca

SEQ ID NO: 2883304 - RNA, 16 nt, Mycobacterium avium subsp. paratuberculosis
gggcgguccgcuccac

SEQ ID NO: 2883305 - RNA, 15 nt, Mycobacterium avium subsp. paratuberculosis
gggcggucgcgcagc

SEQ ID NO: 2883306 - RNA, 19 nt, Mycobacterium avium subsp. paratuberculosis
gggcggucgcgcagccgcc

SEQ ID NO: 2883307 - RNA, 20 nt, Mycobacterium avium subsp. paratuberculosis
gggcggucgcgucgucggcg

SEQ ID NO: 2883308 - RNA, 14 nt, Mycobacterium avium subsp. paratuberculosis
gggcggugaccacg

SEQ ID NO: 2883309 - RNA, 13 nt, Mycobacterium avium subsp. paratuberculosis
gggcggugcagcc

SEQ ID NO: 2883310 - RNA, 15 nt, Mycobacterium avium subsp. paratuberculosis
gggcggugcgcaguc

SEQ ID NO: 2883311 - RNA, 23 nt, Mycobacterium avium subsp. paratuberculosis
gggcgguugccugguucgacgug

SEQ ID NO: 2883312 - RNA, 17 nt, Mycobacterium avium subsp. paratuberculosis
gggcguacagcggcgcc

SEQ ID NO: 2883313 - RNA, 16 nt, Mycobacterium avium subsp. paratuberculosis
gggcguacgcgcugcc

SEQ ID NO: 2883314 - RNA, 19 nt, Mycobacterium avium subsp. paratuberculosis
gggcguacugcucggcgcg

SEQ ID NO: 2883315 - RNA, 22 nt, Mycobacterium avium subsp. paratuberculosis
gggcguacugcucggcgcggcu

SEQ ID NO: 2883316 - RNA, 21 nt, Mycobacterium avium subsp. paratuberculosis
gggcguagugcagcugcagcg

SEQ ID NO: 2883317 - RNA, 16 nt, Mycobacterium avium subsp. paratuberculosis
gggcgucacgccagcg

SEQ ID NO: 2883318 - RNA, 17 nt, Mycobacterium avium subsp. paratuberculosis
gggcgucacgccagcgu

SEQ ID NO: 2883319 - RNA, 19 nt, Mycobacterium avium subsp. paratuberculosis
gggcgucacgccagcguga

SEQ ID NO: 2883320 - RNA, 19 nt, Mycobacterium avium subsp. paratuberculosis
gggcgucacucuggcguga

SEQ ID NO: 2883321 - RNA, 22 nt, Mycobacterium avium subsp. paratuberculosis
gggcgucaggcgcugggugcgg

SEQ ID NO: 2883322 - RNA, 14 nt, Mycobacterium avium subsp. paratuberculosis
gggcguccagcgag

SEQ ID NO: 2883323 - RNA, 23 nt, Mycobacterium avium subsp. paratuberculosis
gggcguccgagaagggccgccgc

SEQ ID NO: 2883324 - RNA, 15 nt, Mycobacterium avium subsp. paratuberculosis
gggcguccucgucgg

SEQ ID NO: 2883325 - RNA, 14 nt, Mycobacterium avium subsp. paratuberculosis
gggcguccugcggg

SEQ ID NO: 2883326 - RNA, 13 nt, Mycobacterium avium subsp. paratuberculosis
gggcgucgcccgc

SEQ ID NO: 2883327 - RNA, 15 nt, Mycobacterium avium subsp. paratuberculosis
gggcgucgcccgccg

SEQ ID NO: 2883328 - RNA, 21 nt, Mycobacterium avium subsp. paratuberculosis
gggcgucggacaugccggcgc

SEQ ID NO: 2883329 - RNA, 13 nt, Mycobacterium avium subsp. paratuberculosis
gggcgucggcgcc

SEQ ID NO: 2883330 - RNA, 13 nt, Mycobacterium avium subsp. paratuberculosis
gggcgucggcggu

SEQ ID NO: 2883331 - RNA, 14 nt, Mycobacterium avium subsp. paratuberculosis
gggcgucggcggug

SEQ ID NO: 2883332 - RNA, 18 nt, Mycobacterium avium subsp. paratuberculosis
gggcgucggcgguggucc

SEQ ID NO: 2883333 - RNA, 17 nt, Mycobacterium avium subsp. paratuberculosis
gggcgucggggcccucc

SEQ ID NO: 2883334 - RNA, 17 nt, Mycobacterium avium subsp. paratuberculosis
gggcgucgucggccggc

SEQ ID NO: 2883335 - RNA, 12 nt, Mycobacterium avium subsp. paratuberculosis
gggcgugacgcc

SEQ ID NO: 2883336 - RNA, 14 nt, Mycobacterium avium subsp. paratuberculosis
gggcgugacgccgc

SEQ ID NO: 2883337 - RNA, 17 nt, Mycobacterium avium subsp. paratuberculosis
gggcgugaucuguucgg

SEQ ID NO: 2883338 - RNA, 17 nt, Mycobacterium avium subsp. paratuberculosis
gggcgugcaggccgcgg

SEQ ID NO: 2883339 - RNA, 14 nt, Mycobacterium avium subsp. paratuberculosis
gggcgugcccggcg

SEQ ID NO: 2883340 - RNA, 15 nt, Mycobacterium avium subsp. paratuberculosis
gggcgugcccggcgc

SEQ ID NO: 2883341 - RNA, 19 nt, Mycobacterium avium subsp. paratuberculosis
gggcgugcccggcgcacag

SEQ ID NO: 2883342 - RNA, 14 nt, Mycobacterium avium subsp. paratuberculosis
gggcgugccgaacg

SEQ ID NO: 2883343 - RNA, 12 nt, Mycobacterium avium subsp. paratuberculosis
gggcgugccgga

SEQ ID NO: 2883344 - RNA, 21 nt, Mycobacterium avium subsp. paratuberculosis
gggcgugccggacaccggcac

SEQ ID NO: 2883345 - RNA, 12 nt, Mycobacterium avium subsp. paratuberculosis
gggcgugccggc

SEQ ID NO: 2883346 - RNA, 16 nt, Mycobacterium avium subsp. paratuberculosis
gggcgugccggcccgg

SEQ ID NO: 2883347 - RNA, 14 nt, Mycobacterium avium subsp. paratuberculosis
gggcgugccggcgg

SEQ ID NO: 2883348 - RNA, 15 nt, Mycobacterium avium subsp. paratuberculosis
gggcgugccggcggc

SEQ ID NO: 2883349 - RNA, 18 nt, Mycobacterium avium subsp. paratuberculosis
gggcgugccggcggcgga

SEQ ID NO: 2883350 - RNA, 16 nt, Mycobacterium avium subsp. paratuberculosis
gggcgugcgcggccgc

SEQ ID NO: 2883351 - RNA, 19 nt, Mycobacterium avium subsp. paratuberculosis
gggcgugcgcggccgccca

SEQ ID NO: 2883352 - RNA, 12 nt, Mycobacterium avium subsp. paratuberculosis
gggcgugcgcgu

SEQ ID NO: 2883353 - RNA, 21 nt, Mycobacterium avium subsp. paratuberculosis
gggcguggaacgcgucgcgcc

SEQ ID NO: 2883354 - RNA, 23 nt, Mycobacterium avium subsp. paratuberculosis
gggcguggaacgcgucgcgccag

SEQ ID NO: 2883355 - RNA, 15 nt, Mycobacterium avium subsp. paratuberculosis
gggcguggcgucggu

SEQ ID NO: 2883356 - RNA, 16 nt, Mycobacterium avium subsp. paratuberculosis
gggcguggcgucggug

SEQ ID NO: 2883357 - RNA, 20 nt, Mycobacterium avium subsp. paratuberculosis
gggcguggucgccguuggcg

SEQ ID NO: 2883358 - RNA, 18 nt, Mycobacterium avium subsp. paratuberculosis
gggcguguagccugcggc

SEQ ID NO: 2883359 - RNA, 20 nt, Mycobacterium avium subsp. paratuberculosis
gggcguguagccugcggccu

SEQ ID NO: 2883360 - RNA, 23 nt, Mycobacterium avium subsp. paratuberculosis
gggcguguagccugcggccugca

SEQ ID NO: 2883361 - RNA, 17 nt, Mycobacterium avium subsp. paratuberculosis
gggcguguugcaggcgg

SEQ ID NO: 2883362 - RNA, 23 nt, Mycobacterium avium subsp. paratuberculosis
gggcguucaucaccuggucgggu

SEQ ID NO: 2883363 - RNA, 23 nt, Mycobacterium avium subsp. paratuberculosis
gggcguucgcggugggcucgucg

SEQ ID NO: 2883364 - RNA, 15 nt, Mycobacterium avium subsp. paratuberculosis
gggcguugcccgccg

SEQ ID NO: 2883365 - RNA, 20 nt, Mycobacterium avium subsp. paratuberculosis
gggcguugcccgccgcggcg

SEQ ID NO: 2883366 - RNA, 20 nt, Mycobacterium avium subsp. paratuberculosis
gggcguugcccgucgccucc

SEQ ID NO: 2883367 - RNA, 13 nt, Mycobacterium avium subsp. paratuberculosis
gggcguugccggu

SEQ ID NO: 2883368 - RNA, 18 nt, Mycobacterium avium subsp. paratuberculosis
gggcguugccggucucga

SEQ ID NO: 2883369 - RNA, 15 nt, Mycobacterium avium subsp. paratuberculosis
gggcuagacgcgcac

SEQ ID NO: 2883370 - RNA, 18 nt, Mycobacterium avium subsp. paratuberculosis
gggcuagacgcgcaccag

SEQ ID NO: 2883371 - RNA, 21 nt, Mycobacterium avium subsp. paratuberculosis
gggcuagacgcgcaccagggc

SEQ ID NO: 2883372 - RNA, 22 nt, Mycobacterium avium subsp. paratuberculosis
gggcuaggcucggcagccggcu

SEQ ID NO: 2883373 - RNA, 16 nt, Mycobacterium avium subsp. paratuberculosis
gggcuaucgcccggcg

SEQ ID NO: 2883374 - RNA, 20 nt, Mycobacterium avium subsp. paratuberculosis
gggcuaucgcccggcgcccg

SEQ ID NO: 2883375 - RNA, 17 nt, Mycobacterium avium subsp. paratuberculosis
gggcucaacaggcgagu

SEQ ID NO: 2883376 - RNA, 21 nt, Mycobacterium avium subsp. paratuberculosis
gggcucacuuuugacaggugg

SEQ ID NO: 2883377 - RNA, 20 nt, Mycobacterium avium subsp. paratuberculosis
gggcucagccgaagccggcg

SEQ ID NO: 2883378 - RNA, 23 nt, Mycobacterium avium subsp. paratuberculosis
gggcucagccgaagccggcgcag

SEQ ID NO: 2883379 - RNA, 20 nt, Mycobacterium avium subsp. paratuberculosis
gggcucauacggcggcucgg

SEQ ID NO: 2883380 - RNA, 18 nt, Mycobacterium avium subsp. paratuberculosis
gggcucccagucccagca

SEQ ID NO: 2883381 - RNA, 23 nt, Mycobacterium avium subsp. paratuberculosis
gggcucccagucccagcacagcc

SEQ ID NO: 2883382 - RNA, 19 nt, Mycobacterium avium subsp. paratuberculosis
gggcucccgcuccauggcg

SEQ ID NO: 2883383 - RNA, 17 nt, Mycobacterium avium subsp. paratuberculosis
gggcuccucgaccacgc

SEQ ID NO: 2883384 - RNA, 22 nt, Mycobacterium avium subsp. paratuberculosis
gggcucgaacaacccggccgcg

SEQ ID NO: 2883385 - RNA, 20 nt, Mycobacterium avium subsp. paratuberculosis
gggcucgacaggcagcccgg

SEQ ID NO: 2883386 - RNA, 13 nt, Mycobacterium avium subsp. paratuberculosis
gggcucgaccacg

SEQ ID NO: 2883387 - RNA, 12 nt, Mycobacterium avium subsp. paratuberculosis
gggcucgagcaa

SEQ ID NO: 2883388 - RNA, 15 nt, Mycobacterium avium subsp. paratuberculosis
gggcucgagcaacac

SEQ ID NO: 2883389 - RNA, 14 nt, Mycobacterium avium subsp. paratuberculosis
gggcucgagcaccg

SEQ ID NO: 2883390 - RNA, 15 nt, Mycobacterium avium subsp. paratuberculosis
gggcucgagggcggc

SEQ ID NO: 2883391 - RNA, 16 nt, Mycobacterium avium subsp. paratuberculosis
gggcucgagggcggcg

SEQ ID NO: 2883392 - RNA, 19 nt, Mycobacterium avium subsp. paratuberculosis
gggcucgagugccggcagc

SEQ ID NO: 2883393 - RNA, 20 nt, Mycobacterium avium subsp. paratuberculosis
gggcucgagugccggcagcc

SEQ ID NO: 2883394 - RNA, 20 nt, Mycobacterium avium subsp. paratuberculosis
gggcucgaguuuggccagcu

SEQ ID NO: 2883395 - RNA, 19 nt, Mycobacterium avium subsp. paratuberculosis
gggcucgauguugaucgcc

SEQ ID NO: 2883396 - RNA, 20 nt, Mycobacterium avium subsp. paratuberculosis
gggcucgauguugaucgcca

SEQ ID NO: 2883397 - RNA, 23 nt, Mycobacterium avium subsp. paratuberculosis
gggcucgauguugaucgccaugc

SEQ ID NO: 2883398 - RNA, 21 nt, Mycobacterium avium subsp. paratuberculosis
gggcucgcccgggcuaucgcc

SEQ ID NO: 2883399 - RNA, 16 nt, Mycobacterium avium subsp. paratuberculosis
gggcucgccggcccga

SEQ ID NO: 2883400 - RNA, 13 nt, Mycobacterium avium subsp. paratuberculosis
gggcucgcgcacc

SEQ ID NO: 2883401 - RNA, 17 nt, Mycobacterium avium subsp. paratuberculosis
gggcucgcgcuggcggc

SEQ ID NO: 2883402 - RNA, 13 nt, Mycobacterium avium subsp. paratuberculosis
gggcucgcgggug

SEQ ID NO: 2883403 - RNA, 22 nt, Mycobacterium avium subsp. paratuberculosis
gggcucgcgggugucgagccac

SEQ ID NO: 2883404 - RNA, 18 nt, Mycobacterium avium subsp. paratuberculosis
gggcucggaguugcgcag

SEQ ID NO: 2883405 - RNA, 20 nt, Mycobacterium avium subsp. paratuberculosis
gggcucggaguugcgcagcc

SEQ ID NO: 2883406 - RNA, 20 nt, Mycobacterium avium subsp. paratuberculosis
gggcucggccaucccggugc

SEQ ID NO: 2883407 - RNA, 21 nt, Mycobacterium avium subsp. paratuberculosis
gggcucggccgccgacaccac

SEQ ID NO: 2883408 - RNA, 13 nt, Mycobacterium avium subsp. paratuberculosis
gggcucggcgccg

SEQ ID NO: 2883409 - RNA, 19 nt, Mycobacterium avium subsp. paratuberculosis
gggcucggcgccgaccucg

SEQ ID NO: 2883410 - RNA, 16 nt, Mycobacterium avium subsp. paratuberculosis
gggcucgucgugaugg

SEQ ID NO: 2883411 - RNA, 18 nt, Mycobacterium avium subsp. paratuberculosis
gggcucgucguugcgcag

SEQ ID NO: 2883412 - RNA, 22 nt, Mycobacterium avium subsp. paratuberculosis
gggcugaagaucaacagccgcc

SEQ ID NO: 2883413 - RNA, 18 nt, Mycobacterium avium subsp. paratuberculosis
gggcugacccggaugauc

SEQ ID NO: 2883414 - RNA, 13 nt, Mycobacterium avium subsp. paratuberculosis
gggcugaccgcca

SEQ ID NO: 2883415 - RNA, 16 nt, Mycobacterium avium subsp. paratuberculosis
gggcugaccgccagga

SEQ ID NO: 2883416 - RNA, 13 nt, Mycobacterium avium subsp. paratuberculosis
gggcugaccgucg

SEQ ID NO: 2883417 - RNA, 14 nt, Mycobacterium avium subsp. paratuberculosis
gggcugaccgucga

SEQ ID NO: 2883418 - RNA, 17 nt, Mycobacterium avium subsp. paratuberculosis
gggcugaccgucgacca

SEQ ID NO: 2883419 - RNA, 12 nt, Mycobacterium avium subsp. paratuberculosis
gggcugaccucg

SEQ ID NO: 2883420 - RNA, 15 nt, Mycobacterium avium subsp. paratuberculosis
gggcugaccucgccg

SEQ ID NO: 2883421 - RNA, 17 nt, Mycobacterium avium subsp. paratuberculosis
gggcugaccucgccgcc

SEQ ID NO: 2883422 - RNA, 18 nt, Mycobacterium avium subsp. paratuberculosis
gggcugaccucgccgccc

SEQ ID NO: 2883423 - RNA, 20 nt, Mycobacterium avium subsp. paratuberculosis
gggcugagcugugccgcggu

SEQ ID NO: 2883424 - RNA, 18 nt, Mycobacterium avium subsp. paratuberculosis
gggcugaguucggugaac

SEQ ID NO: 2883425 - RNA, 21 nt, Mycobacterium avium subsp. paratuberculosis
gggcugauccgcgacgccaac

SEQ ID NO: 2883426 - RNA, 22 nt, Mycobacterium avium subsp. paratuberculosis
gggcugauccgcgacgccaaca

SEQ ID NO: 2883427 - RNA, 21 nt, Mycobacterium avium subsp. paratuberculosis
gggcugcaacaacuucggggu

SEQ ID NO: 2883428 - RNA, 13 nt, Mycobacterium avium subsp. paratuberculosis
gggcugcaucucc

SEQ ID NO: 2883429 - RNA, 19 nt, Mycobacterium avium subsp. paratuberculosis
gggcugcaucuccagccgc

SEQ ID NO: 2883430 - RNA, 22 nt, Mycobacterium avium subsp. paratuberculosis
gggcugcaucuccagccgcggc

SEQ ID NO: 2883431 - RNA, 14 nt, Mycobacterium avium subsp. paratuberculosis
gggcugcccaccac

SEQ ID NO: 2883432 - RNA, 16 nt, Mycobacterium avium subsp. paratuberculosis
gggcugcccaccacca

SEQ ID NO: 2883433 - RNA, 18 nt, Mycobacterium avium subsp. paratuberculosis
gggcugcccaccaccagg

SEQ ID NO: 2883434 - RNA, 13 nt, Mycobacterium avium subsp. paratuberculosis
gggcugcgcagca

SEQ ID NO: 2883435 - RNA, 16 nt, Mycobacterium avium subsp. paratuberculosis
gggcugcgcagcaccg

SEQ ID NO: 2883436 - RNA, 19 nt, Mycobacterium avium subsp. paratuberculosis
gggcugcgcuugcggcgca

SEQ ID NO: 2883437 - RNA, 12 nt, Mycobacterium avium subsp. paratuberculosis
gggcugcgggcc

SEQ ID NO: 2883438 - RNA, 17 nt, Mycobacterium avium subsp. paratuberculosis
gggcugcgggccaggcg

SEQ ID NO: 2883439 - RNA, 17 nt, Mycobacterium avium subsp. paratuberculosis
gggcugcgguuccgggc

SEQ ID NO: 2883440 - RNA, 23 nt, Mycobacterium avium subsp. paratuberculosis
gggcuggaguggucaggcccagg

SEQ ID NO: 2883441 - RNA, 19 nt, Mycobacterium avium subsp. paratuberculosis
gggcuggccgcacggugca

SEQ ID NO: 2883442 - RNA, 18 nt, Mycobacterium avium subsp. paratuberculosis
gggcuggcgcuggaucug

SEQ ID NO: 2883443 - RNA, 12 nt, Mycobacterium avium subsp. paratuberculosis
gggcuggcggcg

SEQ ID NO: 2883444 - RNA, 13 nt, Mycobacterium avium subsp. paratuberculosis
gggcuggcggcga

SEQ ID NO: 2883445 - RNA, 16 nt, Mycobacterium avium subsp. paratuberculosis
gggcuggugcgcagcc

SEQ ID NO: 2883446 - RNA, 17 nt, Mycobacterium avium subsp. paratuberculosis
gggcuggugcgcagccg

SEQ ID NO: 2883447 - RNA, 16 nt, Mycobacterium avium subsp. paratuberculosis
gggcugucccggccgc

SEQ ID NO: 2883448 - RNA, 17 nt, Mycobacterium avium subsp. paratuberculosis
gggcugucccggccgcg

SEQ ID NO: 2883449 - RNA, 18 nt, Mycobacterium avium subsp. paratuberculosis
gggcugucccggccgcga

SEQ ID NO: 2883450 - RNA, 23 nt, Mycobacterium avium subsp. paratuberculosis
gggcugucccggccgcgacagcc

SEQ ID NO: 2883451 - RNA, 17 nt, Mycobacterium avium subsp. paratuberculosis
gggcuguccucccagcg

SEQ ID NO: 2883452 - RNA, 16 nt, Mycobacterium avium subsp. paratuberculosis
gggcugucgggcaggc

SEQ ID NO: 2883453 - RNA, 17 nt, Mycobacterium avium subsp. paratuberculosis
gggcugugccggcgggu

SEQ ID NO: 2883454 - RNA, 21 nt, Mycobacterium avium subsp. paratuberculosis
gggcugugggcgcagggccgc

SEQ ID NO: 2883455 - RNA, 18 nt, Mycobacterium avium subsp. paratuberculosis
gggcuguugaccacggcc

SEQ ID NO: 2883456 - RNA, 22 nt, Mycobacterium avium subsp. paratuberculosis
gggcuguugaccacggccuggu

SEQ ID NO: 2883457 - RNA, 14 nt, Mycobacterium avium subsp. paratuberculosis
gggcuucccacgcc

SEQ ID NO: 2883458 - RNA, 14 nt, Mycobacterium avium subsp. paratuberculosis
gggcuucgaacgcc

SEQ ID NO: 2883459 - RNA, 18 nt, Mycobacterium avium subsp. paratuberculosis
gggcuugcgcaacagcgu

SEQ ID NO: 2883460 - RNA, 21 nt, Mycobacterium avium subsp. paratuberculosis
gggcuugcgcaacagcgugca

SEQ ID NO: 2883461 - RNA, 14 nt, Mycobacterium avium subsp. paratuberculosis
gggcuuggcgacga

SEQ ID NO: 2883462 - RNA, 19 nt, Mycobacterium avium subsp. paratuberculosis
gggcuugggcccgucggcg

SEQ ID NO: 2883463 - RNA, 22 nt, Mycobacterium avium subsp. paratuberculosis
gggcuugggcgcgaucggcagg

SEQ ID NO: 2883464 - RNA, 19 nt, Mycobacterium avium subsp. paratuberculosis
gggcuuuagaaggccgccu

SEQ ID NO: 2883465 - RNA, 20 nt, Mycobacterium avium subsp. paratuberculosis
gggcuuuagaaggccgccuc

SEQ ID NO: 2883466 - RNA, 20 nt, Mycobacterium avium subsp. paratuberculosis
gggcuuuugcgucugcucgc

SEQ ID NO: 2883467 - RNA, 22 nt, Mycobacterium avium subsp. paratuberculosis
gggcuuuugcgucugcucgccg

SEQ ID NO: 2883468 - RNA, 12 nt, Mycobacterium avium subsp. paratuberculosis
ggggaacaccgg

SEQ ID NO: 2883469 - RNA, 17 nt, Mycobacterium avium subsp. paratuberculosis
ggggaacaccggcgagg

SEQ ID NO: 2883470 - RNA, 21 nt, Mycobacterium avium subsp. paratuberculosis
ggggaaccgcccuuccagcac

SEQ ID NO: 2883471 - RNA, 23 nt, Mycobacterium avium subsp. paratuberculosis
ggggaacucggugaugccggcca

SEQ ID NO: 2883472 - RNA, 13 nt, Mycobacterium avium subsp. paratuberculosis
ggggaagcccagc

SEQ ID NO: 2883473 - RNA, 20 nt, Mycobacterium avium subsp. paratuberculosis
ggggaaguccgggucgcgga

SEQ ID NO: 2883474 - RNA, 16 nt, Mycobacterium avium subsp. paratuberculosis
ggggacccgcaccgga

SEQ ID NO: 2883475 - RNA, 17 nt, Mycobacterium avium subsp. paratuberculosis
ggggaccguccccgucc

SEQ ID NO: 2883476 - RNA, 17 nt, Mycobacterium avium subsp. paratuberculosis
ggggacgacggcgggga

SEQ ID NO: 2883477 - RNA, 17 nt, Mycobacterium avium subsp. paratuberculosis
ggggacgcugaacagcc

SEQ ID NO: 2883478 - RNA, 15 nt, Mycobacterium avium subsp. paratuberculosis
ggggacggugcagcc

SEQ ID NO: 2883479 - RNA, 18 nt, Mycobacterium avium subsp. paratuberculosis
ggggacggugcagccggg

SEQ ID NO: 2883480 - RNA, 19 nt, Mycobacterium avium subsp. paratuberculosis
ggggacgucgacgugggcg

SEQ ID NO: 2883481 - RNA, 19 nt, Mycobacterium avium subsp. paratuberculosis
ggggacuuucgcgucugcu

SEQ ID NO: 2883482 - RNA, 20 nt, Mycobacterium avium subsp. paratuberculosis
ggggacuuucgcgucugcuc

SEQ ID NO: 2883483 - RNA, 21 nt, Mycobacterium avium subsp. paratuberculosis
ggggacuuucgcgucugcucg

SEQ ID NO: 2883484 - RNA, 12 nt, Mycobacterium avium subsp. paratuberculosis
ggggagaggcgc

SEQ ID NO: 2883485 - RNA, 14 nt, Mycobacterium avium subsp. paratuberculosis
ggggagaggcgcgg

SEQ ID NO: 2883486 - RNA, 19 nt, Mycobacterium avium subsp. paratuberculosis
ggggagcaggacgguggcc

SEQ ID NO: 2883487 - RNA, 20 nt, Mycobacterium avium subsp. paratuberculosis
ggggagccgaagaucaccgc

SEQ ID NO: 2883488 - RNA, 13 nt, Mycobacterium avium subsp. paratuberculosis
ggggagcggcgga

SEQ ID NO: 2883489 - RNA, 12 nt, Mycobacterium avium subsp. paratuberculosis
ggggaggcccag

SEQ ID NO: 2883490 - RNA, 21 nt, Mycobacterium avium subsp. paratuberculosis
ggggagggucgguggcccagc

SEQ ID NO: 2883491 - RNA, 22 nt, Mycobacterium avium subsp. paratuberculosis
ggggaggucgucgcguccagca

SEQ ID NO: 2883492 - RNA, 18 nt, Mycobacterium avium subsp. paratuberculosis
ggggaguagucggcgauc

SEQ ID NO: 2883493 - RNA, 18 nt, Mycobacterium avium subsp. paratuberculosis
ggggauccagcggcggcc

SEQ ID NO: 2883494 - RNA, 17 nt, Mycobacterium avium subsp. paratuberculosis
ggggauccgccugcgcg

SEQ ID NO: 2883495 - RNA, 19 nt, Mycobacterium avium subsp. paratuberculosis
ggggauccgccugcgcggg

SEQ ID NO: 2883496 - RNA, 13 nt, Mycobacterium avium subsp. paratuberculosis
ggggaucgccagg

SEQ ID NO: 2883497 - RNA, 15 nt, Mycobacterium avium subsp. paratuberculosis
ggggaucgcgcagcc

SEQ ID NO: 2883498 - RNA, 18 nt, Mycobacterium avium subsp. paratuberculosis
ggggaucgcgcagccgcg

SEQ ID NO: 2883499 - RNA, 21 nt, Mycobacterium avium subsp. paratuberculosis
ggggaugacggucugcaccgg

SEQ ID NO: 2883500 - RNA, 13 nt, Mycobacterium avium subsp. paratuberculosis
ggggaugcccggg

SEQ ID NO: 2883501 - RNA, 22 nt, Mycobacterium avium subsp. paratuberculosis
ggggaugccgaaccgcugcgga

SEQ ID NO: 2883502 - RNA, 16 nt, Mycobacterium avium subsp. paratuberculosis
ggggauggugcgccgg

SEQ ID NO: 2883503 - RNA, 22 nt, Mycobacterium avium subsp. paratuberculosis
ggggauguagccgccgguggcg

SEQ ID NO: 2883504 - RNA, 21 nt, Mycobacterium avium subsp. paratuberculosis
ggggaugucgucgggcgcggu

SEQ ID NO: 2883505 - RNA, 20 nt, Mycobacterium avium subsp. paratuberculosis
ggggauuucacgucugcucg

SEQ ID NO: 2883506 - RNA, 20 nt, Mycobacterium avium subsp. paratuberculosis
ggggauuuuuuggggcgggg

SEQ ID NO: 2883507 - RNA, 21 nt, Mycobacterium avium subsp. paratuberculosis
ggggauuuuuuggggcggggc

SEQ ID NO: 2883508 - RNA, 14 nt, Mycobacterium avium subsp. paratuberculosis
ggggcaagcagcgg

SEQ ID NO: 2883509 - RNA, 21 nt, Mycobacterium avium subsp. paratuberculosis
ggggcacguccccgugcagcc

SEQ ID NO: 2883510 - RNA, 17 nt, Mycobacterium avium subsp. paratuberculosis
ggggcagacccgcgucg

SEQ ID NO: 2883511 - RNA, 21 nt, Mycobacterium avium subsp. paratuberculosis
ggggcagaccgugugccagcc

SEQ ID NO: 2883512 - RNA, 14 nt, Mycobacterium avium subsp. paratuberculosis
ggggcagcaccucg

SEQ ID NO: 2883513 - RNA, 14 nt, Mycobacterium avium subsp. paratuberculosis
ggggcagcagcgcc

SEQ ID NO: 2883514 - RNA, 17 nt, Mycobacterium avium subsp. paratuberculosis
ggggcagcagcgcccac

SEQ ID NO: 2883515 - RNA, 21 nt, Mycobacterium avium subsp. paratuberculosis
ggggcagcugauagcccgccg

SEQ ID NO: 2883516 - RNA, 14 nt, Mycobacterium avium subsp. paratuberculosis
ggggcagcugcugg

SEQ ID NO: 2883517 - RNA, 15 nt, Mycobacterium avium subsp. paratuberculosis
ggggcagggcauccg

SEQ ID NO: 2883518 - RNA, 22 nt, Mycobacterium avium subsp. paratuberculosis
ggggcaguagugguccaccgcc

SEQ ID NO: 2883519 - RNA, 23 nt, Mycobacterium avium subsp. paratuberculosis
ggggcaguagugguccaccgccg

SEQ ID NO: 2883520 - RNA, 21 nt, Mycobacterium avium subsp. paratuberculosis
ggggcaucgcagcgcgcggcg

SEQ ID NO: 2883521 - RNA, 23 nt, Mycobacterium avium subsp. paratuberculosis
ggggcaucgcagcgcgcggcgca

SEQ ID NO: 2883522 - RNA, 20 nt, Mycobacterium avium subsp. paratuberculosis
ggggccaacuccggcggcag

SEQ ID NO: 2883523 - RNA, 13 nt, Mycobacterium avium subsp. paratuberculosis
ggggccaccaggc

SEQ ID NO: 2883524 - RNA, 16 nt, Mycobacterium avium subsp. paratuberculosis
ggggccaccaggcgcc

SEQ ID NO: 2883525 - RNA, 13 nt, Mycobacterium avium subsp. paratuberculosis
ggggccagcacgc

SEQ ID NO: 2883526 - RNA, 23 nt, Mycobacterium avium subsp. paratuberculosis
ggggccagcgccgagaucgcggu

SEQ ID NO: 2883527 - RNA, 19 nt, Mycobacterium avium subsp. paratuberculosis
ggggcccaccccggacaac

SEQ ID NO: 2883528 - RNA, 18 nt, Mycobacterium avium subsp. paratuberculosis
ggggcccgcgacccagac

SEQ ID NO: 2883529 - RNA, 14 nt, Mycobacterium avium subsp. paratuberculosis
ggggcccggcccgg

SEQ ID NO: 2883530 - RNA, 16 nt, Mycobacterium avium subsp. paratuberculosis
ggggcccggcccggcg

SEQ ID NO: 2883531 - RNA, 15 nt, Mycobacterium avium subsp. paratuberculosis
ggggcccguccccac

SEQ ID NO: 2883532 - RNA, 18 nt, Mycobacterium avium subsp. paratuberculosis
ggggcccucgcucaaccc

SEQ ID NO: 2883533 - RNA, 21 nt, Mycobacterium avium subsp. paratuberculosis
ggggccgaugaccgcggcggg

SEQ ID NO: 2883534 - RNA, 23 nt, Mycobacterium avium subsp. paratuberculosis
ggggccgaugaccgcggcgggca

SEQ ID NO: 2883535 - RNA, 18 nt, Mycobacterium avium subsp. paratuberculosis
ggggccgauguucacccc

SEQ ID NO: 2883536 - RNA, 15 nt, Mycobacterium avium subsp. paratuberculosis
ggggccgccgucggu

SEQ ID NO: 2883537 - RNA, 13 nt, Mycobacterium avium subsp. paratuberculosis
ggggccggccgcc

SEQ ID NO: 2883538 - RNA, 20 nt, Mycobacterium avium subsp. paratuberculosis
ggggccggccgcccgcacca

SEQ ID NO: 2883539 - RNA, 22 nt, Mycobacterium avium subsp. paratuberculosis
ggggccggcgaaggacagccgg

SEQ ID NO: 2883540 - RNA, 16 nt, Mycobacterium avium subsp. paratuberculosis
ggggccggcgcggugc

SEQ ID NO: 2883541 - RNA, 19 nt, Mycobacterium avium subsp. paratuberculosis
ggggccggcgcuggcgugc

SEQ ID NO: 2883542 - RNA, 13 nt, Mycobacterium avium subsp. paratuberculosis
ggggccggcggcg

SEQ ID NO: 2883543 - RNA, 17 nt, Mycobacterium avium subsp. paratuberculosis
ggggccggcggcggcca

SEQ ID NO: 2883544 - RNA, 15 nt, Mycobacterium avium subsp. paratuberculosis
ggggccggcgggggc

SEQ ID NO: 2883545 - RNA, 22 nt, Mycobacterium avium subsp. paratuberculosis
ggggccggugcguccgccggcg

SEQ ID NO: 2883546 - RNA, 15 nt, Mycobacterium avium subsp. paratuberculosis
ggggccgguuggugc

SEQ ID NO: 2883547 - RNA, 19 nt, Mycobacterium avium subsp. paratuberculosis
ggggccuccaccagcggcg

SEQ ID NO: 2883548 - RNA, 16 nt, Mycobacterium avium subsp. paratuberculosis
ggggccuccagccagc

SEQ ID NO: 2883549 - RNA, 14 nt, Mycobacterium avium subsp. paratuberculosis
ggggccucgucgcc

SEQ ID NO: 2883550 - RNA, 16 nt, Mycobacterium avium subsp. paratuberculosis
ggggccuucuuggcgg

SEQ ID NO: 2883551 - RNA, 19 nt, Mycobacterium avium subsp. paratuberculosis
ggggccuucuuggcggcgg

SEQ ID NO: 2883552 - RNA, 15 nt, Mycobacterium avium subsp. paratuberculosis
ggggcgaacccggcg

SEQ ID NO: 2883553 - RNA, 20 nt, Mycobacterium avium subsp. paratuberculosis
ggggcgaccuugcgcagccg

SEQ ID NO: 2883554 - RNA, 17 nt, Mycobacterium avium subsp. paratuberculosis
ggggcgagccggcccgg

SEQ ID NO: 2883555 - RNA, 19 nt, Mycobacterium avium subsp. paratuberculosis
ggggcgagcuggccgccca

SEQ ID NO: 2883556 - RNA, 21 nt, Mycobacterium avium subsp. paratuberculosis
ggggcgagcuggccgcccacc

SEQ ID NO: 2883557 - RNA, 13 nt, Mycobacterium avium subsp. paratuberculosis
ggggcgcaccgcc

SEQ ID NO: 2883558 - RNA, 18 nt, Mycobacterium avium subsp. paratuberculosis
ggggcgcagauggggauc

SEQ ID NO: 2883559 - RNA, 21 nt, Mycobacterium avium subsp. paratuberculosis
ggggcgcagcccggcgguuga

SEQ ID NO: 2883560 - RNA, 12 nt, Mycobacterium avium subsp. paratuberculosis
ggggcgcagccg

SEQ ID NO: 2883561 - RNA, 16 nt, Mycobacterium avium subsp. paratuberculosis
ggggcgcagcugcagc

SEQ ID NO: 2883562 - RNA, 15 nt, Mycobacterium avium subsp. paratuberculosis
ggggcgccccgcugg

SEQ ID NO: 2883563 - RNA, 17 nt, Mycobacterium avium subsp. paratuberculosis
ggggcgccgacagucgc

SEQ ID NO: 2883564 - RNA, 19 nt, Mycobacterium avium subsp. paratuberculosis
ggggcgccgacagucgcgg

SEQ ID NO: 2883565 - RNA, 13 nt, Mycobacterium avium subsp. paratuberculosis
ggggcgccgcggc

SEQ ID NO: 2883566 - RNA, 14 nt, Mycobacterium avium subsp. paratuberculosis
ggggcgccgcggcg

SEQ ID NO: 2883567 - RNA, 13 nt, Mycobacterium avium subsp. paratuberculosis
ggggcgcgcaggc

SEQ ID NO: 2883568 - RNA, 14 nt, Mycobacterium avium subsp. paratuberculosis
ggggcgcgcgccgg

SEQ ID NO: 2883569 - RNA, 15 nt, Mycobacterium avium subsp. paratuberculosis
ggggcgcgcgccggg

SEQ ID NO: 2883570 - RNA, 16 nt, Mycobacterium avium subsp. paratuberculosis
ggggcgcgcgccggga

SEQ ID NO: 2883571 - RNA, 23 nt, Mycobacterium avium subsp. paratuberculosis
ggggcgcggaccgcacccccagc

SEQ ID NO: 2883572 - RNA, 23 nt, Mycobacterium avium subsp. paratuberculosis
ggggcgcggcaucgugaugcggg

SEQ ID NO: 2883573 - RNA, 17 nt, Mycobacterium avium subsp. paratuberculosis
ggggcgcgggcggcagg

SEQ ID NO: 2883574 - RNA, 19 nt, Mycobacterium avium subsp. paratuberculosis
ggggcggauccccgcgcug

SEQ ID NO: 2883575 - RNA, 13 nt, Mycobacterium avium subsp. paratuberculosis
ggggcggccgccg

SEQ ID NO: 2883576 - RNA, 14 nt, Mycobacterium avium subsp. paratuberculosis
ggggcggccgccgg

SEQ ID NO: 2883577 - RNA, 13 nt, Mycobacterium avium subsp. paratuberculosis
ggggcggccgggc

SEQ ID NO: 2883578 - RNA, 18 nt, Mycobacterium avium subsp. paratuberculosis
ggggcggccugagccgcc

SEQ ID NO: 2883579 - RNA, 16 nt, Mycobacterium avium subsp. paratuberculosis
ggggcggcggcgccgg

SEQ ID NO: 2883580 - RNA, 17 nt, Mycobacterium avium subsp. paratuberculosis
ggggcggcgggcgaagu

SEQ ID NO: 2883581 - RNA, 12 nt, Mycobacterium avium subsp. paratuberculosis
ggggcgggcacg

SEQ ID NO: 2883582 - RNA, 15 nt, Mycobacterium avium subsp. paratuberculosis
ggggcgggcggcggc

SEQ ID NO: 2883583 - RNA, 17 nt, Mycobacterium avium subsp. paratuberculosis
ggggcggugcagccggg

SEQ ID NO: 2883584 - RNA, 18 nt, Mycobacterium avium subsp. paratuberculosis
ggggcggugcagccgggu

SEQ ID NO: 2883585 - RNA, 17 nt, Mycobacterium avium subsp. paratuberculosis
ggggcguacgcgcugcc

SEQ ID NO: 2883586 - RNA, 17 nt, Mycobacterium avium subsp. paratuberculosis
ggggcgucgaugcguga

SEQ ID NO: 2883587 - RNA, 14 nt, Mycobacterium avium subsp. paratuberculosis
ggggcgucgcccgc

SEQ ID NO: 2883588 - RNA, 13 nt, Mycobacterium avium subsp. paratuberculosis
ggggcgucgccgc

SEQ ID NO: 2883589 - RNA, 14 nt, Mycobacterium avium subsp. paratuberculosis
ggggcgucgccgcc

SEQ ID NO: 2883590 - RNA, 15 nt, Mycobacterium avium subsp. paratuberculosis
ggggcgucggacgcc

SEQ ID NO: 2883591 - RNA, 13 nt, Mycobacterium avium subsp. paratuberculosis
ggggcgucggcgg

SEQ ID NO: 2883592 - RNA, 17 nt, Mycobacterium avium subsp. paratuberculosis
ggggcguuggugcggga

SEQ ID NO: 2883593 - RNA, 15 nt, Mycobacterium avium subsp. paratuberculosis
ggggcuacaaaacca

SEQ ID NO: 2883594 - RNA, 13 nt, Mycobacterium avium subsp. paratuberculosis
ggggcuauccggg

SEQ ID NO: 2883595 - RNA, 22 nt, Mycobacterium avium subsp. paratuberculosis
ggggcucagccgaagccggcgc

SEQ ID NO: 2883596 - RNA, 18 nt, Mycobacterium avium subsp. paratuberculosis
ggggcugcgggccaggcg

SEQ ID NO: 2883597 - RNA, 13 nt, Mycobacterium avium subsp. paratuberculosis
ggggcuggccgca

SEQ ID NO: 2883598 - RNA, 17 nt, Mycobacterium avium subsp. paratuberculosis
ggggcuguccucccagc

SEQ ID NO: 2883599 - RNA, 20 nt, Mycobacterium avium subsp. paratuberculosis
ggggcuguccucccagcgcc

SEQ ID NO: 2883600 - RNA, 23 nt, Mycobacterium avium subsp. paratuberculosis
ggggcuguccucccagcgcccgg

SEQ ID NO: 2883601 - RNA, 16 nt, Mycobacterium avium subsp. paratuberculosis
ggggcuucgaacgccc

SEQ ID NO: 2883602 - RNA, 18 nt, Mycobacterium avium subsp. paratuberculosis
ggggcuucgaacgcccgc

SEQ ID NO: 2883603 - RNA, 22 nt, Mycobacterium avium subsp. paratuberculosis
ggggcuucgaacgcccgcacca

SEQ ID NO: 2883604 - RNA, 14 nt, Mycobacterium avium subsp. paratuberculosis
ggggcuuuugcguc

SEQ ID NO: 2883605 - RNA, 20 nt, Mycobacterium avium subsp. paratuberculosis
ggggcuuuugcgucugcucg

SEQ ID NO: 2883606 - RNA, 22 nt, Mycobacterium avium subsp. paratuberculosis
ggggcuuuugcgucugcucgcg

SEQ ID NO: 2883607 - RNA, 23 nt, Mycobacterium avium subsp. paratuberculosis
gggggaagcccagcacccgcucg

SEQ ID NO: 2883608 - RNA, 23 nt, Mycobacterium avium subsp. paratuberculosis
gggggaccagcgcaaccgcggcg

SEQ ID NO: 2883609 - RNA, 20 nt, Mycobacterium avium subsp. paratuberculosis
gggggagucggggugcucga

SEQ ID NO: 2883610 - RNA, 19 nt, Mycobacterium avium subsp. paratuberculosis
gggggauccgccugcgcgg

SEQ ID NO: 2883611 - RNA, 22 nt, Mycobacterium avium subsp. paratuberculosis
gggggauuucacgucugcucgg

SEQ ID NO: 2883612 - RNA, 13 nt, Mycobacterium avium subsp. paratuberculosis
gggggcgagccgg

SEQ ID NO: 2883613 - RNA, 14 nt, Mycobacterium avium subsp. paratuberculosis
gggggcgagccggc

SEQ ID NO: 2883614 - RNA, 22 nt, Mycobacterium avium subsp. paratuberculosis
gggggcgccgcggcgccgccac

SEQ ID NO: 2883615 - RNA, 23 nt, Mycobacterium avium subsp. paratuberculosis
gggggcggccgggccgcggcggu

SEQ ID NO: 2883616 - RNA, 14 nt, Mycobacterium avium subsp. paratuberculosis
gggggcggcggggu

SEQ ID NO: 2883617 - RNA, 17 nt, Mycobacterium avium subsp. paratuberculosis
gggggcuuuugcgucug

SEQ ID NO: 2883618 - RNA, 18 nt, Mycobacterium avium subsp. paratuberculosis
gggggcuuuugcgucugc

SEQ ID NO: 2883619 - RNA, 20 nt, Mycobacterium avium subsp. paratuberculosis
gggggcuuuugcgucugcuc

SEQ ID NO: 2883620 - RNA, 11 nt, Mycobacterium avium subsp. paratuberculosis
ggggggcacgu

SEQ ID NO: 2883621 - RNA, 17 nt, Mycobacterium avium subsp. paratuberculosis
ggggguaaaccgccagc

SEQ ID NO: 2883622 - RNA, 18 nt, Mycobacterium avium subsp. paratuberculosis
ggggguaaaccgccagca

SEQ ID NO: 2883623 - RNA, 23 nt, Mycobacterium avium subsp. paratuberculosis
gggggucaucagugaccgcacga

SEQ ID NO: 2883624 - RNA, 18 nt, Mycobacterium avium subsp. paratuberculosis
ggggguccagggugccga

SEQ ID NO: 2883625 - RNA, 14 nt, Mycobacterium avium subsp. paratuberculosis
gggggucgacccgc

SEQ ID NO: 2883626 - RNA, 13 nt, Mycobacterium avium subsp. paratuberculosis
gggggucgacugg

SEQ ID NO: 2883627 - RNA, 22 nt, Mycobacterium avium subsp. paratuberculosis
gggggucgacugggccaggucg

SEQ ID NO: 2883628 - RNA, 13 nt, Mycobacterium avium subsp. paratuberculosis
gggggucggugac

SEQ ID NO: 2883629 - RNA, 15 nt, Mycobacterium avium subsp. paratuberculosis
gggggugccgaccgc

SEQ ID NO: 2883630 - RNA, 14 nt, Mycobacterium avium subsp. paratuberculosis
ggggguggcgucga

SEQ ID NO: 2883631 - RNA, 13 nt, Mycobacterium avium subsp. paratuberculosis
gggggugggcucc

SEQ ID NO: 2883632 - RNA, 17 nt, Mycobacterium avium subsp. paratuberculosis
ggggguuucgugugcuc

SEQ ID NO: 2883633 - RNA, 18 nt, Mycobacterium avium subsp. paratuberculosis
ggggguuucgugugcuca

SEQ ID NO: 2883634 - RNA, 15 nt, Mycobacterium avium subsp. paratuberculosis
gggguacucggcggc

SEQ ID NO: 2883635 - RNA, 16 nt, Mycobacterium avium subsp. paratuberculosis
gggguacucggcggcg

SEQ ID NO: 2883636 - RNA, 16 nt, Mycobacterium avium subsp. paratuberculosis
gggguagccggcccgc

SEQ ID NO: 2883637 - RNA, 17 nt, Mycobacterium avium subsp. paratuberculosis
gggguaguucugcucga

SEQ ID NO: 2883638 - RNA, 19 nt, Mycobacterium avium subsp. paratuberculosis
ggggucaccuuggccggau

SEQ ID NO: 2883639 - RNA, 20 nt, Mycobacterium avium subsp. paratuberculosis
ggggucaccuuggccggauc

SEQ ID NO: 2883640 - RNA, 15 nt, Mycobacterium avium subsp. paratuberculosis
gggguccaccggccg

SEQ ID NO: 2883641 - RNA, 19 nt, Mycobacterium avium subsp. paratuberculosis
gggguccaccggccgaugg

SEQ ID NO: 2883642 - RNA, 20 nt, Mycobacterium avium subsp. paratuberculosis
ggggucccaauccucgccga

SEQ ID NO: 2883643 - RNA, 19 nt, Mycobacterium avium subsp. paratuberculosis
gggguccggggcacggugg

SEQ ID NO: 2883644 - RNA, 20 nt, Mycobacterium avium subsp. paratuberculosis
gggguccuccagcggcaggu

SEQ ID NO: 2883645 - RNA, 22 nt, Mycobacterium avium subsp. paratuberculosis
gggguccucgauggcggcggcu

SEQ ID NO: 2883646 - RNA, 15 nt, Mycobacterium avium subsp. paratuberculosis
gggguccucucggcg

SEQ ID NO: 2883647 - RNA, 17 nt, Mycobacterium avium subsp. paratuberculosis
gggguccucucggcgcc

SEQ ID NO: 2883648 - RNA, 18 nt, Mycobacterium avium subsp. paratuberculosis
gggguccucucggcgccg

SEQ ID NO: 2883649 - RNA, 23 nt, Mycobacterium avium subsp. paratuberculosis
ggggucgaacaucacccggcggc

SEQ ID NO: 2883650 - RNA, 16 nt, Mycobacterium avium subsp. paratuberculosis
ggggucgagaagcccg

SEQ ID NO: 2883651 - RNA, 19 nt, Mycobacterium avium subsp. paratuberculosis
ggggucgccgucgugcucg

SEQ ID NO: 2883652 - RNA, 20 nt, Mycobacterium avium subsp. paratuberculosis
ggggucgccgucgugcucga

SEQ ID NO: 2883653 - RNA, 13 nt, Mycobacterium avium subsp. paratuberculosis
ggggucgcgggcg

SEQ ID NO: 2883654 - RNA, 15 nt, Mycobacterium avium subsp. paratuberculosis
ggggucgcgggcgcc

SEQ ID NO: 2883655 - RNA, 17 nt, Mycobacterium avium subsp. paratuberculosis
ggggucgcgggcgccga

SEQ ID NO: 2883656 - RNA, 23 nt, Mycobacterium avium subsp. paratuberculosis
ggggucggagcgcuccaccaccg

SEQ ID NO: 2883657 - RNA, 13 nt, Mycobacterium avium subsp. paratuberculosis
ggggucggccagc

SEQ ID NO: 2883658 - RNA, 13 nt, Mycobacterium avium subsp. paratuberculosis
ggggucggccgag

SEQ ID NO: 2883659 - RNA, 13 nt, Mycobacterium avium subsp. paratuberculosis
ggggucggccgga

SEQ ID NO: 2883660 - RNA, 11 nt, Mycobacterium avium subsp. paratuberculosis
ggggucggcgc

SEQ ID NO: 2883661 - RNA, 13 nt, Mycobacterium avium subsp. paratuberculosis
ggggucggcgccc

SEQ ID NO: 2883662 - RNA, 14 nt, Mycobacterium avium subsp. paratuberculosis
ggggucggcgcccu

SEQ ID NO: 2883663 - RNA, 14 nt, Mycobacterium avium subsp. paratuberculosis
ggggucgggccgga

SEQ ID NO: 2883664 - RNA, 15 nt, Mycobacterium avium subsp. paratuberculosis
ggggucugcacgaug

SEQ ID NO: 2883665 - RNA, 19 nt, Mycobacterium avium subsp. paratuberculosis
ggggucuggucgguuugcg

SEQ ID NO: 2883666 - RNA, 20 nt, Mycobacterium avium subsp. paratuberculosis
ggggugaaggcggccaccgc

SEQ ID NO: 2883667 - RNA, 18 nt, Mycobacterium avium subsp. paratuberculosis
ggggugacuucgagccgg

SEQ ID NO: 2883668 - RNA, 17 nt, Mycobacterium avium subsp. paratuberculosis
ggggugaggcacccgcu

SEQ ID NO: 2883669 - RNA, 17 nt, Mycobacterium avium subsp. paratuberculosis
ggggugaugccggcggu

SEQ ID NO: 2883670 - RNA, 17 nt, Mycobacterium avium subsp. paratuberculosis
ggggugcaccgugguga

SEQ ID NO: 2883671 - RNA, 18 nt, Mycobacterium avium subsp. paratuberculosis
ggggugcccaccagcauc

SEQ ID NO: 2883672 - RNA, 13 nt, Mycobacterium avium subsp. paratuberculosis
ggggugcccggcg

SEQ ID NO: 2883673 - RNA, 20 nt, Mycobacterium avium subsp. paratuberculosis
ggggugcccuuuacccggac

SEQ ID NO: 2883674 - RNA, 21 nt, Mycobacterium avium subsp. paratuberculosis
ggggugccgcagcggcggcac

SEQ ID NO: 2883675 - RNA, 15 nt, Mycobacterium avium subsp. paratuberculosis
ggggugccgcccaac

SEQ ID NO: 2883676 - RNA, 15 nt, Mycobacterium avium subsp. paratuberculosis
ggggugccggaggcg

SEQ ID NO: 2883677 - RNA, 15 nt, Mycobacterium avium subsp. paratuberculosis
ggggugcgccaggca

SEQ ID NO: 2883678 - RNA, 14 nt, Mycobacterium avium subsp. paratuberculosis
gggguggccggcca

SEQ ID NO: 2883679 - RNA, 13 nt, Mycobacterium avium subsp. paratuberculosis
gggguggcgccgg

SEQ ID NO: 2883680 - RNA, 15 nt, Mycobacterium avium subsp. paratuberculosis
ggggugggcacgucg

SEQ ID NO: 2883681 - RNA, 14 nt, Mycobacterium avium subsp. paratuberculosis
ggggugggccaucg

SEQ ID NO: 2883682 - RNA, 13 nt, Mycobacterium avium subsp. paratuberculosis
ggggugggcgaac

SEQ ID NO: 2883683 - RNA, 20 nt, Mycobacterium avium subsp. paratuberculosis
gggguggugaaacgaguuca

SEQ ID NO: 2883684 - RNA, 10 nt, Mycobacterium avium subsp. paratuberculosis
gggguggugg

SEQ ID NO: 2883685 - RNA, 20 nt, Mycobacterium avium subsp. paratuberculosis
ggggugucagcgcgaccucg

SEQ ID NO: 2883686 - RNA, 15 nt, Mycobacterium avium subsp. paratuberculosis
ggggugucgacccag

SEQ ID NO: 2883687 - RNA, 15 nt, Mycobacterium avium subsp. paratuberculosis
ggggugugcggcacg

SEQ ID NO: 2883688 - RNA, 14 nt, Mycobacterium avium subsp. paratuberculosis
gggguguucaccgc

SEQ ID NO: 2883689 - RNA, 20 nt, Mycobacterium avium subsp. paratuberculosis
gggguguucaccgcgccggg

SEQ ID NO: 2883690 - RNA, 20 nt, Mycobacterium avium subsp. paratuberculosis
gggguuccaccguucgggug

SEQ ID NO: 2883691 - RNA, 19 nt, Mycobacterium avium subsp. paratuberculosis
gggguucccggccgguggc

SEQ ID NO: 2883692 - RNA, 14 nt, Mycobacterium avium subsp. paratuberculosis
gggguucgacguca

SEQ ID NO: 2883693 - RNA, 19 nt, Mycobacterium avium subsp. paratuberculosis
gggguugacccggccgguc

SEQ ID NO: 2883694 - RNA, 22 nt, Mycobacterium avium subsp. paratuberculosis
gggguugaccuugaccagcuug

SEQ ID NO: 2883695 - RNA, 22 nt, Mycobacterium avium subsp. paratuberculosis
gggguuggagaagaucuucucg

SEQ ID NO: 2883696 - RNA, 16 nt, Mycobacterium avium subsp. paratuberculosis
gggguuucgugugcuc

SEQ ID NO: 2883697 - RNA, 18 nt, Mycobacterium avium subsp. paratuberculosis
gggguuuugaucagcccg

SEQ ID NO: 2883698 - RNA, 14 nt, Mycobacterium avium subsp. paratuberculosis
ggguaaccgcagcc

SEQ ID NO: 2883699 - RNA, 22 nt, Mycobacterium avium subsp. paratuberculosis
ggguaaccgcagccgggugcgg

SEQ ID NO: 2883700 - RNA, 16 nt, Mycobacterium avium subsp. paratuberculosis
ggguacaccgagccgg

SEQ ID NO: 2883701 - RNA, 21 nt, Mycobacterium avium subsp. paratuberculosis
ggguacaccgagccggggcug

SEQ ID NO: 2883702 - RNA, 14 nt, Mycobacterium avium subsp. paratuberculosis
ggguaccacuugaa

SEQ ID NO: 2883703 - RNA, 20 nt, Mycobacterium avium subsp. paratuberculosis
ggguaccacuugaaggaggc

SEQ ID NO: 2883704 - RNA, 15 nt, Mycobacterium avium subsp. paratuberculosis
ggguaccucugcgcg

SEQ ID NO: 2883705 - RNA, 13 nt, Mycobacterium avium subsp. paratuberculosis
ggguacgcguacg

SEQ ID NO: 2883706 - RNA, 22 nt, Mycobacterium avium subsp. paratuberculosis
ggguagaaccagcccggcccgu

SEQ ID NO: 2883707 - RNA, 21 nt, Mycobacterium avium subsp. paratuberculosis
ggcgcucgccgcgcggcccgc

SEQ ID NO: 2883708 - RNA, 15 nt, Mycobacterium avium subsp. paratuberculosis
ggcgcucgcgggugc

SEQ ID NO: 2883709 - RNA, 20 nt, Mycobacterium avium subsp. paratuberculosis
ggcggaggccugcgcggccg

SEQ ID NO: 2883710 - RNA, 19 nt, Mycobacterium avium subsp. paratuberculosis
ggcggaggcgaaugcggcc

SEQ ID NO: 2883711 - RNA, 17 nt, Mycobacterium avium subsp. paratuberculosis
ggcggaggucagcggcc

SEQ ID NO: 2883712 - RNA, 23 nt, Mycobacterium avium subsp. paratuberculosis
ggcggaggucagcggcccgauca

SEQ ID NO: 2883713 - RNA, 21 nt, Mycobacterium avium subsp. paratuberculosis
ggcggaggucauggcgaccgc

SEQ ID NO: 2883714 - RNA, 20 nt, Mycobacterium avium subsp. paratuberculosis
ggcggagucguagucgaugc

SEQ ID NO: 2883715 - RNA, 17 nt, Mycobacterium avium subsp. paratuberculosis
ggcggauauagccgacg

SEQ ID NO: 2883716 - RNA, 16 nt, Mycobacterium avium subsp. paratuberculosis
ggcggaucagcaccga

SEQ ID NO: 2883717 - RNA, 19 nt, Mycobacterium avium subsp. paratuberculosis
ggcggaucaguaccggcga

SEQ ID NO: 2883718 - RNA, 22 nt, Mycobacterium avium subsp. paratuberculosis
ggcggaucaguaccggcgaugc

SEQ ID NO: 2883719 - RNA, 24 nt, Mycobacterium avium subsp. paratuberculosis
ggcggauccagguggggcacgggc

SEQ ID NO: 2883720 - RNA, 16 nt, Mycobacterium avium subsp. paratuberculosis
ggcggauccccgcgcu

SEQ ID NO: 2883721 - RNA, 17 nt, Mycobacterium avium subsp. paratuberculosis
ggcggauccccgcgcug

SEQ ID NO: 2883722 - RNA, 15 nt, Mycobacterium avium subsp. paratuberculosis
ggcggaucgcgugcg

SEQ ID NO: 2883723 - RNA, 22 nt, Mycobacterium avium subsp. paratuberculosis
ggcggaucgcgugcgucacgcu

SEQ ID NO: 2883724 - RNA, 18 nt, Mycobacterium avium subsp. paratuberculosis
ggcggaucuucucgcugc

SEQ ID NO: 2883725 - RNA, 20 nt, Mycobacterium avium subsp. paratuberculosis
ggcggaucuucucgcugcuc

SEQ ID NO: 2883726 - RNA, 15 nt, Mycobacterium avium subsp. paratuberculosis
ggcggauggcgcccu

SEQ ID NO: 2883727 - RNA, 20 nt, Mycobacterium avium subsp. paratuberculosis
ggcggaugugccuggcccag

SEQ ID NO: 2883728 - RNA, 15 nt, Mycobacterium avium subsp. paratuberculosis
ggcggauucucgcuc

SEQ ID NO: 2883729 - RNA, 20 nt, Mycobacterium avium subsp. paratuberculosis
ggcggauucucgcucugccg

SEQ ID NO: 2883730 - RNA, 14 nt, Mycobacterium avium subsp. paratuberculosis
ggcggauuggugcc

SEQ ID NO: 2883731 - RNA, 17 nt, Mycobacterium avium subsp. paratuberculosis
ggcggcaaaacgcuggg

SEQ ID NO: 2883732 - RNA, 13 nt, Mycobacterium avium subsp. paratuberculosis
ggcggcaaccagc

SEQ ID NO: 2883733 - RNA, 14 nt, Mycobacterium avium subsp. paratuberculosis
ggcggcaaccagcu

SEQ ID NO: 2883734 - RNA, 23 nt, Mycobacterium avium subsp. paratuberculosis
ggcggcaagcccuuuggcggcca

SEQ ID NO: 2883735 - RNA, 15 nt, Mycobacterium avium subsp. paratuberculosis
ggcggcaaguccggg

SEQ ID NO: 2883736 - RNA, 15 nt, Mycobacterium avium subsp. paratuberculosis
ggcggcacaccgcgc

SEQ ID NO: 2883737 - RNA, 13 nt, Mycobacterium avium subsp. paratuberculosis
ggcggcaccaccc

SEQ ID NO: 2883738 - RNA, 20 nt, Mycobacterium avium subsp. paratuberculosis
ggcggcaccacccgcggccg

SEQ ID NO: 2883739 - RNA, 15 nt, Mycobacterium avium subsp. paratuberculosis
ggcggcaccacccgg

SEQ ID NO: 2883740 - RNA, 13 nt, Mycobacterium avium subsp. paratuberculosis
ggcggcacccagg

SEQ ID NO: 2883741 - RNA, 16 nt, Mycobacterium avium subsp. paratuberculosis
ggcggcaccgcccggg

SEQ ID NO: 2883742 - RNA, 13 nt, Mycobacterium avium subsp. paratuberculosis
ggcggcaccgccg

SEQ ID NO: 2883743 - RNA, 18 nt, Mycobacterium avium subsp. paratuberculosis
ggcggcaccgccgcggug

SEQ ID NO: 2883744 - RNA, 20 nt, Mycobacterium avium subsp. paratuberculosis
ggcggcaccgccgcgguggg

SEQ ID NO: 2883745 - RNA, 22 nt, Mycobacterium avium subsp. paratuberculosis
ggcggcaccgcggcucggucgc

SEQ ID NO: 2883746 - RNA, 15 nt, Mycobacterium avium subsp. paratuberculosis
ggcggcaccgcugcc

SEQ ID NO: 2883747 - RNA, 16 nt, Mycobacterium avium subsp. paratuberculosis
ggcggcaccgcugccg

SEQ ID NO: 2883748 - RNA, 12 nt, Mycobacterium avium subsp. paratuberculosis
ggcggcagcagc

SEQ ID NO: 2883749 - RNA, 14 nt, Mycobacterium avium subsp. paratuberculosis
ggcggcagcagcug

SEQ ID NO: 2883750 - RNA, 14 nt, Mycobacterium avium subsp. paratuberculosis
ggcggcagccaggc

SEQ ID NO: 2883751 - RNA, 22 nt, Mycobacterium avium subsp. paratuberculosis
ggcggcagcgacucgggcagga

SEQ ID NO: 2883752 - RNA, 23 nt, Mycobacterium avium subsp. paratuberculosis
ggcggcagcgacucgggcaggau

SEQ ID NO: 2883753 - RNA, 18 nt, Mycobacterium avium subsp. paratuberculosis
ggcggcagggccagcacc

SEQ ID NO: 2883754 - RNA, 19 nt, Mycobacterium avium subsp. paratuberculosis
ggcggcagggccagcacca

SEQ ID NO: 2883755 - RNA, 18 nt, Mycobacterium avium subsp. paratuberculosis
ggcggcaggugaaggugc

SEQ ID NO: 2883756 - RNA, 12 nt, Mycobacterium avium subsp. paratuberculosis
ggcggcaggugg

SEQ ID NO: 2883757 - RNA, 21 nt, Mycobacterium avium subsp. paratuberculosis
ggcggcagguggggcagcacc

SEQ ID NO: 2883758 - RNA, 15 nt, Mycobacterium avium subsp. paratuberculosis
ggcggcagucgcagc

SEQ ID NO: 2883759 - RNA, 16 nt, Mycobacterium avium subsp. paratuberculosis
ggcggcagucgcagca

SEQ ID NO: 2883760 - RNA, 14 nt, Mycobacterium avium subsp. paratuberculosis
ggcggcagugcgcc

SEQ ID NO: 2883761 - RNA, 19 nt, Mycobacterium avium subsp. paratuberculosis
ggcggcagugcgccguccc

SEQ ID NO: 2883762 - RNA, 22 nt, Mycobacterium avium subsp. paratuberculosis
ggcggcagugcgccgucccgga

SEQ ID NO: 2883763 - RNA, 17 nt, Mycobacterium avium subsp. paratuberculosis
ggcggcauccccagcug

SEQ ID NO: 2883764 - RNA, 19 nt, Mycobacterium avium subsp. paratuberculosis
ggcggcauccccagcuggg

SEQ ID NO: 2883765 - RNA, 22 nt, Mycobacterium avium subsp. paratuberculosis
ggcggcauccccagcugggccg

SEQ ID NO: 2883766 - RNA, 16 nt, Mycobacterium avium subsp. paratuberculosis
ggcggcaucgcgccgc

SEQ ID NO: 2883767 - RNA, 17 nt, Mycobacterium avium subsp. paratuberculosis
ggcggcaucgcgccgca

SEQ ID NO: 2883768 - RNA, 19 nt, Mycobacterium avium subsp. paratuberculosis
ggcggcaucgcgccgcaug

SEQ ID NO: 2883769 - RNA, 15 nt, Mycobacterium avium subsp. paratuberculosis
ggcggcaucgcgcgc

SEQ ID NO: 2883770 - RNA, 19 nt, Mycobacterium avium subsp. paratuberculosis
ggcggcaucgcgcgcggcg

SEQ ID NO: 2883771 - RNA, 23 nt, Mycobacterium avium subsp. paratuberculosis
ggcggcaucgcgcgcggcggcca

SEQ ID NO: 2883772 - RNA, 21 nt, Mycobacterium avium subsp. paratuberculosis
ggcggcauguucgaugcgguc

SEQ ID NO: 2883773 - RNA, 17 nt, Mycobacterium avium subsp. paratuberculosis
ggcggccaacaacgcca

SEQ ID NO: 2883774 - RNA, 20 nt, Mycobacterium avium subsp. paratuberculosis
ggcggccaacaacgccaaga

SEQ ID NO: 2883775 - RNA, 14 nt, Mycobacterium avium subsp. paratuberculosis
ggcggccaacgccu

SEQ ID NO: 2883776 - RNA, 20 nt, Mycobacterium avium subsp. paratuberculosis
ggcggccaacgccucgucga

SEQ ID NO: 2883777 - RNA, 14 nt, Mycobacterium avium subsp. paratuberculosis
ggcggccaacgcga

SEQ ID NO: 2883778 - RNA, 21 nt, Mycobacterium avium subsp. paratuberculosis
ggcggccacacuggccaugcu

SEQ ID NO: 2883779 - RNA, 18 nt, Mycobacterium avium subsp. paratuberculosis
ggcggccaccaacggcag

SEQ ID NO: 2883780 - RNA, 20 nt, Mycobacterium avium subsp. paratuberculosis
ggcggccaccaacggcagca

SEQ ID NO: 2883781 - RNA, 14 nt, Mycobacterium avium subsp. paratuberculosis
ggcggccaccacuu

SEQ ID NO: 2883782 - RNA, 16 nt, Mycobacterium avium subsp. paratuberculosis
ggcggccaccacuucc

SEQ ID NO: 2883783 - RNA, 17 nt, Mycobacterium avium subsp. paratuberculosis
ggcggccaccagccggc

SEQ ID NO: 2883784 - RNA, 19 nt, Mycobacterium avium subsp. paratuberculosis
ggcggccaccagccggccg

SEQ ID NO: 2883785 - RNA, 16 nt, Mycobacterium avium subsp. paratuberculosis
ggcggccaccaugccg

SEQ ID NO: 2883786 - RNA, 23 nt, Mycobacterium avium subsp. paratuberculosis
ggcggccaccaugccggcgucca

SEQ ID NO: 2883787 - RNA, 12 nt, Mycobacterium avium subsp. paratuberculosis
ggcggccaccgc

SEQ ID NO: 2883788 - RNA, 13 nt, Mycobacterium avium subsp. paratuberculosis
ggcggccaccgcg

SEQ ID NO: 2883789 - RNA, 14 nt, Mycobacterium avium subsp. paratuberculosis
ggcggccaccgcgc

SEQ ID NO: 2883790 - RNA, 15 nt, Mycobacterium avium subsp. paratuberculosis
ggcggccaccgcgcc

SEQ ID NO: 2883791 - RNA, 16 nt, Mycobacterium avium subsp. paratuberculosis
ggcggccaccgcgccc

SEQ ID NO: 2883792 - RNA, 22 nt, Mycobacterium avium subsp. paratuberculosis
ggcggccaccgcgccccggcgc

SEQ ID NO: 2883793 - RNA, 22 nt, Mycobacterium avium subsp. paratuberculosis
ggcggccaccgcgccgugggcg

SEQ ID NO: 2883794 - RNA, 13 nt, Mycobacterium avium subsp. paratuberculosis
ggcggccgcccgg

SEQ ID NO: 2883795 - RNA, 16 nt, Mycobacterium avium subsp. paratuberculosis
ggcggccgccgcccgc

SEQ ID NO: 2883796 - RNA, 18 nt, Mycobacterium avium subsp. paratuberculosis
ggcggccgccgcccgcgc

SEQ ID NO: 2883797 - RNA, 22 nt, Mycobacterium avium subsp. paratuberculosis
ggcggccgccgcccgcgcggcg

SEQ ID NO: 2883798 - RNA, 15 nt, Mycobacterium avium subsp. paratuberculosis
ggcggccgccgcgau

SEQ ID NO: 2883799 - RNA, 23 nt, Mycobacterium avium subsp. paratuberculosis
ggcggccgccgcgaucagggccc

SEQ ID NO: 2883800 - RNA, 12 nt, Mycobacterium avium subsp. paratuberculosis
ggcggccgccgg

SEQ ID NO: 2883801 - RNA, 15 nt, Mycobacterium avium subsp. paratuberculosis
ggcggccgccggcac

SEQ ID NO: 2883802 - RNA, 13 nt, Mycobacterium avium subsp. paratuberculosis
ggcggccgccggg

SEQ ID NO: 2883803 - RNA, 15 nt, Mycobacterium avium subsp. paratuberculosis
ggcggccgccgggcc

SEQ ID NO: 2883804 - RNA, 19 nt, Mycobacterium avium subsp. paratuberculosis
ggcggccgccgggccggcg

SEQ ID NO: 2883805 - RNA, 20 nt, Mycobacterium avium subsp. paratuberculosis
ggcggccgccgggccggcgg

SEQ ID NO: 2883806 - RNA, 21 nt, Mycobacterium avium subsp. paratuberculosis
ggcggccgccgggccggcggc

SEQ ID NO: 2883807 - RNA, 23 nt, Mycobacterium avium subsp. paratuberculosis
ggcggccgccgggccggcggcca

SEQ ID NO: 2883808 - RNA, 18 nt, Mycobacterium avium subsp. paratuberculosis
ggcggccgcgacggacca

SEQ ID NO: 2883809 - RNA, 22 nt, Mycobacterium avium subsp. paratuberculosis
ggcggccgcgacggaccagugc

SEQ ID NO: 2883810 - RNA, 15 nt, Mycobacterium avium subsp. paratuberculosis
ggcggccgcgagccc

SEQ ID NO: 2883811 - RNA, 19 nt, Mycobacterium avium subsp. paratuberculosis
ggcggccgcgagcccggcg

SEQ ID NO: 2883812 - RNA, 18 nt, Mycobacterium avium subsp. paratuberculosis
ggcggccgcggacccgac

SEQ ID NO: 2883813 - RNA, 16 nt, Mycobacterium avium subsp. paratuberculosis
ggcggccgcgucgccg

SEQ ID NO: 2883814 - RNA, 19 nt, Mycobacterium avium subsp. paratuberculosis
ggcggccgcgucgccgauc

SEQ ID NO: 2883815 - RNA, 22 nt, Mycobacterium avium subsp. paratuberculosis
ggcggccgcgucggcggucgcc

SEQ ID NO: 2883816 - RNA, 23 nt, Mycobacterium avium subsp. paratuberculosis
ggcggccgcgucggcggucgcca

SEQ ID NO: 2883817 - RNA, 23 nt, Mycobacterium avium subsp. paratuberculosis
ggcggccgcuaguuggugcuggg

SEQ ID NO: 2883818 - RNA, 14 nt, Mycobacterium avium subsp. paratuberculosis
ggcggccggagccg

SEQ ID NO: 2883819 - RNA, 16 nt, Mycobacterium avium subsp. paratuberculosis
ggcggccggagccgac

SEQ ID NO: 2883820 - RNA, 14 nt, Mycobacterium avium subsp. paratuberculosis
ggcggccggccagc

SEQ ID NO: 2883821 - RNA, 15 nt, Mycobacterium avium subsp. paratuberculosis
ggcggccggccagca

SEQ ID NO: 2883822 - RNA, 13 nt, Mycobacterium avium subsp. paratuberculosis
ggcggccggcccc

SEQ ID NO: 2883823 - RNA, 14 nt, Mycobacterium avium subsp. paratuberculosis
ggcggccggccccg

SEQ ID NO: 2883824 - RNA, 20 nt, Mycobacterium avium subsp. paratuberculosis
ggcggccggccccggccggg

SEQ ID NO: 2883825 - RNA, 16 nt, Mycobacterium avium subsp. paratuberculosis
ggcggccggcccggcc

SEQ ID NO: 2883826 - RNA, 20 nt, Mycobacterium avium subsp. paratuberculosis
ggcggccggcccggcccgac

SEQ ID NO: 2883827 - RNA, 13 nt, Mycobacterium avium subsp. paratuberculosis
ggcggccggccgc

SEQ ID NO: 2883828 - RNA, 14 nt, Mycobacterium avium subsp. paratuberculosis
ggcggccggccgcg

SEQ ID NO: 2883829 - RNA, 17 nt, Mycobacterium avium subsp. paratuberculosis
ggcggccggccgcgccc

SEQ ID NO: 2883830 - RNA, 18 nt, Mycobacterium avium subsp. paratuberculosis
ggcggccggccgcgccca

SEQ ID NO: 2883831 - RNA, 16 nt, Mycobacterium avium subsp. paratuberculosis
ggcggccggccgcgcg

SEQ ID NO: 2883832 - RNA, 12 nt, Mycobacterium avium subsp. paratuberculosis
ggcggccggcgc

SEQ ID NO: 2883833 - RNA, 19 nt, Mycobacterium avium subsp. paratuberculosis
ggcggccggcgccgaccga

SEQ ID NO: 2883834 - RNA, 14 nt, Mycobacterium avium subsp. paratuberculosis
ggcggccggcggca

SEQ ID NO: 2883835 - RNA, 20 nt, Mycobacterium avium subsp. paratuberculosis
ggcggccgggaucuggccgg

SEQ ID NO: 2883836 - RNA, 21 nt, Mycobacterium avium subsp. paratuberculosis
ggcggccgggaucuggccggu

SEQ ID NO: 2883837 - RNA, 19 nt, Mycobacterium avium subsp. paratuberculosis
ggcggccgggccgcggcgg

SEQ ID NO: 2883838 - RNA, 11 nt, Mycobacterium avium subsp. paratuberculosis
ggcggccgggg

SEQ ID NO: 2883839 - RNA, 13 nt, Mycobacterium avium subsp. paratuberculosis
ggcggccggggug

SEQ ID NO: 2883840 - RNA, 13 nt, Mycobacterium avium subsp. paratuberculosis
ggcggccgggugu

SEQ ID NO: 2883841 - RNA, 20 nt, Mycobacterium avium subsp. paratuberculosis
ggcggccggguguagcuggg

SEQ ID NO: 2883842 - RNA, 14 nt, Mycobacterium avium subsp. paratuberculosis
ggcggccgucgcgc

SEQ ID NO: 2883843 - RNA, 18 nt, Mycobacterium avium subsp. paratuberculosis
ggcggccgucgcgcacca

SEQ ID NO: 2883844 - RNA, 20 nt, Mycobacterium avium subsp. paratuberculosis
ggcggccgucuugcccggcg

SEQ ID NO: 2883845 - RNA, 17 nt, Mycobacterium avium subsp. paratuberculosis
ggcggccguggucgaug

SEQ ID NO: 2883846 - RNA, 17 nt, Mycobacterium avium subsp. paratuberculosis
ggcggccucgccgucga

SEQ ID NO: 2883847 - RNA, 13 nt, Mycobacterium avium subsp. paratuberculosis
ggcggccucggcg

SEQ ID NO: 2883848 - RNA, 15 nt, Mycobacterium avium subsp. paratuberculosis
ggcggccucggcguc

SEQ ID NO: 2883849 - RNA, 20 nt, Mycobacterium avium subsp. paratuberculosis
ggcggccucggcguccgcgg

SEQ ID NO: 2883850 - RNA, 16 nt, Mycobacterium avium subsp. paratuberculosis
ggcggccucggugcuc

SEQ ID NO: 2883851 - RNA, 17 nt, Mycobacterium avium subsp. paratuberculosis
ggcggccugagccgccg

SEQ ID NO: 2883852 - RNA, 18 nt, Mycobacterium avium subsp. paratuberculosis
ggcggccugcacccaggu

SEQ ID NO: 2883853 - RNA, 21 nt, Mycobacterium avium subsp. paratuberculosis
ggcggccugcacccaggucau

SEQ ID NO: 2883854 - RNA, 14 nt, Mycobacterium avium subsp. paratuberculosis
ggcggccugcgcca

SEQ ID NO: 2883855 - RNA, 14 nt, Mycobacterium avium subsp. paratuberculosis
ggcggccugcggcg

SEQ ID NO: 2883856 - RNA, 16 nt, Mycobacterium avium subsp. paratuberculosis
ggcggccugcggcggc

SEQ ID NO: 2883857 - RNA, 17 nt, Mycobacterium avium subsp. paratuberculosis
ggcggccugcggcggca

SEQ ID NO: 2883858 - RNA, 15 nt, Mycobacterium avium subsp. paratuberculosis
ggcggccugcuccag

SEQ ID NO: 2883859 - RNA, 16 nt, Mycobacterium avium subsp. paratuberculosis
ggcggccugcucgcag

SEQ ID NO: 2883860 - RNA, 13 nt, Mycobacterium avium subsp. paratuberculosis
ggcggccugcugc

SEQ ID NO: 2883861 - RNA, 21 nt, Mycobacterium avium subsp. paratuberculosis
ggcggccugcuucucgccguc

SEQ ID NO: 2883862 - RNA, 22 nt, Mycobacterium avium subsp. paratuberculosis
ggcggccugcuucucgccgucg

SEQ ID NO: 2883863 - RNA, 20 nt, Mycobacterium avium subsp. paratuberculosis
ggcggccugcuugaccgcca

SEQ ID NO: 2883864 - RNA, 22 nt, Mycobacterium avium subsp. paratuberculosis
ggcggccugcuugaccgccaga

SEQ ID NO: 2883865 - RNA, 20 nt, Mycobacterium avium subsp. paratuberculosis
ggcggccuggccgucgcggc

SEQ ID NO: 2883866 - RNA, 17 nt, Mycobacterium avium subsp. paratuberculosis
ggcggccuucuuggccg

SEQ ID NO: 2883867 - RNA, 22 nt, Mycobacterium avium subsp. paratuberculosis
ggcggcgaacaccagcacccag

SEQ ID NO: 2883868 - RNA, 17 nt, Mycobacterium avium subsp. paratuberculosis
ggcggcgaacgcgcggu

SEQ ID NO: 2883869 - RNA, 17 nt, Mycobacterium avium subsp. paratuberculosis
ggcggcgaagccggccc

SEQ ID NO: 2883870 - RNA, 23 nt, Mycobacterium avium subsp. paratuberculosis
ggcggcgaagccggccccgcccg

SEQ ID NO: 2883871 - RNA, 12 nt, Mycobacterium avium subsp. paratuberculosis
ggcggcgaauac

SEQ ID NO: 2883872 - RNA, 18 nt, Mycobacterium avium subsp. paratuberculosis
ggcggcgaauaccagggc

SEQ ID NO: 2883873 - RNA, 18 nt, Mycobacterium avium subsp. paratuberculosis
ggcggcgaaugccugacg

SEQ ID NO: 2883874 - RNA, 13 nt, Mycobacterium avium subsp. paratuberculosis
ggcggcgacacgc

SEQ ID NO: 2883875 - RNA, 18 nt, Mycobacterium avium subsp. paratuberculosis
ggcggcgacacgccgacg

SEQ ID NO: 2883876 - RNA, 16 nt, Mycobacterium avium subsp. paratuberculosis
ggcggcgacaucgaug

SEQ ID NO: 2883877 - RNA, 23 nt, Mycobacterium avium subsp. paratuberculosis
ggcggcgaccaaugcccugaccc

SEQ ID NO: 2883878 - RNA, 13 nt, Mycobacterium avium subsp. paratuberculosis
ggcggcgaccgcg

SEQ ID NO: 2883879 - RNA, 20 nt, Mycobacterium avium subsp. paratuberculosis
ggcggcggaaucgcaaccag

SEQ ID NO: 2883880 - RNA, 20 nt, Mycobacterium avium subsp. paratuberculosis
ggcggcggaccgucgguguc

SEQ ID NO: 2883881 - RNA, 13 nt, Mycobacterium avium subsp. paratuberculosis
ggcggcggcaccg

SEQ ID NO: 2883882 - RNA, 14 nt, Mycobacterium avium subsp. paratuberculosis
ggcggcggcaccga

SEQ ID NO: 2883883 - RNA, 20 nt, Mycobacterium avium subsp. paratuberculosis
ggcggcggccaccucgccgc

SEQ ID NO: 2883884 - RNA, 13 nt, Mycobacterium avium subsp. paratuberculosis
ggcggcggccagc

SEQ ID NO: 2883885 - RNA, 13 nt, Mycobacterium avium subsp. paratuberculosis
ggcggcggcccgc

SEQ ID NO: 2883886 - RNA, 14 nt, Mycobacterium avium subsp. paratuberculosis
ggcggcggcccgcg

SEQ ID NO: 2883887 - RNA, 16 nt, Mycobacterium avium subsp. paratuberculosis
ggcggcggcccgcgcg

SEQ ID NO: 2883888 - RNA, 13 nt, Mycobacterium avium subsp. paratuberculosis
ggcggcggcccgu

SEQ ID NO: 2883889 - RNA, 17 nt, Mycobacterium avium subsp. paratuberculosis
ggcggcggcccguccgc

SEQ ID NO: 2883890 - RNA, 22 nt, Mycobacterium avium subsp. paratuberculosis
ggcggcggcccguccgccccgc

SEQ ID NO: 2883891 - RNA, 14 nt, Mycobacterium avium subsp. paratuberculosis
ggcggcggccgcgu

SEQ ID NO: 2883892 - RNA, 23 nt, Mycobacterium avium subsp. paratuberculosis
ggcggcggccgcgucgccgaucg

SEQ ID NO: 2883893 - RNA, 14 nt, Mycobacterium avium subsp. paratuberculosis
ggcggcggccuccg

SEQ ID NO: 2883894 - RNA, 12 nt, Mycobacterium avium subsp. paratuberculosis
ggcggcggccug

SEQ ID NO: 2883895 - RNA, 14 nt, Mycobacterium avium subsp. paratuberculosis
ggcggcggccugca

SEQ ID NO: 2883896 - RNA, 13 nt, Mycobacterium avium subsp. paratuberculosis
ggcggcggcgcgc

SEQ ID NO: 2883897 - RNA, 15 nt, Mycobacterium avium subsp. paratuberculosis
ggcggcggcgcgccg

SEQ ID NO: 2883898 - RNA, 15 nt, Mycobacterium avium subsp. paratuberculosis
ggcggcggcgcgugc

SEQ ID NO: 2883899 - RNA, 13 nt, Mycobacterium avium subsp. paratuberculosis
ggcggcggcggca

SEQ ID NO: 2883900 - RNA, 14 nt, Mycobacterium avium subsp. paratuberculosis
ggcggcggcggcag

SEQ ID NO: 2883901 - RNA, 14 nt, Mycobacterium avium subsp. paratuberculosis
ggcggcggcggccg

SEQ ID NO: 2883902 - RNA, 14 nt, Mycobacterium avium subsp. paratuberculosis
ggcggcggcgggaa

SEQ ID NO: 2883903 - RNA, 15 nt, Mycobacterium avium subsp. paratuberculosis
ggcggcggcgggcca

SEQ ID NO: 2883904 - RNA, 14 nt, Mycobacterium avium subsp. paratuberculosis
ggcggcggcguugg

SEQ ID NO: 2883905 - RNA, 19 nt, Mycobacterium avium subsp. paratuberculosis
ggcggcgggagcuaggcgg

SEQ ID NO: 2883906 - RNA, 22 nt, Mycobacterium avium subsp. paratuberculosis
ggcggcgggagcuaggcggccg

SEQ ID NO: 2883907 - RNA, 12 nt, Mycobacterium avium subsp. paratuberculosis
ggcggcgggcca

SEQ ID NO: 2883908 - RNA, 21 nt, Mycobacterium avium subsp. paratuberculosis
ggcggcgggccagggcgagga

SEQ ID NO: 2883909 - RNA, 12 nt, Mycobacterium avium subsp. paratuberculosis
ggcggcgggccc

SEQ ID NO: 2883910 - RNA, 14 nt, Mycobacterium avium subsp. paratuberculosis
ggcggcgggcccgg

SEQ ID NO: 2883911 - RNA, 16 nt, Mycobacterium avium subsp. paratuberculosis
ggcggcgggcccggcg

SEQ ID NO: 2883912 - RNA, 17 nt, Mycobacterium avium subsp. paratuberculosis
ggcggcgggcccggcga

SEQ ID NO: 2883913 - RNA, 13 nt, Mycobacterium avium subsp. paratuberculosis
ggcggcgggcucg

SEQ ID NO: 2883914 - RNA, 14 nt, Mycobacterium avium subsp. paratuberculosis
ggcggcgggggcga

SEQ ID NO: 2883915 - RNA, 17 nt, Mycobacterium avium subsp. paratuberculosis
ggcggcgggggcgagac

SEQ ID NO: 2883916 - RNA, 18 nt, Mycobacterium avium subsp. paratuberculosis
ggcggcgggggcgggccc

SEQ ID NO: 2883917 - RNA, 18 nt, Mycobacterium avium subsp. paratuberculosis
ggcggcggggugacgguc

SEQ ID NO: 2883918 - RNA, 22 nt, Mycobacterium avium subsp. paratuberculosis
ggcggcgguauucgucacccca

SEQ ID NO: 2883919 - RNA, 15 nt, Mycobacterium avium subsp. paratuberculosis
ggcggcggucggcau

SEQ ID NO: 2883920 - RNA, 15 nt, Mycobacterium avium subsp. paratuberculosis
ggcggcggucuucuu

SEQ ID NO: 2883921 - RNA, 15 nt, Mycobacterium avium subsp. paratuberculosis
ggcggcggugagcgc

SEQ ID NO: 2883922 - RNA, 13 nt, Mycobacterium avium subsp. paratuberculosis
ggcggcggugauc

SEQ ID NO: 2883923 - RNA, 24 nt, Mycobacterium avium subsp. paratuberculosis
ggcggcggugaucgccggaucgcc

SEQ ID NO: 2883924 - RNA, 20 nt, Mycobacterium avium subsp. paratuberculosis
ggcggcggugaucucgucgg

SEQ ID NO: 2883925 - RNA, 20 nt, Mycobacterium avium subsp. paratuberculosis
ggcggcggugcucucgucgu

SEQ ID NO: 2883926 - RNA, 13 nt, Mycobacterium avium subsp. paratuberculosis
ggcggcgguggcc

SEQ ID NO: 2883927 - RNA, 16 nt, Mycobacterium avium subsp. paratuberculosis
ggcggcgguggccugg

SEQ ID NO: 2883928 - RNA, 11 nt, Mycobacterium avium subsp. paratuberculosis
ggcggcggugu

SEQ ID NO: 2883929 - RNA, 19 nt, Mycobacterium avium subsp. paratuberculosis
ggcggcggugucgcccagc

SEQ ID NO: 2883930 - RNA, 20 nt, Mycobacterium avium subsp. paratuberculosis
ggcggcguagucggcgcagc

SEQ ID NO: 2883931 - RNA, 23 nt, Mycobacterium avium subsp. paratuberculosis
ggcggcgucccacguggugauca

SEQ ID NO: 2883932 - RNA, 23 nt, Mycobacterium avium subsp. paratuberculosis
ggcggcgucccagugcucgacca

SEQ ID NO: 2883933 - RNA, 14 nt, Mycobacterium avium subsp. paratuberculosis
ggcggcguccgcgg

SEQ ID NO: 2883934 - RNA, 17 nt, Mycobacterium avium subsp. paratuberculosis
ggcggcguccgcggccg

SEQ ID NO: 2883935 - RNA, 20 nt, Mycobacterium avium subsp. paratuberculosis
ggcggcguccgcggccgcgg

SEQ ID NO: 2883936 - RNA, 16 nt, Mycobacterium avium subsp. paratuberculosis
ggcggcgucgaccgcc

SEQ ID NO: 2883937 - RNA, 20 nt, Mycobacterium avium subsp. paratuberculosis
ggcggcgucgaccgccccgc

SEQ ID NO: 2883938 - RNA, 19 nt, Mycobacterium avium subsp. paratuberculosis
ggcggcgucgagcaccucc

SEQ ID NO: 2883939 - RNA, 20 nt, Mycobacterium avium subsp. paratuberculosis
ggcggcgucgagcaccucca

SEQ ID NO: 2883940 - RNA, 13 nt, Mycobacterium avium subsp. paratuberculosis
ggcggcgucgagu

SEQ ID NO: 2883941 - RNA, 15 nt, Mycobacterium avium subsp. paratuberculosis
ggcggcgucggcgac

SEQ ID NO: 2883942 - RNA, 21 nt, Mycobacterium avium subsp. paratuberculosis
ggcggcgucguaguugcggcc

SEQ ID NO: 2883943 - RNA, 15 nt, Mycobacterium avium subsp. paratuberculosis
ggcggcgucgucgcc

SEQ ID NO: 2883944 - RNA, 15 nt, Mycobacterium avium subsp. paratuberculosis
ggcggcgucgugacc

SEQ ID NO: 2883945 - RNA, 17 nt, Mycobacterium avium subsp. paratuberculosis
ggcggcgugcaccgccc

SEQ ID NO: 2883946 - RNA, 19 nt, Mycobacterium avium subsp. paratuberculosis
ggcggcgugcaccgcccgc

SEQ ID NO: 2883947 - RNA, 22 nt, Mycobacterium avium subsp. paratuberculosis
ggcggcgugcaccgcccgcgcg

SEQ ID NO: 2883948 - RNA, 20 nt, Mycobacterium avium subsp. paratuberculosis
ggcggcgugccagggcagcg

SEQ ID NO: 2883949 - RNA, 15 nt, Mycobacterium avium subsp. paratuberculosis
ggcggcgugcccgcu

SEQ ID NO: 2883950 - RNA, 17 nt, Mycobacterium avium subsp. paratuberculosis
ggcggcgugcccgcucg

SEQ ID NO: 2883951 - RNA, 16 nt, Mycobacterium avium subsp. paratuberculosis
ggcggcgugccgcccg

SEQ ID NO: 2883952 - RNA, 21 nt, Mycobacterium avium subsp. paratuberculosis
ggcggcgugggguucccggcc

SEQ ID NO: 2883953 - RNA, 17 nt, Mycobacterium avium subsp. paratuberculosis
ggcggcguuggccgccg

SEQ ID NO: 2883954 - RNA, 23 nt, Mycobacterium avium subsp. paratuberculosis
ggcggcucagcaacccgccgagc

SEQ ID NO: 2883955 - RNA, 18 nt, Mycobacterium avium subsp. paratuberculosis
ggcggcuccgaucuccug

SEQ ID NO: 2883956 - RNA, 15 nt, Mycobacterium avium subsp. paratuberculosis
ggcggcucgccggcg

SEQ ID NO: 2883957 - RNA, 15 nt, Mycobacterium avium subsp. paratuberculosis
ggcggcucggcggcg

SEQ ID NO: 2883958 - RNA, 16 nt, Mycobacterium avium subsp. paratuberculosis
ggcggcucggcggcgu

SEQ ID NO: 2883959 - RNA, 12 nt, Mycobacterium avium subsp. paratuberculosis
ggcggcucgggg

SEQ ID NO: 2883960 - RNA, 15 nt, Mycobacterium avium subsp. paratuberculosis
ggcggcucgggggug

SEQ ID NO: 2883961 - RNA, 17 nt, Mycobacterium avium subsp. paratuberculosis
ggcggcucggggguguc

SEQ ID NO: 2883962 - RNA, 22 nt, Mycobacterium avium subsp. paratuberculosis
ggcggcugaaccaccgcgccca

SEQ ID NO: 2883963 - RNA, 15 nt, Mycobacterium avium subsp. paratuberculosis
ggcggcugggccgcg

SEQ ID NO: 2883964 - RNA, 14 nt, Mycobacterium avium subsp. paratuberculosis
ggcggggccgguga

SEQ ID NO: 2883965 - RNA, 21 nt, Mycobacterium avium subsp. paratuberculosis
ggcggggccuccaccagcggc

SEQ ID NO: 2883966 - RNA, 14 nt, Mycobacterium avium subsp. paratuberculosis
ggcggggcgucgcc

SEQ ID NO: 2883967 - RNA, 12 nt, Mycobacterium avium subsp. paratuberculosis
ggcggggcgucu

SEQ ID NO: 2883968 - RNA, 14 nt, Mycobacterium avium subsp. paratuberculosis
ggcggggcgugccc

SEQ ID NO: 2883969 - RNA, 17 nt, Mycobacterium avium subsp. paratuberculosis
ggcgggggagccgugca

SEQ ID NO: 2883970 - RNA, 16 nt, Mycobacterium avium subsp. paratuberculosis
ggcgggggauccgccu

SEQ ID NO: 2883971 - RNA, 21 nt, Mycobacterium avium subsp. paratuberculosis
ggcgggggauccgccugcgcg

SEQ ID NO: 2883972 - RNA, 17 nt, Mycobacterium avium subsp. paratuberculosis
ggcgggggaucggcggg

SEQ ID NO: 2883973 - RNA, 14 nt, Mycobacterium avium subsp. paratuberculosis
ggcgggggcaggga

SEQ ID NO: 2883974 - RNA, 15 nt, Mycobacterium avium subsp. paratuberculosis
ggcgggggcggcggg

SEQ ID NO: 2883975 - RNA, 15 nt, Mycobacterium avium subsp. paratuberculosis
ggcgggggcgggccc

SEQ ID NO: 2883976 - RNA, 18 nt, Mycobacterium avium subsp. paratuberculosis
ggcggggguucgacguca

SEQ ID NO: 2883977 - RNA, 23 nt, Mycobacterium avium subsp. paratuberculosis
ggcggggguucguugcgccgcca

SEQ ID NO: 2883978 - RNA, 18 nt, Mycobacterium avium subsp. paratuberculosis
ggcgggguccacgcagug

SEQ ID NO: 2883979 - RNA, 12 nt, Mycobacterium avium subsp. paratuberculosis
ggcggggucuca

SEQ ID NO: 2883980 - RNA, 20 nt, Mycobacterium avium subsp. paratuberculosis
ggcggggugcgcggcgagcg

SEQ ID NO: 2883981 - RNA, 16 nt, Mycobacterium avium subsp. paratuberculosis
ggcgggguggccacca

SEQ ID NO: 2883982 - RNA, 17 nt, Mycobacterium avium subsp. paratuberculosis
ggcggggugggcaccug

SEQ ID NO: 2883983 - RNA, 18 nt, Mycobacterium avium subsp. paratuberculosis
ggcgggguuccgucgaac

SEQ ID NO: 2883984 - RNA, 16 nt, Mycobacterium avium subsp. paratuberculosis
ggcggguacagccgca

SEQ ID NO: 2883985 - RNA, 19 nt, Mycobacterium avium subsp. paratuberculosis
ggcggguagaaccagcccg

SEQ ID NO: 2883986 - RNA, 22 nt, Mycobacterium avium subsp. paratuberculosis
ggcggguagaaccagcccggcc

SEQ ID NO: 2883987 - RNA, 21 nt, Mycobacterium avium subsp. paratuberculosis
ggcggguaggcgucgcgcagc

SEQ ID NO: 2883988 - RNA, 17 nt, Mycobacterium avium subsp. paratuberculosis
ggcggguaugucggcga

SEQ ID NO: 2883989 - RNA, 17 nt, Mycobacterium avium subsp. paratuberculosis
ggcgggucagcacccgc

SEQ ID NO: 2883990 - RNA, 14 nt, Mycobacterium avium subsp. paratuberculosis
ggcgggucagcagc

SEQ ID NO: 2883991 - RNA, 18 nt, Mycobacterium avium subsp. paratuberculosis
ggcgggucgucgaugccc

SEQ ID NO: 2883992 - RNA, 13 nt, Mycobacterium avium subsp. paratuberculosis
ggcgggucuguga

SEQ ID NO: 2883993 - RNA, 19 nt, Mycobacterium avium subsp. paratuberculosis
ggcgggucugugaccacgg

SEQ ID NO: 2883994 - RNA, 14 nt, Mycobacterium avium subsp. paratuberculosis
ggcgggugagccgg

SEQ ID NO: 2883995 - RNA, 15 nt, Mycobacterium avium subsp. paratuberculosis
ggcggguggcgauga

SEQ ID NO: 2883996 - RNA, 13 nt, Mycobacterium avium subsp. paratuberculosis
ggcgggugggggu

SEQ ID NO: 2883997 - RNA, 23 nt, Mycobacterium avium subsp. paratuberculosis
ggcggguguauucgcccaccccg

SEQ ID NO: 2883998 - RNA, 20 nt, Mycobacterium avium subsp. paratuberculosis
ggcggguugcugagccgccg

SEQ ID NO: 2883999 - RNA, 23 nt, Mycobacterium avium subsp. paratuberculosis
ggcggguugcugagccgccgagc

SEQ ID NO: 2884000 - RNA, 16 nt, Mycobacterium avium subsp. paratuberculosis
ggcggguuggugucga

SEQ ID NO: 2884001 - RNA, 22 nt, Mycobacterium avium subsp. paratuberculosis
ggcgguaccgaacgacgagccg

SEQ ID NO: 2884002 - RNA, 17 nt, Mycobacterium avium subsp. paratuberculosis
ggcgguaccgccgaucg

SEQ ID NO: 2884003 - RNA, 18 nt, Mycobacterium avium subsp. paratuberculosis
ggcgguacgcgccgcgcg

SEQ ID NO: 2884004 - RNA, 22 nt, Mycobacterium avium subsp. paratuberculosis
ggcgguacgcgccgcgcgcccu

SEQ ID NO: 2884005 - RNA, 13 nt, Mycobacterium avium subsp. paratuberculosis
ggcgguaucggug

SEQ ID NO: 2884006 - RNA, 19 nt, Mycobacterium avium subsp. paratuberculosis
ggcgguaucgguggauccg

SEQ ID NO: 2884007 - RNA, 15 nt, Mycobacterium avium subsp. paratuberculosis
ggcgguaugcccggg

SEQ ID NO: 2884008 - RNA, 16 nt, Mycobacterium avium subsp. paratuberculosis
ggcgguaugcccgggc

SEQ ID NO: 2884009 - RNA, 20 nt, Mycobacterium avium subsp. paratuberculosis
ggcgguaugcccgggccguc

SEQ ID NO: 2884010 - RNA, 22 nt, Mycobacterium avium subsp. paratuberculosis
ggcggucaacacgaagccggug

SEQ ID NO: 2884011 - RNA, 16 nt, Mycobacterium avium subsp. paratuberculosis
ggcggucaccaaggcg

SEQ ID NO: 2884012 - RNA, 22 nt, Mycobacterium avium subsp. paratuberculosis
ggcggucaccaaggcgauuucg

SEQ ID NO: 2884013 - RNA, 17 nt, Mycobacterium avium subsp. paratuberculosis
ggcggucagcaccguca

SEQ ID NO: 2884014 - RNA, 20 nt, Mycobacterium avium subsp. paratuberculosis
ggcggucagcauggcgauga

SEQ ID NO: 2884015 - RNA, 14 nt, Mycobacterium avium subsp. paratuberculosis
ggcggucaggccgu

SEQ ID NO: 2884016 - RNA, 19 nt, Mycobacterium avium subsp. paratuberculosis
ggcggucaggccgucucga

SEQ ID NO: 2884017 - RNA, 23 nt, Mycobacterium avium subsp. paratuberculosis
ggcggucauugaucuccgcggcg

SEQ ID NO: 2884018 - RNA, 15 nt, Mycobacterium avium subsp. paratuberculosis
ggcgguccaccacca

SEQ ID NO: 2884019 - RNA, 17 nt, Mycobacterium avium subsp. paratuberculosis
ggcgguccaccaccaca

SEQ ID NO: 2884020 - RNA, 20 nt, Mycobacterium avium subsp. paratuberculosis
ggcgguccaccaccacaccc

SEQ ID NO: 2884021 - RNA, 22 nt, Mycobacterium avium subsp. paratuberculosis
ggcgguccaccaccacacccgc

SEQ ID NO: 2884022 - RNA, 18 nt, Mycobacterium avium subsp. paratuberculosis
ggcgguccaccgacgcca

SEQ ID NO: 2884023 - RNA, 23 nt, Mycobacterium avium subsp. paratuberculosis
ggcgguccaccgacgccacgucg

SEQ ID NO: 2884024 - RNA, 19 nt, Mycobacterium avium subsp. paratuberculosis
ggcgguccaguacaccgcg

SEQ ID NO: 2884025 - RNA, 20 nt, Mycobacterium avium subsp. paratuberculosis
ggcgguccaguacaccgcga

SEQ ID NO: 2884026 - RNA, 14 nt, Mycobacterium avium subsp. paratuberculosis
ggcggucccgcaug

SEQ ID NO: 2884027 - RNA, 15 nt, Mycobacterium avium subsp. paratuberculosis
ggcggucccggcgga

SEQ ID NO: 2884028 - RNA, 16 nt, Mycobacterium avium subsp. paratuberculosis
ggcggucccggcggac

SEQ ID NO: 2884029 - RNA, 21 nt, Mycobacterium avium subsp. paratuberculosis
ggcggucccgugcgccgccca

SEQ ID NO: 2884030 - RNA, 22 nt, Mycobacterium avium subsp. paratuberculosis
ggcggucccgugcgccgcccac

SEQ ID NO: 2884031 - RNA, 15 nt, Mycobacterium avium subsp. paratuberculosis
ggcgguccgacaccg

SEQ ID NO: 2884032 - RNA, 13 nt, Mycobacterium avium subsp. paratuberculosis
ggcgguccgccgc

SEQ ID NO: 2884033 - RNA, 19 nt, Mycobacterium avium subsp. paratuberculosis
ggcgguccgccgcagcggc

SEQ ID NO: 2884034 - RNA, 17 nt, Mycobacterium avium subsp. paratuberculosis
ggcgguccgcuccacca

SEQ ID NO: 2884035 - RNA, 18 nt, Mycobacterium avium subsp. paratuberculosis
ggcgguccugcggcgaca

SEQ ID NO: 2884036 - RNA, 14 nt, Mycobacterium avium subsp. paratuberculosis
ggcggucgaacgcg

SEQ ID NO: 2884037 - RNA, 18 nt, Mycobacterium avium subsp. paratuberculosis
ggcggucgaacgcggcgc

SEQ ID NO: 2884038 - RNA, 21 nt, Mycobacterium avium subsp. paratuberculosis
ggcggucgaacgcggcgccga

SEQ ID NO: 2884039 - RNA, 20 nt, Mycobacterium avium subsp. paratuberculosis
ggcggucgacuggucgucga

SEQ ID NO: 2884040 - RNA, 21 nt, Mycobacterium avium subsp. paratuberculosis
ggcggucgacuggucgucgag

SEQ ID NO: 2884041 - RNA, 14 nt, Mycobacterium avium subsp. paratuberculosis
ggcggucgccagcg

SEQ ID NO: 2884042 - RNA, 12 nt, Mycobacterium avium subsp. paratuberculosis
ggcggucgccga

SEQ ID NO: 2884043 - RNA, 12 nt, Mycobacterium avium subsp. paratuberculosis
ggcggucgcgcc

SEQ ID NO: 2884044 - RNA, 15 nt, Mycobacterium avium subsp. paratuberculosis
ggcggucgcgcgccg

SEQ ID NO: 2884045 - RNA, 18 nt, Mycobacterium avium subsp. paratuberculosis
ggcggucgcgcgccggcg

SEQ ID NO: 2884046 - RNA, 20 nt, Mycobacterium avium subsp. paratuberculosis
ggcggucgcgcgccggcgca

SEQ ID NO: 2884047 - RNA, 17 nt, Mycobacterium avium subsp. paratuberculosis
ggcggucgcggugccca

SEQ ID NO: 2884048 - RNA, 17 nt, Mycobacterium avium subsp. paratuberculosis
ggcggucgcugaccccg

SEQ ID NO: 2884049 - RNA, 17 nt, Mycobacterium avium subsp. paratuberculosis
ggcguacugcucggcgc

SEQ ID NO: 2884050 - RNA, 21 nt, Mycobacterium avium subsp. paratuberculosis
ggcguacugcucggcgcggcu

SEQ ID NO: 2884051 - RNA, 19 nt, Mycobacterium avium subsp. paratuberculosis
ggcguagaccagcgacgcc

SEQ ID NO: 2884052 - RNA, 20 nt, Mycobacterium avium subsp. paratuberculosis
ggcguagaccagcgacgcca

SEQ ID NO: 2884053 - RNA, 14 nt, Mycobacterium avium subsp. paratuberculosis
ggcguagagccgcu

SEQ ID NO: 2884054 - RNA, 23 nt, Mycobacterium avium subsp. paratuberculosis
ggcguagaucugcacgcuguugg

SEQ ID NO: 2884055 - RNA, 21 nt, Mycobacterium avium subsp. paratuberculosis
ggcguagcgccagucgcggcg

SEQ ID NO: 2884056 - RNA, 17 nt, Mycobacterium avium subsp. paratuberculosis
ggcguagcgggucagcu

SEQ ID NO: 2884057 - RNA, 15 nt, Mycobacterium avium subsp. paratuberculosis
ggcguaggcggccau

SEQ ID NO: 2884058 - RNA, 15 nt, Mycobacterium avium subsp. paratuberculosis
ggcguagggcagccc

SEQ ID NO: 2884059 - RNA, 20 nt, Mycobacterium avium subsp. paratuberculosis
ggcguagggcagcccgagca

SEQ ID NO: 2884060 - RNA, 23 nt, Mycobacterium avium subsp. paratuberculosis
ggcguaggugggcagcgcggcca

SEQ ID NO: 2884061 - RNA, 21 nt, Mycobacterium avium subsp. paratuberculosis
ggcguagucgauggccucguc

SEQ ID NO: 2884062 - RNA, 15 nt, Mycobacterium avium subsp. paratuberculosis
ggcguagucgucgau

SEQ ID NO: 2884063 - RNA, 13 nt, Mycobacterium avium subsp. paratuberculosis
ggcguagugcgcc

SEQ ID NO: 2884064 - RNA, 18 nt, Mycobacterium avium subsp. paratuberculosis
ggcguagugggucggcgg

SEQ ID NO: 2884065 - RNA, 14 nt, Mycobacterium avium subsp. paratuberculosis
ggcguaguggugca

SEQ ID NO: 2884066 - RNA, 19 nt, Mycobacterium avium subsp. paratuberculosis
ggcguaguggugcaggugc

SEQ ID NO: 2884067 - RNA, 18 nt, Mycobacterium avium subsp. paratuberculosis
ggcguaguucgucgaaca

SEQ ID NO: 2884068 - RNA, 22 nt, Mycobacterium avium subsp. paratuberculosis
ggcguaucaacugagcgcccgg

SEQ ID NO: 2884069 - RNA, 19 nt, Mycobacterium avium subsp. paratuberculosis
ggcguaucuccaccgucga

SEQ ID NO: 2884070 - RNA, 17 nt, Mycobacterium avium subsp. paratuberculosis
ggcguaugccuccucgg

SEQ ID NO: 2884071 - RNA, 18 nt, Mycobacterium avium subsp. paratuberculosis
ggcguaugccuccucggu

SEQ ID NO: 2884072 - RNA, 19 nt, Mycobacterium avium subsp. paratuberculosis
ggcguauucggcgcgcaac

SEQ ID NO: 2884073 - RNA, 20 nt, Mycobacterium avium subsp. paratuberculosis
ggcguauucgucgucggccu

SEQ ID NO: 2884074 - RNA, 22 nt, Mycobacterium avium subsp. paratuberculosis
ggcguauucgucgucggccucg

SEQ ID NO: 2884075 - RNA, 22 nt, Mycobacterium avium subsp. paratuberculosis
ggcgucaccaggcugcucggcg

SEQ ID NO: 2884076 - RNA, 13 nt, Mycobacterium avium subsp. paratuberculosis
ggcgucaccgcgg

SEQ ID NO: 2884077 - RNA, 17 nt, Mycobacterium avium subsp. paratuberculosis
ggcgucaccgcggguga

SEQ ID NO: 2884078 - RNA, 24 nt, Mycobacterium avium subsp. paratuberculosis
ggcgucacgcaucagggccagccg

SEQ ID NO: 2884079 - RNA, 14 nt, Mycobacterium avium subsp. paratuberculosis
ggcgucacgccagc

SEQ ID NO: 2884080 - RNA, 15 nt, Mycobacterium avium subsp. paratuberculosis
ggcgucacgccagcg

SEQ ID NO: 2884081 - RNA, 18 nt, Mycobacterium avium subsp. paratuberculosis
ggcgucacgccagcguga

SEQ ID NO: 2884082 - RNA, 16 nt, Mycobacterium avium subsp. paratuberculosis
ggcgucacgcugcgcg

SEQ ID NO: 2884083 - RNA, 17 nt, Mycobacterium avium subsp. paratuberculosis
ggcgucacgcugcgcgc

SEQ ID NO: 2884084 - RNA, 18 nt, Mycobacterium avium subsp. paratuberculosis
ggcgucacgcugcgcgcc

SEQ ID NO: 2884085 - RNA, 19 nt, Mycobacterium avium subsp. paratuberculosis
ggcgucacgcuggcgugac

SEQ ID NO: 2884086 - RNA, 18 nt, Mycobacterium avium subsp. paratuberculosis
ggcgucacguccaucaug

SEQ ID NO: 2884087 - RNA, 15 nt, Mycobacterium avium subsp. paratuberculosis
ggcgucacucuggcg

SEQ ID NO: 2884088 - RNA, 17 nt, Mycobacterium avium subsp. paratuberculosis
ggcgucacucuggcgug

SEQ ID NO: 2884089 - RNA, 18 nt, Mycobacterium avium subsp. paratuberculosis
ggcgucacucuggcguga

SEQ ID NO: 2884090 - RNA, 19 nt, Mycobacterium avium subsp. paratuberculosis
ggcgucacucuggcgugac

SEQ ID NO: 2884091 - RNA, 15 nt, Mycobacterium avium subsp. paratuberculosis
ggcgucagagguugg

SEQ ID NO: 2884092 - RNA, 13 nt, Mycobacterium avium subsp. paratuberculosis
ggcgucaggcgcu

SEQ ID NO: 2884093 - RNA, 20 nt, Mycobacterium avium subsp. paratuberculosis
ggcgucaggcgcugggugcg

SEQ ID NO: 2884094 - RNA, 22 nt, Mycobacterium avium subsp. paratuberculosis
ggcgucaggcgcugggugcggg

SEQ ID NO: 2884095 - RNA, 15 nt, Mycobacterium avium subsp. paratuberculosis
ggcgucagggguugg

SEQ ID NO: 2884096 - RNA, 23 nt, Mycobacterium avium subsp. paratuberculosis
ggcgucagggguuggcgcgcaga

SEQ ID NO: 2884097 - RNA, 21 nt, Mycobacterium avium subsp. paratuberculosis
ggcgucaucguggacaggagg

SEQ ID NO: 2884098 - RNA, 20 nt, Mycobacterium avium subsp. paratuberculosis
ggcguccaaugcgccgaugg

SEQ ID NO: 2884099 - RNA, 13 nt, Mycobacterium avium subsp. paratuberculosis
ggcguccaccagc

SEQ ID NO: 2884100 - RNA, 23 nt, Mycobacterium avium subsp. paratuberculosis
ggcguccaccagcacgccguuga

SEQ ID NO: 2884101 - RNA, 14 nt, Mycobacterium avium subsp. paratuberculosis
ggcguccaccgaca

SEQ ID NO: 2884102 - RNA, 17 nt, Mycobacterium avium subsp. paratuberculosis
ggcguccaccggucgac

SEQ ID NO: 2884103 - RNA, 18 nt, Mycobacterium avium subsp. paratuberculosis
ggcguccagaugccguuc

SEQ ID NO: 2884104 - RNA, 12 nt, Mycobacterium avium subsp. paratuberculosis
ggcguccagcac

SEQ ID NO: 2884105 - RNA, 13 nt, Mycobacterium avium subsp. paratuberculosis
ggcguccagcacc

SEQ ID NO: 2884106 - RNA, 20 nt, Mycobacterium avium subsp. paratuberculosis
ggcguccagcaccugcucga

SEQ ID NO: 2884107 - RNA, 22 nt, Mycobacterium avium subsp. paratuberculosis
ggcguccagcaccugcucgaug

SEQ ID NO: 2884108 - RNA, 13 nt, Mycobacterium avium subsp. paratuberculosis
ggcguccagccag

SEQ ID NO: 2884109 - RNA, 19 nt, Mycobacterium avium subsp. paratuberculosis
ggcguccagcgccgccacg

SEQ ID NO: 2884110 - RNA, 13 nt, Mycobacterium avium subsp. paratuberculosis
ggcguccagcgcg

SEQ ID NO: 2884111 - RNA, 17 nt, Mycobacterium avium subsp. paratuberculosis
ggcguccagcggguugc

SEQ ID NO: 2884112 - RNA, 14 nt, Mycobacterium avium subsp. paratuberculosis
ggcguccagcugcg

SEQ ID NO: 2884113 - RNA, 18 nt, Mycobacterium avium subsp. paratuberculosis
ggcguccagcugcgcgcc

SEQ ID NO: 2884114 - RNA, 22 nt, Mycobacterium avium subsp. paratuberculosis
ggcguccagcugcgcgccggcg

SEQ ID NO: 2884115 - RNA, 18 nt, Mycobacterium avium subsp. paratuberculosis
ggcguccaggcgcaccgc

SEQ ID NO: 2884116 - RNA, 22 nt, Mycobacterium avium subsp. paratuberculosis
ggcguccaggcgcaccgccacc

SEQ ID NO: 2884117 - RNA, 15 nt, Mycobacterium avium subsp. paratuberculosis
ggcguccagggccac

SEQ ID NO: 2884118 - RNA, 17 nt, Mycobacterium avium subsp. paratuberculosis
ggcguccagggccaccg

SEQ ID NO: 2884119 - RNA, 18 nt, Mycobacterium avium subsp. paratuberculosis
ggcguccagggccaccgc

SEQ ID NO: 2884120 - RNA, 15 nt, Mycobacterium avium subsp. paratuberculosis
ggcguccaggucgcc

SEQ ID NO: 2884121 - RNA, 17 nt, Mycobacterium avium subsp. paratuberculosis
ggcguccaggucgcccu

SEQ ID NO: 2884122 - RNA, 22 nt, Mycobacterium avium subsp. paratuberculosis
ggcguccaguagccgccgggcg

SEQ ID NO: 2884123 - RNA, 20 nt, Mycobacterium avium subsp. paratuberculosis
ggcguccaguucggccagcg

SEQ ID NO: 2884124 - RNA, 18 nt, Mycobacterium avium subsp. paratuberculosis
ggcgucccagugcucgac

SEQ ID NO: 2884125 - RNA, 15 nt, Mycobacterium avium subsp. paratuberculosis
ggcguccccggcggu

SEQ ID NO: 2884126 - RNA, 15 nt, Mycobacterium avium subsp. paratuberculosis
ggcgucccgcgccac

SEQ ID NO: 2884127 - RNA, 20 nt, Mycobacterium avium subsp. paratuberculosis
ggcgucccggguaccucugc

SEQ ID NO: 2884128 - RNA, 16 nt, Mycobacterium avium subsp. paratuberculosis
ggcguccgcaagcacc

SEQ ID NO: 2884129 - RNA, 20 nt, Mycobacterium avium subsp. paratuberculosis
ggcguccgcgaacgggugcg

SEQ ID NO: 2884130 - RNA, 14 nt, Mycobacterium avium subsp. paratuberculosis
ggcguccgcggccg

SEQ ID NO: 2884131 - RNA, 15 nt, Mycobacterium avium subsp. paratuberculosis
ggcguccgcggccgc

SEQ ID NO: 2884132 - RNA, 15 nt, Mycobacterium avium subsp. paratuberculosis
ggcguccgcggcgga

SEQ ID NO: 2884133 - RNA, 20 nt, Mycobacterium avium subsp. paratuberculosis
ggcgucggccagcggcagcg

SEQ ID NO: 2884134 - RNA, 21 nt, Mycobacterium avium subsp. paratuberculosis
ggcgucggccagcggcagcga

SEQ ID NO: 2884135 - RNA, 16 nt, Mycobacterium avium subsp. paratuberculosis
ggcgucggccgggcug

SEQ ID NO: 2884136 - RNA, 16 nt, Mycobacterium avium subsp. paratuberculosis
ggcgucggccgggggc

SEQ ID NO: 2884137 - RNA, 17 nt, Mycobacterium avium subsp. paratuberculosis
ggcgucggccgggggcg

SEQ ID NO: 2884138 - RNA, 20 nt, Mycobacterium avium subsp. paratuberculosis
ggcgucggccgggggcgcgg

SEQ ID NO: 2884139 - RNA, 23 nt, Mycobacterium avium subsp. paratuberculosis
ggcgucggccgggggcgcgggcg

SEQ ID NO: 2884140 - RNA, 16 nt, Mycobacterium avium subsp. paratuberculosis
ggcgucggccugcccg

SEQ ID NO: 2884141 - RNA, 16 nt, Mycobacterium avium subsp. paratuberculosis
ggcgucggcgacggcg

SEQ ID NO: 2884142 - RNA, 20 nt, Mycobacterium avium subsp. paratuberculosis
ggcgucggcgacggcgucca

SEQ ID NO: 2884143 - RNA, 23 nt, Mycobacterium avium subsp. paratuberculosis
ggcgucggcgaucucggucaccg

SEQ ID NO: 2884144 - RNA, 23 nt, Mycobacterium avium subsp. paratuberculosis
ggcgucggcgccccccugcucgc

SEQ ID NO: 2884145 - RNA, 15 nt, Mycobacterium avium subsp. paratuberculosis
ggcgucggcgcgcac

SEQ ID NO: 2884146 - RNA, 16 nt, Mycobacterium avium subsp. paratuberculosis
ggcgucggcgcgcacc

SEQ ID NO: 2884147 - RNA, 16 nt, Mycobacterium avium subsp. paratuberculosis
ggcgucggcgcgugcc

SEQ ID NO: 2884148 - RNA, 13 nt, Mycobacterium avium subsp. paratuberculosis
ggcgucggcggcc

SEQ ID NO: 2884149 - RNA, 14 nt, Mycobacterium avium subsp. paratuberculosis
ggcgucggcggccu

SEQ ID NO: 2884150 - RNA, 15 nt, Mycobacterium avium subsp. paratuberculosis
ggcgucggcggccug

SEQ ID NO: 2884151 - RNA, 19 nt, Mycobacterium avium subsp. paratuberculosis
ggcgucggcgggcgugccg

SEQ ID NO: 2884152 - RNA, 14 nt, Mycobacterium avium subsp. paratuberculosis
ggcgucggcggugg

SEQ ID NO: 2884153 - RNA, 20 nt, Mycobacterium avium subsp. paratuberculosis
ggcgucggcguagggcagcc

SEQ ID NO: 2884154 - RNA, 22 nt, Mycobacterium avium subsp. paratuberculosis
ggcgucggcguagggcagcccg

SEQ ID NO: 2884155 - RNA, 14 nt, Mycobacterium avium subsp. paratuberculosis
ggcgucggcgucga

SEQ ID NO: 2884156 - RNA, 19 nt, Mycobacterium avium subsp. paratuberculosis
ggcgucggcgucgaacggc

SEQ ID NO: 2884157 - RNA, 13 nt, Mycobacterium avium subsp. paratuberculosis
ggcgucgggccgg

SEQ ID NO: 2884158 - RNA, 18 nt, Mycobacterium avium subsp. paratuberculosis
ggcgucgggccgggggcg

SEQ ID NO: 2884159 - RNA, 15 nt, Mycobacterium avium subsp. paratuberculosis
ggcgucgggcgggug

SEQ ID NO: 2884160 - RNA, 17 nt, Mycobacterium avium subsp. paratuberculosis
ggcgucgggcuugcgca

SEQ ID NO: 2884161 - RNA, 22 nt, Mycobacterium avium subsp. paratuberculosis
ggcgucggggcccuccgcggcg

SEQ ID NO: 2884162 - RNA, 13 nt, Mycobacterium avium subsp. paratuberculosis
ggcgucggggggu

SEQ ID NO: 2884163 - RNA, 22 nt, Mycobacterium avium subsp. paratuberculosis
ggcgucggguagggcgccgucg

SEQ ID NO: 2884164 - RNA, 23 nt, Mycobacterium avium subsp. paratuberculosis
ggcgucggucagcaggcgccgca

SEQ ID NO: 2884165 - RNA, 20 nt, Mycobacterium avium subsp. paratuberculosis
ggcgucgguggcggcggcga

SEQ ID NO: 2884166 - RNA, 22 nt, Mycobacterium avium subsp. paratuberculosis
ggcgucggugucccgcgcccgc

SEQ ID NO: 2884167 - RNA, 14 nt, Mycobacterium avium subsp. paratuberculosis
ggcgucguacagca

SEQ ID NO: 2884168 - RNA, 21 nt, Mycobacterium avium subsp. paratuberculosis
ggcgucguacagcagccccug

SEQ ID NO: 2884169 - RNA, 17 nt, Mycobacterium avium subsp. paratuberculosis
ggcgucguagacgcugc

SEQ ID NO: 2884170 - RNA, 21 nt, Mycobacterium avium subsp. paratuberculosis
ggcgucguaguugcggccggc

SEQ ID NO: 2884171 - RNA, 24 nt, Mycobacterium avium subsp. paratuberculosis
ggcgucguaguugcggccggcggu

SEQ ID NO: 2884172 - RNA, 21 nt, Mycobacterium avium subsp. paratuberculosis
ggcgucgucgagcaccggcag

SEQ ID NO: 2884173 - RNA, 14 nt, Mycobacterium avium subsp. paratuberculosis
ggcgucgucggccg

SEQ ID NO: 2884174 - RNA, 19 nt, Mycobacterium avium subsp. paratuberculosis
ggcgucgucggccggcucg

SEQ ID NO: 2884175 - RNA, 15 nt, Mycobacterium avium subsp. paratuberculosis
ggcgucgucggcggc

SEQ ID NO: 2884176 - RNA, 20 nt, Mycobacterium avium subsp. paratuberculosis
ggcgucgucggcggcgacgu

SEQ ID NO: 2884177 - RNA, 21 nt, Mycobacterium avium subsp. paratuberculosis
ggcgucgucgucgagccgcuc

SEQ ID NO: 2884178 - RNA, 22 nt, Mycobacterium avium subsp. paratuberculosis
ggcgucgucgucgagccgcucg

SEQ ID NO: 2884179 - RNA, 18 nt, Mycobacterium avium subsp. paratuberculosis
ggcgucguggucgacgcc

SEQ ID NO: 2884180 - RNA, 20 nt, Mycobacterium avium subsp. paratuberculosis
ggcgucucggcgucucggcg

SEQ ID NO: 2884181 - RNA, 21 nt, Mycobacterium avium subsp. paratuberculosis
ggcgucugccuugcugacgcc

SEQ ID NO: 2884182 - RNA, 16 nt, Mycobacterium avium subsp. paratuberculosis
ggcgucuugcugcgga

SEQ ID NO: 2884183 - RNA, 21 nt, Mycobacterium avium subsp. paratuberculosis
ggcgugaauccucagcacggc

SEQ ID NO: 2884184 - RNA, 21 nt, Mycobacterium avium subsp. paratuberculosis
ggcgugaaucuuggccagcag

SEQ ID NO: 2884185 - RNA, 23 nt, Mycobacterium avium subsp. paratuberculosis
ggcgugacaggguaacccgggac

SEQ ID NO: 2884186 - RNA, 20 nt, Mycobacterium avium subsp. paratuberculosis
ggcgugaccggcugcucgcg

SEQ ID NO: 2884187 - RNA, 16 nt, Mycobacterium avium subsp. paratuberculosis
ggcgugacgccgcugc

SEQ ID NO: 2884188 - RNA, 17 nt, Mycobacterium avium subsp. paratuberculosis
ggcgugacgcucgacgg

SEQ ID NO: 2884189 - RNA, 21 nt, Mycobacterium avium subsp. paratuberculosis
ggcgugacgcucgacggccgg

SEQ ID NO: 2884190 - RNA, 19 nt, Mycobacterium avium subsp. paratuberculosis
ggcgugacgcucgaggccc

SEQ ID NO: 2884191 - RNA, 21 nt, Mycobacterium avium subsp. paratuberculosis
ggcgugacgcucgaggccccg

SEQ ID NO: 2884192 - RNA, 23 nt, Mycobacterium avium subsp. paratuberculosis
ggcgugacgcucgaggccccgcg

SEQ ID NO: 2884193 - RNA, 17 nt, Mycobacterium avium subsp. paratuberculosis
ggcgugacgcucggccg

SEQ ID NO: 2884194 - RNA, 16 nt, Mycobacterium avium subsp. paratuberculosis
ggcgugacgcucggcg

SEQ ID NO: 2884195 - RNA, 21 nt, Mycobacterium avium subsp. paratuberculosis
ggcgugacgcucggcgccgcg

SEQ ID NO: 2884196 - RNA, 20 nt, Mycobacterium avium subsp. paratuberculosis
ggcgugacgcucggcgccgg

SEQ ID NO: 2884197 - RNA, 20 nt, Mycobacterium avium subsp. paratuberculosis
ggcgugacgcucggcggccg

SEQ ID NO: 2884198 - RNA, 24 nt, Mycobacterium avium subsp. paratuberculosis
ggcgugacggaugugacgcgggac

SEQ ID NO: 2884199 - RNA, 19 nt, Mycobacterium avium subsp. paratuberculosis
ggcgugacggucgaccucg

SEQ ID NO: 2884200 - RNA, 22 nt, Mycobacterium avium subsp. paratuberculosis
ggcgugaucuguucggcggcga

SEQ ID NO: 2884201 - RNA, 18 nt, Mycobacterium avium subsp. paratuberculosis
ggcgugaugacggcggcg

SEQ ID NO: 2884202 - RNA, 13 nt, Mycobacterium avium subsp. paratuberculosis
ggcgugcacaggc

SEQ ID NO: 2884203 - RNA, 19 nt, Mycobacterium avium subsp. paratuberculosis
ggcgugcacaggccgccgc

SEQ ID NO: 2884204 - RNA, 20 nt, Mycobacterium avium subsp. paratuberculosis
ggcgugcacaggccgccgca

SEQ ID NO: 2884205 - RNA, 23 nt, Mycobacterium avium subsp. paratuberculosis
ggcgugcacccgguucugggcgg

SEQ ID NO: 2884206 - RNA, 17 nt, Mycobacterium avium subsp. paratuberculosis
ggcgugcaccgcccgcg

SEQ ID NO: 2884207 - RNA, 13 nt, Mycobacterium avium subsp. paratuberculosis
ggcgugcagccga

SEQ ID NO: 2884208 - RNA, 15 nt, Mycobacterium avium subsp. paratuberculosis
ggcgugcagcgcggc

SEQ ID NO: 2884209 - RNA, 16 nt, Mycobacterium avium subsp. paratuberculosis
ggcgugcagcgcggcg

SEQ ID NO: 2884210 - RNA, 16 nt, Mycobacterium avium subsp. paratuberculosis
ggcgugcagucccaga

SEQ ID NO: 2884211 - RNA, 17 nt, Mycobacterium avium subsp. paratuberculosis
ggcgugccacagcauga

SEQ ID NO: 2884212 - RNA, 17 nt, Mycobacterium avium subsp. paratuberculosis
ggcgugccaccgcuggg

SEQ ID NO: 2884213 - RNA, 19 nt, Mycobacterium avium subsp. paratuberculosis
ggcgugccaccgcugggcg

SEQ ID NO: 2884214 - RNA, 15 nt, Mycobacterium avium subsp. paratuberculosis
ggcgugccagggcag

SEQ ID NO: 2884215 - RNA, 17 nt, Mycobacterium avium subsp. paratuberculosis
ggcgugccagggcagcg

SEQ ID NO: 2884216 - RNA, 20 nt, Mycobacterium avium subsp. paratuberculosis
ggcgugccagggcagcgcga

SEQ ID NO: 2884217 - RNA, 17 nt, Mycobacterium avium subsp. paratuberculosis
ggcguugagccggcgca

SEQ ID NO: 2884218 - RNA, 22 nt, Mycobacterium avium subsp. paratuberculosis
ggcguugagcuucucggugauc

SEQ ID NO: 2884219 - RNA, 21 nt, Mycobacterium avium subsp. paratuberculosis
ggcguugagggcggggcagca

SEQ ID NO: 2884220 - RNA, 19 nt, Mycobacterium avium subsp. paratuberculosis
ggcguugaugucggccagg

SEQ ID NO: 2884221 - RNA, 18 nt, Mycobacterium avium subsp. paratuberculosis
ggcguugcauuucggcgu

SEQ ID NO: 2884222 - RNA, 16 nt, Mycobacterium avium subsp. paratuberculosis
ggcguugcccgccgcg

SEQ ID NO: 2884223 - RNA, 18 nt, Mycobacterium avium subsp. paratuberculosis
ggcguugcccgccgcggc

SEQ ID NO: 2884224 - RNA, 21 nt, Mycobacterium avium subsp. paratuberculosis
ggcguugcccgccgcggcgag

SEQ ID NO: 2884225 - RNA, 13 nt, Mycobacterium avium subsp. paratuberculosis
ggcguugccgguc

SEQ ID NO: 2884226 - RNA, 14 nt, Mycobacterium avium subsp. paratuberculosis
ggcguugcgccgcg

SEQ ID NO: 2884227 - RNA, 15 nt, Mycobacterium avium subsp. paratuberculosis
ggcguugcgccgcga

SEQ ID NO: 2884228 - RNA, 23 nt, Mycobacterium avium subsp. paratuberculosis
ggcguugcgccgcgagcgcagca

SEQ ID NO: 2884229 - RNA, 15 nt, Mycobacterium avium subsp. paratuberculosis
ggcguugcggaucga

SEQ ID NO: 2884230 - RNA, 23 nt, Mycobacterium avium subsp. paratuberculosis
ggcguugcggaucgaacggcgga

SEQ ID NO: 2884231 - RNA, 17 nt, Mycobacterium avium subsp. paratuberculosis
ggcguugcgggcgaacg

SEQ ID NO: 2884232 - RNA, 19 nt, Mycobacterium avium subsp. paratuberculosis
ggcguugcgggcgaacgcg

SEQ ID NO: 2884233 - RNA, 19 nt, Mycobacterium avium subsp. paratuberculosis
ggcguugcggguggagaag

SEQ ID NO: 2884234 - RNA, 15 nt, Mycobacterium avium subsp. paratuberculosis
ggcguugcuggcgcg

SEQ ID NO: 2884235 - RNA, 15 nt, Mycobacterium avium subsp. paratuberculosis
ggcguuggacagcuc

SEQ ID NO: 2884236 - RNA, 13 nt, Mycobacterium avium subsp. paratuberculosis
ggcguuggagccg

SEQ ID NO: 2884237 - RNA, 14 nt, Mycobacterium avium subsp. paratuberculosis
ggcguuggagccga

SEQ ID NO: 2884238 - RNA, 20 nt, Mycobacterium avium subsp. paratuberculosis
ggcguuggagccgaccagcg

SEQ ID NO: 2884239 - RNA, 22 nt, Mycobacterium avium subsp. paratuberculosis
ggcguuggcccgcacccgccgc

SEQ ID NO: 2884240 - RNA, 15 nt, Mycobacterium avium subsp. paratuberculosis
ggcguuggccgccgc

SEQ ID NO: 2884241 - RNA, 20 nt, Mycobacterium avium subsp. paratuberculosis
ggcguuggcuuccucgcuga

SEQ ID NO: 2884242 - RNA, 16 nt, Mycobacterium avium subsp. paratuberculosis
ggcguuguggccaccg

SEQ ID NO: 2884243 - RNA, 13 nt, Mycobacterium avium subsp. paratuberculosis
ggcguuucgugug

SEQ ID NO: 2884244 - RNA, 20 nt, Mycobacterium avium subsp. paratuberculosis
ggcguuugccacugagcgca

SEQ ID NO: 2884245 - RNA, 14 nt, Mycobacterium avium subsp. paratuberculosis
ggcguuugguguga

SEQ ID NO: 2884246 - RNA, 16 nt, Mycobacterium avium subsp. paratuberculosis
ggcguuuuugugggug

SEQ ID NO: 2884247 - RNA, 17 nt, Mycobacterium avium subsp. paratuberculosis
ggcguuuuugugggugg

SEQ ID NO: 2884248 - RNA, 20 nt, Mycobacterium avium subsp. paratuberculosis
ggcuaacgcuggucgaacgc

SEQ ID NO: 2884249 - RNA, 16 nt, Mycobacterium avium subsp. paratuberculosis
ggcuaagccggcgucg

SEQ ID NO: 2884250 - RNA, 23 nt, Mycobacterium avium subsp. paratuberculosis
ggcuaagucguugcccgccagca

SEQ ID NO: 2884251 - RNA, 19 nt, Mycobacterium avium subsp. paratuberculosis
ggcuaccaguugagccgga

SEQ ID NO: 2884252 - RNA, 19 nt, Mycobacterium avium subsp. paratuberculosis
ggcuaccuaggcgucgucg

SEQ ID NO: 2884253 - RNA, 18 nt, Mycobacterium avium subsp. paratuberculosis
ggcuaccugaccagcggc

SEQ ID NO: 2884254 - RNA, 15 nt, Mycobacterium avium subsp. paratuberculosis
ggcuacucggacgcc

SEQ ID NO: 2884255 - RNA, 18 nt, Mycobacterium avium subsp. paratuberculosis
ggcuacucggacgccggc

SEQ ID NO: 2884256 - RNA, 23 nt, Mycobacterium avium subsp. paratuberculosis
ggcuagacgcgcaccagggccgc

SEQ ID NO: 2884257 - RNA, 12 nt, Mycobacterium avium subsp. paratuberculosis
ggcuagcggcug

SEQ ID NO: 2884258 - RNA, 20 nt, Mycobacterium avium subsp. paratuberculosis
ggcuagcgggcgcgcagcca

SEQ ID NO: 2884259 - RNA, 13 nt, Mycobacterium avium subsp. paratuberculosis
ggcuaggcucggc

SEQ ID NO: 2884260 - RNA, 17 nt, Mycobacterium avium subsp. paratuberculosis
ggcuaggcucggcagcc

SEQ ID NO: 2884261 - RNA, 18 nt, Mycobacterium avium subsp. paratuberculosis
ggcuaggcucggcagccg

SEQ ID NO: 2884262 - RNA, 14 nt, Mycobacterium avium subsp. paratuberculosis
ggcuaucgcccggc

SEQ ID NO: 2884263 - RNA, 17 nt, Mycobacterium avium subsp. paratuberculosis
ggcuaucgcccggcgcc

SEQ ID NO: 2884264 - RNA, 21 nt, Mycobacterium avium subsp. paratuberculosis
ggcucaaaccguugaccacca

SEQ ID NO: 2884265 - RNA, 21 nt, Mycobacterium avium subsp. paratuberculosis
ggcucaacacguccuggcgcc

SEQ ID NO: 2884266 - RNA, 18 nt, Mycobacterium avium subsp. paratuberculosis
ggcucaacggccggcgcc

SEQ ID NO: 2884267 - RNA, 19 nt, Mycobacterium avium subsp. paratuberculosis
ggcucaacggccggcgccg

SEQ ID NO: 2884268 - RNA, 20 nt, Mycobacterium avium subsp. paratuberculosis
ggcucacagcgcggcgguga

SEQ ID NO: 2884269 - RNA, 16 nt, Mycobacterium avium subsp. paratuberculosis
ggcucacaugggcgcg

SEQ ID NO: 2884270 - RNA, 17 nt, Mycobacterium avium subsp. paratuberculosis
ggcucacaugggcgcgu

SEQ ID NO: 2884271 - RNA, 16 nt, Mycobacterium avium subsp. paratuberculosis
ggcucaccagguccuc

SEQ ID NO: 2884272 - RNA, 16 nt, Mycobacterium avium subsp. paratuberculosis
ggcucacgacuccugg

SEQ ID NO: 2884273 - RNA, 19 nt, Mycobacterium avium subsp. paratuberculosis
ggcucacgacuccuggccg

SEQ ID NO: 2884274 - RNA, 20 nt, Mycobacterium avium subsp. paratuberculosis
ggcucacguagucgaccggg

SEQ ID NO: 2884275 - RNA, 20 nt, Mycobacterium avium subsp. paratuberculosis
ggcucacuuuugacaggugg

SEQ ID NO: 2884276 - RNA, 15 nt, Mycobacterium avium subsp. paratuberculosis
ggcucagcaacccgc

SEQ ID NO: 2884277 - RNA, 12 nt, Mycobacterium avium subsp. paratuberculosis
ggcucagcagca

SEQ ID NO: 2884278 - RNA, 14 nt, Mycobacterium avium subsp. paratuberculosis
ggcucagcagcacc

SEQ ID NO: 2884279 - RNA, 13 nt, Mycobacterium avium subsp. paratuberculosis
ggcucagcccggc

SEQ ID NO: 2884280 - RNA, 14 nt, Mycobacterium avium subsp. paratuberculosis
ggcucagcccggcg

SEQ ID NO: 2884281 - RNA, 16 nt, Mycobacterium avium subsp. paratuberculosis
ggcucagcccggcgcu

SEQ ID NO: 2884282 - RNA, 18 nt, Mycobacterium avium subsp. paratuberculosis
ggcucagcccggcgcuca

SEQ ID NO: 2884283 - RNA, 15 nt, Mycobacterium avium subsp. paratuberculosis
ggcucagccgaagcc

SEQ ID NO: 2884284 - RNA, 18 nt, Mycobacterium avium subsp. paratuberculosis
ggcucagcgcaccgccgu

SEQ ID NO: 2884285 - RNA, 20 nt, Mycobacterium avium subsp. paratuberculosis
ggcucagcgcaccgccgucg

SEQ ID NO: 2884286 - RNA, 23 nt, Mycobacterium avium subsp. paratuberculosis
ggcucagcgcaccgccgucgggg

SEQ ID NO: 2884287 - RNA, 21 nt, Mycobacterium avium subsp. paratuberculosis
ggcucagcgcgacgugccggc

SEQ ID NO: 2884288 - RNA, 22 nt, Mycobacterium avium subsp. paratuberculosis
ggcucagcgcgacgugccggcg

SEQ ID NO: 2884289 - RNA, 20 nt, Mycobacterium avium subsp. paratuberculosis
ggcucagcggcaacugcagg

SEQ ID NO: 2884290 - RNA, 17 nt, Mycobacterium avium subsp. paratuberculosis
ggcucagcggcaggugc

SEQ ID NO: 2884291 - RNA, 17 nt, Mycobacterium avium subsp. paratuberculosis
ggcucaggaucagcagc

SEQ ID NO: 2884292 - RNA, 18 nt, Mycobacterium avium subsp. paratuberculosis
ggcucaggaucagcagcc

SEQ ID NO: 2884293 - RNA, 20 nt, Mycobacterium avium subsp. paratuberculosis
ggcucaggaucagcagccgu

SEQ ID NO: 2884294 - RNA, 17 nt, Mycobacterium avium subsp. paratuberculosis
ggcucaggccgguggcg

SEQ ID NO: 2884295 - RNA, 20 nt, Mycobacterium avium subsp. paratuberculosis
ggcucagggugcgcuggccg

SEQ ID NO: 2884296 - RNA, 15 nt, Mycobacterium avium subsp. paratuberculosis
ggcucauacggcggc

SEQ ID NO: 2884297 - RNA, 23 nt, Mycobacterium avium subsp. paratuberculosis
ggcucauacggcggcucgggggu

SEQ ID NO: 2884298 - RNA, 13 nt, Mycobacterium avium subsp. paratuberculosis
ggcuccaccgcgc

SEQ ID NO: 2884299 - RNA, 17 nt, Mycobacterium avium subsp. paratuberculosis
ggcuccaccgcgccggc

SEQ ID NO: 2884300 - RNA, 20 nt, Mycobacterium avium subsp. paratuberculosis
ggcuccaccgcgccggcggc

SEQ ID NO: 2884301 - RNA, 22 nt, Mycobacterium avium subsp. paratuberculosis
ggcuccaccgcgccggcggcgg

SEQ ID NO: 2884302 - RNA, 23 nt, Mycobacterium avium subsp. paratuberculosis
ggcuccaccgcgccggcggcggc

SEQ ID NO: 2884303 - RNA, 17 nt, Mycobacterium avium subsp. paratuberculosis
ggcuccagcgcccgccg

SEQ ID NO: 2884304 - RNA, 21 nt, Mycobacterium avium subsp. paratuberculosis
ggcuccagguagggcacaccg

SEQ ID NO: 2884305 - RNA, 12 nt, Mycobacterium avium subsp. paratuberculosis
ggcucccaccgu

SEQ ID NO: 2884306 - RNA, 18 nt, Mycobacterium avium subsp. paratuberculosis
ggcucccagucccagcac

SEQ ID NO: 2884307 - RNA, 19 nt, Mycobacterium avium subsp. paratuberculosis
ggcucccagucccagcaca

SEQ ID NO: 2884308 - RNA, 13 nt, Mycobacterium avium subsp. paratuberculosis
ggcucccgcucgc

SEQ ID NO: 2884309 - RNA, 12 nt, Mycobacterium avium subsp. paratuberculosis
ggcuccgcacga

SEQ ID NO: 2884310 - RNA, 19 nt, Mycobacterium avium subsp. paratuberculosis
ggcuccgcaugcccgggcg

SEQ ID NO: 2884311 - RNA, 20 nt, Mycobacterium avium subsp. paratuberculosis
ggcuccgcguucgaccucca

SEQ ID NO: 2884312 - RNA, 21 nt, Mycobacterium avium subsp. paratuberculosis
ggcuccgcguucgaccuccac

SEQ ID NO: 2884313 - RNA, 23 nt, Mycobacterium avium subsp. paratuberculosis
ggcuccgcguucgaccuccacga

SEQ ID NO: 2884314 - RNA, 17 nt, Mycobacterium avium subsp. paratuberculosis
ggcuccggccgcgccgg

SEQ ID NO: 2884315 - RNA, 18 nt, Mycobacterium avium subsp. paratuberculosis
ggcuccggccgcgccggc

SEQ ID NO: 2884316 - RNA, 19 nt, Mycobacterium avium subsp. paratuberculosis
ggcuccggccgcgccggcc

SEQ ID NO: 2884317 - RNA, 24 nt, Mycobacterium avium subsp. paratuberculosis
ggcuccggccgcgccggccuuggc

SEQ ID NO: 2884318 - RNA, 21 nt, Mycobacterium avium subsp. paratuberculosis
ggcuccuaugucggugcggcg

SEQ ID NO: 2884319 - RNA, 21 nt, Mycobacterium avium subsp. paratuberculosis
ggcuccugccguucggccagc

SEQ ID NO: 2884320 - RNA, 23 nt, Mycobacterium avium subsp. paratuberculosis
ggcucgaaaugccuuggcggcgu

SEQ ID NO: 2884321 - RNA, 17 nt, Mycobacterium avium subsp. paratuberculosis
ggcucgaacaacccggc

SEQ ID NO: 2884322 - RNA, 20 nt, Mycobacterium avium subsp. paratuberculosis
ggcucgaacaacccggccgc

SEQ ID NO: 2884323 - RNA, 19 nt, Mycobacterium avium subsp. paratuberculosis
ggcucgaaguggcagcgcu

SEQ ID NO: 2884324 - RNA, 20 nt, Mycobacterium avium subsp. paratuberculosis
ggcucgaaguggcagcgcuc

SEQ ID NO: 2884325 - RNA, 22 nt, Mycobacterium avium subsp. paratuberculosis
ggcucgacaggcagcccggcug

SEQ ID NO: 2884326 - RNA, 13 nt, Mycobacterium avium subsp. paratuberculosis
ggcucgaccacgc

SEQ ID NO: 2884327 - RNA, 13 nt, Mycobacterium avium subsp. paratuberculosis
ggcucgagcccca

SEQ ID NO: 2884328 - RNA, 17 nt, Mycobacterium avium subsp. paratuberculosis
ggcucgagggcggcgac

SEQ ID NO: 2884329 - RNA, 18 nt, Mycobacterium avium subsp. paratuberculosis
ggcucgagggcggcgacc

SEQ ID NO: 2884330 - RNA, 20 nt, Mycobacterium avium subsp. paratuberculosis
ggcucgagggcggcgaccug

SEQ ID NO: 2884331 - RNA, 18 nt, Mycobacterium avium subsp. paratuberculosis
ggcucgagugccggcagc

SEQ ID NO: 2884332 - RNA, 22 nt, Mycobacterium avium subsp. paratuberculosis
ggcucgagugccggcagcccgg

SEQ ID NO: 2884333 - RNA, 23 nt, Mycobacterium avium subsp. paratuberculosis
ggcucgagugccggcagcccgga

SEQ ID NO: 2884334 - RNA, 19 nt, Mycobacterium avium subsp. paratuberculosis
ggcucgaguuuggccagcu

SEQ ID NO: 2884335 - RNA, 22 nt, Mycobacterium avium subsp. paratuberculosis
ggcucgaguuuggccagcucgg

SEQ ID NO: 2884336 - RNA, 19 nt, Mycobacterium avium subsp. paratuberculosis
ggcucgauggacgccagca

SEQ ID NO: 2884337 - RNA, 23 nt, Mycobacterium avium subsp. paratuberculosis
ggcucgcagaugauuucgaagcu

SEQ ID NO: 2884338 - RNA, 23 nt, Mycobacterium avium subsp. paratuberculosis
ggcucgcccgggcuaucgcccgg

SEQ ID NO: 2884339 - RNA, 17 nt, Mycobacterium avium subsp. paratuberculosis
ggcucgccgauccgcgg

SEQ ID NO: 2884340 - RNA, 23 nt, Mycobacterium avium subsp. paratuberculosis
ggcucgccgcgcaucaucgccca

SEQ ID NO: 2884341 - RNA, 15 nt, Mycobacterium avium subsp. paratuberculosis
ggcucgccggcgucu

SEQ ID NO: 2884342 - RNA, 18 nt, Mycobacterium avium subsp. paratuberculosis
ggcucgccgggcugcacg

SEQ ID NO: 2884343 - RNA, 20 nt, Mycobacterium avium subsp. paratuberculosis
ggcucgccucggggaucgcc

SEQ ID NO: 2884344 - RNA, 17 nt, Mycobacterium avium subsp. paratuberculosis
ggcucgccugcgagcgu

SEQ ID NO: 2884345 - RNA, 19 nt, Mycobacterium avium subsp. paratuberculosis
ggcucgcgagggcgggcca

SEQ ID NO: 2884346 - RNA, 21 nt, Mycobacterium avium subsp. paratuberculosis
ggcucgcgcacccguaacacg

SEQ ID NO: 2884347 - RNA, 12 nt, Mycobacterium avium subsp. paratuberculosis
ggcucgcgcugg

SEQ ID NO: 2884348 - RNA, 16 nt, Mycobacterium avium subsp. paratuberculosis
ggcucgcgcuggcggc

SEQ ID NO: 2884349 - RNA, 18 nt, Mycobacterium avium subsp. paratuberculosis
ggcucgcgcuggcggcca

SEQ ID NO: 2884350 - RNA, 21 nt, Mycobacterium avium subsp. paratuberculosis
ggcucgcgcuggcggccaucg

SEQ ID NO: 2884351 - RNA, 23 nt, Mycobacterium avium subsp. paratuberculosis
ggcucgcgcuggcggccaucgcc

SEQ ID NO: 2884352 - RNA, 19 nt, Mycobacterium avium subsp. paratuberculosis
ggcucgcgggggccgcgau

SEQ ID NO: 2884353 - RNA, 12 nt, Mycobacterium avium subsp. paratuberculosis
ggcucgcggggu

SEQ ID NO: 2884354 - RNA, 18 nt, Mycobacterium avium subsp. paratuberculosis
ggcucgcgggugcggcgc

SEQ ID NO: 2884355 - RNA, 16 nt, Mycobacterium avium subsp. paratuberculosis
ggcucgcgggugucga

SEQ ID NO: 2884356 - RNA, 17 nt, Mycobacterium avium subsp. paratuberculosis
ggcucgcucccgcgcgg

SEQ ID NO: 2884357 - RNA, 13 nt, Mycobacterium avium subsp. paratuberculosis
ggcucggacgacu

SEQ ID NO: 2884358 - RNA, 20 nt, Mycobacterium avium subsp. paratuberculosis
ggcucggaguugcgcagccg

SEQ ID NO: 2884359 - RNA, 21 nt, Mycobacterium avium subsp. paratuberculosis
ggcucggaguugcgcagccgg

SEQ ID NO: 2884360 - RNA, 19 nt, Mycobacterium avium subsp. paratuberculosis
ggcucggccaucccggugc

SEQ ID NO: 2884361 - RNA, 14 nt, Mycobacterium avium subsp. paratuberculosis
ggcucggcccgccg

SEQ ID NO: 2884362 - RNA, 20 nt, Mycobacterium avium subsp. paratuberculosis
ggcucggcccgccgggcgcc

SEQ ID NO: 2884363 - RNA, 20 nt, Mycobacterium avium subsp. paratuberculosis
ggcucggccgaugagccuca

SEQ ID NO: 2884364 - RNA, 19 nt, Mycobacterium avium subsp. paratuberculosis
ggcucggccuucggggugg

SEQ ID NO: 2884365 - RNA, 20 nt, Mycobacterium avium subsp. paratuberculosis
ggcucggcgacaacagcgcc

SEQ ID NO: 2884366 - RNA, 15 nt, Mycobacterium avium subsp. paratuberculosis
ggcucggcgccgacc

SEQ ID NO: 2884367 - RNA, 22 nt, Mycobacterium avium subsp. paratuberculosis
ggcucggcgccgaccucggcca

SEQ ID NO: 2884368 - RNA, 13 nt, Mycobacterium avium subsp. paratuberculosis
ggcucggcgcuga

SEQ ID NO: 2884369 - RNA, 12 nt, Mycobacterium avium subsp. paratuberculosis
ggcucggcggcg

SEQ ID NO: 2884370 - RNA, 13 nt, Mycobacterium avium subsp. paratuberculosis
ggcucggcgucgu

SEQ ID NO: 2884371 - RNA, 18 nt, Mycobacterium avium subsp. paratuberculosis
ggcucggcucggccggcc

SEQ ID NO: 2884372 - RNA, 14 nt, Mycobacterium avium subsp. paratuberculosis
ggcucgggcggugg

SEQ ID NO: 2884373 - RNA, 16 nt, Mycobacterium avium subsp. paratuberculosis
ggcucgggcgguggcg

SEQ ID NO: 2884374 - RNA, 16 nt, Mycobacterium avium subsp. paratuberculosis
ggcucggggucggccg

SEQ ID NO: 2884375 - RNA, 17 nt, Mycobacterium avium subsp. paratuberculosis
ggcucggggucggccga

SEQ ID NO: 2884376 - RNA, 19 nt, Mycobacterium avium subsp. paratuberculosis
ggcucgguaugcggcgacg

SEQ ID NO: 2884377 - RNA, 15 nt, Mycobacterium avium subsp. paratuberculosis
ggcucggucgacacg

SEQ ID NO: 2884378 - RNA, 13 nt, Mycobacterium avium subsp. paratuberculosis
ggcucggucgcga

SEQ ID NO: 2884379 - RNA, 17 nt, Mycobacterium avium subsp. paratuberculosis
ggcucggucuccuccag

SEQ ID NO: 2884380 - RNA, 14 nt, Mycobacterium avium subsp. paratuberculosis
ggcucggugccgcg

SEQ ID NO: 2884381 - RNA, 19 nt, Mycobacterium avium subsp. paratuberculosis
ggcucgucgaacucgugga

SEQ ID NO: 2884382 - RNA, 21 nt, Mycobacterium avium subsp. paratuberculosis
ggcucgugcagccggcggcgc

SEQ ID NO: 2884383 - RNA, 20 nt, Mycobacterium avium subsp. paratuberculosis
ggcucguggaacgacgccag

SEQ ID NO: 2884384 - RNA, 21 nt, Mycobacterium avium subsp. paratuberculosis
ggcucgugggaaugcggcugg

SEQ ID NO: 2884385 - RNA, 17 nt, Mycobacterium avium subsp. paratuberculosis
ggcugcgcguucggcgc

SEQ ID NO: 2884386 - RNA, 19 nt, Mycobacterium avium subsp. paratuberculosis
ggcugcgcguucggcgcca

SEQ ID NO: 2884387 - RNA, 18 nt, Mycobacterium avium subsp. paratuberculosis
ggcugcgcuugcggcgca

SEQ ID NO: 2884388 - RNA, 22 nt, Mycobacterium avium subsp. paratuberculosis
ggcugcggcgagucccggcgca

SEQ ID NO: 2884389 - RNA, 15 nt, Mycobacterium avium subsp. paratuberculosis
ggcugcgggcaucgc

SEQ ID NO: 2884390 - RNA, 19 nt, Mycobacterium avium subsp. paratuberculosis
ggcugcgggccaggcggga

SEQ ID NO: 2884391 - RNA, 15 nt, Mycobacterium avium subsp. paratuberculosis
ggcugcgguuccggg

SEQ ID NO: 2884392 - RNA, 12 nt, Mycobacterium avium subsp. paratuberculosis
ggcugcgguugg

SEQ ID NO: 2884393 - RNA, 11 nt, Mycobacterium avium subsp. paratuberculosis
ggcugcucgaa

SEQ ID NO: 2884394 - RNA, 17 nt, Mycobacterium avium subsp. paratuberculosis
ggcugcucgaaccgcga

SEQ ID NO: 2884395 - RNA, 14 nt, Mycobacterium avium subsp. paratuberculosis
ggcugcucggcggg

SEQ ID NO: 2884396 - RNA, 21 nt, Mycobacterium avium subsp. paratuberculosis
ggcugcugcacgacgaccgcg

SEQ ID NO: 2884397 - RNA, 23 nt, Mycobacterium avium subsp. paratuberculosis
ggcugcugcacgacgaccgcgac

SEQ ID NO: 2884398 - RNA, 21 nt, Mycobacterium avium subsp. paratuberculosis
ggcugcugcacgucgccggcg

SEQ ID NO: 2884399 - RNA, 22 nt, Mycobacterium avium subsp. paratuberculosis
ggcugcugcagcgcccgggcca

SEQ ID NO: 2884400 - RNA, 16 nt, Mycobacterium avium subsp. paratuberculosis
ggcugcuggcgcuggg

SEQ ID NO: 2884401 - RNA, 22 nt, Mycobacterium avium subsp. paratuberculosis
ggcugcuguucguccgugcugc

SEQ ID NO: 2884402 - RNA, 16 nt, Mycobacterium avium subsp. paratuberculosis
ggcuggaaucccgccu

SEQ ID NO: 2884403 - RNA, 19 nt, Mycobacterium avium subsp. paratuberculosis
ggcuggaaucccgccucgg

SEQ ID NO: 2884404 - RNA, 18 nt, Mycobacterium avium subsp. paratuberculosis
ggcuggaguaggugcccg

SEQ ID NO: 2884405 - RNA, 13 nt, Mycobacterium avium subsp. paratuberculosis
ggcuggcaacagu

SEQ ID NO: 2884406 - RNA, 14 nt, Mycobacterium avium subsp. paratuberculosis
ggcuggcaucgucg

SEQ ID NO: 2884407 - RNA, 17 nt, Mycobacterium avium subsp. paratuberculosis
ggcuggcaucgucggcg

SEQ ID NO: 2884408 - RNA, 12 nt, Mycobacterium avium subsp. paratuberculosis
ggcuggccagcu

SEQ ID NO: 2884409 - RNA, 21 nt, Mycobacterium avium subsp. paratuberculosis
ggcuggccaggcuggcgucga

SEQ ID NO: 2884410 - RNA, 13 nt, Mycobacterium avium subsp. paratuberculosis
ggcuggcccggcg

SEQ ID NO: 2884411 - RNA, 17 nt, Mycobacterium avium subsp. paratuberculosis
ggcuggccgagcggcug

SEQ ID NO: 2884412 - RNA, 14 nt, Mycobacterium avium subsp. paratuberculosis
ggcuggccgcggcg

SEQ ID NO: 2884413 - RNA, 15 nt, Mycobacterium avium subsp. paratuberculosis
ggcuggccgucggcg

SEQ ID NO: 2884414 - RNA, 13 nt, Mycobacterium avium subsp. paratuberculosis
ggcuggcggcaac

SEQ ID NO: 2884415 - RNA, 18 nt, Mycobacterium avium subsp. paratuberculosis
ggcuggcggcaacggcca

SEQ ID NO: 2884416 - RNA, 13 nt, Mycobacterium avium subsp. paratuberculosis
ggcuggcgggugg

SEQ ID NO: 2884417 - RNA, 14 nt, Mycobacterium avium subsp. paratuberculosis
ggcuggcggguggu

SEQ ID NO: 2884418 - RNA, 18 nt, Mycobacterium avium subsp. paratuberculosis
ggcuggcguaggacagca

SEQ ID NO: 2884419 - RNA, 22 nt, Mycobacterium avium subsp. paratuberculosis
ggcuggcguaggacagcagccg

SEQ ID NO: 2884420 - RNA, 17 nt, Mycobacterium avium subsp. paratuberculosis
ggcugggcagccgcgcg

SEQ ID NO: 2884421 - RNA, 22 nt, Mycobacterium avium subsp. paratuberculosis
ggcugggcuuccacagcccguu

SEQ ID NO: 2884422 - RNA, 14 nt, Mycobacterium avium subsp. paratuberculosis
ggcugggucaccac

SEQ ID NO: 2884423 - RNA, 22 nt, Mycobacterium avium subsp. paratuberculosis
ggcuggguccgauuucccgacu

SEQ ID NO: 2884424 - RNA, 19 nt, Mycobacterium avium subsp. paratuberculosis
ggcugggucggucccgaca

SEQ ID NO: 2884425 - RNA, 14 nt, Mycobacterium avium subsp. paratuberculosis
ggcuggguggacac

SEQ ID NO: 2884426 - RNA, 16 nt, Mycobacterium avium subsp. paratuberculosis
ggcuggucacccacug

SEQ ID NO: 2884427 - RNA, 20 nt, Mycobacterium avium subsp. paratuberculosis
ggcuggucacccacuggcgg

SEQ ID NO: 2884428 - RNA, 23 nt, Mycobacterium avium subsp. paratuberculosis
ggcuggucacccacuggcggccg

SEQ ID NO: 2884429 - RNA, 16 nt, Mycobacterium avium subsp. paratuberculosis
ggcuggucggccuggc

SEQ ID NO: 2884430 - RNA, 20 nt, Mycobacterium avium subsp. paratuberculosis
ggcuggucggccuggcccaa

SEQ ID NO: 2884431 - RNA, 14 nt, Mycobacterium avium subsp. paratuberculosis
ggcuggucggcggc

SEQ ID NO: 2884432 - RNA, 13 nt, Mycobacterium avium subsp. paratuberculosis
ggcuggugcagca

SEQ ID NO: 2884433 - RNA, 16 nt, Mycobacterium avium subsp. paratuberculosis
ggcuggugcgcagccg

SEQ ID NO: 2884434 - RNA, 16 nt, Mycobacterium avium subsp. paratuberculosis
ggcuguagcacccggc

SEQ ID NO: 2884435 - RNA, 21 nt, Mycobacterium avium subsp. paratuberculosis
ggcuguagcacccggccggcg

SEQ ID NO: 2884436 - RNA, 15 nt, Mycobacterium avium subsp. paratuberculosis
ggcuguccaccugca

SEQ ID NO: 2884437 - RNA, 23 nt, Mycobacterium avium subsp. paratuberculosis
ggcuguccaccugcaccugggug

SEQ ID NO: 2884438 - RNA, 14 nt, Mycobacterium avium subsp. paratuberculosis
ggcuguccagcagc

SEQ ID NO: 2884439 - RNA, 17 nt, Mycobacterium avium subsp. paratuberculosis
ggcugucccggccgcga

SEQ ID NO: 2884440 - RNA, 22 nt, Mycobacterium avium subsp. paratuberculosis
ggcugucccggccgcgacagcc

SEQ ID NO: 2884441 - RNA, 19 nt, Mycobacterium avium subsp. paratuberculosis
ggcuguccgcguggccgag

SEQ ID NO: 2884442 - RNA, 21 nt, Mycobacterium avium subsp. paratuberculosis
ggcuguccgcguggccgagga

SEQ ID NO: 2884443 - RNA, 14 nt, Mycobacterium avium subsp. paratuberculosis
ggcuguccucccag

SEQ ID NO: 2884444 - RNA, 18 nt, Mycobacterium avium subsp. paratuberculosis
ggcuguccucccagcgcc

SEQ ID NO: 2884445 - RNA, 14 nt, Mycobacterium avium subsp. paratuberculosis
ggcuguccugcggu

SEQ ID NO: 2884446 - RNA, 22 nt, Mycobacterium avium subsp. paratuberculosis
ggcugucgacaggaucgacaac

SEQ ID NO: 2884447 - RNA, 14 nt, Mycobacterium avium subsp. paratuberculosis
ggcugucgcgcuga

SEQ ID NO: 2884448 - RNA, 12 nt, Mycobacterium avium subsp. paratuberculosis
ggcugucggcgc

SEQ ID NO: 2884449 - RNA, 15 nt, Mycobacterium avium subsp. paratuberculosis
ggcugucggcgccca

SEQ ID NO: 2884450 - RNA, 17 nt, Mycobacterium avium subsp. paratuberculosis
ggcugucgggcaggccg

SEQ ID NO: 2884451 - RNA, 20 nt, Mycobacterium avium subsp. paratuberculosis
ggcugucgggcaggccggug

SEQ ID NO: 2884452 - RNA, 21 nt, Mycobacterium avium subsp. paratuberculosis
ggcugucgggugccgccuugg

SEQ ID NO: 2884453 - RNA, 18 nt, Mycobacterium avium subsp. paratuberculosis
ggcugucguagcggccca

SEQ ID NO: 2884454 - RNA, 19 nt, Mycobacterium avium subsp. paratuberculosis
ggcugugaucgcugacgcc

SEQ ID NO: 2884455 - RNA, 20 nt, Mycobacterium avium subsp. paratuberculosis
ggcugugcacgauggacagg

SEQ ID NO: 2884456 - RNA, 18 nt, Mycobacterium avium subsp. paratuberculosis
ggcuguggaugacgcagc

SEQ ID NO: 2884457 - RNA, 20 nt, Mycobacterium avium subsp. paratuberculosis
ggcuguggaugacgcagccg

SEQ ID NO: 2884458 - RNA, 16 nt, Mycobacterium avium subsp. paratuberculosis
ggcugugggccagcag

SEQ ID NO: 2884459 - RNA, 17 nt, Mycobacterium avium subsp. paratuberculosis
ggcuuaccgaccucgag

SEQ ID NO: 2884460 - RNA, 20 nt, Mycobacterium avium subsp. paratuberculosis
ggcuuaccgaccucgaggcc

SEQ ID NO: 2884461 - RNA, 19 nt, Mycobacterium avium subsp. paratuberculosis
ggcuuaccggcgggcggcg

SEQ ID NO: 2884462 - RNA, 21 nt, Mycobacterium avium subsp. paratuberculosis
ggcuuaccggcgggcggcggc

SEQ ID NO: 2884463 - RNA, 20 nt, Mycobacterium avium subsp. paratuberculosis
ggcuucauaugacgccggcc

SEQ ID NO: 2884464 - RNA, 21 nt, Mycobacterium avium subsp. paratuberculosis
ggcuuccccaaccuggacggu

SEQ ID NO: 2884465 - RNA, 14 nt, Mycobacterium avium subsp. paratuberculosis
ggcuuccuccucgg

SEQ ID NO: 2884466 - RNA, 20 nt, Mycobacterium avium subsp. paratuberculosis
ggcuuccuccucggcgcgga

SEQ ID NO: 2884467 - RNA, 23 nt, Mycobacterium avium subsp. paratuberculosis
ggcuucgaacgcccgcaccacga

SEQ ID NO: 2884468 - RNA, 20 nt, Mycobacterium avium subsp. paratuberculosis
ggcuucgccgccgcaccggc

SEQ ID NO: 2884469 - RNA, 22 nt, Mycobacterium avium subsp. paratuberculosis
gggacgaaggugcgcacgaacg

SEQ ID NO: 2884470 - RNA, 21 nt, Mycobacterium avium subsp. paratuberculosis
gggacgaaugucucgaugaca

SEQ ID NO: 2884471 - RNA, 15 nt, Mycobacterium avium subsp. paratuberculosis
gggacgacgccgaac

SEQ ID NO: 2884472 - RNA, 21 nt, Mycobacterium avium subsp. paratuberculosis
gggacgacgccgaacugccgg

SEQ ID NO: 2884473 - RNA, 14 nt, Mycobacterium avium subsp. paratuberculosis
gggacgacggcgcc

SEQ ID NO: 2884474 - RNA, 15 nt, Mycobacterium avium subsp. paratuberculosis
gggacgacggcgccg

SEQ ID NO: 2884475 - RNA, 17 nt, Mycobacterium avium subsp. paratuberculosis
gggacgacggcgccgcc

SEQ ID NO: 2884476 - RNA, 20 nt, Mycobacterium avium subsp. paratuberculosis
gggacgaucugcgucaugga

SEQ ID NO: 2884477 - RNA, 20 nt, Mycobacterium avium subsp. paratuberculosis
gggacgccguugacaccggg

SEQ ID NO: 2884478 - RNA, 16 nt, Mycobacterium avium subsp. paratuberculosis
gggacgcggcaggcgc

SEQ ID NO: 2884479 - RNA, 19 nt, Mycobacterium avium subsp. paratuberculosis
gggacgcugaacagcccga

SEQ ID NO: 2884480 - RNA, 13 nt, Mycobacterium avium subsp. paratuberculosis
gggacggcggcga

SEQ ID NO: 2884481 - RNA, 23 nt, Mycobacterium avium subsp. paratuberculosis
gggacggcggcgaguucggcggc

SEQ ID NO: 2884482 - RNA, 19 nt, Mycobacterium avium subsp. paratuberculosis
gggacggcggguggggguc

SEQ ID NO: 2884483 - RNA, 14 nt, Mycobacterium avium subsp. paratuberculosis
gggacgggucggcg

SEQ ID NO: 2884484 - RNA, 18 nt, Mycobacterium avium subsp. paratuberculosis
gggacgggucggcggcga

SEQ ID NO: 2884485 - RNA, 16 nt, Mycobacterium avium subsp. paratuberculosis
gggacgggucgguggu

SEQ ID NO: 2884486 - RNA, 21 nt, Mycobacterium avium subsp. paratuberculosis
gggacgggucggugguucgcg

SEQ ID NO: 2884487 - RNA, 21 nt, Mycobacterium avium subsp. paratuberculosis
gggacggguugcaggccacgc

SEQ ID NO: 2884488 - RNA, 16 nt, Mycobacterium avium subsp. paratuberculosis
gggacgucagcccgcg

SEQ ID NO: 2884489 - RNA, 14 nt, Mycobacterium avium subsp. paratuberculosis
gggacguccgcgcg

SEQ ID NO: 2884490 - RNA, 22 nt, Mycobacterium avium subsp. paratuberculosis
gggacgucgacgugggcggcca

SEQ ID NO: 2884491 - RNA, 20 nt, Mycobacterium avium subsp. paratuberculosis
gggacgucgucgucccaggg

SEQ ID NO: 2884492 - RNA, 15 nt, Mycobacterium avium subsp. paratuberculosis
gggacgugucggggu

SEQ ID NO: 2884493 - RNA, 23 nt, Mycobacterium avium subsp. paratuberculosis
gggacgugucgggguggugggcg

SEQ ID NO: 2884494 - RNA, 13 nt, Mycobacterium avium subsp. paratuberculosis
gggacguugaugu

SEQ ID NO: 2884495 - RNA, 22 nt, Mycobacterium avium subsp. paratuberculosis
gggacguugaugucguccaugc

SEQ ID NO: 2884496 - RNA, 21 nt, Mycobacterium avium subsp. paratuberculosis
gggacugcgccggggccgcgg

SEQ ID NO: 2884497 - RNA, 22 nt, Mycobacterium avium subsp. paratuberculosis
gggacugcgccggggccgcggc

SEQ ID NO: 2884498 - RNA, 14 nt, Mycobacterium avium subsp. paratuberculosis
gggacuggauggcg

SEQ ID NO: 2884499 - RNA, 23 nt, Mycobacterium avium subsp. paratuberculosis
gggagaacagguaggacaccgaa

SEQ ID NO: 2884500 - RNA, 17 nt, Mycobacterium avium subsp. paratuberculosis
gggagaacucgaucugc

SEQ ID NO: 2884501 - RNA, 20 nt, Mycobacterium avium subsp. paratuberculosis
gggagacgcugugcgccaga

SEQ ID NO: 2884502 - RNA, 13 nt, Mycobacterium avium subsp. paratuberculosis
gggagagcgcggg

SEQ ID NO: 2884503 - RNA, 15 nt, Mycobacterium avium subsp. paratuberculosis
gggagagcgggaccg

SEQ ID NO: 2884504 - RNA, 18 nt, Mycobacterium avium subsp. paratuberculosis
gggagaggcgcggcgcga

SEQ ID NO: 2884505 - RNA, 20 nt, Mycobacterium avium subsp. paratuberculosis
gggagaggcgcggcgcgagg

SEQ ID NO: 2884506 - RNA, 21 nt, Mycobacterium avium subsp. paratuberculosis
gggagauacggucgcaccgcg

SEQ ID NO: 2884507 - RNA, 23 nt, Mycobacterium avium subsp. paratuberculosis
gggagcacgugaugagcgaggac

SEQ ID NO: 2884508 - RNA, 13 nt, Mycobacterium avium subsp. paratuberculosis
gggagcacucgau

SEQ ID NO: 2884509 - RNA, 22 nt, Mycobacterium avium subsp. paratuberculosis
gggagcagcacgaucgagccgg

SEQ ID NO: 2884510 - RNA, 13 nt, Mycobacterium avium subsp. paratuberculosis
gggagccggccag

SEQ ID NO: 2884511 - RNA, 14 nt, Mycobacterium avium subsp. paratuberculosis
gggagccggccagg

SEQ ID NO: 2884512 - RNA, 13 nt, Mycobacterium avium subsp. paratuberculosis
gggagccgugcag

SEQ ID NO: 2884513 - RNA, 15 nt, Mycobacterium avium subsp. paratuberculosis
gggagcgcuggucgg

SEQ ID NO: 2884514 - RNA, 15 nt, Mycobacterium avium subsp. paratuberculosis
gggagcgggccacgc

SEQ ID NO: 2884515 - RNA, 16 nt, Mycobacterium avium subsp. paratuberculosis
gggagcgggccacgca

SEQ ID NO: 2884516 - RNA, 11 nt, Mycobacterium avium subsp. paratuberculosis
gggagcggggu

SEQ ID NO: 2884517 - RNA, 17 nt, Mycobacterium avium subsp. paratuberculosis
gggagcuaggcggccgg

SEQ ID NO: 2884518 - RNA, 20 nt, Mycobacterium avium subsp. paratuberculosis
gggagcuaggcggccgggcg

SEQ ID NO: 2884519 - RNA, 18 nt, Mycobacterium avium subsp. paratuberculosis
gggaggaagugcacgccg

SEQ ID NO: 2884520 - RNA, 15 nt, Mycobacterium avium subsp. paratuberculosis
gggaggacagcaccg

SEQ ID NO: 2884521 - RNA, 21 nt, Mycobacterium avium subsp. paratuberculosis
gggaggacagggaggacagca

SEQ ID NO: 2884522 - RNA, 21 nt, Mycobacterium avium subsp. paratuberculosis
gggaggccagcaccuucagcg

SEQ ID NO: 2884523 - RNA, 23 nt, Mycobacterium avium subsp. paratuberculosis
gggaggccagcaccuucagcggg

SEQ ID NO: 2884524 - RNA, 18 nt, Mycobacterium avium subsp. paratuberculosis
gggaggcccagcccgccg

SEQ ID NO: 2884525 - RNA, 21 nt, Mycobacterium avium subsp. paratuberculosis
gggaggcccaguagcggaagu

SEQ ID NO: 2884526 - RNA, 23 nt, Mycobacterium avium subsp. paratuberculosis
gggaggcggcgguauucgucacc

SEQ ID NO: 2884527 - RNA, 21 nt, Mycobacterium avium subsp. paratuberculosis
gggaggcguugcgucccgcgc

SEQ ID NO: 2884528 - RNA, 23 nt, Mycobacterium avium subsp. paratuberculosis
gggaggcguugcgucccgcgccg

SEQ ID NO: 2884529 - RNA, 23 nt, Mycobacterium avium subsp. paratuberculosis
gggagguacucgagcgugcccgc

SEQ ID NO: 2884530 - RNA, 16 nt, Mycobacterium avium subsp. paratuberculosis
gggaguagucggcgau

SEQ ID NO: 2884531 - RNA, 14 nt, Mycobacterium avium subsp. paratuberculosis
gggagugacguuga

SEQ ID NO: 2884532 - RNA, 15 nt, Mycobacterium avium subsp. paratuberculosis
gggaguggccggcgu

SEQ ID NO: 2884533 - RNA, 12 nt, Mycobacterium avium subsp. paratuberculosis
gggauaccgcga

SEQ ID NO: 2884534 - RNA, 17 nt, Mycobacterium avium subsp. paratuberculosis
gggauaccgcgaccgcc

SEQ ID NO: 2884535 - RNA, 15 nt, Mycobacterium avium subsp. paratuberculosis
gggauagagcaccgc

SEQ ID NO: 2884536 - RNA, 14 nt, Mycobacterium avium subsp. paratuberculosis
gggauagccgagcg

SEQ ID NO: 2884537 - RNA, 19 nt, Mycobacterium avium subsp. paratuberculosis
gggauagccgagcggcgcc

SEQ ID NO: 2884538 - RNA, 13 nt, Mycobacterium avium subsp. paratuberculosis
gggauagggcgcg

SEQ ID NO: 2884539 - RNA, 14 nt, Mycobacterium avium subsp. paratuberculosis
gggauagggcgcgu

SEQ ID NO: 2884540 - RNA, 16 nt, Mycobacterium avium subsp. paratuberculosis
gggauauucgcccagc

SEQ ID NO: 2884541 - RNA, 18 nt, Mycobacterium avium subsp. paratuberculosis
gggaucacacgcgcgccc

SEQ ID NO: 2884542 - RNA, 17 nt, Mycobacterium avium subsp. paratuberculosis
gggaucaccucaucgcc

SEQ ID NO: 2884543 - RNA, 19 nt, Mycobacterium avium subsp. paratuberculosis
gggaucaccucaucgccca

SEQ ID NO: 2884544 - RNA, 16 nt, Mycobacterium avium subsp. paratuberculosis
gggaucaccucgcuga

SEQ ID NO: 2884545 - RNA, 16 nt, Mycobacterium avium subsp. paratuberculosis
gggaucagcagcaccg

SEQ ID NO: 2884546 - RNA, 17 nt, Mycobacterium avium subsp. paratuberculosis
gggaucagccguaccga

SEQ ID NO: 2884547 - RNA, 18 nt, Mycobacterium avium subsp. paratuberculosis
gggauccagcggcggccu

SEQ ID NO: 2884548 - RNA, 16 nt, Mycobacterium avium subsp. paratuberculosis
gggauccgccugcgcg

SEQ ID NO: 2884549 - RNA, 19 nt, Mycobacterium avium subsp. paratuberculosis
gggauccgccugcgcgggc

SEQ ID NO: 2884550 - RNA, 22 nt, Mycobacterium avium subsp. paratuberculosis
gggauccgccugcgcgggcgcg

SEQ ID NO: 2884551 - RNA, 23 nt, Mycobacterium avium subsp. paratuberculosis
gggauccgccugcgcgggcgcgg

SEQ ID NO: 2884552 - RNA, 22 nt, Mycobacterium avium subsp. paratuberculosis
gggauccggauugccgggcagc

SEQ ID NO: 2884553 - RNA, 14 nt, Mycobacterium avium subsp. paratuberculosis
gggcacggcgaugu

SEQ ID NO: 2884554 - RNA, 20 nt, Mycobacterium avium subsp. paratuberculosis
gggcacggucagguggaugg

SEQ ID NO: 2884555 - RNA, 21 nt, Mycobacterium avium subsp. paratuberculosis
ggcgcagcgccgcgccgaccu

SEQ ID NO: 2884556 - RNA, 23 nt, Mycobacterium avium subsp. paratuberculosis
ggcgcagcgcgucgcgcccggcg

SEQ ID NO: 2884557 - RNA, 15 nt, Mycobacterium avium subsp. paratuberculosis
ggcgcagcggcccga

SEQ ID NO: 2884558 - RNA, 13 nt, Mycobacterium avium subsp. paratuberculosis
ggcgcagcgucuc

SEQ ID NO: 2884559 - RNA, 13 nt, Mycobacterium avium subsp. paratuberculosis
ggcgcagcucgcg

SEQ ID NO: 2884560 - RNA, 20 nt, Mycobacterium avium subsp. paratuberculosis
ggcgcagcucgcgcagcugg

SEQ ID NO: 2884561 - RNA, 15 nt, Mycobacterium avium subsp. paratuberculosis
ggcgcagcucgucgu

SEQ ID NO: 2884562 - RNA, 18 nt, Mycobacterium avium subsp. paratuberculosis
ggcgcagcucgucguggg

SEQ ID NO: 2884563 - RNA, 14 nt, Mycobacterium avium subsp. paratuberculosis
ggcgcaggccgguc

SEQ ID NO: 2884564 - RNA, 13 nt, Mycobacterium avium subsp. paratuberculosis
ggcgcaggcgcgc

SEQ ID NO: 2884565 - RNA, 16 nt, Mycobacterium avium subsp. paratuberculosis
ggcgcaggcgcgcacc

SEQ ID NO: 2884566 - RNA, 17 nt, Mycobacterium avium subsp. paratuberculosis
ggcgcaggcgcgcacca

SEQ ID NO: 2884567 - RNA, 20 nt, Mycobacterium avium subsp. paratuberculosis
ggcgcagggccgcuacgccg

SEQ ID NO: 2884568 - RNA, 17 nt, Mycobacterium avium subsp. paratuberculosis
ggcgcagggcggccggc

SEQ ID NO: 2884569 - RNA, 19 nt, Mycobacterium avium subsp. paratuberculosis
ggcgcagggcggccggcca

SEQ ID NO: 2884570 - RNA, 21 nt, Mycobacterium avium subsp. paratuberculosis
ggcgcagggcggccggccagu

SEQ ID NO: 2884571 - RNA, 16 nt, Mycobacterium avium subsp. paratuberculosis
ggcgcagggcguucga

SEQ ID NO: 2884572 - RNA, 22 nt, Mycobacterium avium subsp. paratuberculosis
ggcgcagggcguucgacgucca

SEQ ID NO: 2884573 - RNA, 17 nt, Mycobacterium avium subsp. paratuberculosis
ggcgcagguccacccgc

SEQ ID NO: 2884574 - RNA, 18 nt, Mycobacterium avium subsp. paratuberculosis
ggcgcagguccacccgcc

SEQ ID NO: 2884575 - RNA, 15 nt, Mycobacterium avium subsp. paratuberculosis
ggcgcagguccggca

SEQ ID NO: 2884576 - RNA, 22 nt, Mycobacterium avium subsp. paratuberculosis
ggcgcagguccggcagcgcgcc

SEQ ID NO: 2884577 - RNA, 23 nt, Mycobacterium avium subsp. paratuberculosis
ggcgcaggugaucaaagccggug

SEQ ID NO: 2884578 - RNA, 15 nt, Mycobacterium avium subsp. paratuberculosis
ggcgcaggugggcgg

SEQ ID NO: 2884579 - RNA, 18 nt, Mycobacterium avium subsp. paratuberculosis
ggcgcaggugggcggugc

SEQ ID NO: 2884580 - RNA, 11 nt, Mycobacterium avium subsp. paratuberculosis
ggcgcaggugu

SEQ ID NO: 2884581 - RNA, 17 nt, Mycobacterium avium subsp. paratuberculosis
ggcgcagguguccagcc

SEQ ID NO: 2884582 - RNA, 19 nt, Mycobacterium avium subsp. paratuberculosis
ggcgcagguuguccagccg

SEQ ID NO: 2884583 - RNA, 20 nt, Mycobacterium avium subsp. paratuberculosis
ggcgcagguuguccagccgg

SEQ ID NO: 2884584 - RNA, 22 nt, Mycobacterium avium subsp. paratuberculosis
ggcgcagguuguccagccggug

SEQ ID NO: 2884585 - RNA, 23 nt, Mycobacterium avium subsp. paratuberculosis
ggcgcagguuguccagccggugc

SEQ ID NO: 2884586 - RNA, 13 nt, Mycobacterium avium subsp. paratuberculosis
ggcgcaguccagg

SEQ ID NO: 2884587 - RNA, 15 nt, Mycobacterium avium subsp. paratuberculosis
ggcgcaguccagggu

SEQ ID NO: 2884588 - RNA, 16 nt, Mycobacterium avium subsp. paratuberculosis
ggcgcaguccagggug

SEQ ID NO: 2884589 - RNA, 22 nt, Mycobacterium avium subsp. paratuberculosis
ggcgcaguccagggugguggug

SEQ ID NO: 2884590 - RNA, 16 nt, Mycobacterium avium subsp. paratuberculosis
ggcgcagucggccgga

SEQ ID NO: 2884591 - RNA, 23 nt, Mycobacterium avium subsp. paratuberculosis
ggcgcaguucgaccggcaccagc

SEQ ID NO: 2884592 - RNA, 24 nt, Mycobacterium avium subsp. paratuberculosis
ggcgcaguucgaccggcaccagca

SEQ ID NO: 2884593 - RNA, 17 nt, Mycobacterium avium subsp. paratuberculosis
ggcgcaucaccuucugc

SEQ ID NO: 2884594 - RNA, 12 nt, Mycobacterium avium subsp. paratuberculosis
ggcgcaucagcg

SEQ ID NO: 2884595 - RNA, 16 nt, Mycobacterium avium subsp. paratuberculosis
ggcgcaucagcggggc

SEQ ID NO: 2884596 - RNA, 17 nt, Mycobacterium avium subsp. paratuberculosis
ggcgcaucagcggggcg

SEQ ID NO: 2884597 - RNA, 18 nt, Mycobacterium avium subsp. paratuberculosis
ggcgcaucaucucggcga

SEQ ID NO: 2884598 - RNA, 21 nt, Mycobacterium avium subsp. paratuberculosis
ggcgcaucaucucggcgaagu

SEQ ID NO: 2884599 - RNA, 17 nt, Mycobacterium avium subsp. paratuberculosis
ggcgcaugaccgauccg

SEQ ID NO: 2884600 - RNA, 11 nt, Mycobacterium avium subsp. paratuberculosis
ggcgcaugcca

SEQ ID NO: 2884601 - RNA, 15 nt, Mycobacterium avium subsp. paratuberculosis
ggcgcaugccagacc

SEQ ID NO: 2884602 - RNA, 17 nt, Mycobacterium avium subsp. paratuberculosis
ggcgcaugccagaccac

SEQ ID NO: 2884603 - RNA, 19 nt, Mycobacterium avium subsp. paratuberculosis
ggcgccaacaacucgacgc

SEQ ID NO: 2884604 - RNA, 20 nt, Mycobacterium avium subsp. paratuberculosis
ggcgccaacaacucgacgcu

SEQ ID NO: 2884605 - RNA, 21 nt, Mycobacterium avium subsp. paratuberculosis
ggcgccacaacuggucgugcu

SEQ ID NO: 2884606 - RNA, 20 nt, Mycobacterium avium subsp. paratuberculosis
ggcgccacagcagcaccagc

SEQ ID NO: 2884607 - RNA, 21 nt, Mycobacterium avium subsp. paratuberculosis
ggcgccacagcagcaccagcg

SEQ ID NO: 2884608 - RNA, 14 nt, Mycobacterium avium subsp. paratuberculosis
ggcgccacagccgg

SEQ ID NO: 2884609 - RNA, 19 nt, Mycobacterium avium subsp. paratuberculosis
ggcgccacagccggggauc

SEQ ID NO: 2884610 - RNA, 13 nt, Mycobacterium avium subsp. paratuberculosis
ggcgccaccagcc

SEQ ID NO: 2884611 - RNA, 14 nt, Mycobacterium avium subsp. paratuberculosis
ggcgccaccagcca

SEQ ID NO: 2884612 - RNA, 18 nt, Mycobacterium avium subsp. paratuberculosis
ggcgccaccggcuggccg

SEQ ID NO: 2884613 - RNA, 16 nt, Mycobacterium avium subsp. paratuberculosis
ggcgccaccgggaccu

SEQ ID NO: 2884614 - RNA, 20 nt, Mycobacterium avium subsp. paratuberculosis
ggcgccaccggguaaguguc

SEQ ID NO: 2884615 - RNA, 21 nt, Mycobacterium avium subsp. paratuberculosis
ggcgccacgacugcgcggccg

SEQ ID NO: 2884616 - RNA, 23 nt, Mycobacterium avium subsp. paratuberculosis
ggcgccacgacugcgcggccggc

SEQ ID NO: 2884617 - RNA, 19 nt, Mycobacterium avium subsp. paratuberculosis
ggcgccacgcuggcgugac

SEQ ID NO: 2884618 - RNA, 20 nt, Mycobacterium avium subsp. paratuberculosis
ggcgccacgcuggcgugacg

SEQ ID NO: 2884619 - RNA, 22 nt, Mycobacterium avium subsp. paratuberculosis
ggcgccacgcuggcgugacgcu

SEQ ID NO: 2884620 - RNA, 16 nt, Mycobacterium avium subsp. paratuberculosis
ggcgccacugccgccg

SEQ ID NO: 2884621 - RNA, 20 nt, Mycobacterium avium subsp. paratuberculosis
ggcgccacugccgccgccca

SEQ ID NO: 2884622 - RNA, 22 nt, Mycobacterium avium subsp. paratuberculosis
ggcgccacugccgccgcccagg

SEQ ID NO: 2884623 - RNA, 12 nt, Mycobacterium avium subsp. paratuberculosis
ggcgccagcacc

SEQ ID NO: 2884624 - RNA, 16 nt, Mycobacterium avium subsp. paratuberculosis
ggcgccagcaccucga

SEQ ID NO: 2884625 - RNA, 12 nt, Mycobacterium avium subsp. paratuberculosis
ggcgccagcagc

SEQ ID NO: 2884626 - RNA, 13 nt, Mycobacterium avium subsp. paratuberculosis
ggcgccagcagca

SEQ ID NO: 2884627 - RNA, 15 nt, Mycobacterium avium subsp. paratuberculosis
ggcgccagcagcacc

SEQ ID NO: 2884628 - RNA, 18 nt, Mycobacterium avium subsp. paratuberculosis
ggcgccagcagcaccuga

SEQ ID NO: 2884629 - RNA, 18 nt, Mycobacterium avium subsp. paratuberculosis
ggcgccagcccgcccagc

SEQ ID NO: 2884630 - RNA, 19 nt, Mycobacterium avium subsp. paratuberculosis
ggcgccagcccgcccagcg

SEQ ID NO: 2884631 - RNA, 17 nt, Mycobacterium avium subsp. paratuberculosis
ggcgccagcccgccgaa

SEQ ID NO: 2884632 - RNA, 15 nt, Mycobacterium avium subsp. paratuberculosis
ggcgccagcccggug

SEQ ID NO: 2884633 - RNA, 22 nt, Mycobacterium avium subsp. paratuberculosis
ggcgccagcccggugaucgccg

SEQ ID NO: 2884634 - RNA, 13 nt, Mycobacterium avium subsp. paratuberculosis
ggcgccagccgca

SEQ ID NO: 2884635 - RNA, 20 nt, Mycobacterium avium subsp. paratuberculosis
ggcgccagccgcaccgcgac

SEQ ID NO: 2884636 - RNA, 13 nt, Mycobacterium avium subsp. paratuberculosis
ggcgccagccguu

SEQ ID NO: 2884637 - RNA, 21 nt, Mycobacterium avium subsp. paratuberculosis
ggcgccagccguucccggcag

SEQ ID NO: 2884638 - RNA, 22 nt, Mycobacterium avium subsp. paratuberculosis
ggcgccagccguucccggcaga

SEQ ID NO: 2884639 - RNA, 14 nt, Mycobacterium avium subsp. paratuberculosis
ggcgccagcggccg

SEQ ID NO: 2884640 - RNA, 18 nt, Mycobacterium avium subsp. paratuberculosis
ggcgccaguaguggauca

SEQ ID NO: 2884641 - RNA, 13 nt, Mycobacterium avium subsp. paratuberculosis
ggcgccauccgca

SEQ ID NO: 2884642 - RNA, 15 nt, Mycobacterium avium subsp. paratuberculosis
ggcgccauccgcagc

SEQ ID NO: 2884643 - RNA, 21 nt, Mycobacterium avium subsp. paratuberculosis
ggcgccauccgcagcccgucg

SEQ ID NO: 2884644 - RNA, 18 nt, Mycobacterium avium subsp. paratuberculosis
ggcgccauccgccacccg

SEQ ID NO: 2884645 - RNA, 21 nt, Mycobacterium avium subsp. paratuberculosis
ggcgccauccgccacccgcug

SEQ ID NO: 2884646 - RNA, 20 nt, Mycobacterium avium subsp. paratuberculosis
ggcgccaugaacggcggggc

SEQ ID NO: 2884647 - RNA, 21 nt, Mycobacterium avium subsp. paratuberculosis
ggcgccaugaacggcggggcc

SEQ ID NO: 2884648 - RNA, 22 nt, Mycobacterium avium subsp. paratuberculosis
ggcgccaugaacggcggggccu

SEQ ID NO: 2884649 - RNA, 21 nt, Mycobacterium avium subsp. paratuberculosis
ggcgccaugaacuccgacucc

SEQ ID NO: 2884650 - RNA, 16 nt, Mycobacterium avium subsp. paratuberculosis
ggcgccaugcgccgcg

SEQ ID NO: 2884651 - RNA, 16 nt, Mycobacterium avium subsp. paratuberculosis
ggcgccauggcccacg

SEQ ID NO: 2884652 - RNA, 13 nt, Mycobacterium avium subsp. paratuberculosis
ggcgcccacagca

SEQ ID NO: 2884653 - RNA, 16 nt, Mycobacterium avium subsp. paratuberculosis
ggcgcccacagcaggu

SEQ ID NO: 2884654 - RNA, 17 nt, Mycobacterium avium subsp. paratuberculosis
ggcgcccacagcaggua

SEQ ID NO: 2884655 - RNA, 14 nt, Mycobacterium avium subsp. paratuberculosis
ggcgcccaccgcgg

SEQ ID NO: 2884656 - RNA, 19 nt, Mycobacterium avium subsp. paratuberculosis
ggcgcccaccgcggcgcgc

SEQ ID NO: 2884657 - RNA, 20 nt, Mycobacterium avium subsp. paratuberculosis
ggcgcccaccgcggcgcgcg

SEQ ID NO: 2884658 - RNA, 23 nt, Mycobacterium avium subsp. paratuberculosis
ggcgcccaccgcggcgcgcggcc

SEQ ID NO: 2884659 - RNA, 19 nt, Mycobacterium avium subsp. paratuberculosis
ggcgcccacggccaccacg

SEQ ID NO: 2884660 - RNA, 20 nt, Mycobacterium avium subsp. paratuberculosis
ggcgcccagaucggccagcc

SEQ ID NO: 2884661 - RNA, 21 nt, Mycobacterium avium subsp. paratuberculosis
ggcgcccagaucggccagcca

SEQ ID NO: 2884662 - RNA, 18 nt, Mycobacterium avium subsp. paratuberculosis
ggcgcccagaugccgccg

SEQ ID NO: 2884663 - RNA, 21 nt, Mycobacterium avium subsp. paratuberculosis
ggcgcccagaugccgccgcca

SEQ ID NO: 2884664 - RNA, 20 nt, Mycobacterium avium subsp. paratuberculosis
ggcgcccagcaaacccagca

SEQ ID NO: 2884665 - RNA, 21 nt, Mycobacterium avium subsp. paratuberculosis
ggcgcccagcaaacccagcac

SEQ ID NO: 2884666 - RNA, 12 nt, Mycobacterium avium subsp. paratuberculosis
ggcgcccagccc

SEQ ID NO: 2884667 - RNA, 23 nt, Mycobacterium avium subsp. paratuberculosis
ggcgcccagcccgagcaccagcg

SEQ ID NO: 2884668 - RNA, 20 nt, Mycobacterium avium subsp. paratuberculosis
ggcgcccagcgagcugccgg

SEQ ID NO: 2884669 - RNA, 21 nt, Mycobacterium avium subsp. paratuberculosis
ggcgcccagcgagcugccggc

SEQ ID NO: 2884670 - RNA, 22 nt, Mycobacterium avium subsp. paratuberculosis
ggcgcccagcgagcugccggcg

SEQ ID NO: 2884671 - RNA, 14 nt, Mycobacterium avium subsp. paratuberculosis
ggcgcccagcggcg

SEQ ID NO: 2884672 - RNA, 12 nt, Mycobacterium avium subsp. paratuberculosis
ggcgcccagcgu

SEQ ID NO: 2884673 - RNA, 19 nt, Mycobacterium avium subsp. paratuberculosis
ggcgcccagcgucucggcg

SEQ ID NO: 2884674 - RNA, 20 nt, Mycobacterium avium subsp. paratuberculosis
ggcgcccagcgucucggcgg

SEQ ID NO: 2884675 - RNA, 22 nt, Mycobacterium avium subsp. paratuberculosis
ggcgcccagcgucucggcggcc

SEQ ID NO: 2884676 - RNA, 23 nt, Mycobacterium avium subsp. paratuberculosis
ggcgcccagcguggucacccgca

SEQ ID NO: 2884677 - RNA, 22 nt, Mycobacterium avium subsp. paratuberculosis
ggcgcccaggggucccaggugg

SEQ ID NO: 2884678 - RNA, 22 nt, Mycobacterium avium subsp. paratuberculosis
ggcgcccagguccaccagguga

SEQ ID NO: 2884679 - RNA, 17 nt, Mycobacterium avium subsp. paratuberculosis
ggcgccccagcuccucg

SEQ ID NO: 2884680 - RNA, 18 nt, Mycobacterium avium subsp. paratuberculosis
ggcgccccagcuccucgg

SEQ ID NO: 2884681 - RNA, 23 nt, Mycobacterium avium subsp. paratuberculosis
ggcgccccagcuccucggcccca

SEQ ID NO: 2884682 - RNA, 17 nt, Mycobacterium avium subsp. paratuberculosis
ggcgccccccugcucgc

SEQ ID NO: 2884683 - RNA, 18 nt, Mycobacterium avium subsp. paratuberculosis
ggcgcccccgcgacgucc

SEQ ID NO: 2884684 - RNA, 13 nt, Mycobacterium avium subsp. paratuberculosis
ggcgccccgcccg

SEQ ID NO: 2884685 - RNA, 14 nt, Mycobacterium avium subsp. paratuberculosis
ggcgccccgcccgc

SEQ ID NO: 2884686 - RNA, 15 nt, Mycobacterium avium subsp. paratuberculosis
ggcgccccgcccgcg

SEQ ID NO: 2884687 - RNA, 16 nt, Mycobacterium avium subsp. paratuberculosis
ggcgccccgcccgcga

SEQ ID NO: 2884688 - RNA, 15 nt, Mycobacterium avium subsp. paratuberculosis
ggcgccccggcgcug

SEQ ID NO: 2884689 - RNA, 14 nt, Mycobacterium avium subsp. paratuberculosis
ggcgcccgacaucc

SEQ ID NO: 2884690 - RNA, 14 nt, Mycobacterium avium subsp. paratuberculosis
ggcgcccgagccgc

SEQ ID NO: 2884691 - RNA, 12 nt, Mycobacterium avium subsp. paratuberculosis
ggcgcccgaucg

SEQ ID NO: 2884692 - RNA, 21 nt, Mycobacterium avium subsp. paratuberculosis
ggcgcccgaucggcacccgca

SEQ ID NO: 2884693 - RNA, 14 nt, Mycobacterium avium subsp. paratuberculosis
ggcgcccgcaggcc

SEQ ID NO: 2884694 - RNA, 21 nt, Mycobacterium avium subsp. paratuberculosis
ggcgcccgcaggccgcgagcc

SEQ ID NO: 2884695 - RNA, 23 nt, Mycobacterium avium subsp. paratuberculosis
ggcgcccgcaggccgcgagcccg

SEQ ID NO: 2884696 - RNA, 16 nt, Mycobacterium avium subsp. paratuberculosis
ggcgcccgccccgacg

SEQ ID NO: 2884697 - RNA, 13 nt, Mycobacterium avium subsp. paratuberculosis
ggcgcccgcggcc

SEQ ID NO: 2884698 - RNA, 15 nt, Mycobacterium avium subsp. paratuberculosis
ggcgcccgcggccuc

SEQ ID NO: 2884699 - RNA, 16 nt, Mycobacterium avium subsp. paratuberculosis
ggcgcccgcggccucc

SEQ ID NO: 2884700 - RNA, 15 nt, Mycobacterium avium subsp. paratuberculosis
ggcgcccgcggcgcg

SEQ ID NO: 2884701 - RNA, 17 nt, Mycobacterium avium subsp. paratuberculosis
ggcgcccgcggcgcgca

SEQ ID NO: 2884702 - RNA, 17 nt, Mycobacterium avium subsp. paratuberculosis
ggcgcccgcuccggcgg

SEQ ID NO: 2884703 - RNA, 19 nt, Mycobacterium avium subsp. paratuberculosis
ggcgcccgcuccggcggac

SEQ ID NO: 2884704 - RNA, 21 nt, Mycobacterium avium subsp. paratuberculosis
ggcgcccggagcugucgguga

SEQ ID NO: 2884705 - RNA, 14 nt, Mycobacterium avium subsp. paratuberculosis
ggcgcccggcagcc

SEQ ID NO: 2884706 - RNA, 18 nt, Mycobacterium avium subsp. paratuberculosis
ggcgcccggcagccgcuc

SEQ ID NO: 2884707 - RNA, 15 nt, Mycobacterium avium subsp. paratuberculosis
ggcgcccggcccagc

SEQ ID NO: 2884708 - RNA, 16 nt, Mycobacterium avium subsp. paratuberculosis
ggcgcccggcccagcc

SEQ ID NO: 2884709 - RNA, 17 nt, Mycobacterium avium subsp. paratuberculosis
ggcgcccggcccagccg

SEQ ID NO: 2884710 - RNA, 19 nt, Mycobacterium avium subsp. paratuberculosis
ggcgcccggcccagccgcu

SEQ ID NO: 2884711 - RNA, 13 nt, Mycobacterium avium subsp. paratuberculosis
ggcgcccggccgg

SEQ ID NO: 2884712 - RNA, 17 nt, Mycobacterium avium subsp. paratuberculosis
ggcgcccggccggcccc

SEQ ID NO: 2884713 - RNA, 15 nt, Mycobacterium avium subsp. paratuberculosis
ggcgcccggcgcgcc

SEQ ID NO: 2884714 - RNA, 17 nt, Mycobacterium avium subsp. paratuberculosis
ggcgcccggcgcgccac

SEQ ID NO: 2884715 - RNA, 21 nt, Mycobacterium avium subsp. paratuberculosis
ggcgcccggcgcgccacgacg

SEQ ID NO: 2884716 - RNA, 24 nt, Mycobacterium avium subsp. paratuberculosis
ggcgcccucgaugcgcaccgugcc

SEQ ID NO: 2884717 - RNA, 14 nt, Mycobacterium avium subsp. paratuberculosis
ggcgcccucgccga

SEQ ID NO: 2884718 - RNA, 18 nt, Mycobacterium avium subsp. paratuberculosis
ggcgcccucgccgaccug

SEQ ID NO: 2884719 - RNA, 16 nt, Mycobacterium avium subsp. paratuberculosis
ggcgcccucggcgauc

SEQ ID NO: 2884720 - RNA, 19 nt, Mycobacterium avium subsp. paratuberculosis
ggcgcccugcacccagccg

SEQ ID NO: 2884721 - RNA, 19 nt, Mycobacterium avium subsp. paratuberculosis
ggcgcccugcgagcccggg

SEQ ID NO: 2884722 - RNA, 13 nt, Mycobacterium avium subsp. paratuberculosis
ggcgcccugcgcg

SEQ ID NO: 2884723 - RNA, 14 nt, Mycobacterium avium subsp. paratuberculosis
ggcgcccugcgcgc

SEQ ID NO: 2884724 - RNA, 17 nt, Mycobacterium avium subsp. paratuberculosis
ggcgcccuucccggucg

SEQ ID NO: 2884725 - RNA, 14 nt, Mycobacterium avium subsp. paratuberculosis
ggcgcccuucggcg

SEQ ID NO: 2884726 - RNA, 21 nt, Mycobacterium avium subsp. paratuberculosis
ggcgcccuucggcgcccgcuc

SEQ ID NO: 2884727 - RNA, 18 nt, Mycobacterium avium subsp. paratuberculosis
ggcgcccuugccgaugcc

SEQ ID NO: 2884728 - RNA, 23 nt, Mycobacterium avium subsp. paratuberculosis
ggcgcccuugccgaugccggcgu

SEQ ID NO: 2884729 - RNA, 17 nt, Mycobacterium avium subsp. paratuberculosis
ggcgcccuuggccuccg

SEQ ID NO: 2884730 - RNA, 23 nt, Mycobacterium avium subsp. paratuberculosis
ggcgccgaacagaugccugccca

SEQ ID NO: 2884731 - RNA, 19 nt, Mycobacterium avium subsp. paratuberculosis
ggcgccgaaccgggugacg

SEQ ID NO: 2884732 - RNA, 15 nt, Mycobacterium avium subsp. paratuberculosis
ggcgccgaacgucga

SEQ ID NO: 2884733 - RNA, 23 nt, Mycobacterium avium subsp. paratuberculosis
ggcgccgaacgucgagcgcggcc

SEQ ID NO: 2884734 - RNA, 20 nt, Mycobacterium avium subsp. paratuberculosis
ggcgccgaacucggcgccgc

SEQ ID NO: 2884735 - RNA, 21 nt, Mycobacterium avium subsp. paratuberculosis
ggcgccgaacucggcgccgcc

SEQ ID NO: 2884736 - RNA, 22 nt, Mycobacterium avium subsp. paratuberculosis
ggcgccgaacucggcgccgccg

SEQ ID NO: 2884737 - RNA, 19 nt, Mycobacterium avium subsp. paratuberculosis
ggcgccgaagauggccagg

SEQ ID NO: 2884738 - RNA, 20 nt, Mycobacterium avium subsp. paratuberculosis
ggcgccgaagauggccagga

SEQ ID NO: 2884739 - RNA, 23 nt, Mycobacterium avium subsp. paratuberculosis
ggcgccgaagccgucgaccccgc

SEQ ID NO: 2884740 - RNA, 23 nt, Mycobacterium avium subsp. paratuberculosis
ggcgccgaaugccacgccgaugg

SEQ ID NO: 2884741 - RNA, 17 nt, Mycobacterium avium subsp. paratuberculosis
ggcgccgacagucgcgg

SEQ ID NO: 2884742 - RNA, 19 nt, Mycobacterium avium subsp. paratuberculosis
ggcgccgacagucgcgggc

SEQ ID NO: 2884743 - RNA, 17 nt, Mycobacterium avium subsp. paratuberculosis
ggcgccgacccccgccg

SEQ ID NO: 2884744 - RNA, 16 nt, Mycobacterium avium subsp. paratuberculosis
ggcgccgaccgagggc

SEQ ID NO: 2884745 - RNA, 19 nt, Mycobacterium avium subsp. paratuberculosis
ggcgccgaccucggccagc

SEQ ID NO: 2884746 - RNA, 20 nt, Mycobacterium avium subsp. paratuberculosis
ggcgccgacgacgucgcgca

SEQ ID NO: 2884747 - RNA, 19 nt, Mycobacterium avium subsp. paratuberculosis
ggcgccgacgaucccggcg

SEQ ID NO: 2884748 - RNA, 22 nt, Mycobacterium avium subsp. paratuberculosis
ggcgccgacgaucccggcgagc

SEQ ID NO: 2884749 - RNA, 13 nt, Mycobacterium avium subsp. paratuberculosis
ggcgccgacgucc

SEQ ID NO: 2884750 - RNA, 19 nt, Mycobacterium avium subsp. paratuberculosis
ggcgccgagaacaggccga

SEQ ID NO: 2884751 - RNA, 12 nt, Mycobacterium avium subsp. paratuberculosis
ggcgccgagcac

SEQ ID NO: 2884752 - RNA, 20 nt, Mycobacterium avium subsp. paratuberculosis
ggcgccgagcacgaacgcgg

SEQ ID NO: 2884753 - RNA, 22 nt, Mycobacterium avium subsp. paratuberculosis
ggcgccgagcacgaacgcggcc

SEQ ID NO: 2884754 - RNA, 11 nt, Mycobacterium avium subsp. paratuberculosis
ggcgccgagcg

SEQ ID NO: 2884755 - RNA, 15 nt, Mycobacterium avium subsp. paratuberculosis
ggcgccgagcgugaa

SEQ ID NO: 2884756 - RNA, 15 nt, Mycobacterium avium subsp. paratuberculosis
ggcgccgaguccggg

SEQ ID NO: 2884757 - RNA, 21 nt, Mycobacterium avium subsp. paratuberculosis
ggcgccgaguccgggccgccg

SEQ ID NO: 2884758 - RNA, 22 nt, Mycobacterium avium subsp. paratuberculosis
ggcgccgaguccgggccgccgg

SEQ ID NO: 2884759 - RNA, 23 nt, Mycobacterium avium subsp. paratuberculosis
ggcgccgaguccgggccgccggc

SEQ ID NO: 2884760 - RNA, 13 nt, Mycobacterium avium subsp. paratuberculosis
ggcgccgaucgcg

SEQ ID NO: 2884761 - RNA, 14 nt, Mycobacterium avium subsp. paratuberculosis
ggcgccgaucgcgc

SEQ ID NO: 2884762 - RNA, 16 nt, Mycobacterium avium subsp. paratuberculosis
ggcgccgaucgcgcgc

SEQ ID NO: 2884763 - RNA, 17 nt, Mycobacterium avium subsp. paratuberculosis
ggcgccgaucgcgcgca

SEQ ID NO: 2884764 - RNA, 19 nt, Mycobacterium avium subsp. paratuberculosis
ggcgccgaucugcucggcu

SEQ ID NO: 2884765 - RNA, 21 nt, Mycobacterium avium subsp. paratuberculosis
ggcgccgaugcccgccccgga

SEQ ID NO: 2884766 - RNA, 17 nt, Mycobacterium avium subsp. paratuberculosis
ggcgccgcagcacgcug

SEQ ID NO: 2884767 - RNA, 14 nt, Mycobacterium avium subsp. paratuberculosis
ggcgccgcagcagg

SEQ ID NO: 2884768 - RNA, 17 nt, Mycobacterium avium subsp. paratuberculosis
ggcgccgcagcggcgcc

SEQ ID NO: 2884769 - RNA, 18 nt, Mycobacterium avium subsp. paratuberculosis
ggcgccgcagcggcgccg

SEQ ID NO: 2884770 - RNA, 19 nt, Mycobacterium avium subsp. paratuberculosis
ggcgccgcagcggcgccgg

SEQ ID NO: 2884771 - RNA, 15 nt, Mycobacterium avium subsp. paratuberculosis
ggcgccgcagcucgu

SEQ ID NO: 2884772 - RNA, 21 nt, Mycobacterium avium subsp. paratuberculosis
ggcgccgccaccacgauguug

SEQ ID NO: 2884773 - RNA, 16 nt, Mycobacterium avium subsp. paratuberculosis
ggcgccgccacggcac

SEQ ID NO: 2884774 - RNA, 13 nt, Mycobacterium avium subsp. paratuberculosis
ggcgccgcccacc

SEQ ID NO: 2884775 - RNA, 17 nt, Mycobacterium avium subsp. paratuberculosis
ggcgccgcccaccagca

SEQ ID NO: 2884776 - RNA, 13 nt, Mycobacterium avium subsp. paratuberculosis
ggcgccgcccggc

SEQ ID NO: 2884777 - RNA, 15 nt, Mycobacterium avium subsp. paratuberculosis
ggcgccgcccggcga

SEQ ID NO: 2884778 - RNA, 15 nt, Mycobacterium avium subsp. paratuberculosis
ggcgccgcccgggcc

SEQ ID NO: 2884779 - RNA, 12 nt, Mycobacterium avium subsp. paratuberculosis
ggcgccgccgaa

SEQ ID NO: 2884780 - RNA, 18 nt, Mycobacterium avium subsp. paratuberculosis
ggcgccgccgaccgcccg

SEQ ID NO: 2884781 - RNA, 18 nt, Mycobacterium avium subsp. paratuberculosis
ggcgccgccgagccgcgg

SEQ ID NO: 2884782 - RNA, 19 nt, Mycobacterium avium subsp. paratuberculosis
ggcgccgccgagccgcggg

SEQ ID NO: 2884783 - RNA, 23 nt, Mycobacterium avium subsp. paratuberculosis
ggcgccgccgagccgcgggugac

SEQ ID NO: 2884784 - RNA, 16 nt, Mycobacterium avium subsp. paratuberculosis
ggcgccgccgcgcagg

SEQ ID NO: 2884785 - RNA, 17 nt, Mycobacterium avium subsp. paratuberculosis
ggcgccgccggcgucga

SEQ ID NO: 2884786 - RNA, 13 nt, Mycobacterium avium subsp. paratuberculosis
ggcgccgccgguc

SEQ ID NO: 2884787 - RNA, 21 nt, Mycobacterium avium subsp. paratuberculosis
ggcgccgccggucgcccccuc

SEQ ID NO: 2884788 - RNA, 16 nt, Mycobacterium avium subsp. paratuberculosis
ggcgccgccguucgcc

SEQ ID NO: 2884789 - RNA, 20 nt, Mycobacterium avium subsp. paratuberculosis
ggcgccgccguucgccggcg

SEQ ID NO: 2884790 - RNA, 13 nt, Mycobacterium avium subsp. paratuberculosis
ggcgccgcgaccc

SEQ ID NO: 2884791 - RNA, 14 nt, Mycobacterium avium subsp. paratuberculosis
ggcgccgcgacccc

SEQ ID NO: 2884792 - RNA, 23 nt, Mycobacterium avium subsp. paratuberculosis
ggcgccgcgaccccggaccgcgg

SEQ ID NO: 2884793 - RNA, 13 nt, Mycobacterium avium subsp. paratuberculosis
ggcgccgcgccgg

SEQ ID NO: 2884794 - RNA, 15 nt, Mycobacterium avium subsp. paratuberculosis
ggcgccgcgccggca

SEQ ID NO: 2884795 - RNA, 16 nt, Mycobacterium avium subsp. paratuberculosis
ggcgccgcgcgccagc

SEQ ID NO: 2884796 - RNA, 12 nt, Mycobacterium avium subsp. paratuberculosis
ggcgccgcggcc

SEQ ID NO: 2884797 - RNA, 14 nt, Mycobacterium avium subsp. paratuberculosis
ggcgccgcggcccu

SEQ ID NO: 2884798 - RNA, 13 nt, Mycobacterium avium subsp. paratuberculosis
ggcgccgcggccg

SEQ ID NO: 2884799 - RNA, 13 nt, Mycobacterium avium subsp. paratuberculosis
ggcgccgcggcgc

SEQ ID NO: 2884800 - RNA, 14 nt, Mycobacterium avium subsp. paratuberculosis
ggcgccgcggcggc

SEQ ID NO: 2884801 - RNA, 15 nt, Mycobacterium avium subsp. paratuberculosis
ggcgccgcggcggca

SEQ ID NO: 2884802 - RNA, 14 nt, Mycobacterium avium subsp. paratuberculosis
ggcgccgcgggcgc

SEQ ID NO: 2884803 - RNA, 16 nt, Mycobacterium avium subsp. paratuberculosis
ggcgccgcgggcgccg

SEQ ID NO: 2884804 - RNA, 18 nt, Mycobacterium avium subsp. paratuberculosis
ggcgccgcgggcgccgua

SEQ ID NO: 2884805 - RNA, 19 nt, Mycobacterium avium subsp. paratuberculosis
ggcgccgcgggcggucgcg

SEQ ID NO: 2884806 - RNA, 13 nt, Mycobacterium avium subsp. paratuberculosis
ggcgccgcggggc
